United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 3

SEQ ID NO: 82974 - RNA, 22 nt, Human
ucuccaagaaaagaucucagcu

SEQ ID NO: 82975 - RNA, 22 nt, Human
ucuccaaggcccuacucuauuu

SEQ ID NO: 82976 - RNA, 22 nt, Human
ucuccacaagcuuucuccuuuu

SEQ ID NO: 82977 - RNA, 22 nt, Human
ucuccacagucccaccucgcuu

SEQ ID NO: 82978 - RNA, 22 nt, Human
ucuccagaguaaccuuggagca

SEQ ID NO: 82979 - RNA, 22 nt, Human
ucuccaggaaagacacuggacu

SEQ ID NO: 82980 - RNA, 22 nt, Human
ucuccaggagaaauaugaagga

SEQ ID NO: 82981 - RNA, 22 nt, Human
ucuccaggcccacugauuuaua

SEQ ID NO: 82982 - RNA, 22 nt, Human
ucuccaggcuuaaucucagcuu

SEQ ID NO: 82983 - RNA, 22 nt, Human
ucuccagggagguagcccagug

SEQ ID NO: 82984 - RNA, 22 nt, Human
ucuccagguggcuugggcuucu

SEQ ID NO: 82985 - RNA, 22 nt, Human
ucuccagguggggucaccuuuu

SEQ ID NO: 82986 - RNA, 23 nt, Human
ucuccagugucucuucauugagu

SEQ ID NO: 82987 - RNA, 22 nt, Human
ucuccauaggcaguucauaaca

SEQ ID NO: 82988 - RNA, 22 nt, Human
ucuccaucugucauucuugucc

SEQ ID NO: 82989 - RNA, 22 nt, Human
ucuccauuuuauagauaaugaa

SEQ ID NO: 82990 - RNA, 22 nt, Human
ucucccacagucucccauggcu

SEQ ID NO: 82991 - RNA, 22 nt, Human
ucucccacugcaagcccaggcu

SEQ ID NO: 82992 - RNA, 22 nt, Human
ucucccagaaguccucaguaca

SEQ ID NO: 82993 - RNA, 19 nt, Human
ucucccagcugagaagggc

SEQ ID NO: 82994 - RNA, 20 nt, Human
ucucccaggcucagggaaga

SEQ ID NO: 82995 - RNA, 22 nt, Human
ucucccaggcuggagugcagug

SEQ ID NO: 82996 - RNA, 22 nt, Human
ucucccaguggugcagaaagca

SEQ ID NO: 82997 - RNA, 19 nt, Human
ucucccaugccugugucua

SEQ ID NO: 82998 - RNA, 22 nt, Human
ucuccccagcugagcugcccuu

SEQ ID NO: 82999 - RNA, 22 nt, Human
ucuccccuacucuaaaucugca

SEQ ID NO: 83000 - RNA, 19 nt, Human
ucucccggcacuccugccc

SEQ ID NO: 83001 - RNA, 22 nt, Human
ucucccucauuccugcuuccau

SEQ ID NO: 83002 - RNA, 22 nt, Human
ucucccuggagcccugaagcau

SEQ ID NO: 83003 - RNA, 22 nt, Human
ucucccuuggucacagauuccu

SEQ ID NO: 83004 - RNA, 22 nt, Human
ucuccggguggcggcgaaggga

SEQ ID NO: 83005 - RNA, 22 nt, Human
ucuccuaauuaaaugcucuuau

SEQ ID NO: 83006 - RNA, 22 nt, Human
ucuccuccagaggcugugggga

SEQ ID NO: 83007 - RNA, 21 nt, Human
ucuccucccggggagaggccg

SEQ ID NO: 83008 - RNA, 23 nt, Human
ucuccuccuagauacagucaugg

SEQ ID NO: 83009 - RNA, 22 nt, Human
ucuccucucuuaccugguacaa

SEQ ID NO: 83010 - RNA, 22 nt, Human
ucuccugaagaccaugugcacu

SEQ ID NO: 83011 - RNA, 22 nt, Human
gugugcaggggcuugguggagc

SEQ ID NO: 83012 - RNA, 22 nt, Human
gugugcaguagagaaagagcag

SEQ ID NO: 83013 - RNA, 22 nt, Human
gugugcagugagcaaaagaucu

SEQ ID NO: 83014 - RNA, 22 nt, Human
gugugcaucucacccuuccccg

SEQ ID NO: 83015 - RNA, 22 nt, Human
gugugcaugaggauaggaauaa

SEQ ID NO: 83016 - RNA, 22 nt, Human
gugugcauggagggggcaguga

SEQ ID NO: 83017 - RNA, 22 nt, Human
gugugcaugugcuugcacagau

SEQ ID NO: 83018 - RNA, 22 nt, Human
gugugcauguggaagcauguau

SEQ ID NO: 83019 - RNA, 22 nt, Human
gugugccaagagauaguugcug

SEQ ID NO: 83020 - RNA, 22 nt, Human
gugugccaccagucaaggugaa

SEQ ID NO: 83021 - RNA, 22 nt, Human
gucucauaugauauaaaugcag

SEQ ID NO: 83022 - RNA, 22 nt, Human
gucucauugguucugccagagu

SEQ ID NO: 83023 - RNA, 22 nt, Human
gucuccacagcccagcugccac

SEQ ID NO: 83024 - RNA, 22 nt, Human
gucuccagagguuacauccugu

SEQ ID NO: 83025 - RNA, 22 nt, Human
gucuccagccauucucugauca

SEQ ID NO: 83026 - RNA, 22 nt, Human
gucuccagggcugcuggcgccu

SEQ ID NO: 83027 - RNA, 22 nt, Human
gucuccuaaaccauccugguac

SEQ ID NO: 83028 - RNA, 22 nt, Human
gucuccuccauggagaugguau

SEQ ID NO: 83029 - RNA, 22 nt, Human
gucuccuggcugcagcuaagac

SEQ ID NO: 83030 - RNA, 22 nt, Human
gucucuaucauagcugaacccu

SEQ ID NO: 83031 - RNA, 22 nt, Human
gucucucugcuaggccuccagu

SEQ ID NO: 83032 - RNA, 22 nt, Human
gucucugaagucaguuuuucua

SEQ ID NO: 83033 - RNA, 19 nt, Human
gucucugcuccagggucuc

SEQ ID NO: 83034 - RNA, 22 nt, Human
gucucugugcccccauuuccgu

SEQ ID NO: 83035 - RNA, 22 nt, Human
gucucuguggcuggcuccuucc

SEQ ID NO: 83036 - RNA, 22 nt, Human
gucucuguuauuuccaggguca

SEQ ID NO: 83037 - RNA, 22 nt, Human
gucucuuuuauggugaguugau

SEQ ID NO: 83038 - RNA, 22 nt, Human
gucugaaaaugcccuacgauug

SEQ ID NO: 83039 - RNA, 22 nt, Human
gucugaagccagugguaguccg

SEQ ID NO: 83040 - RNA, 22 nt, Human
gucugaaugaugagugggacuc

SEQ ID NO: 83041 - RNA, 22 nt, Human
gucugagaaucuugcauaucau

SEQ ID NO: 83042 - RNA, 22 nt, Human
gucugagggguuucccaggaca

SEQ ID NO: 83043 - RNA, 22 nt, Human
gucugagggucaugggucucac

SEQ ID NO: 83044 - RNA, 22 nt, Human
gucugcagacaacuuagaagca

SEQ ID NO: 83045 - RNA, 20 nt, Human
gucugcaguaagagggaaua

SEQ ID NO: 83046 - RNA, 22 nt, Human
gucugcauacaggacaugcaca

SEQ ID NO: 83047 - RNA, 20 nt, Human
gucugcccaggccaccacgg

SEQ ID NO: 83048 - RNA, 22 nt, Human
gucugcccggccuuccuccacc

SEQ ID NO: 83049 - RNA, 22 nt, Human
gucugcccucacaugcacucuu

SEQ ID NO: 83050 - RNA, 22 nt, Human
gucugcccuggggcaucaguuu

SEQ ID NO: 83051 - RNA, 22 nt, Human
gucugccugcuaguggcugccu

SEQ ID NO: 83052 - RNA, 22 nt, Human
gucugccugggacgcugggagu

SEQ ID NO: 83053 - RNA, 18 nt, Human
gucugccuucucccuucc

SEQ ID NO: 83054 - RNA, 22 nt, Human
gucugcugacagagcauggacc

SEQ ID NO: 83055 - RNA, 22 nt, Human
gucugcugcagagcauggcuuu

SEQ ID NO: 83056 - RNA, 22 nt, Human
gucugcugcuucuguugaagca

SEQ ID NO: 83057 - RNA, 22 nt, Human
gucugcuggugccuggccugcg

SEQ ID NO: 83058 - RNA, 22 nt, Human
gucugcugugccuuggggaaaa

SEQ ID NO: 83059 - RNA, 22 nt, Human
gucugcuuucugggaacucuuu

SEQ ID NO: 83060 - RNA, 22 nt, Human
gucugcuuugucuuucaugaua

SEQ ID NO: 83061 - RNA, 22 nt, Human
gucuggaaagagcugagguuca

SEQ ID NO: 83062 - RNA, 22 nt, Human
gucuggaaaggggcuuuuaucu

SEQ ID NO: 83063 - RNA, 22 nt, Human
gucuggaagaaccugugccagu

SEQ ID NO: 83064 - RNA, 22 nt, Human
gucuggaagaacuagggauguu

SEQ ID NO: 83065 - RNA, 22 nt, Human
gucuggaaggaggagauggagc

SEQ ID NO: 83066 - RNA, 22 nt, Human
gucuggaagggagugcauuuuc

SEQ ID NO: 83067 - RNA, 22 nt, Human
gucuggagccacugcugcugcu

SEQ ID NO: 83068 - RNA, 22 nt, Human
gucuggaggaaaagguuaaaug

SEQ ID NO: 83069 - RNA, 22 nt, Human
gucuggaggcccgucagcccua

SEQ ID NO: 83070 - RNA, 21 nt, Human
gucuggaugcccuucucuugg

SEQ ID NO: 83071 - RNA, 22 nt, Human
gucuggcucccacucuuacaaa

SEQ ID NO: 83072 - RNA, 22 nt, Human
gucuggcucuggaaggcaaagg

SEQ ID NO: 83073 - RNA, 22 nt, Human
gucuggcuguccagcuuaucua

SEQ ID NO: 83074 - RNA, 22 nt, Human
gucuggcuuugcucagaugcug

SEQ ID NO: 83075 - RNA, 22 nt, Human
gucugggauugggguaaagaag

SEQ ID NO: 83076 - RNA, 22 nt, Human
gucuggggaagucagggcauca

SEQ ID NO: 83077 - RNA, 22 nt, Human
gucuggggcagcaaggcgcgcg

SEQ ID NO: 83078 - RNA, 22 nt, Human
gucuggggguccgggugccugc

SEQ ID NO: 83079 - RNA, 22 nt, Human
gucugggguccuuuuggcuuua

SEQ ID NO: 83080 - RNA, 22 nt, Human
gucugggucuccacagucagca

SEQ ID NO: 83081 - RNA, 22 nt, Human
gucuggguuaaguccugauaau

SEQ ID NO: 83082 - RNA, 22 nt, Human
gucuggguuucaugggcacugg

SEQ ID NO: 83083 - RNA, 22 nt, Human
gucuguacccacguccugcuag

SEQ ID NO: 83084 - RNA, 22 nt, Human
gucuguagaugagucuuaagaa

SEQ ID NO: 83085 - RNA, 22 nt, Human
gucugucaucugagauggagug

SEQ ID NO: 83086 - RNA, 22 nt, Human
gucuguccaucagcaaaggcuu

SEQ ID NO: 83087 - RNA, 22 nt, Human
gucugucccaauagccaacagg

SEQ ID NO: 83088 - RNA, 22 nt, Human
gucugugggccaaauacagccc

SEQ ID NO: 83089 - RNA, 22 nt, Human
gucuguuaccuccaagaccauu

SEQ ID NO: 83090 - RNA, 22 nt, Human
gucuguuagugauaacuguuuu

SEQ ID NO: 83091 - RNA, 22 nt, Human
gucuuaaaaucagaggauauag

SEQ ID NO: 83092 - RNA, 22 nt, Human
gucuuauuaaaaaucuaauccc

SEQ ID NO: 83093 - RNA, 22 nt, Human
gucuuauuaaaaugcaguuucu

SEQ ID NO: 83094 - RNA, 22 nt, Human
gucuuauuagguuaacccugcu

SEQ ID NO: 83095 - RNA, 22 nt, Human
gucuucaauagagccucaauuu

SEQ ID NO: 83096 - RNA, 22 nt, Human
gucuucauucucauagcccugg

SEQ ID NO: 83097 - RNA, 22 nt, Human
gucuucugaucugguuagccau

SEQ ID NO: 83098 - RNA, 22 nt, Human
gucuucugcaacugcaccugcc

SEQ ID NO: 83099 - RNA, 22 nt, Human
gucuucuguaagaugagguccc

SEQ ID NO: 83100 - RNA, 22 nt, Human
gucuucuuguguugccugucuu

SEQ ID NO: 83101 - RNA, 22 nt, Human
gucuucuuuucagucugcuugu

SEQ ID NO: 83102 - RNA, 22 nt, Human
gucuugcacuuaccuaagaacu

SEQ ID NO: 83103 - RNA, 22 nt, Human
gucuuguccauuccaugcugcu

SEQ ID NO: 83104 - RNA, 22 nt, Human
gucuuguuaagauuuuggaaua

SEQ ID NO: 83105 - RNA, 22 nt, Human
gucuuguuggaguucuugcagc

SEQ ID NO: 83106 - RNA, 22 nt, Human
gucuuuaguugaaacauguggu

SEQ ID NO: 83107 - RNA, 16 nt, Human
gucuuuauucacuuag

SEQ ID NO: 83108 - RNA, 22 nt, Human
gucuuucauggauauucaguuu

SEQ ID NO: 83109 - RNA, 22 nt, Human
gucuuucuaugaugaacuguug

SEQ ID NO: 83110 - RNA, 22 nt, Human
gucuuucuucagagcuuggacu

SEQ ID NO: 83111 - RNA, 22 nt, Human
gucuuugccacacuucuguaca

SEQ ID NO: 83112 - RNA, 22 nt, Human
gucuuugcugucuuugcucuca

SEQ ID NO: 83113 - RNA, 22 nt, Human
gucuuuggaggcacuguugagu

SEQ ID NO: 83114 - RNA, 22 nt, Human
gucuuugugguaguccucagcc

SEQ ID NO: 83115 - RNA, 21 nt, Human
gucuuuuaagugaagagaggc

SEQ ID NO: 83116 - RNA, 21 nt, Human
gucuuuuuaauugcgauuucc

SEQ ID NO: 83117 - RNA, 22 nt, Human
gucuuuuuauuauagaguggag

SEQ ID NO: 83118 - RNA, 22 nt, Human
gucuuuuucuacgauagcgccu

SEQ ID NO: 83119 - RNA, 22 nt, Human
gugaaaaaugauuuguuaacug

SEQ ID NO: 83120 - RNA, 22 nt, Human
gugaaaagagagccugugucag

SEQ ID NO: 83121 - RNA, 22 nt, Human
gugaaaagcaacauuguggacc

SEQ ID NO: 83122 - RNA, 22 nt, Human
gugaaaguaagaaaguaggacu

SEQ ID NO: 83123 - RNA, 22 nt, Human
gugaaauauuuaacguccaggu

SEQ ID NO: 83124 - RNA, 22 nt, Human
guuauuuauaagguguaacucc

SEQ ID NO: 83125 - RNA, 21 nt, Human
guuauuuuaagugagcuuugc

SEQ ID NO: 83126 - RNA, 19 nt, Human
guucaaacacugauucagc

SEQ ID NO: 83127 - RNA, 22 nt, Human
guucaaccaugauuaggaacug

SEQ ID NO: 83128 - RNA, 22 nt, Human
guucaaccccuugaugguacag

SEQ ID NO: 83129 - RNA, 18 nt, Human
guucaaggucaagagaga

SEQ ID NO: 83130 - RNA, 22 nt, Human
gugaaccucugaaaggcaguga

SEQ ID NO: 83131 - RNA, 22 nt, Human
gugaacucagucucucuugcua

SEQ ID NO: 83132 - RNA, 22 nt, Human
gugaacucugacucucaugccu

SEQ ID NO: 83133 - RNA, 22 nt, Human
gugaagaaggcaauacaaagaa

SEQ ID NO: 83134 - RNA, 21 nt, Human
gugaagacuuugccuuuaaga

SEQ ID NO: 83135 - RNA, 22 nt, Human
gugaagauaaggaugcugcagu

SEQ ID NO: 83136 - RNA, 22 nt, Human
gugaagcauaugcuucucugcc

SEQ ID NO: 83137 - RNA, 22 nt, Human
gugaagccacagagccacgccg

SEQ ID NO: 83138 - RNA, 22 nt, Human
gugaagccucggaaccaagcuc

SEQ ID NO: 83139 - RNA, 18 nt, Human
gugaagcuuuauugaaug

SEQ ID NO: 83140 - RNA, 22 nt, Human
gugaaggaccaauaugacucau

SEQ ID NO: 83141 - RNA, 22 nt, Human
gugaaggacuagcauggagggc

SEQ ID NO: 83142 - RNA, 22 nt, Human
gugaaggcaaugauaagaguga

SEQ ID NO: 83143 - RNA, 22 nt, Human
gugaaggccaguaggguccugg

SEQ ID NO: 83144 - RNA, 20 nt, Human
gugaagggagucaggugugc

SEQ ID NO: 83145 - RNA, 22 nt, Human
gugaaguucaagcuugccaucu

SEQ ID NO: 83146 - RNA, 22 nt, Human
gugaauaauauuguuuauaaaa

SEQ ID NO: 83147 - RNA, 22 nt, Human
gugaaugaaaggaugauucuuu

SEQ ID NO: 83148 - RNA, 22 nt, Human
gugaaugauagcuucucuuugg

SEQ ID NO: 83149 - RNA, 17 nt, Human
gugaauggcauagucgg

SEQ ID NO: 83150 - RNA, 22 nt, Human
gugaauggggcaggaaggaugg

SEQ ID NO: 83151 - RNA, 22 nt, Human
gugaaugguugugaacaucuuu

SEQ ID NO: 83152 - RNA, 22 nt, Human
gugaauuaaauauagccagguc

SEQ ID NO: 83153 - RNA, 22 nt, Human
gugaauuaggacaaaagggcuu

SEQ ID NO: 83154 - RNA, 22 nt, Human
gugaauuaggcuauggcagagg

SEQ ID NO: 83155 - RNA, 22 nt, Human
gugacaaaggucaagcuuuuga

SEQ ID NO: 83156 - RNA, 22 nt, Human
gugacagagugagaccuugucu

SEQ ID NO: 83157 - RNA, 22 nt, Human
gugacagugacagcuagauagu

SEQ ID NO: 83158 - RNA, 22 nt, Human
gugacauuuacgaaucuuaucc

SEQ ID NO: 83159 - RNA, 22 nt, Human
gugaccagagcgggagauuggg

SEQ ID NO: 83160 - RNA, 22 nt, Human
gugaccagcccauagagaggcg

SEQ ID NO: 83161 - RNA, 22 nt, Human
gugaccaguuggcagggguggg

SEQ ID NO: 83162 - RNA, 22 nt, Human
gugacccagguagguaagcaau

SEQ ID NO: 83163 - RNA, 22 nt, Human
gugacguuuaauagugacaugg

SEQ ID NO: 83164 - RNA, 22 nt, Human
gugacugugaacuguuucugau

SEQ ID NO: 83165 - RNA, 22 nt, Human
gugacugugagucgcugugaca

SEQ ID NO: 83166 - RNA, 22 nt, Human
gugacugugaucuuauuugcaa

SEQ ID NO: 83167 - RNA, 22 nt, Human
gugagaaaugacaaaugugucg

SEQ ID NO: 83168 - RNA, 22 nt, Human
gugagaagauaaguauugcaaa

SEQ ID NO: 83169 - RNA, 22 nt, Human
gugagaaugagauuggaaugua

SEQ ID NO: 83170 - RNA, 22 nt, Human
gugagacaauuccucaguagac

SEQ ID NO: 83171 - RNA, 19 nt, Human
gugagacccugcauagggc

SEQ ID NO: 83172 - RNA, 22 nt, Human
gugagagaauuugaguuaaauu

SEQ ID NO: 83173 - RNA, 22 nt, Human
gugagagaugcuuucuuaacgc

SEQ ID NO: 83174 - RNA, 22 nt, Human
gugagagauugauuguagcggc

SEQ ID NO: 83175 - RNA, 22 nt, Human
gugagagcugcuccagaucucu

SEQ ID NO: 83176 - RNA, 22 nt, Human
gugagaguaccaccucaacauc

SEQ ID NO: 83177 - RNA, 22 nt, Human
gugagcaaagguuaaacauuua

SEQ ID NO: 83178 - RNA, 22 nt, Human
gugagcagagaucgcgugauug

SEQ ID NO: 83179 - RNA, 22 nt, Human
gugagcagccucaccugagggu

SEQ ID NO: 83180 - RNA, 22 nt, Human
gugagcuguuggaguggcagag

SEQ ID NO: 83181 - RNA, 22 nt, Human
gugagcuguuuuggacccaucu

SEQ ID NO: 83182 - RNA, 22 nt, Human
gugaggagcucuuugacucacg

SEQ ID NO: 83183 - RNA, 22 nt, Human
gugaggagcugacacuggggug

SEQ ID NO: 83184 - RNA, 22 nt, Human
gugaggagucugaagcacauaa

SEQ ID NO: 83185 - RNA, 19 nt, Human
gugaggauacugcucagag

SEQ ID NO: 83186 - RNA, 22 nt, Human
gugaggcaagggcauacuaggc

SEQ ID NO: 83187 - RNA, 22 nt, Human
gugaggcaggcauucuccuuuc

SEQ ID NO: 83188 - RNA, 22 nt, Human
gugaggccgcacgccccggagu

SEQ ID NO: 83189 - RNA, 22 nt, Human
gugagggagguagauuucauca

SEQ ID NO: 83190 - RNA, 22 nt, Human
gugagggguggcugagcaguuu

SEQ ID NO: 83191 - RNA, 22 nt, Human
gugagguaaagcacagaaauag

SEQ ID NO: 83192 - RNA, 22 nt, Human
gugagguccauguuaauggguu

SEQ ID NO: 83193 - RNA, 22 nt, Human
gugagguccucccugcugggag

SEQ ID NO: 83194 - RNA, 22 nt, Human
gugaggugggcugggcucuaug

SEQ ID NO: 83195 - RNA, 22 nt, Human
gugagucaauguauugcagcaa

SEQ ID NO: 83196 - RNA, 22 nt, Human
gugagugccaggugaaguaugu

SEQ ID NO: 83197 - RNA, 22 nt, Human
gugauaauugcagagaaaggag

SEQ ID NO: 83198 - RNA, 22 nt, Human
gugauacagguguucuggauau

SEQ ID NO: 83199 - RNA, 22 nt, Human
gugauaucuuacaauucucuuu

SEQ ID NO: 83200 - RNA, 22 nt, Human
gugauauuucaagaguggggca

SEQ ID NO: 83201 - RNA, 22 nt, Human
gugauccgaugucagucgcaga

SEQ ID NO: 83202 - RNA, 22 nt, Human
gugaugucacacccuugauaga

SEQ ID NO: 83203 - RNA, 22 nt, Human
gugaugucagcaagaauaggaa

SEQ ID NO: 83204 - RNA, 22 nt, Human
gugaugucuuguacauaugauu

SEQ ID NO: 83205 - RNA, 22 nt, Human
gugauuaagcauuucagaauuu

SEQ ID NO: 83206 - RNA, 22 nt, Human
gugauucauucgauuaguauuu

SEQ ID NO: 83207 - RNA, 22 nt, Human
gugauuccuauuaguacaugca

SEQ ID NO: 83208 - RNA, 22 nt, Human
gugauucucaaauugugauauc

SEQ ID NO: 83209 - RNA, 21 nt, Human
gugauucucugaguuuugggg

SEQ ID NO: 83210 - RNA, 22 nt, Human
gugauucugcacgucauuccug

SEQ ID NO: 83211 - RNA, 22 nt, Human
gugauucuguucuggugcugcc

SEQ ID NO: 83212 - RNA, 22 nt, Human
gugauucuuccugcuggcauac

SEQ ID NO: 83213 - RNA, 22 nt, Human
gugauucuuugaucuaugaaag

SEQ ID NO: 83214 - RNA, 22 nt, Human
gugauuuagauguugaaaguga

SEQ ID NO: 83215 - RNA, 22 nt, Human
gugauuucagguuuuucauacu

SEQ ID NO: 83216 - RNA, 22 nt, Human
gugcaaaaggcauugugguuuu

SEQ ID NO: 83217 - RNA, 22 nt, Human
gugcaaaaguaacugugguuuu

SEQ ID NO: 83218 - RNA, 22 nt, Human
gugcaaaaguaauugagguuuu

SEQ ID NO: 83219 - RNA, 22 nt, Human
gugcaaaaguaauugcuguuuu

SEQ ID NO: 83220 - RNA, 22 nt, Human
gugcaaagcuuaacauucugca

SEQ ID NO: 83221 - RNA, 22 nt, Human
gugcaaagugcauggggaaggg

SEQ ID NO: 83222 - RNA, 22 nt, Human
gugcaaauguaauugccauuga

SEQ ID NO: 83223 - RNA, 22 nt, Human
gugcaaauguaauugugauuuu

SEQ ID NO: 83224 - RNA, 22 nt, Human
gugcaaauguaauugugguuuu

SEQ ID NO: 83225 - RNA, 22 nt, Human
gugcaagaaggggagacugggu

SEQ ID NO: 83226 - RNA, 22 nt, Human
gugcaaguccagaaagaacucu

SEQ ID NO: 83227 - RNA, 22 nt, Human
gugcaauaaauaaauagauugu

SEQ ID NO: 83228 - RNA, 22 nt, Human
gugcaauauugccauguucuug

SEQ ID NO: 83229 - RNA, 22 nt, Human
gugcaauccucauagaacucau

SEQ ID NO: 83230 - RNA, 22 nt, Human
gugcaaucuguugacuggacuu

SEQ ID NO: 83231 - RNA, 18 nt, Human
gugcaaugaauagcagag

SEQ ID NO: 83232 - RNA, 22 nt, Human
gugcaauuuugcaucuguaugc

SEQ ID NO: 83233 - RNA, 22 nt, Human
gugcacagauuuaauuuuauuc

SEQ ID NO: 83234 - RNA, 23 nt, Human
gugcacagucaagcccagcuuag

SEQ ID NO: 83235 - RNA, 21 nt, Human
gugcacaguccugcacacagg

SEQ ID NO: 83236 - RNA, 22 nt, Human
gugcaccccggggcccugcucc

SEQ ID NO: 83237 - RNA, 22 nt, Human
gucugcccucacgccagcuggg

SEQ ID NO: 83238 - RNA, 22 nt, Human
gucugccucagccgggggccgc

SEQ ID NO: 83239 - RNA, 22 nt, Human
ucuggcagagucagugcacaca

SEQ ID NO: 83240 - RNA, 22 nt, Human
ucuggcagagugauaggauaag

SEQ ID NO: 83241 - RNA, 22 nt, Human
ucuggcagcagcaucaguggcu

SEQ ID NO: 83242 - RNA, 22 nt, Human
ucuggcaggauaucgaagugaa

SEQ ID NO: 83243 - RNA, 22 nt, Human
ucuggcagggguucugcacuug

SEQ ID NO: 83244 - RNA, 19 nt, Human
ucuggcagguaauuaggga

SEQ ID NO: 83245 - RNA, 22 nt, Human
ucuggcagguucccauguuaug

SEQ ID NO: 83246 - RNA, 22 nt, Human
ucuggccaacaaaaacuaaguc

SEQ ID NO: 83247 - RNA, 22 nt, Human
ucuggccaacccucaaguugua

SEQ ID NO: 83248 - RNA, 22 nt, Human
ucuggccauggcaagccgagug

SEQ ID NO: 83249 - RNA, 22 nt, Human
ucuggcccagccccugagguca

SEQ ID NO: 83250 - RNA, 22 nt, Human
ucuggccccauacagagggucu

SEQ ID NO: 83251 - RNA, 22 nt, Human
ucuggccccgcaugcacuuuau

SEQ ID NO: 83252 - RNA, 22 nt, Human
ucuggccccuggcaguccugga

SEQ ID NO: 83253 - RNA, 22 nt, Human
ucuggccuacuggaguccauga

SEQ ID NO: 83254 - RNA, 22 nt, Human
ucuggccucuugggaugcuccc

SEQ ID NO: 83255 - RNA, 22 nt, Human
ucuggccuuaucuguccaagcc

SEQ ID NO: 83256 - RNA, 22 nt, Human
ucuggcucaaaauacguacucu

SEQ ID NO: 83257 - RNA, 22 nt, Human
uaaauucugaucaaguuccuuc

SEQ ID NO: 83258 - RNA, 22 nt, Human
uaaauugaaaaucuacagaaca

SEQ ID NO: 83259 - RNA, 21 nt, Human
uaacaaagacuucuggucagg

SEQ ID NO: 83260 - RNA, 22 nt, Human
uaacaaaguaccauagacugga

SEQ ID NO: 83261 - RNA, 19 nt, Human
uaacaaagucugaagucag

SEQ ID NO: 83262 - RNA, 22 nt, Human
uaacaacugaggaagaggcaga

SEQ ID NO: 83263 - RNA, 22 nt, Human
uaacaacuugcuuuuaucuuag

SEQ ID NO: 83264 - RNA, 22 nt, Human
uaacaagaaauacauugguucu

SEQ ID NO: 83265 - RNA, 22 nt, Human
uaacaagaugucacuccugucc

SEQ ID NO: 83266 - RNA, 22 nt, Human
uaacaaggcaauuugugauccu

SEQ ID NO: 83267 - RNA, 22 nt, Human
uaacaauacccauucuaauuac

SEQ ID NO: 83268 - RNA, 18 nt, Human
uaacaauccugagugucu

SEQ ID NO: 83269 - RNA, 22 nt, Human
uaacaaugcaaaaugaauuuag

SEQ ID NO: 83270 - RNA, 23 nt, Human
uaacaauggacuccucuuagcua

SEQ ID NO: 83271 - RNA, 22 nt, Human
uaacaaugggaaggacugauga

SEQ ID NO: 83272 - RNA, 22 nt, Human
uaacaaugguuuugcugauaau

SEQ ID NO: 83273 - RNA, 22 nt, Human
uaacaauuugcuucauuuguuu

SEQ ID NO: 83274 - RNA, 22 nt, Human
uaacacacugaaggugagaugg

SEQ ID NO: 83275 - RNA, 22 nt, Human
uaacacagaguaaguggucaau

SEQ ID NO: 83276 - RNA, 17 nt, Human
uaacacaggcucagaga

SEQ ID NO: 83277 - RNA, 22 nt, Human
uaacacagugucuaccauuauu

SEQ ID NO: 83278 - RNA, 22 nt, Human
uaacacaguucucuguugcaca

SEQ ID NO: 83279 - RNA, 22 nt, Human
uaacacauagauauuuuaacuu

SEQ ID NO: 83280 - RNA, 22 nt, Human
uaacacauauuugcaguaagca

SEQ ID NO: 83281 - RNA, 22 nt, Human
uaacacaugguuaguacacaau

SEQ ID NO: 83282 - RNA, 22 nt, Human
uaacacugcuucauuuuggaga

SEQ ID NO: 83283 - RNA, 22 nt, Human
uaacacugguauuucauuuagu

SEQ ID NO: 83284 - RNA, 22 nt, Human
uaacacuguccaaagaauucca

SEQ ID NO: 83285 - RNA, 22 nt, Human
uaacacuugggggcauccuuag

SEQ ID NO: 83286 - RNA, 22 nt, Human
uaacagaaacagauaaguguaa

SEQ ID NO: 83287 - RNA, 22 nt, Human
uaacagaaauagaaaugagagu

SEQ ID NO: 83288 - RNA, 22 nt, Human
uaacagaaauauuuccagguga

SEQ ID NO: 83289 - RNA, 22 nt, Human
uaacagaaauuuuaguuagggg

SEQ ID NO: 83290 - RNA, 22 nt, Human
uaacagaagaaaacauauugga

SEQ ID NO: 83291 - RNA, 22 nt, Human
uaacagaauuugcuaaacuccg

SEQ ID NO: 83292 - RNA, 22 nt, Human
uaacagagugaaaaucagcaca

SEQ ID NO: 83293 - RNA, 22 nt, Human
uaacagaguuguacaguuacgu

SEQ ID NO: 83294 - RNA, 22 nt, Human
uaacagcaaccacagugcuggu

SEQ ID NO: 83295 - RNA, 22 nt, Human
uaacagcacuggcaggcacugu

SEQ ID NO: 83296 - RNA, 22 nt, Human
uaacagcauuugaaugaguaac

SEQ ID NO: 83297 - RNA, 22 nt, Human
uaacagcccucccuccauccug

SEQ ID NO: 83298 - RNA, 22 nt, Human
uaacaggcaaggucacaccuug

SEQ ID NO: 83299 - RNA, 22 nt, Human
uaacaggcugaucauauauccu

SEQ ID NO: 83300 - RNA, 19 nt, Human
uaacaggggaaaaugauca

SEQ ID NO: 83301 - RNA, 22 nt, Human
uaacaggugguaguuugugcuc

SEQ ID NO: 83302 - RNA, 20 nt, Human
uaacaguaagugauguuaca

SEQ ID NO: 83303 - RNA, 22 nt, Human
uaacaguaccauuaacuuugau

SEQ ID NO: 83304 - RNA, 22 nt, Human
uaacaguugguguaauuucuug

SEQ ID NO: 83305 - RNA, 20 nt, Human
uaacaguuguagaggguuuu

SEQ ID NO: 83306 - RNA, 22 nt, Human
uaacaucuuauuggcaaagaua

SEQ ID NO: 83307 - RNA, 22 nt, Human
uaacaugcuaggaagagugauu

SEQ ID NO: 83308 - RNA, 22 nt, Human
uaacauuauacagagaggacag

SEQ ID NO: 83309 - RNA, 22 nt, Human
uaacauuccauggaucugcaga

SEQ ID NO: 83310 - RNA, 22 nt, Human
uaacauuccucaaaguuuucag

SEQ ID NO: 83311 - RNA, 22 nt, Human
uaacauucuuaacuuagaaaca

SEQ ID NO: 83312 - RNA, 22 nt, Human
uaacauugucaguucaacugcu

SEQ ID NO: 83313 - RNA, 22 nt, Human
uaaccaaagggccuaaggaaug

SEQ ID NO: 83314 - RNA, 22 nt, Human
uaaccaagcaaacuuucauugu

SEQ ID NO: 83315 - RNA, 22 nt, Human
uaacccaaaggcaaugucucga

SEQ ID NO: 83316 - RNA, 22 nt, Human
uaaccucuauuuuuauaaaagu

SEQ ID NO: 83317 - RNA, 22 nt, Human
uaaccucugagcuccagcuucu

SEQ ID NO: 83318 - RNA, 22 nt, Human
uaaccugaacacacaauaggga

SEQ ID NO: 83319 - RNA, 23 nt, Human
uaaccugagauugcaagggagcu

SEQ ID NO: 83320 - RNA, 22 nt, Human
uaaccugaggagaacagugcuu

SEQ ID NO: 83321 - RNA, 23 nt, Human
uaaccugaguuuuuuagaugcaa

SEQ ID NO: 83322 - RNA, 22 nt, Human
uaaccugggaucugacgggaug

SEQ ID NO: 83323 - RNA, 22 nt, Human
uaacuacaagggcggucucugu

SEQ ID NO: 83324 - RNA, 22 nt, Human
uaacucucacagugcaacauga

SEQ ID NO: 83325 - RNA, 22 nt, Human
uaacucuuccaacacuccuucc

SEQ ID NO: 83326 - RNA, 22 nt, Human
uaacucuuuacuauacauuuau

SEQ ID NO: 83327 - RNA, 19 nt, Human
uaacucuuuccuuuucccc

SEQ ID NO: 83328 - RNA, 22 nt, Human
uaacugaugugaacuuaccauu

SEQ ID NO: 83329 - RNA, 22 nt, Human
uaacugcagaggaaaugcaucu

SEQ ID NO: 83330 - RNA, 22 nt, Human
uaacugccuacugugcaaauau

SEQ ID NO: 83331 - RNA, 22 nt, Human
uaacugcucagugaguauuuuu

SEQ ID NO: 83332 - RNA, 22 nt, Human
uaacuggcuuaaauuuuaucaa

SEQ ID NO: 83333 - RNA, 22 nt, Human
uaacugguuuggcucagggucu

SEQ ID NO: 83334 - RNA, 22 nt, Human
uaacuguaauauaaauaugagu

SEQ ID NO: 83335 - RNA, 22 nt, Human
uaacuguaccuagauaacgaac

SEQ ID NO: 83336 - RNA, 22 nt, Human
uaacuguaguuauaaagcuauc

SEQ ID NO: 83337 - RNA, 22 nt, Human
uaacuguauuuuaggucucauu

SEQ ID NO: 83338 - RNA, 22 nt, Human
uaacuguauuuuucugagauuc

SEQ ID NO: 83339 - RNA, 22 nt, Human
uaacugucacuucugcacaucu

SEQ ID NO: 83340 - RNA, 22 nt, Human
uaacuucaagucuguggaucag

SEQ ID NO: 83341 - RNA, 22 nt, Human
uaacuucugaauagcaauagua

SEQ ID NO: 83342 - RNA, 22 nt, Human
uaacuugagcucucagugcuau

SEQ ID NO: 83343 - RNA, 22 nt, Human
uaacuugguuggugggcaggag

SEQ ID NO: 83344 - RNA, 22 nt, Human
uaacuuguguuacauuacucuu

SEQ ID NO: 83345 - RNA, 22 nt, Human
uaacuuuaggaauagguaaucu

SEQ ID NO: 83346 - RNA, 22 nt, Human
uaacuuucacaucacacugacu

SEQ ID NO: 83347 - RNA, 22 nt, Human
uaacuuucuucauaugugaacc

SEQ ID NO: 83348 - RNA, 22 nt, Human
ucugggucggaagccccaggga

SEQ ID NO: 83349 - RNA, 22 nt, Human
ucugggucucagagugaccaug

SEQ ID NO: 83350 - RNA, 22 nt, Human
ucugggucuuuacccauggaau

SEQ ID NO: 83351 - RNA, 22 nt, Human
ucugggugacccugggcaaggc

SEQ ID NO: 83352 - RNA, 22 nt, Human
ucugggugaugaaaugcacugu

SEQ ID NO: 83353 - RNA, 22 nt, Human
ucugggugcccuuugcucuguu

SEQ ID NO: 83354 - RNA, 22 nt, Human
ucugggugucacuccugccugc

SEQ ID NO: 83355 - RNA, 20 nt, Human
ucuggguugaaaucaagauc

SEQ ID NO: 83356 - RNA, 22 nt, Human
ucugguacuagaggagugcugg

SEQ ID NO: 83357 - RNA, 22 nt, Human
ucuggucaguaauaagaagugg

SEQ ID NO: 83358 - RNA, 22 nt, Human
ucuggucccugcucacuucuug

SEQ ID NO: 83359 - RNA, 22 nt, Human
ucuggucccuuuuccugcaguc

SEQ ID NO: 83360 - RNA, 22 nt, Human
ucugguccucucugugaugcua

SEQ ID NO: 83361 - RNA, 21 nt, Human
ucuggucugcuguggaccugg

SEQ ID NO: 83362 - RNA, 22 nt, Human
ucugguuagccaauaaugccaa

SEQ ID NO: 83363 - RNA, 22 nt, Human
ucuguaaaacaauauuguauuc

SEQ ID NO: 83364 - RNA, 22 nt, Human
ucuguaaaauuaguauaauugu

SEQ ID NO: 83365 - RNA, 22 nt, Human
ucuguaaacaccauguuagagu

SEQ ID NO: 83366 - RNA, 22 nt, Human
ucuguaaagauguuuauaccuu

SEQ ID NO: 83367 - RNA, 19 nt, Human
ucuguaacacucuagccuu

SEQ ID NO: 83368 - RNA, 22 nt, Human
ucuguaaguguugguuauucua

SEQ ID NO: 83369 - RNA, 23 nt, Human
ucuguacacaucagcaucuccca

SEQ ID NO: 83370 - RNA, 21 nt, Human
ucuguacaucauugagucccc

SEQ ID NO: 83371 - RNA, 22 nt, Human
ucuguacaugaguugagaauca

SEQ ID NO: 83372 - RNA, 22 nt, Human
ucuguacauuuggggaccccag

SEQ ID NO: 83373 - RNA, 22 nt, Human
ucuguacauuuguguugugaau

SEQ ID NO: 83374 - RNA, 22 nt, Human
gugggcuuuugacagugccugg

SEQ ID NO: 83375 - RNA, 22 nt, Human
guggggacgggauggcucacug

SEQ ID NO: 83376 - RNA, 22 nt, Human
guggggagggagaugcugaagu

SEQ ID NO: 83377 - RNA, 22 nt, Human
guggggcggcagaugcucccug

SEQ ID NO: 83378 - RNA, 22 nt, Human
gugggggacccaggugcugucc

SEQ ID NO: 83379 - RNA, 22 nt, Human
guggggguggaaaggcaaguug

SEQ ID NO: 83380 - RNA, 18 nt, Human
gugggguguugugaggau

SEQ ID NO: 83381 - RNA, 22 nt, Human
gugggucccuaaacacauccca

SEQ ID NO: 83382 - RNA, 22 nt, Human
guggguccgcuugguuccggug

SEQ ID NO: 83383 - RNA, 22 nt, Human
guggguggacggugcuuuuguu

SEQ ID NO: 83384 - RNA, 22 nt, Human
guggguggagacugggugcaag

SEQ ID NO: 83385 - RNA, 22 nt, Human
guggguggauuccagcaacgcu

SEQ ID NO: 83386 - RNA, 22 nt, Human
gugguaauuuaauccuacacug

SEQ ID NO: 83387 - RNA, 22 nt, Human
gugguacagcugaaaggcuugc

SEQ ID NO: 83388 - RNA, 22 nt, Human
gugguaggcacagagaacaaga

SEQ ID NO: 83389 - RNA, 22 nt, Human
guggucagguuaucagaucaua

SEQ ID NO: 83390 - RNA, 22 nt, Human
guggucaguuaggcaaucaugu

SEQ ID NO: 83391 - RNA, 22 nt, Human
guggucaucuaacuaaauuuuc

SEQ ID NO: 83392 - RNA, 22 nt, Human
guggucauguuaauuaugaucc

SEQ ID NO: 83393 - RNA, 22 nt, Human
guggucauuugucugagcucca

SEQ ID NO: 83394 - RNA, 22 nt, Human
gugguccaucaugcagagcucc

SEQ ID NO: 83395 - RNA, 22 nt, Human
gugguccuggcaaccaugguga

SEQ ID NO: 83396 - RNA, 22 nt, Human
gugguccuguccugacggcuuc

SEQ ID NO: 83397 - RNA, 22 nt, Human
gugguccuuacaggaggcuuac

SEQ ID NO: 83398 - RNA, 22 nt, Human
guggucuggggucaggccugag

SEQ ID NO: 83399 - RNA, 22 nt, Human
guggugaagccccaucucugcu

SEQ ID NO: 83400 - RNA, 22 nt, Human
guggugagauugcuggaucaaa

SEQ ID NO: 83401 - RNA, 22 nt, Human
gugguggaugucuguaaucuca

SEQ ID NO: 83402 - RNA, 22 nt, Human
gugguguaggucacaguuagga

SEQ ID NO: 83403 - RNA, 22 nt, Human
gugguuguuuaggucguggauc

SEQ ID NO: 83404 - RNA, 22 nt, Human
gugguuuuggaggccacuguuu

SEQ ID NO: 83405 - RNA, 22 nt, Human
guguaaacaacagugguuugaa

SEQ ID NO: 83406 - RNA, 21 nt, Human
guguaaacggacucaugcagu

SEQ ID NO: 83407 - RNA, 22 nt, Human
guguaaaugccccauucauuga

SEQ ID NO: 83408 - RNA, 22 nt, Human
guguaacuugcuggaaaaacua

SEQ ID NO: 83409 - RNA, 22 nt, Human
guguaaggugaaaucaacaaau

SEQ ID NO: 83410 - RNA, 22 nt, Human
guguaauugaaauugagaacca

SEQ ID NO: 83411 - RNA, 22 nt, Human
guguacagauaucucacguucu

SEQ ID NO: 83412 - RNA, 22 nt, Human
guguacaguaagugaaucuagg

SEQ ID NO: 83413 - RNA, 22 nt, Human
guguacaugagaaaucaacuuu

SEQ ID NO: 83414 - RNA, 22 nt, Human
guguacugcaaaugcugcugcc

SEQ ID NO: 83415 - RNA, 22 nt, Human
guguagagugacaaggugggaa

SEQ ID NO: 83416 - RNA, 22 nt, Human
guguagcauauagcaagagcau

SEQ ID NO: 83417 - RNA, 22 nt, Human
guguagcuuuggagugggaggc

SEQ ID NO: 83418 - RNA, 22 nt, Human
guguagguaagcaugcagcuga

SEQ ID NO: 83419 - RNA, 22 nt, Human
guguauaauccugcaaagggag

SEQ ID NO: 83420 - RNA, 22 nt, Human
guguaucaguaacuguggacag

SEQ ID NO: 83421 - RNA, 22 nt, Human
guguaucuggcaugucgagugu

SEQ ID NO: 83422 - RNA, 22 nt, Human
guguaugagccuccagcugggc

SEQ ID NO: 83423 - RNA, 22 nt, Human
gugucacaagagcccaggaaac

SEQ ID NO: 83424 - RNA, 22 nt, Human
gugucacaugguuuacugcagc

SEQ ID NO: 83425 - RNA, 22 nt, Human
gugucauacagaaugcauaagu

SEQ ID NO: 83426 - RNA, 22 nt, Human
gugucaugcacacucaguguug

SEQ ID NO: 83427 - RNA, 22 nt, Human
guguccagagaacugugggagc

SEQ ID NO: 83428 - RNA, 17 nt, Human
guguccaggccgauggc

SEQ ID NO: 83429 - RNA, 22 nt, Human
guguccagggccguguugucuu

SEQ ID NO: 83430 - RNA, 22 nt, Human
guguccagggcuggaagugagg

SEQ ID NO: 83431 - RNA, 22 nt, Human
gugucccaaagauuagaaauca

SEQ ID NO: 83432 - RNA, 22 nt, Human
gugucccaauguucaggacggc

SEQ ID NO: 83433 - RNA, 22 nt, Human
gugucccacucuggaggugaag

SEQ ID NO: 83434 - RNA, 22 nt, Human
guguccuggagcccccaguuca

SEQ ID NO: 83435 - RNA, 18 nt, Human
guguccuggcugcggcgc

SEQ ID NO: 83436 - RNA, 22 nt, Human
guguccugggggacuucagguu

SEQ ID NO: 83437 - RNA, 22 nt, Human
guguccugggucucugauucuu

SEQ ID NO: 83438 - RNA, 22 nt, Human
guguccuguuucccugucuaua

SEQ ID NO: 83439 - RNA, 22 nt, Human
gugucucuuccuuucaaguggg

SEQ ID NO: 83440 - RNA, 22 nt, Human
gugucugaguuuggaaagucca

SEQ ID NO: 83441 - RNA, 22 nt, Human
gugucugcaagauagccaaguc

SEQ ID NO: 83442 - RNA, 20 nt, Human
gugucugcauauagcaggug

SEQ ID NO: 83443 - RNA, 22 nt, Human
gugucugcauauucaaacuugu

SEQ ID NO: 83444 - RNA, 22 nt, Human
gugucuuagaaagacugaaugc

SEQ ID NO: 83445 - RNA, 22 nt, Human
gugucuuuauuccucuauguuu

SEQ ID NO: 83446 - RNA, 17 nt, Human
gugucuuugcuguugug

SEQ ID NO: 83447 - RNA, 22 nt, Human
gugugacuuuauuuggaaauag

SEQ ID NO: 83448 - RNA, 22 nt, Human
gugugagagacugaagaaagcc

SEQ ID NO: 83449 - RNA, 22 nt, Human
gugugagcagguuugaccuaag

SEQ ID NO: 83450 - RNA, 22 nt, Human
gugugagcaucaaagccuguca

SEQ ID NO: 83451 - RNA, 22 nt, Human
gugugagugaaaguaguuugau

SEQ ID NO: 83452 - RNA, 22 nt, Human
gugugcagcagagacaggacuc

SEQ ID NO: 83453 - RNA, 22 nt, Human
gugugcagggggccagcgcagc

SEQ ID NO: 83454 - RNA, 22 nt, Human
gugugcaggugucagugcagcu

SEQ ID NO: 83455 - RNA, 22 nt, Human
gugugccaccacugacaggauu

SEQ ID NO: 83456 - RNA, 22 nt, Human
gugugccagacaugaugcuaug

SEQ ID NO: 83457 - RNA, 22 nt, Human
guucagaguauuaauugauuua

SEQ ID NO: 83458 - RNA, 22 nt, Human
guucagcagcagugauuuugug

SEQ ID NO: 83459 - RNA, 22 nt, Human
guucagcuaggaauggagaugc

SEQ ID NO: 83460 - RNA, 22 nt, Human
guucaguauuaaugagaugauu

SEQ ID NO: 83461 - RNA, 22 nt, Human
guucagugauucucgguguuca

SEQ ID NO: 83462 - RNA, 22 nt, Human
guucaguguuuacaugauuguu

SEQ ID NO: 83463 - RNA, 22 nt, Human
guucaguguuugauuucugcug

SEQ ID NO: 83464 - RNA, 22 nt, Human
guucaguguuuuuauugacagg

SEQ ID NO: 83465 - RNA, 22 nt, Human
guucaguuauuucugaagauau

SEQ ID NO: 83466 - RNA, 22 nt, Human
guucaguuugacaaccuuuaua

SEQ ID NO: 83467 - RNA, 22 nt, Human
guucauaauuugaaggaauagg

SEQ ID NO: 83468 - RNA, 18 nt, Human
guucaucuuuuucuaaag

SEQ ID NO: 83469 - RNA, 21 nt, Human
guucaugucagcauuaaggga

SEQ ID NO: 83470 - RNA, 20 nt, Human
guucaugucucaaauagaaa

SEQ ID NO: 83471 - RNA, 22 nt, Human
guucauguggaaauuuaaaaca

SEQ ID NO: 83472 - RNA, 22 nt, Human
guucaugugguuuuuaaaggau

SEQ ID NO: 83473 - RNA, 22 nt, Human
guucauuguguguggucuucuu

SEQ ID NO: 83474 - RNA, 19 nt, Human
guuccaaaggccagaccuu

SEQ ID NO: 83475 - RNA, 22 nt, Human
guuccacaucacacuacuugau

SEQ ID NO: 83476 - RNA, 22 nt, Human
guuccacauuuguaaaaugagg

SEQ ID NO: 83477 - RNA, 22 nt, Human
guuccagacuugccaguggaag

SEQ ID NO: 83478 - RNA, 22 nt, Human
guuccaggcaguggcaacagcu

SEQ ID NO: 83479 - RNA, 22 nt, Human
guuccagggaagggaaggcaga

SEQ ID NO: 83480 - RNA, 22 nt, Human
guuccucacguggacagaugau

SEQ ID NO: 83481 - RNA, 22 nt, Human
guuccucauccagucaugacua

SEQ ID NO: 83482 - RNA, 22 nt, Human
guuccugaaagaugaguaauua

SEQ ID NO: 83483 - RNA, 22 nt, Human
guuccugugggguuaacccuga

SEQ ID NO: 83484 - RNA, 22 nt, Human
guuccuuagaguugauauggua

SEQ ID NO: 83485 - RNA, 22 nt, Human
guuccuuguaauuuguuaagga

SEQ ID NO: 83486 - RNA, 22 nt, Human
guucuaauaggagaaaagacag

SEQ ID NO: 83487 - RNA, 22 nt, Human
guucuauguugagauagcuaau

SEQ ID NO: 83488 - RNA, 22 nt, Human
guucuauuccccuuaucuguga

SEQ ID NO: 83489 - RNA, 22 nt, Human
guucuauucuccaguuacauau

SEQ ID NO: 83490 - RNA, 22 nt, Human
guucucaguggggagcaggguu

SEQ ID NO: 83491 - RNA, 22 nt, Human
guucucaguucaggaaggacau

SEQ ID NO: 83492 - RNA, 22 nt, Human
uaagaauauugggaauggaugg

SEQ ID NO: 83493 - RNA, 22 nt, Human
uaagaauuguguugaauagagu

SEQ ID NO: 83494 - RNA, 22 nt, Human
uaagacaaauacuauuucaaga

SEQ ID NO: 83495 - RNA, 22 nt, Human
uaagacaauucuucagucacaa

SEQ ID NO: 83496 - RNA, 22 nt, Human
uaagacacauucauaucugucu

SEQ ID NO: 83497 - RNA, 22 nt, Human
uaagacacauugagaaacacaa

SEQ ID NO: 83498 - RNA, 19 nt, Human
uaagacagauuccuagagu

SEQ ID NO: 83499 - RNA, 22 nt, Human
uaagacagggagggcucucagc

SEQ ID NO: 83500 - RNA, 21 nt, Human
uaagacaguaugaauacuuuc

SEQ ID NO: 83501 - RNA, 22 nt, Human
uaagacauccguugcuuauaau

SEQ ID NO: 83502 - RNA, 22 nt, Human
uaagacaugguugaucuagugu

SEQ ID NO: 83503 - RNA, 22 nt, Human
uaagacauguccaggcugugag

SEQ ID NO: 83504 - RNA, 22 nt, Human
uaagacauuugaaaugugaucc

SEQ ID NO: 83505 - RNA, 22 nt, Human
uaagacauuugacaaaccauuu

SEQ ID NO: 83506 - RNA, 22 nt, Human
uaagaccaaaguucuguaggga

SEQ ID NO: 83507 - RNA, 22 nt, Human
uaagagaacuggauagauagga

SEQ ID NO: 83508 - RNA, 22 nt, Human
uaagagaugcuuuucuaaauaa

SEQ ID NO: 83509 - RNA, 22 nt, Human
uaagagauucuaaagcuacugg

SEQ ID NO: 83510 - RNA, 22 nt, Human
uaagagcagaacagcaacauau

SEQ ID NO: 83511 - RNA, 22 nt, Human
uaagagcauaggcuugaaaaua

SEQ ID NO: 83512 - RNA, 22 nt, Human
uaagagcuaggauuuuaaauca

SEQ ID NO: 83513 - RNA, 21 nt, Human
uaagagcuauuauugcaaacc

SEQ ID NO: 83514 - RNA, 22 nt, Human
uaagagcugaggcauugggaca

SEQ ID NO: 83515 - RNA, 22 nt, Human
uaagagcuguucagguacccau

SEQ ID NO: 83516 - RNA, 22 nt, Human
uaagauaaggagagugcuagua

SEQ ID NO: 83517 - RNA, 22 nt, Human
uaagauaauccauuauaauguu

SEQ ID NO: 83518 - RNA, 22 nt, Human
uaagauaugguaggaaguuugg

SEQ ID NO: 83519 - RNA, 19 nt, Human
uaagauggcaagugucucu

SEQ ID NO: 83520 - RNA, 22 nt, Human
uaagaugucaaagggucacagu

SEQ ID NO: 83521 - RNA, 22 nt, Human
uaagauguggaaucacagcuuc

SEQ ID NO: 83522 - RNA, 22 nt, Human
uaagcaagggucucuguaucag

SEQ ID NO: 83523 - RNA, 22 nt, Human
uaagcaagugguagaaggacaa

SEQ ID NO: 83524 - RNA, 22 nt, Human
uaagcaaucuaaaagccuuacc

SEQ ID NO: 83525 - RNA, 22 nt, Human
uaagcagaaaaagugggaguua

SEQ ID NO: 83526 - RNA, 22 nt, Human
uaagcagaugcugucugcacaa

SEQ ID NO: 83527 - RNA, 20 nt, Human
uaagcauaguugucaggguc

SEQ ID NO: 83528 - RNA, 22 nt, Human
uaagcauggugguaaaagaggu

SEQ ID NO: 83529 - RNA, 22 nt, Human
uaagcauucaaugcuuagcacu

SEQ ID NO: 83530 - RNA, 22 nt, Human
uaagcccacauuuuucugaaga

SEQ ID NO: 83531 - RNA, 22 nt, Human
uaagccugcaugaaccaugaga

SEQ ID NO: 83532 - RNA, 22 nt, Human
uaagcuauuccugaagaagguu

SEQ ID NO: 83533 - RNA, 22 nt, Human
uaagcuucaaagaacauauugg

SEQ ID NO: 83534 - RNA, 22 nt, Human
uaaggaaaauggacaucaaaca

SEQ ID NO: 83535 - RNA, 22 nt, Human
uaaggaaacaacuuguauuuuu

SEQ ID NO: 83536 - RNA, 22 nt, Human
uaaggaaagugccaugauuucu

SEQ ID NO: 83537 - RNA, 22 nt, Human
uaaggaauagugcuaugaaaaa

SEQ ID NO: 83538 - RNA, 22 nt, Human
uaaggaauaucauaagaaguag

SEQ ID NO: 83539 - RNA, 22 nt, Human
uaaggacaauuugucgcuugca

SEQ ID NO: 83540 - RNA, 22 nt, Human
uaaggacauugguuuugaguaa

SEQ ID NO: 83541 - RNA, 22 nt, Human
uaaggaggcgagguggugagca

SEQ ID NO: 83542 - RNA, 22 nt, Human
uaaggcaaguuuuuaguggaca

SEQ ID NO: 83543 - RNA, 22 nt, Human
uaaggcagauguggaaucaauu

SEQ ID NO: 83544 - RNA, 19 nt, Human
uaaggcagcagugacaggc

SEQ ID NO: 83545 - RNA, 22 nt, Human
uaaggcagccgcucagagaggu

SEQ ID NO: 83546 - RNA, 22 nt, Human
uaaggcagugaaacuauucugu

SEQ ID NO: 83547 - RNA, 22 nt, Human
uaaggcauaaggaagauuugga

SEQ ID NO: 83548 - RNA, 22 nt, Human
uaaggcauaaggccagaggcua

SEQ ID NO: 83549 - RNA, 19 nt, Human
uaaggccaaaaguaagugu

SEQ ID NO: 83550 - RNA, 22 nt, Human
uaaggccaaggggccauagucu

SEQ ID NO: 83551 - RNA, 22 nt, Human
uaaggccauuauggugggcccg

SEQ ID NO: 83552 - RNA, 22 nt, Human
uaaggccuugaaaggauguccu

SEQ ID NO: 83553 - RNA, 22 nt, Human
uaaggcuacugucagcuucagg

SEQ ID NO: 83554 - RNA, 22 nt, Human
uaaggcuaucugaguuuaugug

SEQ ID NO: 83555 - RNA, 22 nt, Human
uaaggcuaucuuuugagugugu

SEQ ID NO: 83556 - RNA, 22 nt, Human
uaaggcucccuuugccacuugu

SEQ ID NO: 83557 - RNA, 22 nt, Human
uaaggcuucagcauucaaaaca

SEQ ID NO: 83558 - RNA, 22 nt, Human
uaaggcuuuccuugucaucuuu

SEQ ID NO: 83559 - RNA, 22 nt, Human
uaaggcuuucuaaauaugcaga

SEQ ID NO: 83560 - RNA, 22 nt, Human
uaagggaacagcuucaaacuca

SEQ ID NO: 83561 - RNA, 22 nt, Human
uaagggcugacuuggaacuguc

SEQ ID NO: 83562 - RNA, 22 nt, Human
uaaggugagcuguauaacaggg

SEQ ID NO: 83563 - RNA, 18 nt, Human
uaaguaaggucauauggg

SEQ ID NO: 83564 - RNA, 22 nt, Human
uaaguagacuguugaacuuggu

SEQ ID NO: 83565 - RNA, 22 nt, Human
uaaguaguagggccagaauuug

SEQ ID NO: 83566 - RNA, 22 nt, Human
uacaaagauaaaaucucaccau

SEQ ID NO: 83567 - RNA, 22 nt, Human
uacaaagcuuguacugugugac

SEQ ID NO: 83568 - RNA, 22 nt, Human
uacaaaggagauaaauuggagg

SEQ ID NO: 83569 - RNA, 19 nt, Human
uacaaaggaggauguaaaa

SEQ ID NO: 83570 - RNA, 22 nt, Human
uacaaaggaggugcauagaaca

SEQ ID NO: 83571 - RNA, 22 nt, Human
uacaaaguagaaauucaguaaa

SEQ ID NO: 83572 - RNA, 22 nt, Human
uacaaaguauauuucuagcugu

SEQ ID NO: 83573 - RNA, 22 nt, Human
uacaaagucacauugaaaugaa

SEQ ID NO: 83574 - RNA, 22 nt, Human
uacaaagucuuggguucuaggc

SEQ ID NO: 83575 - RNA, 22 nt, Human
uacaaagugacaagcucugcug

SEQ ID NO: 83576 - RNA, 22 nt, Human
uacaaagugagcaaccucuuuu

SEQ ID NO: 83577 - RNA, 22 nt, Human
uacaaagugggaaacgaagguu

SEQ ID NO: 83578 - RNA, 22 nt, Human
uacaaaucagaucaugaguuua

SEQ ID NO: 83579 - RNA, 22 nt, Human
uacaaaugaaccaacuuugaug

SEQ ID NO: 83580 - RNA, 22 nt, Human
uacaacaguucaugaaaugaaa

SEQ ID NO: 83581 - RNA, 22 nt, Human
uacaacauaacgggcauucagu

SEQ ID NO: 83582 - RNA, 22 nt, Human
uacaacauguaaagugguuuaa

SEQ ID NO: 83583 - RNA, 22 nt, Human
uacaacgugggacuuuguuucu

SEQ ID NO: 83584 - RNA, 22 nt, Human
uacaacuuccagcuuucagccc

SEQ ID NO: 83585 - RNA, 22 nt, Human
uacaagaaaguccaguggguuu

SEQ ID NO: 83586 - RNA, 22 nt, Human
uacaagagaacuaauguaaguc

SEQ ID NO: 83587 - RNA, 22 nt, Human
uacaagagcaguaagcuugucc

SEQ ID NO: 83588 - RNA, 22 nt, Human
uacaagagguauauagaaacag

SEQ ID NO: 83589 - RNA, 22 nt, Human
uacaagcucacaaauuuuuaag

SEQ ID NO: 83590 - RNA, 19 nt, Human
uacaagcuuuuuuggcagg

SEQ ID NO: 83591 - RNA, 22 nt, Human
uacaaggcaaauccaugauguc

SEQ ID NO: 83592 - RNA, 23 nt, Human
uacaagguagcauuaguuucuuc

SEQ ID NO: 83593 - RNA, 22 nt, Human
uacaaguaaauuguagauacca

SEQ ID NO: 83594 - RNA, 19 nt, Human
uacaaguaggcguuuucuc

SEQ ID NO: 83595 - RNA, 22 nt, Human
uacaaguauggaaugauucuca

SEQ ID NO: 83596 - RNA, 22 nt, Human
uacaagucauuggaugaggaau

SEQ ID NO: 83597 - RNA, 22 nt, Human
uacaaguguaagcuugugagac

SEQ ID NO: 83598 - RNA, 22 nt, Human
uacaauacuuaaccuauuuugc

SEQ ID NO: 83599 - RNA, 22 nt, Human
uacaaugacucucaguuuggcu

SEQ ID NO: 83600 - RNA, 22 nt, Human
uacaaugcauucguugucucgg

SEQ ID NO: 83601 - RNA, 22 nt, Human
uacaauguaauucugauuaugu

SEQ ID NO: 83602 - RNA, 22 nt, Human
uacaaugugugcuucuugucac

SEQ ID NO: 83603 - RNA, 22 nt, Human
uacaauguucauagcuuuggca

SEQ ID NO: 83604 - RNA, 22 nt, Human
uacacaacugacaaccauucug

SEQ ID NO: 83605 - RNA, 22 nt, Human
uacacaaucuguuuuuccauuu

SEQ ID NO: 83606 - RNA, 22 nt, Human
uacacaaugacuuaagauguca

SEQ ID NO: 83607 - RNA, 22 nt, Human
uacacaauucuggaugcauguc

SEQ ID NO: 83608 - RNA, 22 nt, Human
uacacacagaggccaugggauu

SEQ ID NO: 83609 - RNA, 22 nt, Human
ucuuauaauguugaaggguugg

SEQ ID NO: 83610 - RNA, 22 nt, Human
ucuuauaccccuaaacugcagc

SEQ ID NO: 83611 - RNA, 22 nt, Human
ucuuauaugcacauacauuggg

SEQ ID NO: 83612 - RNA, 22 nt, Human
ucuuaucuuauaccuaacagcc

SEQ ID NO: 83613 - RNA, 22 nt, Human
ucuuaugucaagaaugaauauu

SEQ ID NO: 83614 - RNA, 22 nt, Human
ucuuaugugcugugagauuuuu

SEQ ID NO: 83615 - RNA, 22 nt, Human
ucuuauugguaaugauggcauu

SEQ ID NO: 83616 - RNA, 22 nt, Human
ucuuauuuuuuaaugacagaga

SEQ ID NO: 83617 - RNA, 22 nt, Human
ucuucaaagcauaugcaggcau

SEQ ID NO: 83618 - RNA, 22 nt, Human
ucuucaaaugcuaguaauauca

SEQ ID NO: 83619 - RNA, 22 nt, Human
ucuucacaguccuggucagugg

SEQ ID NO: 83620 - RNA, 22 nt, Human
ucuucacauggagaagcaacuc

SEQ ID NO: 83621 - RNA, 22 nt, Human
ucuucacauucacguaacauag

SEQ ID NO: 83622 - RNA, 22 nt, Human
ucuucagaaaauuaucacuugu

SEQ ID NO: 83623 - RNA, 22 nt, Human
ucuucagagcauuucugaggua

SEQ ID NO: 83624 - RNA, 22 nt, Human
ucuucagauaaagggagaguau

SEQ ID NO: 83625 - RNA, 22 nt, Human
ucuucagauggccaguuguccc

SEQ ID NO: 83626 - RNA, 22 nt, Human
ucuucagggucugccccagggg

SEQ ID NO: 83627 - RNA, 21 nt, Human
ucuucaguacacuugcacgcc

SEQ ID NO: 83628 - RNA, 22 nt, Human
ucuucagugcaugcccucaggc

SEQ ID NO: 83629 - RNA, 22 nt, Human
ucuucauacucaucacauaggu

SEQ ID NO: 83630 - RNA, 22 nt, Human
ucuucauggucugguucuccag

SEQ ID NO: 83631 - RNA, 22 nt, Human
ucuucaugucaugguauauuga

SEQ ID NO: 83632 - RNA, 22 nt, Human
ucuucaugucucugcuugaguc

SEQ ID NO: 83633 - RNA, 22 nt, Human
ucuucauucucgccuuugucgu

SEQ ID NO: 83634 - RNA, 22 nt, Human
ucuucauuuugaagaggcagaa

SEQ ID NO: 83635 - RNA, 22 nt, Human
ucuuccaaaugcagcuaaagcu

SEQ ID NO: 83636 - RNA, 21 nt, Human
ucuuccaagggcugcugagac

SEQ ID NO: 83637 - RNA, 22 nt, Human
ucuuccagagccuccaucccua

SEQ ID NO: 83638 - RNA, 19 nt, Human
ucuuccagcaucugggggc

SEQ ID NO: 83639 - RNA, 20 nt, Human
ucuuccagguacagucugca

SEQ ID NO: 83640 - RNA, 22 nt, Human
ucuuccagugcuguguagagcu

SEQ ID NO: 83641 - RNA, 22 nt, Human
ucuucccagcugcugcgaugcc

SEQ ID NO: 83642 - RNA, 22 nt, Human
ucuucccauuaguaaugaagug

SEQ ID NO: 83643 - RNA, 22 nt, Human
ucuucccucuucugccaaauac

SEQ ID NO: 83644 - RNA, 19 nt, Human
ucuucccuggcugucaguc

SEQ ID NO: 83645 - RNA, 22 nt, Human
ucuuccuaguuacauaugcaca

SEQ ID NO: 83646 - RNA, 22 nt, Human
ucuuccuauggggcugcaggaa

SEQ ID NO: 83647 - RNA, 22 nt, Human
ucuuccucucuaauugaucaga

SEQ ID NO: 83648 - RNA, 22 nt, Human
ucuuccucuucugcugagaagu

SEQ ID NO: 83649 - RNA, 21 nt, Human
ucuuccugacauaugcaaggc

SEQ ID NO: 83650 - RNA, 21 nt, Human
ucuuccugcuccacacucccc

SEQ ID NO: 83651 - RNA, 22 nt, Human
ucuuccugcuuuggugaggcuu

SEQ ID NO: 83652 - RNA, 16 nt, Human
ucuuccuuuugauuuu

SEQ ID NO: 83653 - RNA, 17 nt, Human
ucuucgggcgcuaggua

SEQ ID NO: 83654 - RNA, 22 nt, Human
ucuucuccaguucauccuacca

SEQ ID NO: 83655 - RNA, 22 nt, Human
ucuucucuccugcuuggcagaa

SEQ ID NO: 83656 - RNA, 19 nt, Human
ucuucugacuucaagaaac

SEQ ID NO: 83657 - RNA, 22 nt, Human
ucuucugagacuucucuuuggu

SEQ ID NO: 83658 - RNA, 22 nt, Human
ucuucugaugccaguaaccaug

SEQ ID NO: 83659 - RNA, 22 nt, Human
ucuucuggaucgaucacauugu

SEQ ID NO: 83660 - RNA, 22 nt, Human
ucuucuggaugagagcggaggc

SEQ ID NO: 83661 - RNA, 22 nt, Human
ucuucuuaugugccauuaucuc

SEQ ID NO: 83662 - RNA, 23 nt, Human
ucuugaaaagccuacagcaguuc

SEQ ID NO: 83663 - RNA, 22 nt, Human
ucuugaaaguaucuuauuuugu

SEQ ID NO: 83664 - RNA, 22 nt, Human
ucuugaaggggggcaguguuga

SEQ ID NO: 83665 - RNA, 22 nt, Human
ucuugaauaaguuucaugagcu

SEQ ID NO: 83666 - RNA, 22 nt, Human
ucuugacauugcaaucuucaga

SEQ ID NO: 83667 - RNA, 22 nt, Human
ucuugacauuguuguuagcagg

SEQ ID NO: 83668 - RNA, 19 nt, Human
ucuugaggaaaguaaggca

SEQ ID NO: 83669 - RNA, 19 nt, Human
ucuugaugagguuucucca

SEQ ID NO: 83670 - RNA, 22 nt, Human
ucuugaugcuuuuucuaaaugu

SEQ ID NO: 83671 - RNA, 21 nt, Human
ucuugauuauuggccucacac

SEQ ID NO: 83672 - RNA, 22 nt, Human
ucuugauuuacucuaauagcuu

SEQ ID NO: 83673 - RNA, 22 nt, Human
ucuugauuuguaaaagaaggau

SEQ ID NO: 83674 - RNA, 22 nt, Human
ucuugauuuuguuaaaauuaga

SEQ ID NO: 83675 - RNA, 22 nt, Human
uaacacuuuggauuaaaauucu

SEQ ID NO: 83676 - RNA, 22 nt, Human
uaacagaaaggggacagaaaua

SEQ ID NO: 83677 - RNA, 22 nt, Human
uaacagaauagcagaaacagaa

SEQ ID NO: 83678 - RNA, 22 nt, Human
uaacagaauccuguuauugcca

SEQ ID NO: 83679 - RNA, 22 nt, Human
uaacagagauagaaauguaaag

SEQ ID NO: 83680 - RNA, 22 nt, Human
uaacagaguaacagguauguaa

SEQ ID NO: 83681 - RNA, 22 nt, Human
uaacagcaggguuacaggcauu

SEQ ID NO: 83682 - RNA, 22 nt, Human
uaacagcaguccucuucucaug

SEQ ID NO: 83683 - RNA, 22 nt, Human
uaacagcuggcguuauaggaau

SEQ ID NO: 83684 - RNA, 22 nt, Human
uaacaggguaggagggcaugaa

SEQ ID NO: 83685 - RNA, 22 nt, Human
uaacaguacauccuuuucucuu

SEQ ID NO: 83686 - RNA, 22 nt, Human
uaacaguagccuuauguggucu

SEQ ID NO: 83687 - RNA, 22 nt, Human
uaacaguauauuuaccaaaccu

SEQ ID NO: 83688 - RNA, 22 nt, Human
uaacagugugaggucucaggcg

SEQ ID NO: 83689 - RNA, 22 nt, Human
uaacaguguguccagucaguuu

SEQ ID NO: 83690 - RNA, 22 nt, Human
uaacaucaaacauguuuuaaag

SEQ ID NO: 83691 - RNA, 22 nt, Human
uaacauccuacacuguugucuu

SEQ ID NO: 83692 - RNA, 22 nt, Human
uaacaucugggcugcguccuga

SEQ ID NO: 83693 - RNA, 22 nt, Human
uaacaugauuugcuauuuagau

SEQ ID NO: 83694 - RNA, 22 nt, Human
uaacauguguauugguuuccua

SEQ ID NO: 83695 - RNA, 22 nt, Human
uaacauguucagacuaccugug

SEQ ID NO: 83696 - RNA, 22 nt, Human
uaacauuacagacaccuugugu

SEQ ID NO: 83697 - RNA, 22 nt, Human
uaacauuagguagacauaagcc

SEQ ID NO: 83698 - RNA, 22 nt, Human
uaacauucccuuugugccaagg

SEQ ID NO: 83699 - RNA, 22 nt, Human
uaacauuucggugacaguggga

SEQ ID NO: 83700 - RNA, 22 nt, Human
uaacauuugcugucuccuaugu

SEQ ID NO: 83701 - RNA, 22 nt, Human
uaaccagcaugaaaucugcagc

SEQ ID NO: 83702 - RNA, 22 nt, Human
uaaccaugcaugucucuaguuu

SEQ ID NO: 83703 - RNA, 22 nt, Human
uaaccugacugcucuuuagaau

SEQ ID NO: 83704 - RNA, 22 nt, Human
uaaccugcugugcuggucaguc

SEQ ID NO: 83705 - RNA, 22 nt, Human
uaaccuggaugugccaacguga

SEQ ID NO: 83706 - RNA, 22 nt, Human
uaaccuggggccugaagaccau

SEQ ID NO: 83707 - RNA, 22 nt, Human
uaaccuuucaggcauguagguu

SEQ ID NO: 83708 - RNA, 22 nt, Human
uaacguuugauaacuucuguuc

SEQ ID NO: 83709 - RNA, 22 nt, Human
uaacuaagugacucaagugauc

SEQ ID NO: 83710 - RNA, 22 nt, Human
uaacuacauuucacugcaauua

SEQ ID NO: 83711 - RNA, 22 nt, Human
uaacucacuccaaaaaggcauu

SEQ ID NO: 83712 - RNA, 22 nt, Human
uaacucugcuuguucucugagu

SEQ ID NO: 83713 - RNA, 23 nt, Human
uaacucugugaagggugacuggg

SEQ ID NO: 83714 - RNA, 22 nt, Human
uaacugaaaaucccucuucucc

SEQ ID NO: 83715 - RNA, 22 nt, Human
uaacugaacagccuaauucuuu

SEQ ID NO: 83716 - RNA, 22 nt, Human
uaacugaacaucucaaaucaag

SEQ ID NO: 83717 - RNA, 22 nt, Human
uaacugaagcuggaagcgcugg

SEQ ID NO: 83718 - RNA, 22 nt, Human
uaacugaauguauuacaacaga

SEQ ID NO: 83719 - RNA, 22 nt, Human
uaacugauguucccuuacugua

SEQ ID NO: 83720 - RNA, 22 nt, Human
uaacugguagauuuuaaaucgg

SEQ ID NO: 83721 - RNA, 22 nt, Human
uaacuggugaguugguugagug

SEQ ID NO: 83722 - RNA, 19 nt, Human
uaacugguuaaaaagcuug

SEQ ID NO: 83723 - RNA, 18 nt, Human
uaacugguuucuucccau

SEQ ID NO: 83724 - RNA, 22 nt, Human
uaacuguacaacugguuaguca

SEQ ID NO: 83725 - RNA, 22 nt, Human
uaacuguauauuaagguggccc

SEQ ID NO: 83726 - RNA, 22 nt, Human
uaacugugaaguaauuguggau

SEQ ID NO: 83727 - RNA, 22 nt, Human
uaacugugugaacgugaucauu

SEQ ID NO: 83728 - RNA, 22 nt, Human
uaacuguugugcgggucucugg

SEQ ID NO: 83729 - RNA, 22 nt, Human
uaacuucaaaauugccacaugu

SEQ ID NO: 83730 - RNA, 22 nt, Human
uaacuucacuggacucagcagc

SEQ ID NO: 83731 - RNA, 22 nt, Human
uaacuucuuugguuuaaagaga

SEQ ID NO: 83732 - RNA, 22 nt, Human
uaacuugaacauggagaguaag

SEQ ID NO: 83733 - RNA, 22 nt, Human
uaacuuuaugacaugucuugcu

SEQ ID NO: 83734 - RNA, 20 nt, Human
uaacuuucuaugcuuucagc

SEQ ID NO: 83735 - RNA, 22 nt, Human
uaacuuuuacuuaccaucugag

SEQ ID NO: 83736 - RNA, 22 nt, Human
uaacuuuucuaggugugauaau

SEQ ID NO: 83737 - RNA, 22 nt, Human
uaagaaacuauggagaagaacu

SEQ ID NO: 83738 - RNA, 22 nt, Human
uaagaaacuuaacugggaacua

SEQ ID NO: 83739 - RNA, 20 nt, Human
uaagaacaagacuaggaagc

SEQ ID NO: 83740 - RNA, 22 nt, Human
uaagaacagauaaaguuucccc

SEQ ID NO: 83741 - RNA, 22 nt, Human
uaagaacagugucugucucaca

SEQ ID NO: 83742 - RNA, 22 nt, Human
uaagaacaguguuucaucucua

SEQ ID NO: 83743 - RNA, 22 nt, Human
uagcacacgcauuagcaaauca

SEQ ID NO: 83744 - RNA, 22 nt, Human
uagcacagagcuuuuaaacuuc

SEQ ID NO: 83745 - RNA, 22 nt, Human
uagcacagggcauaugcggugg

SEQ ID NO: 83746 - RNA, 22 nt, Human
uagcacccauggaaucugcugg

SEQ ID NO: 83747 - RNA, 22 nt, Human
uagcaccugugcacaccaggca

SEQ ID NO: 83748 - RNA, 22 nt, Human
uagcacuaucuugggauuugga

SEQ ID NO: 83749 - RNA, 22 nt, Human
uagcacugagucuagcuuugga

SEQ ID NO: 83750 - RNA, 21 nt, Human
uagcacuucgcuguaauuggg

SEQ ID NO: 83751 - RNA, 21 nt, Human
uagcagaaacaguucaggcca

SEQ ID NO: 83752 - RNA, 22 nt, Human
uagcagaaccagcagucaauuu

SEQ ID NO: 83753 - RNA, 22 nt, Human
uagcagaaccagucagugagcc

SEQ ID NO: 83754 - RNA, 21 nt, Human
uagcagagaguuaacuucucc

SEQ ID NO: 83755 - RNA, 21 nt, Human
uagcagagaucauuuucuccu

SEQ ID NO: 83756 - RNA, 22 nt, Human
uagcagaggaaauccagaguaa

SEQ ID NO: 83757 - RNA, 22 nt, Human
uagcagaggcaaggaugugaau

SEQ ID NO: 83758 - RNA, 22 nt, Human
uagcagaggcuacugcuccuug

SEQ ID NO: 83759 - RNA, 22 nt, Human
uagcagagugauuggccaugag

SEQ ID NO: 83760 - RNA, 22 nt, Human
uagcagaguuugguaccugggg

SEQ ID NO: 83761 - RNA, 22 nt, Human
uagcagcacaaauggacuauga

SEQ ID NO: 83762 - RNA, 22 nt, Human
uagcagcaccuuucuaaucuga

SEQ ID NO: 83763 - RNA, 20 nt, Human
uagcagcagaaagaacuuag

SEQ ID NO: 83764 - RNA, 17 nt, Human
uagcagcaguaauugug

SEQ ID NO: 83765 - RNA, 22 nt, Human
uagcagcauuaauuccauuugc

SEQ ID NO: 83766 - RNA, 22 nt, Human
uagcagcuaugccauuuugaca

SEQ ID NO: 83767 - RNA, 22 nt, Human
uagcagcugcaucauuuuacag

SEQ ID NO: 83768 - RNA, 22 nt, Human
uagcagcuggggcuauucauca

SEQ ID NO: 83769 - RNA, 22 nt, Human
uagcagcugucaguuucacaua

SEQ ID NO: 83770 - RNA, 22 nt, Human
uagcagcuuccagagagggcag

SEQ ID NO: 83771 - RNA, 22 nt, Human
uagcaggaauaugagguuaaua

SEQ ID NO: 83772 - RNA, 21 nt, Human
uagcaggaggccccugcuugc

SEQ ID NO: 83773 - RNA, 22 nt, Human
uagcaggcaucucagagauaau

SEQ ID NO: 83774 - RNA, 22 nt, Human
uagcagggaagaugaucagaau

SEQ ID NO: 83775 - RNA, 22 nt, Human
uagcagggagggccagugucaa

SEQ ID NO: 83776 - RNA, 22 nt, Human
uagcagggauacaaggucgccu

SEQ ID NO: 83777 - RNA, 18 nt, Human
uagcagggcuuguccuuu

SEQ ID NO: 83778 - RNA, 22 nt, Human
uagcaggugcucauuuaacucc

SEQ ID NO: 83779 - RNA, 22 nt, Human
uagcaguacugggcauguguuu

SEQ ID NO: 83780 - RNA, 22 nt, Human
uagcaguauuccggaauacuuu

SEQ ID NO: 83781 - RNA, 22 nt, Human
uagcagugccaggauuuugcug

SEQ ID NO: 83782 - RNA, 22 nt, Human
uagcaguuaaucugagccaaga

SEQ ID NO: 83783 - RNA, 22 nt, Human
uagcauauggaggguaagaggg

SEQ ID NO: 83784 - RNA, 22 nt, Human
ugagacgaagucuugcucuguu

SEQ ID NO: 83785 - RNA, 22 nt, Human
ugagacuuaagaggucauguug

SEQ ID NO: 83786 - RNA, 22 nt, Human
ugagacuuccugaugaggcccg

SEQ ID NO: 83787 - RNA, 22 nt, Human
ugagagacacacugugcaugua

SEQ ID NO: 83788 - RNA, 22 nt, Human
ugagagaguaauugagugguaa

SEQ ID NO: 83789 - RNA, 22 nt, Human
ugagagauuuucaugagugcuu

SEQ ID NO: 83790 - RNA, 17 nt, Human
ugagagcagggcugggc

SEQ ID NO: 83791 - RNA, 23 nt, Human
ugagagccuggcagccuggguuc

SEQ ID NO: 83792 - RNA, 22 nt, Human
ugagagcugaagauauguuaac

SEQ ID NO: 83793 - RNA, 22 nt, Human
ugagagcuguccaccuguggga

SEQ ID NO: 83794 - RNA, 22 nt, Human
ugagagcuugaguaucacuggc

SEQ ID NO: 83795 - RNA, 18 nt, Human
ugagaggcagguagagga

SEQ ID NO: 83796 - RNA, 19 nt, Human
ugagaggcuuaaggcagcu

SEQ ID NO: 83797 - RNA, 22 nt, Human
ugagaggugaggcaugaggcau

SEQ ID NO: 83798 - RNA, 22 nt, Human
ugagaguagagucuucaucugu

SEQ ID NO: 83799 - RNA, 22 nt, Human
ugagauaacucugauuuauguu

SEQ ID NO: 83800 - RNA, 22 nt, Human
ugagauaauacuucuuagcugg

SEQ ID NO: 83801 - RNA, 22 nt, Human
ugagaucacuuacguggcugca

SEQ ID NO: 83802 - RNA, 22 nt, Human
ugagaucauauguacaaggucu

SEQ ID NO: 83803 - RNA, 22 nt, Human
ugagaucauugacuuguuccug

SEQ ID NO: 83804 - RNA, 22 nt, Human
ugagaucauuuauuuaccuuuc

SEQ ID NO: 83805 - RNA, 23 nt, Human
ugagaucgcccagcugguaggca

SEQ ID NO: 83806 - RNA, 23 nt, Human
ugagaucuuuguaguaucaauga

SEQ ID NO: 83807 - RNA, 22 nt, Human
ugagaugaaagcagaaagacuu

SEQ ID NO: 83808 - RNA, 19 nt, Human
ugagaugccuuccagcccu

SEQ ID NO: 83809 - RNA, 17 nt, Human
ugagauggaagaagacu

SEQ ID NO: 83810 - RNA, 22 nt, Human
ugagauggcugggccccaggag

SEQ ID NO: 83811 - RNA, 22 nt, Human
ugagauggguggguagccaagg

SEQ ID NO: 83812 - RNA, 22 nt, Human
ugagaugguugaccagagagca

SEQ ID NO: 83813 - RNA, 22 nt, Human
ugagauucuguucagaaaaaug

SEQ ID NO: 83814 - RNA, 22 nt, Human
ugagauuuggaaaauuugauau

SEQ ID NO: 83815 - RNA, 20 nt, Human
ugagauuuguauuauaaguc

SEQ ID NO: 83816 - RNA, 22 nt, Human
ugagcaaaaguugauggugcuu

SEQ ID NO: 83817 - RNA, 22 nt, Human
ugagcaauaugugaauuuucuu

SEQ ID NO: 83818 - RNA, 20 nt, Human
ugagcaccaagaaucaagaa

SEQ ID NO: 83819 - RNA, 22 nt, Human
ugagcaccaggcaccacagcuc

SEQ ID NO: 83820 - RNA, 22 nt, Human
ugagcaccucccugacaguggg

SEQ ID NO: 83821 - RNA, 22 nt, Human
ugagcagaaaagaaugcugagc

SEQ ID NO: 83822 - RNA, 22 nt, Human
ugagcagaggagugacguaggu

SEQ ID NO: 83823 - RNA, 22 nt, Human
ugagcagauuuguucuaggggu

SEQ ID NO: 83824 - RNA, 22 nt, Human
ugagcagcaacuguccauggca

SEQ ID NO: 83825 - RNA, 22 nt, Human
ugagcaggacucacugcagccu

SEQ ID NO: 83826 - RNA, 22 nt, Human
ugagcaggagauaaacagguag

SEQ ID NO: 83827 - RNA, 22 nt, Human
ugagcagggacuuugaguguag

SEQ ID NO: 83828 - RNA, 22 nt, Human
ugagcagggacuuuggagucug

SEQ ID NO: 83829 - RNA, 22 nt, Human
ugagcagggagcugggcugagc

SEQ ID NO: 83830 - RNA, 22 nt, Human
ugagcaggucaggaaguacauu

SEQ ID NO: 83831 - RNA, 22 nt, Human
ugagcaguggcaccaggucacc

SEQ ID NO: 83832 - RNA, 22 nt, Human
ugagcaguucgacuucuucccc

SEQ ID NO: 83833 - RNA, 22 nt, Human
ugagcaucuucgugaaagcuuc

SEQ ID NO: 83834 - RNA, 20 nt, Human
ugagccaaacgaugaagagc

SEQ ID NO: 83835 - RNA, 22 nt, Human
ugagccaaggccucaagaauuu

SEQ ID NO: 83836 - RNA, 22 nt, Human
ugagccaaguucacaccauugc

SEQ ID NO: 83837 - RNA, 22 nt, Human
ugagccaaugauuugaauagag

SEQ ID NO: 83838 - RNA, 21 nt, Human
ugagccaggcugacggcugug

SEQ ID NO: 83839 - RNA, 19 nt, Human
ugagccagggaggccaugc

SEQ ID NO: 83840 - RNA, 20 nt, Human
ugagccagucaagcuacauu

SEQ ID NO: 83841 - RNA, 22 nt, Human
ugagccagugugguaaagcuga

SEQ ID NO: 83842 - RNA, 22 nt, Human
ugagcccagaagcccacucggc

SEQ ID NO: 83843 - RNA, 22 nt, Human
ugagcccagagaucugagcuau

SEQ ID NO: 83844 - RNA, 22 nt, Human
ugagcccagagcccuuguaggg

SEQ ID NO: 83845 - RNA, 23 nt, Human
ugagcccaggaggucaaggcugc

SEQ ID NO: 83846 - RNA, 22 nt, Human
ugagccccaggaaauugaggag

SEQ ID NO: 83847 - RNA, 22 nt, Human
ugagcccuaauuuacaacaucu

SEQ ID NO: 83848 - RNA, 22 nt, Human
ugagcccucggcuggggcagag

SEQ ID NO: 83849 - RNA, 22 nt, Human
ugagcccugaggaucuguucgg

SEQ ID NO: 83850 - RNA, 22 nt, Human
ugagcccuugacaucgcccacu

SEQ ID NO: 83851 - RNA, 18 nt, Human
ugagccgguagauggggu

SEQ ID NO: 83852 - RNA, 22 nt, Human
ugagccugcaauaagcacagcc

SEQ ID NO: 83853 - RNA, 22 nt, Human
ugagccugccugcaggugugcu

SEQ ID NO: 83854 - RNA, 22 nt, Human
ugagccugcugucgcuggaccc

SEQ ID NO: 83855 - RNA, 22 nt, Human
ugagccuggagcccagauguuu

SEQ ID NO: 83856 - RNA, 22 nt, Human
ugagccuggagucguggagggg

SEQ ID NO: 83857 - RNA, 22 nt, Human
ugagccuggcggaagcagcgug

SEQ ID NO: 83858 - RNA, 22 nt, Human
ugagcuaggugugcagauauga

SEQ ID NO: 83859 - RNA, 22 nt, Human
uaaagucaagguacuguuucac

SEQ ID NO: 83860 - RNA, 22 nt, Human
uaaagucagauaucuggguuga

SEQ ID NO: 83861 - RNA, 22 nt, Human
uaaagucauaagaguggauccg

SEQ ID NO: 83862 - RNA, 22 nt, Human
uaaagugcagauugugauucag

SEQ ID NO: 83863 - RNA, 22 nt, Human
uaaagugcaggcuacucagaag

SEQ ID NO: 83864 - RNA, 22 nt, Human
uaaagugcaugcggggccagau

SEQ ID NO: 83865 - RNA, 23 nt, Human
uaaagugcugauggugagggagc

SEQ ID NO: 83866 - RNA, 22 nt, Human
uaaagugcugggauuauaggcc

SEQ ID NO: 83867 - RNA, 22 nt, Human
uaaagugcuuccuaacccagag

SEQ ID NO: 83868 - RNA, 22 nt, Human
uaaaguguguauauacauaugg

SEQ ID NO: 83869 - RNA, 22 nt, Human
uaaaguucuggugagagguaag

SEQ ID NO: 83870 - RNA, 22 nt, Human
uaaaguucuuagaacaaggccu

SEQ ID NO: 83871 - RNA, 22 nt, Human
uaaauaagucacugaccauuua

SEQ ID NO: 83872 - RNA, 22 nt, Human
uaaauaaguucuucauuguuug

SEQ ID NO: 83873 - RNA, 22 nt, Human
uaaauacuuaguuuugugucua

SEQ ID NO: 83874 - RNA, 22 nt, Human
uaaauacuuuuacuccacugau

SEQ ID NO: 83875 - RNA, 22 nt, Human
uaaauagaaucuaaacugcuca

SEQ ID NO: 83876 - RNA, 22 nt, Human
uaaauagagaaucagcuuggag

SEQ ID NO: 83877 - RNA, 22 nt, Human
uaaauagggaauagaagaggaa

SEQ ID NO: 83878 - RNA, 22 nt, Human
uaaauaucaccuggaauuguua

SEQ ID NO: 83879 - RNA, 22 nt, Human
uaaaucacuguucauuccacac

SEQ ID NO: 83880 - RNA, 22 nt, Human
uaaaucaguaaggcauauucuc

SEQ ID NO: 83881 - RNA, 22 nt, Human
uaaaucaguagauaugguauag

SEQ ID NO: 83882 - RNA, 22 nt, Human
uaaaucucacuggguauauugg

SEQ ID NO: 83883 - RNA, 19 nt, Human
uaaaucuguauucuucaaa

SEQ ID NO: 83884 - RNA, 22 nt, Human
uaaaucuuguggcaaugcuucu

SEQ ID NO: 83885 - RNA, 22 nt, Human
uaaaugacaacaccugcuuuug

SEQ ID NO: 83886 - RNA, 22 nt, Human
uaaaugacccaugcugaccuca

SEQ ID NO: 83887 - RNA, 22 nt, Human
uaaaugagauuuguucuuuugu

SEQ ID NO: 83888 - RNA, 22 nt, Human
uaaaugagggcugacaugauug

SEQ ID NO: 83889 - RNA, 22 nt, Human
uaaaugcuaucgcauaaaaccu

SEQ ID NO: 83890 - RNA, 22 nt, Human
uaaaugucaaugugauuuauaa

SEQ ID NO: 83891 - RNA, 22 nt, Human
uaaaugugcacuuuacuuuuca

SEQ ID NO: 83892 - RNA, 22 nt, Human
uaaauguggagacucaggaguc

SEQ ID NO: 83893 - RNA, 22 nt, Human
ugaguggguuaucaggaaaggu

SEQ ID NO: 83894 - RNA, 23 nt, Human
ugagugugaaaauccuggagaug

SEQ ID NO: 83895 - RNA, 17 nt, Human
ugaguuaaguuuagauc

SEQ ID NO: 83896 - RNA, 22 nt, Human
ugaguuauaaugaauauuugaa

SEQ ID NO: 83897 - RNA, 22 nt, Human
ugaguucaaauuuuggcucugc

SEQ ID NO: 83898 - RNA, 18 nt, Human
ugaguucauuagacuucc

SEQ ID NO: 83899 - RNA, 22 nt, Human
ugaguucucacccauucuucuu

SEQ ID NO: 83900 - RNA, 23 nt, Human
ugaguucucaucuuggcuucuau

SEQ ID NO: 83901 - RNA, 22 nt, Human
ugaguucugcccuacaccugaa

SEQ ID NO: 83902 - RNA, 22 nt, Human
ugaguugaaagacugacuucug

SEQ ID NO: 83903 - RNA, 22 nt, Human
ugaguuuuggaagacaacacaa

SEQ ID NO: 83904 - RNA, 22 nt, Human
ugauaaacagcugaugaagacc

SEQ ID NO: 83905 - RNA, 22 nt, Human
ugauaaacuuagaaagaauguu

SEQ ID NO: 83906 - RNA, 22 nt, Human
ugauaaauccauguaaauggua

SEQ ID NO: 83907 - RNA, 22 nt, Human
ugauaacuuuaauuugaucuga

SEQ ID NO: 83908 - RNA, 22 nt, Human
ugauaauauuuugaaucauaag

SEQ ID NO: 83909 - RNA, 22 nt, Human
ugauacuuuucuuuuagacuaa

SEQ ID NO: 83910 - RNA, 21 nt, Human
ugauaggguuugggcaauuau

SEQ ID NO: 83911 - RNA, 17 nt, Human
ugauaguucauuuuaag

SEQ ID NO: 83912 - RNA, 20 nt, Human
ugauauauuacucaggggaa

SEQ ID NO: 83913 - RNA, 22 nt, Human
ugauaugggaaaagggcucgga

SEQ ID NO: 83914 - RNA, 22 nt, Human
ugauauguaacuacuccuuaua

SEQ ID NO: 83915 - RNA, 20 nt, Human
ugauauuucuggaaguggag

SEQ ID NO: 83916 - RNA, 22 nt, Human
ugaucaaagccaaaguugagau

SEQ ID NO: 83917 - RNA, 22 nt, Human
ugaucaaauucaggagucugga

SEQ ID NO: 83918 - RNA, 20 nt, Human
ugaucaugugaaagucaugu

SEQ ID NO: 83919 - RNA, 22 nt, Human
ugauccuauuucaguguauguu

SEQ ID NO: 83920 - RNA, 18 nt, Human
ugaucuuucaugauucca

SEQ ID NO: 83921 - RNA, 22 nt, Human
ugaucuuugggccauuaauaaa

SEQ ID NO: 83922 - RNA, 22 nt, Human
ugaucuuuucaaagacaagcuu

SEQ ID NO: 83923 - RNA, 22 nt, Human
ugaugaaaauaugauucugagg

SEQ ID NO: 83924 - RNA, 22 nt, Human
ugaugaauuaguaacaaaugag

SEQ ID NO: 83925 - RNA, 22 nt, Human
ugaugaccgccaacguuuaggu

SEQ ID NO: 83926 - RNA, 22 nt, Human
ugaugaggaccuggucucugcu

SEQ ID NO: 83927 - RNA, 21 nt, Human
ugaugaggucauagcacccuc

SEQ ID NO: 83928 - RNA, 22 nt, Human
ugaugauguuuaucuugguauu

SEQ ID NO: 83929 - RNA, 22 nt, Human
ugaugcauugccgacuuacugg

SEQ ID NO: 83930 - RNA, 22 nt, Human
ugaugccuaugaauuguaaugu

SEQ ID NO: 83931 - RNA, 22 nt, Human
ugaugcugcugggaguggugcu

SEQ ID NO: 83932 - RNA, 22 nt, Human
ugauggaacagccuuugccaaa

SEQ ID NO: 83933 - RNA, 22 nt, Human
ugauggaagugacugucaguuc

SEQ ID NO: 83934 - RNA, 19 nt, Human
ugauggaauuugacauucc

SEQ ID NO: 83935 - RNA, 22 nt, Human
ugauggagcaugugugcuuccu

SEQ ID NO: 83936 - RNA, 22 nt, Human
ugauggcugugcugauguuagg

SEQ ID NO: 83937 - RNA, 22 nt, Human
ugaugggacugccagcugcuga

SEQ ID NO: 83938 - RNA, 22 nt, Human
ugauggugaugguugcacaaug

SEQ ID NO: 83939 - RNA, 22 nt, Human
ugaugguuuuauuaauaggacc

SEQ ID NO: 83940 - RNA, 22 nt, Human
ugauguaagagauacacuugau

SEQ ID NO: 83941 - RNA, 22 nt, Human
ugauguccucaugucaagcucc

SEQ ID NO: 83942 - RNA, 22 nt, Human
ugaugucuaguacauacaagag

SEQ ID NO: 83943 - RNA, 22 nt, Human
ugauuaaaauuuaacuuaguua

SEQ ID NO: 83944 - RNA, 22 nt, Human
ugauuacacaccacagugcucc

SEQ ID NO: 83945 - RNA, 22 nt, Human
ugauucaacuuucuugaaugca

SEQ ID NO: 83946 - RNA, 22 nt, Human
ugauucaagccaccacauacug

SEQ ID NO: 83947 - RNA, 23 nt, Human
ugauucagcaaguccacuucugg

SEQ ID NO: 83948 - RNA, 19 nt, Human
ugauucaucuaacugccuc

SEQ ID NO: 83949 - RNA, 22 nt, Human
ugauucucacagugggaccuca

SEQ ID NO: 83950 - RNA, 21 nt, Human
ugauucucugacugucggaca

SEQ ID NO: 83951 - RNA, 21 nt, Human
ugauucugcauuucuaacagg

SEQ ID NO: 83952 - RNA, 22 nt, Human
ugauucugcccuuucuucugac

SEQ ID NO: 83953 - RNA, 22 nt, Human
ugauucugcuuauggguggauu

SEQ ID NO: 83954 - RNA, 21 nt, Human
ugauucuguuuuaucaucagc

SEQ ID NO: 83955 - RNA, 22 nt, Human
ugauucuuugaccaaaaaauug

SEQ ID NO: 83956 - RNA, 23 nt, Human
ugauugaaaugaggaguauuugu

SEQ ID NO: 83957 - RNA, 22 nt, Human
ugauugaacugagcuucaagau

SEQ ID NO: 83958 - RNA, 22 nt, Human
ugauugaaguguucuguuccag

SEQ ID NO: 83959 - RNA, 22 nt, Human
ugauugaauauucccuugggcc

SEQ ID NO: 83960 - RNA, 22 nt, Human
ugauugacuuuagaauagcacu

SEQ ID NO: 83961 - RNA, 22 nt, Human
ugauugccuacuaugugccaug

SEQ ID NO: 83962 - RNA, 22 nt, Human
ugauuguaugauugaaauauuu

SEQ ID NO: 83963 - RNA, 22 nt, Human
ugauuguuuuaguucccugaug

SEQ ID NO: 83964 - RNA, 22 nt, Human
ugauuuacacaccuaugauuua

SEQ ID NO: 83965 - RNA, 22 nt, Human
ugauuuaccaguuacuaucuug

SEQ ID NO: 83966 - RNA, 22 nt, Human
ugauuuacuucccagcuggguu

SEQ ID NO: 83967 - RNA, 22 nt, Human
ugauuuaugcauuauacuguug

SEQ ID NO: 83968 - RNA, 21 nt, Human
ugauuuaugcccaagucccug

SEQ ID NO: 83969 - RNA, 22 nt, Human
ugauuucaguaaugaggaugaa

SEQ ID NO: 83970 - RNA, 22 nt, Human
ugauuuccacagucaggggugc

SEQ ID NO: 83971 - RNA, 22 nt, Human
ugauuuccacgugcacccaggu

SEQ ID NO: 83972 - RNA, 22 nt, Human
ugauuucccuguagccucugaa

SEQ ID NO: 83973 - RNA, 22 nt, Human
ugauuucuuccuugucauuaga

SEQ ID NO: 83974 - RNA, 22 nt, Human
ugauuucuucuaauuuccauca

SEQ ID NO: 83975 - RNA, 22 nt, Human
ugauuugaaaccuuuggcaaga

SEQ ID NO: 83976 - RNA, 22 nt, Human
ugauuugcgucucauuugaaau

SEQ ID NO: 83977 - RNA, 22 nt, Human
ugauuuguuacacaggugugug

SEQ ID NO: 83978 - RNA, 23 nt, Human
ugauuuuaaaaaguaaguuauca

SEQ ID NO: 83979 - RNA, 22 nt, Human
ugauuuuauugaaacuucacuu

SEQ ID NO: 83980 - RNA, 22 nt, Human
ugauuuugagguuucaggucuu

SEQ ID NO: 83981 - RNA, 22 nt, Human
ugauuuuuaaaauucuccuugc

SEQ ID NO: 83982 - RNA, 22 nt, Human
ugcaaaaauugcuggaaucuuu

SEQ ID NO: 83983 - RNA, 22 nt, Human
ugcaaaacuucucagagccuuu

SEQ ID NO: 83984 - RNA, 22 nt, Human
uaaguucugaugucuguugcca

SEQ ID NO: 83985 - RNA, 18 nt, Human
uaaguucuuaggcagcuu

SEQ ID NO: 83986 - RNA, 22 nt, Human
uaaguuuaaauguacaugaagc

SEQ ID NO: 83987 - RNA, 22 nt, Human
uaaguuuccagauuguaagucc

SEQ ID NO: 83988 - RNA, 22 nt, Human
uaaguuuggggaaaauguuaag

SEQ ID NO: 83989 - RNA, 22 nt, Human
uaauaaaugaaagugcuggcau

SEQ ID NO: 83990 - RNA, 22 nt, Human
uaauaagcguagaagguauauc

SEQ ID NO: 83991 - RNA, 22 nt, Human
uaauaauuaacagugauggguc

SEQ ID NO: 83992 - RNA, 22 nt, Human
uaauaauuaguuauugaucgug

SEQ ID NO: 83993 - RNA, 22 nt, Human
uaauaauuggcaauguugagca

SEQ ID NO: 83994 - RNA, 22 nt, Human
uaauacacacucucauuccuaa

SEQ ID NO: 83995 - RNA, 22 nt, Human
uaauacaguagcuuuuacacag

SEQ ID NO: 83996 - RNA, 22 nt, Human
uaauacaucauucaucuaagga

SEQ ID NO: 83997 - RNA, 22 nt, Human
uaauacauguauuccagagagu

SEQ ID NO: 83998 - RNA, 22 nt, Human
uaauaccacugugcucauuaua

SEQ ID NO: 83999 - RNA, 22 nt, Human
uaauaccuugaucucucuuguc

SEQ ID NO: 84000 - RNA, 22 nt, Human
uaauacugagccaccagguagg

SEQ ID NO: 84001 - RNA, 22 nt, Human
uaauacuuugaaugagagcuaa

SEQ ID NO: 84002 - RNA, 22 nt, Human
uagauauaucugucauacuggu

SEQ ID NO: 84003 - RNA, 22 nt, Human
uagauaugaugagucacuugag

SEQ ID NO: 84004 - RNA, 22 nt, Human
uagauauggccgucuguuuuaa

SEQ ID NO: 84005 - RNA, 22 nt, Human
uagauauguguuuauuaugcug

SEQ ID NO: 84006 - RNA, 22 nt, Human
uagaucaggcugcuuagauaga

SEQ ID NO: 84007 - RNA, 22 nt, Human
uagaucauuagcgggggugaga

SEQ ID NO: 84008 - RNA, 20 nt, Human
uagauccgcaguaaaacuuu

SEQ ID NO: 84009 - RNA, 22 nt, Human
uagaugaaauguguguuauuau

SEQ ID NO: 84010 - RNA, 22 nt, Human
uagaugaaauuuguguguaugc

SEQ ID NO: 84011 - RNA, 22 nt, Human
uagaugaaugacuuauauguca

SEQ ID NO: 84012 - RNA, 22 nt, Human
uagaugaauuagcaauuaucuu

SEQ ID NO: 84013 - RNA, 22 nt, Human
uagaugcuuauaaagagcauau

SEQ ID NO: 84014 - RNA, 22 nt, Human
uagauggaggcuagaugcaggg

SEQ ID NO: 84015 - RNA, 22 nt, Human
uagauggcaccuucuguguguc

SEQ ID NO: 84016 - RNA, 22 nt, Human
uagauggcguccauggccgcag

SEQ ID NO: 84017 - RNA, 22 nt, Human
uagauggcugguguucugagcu

SEQ ID NO: 84018 - RNA, 22 nt, Human
uagauguuaagcuucuagaagg

SEQ ID NO: 84019 - RNA, 22 nt, Human
uagauguuuuaacucuugguua

SEQ ID NO: 84020 - RNA, 22 nt, Human
uagauuaacaguuuuguugaag

SEQ ID NO: 84021 - RNA, 22 nt, Human
uagauucucagaauuuuagaaa

SEQ ID NO: 84022 - RNA, 22 nt, Human
uagauucuccacauguagcaau

SEQ ID NO: 84023 - RNA, 20 nt, Human
uagauucugucuguccaaac

SEQ ID NO: 84024 - RNA, 22 nt, Human
uagauucuguuuccucugguuu

SEQ ID NO: 84025 - RNA, 22 nt, Human
uagauugagcuugacaguguug

SEQ ID NO: 84026 - RNA, 22 nt, Human
uagauuuccucuuccucauucc

SEQ ID NO: 84027 - RNA, 22 nt, Human
uagauuugaaugauguaaagag

SEQ ID NO: 84028 - RNA, 22 nt, Human
uagauuuuaggagauuuuacug

SEQ ID NO: 84029 - RNA, 18 nt, Human
uagcaaagauguggauug

SEQ ID NO: 84030 - RNA, 22 nt, Human
uagcaaagcuccguaguuauuu

SEQ ID NO: 84031 - RNA, 22 nt, Human
uagcaaaggccuuggacacgcu

SEQ ID NO: 84032 - RNA, 22 nt, Human
uagcaaauaaaacaguauugaa

SEQ ID NO: 84033 - RNA, 22 nt, Human
uagcaaaugccugguuaauuag

SEQ ID NO: 84034 - RNA, 22 nt, Human
uagcaacagaaaauaggagugc

SEQ ID NO: 84035 - RNA, 22 nt, Human
uagcaaccagaacagcacucua

SEQ ID NO: 84036 - RNA, 22 nt, Human
uagcaaccuauggauagagaag

SEQ ID NO: 84037 - RNA, 22 nt, Human
uagcaacguguauaaacucaag

SEQ ID NO: 84038 - RNA, 22 nt, Human
uagcaagacaacuuuucucagu

SEQ ID NO: 84039 - RNA, 22 nt, Human
uagcaagaggugaagguuucau

SEQ ID NO: 84040 - RNA, 22 nt, Human
uagcaaggacguccaaagaacu

SEQ ID NO: 84041 - RNA, 22 nt, Human
uagcaaggcuuccaaugaacag

SEQ ID NO: 84042 - RNA, 22 nt, Human
uagcaauaugcuaccuuaaaug

SEQ ID NO: 84043 - RNA, 22 nt, Human
uagcaauccguugaucccuugc

SEQ ID NO: 84044 - RNA, 20 nt, Human
uagcaaugaguguuccauuu

SEQ ID NO: 84045 - RNA, 22 nt, Human
uagcaaugcucuaugaugaaaa

SEQ ID NO: 84046 - RNA, 22 nt, Human
uagcaauguguugacuugguca

SEQ ID NO: 84047 - RNA, 17 nt, Human
uagcacaaagcaggauu

SEQ ID NO: 84048 - RNA, 22 nt, Human
uagcacaaguaucugcuuuucc

SEQ ID NO: 84049 - RNA, 22 nt, Human
uagcacacugcauaugaagauu

SEQ ID NO: 84050 - RNA, 22 nt, Human
uagcacagacagaauggucaua

SEQ ID NO: 84051 - RNA, 22 nt, Human
uagcacaguauuucucaacugg

SEQ ID NO: 84052 - RNA, 22 nt, Human
uagcacaguguucacaacagug

SEQ ID NO: 84053 - RNA, 22 nt, Human
uagcacaguuccugacucuuug

SEQ ID NO: 84054 - RNA, 22 nt, Human
uagcacaugccgggagugaucu

SEQ ID NO: 84055 - RNA, 22 nt, Human
uagcaccaugauggaagagcug

SEQ ID NO: 84056 - RNA, 22 nt, Human
uagcaccugcaggaugugcaca

SEQ ID NO: 84057 - RNA, 22 nt, Human
uagcaccuggucaauucaguca

SEQ ID NO: 84058 - RNA, 22 nt, Human
uagcacugaaucacaugcugcu

SEQ ID NO: 84059 - RNA, 22 nt, Human
uagcacuuguguuaugccuugu

SEQ ID NO: 84060 - RNA, 22 nt, Human
uagcagaagaaauucagaguug

SEQ ID NO: 84061 - RNA, 22 nt, Human
uagcagagaggggacaguggca

SEQ ID NO: 84062 - RNA, 22 nt, Human
uagcagagagguuucagcuaau

SEQ ID NO: 84063 - RNA, 22 nt, Human
uagcagagcagggaucagagcc

SEQ ID NO: 84064 - RNA, 22 nt, Human
uagcagagcgggugcgaggcgg

SEQ ID NO: 84065 - RNA, 22 nt, Human
uagcagagcugcaauauagacc

SEQ ID NO: 84066 - RNA, 22 nt, Human
uagcagagcugggacuagauua

SEQ ID NO: 84067 - RNA, 22 nt, Human
uagcagaggcugucugacuuaa

SEQ ID NO: 84068 - RNA, 22 nt, Human
uagcagaggguagugccggggc

SEQ ID NO: 84069 - RNA, 22 nt, Human
uagcagaguagugccuccagau

SEQ ID NO: 84070 - RNA, 22 nt, Human
uagcagaguaucuugcaaauua

SEQ ID NO: 84071 - RNA, 22 nt, Human
uagcagcaauucaggugugaug

SEQ ID NO: 84072 - RNA, 22 nt, Human
uagcagcagugguguauuuaga

SEQ ID NO: 84073 - RNA, 22 nt, Human
uagcagcauuuuuguagaguau

SEQ ID NO: 84074 - RNA, 22 nt, Human
uagcagcucacuaacucugcgu

SEQ ID NO: 84075 - RNA, 22 nt, Human
uagcagcuuaaguaauuagaau

SEQ ID NO: 84076 - RNA, 21 nt, Human
uagcaggagcgaauuuugaug

SEQ ID NO: 84077 - RNA, 21 nt, Human
uagcaggauuugguuuauuuu

SEQ ID NO: 84078 - RNA, 22 nt, Human
uagcaggcauggagaugacugu

SEQ ID NO: 84079 - RNA, 22 nt, Human
uagcaggcuugugaauggagcc

SEQ ID NO: 84080 - RNA, 22 nt, Human
uagcagggguagauagagugug

SEQ ID NO: 84081 - RNA, 22 nt, Human
uagcaggguccaaugugaggca

SEQ ID NO: 84082 - RNA, 22 nt, Human
uagcagggucucaggagucagg

SEQ ID NO: 84083 - RNA, 22 nt, Human
uagcaguagcauuuaacauaua

SEQ ID NO: 84084 - RNA, 22 nt, Human
uagcaguauggagcgaggccca

SEQ ID NO: 84085 - RNA, 22 nt, Human
uagcagucaucggcagagaaaa

SEQ ID NO: 84086 - RNA, 22 nt, Human
uagcaguggaaucuuuugucca

SEQ ID NO: 84087 - RNA, 22 nt, Human
uagcaguguugccguuggcugc

SEQ ID NO: 84088 - RNA, 22 nt, Human
uagcauaacagguaagagugag

SEQ ID NO: 84089 - RNA, 22 nt, Human
uagcauaggaaaguacugggaa

SEQ ID NO: 84090 - RNA, 21 nt, Human
uagcaucucuacugucauaga

SEQ ID NO: 84091 - RNA, 22 nt, Human
uagcaugucagucgccacacgu

SEQ ID NO: 84092 - RNA, 22 nt, Human
uagcauucagaacugagagcaa

SEQ ID NO: 84093 - RNA, 22 nt, Human
uagcauuccaucacucagcacc

SEQ ID NO: 84094 - RNA, 22 nt, Human
uagcauuucacugaucuucacu

SEQ ID NO: 84095 - RNA, 22 nt, Human
uagcauuucuggccucuacuca

SEQ ID NO: 84096 - RNA, 22 nt, Human
uagcauuuggcaccaguuauuu

SEQ ID NO: 84097 - RNA, 21 nt, Human
uagcauuuuuguauugcugaa

SEQ ID NO: 84098 - RNA, 22 nt, Human
uagccaaaaaguagcaauuauu

SEQ ID NO: 84099 - RNA, 22 nt, Human
uagccaaagaagguauauuugu

SEQ ID NO: 84100 - RNA, 22 nt, Human
uagccaggcaauuaugggugau

SEQ ID NO: 84101 - RNA, 22 nt, Human
uagccaggccuuugaucccggc

SEQ ID NO: 84102 - RNA, 22 nt, Human
uagccaugagcagaucacuaua

SEQ ID NO: 84103 - RNA, 22 nt, Human
uagccauugacuuaaagcuuau

SEQ ID NO: 84104 - RNA, 22 nt, Human
uagcccagcuuggccuauuucu

SEQ ID NO: 84105 - RNA, 21 nt, Human
uagcccucucugucuguguac

SEQ ID NO: 84106 - RNA, 22 nt, Human
uagcccugcugugaugugaagu

SEQ ID NO: 84107 - RNA, 22 nt, Human
uagcccuggagcagggaaauac

SEQ ID NO: 84108 - RNA, 19 nt, Human
uagcccuggccaucaugag

SEQ ID NO: 84109 - RNA, 22 nt, Human
uagccgcuuaauuauuugguga

SEQ ID NO: 84110 - RNA, 22 nt, Human
uagccucucuccuccacaaccu

SEQ ID NO: 84111 - RNA, 22 nt, Human
uaggccagaggagcagcuuugg

SEQ ID NO: 84112 - RNA, 22 nt, Human
uaggccagauuguuauccaugg

SEQ ID NO: 84113 - RNA, 22 nt, Human
uaggccaggacagagcuuccag

SEQ ID NO: 84114 - RNA, 22 nt, Human
uaggccaguaaaauguuucagu

SEQ ID NO: 84115 - RNA, 18 nt, Human
uaggccaguauacuuuuc

SEQ ID NO: 84116 - RNA, 22 nt, Human
uaggccuaagagauacuacugu

SEQ ID NO: 84117 - RNA, 22 nt, Human
uaggccugguacuguguuaaua

SEQ ID NO: 84118 - RNA, 22 nt, Human
uaggcuccaagagcgaacucag

SEQ ID NO: 84119 - RNA, 22 nt, Human
uaggcuccaguguguggcgagu

SEQ ID NO: 84120 - RNA, 22 nt, Human
uaggcuccucucacauucuauu

SEQ ID NO: 84121 - RNA, 22 nt, Human
uaggcuccugaggacuccaugc

SEQ ID NO: 84122 - RNA, 22 nt, Human
uaggcugagguugaugccaggg

SEQ ID NO: 84123 - RNA, 22 nt, Human
uaggcuggaacuuaggcagagg

SEQ ID NO: 84124 - RNA, 22 nt, Human
uaggcuggggguaggaauugag

SEQ ID NO: 84125 - RNA, 22 nt, Human
ucaauaaguaggauaucaagau

SEQ ID NO: 84126 - RNA, 22 nt, Human
ucaauacacaugccgcuguucu

SEQ ID NO: 84127 - RNA, 17 nt, Human
ucaauacacugcuuuua

SEQ ID NO: 84128 - RNA, 21 nt, Human
ucaauacaggugcaugugucu

SEQ ID NO: 84129 - RNA, 22 nt, Human
ucaauacuuaagcuuaauucua

SEQ ID NO: 84130 - RNA, 22 nt, Human
ucaauauuuuuaugagcauaga

SEQ ID NO: 84131 - RNA, 22 nt, Human
ucaaugagccagaauguaguac

SEQ ID NO: 84132 - RNA, 22 nt, Human
ucaaugaugcugaagguagcgu

SEQ ID NO: 84133 - RNA, 22 nt, Human
ucaaugcaacuuccaccuccca

SEQ ID NO: 84134 - RNA, 22 nt, Human
ucaauguaauaaaauacucuau

SEQ ID NO: 84135 - RNA, 22 nt, Human
ucaaugucagcugguaggaaau

SEQ ID NO: 84136 - RNA, 22 nt, Human
ucaauguccgggccccauucca

SEQ ID NO: 84137 - RNA, 22 nt, Human
ucaaugucucuuucuaaaaugu

SEQ ID NO: 84138 - RNA, 22 nt, Human
ucaaugucugucuaucuauuua

SEQ ID NO: 84139 - RNA, 22 nt, Human
ucaauguucaaguaugacaaug

SEQ ID NO: 84140 - RNA, 22 nt, Human
ucaauguucuugguauauccuu

SEQ ID NO: 84141 - RNA, 22 nt, Human
ucaauguuuguucaugaaaaua

SEQ ID NO: 84142 - RNA, 22 nt, Human
ucaauuaugccauugcaauauu

SEQ ID NO: 84143 - RNA, 22 nt, Human
ucaauucaacacaugcacauug

SEQ ID NO: 84144 - RNA, 22 nt, Human
ucaauucagacugagaaaugau

SEQ ID NO: 84145 - RNA, 22 nt, Human
ucaauucuagagccuuacauug

SEQ ID NO: 84146 - RNA, 22 nt, Human
ucaauucuaguggagagaguuu

SEQ ID NO: 84147 - RNA, 22 nt, Human
ucaauucugccucuaaauauuu

SEQ ID NO: 84148 - RNA, 22 nt, Human
ucaauucugguccucaggaacu

SEQ ID NO: 84149 - RNA, 20 nt, Human
ucaauuucagguagcauagu

SEQ ID NO: 84150 - RNA, 22 nt, Human
ucaauuucauucuauuaguuaa

SEQ ID NO: 84151 - RNA, 22 nt, Human
ucaauuuuaugaaacaaaguga

SEQ ID NO: 84152 - RNA, 22 nt, Human
ucacaaaaggccauguggcuuc

SEQ ID NO: 84153 - RNA, 22 nt, Human
ucacaaagggagggauagcugg

SEQ ID NO: 84154 - RNA, 22 nt, Human
ucacaaagugaagugugucaug

SEQ ID NO: 84155 - RNA, 22 nt, Human
ucacaaauauuuuaacaguagg

SEQ ID NO: 84156 - RNA, 22 nt, Human
ucacaacaggaaggaccagcug

SEQ ID NO: 84157 - RNA, 22 nt, Human
ucacaacugggugucuucauca

SEQ ID NO: 84158 - RNA, 22 nt, Human
ucacaagauggcugcugcagcc

SEQ ID NO: 84159 - RNA, 22 nt, Human
ucacaaggauaagccacauaua

SEQ ID NO: 84160 - RNA, 19 nt, Human
ucacaaggccucuuagucu

SEQ ID NO: 84161 - RNA, 22 nt, Human
ucacaagggcccugcaguccac

SEQ ID NO: 84162 - RNA, 22 nt, Human
ucacaauacucacucaauggcu

SEQ ID NO: 84163 - RNA, 20 nt, Human
ucacaauaugagcucauaca

SEQ ID NO: 84164 - RNA, 22 nt, Human
ucacaauaugggugugggaacu

SEQ ID NO: 84165 - RNA, 22 nt, Human
ucacaaugcaaguguucagugg

SEQ ID NO: 84166 - RNA, 22 nt, Human
ucacacacauaaucuaagauua

SEQ ID NO: 84167 - RNA, 22 nt, Human
ucacacacauggauaguauuuu

SEQ ID NO: 84168 - RNA, 22 nt, Human
ucacacagcagccccggguguu

SEQ ID NO: 84169 - RNA, 22 nt, Human
ucacacagcuuggaguuauggu

SEQ ID NO: 84170 - RNA, 22 nt, Human
ucacacagguuugcaaugauuu

SEQ ID NO: 84171 - RNA, 22 nt, Human
ucacacauguaagggcuuugga

SEQ ID NO: 84172 - RNA, 22 nt, Human
ucacacauuugaaggccuguca

SEQ ID NO: 84173 - RNA, 16 nt, Human
ucacacauuuguuggu

SEQ ID NO: 84174 - RNA, 22 nt, Human
ucacaccuguaaucccaggccu

SEQ ID NO: 84175 - RNA, 22 nt, Human
ucacacuaggauguuguuucua

SEQ ID NO: 84176 - RNA, 22 nt, Human
ucacagaaacagaauggcacag

SEQ ID NO: 84177 - RNA, 22 nt, Human
ucacagaacaagccugguggag

SEQ ID NO: 84178 - RNA, 22 nt, Human
ucacagaagcccucgcaaacua

SEQ ID NO: 84179 - RNA, 22 nt, Human
ucacagaaggagggaagcuagu

SEQ ID NO: 84180 - RNA, 22 nt, Human
ucacagaagguggccauagcug

SEQ ID NO: 84181 - RNA, 22 nt, Human
ucacagaaguguagugaggaaa

SEQ ID NO: 84182 - RNA, 18 nt, Human
ucacagaauauugagugg

SEQ ID NO: 84183 - RNA, 20 nt, Human
ucacagaaugccugaagaag

SEQ ID NO: 84184 - RNA, 22 nt, Human
ucacagacaauuguuuuggugu

SEQ ID NO: 84185 - RNA, 22 nt, Human
ucacagacacauuaaacaugug

SEQ ID NO: 84186 - RNA, 19 nt, Human
ucacagacagagcaaucac

SEQ ID NO: 84187 - RNA, 22 nt, Human
ucacagacgcauccucagguag

SEQ ID NO: 84188 - RNA, 22 nt, Human
ucacagacuugucuccagggau

SEQ ID NO: 84189 - RNA, 22 nt, Human
ucacagagaaauguggcacaaa

SEQ ID NO: 84190 - RNA, 22 nt, Human
ucacagagagaauauuguguuu

SEQ ID NO: 84191 - RNA, 22 nt, Human
ucacagagcacacaagaauugc

SEQ ID NO: 84192 - RNA, 22 nt, Human
ucacagagcacguaucaugccu

SEQ ID NO: 84193 - RNA, 22 nt, Human
ucacagagcucacaguuuagca

SEQ ID NO: 84194 - RNA, 22 nt, Human
ucacagcacauggaccgagucc

SEQ ID NO: 84195 - RNA, 22 nt, Human
ucacagcacccugaggugcugg

SEQ ID NO: 84196 - RNA, 22 nt, Human
ucacagcagaauuuaggaggca

SEQ ID NO: 84197 - RNA, 22 nt, Human
ucacagcaggguaacaggaaga

SEQ ID NO: 84198 - RNA, 22 nt, Human
ucacagcauucgcaauggacag

SEQ ID NO: 84199 - RNA, 22 nt, Human
ucacagcucugucaauuuuaua

SEQ ID NO: 84200 - RNA, 22 nt, Human
ucacaggacagccuuccacccg

SEQ ID NO: 84201 - RNA, 22 nt, Human
ucacaggagcccaggggagcug

SEQ ID NO: 84202 - RNA, 20 nt, Human
ucacaggagggaaggcaggu

SEQ ID NO: 84203 - RNA, 22 nt, Human
ucacaggauaagguggcaucac

SEQ ID NO: 84204 - RNA, 22 nt, Human
ucacaggcaaagaagauuggug

SEQ ID NO: 84205 - RNA, 19 nt, Human
ucacaggcaucuccccaga

SEQ ID NO: 84206 - RNA, 22 nt, Human
ucacaggcucuagggauuaaga

SEQ ID NO: 84207 - RNA, 22 nt, Human
ucacaggcuugugaacauugca

SEQ ID NO: 84208 - RNA, 22 nt, Human
ucacaggguaucugggauggau

SEQ ID NO: 84209 - RNA, 22 nt, Human
ucacaggguuuggaagccuccu

SEQ ID NO: 84210 - RNA, 22 nt, Human
ucacaguaaaagcauggaagag

SEQ ID NO: 84211 - RNA, 22 nt, Human
ucacaguacugugacuauugac

SEQ ID NO: 84212 - RNA, 22 nt, Human
ucacaguauaaccucauauagg

SEQ ID NO: 84213 - RNA, 22 nt, Human
ucacaguaucagguggagugga

SEQ ID NO: 84214 - RNA, 22 nt, Human
ucacagucggugacuucuugcu

SEQ ID NO: 84215 - RNA, 22 nt, Human
ucacagugauaacuaaguccug

SEQ ID NO: 84216 - RNA, 22 nt, Human
ucacagugcaccagugugaagc

SEQ ID NO: 84217 - RNA, 22 nt, Human
ucacagugcaccccucacaggg

SEQ ID NO: 84218 - RNA, 22 nt, Human
ucacagugugaaggucagucac

SEQ ID NO: 84219 - RNA, 22 nt, Human
ucacaguguuggaaucagagcu

SEQ ID NO: 84220 - RNA, 22 nt, Human
uagcauuuauggucaugugucc

SEQ ID NO: 84221 - RNA, 22 nt, Human
uagcauuuggacauugucaccu

SEQ ID NO: 84222 - RNA, 22 nt, Human
uagcauuuuagcuguuuucucu

SEQ ID NO: 84223 - RNA, 22 nt, Human
uagccagugaauguuuccagug

SEQ ID NO: 84224 - RNA, 22 nt, Human
uagccagugagacccagaaaua

SEQ ID NO: 84225 - RNA, 22 nt, Human
uagccaguuucuuuaacagcaa

SEQ ID NO: 84226 - RNA, 22 nt, Human
uagccauguguggaacacagcc

SEQ ID NO: 84227 - RNA, 22 nt, Human
uagcccagcucaaaugaccggu

SEQ ID NO: 84228 - RNA, 22 nt, Human
uagcccauggacuggucagcug

SEQ ID NO: 84229 - RNA, 17 nt, Human
uagcccauggcugccag

SEQ ID NO: 84230 - RNA, 22 nt, Human
uagcccucagcuuggagcgugg

SEQ ID NO: 84231 - RNA, 22 nt, Human
uagcccucuccagcgaggucug

SEQ ID NO: 84232 - RNA, 22 nt, Human
uagcccucuuuaauccuucccu

SEQ ID NO: 84233 - RNA, 22 nt, Human
uagcccuugaugcugcggccag

SEQ ID NO: 84234 - RNA, 22 nt, Human
uagccggguguugugucaugca

SEQ ID NO: 84235 - RNA, 22 nt, Human
uagccucuggaauccuuucucu

SEQ ID NO: 84236 - RNA, 22 nt, Human
uagcgagguguuucuaggacug

SEQ ID NO: 84237 - RNA, 22 nt, Human
uagcgcaacugcagagaaguag

SEQ ID NO: 84238 - RNA, 22 nt, Human
uagcgcaaugagagagcggugc

SEQ ID NO: 84239 - RNA, 17 nt, Human
uagcuagaccgagucuc

SEQ ID NO: 84240 - RNA, 22 nt, Human
uagcuaggguaagacuuggacc

SEQ ID NO: 84241 - RNA, 22 nt, Human
uagcuaguagauggggaagcug

SEQ ID NO: 84242 - RNA, 22 nt, Human
uagcuauuguugguaguuaccc

SEQ ID NO: 84243 - RNA, 22 nt, Human
uaggcuguaagagagggcagag

SEQ ID NO: 84244 - RNA, 22 nt, Human
uaggcuucccgcucacaugccc

SEQ ID NO: 84245 - RNA, 22 nt, Human
uaggcuuuguguuuugggaaca

SEQ ID NO: 84246 - RNA, 22 nt, Human
uagggaaauauagauuuagggc

SEQ ID NO: 84247 - RNA, 22 nt, Human
uagggagaggaagcaggccgcu

SEQ ID NO: 84248 - RNA, 22 nt, Human
uagggagaugcaagggacggag

SEQ ID NO: 84249 - RNA, 22 nt, Human
uagggagcucuggcagaaggaa

SEQ ID NO: 84250 - RNA, 22 nt, Human
uagggaggcuacuucuuguagg

SEQ ID NO: 84251 - RNA, 22 nt, Human
uagggaugaagaugguauuucu

SEQ ID NO: 84252 - RNA, 22 nt, Human
uagggaugaugucuaaaaucau

SEQ ID NO: 84253 - RNA, 22 nt, Human
uagggauggcagcauguagcuu

SEQ ID NO: 84254 - RNA, 22 nt, Human
uagggauguaaacauaguaauu

SEQ ID NO: 84255 - RNA, 22 nt, Human
uagggauguccugagacuuggc

SEQ ID NO: 84256 - RNA, 22 nt, Human
uagggauguggugagaacugag

SEQ ID NO: 84257 - RNA, 22 nt, Human
uagggcagagcuuguacacgau

SEQ ID NO: 84258 - RNA, 22 nt, Human
uagggcagccacccaggcugcu

SEQ ID NO: 84259 - RNA, 23 nt, Human
uagggcagcugggagggacaugc

SEQ ID NO: 84260 - RNA, 21 nt, Human
uagggcaggcauuggaagaga

SEQ ID NO: 84261 - RNA, 22 nt, Human
uagggcaguuauaacauuagug

SEQ ID NO: 84262 - RNA, 22 nt, Human
uagggccaguuagggaagcuuu

SEQ ID NO: 84263 - RNA, 22 nt, Human
uagggcuccacucccagagauu

SEQ ID NO: 84264 - RNA, 22 nt, Human
uagggcucugcucaucaguugu

SEQ ID NO: 84265 - RNA, 22 nt, Human
uagggcucuggugggcucuguu

SEQ ID NO: 84266 - RNA, 22 nt, Human
uagggcugccauuugcuuuucu

SEQ ID NO: 84267 - RNA, 22 nt, Human
uagggcugugucuccaggacca

SEQ ID NO: 84268 - RNA, 23 nt, Human
uaggggaaaaaucuucugcaauu

SEQ ID NO: 84269 - RNA, 22 nt, Human
uaggggaacuggcacagggcag

SEQ ID NO: 84270 - RNA, 22 nt, Human
uaggggaauugcagugugucca

SEQ ID NO: 84271 - RNA, 22 nt, Human
uaggggagcucgggugcaaucg

SEQ ID NO: 84272 - RNA, 22 nt, Human
uaggggugggauccaggaauua

SEQ ID NO: 84273 - RNA, 22 nt, Human
uagggguuaccuuuagcaucuc

SEQ ID NO: 84274 - RNA, 22 nt, Human
uaggguaguaccaugcugccag

SEQ ID NO: 84275 - RNA, 22 nt, Human
uaggguccaagccuuauaauua

SEQ ID NO: 84276 - RNA, 22 nt, Human
uaggguccauauggaugaaugg

SEQ ID NO: 84277 - RNA, 22 nt, Human
uagggugccuuuuauugcugug

SEQ ID NO: 84278 - RNA, 22 nt, Human
uaggguggagacuggaagcagg

SEQ ID NO: 84279 - RNA, 22 nt, Human
uagguacuuaagaucucagcua

SEQ ID NO: 84280 - RNA, 22 nt, Human
uagguagggaccaccuugggga

SEQ ID NO: 84281 - RNA, 22 nt, Human
uaggucagaacaagcaguaucg

SEQ ID NO: 84282 - RNA, 22 nt, Human
uaggucuccuggccuagagauu

SEQ ID NO: 84283 - RNA, 22 nt, Human
uaggucucucuucuugauggga

SEQ ID NO: 84284 - RNA, 22 nt, Human
uaggucuguaaaugagagagac

SEQ ID NO: 84285 - RNA, 22 nt, Human
uaggugaguuuggggaagauag

SEQ ID NO: 84286 - RNA, 22 nt, Human
uaggugggugacuuccaugggg

SEQ ID NO: 84287 - RNA, 22 nt, Human
uaggugguagagccuggcuugc

SEQ ID NO: 84288 - RNA, 22 nt, Human
uagguggugggauaugagcauc

SEQ ID NO: 84289 - RNA, 22 nt, Human
uaggugguuaugucagccuaga

SEQ ID NO: 84290 - RNA, 22 nt, Human
uaggugucuuguguaugguaca

SEQ ID NO: 84291 - RNA, 22 nt, Human
uagguucagcuuucauccugaa

SEQ ID NO: 84292 - RNA, 22 nt, Human
uagguucaggagauauugcaca

SEQ ID NO: 84293 - RNA, 22 nt, Human
uagguuccaugagggaggcaaa

SEQ ID NO: 84294 - RNA, 22 nt, Human
uagguuuacugaauuaguggaa

SEQ ID NO: 84295 - RNA, 22 nt, Human
uagguuuuccuaaaauucuggu

SEQ ID NO: 84296 - RNA, 22 nt, Human
uaguaaaaagcaauggugagua

SEQ ID NO: 84297 - RNA, 22 nt, Human
uaguaaacagcucugccacaau

SEQ ID NO: 84298 - RNA, 22 nt, Human
uaguaaacaggcaagggaccac

SEQ ID NO: 84299 - RNA, 22 nt, Human
uaguaaacccaugaggcuuaaa

SEQ ID NO: 84300 - RNA, 22 nt, Human
uaguaacccacacaacaguaga

SEQ ID NO: 84301 - RNA, 22 nt, Human
uaguaagcacauggacaagugg

SEQ ID NO: 84302 - RNA, 22 nt, Human
uaguaaguagcuaauauuuacu

SEQ ID NO: 84303 - RNA, 22 nt, Human
uaguaauaaguugugcuuugau

SEQ ID NO: 84304 - RNA, 22 nt, Human
uaguaaucagagguaaacuuua

SEQ ID NO: 84305 - RNA, 22 nt, Human
uaguacagaaaaccucaggguc

SEQ ID NO: 84306 - RNA, 22 nt, Human
uaguacaguacugggcucuagu

SEQ ID NO: 84307 - RNA, 22 nt, Human
uaguacaguggcauucaaacuu

SEQ ID NO: 84308 - RNA, 22 nt, Human
uaguacaguuuacuuucagcgc

SEQ ID NO: 84309 - RNA, 22 nt, Human
uaguacaguuuuggcacaugga

SEQ ID NO: 84310 - RNA, 19 nt, Human
uaguaguagaaaacaauac

SEQ ID NO: 84311 - RNA, 22 nt, Human
uaguagugagucuuuauaaaua

SEQ ID NO: 84312 - RNA, 22 nt, Human
uaguauaugucuaugguuguag

SEQ ID NO: 84313 - RNA, 22 nt, Human
uaguauauuaauucucacgguu

SEQ ID NO: 84314 - RNA, 22 nt, Human
uaguaucuauuaguaacaagag

SEQ ID NO: 84315 - RNA, 22 nt, Human
uaguaucuuucuauauuuccca

SEQ ID NO: 84316 - RNA, 22 nt, Human
uaguaugggaagaacuuuguag

SEQ ID NO: 84317 - RNA, 22 nt, Human
uaguauuuccuguaagcuauag

SEQ ID NO: 84318 - RNA, 22 nt, Human
uaguauuugcagauuuguguca

SEQ ID NO: 84319 - RNA, 22 nt, Human
uagucaccagcuacaggacagc

SEQ ID NO: 84320 - RNA, 22 nt, Human
uagucaccucuuuaaauguccu

SEQ ID NO: 84321 - RNA, 22 nt, Human
uagucaccugugagcugcguag

SEQ ID NO: 84322 - RNA, 22 nt, Human
uagucagacccaagagagccau

SEQ ID NO: 84323 - RNA, 22 nt, Human
uagucagagucuucucuguugu

SEQ ID NO: 84324 - RNA, 22 nt, Human
uagucaggaguaggaguuuugg

SEQ ID NO: 84325 - RNA, 22 nt, Human
uagucaguagcaagguauuuug

SEQ ID NO: 84326 - RNA, 22 nt, Human
uagucagugaucaguggaguug

SEQ ID NO: 84327 - RNA, 22 nt, Human
uaguccagccuuggguguagcc

SEQ ID NO: 84328 - RNA, 22 nt, Human
uaguccaggaagguggggcaga

SEQ ID NO: 84329 - RNA, 22 nt, Human
uauagcaucuaggaugauugca

SEQ ID NO: 84330 - RNA, 22 nt, Human
uauaggaaaggaguggucacaa

SEQ ID NO: 84331 - RNA, 22 nt, Human
uauaggaaguguagugcuugga

SEQ ID NO: 84332 - RNA, 22 nt, Human
uauaggaauaaagugggguaua

SEQ ID NO: 84333 - RNA, 22 nt, Human
uauaggcagaucugagaauauu

SEQ ID NO: 84334 - RNA, 22 nt, Human
uauaggcucuuguuaaccuuuu

SEQ ID NO: 84335 - RNA, 22 nt, Human
uauaggcuuuugccugaagcua

SEQ ID NO: 84336 - RNA, 22 nt, Human
uauaggugaauaaaugaguuua

SEQ ID NO: 84337 - RNA, 22 nt, Human
uauaguacacuuagguacuuca

SEQ ID NO: 84338 - RNA, 21 nt, Human
uauagucacuugagcauuauc

SEQ ID NO: 84339 - RNA, 22 nt, Human
uauagugucucuagaucaaaga

SEQ ID NO: 84340 - RNA, 22 nt, Human
uauauaauuuguaaaagcaccu

SEQ ID NO: 84341 - RNA, 22 nt, Human
uauauccauaggcugugccuag

SEQ ID NO: 84342 - RNA, 22 nt, Human
uauaucuaaguguauguaagag

SEQ ID NO: 84343 - RNA, 22 nt, Human
uauaugcaaugaggugggagua

SEQ ID NO: 84344 - RNA, 20 nt, Human
uauaugcagccaacacuccc

SEQ ID NO: 84345 - RNA, 22 nt, Human
uauaugcagugugucauucaag

SEQ ID NO: 84346 - RNA, 22 nt, Human
uauaugcuugggaaaugguaga

SEQ ID NO: 84347 - RNA, 22 nt, Human
uauauguaagcuauguaagagu

SEQ ID NO: 84348 - RNA, 17 nt, Human
uauauguaugccucucc

SEQ ID NO: 84349 - RNA, 22 nt, Human
uauauguugauacuaauucugg

SEQ ID NO: 84350 - RNA, 22 nt, Human
uauauuaaagugcuuugcagug

SEQ ID NO: 84351 - RNA, 22 nt, Human
uauauuaacuugugauccugga

SEQ ID NO: 84352 - RNA, 22 nt, Human
uauauuauaagcccuuucagaa

SEQ ID NO: 84353 - RNA, 22 nt, Human
uauauuaucauaaaaccauuca

SEQ ID NO: 84354 - RNA, 22 nt, Human
uauauucacuuguguccaacca

SEQ ID NO: 84355 - RNA, 22 nt, Human
uauauucauuuuaaagccaucu

SEQ ID NO: 84356 - RNA, 22 nt, Human
uauauucuauuguaccucuccu

SEQ ID NO: 84357 - RNA, 22 nt, Human
uauauugaccaguacaauuggu

SEQ ID NO: 84358 - RNA, 22 nt, Human
uauauugucucugccuugucug

SEQ ID NO: 84359 - RNA, 22 nt, Human
uauauuguuggugggaauauaa

SEQ ID NO: 84360 - RNA, 22 nt, Human
uauauuuaauccuagagccauu

SEQ ID NO: 84361 - RNA, 22 nt, Human
uauauuugcuaaaugugugcaa

SEQ ID NO: 84362 - RNA, 22 nt, Human
ugccugucuuggaguccuggcc

SEQ ID NO: 84363 - RNA, 22 nt, Human
ugccugugaaaacccugggguu

SEQ ID NO: 84364 - RNA, 19 nt, Human
ugccuguggcgagcaucuu

SEQ ID NO: 84365 - RNA, 22 nt, Human
ugccugugggugaugauuugau

SEQ ID NO: 84366 - RNA, 22 nt, Human
ugccuguguggucugcgcauua

SEQ ID NO: 84367 - RNA, 22 nt, Human
ugccuuaaaaaauucuaaacau

SEQ ID NO: 84368 - RNA, 22 nt, Human
ugccuuaauuucccuguuuugu

SEQ ID NO: 84369 - RNA, 22 nt, Human
ugccuuagaggauagugaagcc

SEQ ID NO: 84370 - RNA, 23 nt, Human
ugccuuaguuagcacauuucuaa

SEQ ID NO: 84371 - RNA, 22 nt, Human
ugccuuccuggagcugaaggcu

SEQ ID NO: 84372 - RNA, 22 nt, Human
ugccuucucccuuggacccuga

SEQ ID NO: 84373 - RNA, 22 nt, Human
ugccuucucuucccugggagcu

SEQ ID NO: 84374 - RNA, 22 nt, Human
ugccuugaacauaguggacagu

SEQ ID NO: 84375 - RNA, 22 nt, Human
ugccuugcuggaugucaguuuu

SEQ ID NO: 84376 - RNA, 20 nt, Human
ugccuugggacagugccugu

SEQ ID NO: 84377 - RNA, 22 nt, Human
ugccuugggagccagcaugcca

SEQ ID NO: 84378 - RNA, 22 nt, Human
ugccuuggugcuucuucaugug

SEQ ID NO: 84379 - RNA, 22 nt, Human
ugccuuuaaaaaggaagucauu

SEQ ID NO: 84380 - RNA, 22 nt, Human
ugccuuuaaccagucuagacag

SEQ ID NO: 84381 - RNA, 22 nt, Human
ugccuuuuccagcuuccaggag

SEQ ID NO: 84382 - RNA, 22 nt, Human
ugccuuuuccaguuccuagaag

SEQ ID NO: 84383 - RNA, 22 nt, Human
ugcgauggcguagacaaauccc

SEQ ID NO: 84384 - RNA, 17 nt, Human
ugcgaugucuguguuug

SEQ ID NO: 84385 - RNA, 22 nt, Human
ugcgccucuaaucucgggcguc

SEQ ID NO: 84386 - RNA, 22 nt, Human
ugcggaaggcagcgcagggugg

SEQ ID NO: 84387 - RNA, 16 nt, Human
ugcggcaacuugcggc

SEQ ID NO: 84388 - RNA, 22 nt, Human
ugcggcaggagaagguguuaug

SEQ ID NO: 84389 - RNA, 22 nt, Human
ugcgggucaucagggagaacgu

SEQ ID NO: 84390 - RNA, 22 nt, Human
ugcguugcgcuccugcagcagg

SEQ ID NO: 84391 - RNA, 22 nt, Human
ugcuaaagcaaacugugcuacu

SEQ ID NO: 84392 - RNA, 22 nt, Human
ugcuaacuauuccuaaagauca

SEQ ID NO: 84393 - RNA, 22 nt, Human
ugcuaagucacucaagaccucu

SEQ ID NO: 84394 - RNA, 22 nt, Human
ugcuaaguucugcaaaagauaa

SEQ ID NO: 84395 - RNA, 22 nt, Human
ugcuaauaaacuccaggcugag

SEQ ID NO: 84396 - RNA, 22 nt, Human
ugcuacauaggauagcucaaau

SEQ ID NO: 84397 - RNA, 22 nt, Human
ugcuacaugcacugugaucuag

SEQ ID NO: 84398 - RNA, 22 nt, Human
ugcuaccuuuuuuauuaaauga

SEQ ID NO: 84399 - RNA, 19 nt, Human
ugcuagaaauucugugacu

SEQ ID NO: 84400 - RNA, 22 nt, Human
ugcuagaagauagcuagaagau

SEQ ID NO: 84401 - RNA, 22 nt, Human
ugcuagaauaccuaccuggagg

SEQ ID NO: 84402 - RNA, 22 nt, Human
ugcuagaauuagguuaaacaaa

SEQ ID NO: 84403 - RNA, 22 nt, Human
ugcuagcacugugcagucuacg

SEQ ID NO: 84404 - RNA, 22 nt, Human
ugcuagggauguagcagugaag

SEQ ID NO: 84405 - RNA, 22 nt, Human
ugcuaggggucagcaccauauc

SEQ ID NO: 84406 - RNA, 22 nt, Human
ugcuaggugcuccucccuaauu

SEQ ID NO: 84407 - RNA, 22 nt, Human
ugcuagugugugagauguucaa

SEQ ID NO: 84408 - RNA, 22 nt, Human
ugcuauauaauggaauuucuaa

SEQ ID NO: 84409 - RNA, 22 nt, Human
ugcuaucuaggcaagguggucc

SEQ ID NO: 84410 - RNA, 22 nt, Human
ugcuaucucuauauccauuuau

SEQ ID NO: 84411 - RNA, 22 nt, Human
ugcuaugugacugcuucagauu

SEQ ID NO: 84412 - RNA, 22 nt, Human
ugcuauuuaacuuuuaugugua

SEQ ID NO: 84413 - RNA, 21 nt, Human
ugcuauuuaauuuuucuguuc

SEQ ID NO: 84414 - RNA, 22 nt, Human
ugcuauuucuaucucauuuaaa

SEQ ID NO: 84415 - RNA, 22 nt, Human
ugcuauuuggcacuuuugaccu

SEQ ID NO: 84416 - RNA, 22 nt, Human
ugcucaacagauauguaacaug

SEQ ID NO: 84417 - RNA, 22 nt, Human
ugcucacugaacucuugcuguc

SEQ ID NO: 84418 - RNA, 22 nt, Human
ugcucagaaacgaggugcagcc

SEQ ID NO: 84419 - RNA, 22 nt, Human
ugcucagagcuccagcucuccu

SEQ ID NO: 84420 - RNA, 22 nt, Human
ugcucagcaaaaagcuugugag

SEQ ID NO: 84421 - RNA, 22 nt, Human
ugcucagcagucaaggucauag

SEQ ID NO: 84422 - RNA, 22 nt, Human
ugcucagcgccaaagcugaugg

SEQ ID NO: 84423 - RNA, 19 nt, Human
ugcucagcuccugugaguc

SEQ ID NO: 84424 - RNA, 22 nt, Human
ugcucaggacaguggaaccuaa

SEQ ID NO: 84425 - RNA, 22 nt, Human
ugcucaggagcuuagagcacag

SEQ ID NO: 84426 - RNA, 22 nt, Human
ugcucaguauagaaaaugauau

SEQ ID NO: 84427 - RNA, 22 nt, Human
ugcucaguuccaugaguggagu

SEQ ID NO: 84428 - RNA, 22 nt, Human
ugcucaucaacaugaugaucau

SEQ ID NO: 84429 - RNA, 22 nt, Human
ugcucaugcuggggacagaugu

SEQ ID NO: 84430 - RNA, 22 nt, Human
ugcucauuaggacugcaaauuc

SEQ ID NO: 84431 - RNA, 22 nt, Human
ugcucauuggcgaucugaggga

SEQ ID NO: 84432 - RNA, 22 nt, Human
ugcuccagccuaugcucuccgg

SEQ ID NO: 84433 - RNA, 23 nt, Human
ugcuccagccucuuugauagugu

SEQ ID NO: 84434 - RNA, 22 nt, Human
ugcuccaggccgccuggggcug

SEQ ID NO: 84435 - RNA, 19 nt, Human
ugcuccaggccuugccgca

SEQ ID NO: 84436 - RNA, 23 nt, Human
ugcuccagguacagaacuccagg

SEQ ID NO: 84437 - RNA, 22 nt, Human
ugcuccagugagcuggccaucc

SEQ ID NO: 84438 - RNA, 22 nt, Human
uauguacaucuugagcaaugaa

SEQ ID NO: 84439 - RNA, 21 nt, Human
uauguagacucguuagaaugc

SEQ ID NO: 84440 - RNA, 22 nt, Human
uauguagagauaaaauccaaau

SEQ ID NO: 84441 - RNA, 22 nt, Human
uauguagauuucucuguuuuuc

SEQ ID NO: 84442 - RNA, 22 nt, Human
uauguagcaauagcaucauacu

SEQ ID NO: 84443 - RNA, 22 nt, Human
uauguaguacuuagugcauaca

SEQ ID NO: 84444 - RNA, 22 nt, Human
uauguauauauguuggguagaa

SEQ ID NO: 84445 - RNA, 22 nt, Human
uauguauauguguguugacaac

SEQ ID NO: 84446 - RNA, 22 nt, Human
uauguaucuguucaucaguuaa

SEQ ID NO: 84447 - RNA, 23 nt, Human
uauguauguauguuuguauggaa

SEQ ID NO: 84448 - RNA, 22 nt, Human
uauguauuagagcuccaugagg

SEQ ID NO: 84449 - RNA, 22 nt, Human
uaugucacauuguaacagugug

SEQ ID NO: 84450 - RNA, 23 nt, Human
uaugucaugagcauauugaaugu

SEQ ID NO: 84451 - RNA, 22 nt, Human
uaugucugaaucuuauuuaaau

SEQ ID NO: 84452 - RNA, 22 nt, Human
uaugucuuacuacagcaauuaa

SEQ ID NO: 84453 - RNA, 22 nt, Human
uaugucuuuuucucacuauagu

SEQ ID NO: 84454 - RNA, 22 nt, Human
uaugugacaaaaguaaacugca

SEQ ID NO: 84455 - RNA, 22 nt, Human
uaugugcaaauuaauugcuaga

SEQ ID NO: 84456 - RNA, 22 nt, Human
uaugugcacauuagagagaugg

SEQ ID NO: 84457 - RNA, 22 nt, Human
uaugugcagcacuugccauuac

SEQ ID NO: 84458 - RNA, 22 nt, Human
uaugugcaggggcaggagcuca

SEQ ID NO: 84459 - RNA, 20 nt, Human
uaugugcaguuugguuuauc

SEQ ID NO: 84460 - RNA, 22 nt, Human
uaugugcaugcugacuugagga

SEQ ID NO: 84461 - RNA, 22 nt, Human
uaugugcauuaucuaguucauu

SEQ ID NO: 84462 - RNA, 22 nt, Human
uauguguaagcuguuuaucuuu

SEQ ID NO: 84463 - RNA, 22 nt, Human
uauguguacucguuaaauauuu

SEQ ID NO: 84464 - RNA, 22 nt, Human
uauguguauaccuauacaugug

SEQ ID NO: 84465 - RNA, 22 nt, Human
uauguguauguacauacauaca

SEQ ID NO: 84466 - RNA, 22 nt, Human
uaugugucaaaccauucaucug

SEQ ID NO: 84467 - RNA, 22 nt, Human
uauguguccuguuaccggcagc

SEQ ID NO: 84468 - RNA, 16 nt, Human
uaugugucucaucuac

SEQ ID NO: 84469 - RNA, 22 nt, Human
uaugugucugucgugcauaaau

SEQ ID NO: 84470 - RNA, 18 nt, Human
uaugugucuguuacaacu

SEQ ID NO: 84471 - RNA, 22 nt, Human
uaugugugcauguauacauuaa

SEQ ID NO: 84472 - RNA, 22 nt, Human
uaugugugcuuuuuccaugcau

SEQ ID NO: 84473 - RNA, 19 nt, Human
uauguguguguauuuacau

SEQ ID NO: 84474 - RNA, 17 nt, Human
uauguguguguuuauac

SEQ ID NO: 84475 - RNA, 17 nt, Human
uauguguguuugcagca

SEQ ID NO: 84476 - RNA, 22 nt, Human
uauguguuauuugguauacauu

SEQ ID NO: 84477 - RNA, 22 nt, Human
uauguuacucacauguucuugc

SEQ ID NO: 84478 - RNA, 22 nt, Human
uauguucaugcuuaugcagaau

SEQ ID NO: 84479 - RNA, 22 nt, Human
uauguucuaaccuugucuuucc

SEQ ID NO: 84480 - RNA, 22 nt, Human
uauguucuuggaaaugaagcuu

SEQ ID NO: 84481 - RNA, 22 nt, Human
uauguugcaccaaccuaauaau

SEQ ID NO: 84482 - RNA, 22 nt, Human
uauguuuaaauguauguguaug

SEQ ID NO: 84483 - RNA, 22 nt, Human
uauguuuacgcugguagaauua

SEQ ID NO: 84484 - RNA, 22 nt, Human
uauguuucaucaggcauggagu

SEQ ID NO: 84485 - RNA, 22 nt, Human
uauguuuguuaucacaacuagg

SEQ ID NO: 84486 - RNA, 22 nt, Human
uauuaaagagagaaucaucauc

SEQ ID NO: 84487 - RNA, 22 nt, Human
uauuaaauauaucuguuaguug

SEQ ID NO: 84488 - RNA, 22 nt, Human
uauuaauaugugugugcaugua

SEQ ID NO: 84489 - RNA, 22 nt, Human
uauuaauucuugccaauucucc

SEQ ID NO: 84490 - RNA, 22 nt, Human
uauuaauuuaaucuccauggua

SEQ ID NO: 84491 - RNA, 22 nt, Human
uauuacaaauuauaaugggaga

SEQ ID NO: 84492 - RNA, 22 nt, Human
uauuacaauuuacauugcacuu

SEQ ID NO: 84493 - RNA, 22 nt, Human
uauuacacagugaaagcaugga

SEQ ID NO: 84494 - RNA, 23 nt, Human
uauuagcaauucccacagagcag

SEQ ID NO: 84495 - RNA, 22 nt, Human
uauuagcagacaagcugcugga

SEQ ID NO: 84496 - RNA, 17 nt, Human
uauuagcuagcuuccag

SEQ ID NO: 84497 - RNA, 22 nt, Human
uauuagcuguguaacucugguu

SEQ ID NO: 84498 - RNA, 18 nt, Human
uauuccugauucaucuuu

SEQ ID NO: 84499 - RNA, 22 nt, Human
uauuccugggccccauuccaga

SEQ ID NO: 84500 - RNA, 22 nt, Human
uauuccuggguuccagcccaga

SEQ ID NO: 84501 - RNA, 22 nt, Human
uauuccuggucccuaccacaga

SEQ ID NO: 84502 - RNA, 22 nt, Human
uauucuagaaguccaccagucu

SEQ ID NO: 84503 - RNA, 22 nt, Human
uauucucagcaacacacaugga

SEQ ID NO: 84504 - RNA, 22 nt, Human
uauucugcuucccguggcacaa

SEQ ID NO: 84505 - RNA, 19 nt, Human
uauucuguuaaccuuuguc

SEQ ID NO: 84506 - RNA, 22 nt, Human
uauucuuguaccuuaaaugauu

SEQ ID NO: 84507 - RNA, 22 nt, Human
uauugaaaugaaugacagugau

SEQ ID NO: 84508 - RNA, 22 nt, Human
uauugaaauucuucauguccuc

SEQ ID NO: 84509 - RNA, 22 nt, Human
uauugaauuagacccuaaaaug

SEQ ID NO: 84510 - RNA, 22 nt, Human
uauugacaauaggcaacugagg

SEQ ID NO: 84511 - RNA, 22 nt, Human
uauugacaggugccugcagaca

SEQ ID NO: 84512 - RNA, 22 nt, Human
uauugacagugacuauugguag

SEQ ID NO: 84513 - RNA, 22 nt, Human
uauugacauuuuuauagcuuga

SEQ ID NO: 84514 - RNA, 22 nt, Human
uauugaguuacagaaaauacuu

SEQ ID NO: 84515 - RNA, 22 nt, Human
uauugaucuggauauuuagaca

SEQ ID NO: 84516 - RNA, 22 nt, Human
uauugauucugucccaaguuga

SEQ ID NO: 84517 - RNA, 22 nt, Human
uauugcaaguggcauaaaauuu

SEQ ID NO: 84518 - RNA, 22 nt, Human
uauugcaauuggcagagugcua

SEQ ID NO: 84519 - RNA, 22 nt, Human
uauugcaauuuggcuaaagaau

SEQ ID NO: 84520 - RNA, 23 nt, Human
uauugcacacauagaaacauaga

SEQ ID NO: 84521 - RNA, 22 nt, Human
uauugcagacaaaaugagcuac

SEQ ID NO: 84522 - RNA, 22 nt, Human
uauugcauaaaaucagguuaga

SEQ ID NO: 84523 - RNA, 21 nt, Human
uauugcauaccaugaaucuga

SEQ ID NO: 84524 - RNA, 22 nt, Human
uauugcauacuuaaauuuccgg

SEQ ID NO: 84525 - RNA, 22 nt, Human
uauugcauagaaggaaggaguu

SEQ ID NO: 84526 - RNA, 22 nt, Human
uauugcaucaguaauuuagugu

SEQ ID NO: 84527 - RNA, 22 nt, Human
uauugcaucauccugcaggggu

SEQ ID NO: 84528 - RNA, 22 nt, Human
uauugcauuaugguaggaaagg

SEQ ID NO: 84529 - RNA, 22 nt, Human
uauugccaaaugucugcuggaa

SEQ ID NO: 84530 - RNA, 22 nt, Human
uauugccugaguguuucauaau

SEQ ID NO: 84531 - RNA, 22 nt, Human
uauugcugcuauugucaguuca

SEQ ID NO: 84532 - RNA, 22 nt, Human
uauugcuugggguacaagguau

SEQ ID NO: 84533 - RNA, 22 nt, Human
uauugcuuucaguugcuuugag

SEQ ID NO: 84534 - RNA, 22 nt, Human
uauuggaauaguuaaggaagau

SEQ ID NO: 84535 - RNA, 22 nt, Human
uauuggaugauucacuuggcag

SEQ ID NO: 84536 - RNA, 22 nt, Human
uauuggauuucugaaagaugag

SEQ ID NO: 84537 - RNA, 22 nt, Human
uauuggcagcaugagcuccugg

SEQ ID NO: 84538 - RNA, 22 nt, Human
uauuggucuucuguucccuauu

SEQ ID NO: 84539 - RNA, 22 nt, Human
uauuggugaugacuugaggcca

SEQ ID NO: 84540 - RNA, 22 nt, Human
uauuggugggggcagagagaga

SEQ ID NO: 84541 - RNA, 22 nt, Human
uauuguacauuucaaaguagcu

SEQ ID NO: 84542 - RNA, 22 nt, Human
uauuguaucuuaccacauguau

SEQ ID NO: 84543 - RNA, 22 nt, Human
uauuguauuaaggauucaagua

SEQ ID NO: 84544 - RNA, 22 nt, Human
uauugucaagaaguuuauagug

SEQ ID NO: 84545 - RNA, 21 nt, Human
uauugucaaucugcuuucaga

SEQ ID NO: 84546 - RNA, 22 nt, Human
uauugucacgucuuaauucuag

SEQ ID NO: 84547 - RNA, 22 nt, Human
uauugucucugcguuguucuau

SEQ ID NO: 84548 - RNA, 22 nt, Human
uauugucuguccgggucaaagc

SEQ ID NO: 84549 - RNA, 22 nt, Human
uauugugaauuuggaagcaaug

SEQ ID NO: 84550 - RNA, 20 nt, Human
uauugugauagguguuaauc

SEQ ID NO: 84551 - RNA, 22 nt, Human
uauugugccagguaauguguuc

SEQ ID NO: 84552 - RNA, 22 nt, Human
uauuguucuucacuggucuuau

SEQ ID NO: 84553 - RNA, 22 nt, Human
uauuuaaaauagugcuccagca

SEQ ID NO: 84554 - RNA, 22 nt, Human
uauuuaauaaaacuauggcaug

SEQ ID NO: 84555 - RNA, 22 nt, Human
uauuuaauuugcucauugugau

SEQ ID NO: 84556 - RNA, 22 nt, Human
uauuuagaacagacaauagaaa

SEQ ID NO: 84557 - RNA, 22 nt, Human
uauuuagaaugcguguacgugu

SEQ ID NO: 84558 - RNA, 22 nt, Human
uauuuaguuaucuuucauaaaa

SEQ ID NO: 84559 - RNA, 21 nt, Human
uauuuaguuuuacaaaugugg

SEQ ID NO: 84560 - RNA, 22 nt, Human
uauuuauaaucugccaaagaga

SEQ ID NO: 84561 - RNA, 22 nt, Human
uauuuauaccaggugaucggag

SEQ ID NO: 84562 - RNA, 22 nt, Human
uauuuauauucugccuucugcu

SEQ ID NO: 84563 - RNA, 22 nt, Human
uauuuaucaagguaggagaaua

SEQ ID NO: 84564 - RNA, 21 nt, Human
uauuuaucucaggcuaucuuu

SEQ ID NO: 84565 - RNA, 22 nt, Human
uauuuaugucucugcagagaau

SEQ ID NO: 84566 - RNA, 22 nt, Human
uauuuauguggaccauaagccu

SEQ ID NO: 84567 - RNA, 22 nt, Human
uauuuauucuuuguacugccuu

SEQ ID NO: 84568 - RNA, 22 nt, Human
uauuucaacguaugaaaagcug

SEQ ID NO: 84569 - RNA, 22 nt, Human
uauuucacauaccacagagugu

SEQ ID NO: 84570 - RNA, 22 nt, Human
uauuucacaucuaugaagugag

SEQ ID NO: 84571 - RNA, 22 nt, Human
uauuucaccuaaaagugucaaa

SEQ ID NO: 84572 - RNA, 22 nt, Human
uauuucaggcuauauuucuugu

SEQ ID NO: 84573 - RNA, 22 nt, Human
uauuucagggagaauaaauuug

SEQ ID NO: 84574 - RNA, 22 nt, Human
uauuucagguauggugugaaau

SEQ ID NO: 84575 - RNA, 22 nt, Human
uauuucagucacuucuucucug

SEQ ID NO: 84576 - RNA, 22 nt, Human
uauuucaugugcaccauaauuc

SEQ ID NO: 84577 - RNA, 21 nt, Human
uauuuccaacccuuuauccuu

SEQ ID NO: 84578 - RNA, 22 nt, Human
uauuuccacaccuuuugaaucu

SEQ ID NO: 84579 - RNA, 18 nt, Human
uauuucccaauggaaaca

SEQ ID NO: 84580 - RNA, 22 nt, Human
uauuuccuugagacggagucuc

SEQ ID NO: 84581 - RNA, 22 nt, Human
uauuucuauuccccaggcaagu

SEQ ID NO: 84582 - RNA, 22 nt, Human
uauuucugagaaccaacuuacc

SEQ ID NO: 84583 - RNA, 22 nt, Human
uauuucuucgggauucaagcua

SEQ ID NO: 84584 - RNA, 22 nt, Human
uauuucuugaguggucaguuuc

SEQ ID NO: 84585 - RNA, 22 nt, Human
uauuugaagacagggucuuuaa

SEQ ID NO: 84586 - RNA, 22 nt, Human
uauuugaaggcauacauuuuga

SEQ ID NO: 84587 - RNA, 22 nt, Human
uauuugaugguucuaaaacagc

SEQ ID NO: 84588 - RNA, 22 nt, Human
uauuugcaacauaaaacucuga

SEQ ID NO: 84589 - RNA, 22 nt, Human
uauuugcuccuuaggcauauuu

SEQ ID NO: 84590 - RNA, 22 nt, Human
uauuugcuuggaaaccuaaucc

SEQ ID NO: 84591 - RNA, 22 nt, Human
uauuugcuuugcuuuauagaga

SEQ ID NO: 84592 - RNA, 22 nt, Human
uauuuggaaacaauucacaugc

SEQ ID NO: 84593 - RNA, 23 nt, Human
uauuuggaaagagggaagaagac

SEQ ID NO: 84594 - RNA, 22 nt, Human
uauuuggaaaggacauguaagu

SEQ ID NO: 84595 - RNA, 22 nt, Human
uauuuggaaauagggcuuugua

SEQ ID NO: 84596 - RNA, 22 nt, Human
uauuuggaauagcuugcuaaug

SEQ ID NO: 84597 - RNA, 22 nt, Human
uauuuggacaccaaguagaagu

SEQ ID NO: 84598 - RNA, 22 nt, Human
uauuuggagauaagauuuuuag

SEQ ID NO: 84599 - RNA, 22 nt, Human
uauuuggagauaagggcuuuaa

SEQ ID NO: 84600 - RNA, 22 nt, Human
uauuugguggcugauuaucuuu

SEQ ID NO: 84601 - RNA, 22 nt, Human
uauuuguauguguguacauaua

SEQ ID NO: 84602 - RNA, 22 nt, Human
uauuugucaagagagggggaua

SEQ ID NO: 84603 - RNA, 22 nt, Human
uauuugucaccuauggcugucc

SEQ ID NO: 84604 - RNA, 22 nt, Human
uauuugucagcuguugaguuca

SEQ ID NO: 84605 - RNA, 22 nt, Human
uauuuguccagguaaauuucag

SEQ ID NO: 84606 - RNA, 22 nt, Human
uauuuguugaauaccccugucu

SEQ ID NO: 84607 - RNA, 22 nt, Human
uauuuguuucuaguggcagcaa

SEQ ID NO: 84608 - RNA, 22 nt, Human
uauuuuaaagugaagggucuug

SEQ ID NO: 84609 - RNA, 22 nt, Human
ucaugcauauuuguaguaguuc

SEQ ID NO: 84610 - RNA, 22 nt, Human
ucaugccaaaauccaguggcuu

SEQ ID NO: 84611 - RNA, 22 nt, Human
ucaugccaauuucugcauggcu

SEQ ID NO: 84612 - RNA, 22 nt, Human
ucaugccauccacaucuguuuc

SEQ ID NO: 84613 - RNA, 22 nt, Human
ucaugcucugguuuagcuguuu

SEQ ID NO: 84614 - RNA, 22 nt, Human
ucaugcugaguccuggcuuugu

SEQ ID NO: 84615 - RNA, 22 nt, Human
ucaugcuuuguuaauguggcac

SEQ ID NO: 84616 - RNA, 22 nt, Human
ucauggaaacaaugcggaaaaa

SEQ ID NO: 84617 - RNA, 23 nt, Human
ucauggaacugggcaaucuugaa

SEQ ID NO: 84618 - RNA, 22 nt, Human
ucauggaagaaagguuuguuuc

SEQ ID NO: 84619 - RNA, 22 nt, Human
ucauggaaggaugcccugcaag

SEQ ID NO: 84620 - RNA, 22 nt, Human
ucauggaauagagcaguggcaa

SEQ ID NO: 84621 - RNA, 22 nt, Human
ucauggagacuuugagccuguu

SEQ ID NO: 84622 - RNA, 22 nt, Human
ucauggauuaaauuauuaaguu

SEQ ID NO: 84623 - RNA, 21 nt, Human
ucauggauuuucucugcuuuu

SEQ ID NO: 84624 - RNA, 22 nt, Human
ucauggcacaugcccuccaggg

SEQ ID NO: 84625 - RNA, 20 nt, Human
ucauggcagccacccacagg

SEQ ID NO: 84626 - RNA, 22 nt, Human
ucauggcagcccuuuacuagag

SEQ ID NO: 84627 - RNA, 22 nt, Human
ucauggcaguuuaauaaguggu

SEQ ID NO: 84628 - RNA, 21 nt, Human
ucauggccagcaaguggcaga

SEQ ID NO: 84629 - RNA, 22 nt, Human
ucauggcucuaaagacauagau

SEQ ID NO: 84630 - RNA, 22 nt, Human
ucauggcuggaagcucaguuag

SEQ ID NO: 84631 - RNA, 22 nt, Human
ucauggcuucaaggaagcaggc

SEQ ID NO: 84632 - RNA, 22 nt, Human
ucauggggugaauuaguaugcu

SEQ ID NO: 84633 - RNA, 22 nt, Human
ucauguaaauguggaugcuucc

SEQ ID NO: 84634 - RNA, 22 nt, Human
ucauguauugaaaagcauuuua

SEQ ID NO: 84635 - RNA, 22 nt, Human
ucaugucagcuguugaugugca

SEQ ID NO: 84636 - RNA, 22 nt, Human
ucaugucccguugcuggcugcc

SEQ ID NO: 84637 - RNA, 18 nt, Human
ucaugucucacaggugau

SEQ ID NO: 84638 - RNA, 22 nt, Human
ucaugucucuaugugccuauua

SEQ ID NO: 84639 - RNA, 22 nt, Human
ucaugugacaggcacuguucug

SEQ ID NO: 84640 - RNA, 22 nt, Human
ucauguuaucagacacagagua

SEQ ID NO: 84641 - RNA, 22 nt, Human
ucauguuuggaguuugcucacu

SEQ ID NO: 84642 - RNA, 22 nt, Human
ucauguuuuaaugccuuuuucu

SEQ ID NO: 84643 - RNA, 22 nt, Human
ucauuaauaagucuaacucucc

SEQ ID NO: 84644 - RNA, 22 nt, Human
ucauuaaucccgggguccaggg

SEQ ID NO: 84645 - RNA, 22 nt, Human
ucauuacaagauuuccaauuug

SEQ ID NO: 84646 - RNA, 22 nt, Human
ucauuacaguguuuauaugucu

SEQ ID NO: 84647 - RNA, 18 nt, Human
ucauuagggauugcaaag

SEQ ID NO: 84648 - RNA, 22 nt, Human
ucauuauccuaguaucuugaau

SEQ ID NO: 84649 - RNA, 22 nt, Human
ucauuauuugcuuuaguuaugu

SEQ ID NO: 84650 - RNA, 22 nt, Human
ucauuauuuuggacuggagugu

SEQ ID NO: 84651 - RNA, 18 nt, Human
ucauucaaagucuacuga

SEQ ID NO: 84652 - RNA, 23 nt, Human
ucauucaaggcugguaucuuuca

SEQ ID NO: 84653 - RNA, 21 nt, Human
ucauucacaggguauuguaua

SEQ ID NO: 84654 - RNA, 22 nt, Human
ucauucagguugggcaaguguc

SEQ ID NO: 84655 - RNA, 22 nt, Human
ucauucauacucuuuucuauua

SEQ ID NO: 84656 - RNA, 22 nt, Human
uccaggcccugggaugggagca

SEQ ID NO: 84657 - RNA, 22 nt, Human
uccaggccgcaggggcagcccc

SEQ ID NO: 84658 - RNA, 22 nt, Human
uccaggccuugacaggucaguu

SEQ ID NO: 84659 - RNA, 20 nt, Human
uccaggccuuguucucagau

SEQ ID NO: 84660 - RNA, 22 nt, Human
uccaggcuagagugcaguggcc

SEQ ID NO: 84661 - RNA, 22 nt, Human
uccaggcuagguuuacaggaca

SEQ ID NO: 84662 - RNA, 19 nt, Human
uccaggcugagagucagcu

SEQ ID NO: 84663 - RNA, 22 nt, Human
uccaggcugcaaggccacaggg

SEQ ID NO: 84664 - RNA, 22 nt, Human
uccaggcugccacagugcaacg

SEQ ID NO: 84665 - RNA, 22 nt, Human
uccaggcuggaaaugucaaacu

SEQ ID NO: 84666 - RNA, 21 nt, Human
uccaggcuggaaggggcguug

SEQ ID NO: 84667 - RNA, 22 nt, Human
uccaggcuggagugcaguggca

SEQ ID NO: 84668 - RNA, 23 nt, Human
uccaggcugggacuucaacuggc

SEQ ID NO: 84669 - RNA, 22 nt, Human
uccagggagcaagucaggccgg

SEQ ID NO: 84670 - RNA, 22 nt, Human
uccagggagucaaaugaacuac

SEQ ID NO: 84671 - RNA, 22 nt, Human
uccagggaugccagccauguug

SEQ ID NO: 84672 - RNA, 20 nt, Human
uccagggcaaacucaucacc

SEQ ID NO: 84673 - RNA, 22 nt, Human
uccagggcaugcucagacucag

SEQ ID NO: 84674 - RNA, 22 nt, Human
uccagggcauggggagagagug

SEQ ID NO: 84675 - RNA, 22 nt, Human
uccagggccaagucauggaacc

SEQ ID NO: 84676 - RNA, 20 nt, Human
uccagggcccuggcuccucu

SEQ ID NO: 84677 - RNA, 22 nt, Human
uccagggcgugugugaaggaaa

SEQ ID NO: 84678 - RNA, 20 nt, Human
uccagggcuagggagcucau

SEQ ID NO: 84679 - RNA, 22 nt, Human
uccagggcucauucccucugca

SEQ ID NO: 84680 - RNA, 22 nt, Human
uccagggcuggguuggcucagc

SEQ ID NO: 84681 - RNA, 22 nt, Human
uccagggcuugacagggugccu

SEQ ID NO: 84682 - RNA, 22 nt, Human
uccagggcuuggcugggacggu

SEQ ID NO: 84683 - RNA, 21 nt, Human
uccagggcuuugauucucuca

SEQ ID NO: 84684 - RNA, 22 nt, Human
uccaggggacacuguuucucca

SEQ ID NO: 84685 - RNA, 22 nt, Human
uccaggguugugggcuucagca

SEQ ID NO: 84686 - RNA, 22 nt, Human
uccagguagggaauaaauguca

SEQ ID NO: 84687 - RNA, 22 nt, Human
uccagguauuacuaaguguuaa

SEQ ID NO: 84688 - RNA, 22 nt, Human
uccaggucagacuucugugccc

SEQ ID NO: 84689 - RNA, 18 nt, Human
uccaggucccaggggaag

SEQ ID NO: 84690 - RNA, 22 nt, Human
uccaggucugugagcuaaaugg

SEQ ID NO: 84691 - RNA, 22 nt, Human
uccaggugacagagacaggaua

SEQ ID NO: 84692 - RNA, 19 nt, Human
uccagguggagagacaccc

SEQ ID NO: 84693 - RNA, 22 nt, Human
uccaggugggcugcacccaggc

SEQ ID NO: 84694 - RNA, 22 nt, Human
uccaguacugaagcuccuucaa

SEQ ID NO: 84695 - RNA, 22 nt, Human
uccagucacuucauuuuacaga

SEQ ID NO: 84696 - RNA, 22 nt, Human
uccaguccauggccucagucuu

SEQ ID NO: 84697 - RNA, 22 nt, Human
uccagucucuacucugagauaa

SEQ ID NO: 84698 - RNA, 22 nt, Human
uccagugaucuagggagcugga

SEQ ID NO: 84699 - RNA, 22 nt, Human
uccaguggugguuugaagggca

SEQ ID NO: 84700 - RNA, 22 nt, Human
uccaguguggaccccugcaguc

SEQ ID NO: 84701 - RNA, 22 nt, Human
uccaguguuuuucuucacaggu

SEQ ID NO: 84702 - RNA, 22 nt, Human
uccaguugccugucucugauua

SEQ ID NO: 84703 - RNA, 22 nt, Human
uccaguuugggugugagcugcg

SEQ ID NO: 84704 - RNA, 22 nt, Human
uccaguuugguucuguucucca

SEQ ID NO: 84705 - RNA, 18 nt, Human
uccaguuuucccagcauc

SEQ ID NO: 84706 - RNA, 22 nt, Human
uccaguuuugaauccugcuucu

SEQ ID NO: 84707 - RNA, 20 nt, Human
uccaguuuuggagacauucu

SEQ ID NO: 84708 - RNA, 19 nt, Human
uccauaagcuuguguucau

SEQ ID NO: 84709 - RNA, 22 nt, Human
uccauacaguccacacggugca

SEQ ID NO: 84710 - RNA, 22 nt, Human
uccauacauugaaauaccauuc

SEQ ID NO: 84711 - RNA, 22 nt, Human
uccauagaaugcaguguaaauu

SEQ ID NO: 84712 - RNA, 22 nt, Human
uccauaggaucugcuucauacu

SEQ ID NO: 84713 - RNA, 22 nt, Human
uccauauacaacuuaaucuuua

SEQ ID NO: 84714 - RNA, 22 nt, Human
uccaucagauucccuccugaga

SEQ ID NO: 84715 - RNA, 22 nt, Human
uccaucaggcucgugggcucuc

SEQ ID NO: 84716 - RNA, 22 nt, Human
uccauccacauuaacagauacg

SEQ ID NO: 84717 - RNA, 22 nt, Human
uccauccauguaggaagauggu

SEQ ID NO: 84718 - RNA, 18 nt, Human
uccauccucugcucuuca

SEQ ID NO: 84719 - RNA, 22 nt, Human
uccaucucaccugcacucugcg

SEQ ID NO: 84720 - RNA, 22 nt, Human
uccaucugcauuugguuucugu

SEQ ID NO: 84721 - RNA, 22 nt, Human
uccaucuggguggggagaagga

SEQ ID NO: 84722 - RNA, 22 nt, Human
uccaugacagcgugagaguuug

SEQ ID NO: 84723 - RNA, 22 nt, Human
uccaugacuaggaaaccaguuu

SEQ ID NO: 84724 - RNA, 17 nt, Human
uccaugagacaugaaga

SEQ ID NO: 84725 - RNA, 22 nt, Human
uccaugagagguaacuuuacaa

SEQ ID NO: 84726 - RNA, 22 nt, Human
uccaugaggcagggaggcuggc

SEQ ID NO: 84727 - RNA, 22 nt, Human
uccaugcaaacaguggcuagcu

SEQ ID NO: 84728 - RNA, 20 nt, Human
uccaugcaaauacagaguuu

SEQ ID NO: 84729 - RNA, 22 nt, Human
uccaugcagagaacugaaguac

SEQ ID NO: 84730 - RNA, 20 nt, Human
uccaugcaguuuccauacag

SEQ ID NO: 84731 - RNA, 22 nt, Human
uccaugccaggcagucgaugca

SEQ ID NO: 84732 - RNA, 22 nt, Human
uccauggagauggaugacugua

SEQ ID NO: 84733 - RNA, 22 nt, Human
uccaugguuucagucuggcugg

SEQ ID NO: 84734 - RNA, 22 nt, Human
uccaugugccaaggggcagagg

SEQ ID NO: 84735 - RNA, 22 nt, Human
uccauguggccagacacuggca

SEQ ID NO: 84736 - RNA, 22 nt, Human
uccauguugagaaugcuauaau

SEQ ID NO: 84737 - RNA, 20 nt, Human
uccauucagcauuguggaaa

SEQ ID NO: 84738 - RNA, 22 nt, Human
uccauucauucagguauuuagu

SEQ ID NO: 84739 - RNA, 22 nt, Human
uccauucauucauugaugaaca

SEQ ID NO: 84740 - RNA, 22 nt, Human
ucacccagacuugugaaugugu

SEQ ID NO: 84741 - RNA, 22 nt, Human
ucacccagauagugagcauagu

SEQ ID NO: 84742 - RNA, 22 nt, Human
ucacccagauuacauccuguca

SEQ ID NO: 84743 - RNA, 22 nt, Human
ucacccagcgggcgcacacucg

SEQ ID NO: 84744 - RNA, 22 nt, Human
ucacccaggcuggacugcagug

SEQ ID NO: 84745 - RNA, 22 nt, Human
ucacccaggcugguaugcagug

SEQ ID NO: 84746 - RNA, 22 nt, Human
ucacccagggacugugauggaa

SEQ ID NO: 84747 - RNA, 22 nt, Human
ucacccagguaauagcaguuug

SEQ ID NO: 84748 - RNA, 22 nt, Human
ucacccauccuggaugagauuc

SEQ ID NO: 84749 - RNA, 22 nt, Human
ucaccccuugugaaugcugcuc

SEQ ID NO: 84750 - RNA, 22 nt, Human
ucacccuuaguguacuaucaug

SEQ ID NO: 84751 - RNA, 22 nt, Human
ucacccuucccagcuguccgcc

SEQ ID NO: 84752 - RNA, 22 nt, Human
ucaccggcagacguggccugau

SEQ ID NO: 84753 - RNA, 22 nt, Human
ucaccuaauugaagucaggagu

SEQ ID NO: 84754 - RNA, 22 nt, Human
ucaccuguuggauguauacugu

SEQ ID NO: 84755 - RNA, 22 nt, Human
ucacuaagugccgaguuuaguu

SEQ ID NO: 84756 - RNA, 22 nt, Human
ucacuagcauuguugaaggacu

SEQ ID NO: 84757 - RNA, 23 nt, Human
ucacuagucaagugccuuugagu

SEQ ID NO: 84758 - RNA, 21 nt, Human
ucacuagugccuucugucauu

SEQ ID NO: 84759 - RNA, 22 nt, Human
ucacuauaauaugucaaaauac

SEQ ID NO: 84760 - RNA, 22 nt, Human
ucacucaaugguaucaggaggu

SEQ ID NO: 84761 - RNA, 22 nt, Human
ucacucagguucaugucuuugu

SEQ ID NO: 84762 - RNA, 22 nt, Human
ucacucaguuuuuggccucugc

SEQ ID NO: 84763 - RNA, 18 nt, Human
ucacucauagacaucuau

SEQ ID NO: 84764 - RNA, 22 nt, Human
ucacucucuaagcaugacagac

SEQ ID NO: 84765 - RNA, 22 nt, Human
ucacucugccuccauauuacua

SEQ ID NO: 84766 - RNA, 22 nt, Human
ucaggaguaaagacagaguucc

SEQ ID NO: 84767 - RNA, 22 nt, Human
ucaggaguacuggugucuacag

SEQ ID NO: 84768 - RNA, 22 nt, Human
ucaggagugauaccauuuguca

SEQ ID NO: 84769 - RNA, 21 nt, Human
ucaggaguggagagaauuggu

SEQ ID NO: 84770 - RNA, 22 nt, Human
ucaggaguugaaggggauccug

SEQ ID NO: 84771 - RNA, 22 nt, Human
ucaggaguuuggccuacagagg

SEQ ID NO: 84772 - RNA, 22 nt, Human
ucaggaucggccuuuuuuuaag

SEQ ID NO: 84773 - RNA, 22 nt, Human
ucaggaugaccacgagccucua

SEQ ID NO: 84774 - RNA, 22 nt, Human
ucaggaugagucaucaagcugc

SEQ ID NO: 84775 - RNA, 17 nt, Human
ucaggauguagcaguag

SEQ ID NO: 84776 - RNA, 22 nt, Human
ucaggauuauuucaguggcuuu

SEQ ID NO: 84777 - RNA, 22 nt, Human
ucaggcaaggcuggucucauac

SEQ ID NO: 84778 - RNA, 22 nt, Human
ucaggcagaggauggggagcgu

SEQ ID NO: 84779 - RNA, 22 nt, Human
ucaggcagaguuaauuugcucc

SEQ ID NO: 84780 - RNA, 22 nt, Human
ucaggcagaugcagggauggau

SEQ ID NO: 84781 - RNA, 22 nt, Human
ucaggcaggaagccccugcaca

SEQ ID NO: 84782 - RNA, 21 nt, Human
ucaggcaggucccacugaaca

SEQ ID NO: 84783 - RNA, 22 nt, Human
ucaggcagguggcuggcuaugg

SEQ ID NO: 84784 - RNA, 22 nt, Human
ucaggcauggcucuuccucagg

SEQ ID NO: 84785 - RNA, 22 nt, Human
ucaggccuagaacacagcagau

SEQ ID NO: 84786 - RNA, 22 nt, Human
ucaggccucagaaauugcacug

SEQ ID NO: 84787 - RNA, 22 nt, Human
ucaggccucagcagcccacagg

SEQ ID NO: 84788 - RNA, 22 nt, Human
ucaggccugcccugaaagcaca

SEQ ID NO: 84789 - RNA, 22 nt, Human
ucaggccugcuguaugauggau

SEQ ID NO: 84790 - RNA, 16 nt, Human
ucaggccuggacgagc

SEQ ID NO: 84791 - RNA, 22 nt, Human
ucaggccuuguccugaccuccu

SEQ ID NO: 84792 - RNA, 22 nt, Human
ucaggccuuucuucagagcuuc

SEQ ID NO: 84793 - RNA, 22 nt, Human
ucaggccuuugaacuuggagug

SEQ ID NO: 84794 - RNA, 22 nt, Human
ucaggcuacacucuuuucaugg

SEQ ID NO: 84795 - RNA, 22 nt, Human
ucaggcucagguuaggggccaa

SEQ ID NO: 84796 - RNA, 22 nt, Human
ucaggcugaaaggacuccaguu

SEQ ID NO: 84797 - RNA, 22 nt, Human
ucaggcugagaaaaucuggacc

SEQ ID NO: 84798 - RNA, 22 nt, Human
ucaggcugaggucaucugcauc

SEQ ID NO: 84799 - RNA, 22 nt, Human
ucaggcugcaucuguaagggug

SEQ ID NO: 84800 - RNA, 22 nt, Human
ucaggcugcuguacugugaaug

SEQ ID NO: 84801 - RNA, 18 nt, Human
ucaggcuggaaguuugcc

SEQ ID NO: 84802 - RNA, 21 nt, Human
ucaggcugucugcugguucca

SEQ ID NO: 84803 - RNA, 22 nt, Human
ucaggcuguggcuucaguucuu

SEQ ID NO: 84804 - RNA, 22 nt, Human
ucaggcuguuagccaccuccuc

SEQ ID NO: 84805 - RNA, 22 nt, Human
ucaggcuucacuccuguccaag

SEQ ID NO: 84806 - RNA, 22 nt, Human
ucaggcuuccaacaaugauguu

SEQ ID NO: 84807 - RNA, 22 nt, Human
ucaggcuuggugcuccagugcc

SEQ ID NO: 84808 - RNA, 22 nt, Human
ucaggcuuugaagucuagcugg

SEQ ID NO: 84809 - RNA, 22 nt, Human
ucaggcuuuuucucaaccucuu

SEQ ID NO: 84810 - RNA, 22 nt, Human
ucagggaaauucaagggagauu

SEQ ID NO: 84811 - RNA, 18 nt, Human
ucagggaagagaauauga

SEQ ID NO: 84812 - RNA, 22 nt, Human
ucagggaagagagaucuccuag

SEQ ID NO: 84813 - RNA, 18 nt, Human
ucagggaaucuuggccuu

SEQ ID NO: 84814 - RNA, 22 nt, Human
ucagggacaggaugggcauuuc

SEQ ID NO: 84815 - RNA, 22 nt, Human
ucagggacagggugcugcugcg

SEQ ID NO: 84816 - RNA, 22 nt, Human
ucagggaccccucugaguggag

SEQ ID NO: 84817 - RNA, 22 nt, Human
ucagggagagccugucugacgu

SEQ ID NO: 84818 - RNA, 22 nt, Human
ucagggagaggugagagccugu

SEQ ID NO: 84819 - RNA, 22 nt, Human
ucagggagauuuggggacucaa

SEQ ID NO: 84820 - RNA, 22 nt, Human
ucagggagggaccugaggcugg

SEQ ID NO: 84821 - RNA, 22 nt, Human
ucagggaguguuggcaggauca

SEQ ID NO: 84822 - RNA, 22 nt, Human
ucagggcacguuucugcaaugc

SEQ ID NO: 84823 - RNA, 22 nt, Human
ucagggcauccauugccuguug

SEQ ID NO: 84824 - RNA, 22 nt, Human
ucagggcauggcugcacuuggc

SEQ ID NO: 84825 - RNA, 20 nt, Human
ucagggcaugggacagcccc

SEQ ID NO: 84826 - RNA, 22 nt, Human
ucagggccacaacaccagaguc

SEQ ID NO: 84827 - RNA, 22 nt, Human
ucagggccacgcggaggugacg

SEQ ID NO: 84828 - RNA, 22 nt, Human
ucagggccaggacuaggaugag

SEQ ID NO: 84829 - RNA, 22 nt, Human
ucagggccaucuuuugccucaa

SEQ ID NO: 84830 - RNA, 19 nt, Human
ucagggccaugagcgccac

SEQ ID NO: 84831 - RNA, 22 nt, Human
ucagggcccuggacaacccucc

SEQ ID NO: 84832 - RNA, 22 nt, Human
ucagggcccuggcaggaaacag

SEQ ID NO: 84833 - RNA, 19 nt, Human
ucagggccgcagaggguac

SEQ ID NO: 84834 - RNA, 22 nt, Human
ucagggccugagcuuuuaauua

SEQ ID NO: 84835 - RNA, 23 nt, Human
ucagggcucacacguuuucuggc

SEQ ID NO: 84836 - RNA, 22 nt, Human
ucagggcucagcaucuggcauu

SEQ ID NO: 84837 - RNA, 22 nt, Human
ucagggcugacugcuacucucc

SEQ ID NO: 84838 - RNA, 22 nt, Human
ucagggcugcagaagaggcagg

SEQ ID NO: 84839 - RNA, 22 nt, Human
ucaggggcagcugugcuuugug

SEQ ID NO: 84840 - RNA, 22 nt, Human
ucaggggcccuucccucagcag

SEQ ID NO: 84841 - RNA, 22 nt, Human
ucaggggcuugaggugcauguc

SEQ ID NO: 84842 - RNA, 22 nt, Human
ucagguggccaaaugggagcgc

SEQ ID NO: 84843 - RNA, 22 nt, Human
ucagguggcuucggggaguggc

SEQ ID NO: 84844 - RNA, 22 nt, Human
ucagguguaucauggaguugaa

SEQ ID NO: 84845 - RNA, 22 nt, Human
ucaggugucuaucuaaccuggu

SEQ ID NO: 84846 - RNA, 22 nt, Human
ucaggugugaacuauuuggaaa

SEQ ID NO: 84847 - RNA, 23 nt, Human
ucaggugugcggacugcugaguc

SEQ ID NO: 84848 - RNA, 22 nt, Human
ucagguguggucaccacagggu

SEQ ID NO: 84849 - RNA, 22 nt, Human
ucaggugugugguggaaggcag

SEQ ID NO: 84850 - RNA, 22 nt, Human
ucagguguuucuggagaaguaa

SEQ ID NO: 84851 - RNA, 22 nt, Human
ucagguuuuucucaaaucaggu

SEQ ID NO: 84852 - RNA, 21 nt, Human
ucaguaaaaaaacuaccuaga

SEQ ID NO: 84853 - RNA, 22 nt, Human
ucaguaaaaccugcuuuuagug

SEQ ID NO: 84854 - RNA, 21 nt, Human
ucaguaaaccuaaagauugua

SEQ ID NO: 84855 - RNA, 22 nt, Human
ucaguaaaggcuagguuaugcu

SEQ ID NO: 84856 - RNA, 22 nt, Human
ucaguaaaucucuaauuggcau

SEQ ID NO: 84857 - RNA, 22 nt, Human
ucaguaacccugcuguucagag

SEQ ID NO: 84858 - RNA, 19 nt, Human
ucaguaacuuuuaagagga

SEQ ID NO: 84859 - RNA, 22 nt, Human
ucaguacagcuuagucuucuca

SEQ ID NO: 84860 - RNA, 23 nt, Human
ucaguacucugcuggguauagag

SEQ ID NO: 84861 - RNA, 22 nt, Human
ucaguacuucugcaucuuccag

SEQ ID NO: 84862 - RNA, 22 nt, Human
ucaguagcagaaagcaaugagu

SEQ ID NO: 84863 - RNA, 22 nt, Human
ucaguagcccuugaguucaugu

SEQ ID NO: 84864 - RNA, 22 nt, Human
ucaguauaauugcuggcacuga

SEQ ID NO: 84865 - RNA, 22 nt, Human
ucaguauuccuggaaauacaag

SEQ ID NO: 84866 - RNA, 22 nt, Human
ucagucaacauaaauccaaggu

SEQ ID NO: 84867 - RNA, 22 nt, Human
ucaguccaaugauuguaggaca

SEQ ID NO: 84868 - RNA, 22 nt, Human
ucaguccagcuccucauuuccc

SEQ ID NO: 84869 - RNA, 22 nt, Human
ucaguccauaggugggccugag

SEQ ID NO: 84870 - RNA, 22 nt, Human
ucagucccaagguccugaggug

SEQ ID NO: 84871 - RNA, 22 nt, Human
ucaguccuccacacaggcaccc

SEQ ID NO: 84872 - RNA, 18 nt, Human
ucaguccuccauagagcu

SEQ ID NO: 84873 - RNA, 22 nt, Human
ucaguccucucuggguuucuua

SEQ ID NO: 84874 - RNA, 22 nt, Human
ucaguccuuaucugguguucag

SEQ ID NO: 84875 - RNA, 20 nt, Human
uccugugugucucaucaacc

SEQ ID NO: 84876 - RNA, 22 nt, Human
uccuguguucaagucauucauu

SEQ ID NO: 84877 - RNA, 22 nt, Human
uccuguguugauagagaugguu

SEQ ID NO: 84878 - RNA, 19 nt, Human
uccuguuauggagcuuagg

SEQ ID NO: 84879 - RNA, 22 nt, Human
uccuguuuaggcuguggucugg

SEQ ID NO: 84880 - RNA, 22 nt, Human
uccuguuucuccugcaaaaucc

SEQ ID NO: 84881 - RNA, 22 nt, Human
ucaucugucuguucaacagccu

SEQ ID NO: 84882 - RNA, 22 nt, Human
ucaugaaaaauuuuccauguca

SEQ ID NO: 84883 - RNA, 22 nt, Human
ucaugaacauggaauaucuuuu

SEQ ID NO: 84884 - RNA, 22 nt, Human
ucaugaaguccaaacuaaagca

SEQ ID NO: 84885 - RNA, 22 nt, Human
ucaugacaacuauauuauucca

SEQ ID NO: 84886 - RNA, 22 nt, Human
ucaugacaaugguagccuguua

SEQ ID NO: 84887 - RNA, 22 nt, Human
ucaugacaggugaguuuuuagg

SEQ ID NO: 84888 - RNA, 22 nt, Human
ucaugacaugugaauugaauau

SEQ ID NO: 84889 - RNA, 22 nt, Human
ucaugacauucaggugcuacau

SEQ ID NO: 84890 - RNA, 18 nt, Human
ucaugagguagaggcugg

SEQ ID NO: 84891 - RNA, 23 nt, Human
ucaugaguggcugcggggcugag

SEQ ID NO: 84892 - RNA, 22 nt, Human
ucaugaguuuaagguuuaggcu

SEQ ID NO: 84893 - RNA, 22 nt, Human
ucaugauaauacaggccuucua

SEQ ID NO: 84894 - RNA, 22 nt, Human
ucaugauuuuucuuuacaguug

SEQ ID NO: 84895 - RNA, 22 nt, Human
ucaugcaacggcucgcugagcc

SEQ ID NO: 84896 - RNA, 22 nt, Human
ucaugcaaucucuuguucagga

SEQ ID NO: 84897 - RNA, 22 nt, Human
ucaugcaauguuaguuugaaag

SEQ ID NO: 84898 - RNA, 22 nt, Human
ucaugcaccucuccaugucccc

SEQ ID NO: 84899 - RNA, 22 nt, Human
ucaugcagagccagucaggaua

SEQ ID NO: 84900 - RNA, 22 nt, Human
ucaugcagauuuggagguauuu

SEQ ID NO: 84901 - RNA, 22 nt, Human
ucaugcaggacuuacgagagau

SEQ ID NO: 84902 - RNA, 22 nt, Human
ucaugcaguuacuguuaugcaa

SEQ ID NO: 84903 - RNA, 22 nt, Human
ucaugcaguuugaaguucaggg

SEQ ID NO: 84904 - RNA, 22 nt, Human
ucaugcaguuuugccaccuaag

SEQ ID NO: 84905 - RNA, 22 nt, Human
ucaugcaucugggcuggcuggu

SEQ ID NO: 84906 - RNA, 19 nt, Human
ucaugcauuucuaagugca

SEQ ID NO: 84907 - RNA, 22 nt, Human
ucaugccaaacugaacacaguu

SEQ ID NO: 84908 - RNA, 22 nt, Human
ucaugccacuuacaaaauaaug

SEQ ID NO: 84909 - RNA, 22 nt, Human
ucaugccaguuaaaggcuguga

SEQ ID NO: 84910 - RNA, 22 nt, Human
ucaugcccagagcaguaaauua

SEQ ID NO: 84911 - RNA, 22 nt, Human
ucaugcuaguuaagaacacaau

SEQ ID NO: 84912 - RNA, 22 nt, Human
ucaugcuauuucgaauguaaua

SEQ ID NO: 84913 - RNA, 22 nt, Human
ucaugcucaucauuagagugac

SEQ ID NO: 84914 - RNA, 22 nt, Human
ucaugcugaggaugcugugaag

SEQ ID NO: 84915 - RNA, 22 nt, Human
ucaugcuuaaaagacacuugag

SEQ ID NO: 84916 - RNA, 22 nt, Human
ucaugcuuauugcauauuugga

SEQ ID NO: 84917 - RNA, 22 nt, Human
ucaugcuuuggguuagaaaccu

SEQ ID NO: 84918 - RNA, 22 nt, Human
ucaugcuuugguugcuguccuu

SEQ ID NO: 84919 - RNA, 19 nt, Human
ucauggaagaaaugugaua

SEQ ID NO: 84920 - RNA, 20 nt, Human
ucauggaaucucacucuagu

SEQ ID NO: 84921 - RNA, 23 nt, Human
ucauggaaugaauucuucuguua

SEQ ID NO: 84922 - RNA, 19 nt, Human
ucauggaucagguaguuua

SEQ ID NO: 84923 - RNA, 22 nt, Human
ucauggaugggcccagcucugu

SEQ ID NO: 84924 - RNA, 22 nt, Human
ucauggcacuuagcacaguccu

SEQ ID NO: 84925 - RNA, 22 nt, Human
ucauggcuaaccaaggccugau

SEQ ID NO: 84926 - RNA, 22 nt, Human
ucauggcuugcagauggccacc

SEQ ID NO: 84927 - RNA, 18 nt, Human
ucauggcuuuagucccuc

SEQ ID NO: 84928 - RNA, 22 nt, Human
ucauggcuuuuucacuguucgc

SEQ ID NO: 84929 - RNA, 22 nt, Human
ucaugggguuuggcuggauguc

SEQ ID NO: 84930 - RNA, 22 nt, Human
ucaugguauauuucacucuuua

SEQ ID NO: 84931 - RNA, 22 nt, Human
ucauguguccuaguucauauaa

SEQ ID NO: 84932 - RNA, 22 nt, Human
ucaugugucugcugcagcuguu

SEQ ID NO: 84933 - RNA, 20 nt, Human
ucauguguguccuacagaga

SEQ ID NO: 84934 - RNA, 22 nt, Human
ucauguguuaaacuccaagaua

SEQ ID NO: 84935 - RNA, 22 nt, Human
ucauguguugcacugaggaccu

SEQ ID NO: 84936 - RNA, 22 nt, Human
ucauguuaucuuggcucuggga

SEQ ID NO: 84937 - RNA, 22 nt, Human
ucauguuauugacucauaauau

SEQ ID NO: 84938 - RNA, 22 nt, Human
ucauguuugagacuaauuuuuc

SEQ ID NO: 84939 - RNA, 22 nt, Human
ucauguuugcccuaagaaaaag

SEQ ID NO: 84940 - RNA, 22 nt, Human
ucauuaaaaugcagauucugac

SEQ ID NO: 84941 - RNA, 22 nt, Human
ucauuaagauuacgugccagaa

SEQ ID NO: 84942 - RNA, 22 nt, Human
ucauuacacaguucaguggaaa

SEQ ID NO: 84943 - RNA, 22 nt, Human
ucauuacagagauauaaucuac

SEQ ID NO: 84944 - RNA, 22 nt, Human
ucauuagaaaugcagauucuca

SEQ ID NO: 84945 - RNA, 22 nt, Human
ucauuauaaacauaugcuaaag

SEQ ID NO: 84946 - RNA, 22 nt, Human
ucauuaucuuggcucauuucug

SEQ ID NO: 84947 - RNA, 18 nt, Human
ucauuauuguuucuggag

SEQ ID NO: 84948 - RNA, 22 nt, Human
ucauucaauguaagcauauaua

SEQ ID NO: 84949 - RNA, 22 nt, Human
ucauucacuuugaaauaaacga

SEQ ID NO: 84950 - RNA, 22 nt, Human
ucauucaucugguguuaguccu

SEQ ID NO: 84951 - RNA, 22 nt, Human
ucauucauucuuucugaauaua

SEQ ID NO: 84952 - RNA, 22 nt, Human
ucauuccuccagcgggagucca

SEQ ID NO: 84953 - RNA, 21 nt, Human
ucauucgauuuccucuaucuc

SEQ ID NO: 84954 - RNA, 22 nt, Human
ucauucuccucuggaaaaggca

SEQ ID NO: 84955 - RNA, 22 nt, Human
ucauucucugggaugcaguuug

SEQ ID NO: 84956 - RNA, 22 nt, Human
ucauugaaugagaugcaauaga

SEQ ID NO: 84957 - RNA, 22 nt, Human
ucauugacaguuguuucaaaua

SEQ ID NO: 84958 - RNA, 22 nt, Human
ucauugaguaauacuguagugu

SEQ ID NO: 84959 - RNA, 22 nt, Human
ucauugauggcuucuuucuugc

SEQ ID NO: 84960 - RNA, 22 nt, Human
ucauugccauggcauuugcaga

SEQ ID NO: 84961 - RNA, 22 nt, Human
ucauuguauacuuuauuuauga

SEQ ID NO: 84962 - RNA, 22 nt, Human
ucauuguauucagaacugaaga

SEQ ID NO: 84963 - RNA, 20 nt, Human
ucauuguguugccaauuccc

SEQ ID NO: 84964 - RNA, 22 nt, Human
ucauuguugcguuaaugucuuc

SEQ ID NO: 84965 - RNA, 22 nt, Human
ucauuguuucugcuuuucauga

SEQ ID NO: 84966 - RNA, 22 nt, Human
ucauuuacacuucacaaaugga

SEQ ID NO: 84967 - RNA, 22 nt, Human
ucauuuacuggauccauaagca

SEQ ID NO: 84968 - RNA, 22 nt, Human
ucauuuaguucuuucaugucca

SEQ ID NO: 84969 - RNA, 22 nt, Human
ucauuuaucgcugccuuuuaaa

SEQ ID NO: 84970 - RNA, 22 nt, Human
ucauuuaugucuuugccaucca

SEQ ID NO: 84971 - RNA, 22 nt, Human
ucauuucaaguucugacagcua

SEQ ID NO: 84972 - RNA, 21 nt, Human
ucauuucagggccuuggcuuc

SEQ ID NO: 84973 - RNA, 17 nt, Human
ucauuucaguaaaucca

SEQ ID NO: 84974 - RNA, 22 nt, Human
ucauuucaguccucugugugag

SEQ ID NO: 84975 - RNA, 22 nt, Human
ucauuucucugagucugauaau

SEQ ID NO: 84976 - RNA, 22 nt, Human
ucauuucuuaacuagagugaac

SEQ ID NO: 84977 - RNA, 20 nt, Human
ucauuucuugggguuccaag

SEQ ID NO: 84978 - RNA, 22 nt, Human
ucauuuguacuugugugcuugu

SEQ ID NO: 84979 - RNA, 22 nt, Human
ucauuugugcaauguagaugaa

SEQ ID NO: 84980 - RNA, 22 nt, Human
ucauuugugcugucagcaugca

SEQ ID NO: 84981 - RNA, 19 nt, Human
ucauuuguuaguagaaguu

SEQ ID NO: 84982 - RNA, 17 nt, Human
ucauuuguugugacuag

SEQ ID NO: 84983 - RNA, 22 nt, Human
ucauuuguuuagguagcaccau

SEQ ID NO: 84984 - RNA, 22 nt, Human
ucauuuuuagcgcgcaaaaguu

SEQ ID NO: 84985 - RNA, 22 nt, Human
ucuaaacuucacuuuaagugcu

SEQ ID NO: 84986 - RNA, 22 nt, Human
ucuaaagaaacauugagaccug

SEQ ID NO: 84987 - RNA, 22 nt, Human
ucuaaagcuccuuccacuaaaa

SEQ ID NO: 84988 - RNA, 20 nt, Human
ucuaaaguacaguuugugug

SEQ ID NO: 84989 - RNA, 22 nt, Human
ucuaaaguaugcuaauauguga

SEQ ID NO: 84990 - RNA, 22 nt, Human
ucuaaagugagucauuucgacu

SEQ ID NO: 84991 - RNA, 22 nt, Human
ucuaaaucccaacaugauauca

SEQ ID NO: 84992 - RNA, 22 nt, Human
ucuaaauggaaagaaaauaccu

SEQ ID NO: 84993 - RNA, 22 nt, Human
ucuaaauucaguuuauuuugau

SEQ ID NO: 84994 - RNA, 22 nt, Human
ucuaaauucuuuccuggguuga

SEQ ID NO: 84995 - RNA, 22 nt, Human
ucuaacaccugucagaugugau

SEQ ID NO: 84996 - RNA, 22 nt, Human
ucuaacuauacaaagaaaacau

SEQ ID NO: 84997 - RNA, 22 nt, Human
ucuaacuugaacucaugacugu

SEQ ID NO: 84998 - RNA, 22 nt, Human
ucuaagacacuguacuuucagu

SEQ ID NO: 84999 - RNA, 22 nt, Human
ugggaguuaguuauacugugac

SEQ ID NO: 85000 - RNA, 22 nt, Human
ugggaguugagacauuuugccc

SEQ ID NO: 85001 - RNA, 22 nt, Human
ugggaguugggugggagacuuc

SEQ ID NO: 85002 - RNA, 22 nt, Human
ugggauaauaaauagaggcaga

SEQ ID NO: 85003 - RNA, 22 nt, Human
ugggauauaaucugaaaaguau

SEQ ID NO: 85004 - RNA, 22 nt, Human
ugggauaucugucagcagcuuc

SEQ ID NO: 85005 - RNA, 22 nt, Human
ugggauauuuugagcuuuccuc

SEQ ID NO: 85006 - RNA, 22 nt, Human
ugggaucuuuugagauacugug

SEQ ID NO: 85007 - RNA, 22 nt, Human
ugggaugaauacaaugggauca

SEQ ID NO: 85008 - RNA, 22 nt, Human
ugggaugaguuguuaggacuga

SEQ ID NO: 85009 - RNA, 19 nt, Human
ugggaugaugcagaaggua

SEQ ID NO: 85010 - RNA, 22 nt, Human
ugggauguggccaugguucucu

SEQ ID NO: 85011 - RNA, 22 nt, Human
ugggcaagucacuucugucuuu

SEQ ID NO: 85012 - RNA, 22 nt, Human
ugggcacaaacaucugccuguu

SEQ ID NO: 85013 - RNA, 22 nt, Human
ugggcacagagucccaucugcc

SEQ ID NO: 85014 - RNA, 22 nt, Human
ugggcacagggguaggaaugag

SEQ ID NO: 85015 - RNA, 22 nt, Human
ugggcacagugaguugccuuua

SEQ ID NO: 85016 - RNA, 22 nt, Human
ugggcacauaguuuuaugguca

SEQ ID NO: 85017 - RNA, 21 nt, Human
ugggcacugagggugcugcuc

SEQ ID NO: 85018 - RNA, 22 nt, Human
ugggcagaaggaagagccaccu

SEQ ID NO: 85019 - RNA, 22 nt, Human
ugggcagaggacagggaagauc

SEQ ID NO: 85020 - RNA, 22 nt, Human
ugggcagaggcagcagaaaccu

SEQ ID NO: 85021 - RNA, 22 nt, Human
ugggcagcaaagacugugugcu

SEQ ID NO: 85022 - RNA, 19 nt, Human
ugggcagcucccucugucc

SEQ ID NO: 85023 - RNA, 22 nt, Human
ugggcaggauaauaucucaugu

SEQ ID NO: 85024 - RNA, 22 nt, Human
ugggcaggaugcguugauucuu

SEQ ID NO: 85025 - RNA, 22 nt, Human
ugggcaucauggacagcagagg

SEQ ID NO: 85026 - RNA, 22 nt, Human
ugggccacaagccaugggacca

SEQ ID NO: 85027 - RNA, 22 nt, Human
ugggccacaguucaccaauccc

SEQ ID NO: 85028 - RNA, 22 nt, Human
ugggccaccugcucuguuucua

SEQ ID NO: 85029 - RNA, 22 nt, Human
ugggccacuaccuucucuggau

SEQ ID NO: 85030 - RNA, 22 nt, Human
ugggccagcucccugccccugg

SEQ ID NO: 85031 - RNA, 23 nt, Human
ugggccagggaguccgguuucuu

SEQ ID NO: 85032 - RNA, 22 nt, Human
ugggccaguucuuuacucgucc

SEQ ID NO: 85033 - RNA, 22 nt, Human
ugggccaguuggaauggauacu

SEQ ID NO: 85034 - RNA, 22 nt, Human
ugggccaguuggugacuacaaa

SEQ ID NO: 85035 - RNA, 22 nt, Human
ugggccauuuuuggaagacugg

SEQ ID NO: 85036 - RNA, 21 nt, Human
ugggcccaguucccgcugggc

SEQ ID NO: 85037 - RNA, 22 nt, Human
ugggcccugacuucaagcaucc

SEQ ID NO: 85038 - RNA, 22 nt, Human
ugggcccugcccuugucugucc

SEQ ID NO: 85039 - RNA, 23 nt, Human
ugggcccuggagucgccagucug

SEQ ID NO: 85040 - RNA, 22 nt, Human
ugggccgggcacuguacugggc

SEQ ID NO: 85041 - RNA, 22 nt, Human
ugggccucaucuucaaugaguc

SEQ ID NO: 85042 - RNA, 22 nt, Human
ugggccuccuccgacagccggg

SEQ ID NO: 85043 - RNA, 22 nt, Human
ugggccucggggaagcccgugu

SEQ ID NO: 85044 - RNA, 22 nt, Human
ugggccugaguuugggaacugg

SEQ ID NO: 85045 - RNA, 18 nt, Human
ugggccugcauccuaguc

SEQ ID NO: 85046 - RNA, 22 nt, Human
ugggccugccccaggcuucagc

SEQ ID NO: 85047 - RNA, 22 nt, Human
ugggccuggguuccuccugggc

SEQ ID NO: 85048 - RNA, 22 nt, Human
ugggccuguugccugaguccau

SEQ ID NO: 85049 - RNA, 22 nt, Human
ugggccuuacuuggggcugacu

SEQ ID NO: 85050 - RNA, 22 nt, Human
ugggcgaggagaaugcugugaa

SEQ ID NO: 85051 - RNA, 22 nt, Human
ugggcuagauauuuuugggcug

SEQ ID NO: 85052 - RNA, 22 nt, Human
ugggcuagauuuggugacccag

SEQ ID NO: 85053 - RNA, 18 nt, Human
ugggcucaaaggauccuc

SEQ ID NO: 85054 - RNA, 22 nt, Human
ugggcucaaucugcuucuguuu

SEQ ID NO: 85055 - RNA, 22 nt, Human
ugggcucagaagauaguuucca

SEQ ID NO: 85056 - RNA, 23 nt, Human
ugggcucagcuuccaguggggag

SEQ ID NO: 85057 - RNA, 22 nt, Human
ugggcucagggaagcuuggccu

SEQ ID NO: 85058 - RNA, 22 nt, Human
ugggcucagucugcuugguccu

SEQ ID NO: 85059 - RNA, 22 nt, Human
ugggcucauggcccagcacugg

SEQ ID NO: 85060 - RNA, 22 nt, Human
ugggcucuagacuuuagugugg

SEQ ID NO: 85061 - RNA, 22 nt, Human
ugggcucucaaagugcggcuug

SEQ ID NO: 85062 - RNA, 22 nt, Human
ugggcucucgucccugcagaag

SEQ ID NO: 85063 - RNA, 22 nt, Human
ugggcucugaagucagucugcu

SEQ ID NO: 85064 - RNA, 22 nt, Human
ugggcucuggagggccuaggau

SEQ ID NO: 85065 - RNA, 22 nt, Human
ugggcucuggguggccugagca

SEQ ID NO: 85066 - RNA, 22 nt, Human
ugggcucuuggaccccaacgcu

SEQ ID NO: 85067 - RNA, 22 nt, Human
ugggcugaaaugcuguggacua

SEQ ID NO: 85068 - RNA, 22 nt, Human
ugggcugaacuucaucugauga

SEQ ID NO: 85069 - RNA, 22 nt, Human
ugggcugagcacugaggaagga

SEQ ID NO: 85070 - RNA, 22 nt, Human
ugggcugagcagugaagcucau

SEQ ID NO: 85071 - RNA, 22 nt, Human
ugggcugaguggcagccagagu

SEQ ID NO: 85072 - RNA, 22 nt, Human
ugggcugcacuccauuuucugc

SEQ ID NO: 85073 - RNA, 22 nt, Human
ugggcugccagcucuccagaug

SEQ ID NO: 85074 - RNA, 22 nt, Human
ugggcugcuucucaaaugucuc

SEQ ID NO: 85075 - RNA, 22 nt, Human
ugggcuggagcuuguugcuucc

SEQ ID NO: 85076 - RNA, 22 nt, Human
ugggcuggcccaccacaccucg

SEQ ID NO: 85077 - RNA, 22 nt, Human
ugggcuggcugaggcauucacu

SEQ ID NO: 85078 - RNA, 22 nt, Human
ugggcuggugagggaucauuua

SEQ ID NO: 85079 - RNA, 22 nt, Human
ugggcuguccagcaccugggcu

SEQ ID NO: 85080 - RNA, 19 nt, Human
ugggcuuccccagggcaga

SEQ ID NO: 85081 - RNA, 22 nt, Human
uggggaaaaugcagaagauuac

SEQ ID NO: 85082 - RNA, 22 nt, Human
uggggaaagauaguuuucucua

SEQ ID NO: 85083 - RNA, 22 nt, Human
uggggaaaguucuugaaaguaa

SEQ ID NO: 85084 - RNA, 22 nt, Human
uggggaaauguccugccuuccc

SEQ ID NO: 85085 - RNA, 16 nt, Human
uggggaagcucgugag

SEQ ID NO: 85086 - RNA, 22 nt, Human
uggggacacagagccaaacuau

SEQ ID NO: 85087 - RNA, 22 nt, Human
uggggacugacagccaggccuc

SEQ ID NO: 85088 - RNA, 22 nt, Human
uggggagaguuacaaggaaucu

SEQ ID NO: 85089 - RNA, 22 nt, Human
uggggagcacgguagggaaaug

SEQ ID NO: 85090 - RNA, 22 nt, Human
uggggaggacgggcgccuuccu

SEQ ID NO: 85091 - RNA, 21 nt, Human
uggggaggggaccugauuaug

SEQ ID NO: 85092 - RNA, 22 nt, Human
uggggagugaugccucggauaa

SEQ ID NO: 85093 - RNA, 19 nt, Human
uggggaugcugaugaccaa

SEQ ID NO: 85094 - RNA, 22 nt, Human
uccaguuuccuguggcugccua

SEQ ID NO: 85095 - RNA, 19 nt, Human
uccaguuuggcaggaagac

SEQ ID NO: 85096 - RNA, 21 nt, Human
uccauaagagaccaucuccua

SEQ ID NO: 85097 - RNA, 22 nt, Human
uccauaagcagguucuuccuga

SEQ ID NO: 85098 - RNA, 22 nt, Human
uccauacacauuuauuuggccu

SEQ ID NO: 85099 - RNA, 22 nt, Human
uccauauauauuagucuuccuu

SEQ ID NO: 85100 - RNA, 22 nt, Human
uccaucaccacagaggacagag

SEQ ID NO: 85101 - RNA, 22 nt, Human
uccaucacuauuaucuacaaca

SEQ ID NO: 85102 - RNA, 22 nt, Human
uccaucauguucacagcuauau

SEQ ID NO: 85103 - RNA, 22 nt, Human
uccauccauggauggaaaugug

SEQ ID NO: 85104 - RNA, 22 nt, Human
uccaucuggugagugaggagcc

SEQ ID NO: 85105 - RNA, 22 nt, Human
uccaucugucuuucccauccac

SEQ ID NO: 85106 - RNA, 20 nt, Human
uccaucuugggcagaagcag

SEQ ID NO: 85107 - RNA, 22 nt, Human
uccaugagaacccuuggagaua

SEQ ID NO: 85108 - RNA, 22 nt, Human
uccaugagcuagggauucauca

SEQ ID NO: 85109 - RNA, 22 nt, Human
uccaugagggacacuggaugcu

SEQ ID NO: 85110 - RNA, 22 nt, Human
uccaugcagaguccaggccuca

SEQ ID NO: 85111 - RNA, 22 nt, Human
uccauuaaugauuauuucugug

SEQ ID NO: 85112 - RNA, 22 nt, Human
uccauucaauucuaaagcccuu

SEQ ID NO: 85113 - RNA, 18 nt, Human
uccauuguucuacuguga

SEQ ID NO: 85114 - RNA, 22 nt, Human
uccauuuacuauucucauaucg

SEQ ID NO: 85115 - RNA, 22 nt, Human
uccauuuggcacucuauuucca

SEQ ID NO: 85116 - RNA, 22 nt, Human
uccauuuuagaagaaaauccac

SEQ ID NO: 85117 - RNA, 22 nt, Human
ucucagggccccaaaggcuagu

SEQ ID NO: 85118 - RNA, 22 nt, Human
ucucagggcuuuucuuuugaau

SEQ ID NO: 85119 - RNA, 22 nt, Human
ucucaggggcagugauccuaag

SEQ ID NO: 85120 - RNA, 22 nt, Human
ucucagggugaggaaagaauuu

SEQ ID NO: 85121 - RNA, 22 nt, Human
ucucagguaagcuucuuugaug

SEQ ID NO: 85122 - RNA, 22 nt, Human
ucucagguggcccccaugagug

SEQ ID NO: 85123 - RNA, 22 nt, Human
ucucagucuuugcaaggaugcu

SEQ ID NO: 85124 - RNA, 22 nt, Human
ucucagugaagaguauaacaaa

SEQ ID NO: 85125 - RNA, 22 nt, Human
ucucagugcagcaaggaauuua

SEQ ID NO: 85126 - RNA, 22 nt, Human
ucucagugcagcuugacagaga

SEQ ID NO: 85127 - RNA, 22 nt, Human
ucucagugcuauccauauucca

SEQ ID NO: 85128 - RNA, 22 nt, Human
ucucaguguguuuucucucaga

SEQ ID NO: 85129 - RNA, 22 nt, Human
ucucaguguuuaaaaagauuuc

SEQ ID NO: 85130 - RNA, 23 nt, Human
ucucaguuccagaggcuacaagu

SEQ ID NO: 85131 - RNA, 22 nt, Human
ucucaguuuccucauauguaaa

SEQ ID NO: 85132 - RNA, 22 nt, Human
ucucaucugccauuugcaggag

SEQ ID NO: 85133 - RNA, 22 nt, Human
ucucauggagucaggagcagaa

SEQ ID NO: 85134 - RNA, 22 nt, Human
ucucaugguuugugauucaaau

SEQ ID NO: 85135 - RNA, 23 nt, Human
ucucaugucuuuccuacaagcau

SEQ ID NO: 85136 - RNA, 22 nt, Human
ucucaugugauucccgugcaug

SEQ ID NO: 85137 - RNA, 20 nt, Human
ucucauuauauccaagaggc

SEQ ID NO: 85138 - RNA, 22 nt, Human
ucucauugaaaugugacugagu

SEQ ID NO: 85139 - RNA, 22 nt, Human
ucucauuggaaaagaguuuaau

SEQ ID NO: 85140 - RNA, 22 nt, Human
ucucauuguccaauugaauuua

SEQ ID NO: 85141 - RNA, 22 nt, Human
ucuccaagcagggcugcaaggc

SEQ ID NO: 85142 - RNA, 22 nt, Human
ucuccacaccagaaggagcuga

SEQ ID NO: 85143 - RNA, 22 nt, Human
ucuccacucugagugccuuuca

SEQ ID NO: 85144 - RNA, 22 nt, Human
ucuccagaaauggggcugggga

SEQ ID NO: 85145 - RNA, 22 nt, Human
ucuccagaggucccuugucucu

SEQ ID NO: 85146 - RNA, 20 nt, Human
ucuccagaugcagaugacau

SEQ ID NO: 85147 - RNA, 22 nt, Human
ucuccaggaaccaucaugguaa

SEQ ID NO: 85148 - RNA, 22 nt, Human
ucuccaggagcaagucacccag

SEQ ID NO: 85149 - RNA, 22 nt, Human
ucuccaggcacuaccuggguaa

SEQ ID NO: 85150 - RNA, 19 nt, Human
ucuccaggcaggugagcga

SEQ ID NO: 85151 - RNA, 22 nt, Human
ucuccagggacugaggcuggag

SEQ ID NO: 85152 - RNA, 22 nt, Human
ucuccagggcagagaauagcaa

SEQ ID NO: 85153 - RNA, 22 nt, Human
ucuccagggcccccgagcguug

SEQ ID NO: 85154 - RNA, 22 nt, Human
ucuccagggugagcuaggccag

SEQ ID NO: 85155 - RNA, 22 nt, Human
ucuccagguagauaugucagga

SEQ ID NO: 85156 - RNA, 22 nt, Human
ucuccaggugagggugguuaga

SEQ ID NO: 85157 - RNA, 22 nt, Human
ucuccaguaucuuuccaaugaa

SEQ ID NO: 85158 - RNA, 22 nt, Human
ucuccagucccuucucuguuag

SEQ ID NO: 85159 - RNA, 22 nt, Human
ucucccaacauguggaggucag

SEQ ID NO: 85160 - RNA, 22 nt, Human
ucucccaaccucuggugggugc

SEQ ID NO: 85161 - RNA, 22 nt, Human
ucucccaagccuggcaggggca

SEQ ID NO: 85162 - RNA, 23 nt, Human
ucucccaagccuggcaggggcac

SEQ ID NO: 85163 - RNA, 22 nt, Human
ucucccaaggcacagaaagagu

SEQ ID NO: 85164 - RNA, 22 nt, Human
ucucccaagggcacauucaagg

SEQ ID NO: 85165 - RNA, 22 nt, Human
ucucccaagugaccaggaaaga

SEQ ID NO: 85166 - RNA, 22 nt, Human
ucucccaggcugcccuguggac

SEQ ID NO: 85167 - RNA, 22 nt, Human
ucucccaggucauacacagaga

SEQ ID NO: 85168 - RNA, 22 nt, Human
ucucccaguccucugugcuuac

SEQ ID NO: 85169 - RNA, 22 nt, Human
ucucccagugucuggcagucag

SEQ ID NO: 85170 - RNA, 22 nt, Human
ucucccccagucucuacagcag

SEQ ID NO: 85171 - RNA, 22 nt, Human
ucuccccucccuggaccagugc

SEQ ID NO: 85172 - RNA, 23 nt, Human
ucucccucaugccuaggccuggg

SEQ ID NO: 85173 - RNA, 22 nt, Human
ucucccucucagauuuauucac

SEQ ID NO: 85174 - RNA, 22 nt, Human
ucucccucuguaagaucagggg

SEQ ID NO: 85175 - RNA, 20 nt, Human
ucucccugcccaucucagau

SEQ ID NO: 85176 - RNA, 16 nt, Human
ucucccuguucuccaa

SEQ ID NO: 85177 - RNA, 22 nt, Human
ucucccuucucuggauuccguu

SEQ ID NO: 85178 - RNA, 22 nt, Human
ucuccgggugcaugugugugcc

SEQ ID NO: 85179 - RNA, 22 nt, Human
ucuccuacucacucaaggcuug

SEQ ID NO: 85180 - RNA, 22 nt, Human
ucuccuccuuuuuucaacauag

SEQ ID NO: 85181 - RNA, 22 nt, Human
ucuccucuccuuucauguuguu

SEQ ID NO: 85182 - RNA, 22 nt, Human
ucuccucugcgcggcagugccc

SEQ ID NO: 85183 - RNA, 22 nt, Human
ucuccugaugaugguacuggca

SEQ ID NO: 85184 - RNA, 22 nt, Human
ucuccuggagcaggaagguggg

SEQ ID NO: 85185 - RNA, 22 nt, Human
ucuccuggauagauacuaucca

SEQ ID NO: 85186 - RNA, 22 nt, Human
ucuccuggccgggcuguccccu

SEQ ID NO: 85187 - RNA, 22 nt, Human
ucuccuggcucuaaaaggcugu

SEQ ID NO: 85188 - RNA, 17 nt, Human
ucuccuggcucuaucag

SEQ ID NO: 85189 - RNA, 22 nt, Human
ucuccugguacccuuccuagca

SEQ ID NO: 85190 - RNA, 22 nt, Human
ucuccugguauguaugcaccug

SEQ ID NO: 85191 - RNA, 20 nt, Human
ucuccuggugacaguaccca

SEQ ID NO: 85192 - RNA, 22 nt, Human
ucuccugguuuguuaaauaauu

SEQ ID NO: 85193 - RNA, 22 nt, Human
ucuccuguaugggacuggcgag

SEQ ID NO: 85194 - RNA, 22 nt, Human
ucuccugugcacccucccugug

SEQ ID NO: 85195 - RNA, 22 nt, Human
ucuccuucgaggcccagcuccc

SEQ ID NO: 85196 - RNA, 22 nt, Human
ucuccuuuaagauuuccucagg

SEQ ID NO: 85197 - RNA, 22 nt, Human
ucuccuuucuggagccugcuca

SEQ ID NO: 85198 - RNA, 22 nt, Human
ucuccuuucuuuuaaaauguca

SEQ ID NO: 85199 - RNA, 22 nt, Human
ucucgacagccuggcacagugg

SEQ ID NO: 85200 - RNA, 22 nt, Human
ucucuaaagauauuuauggcaa

SEQ ID NO: 85201 - RNA, 22 nt, Human
ucucuaaagccuggaagaggag

SEQ ID NO: 85202 - RNA, 22 nt, Human
ucucuaaaguagaaaagacccc

SEQ ID NO: 85203 - RNA, 23 nt, Human
ugucauugugacuacagaaccag

SEQ ID NO: 85204 - RNA, 22 nt, Human
ugucauuuaguccucugugugu

SEQ ID NO: 85205 - RNA, 20 nt, Human
ugucauuuauuuaucaaaug

SEQ ID NO: 85206 - RNA, 22 nt, Human
ugucauuuccugaaugcugagu

SEQ ID NO: 85207 - RNA, 22 nt, Human
ugucauuuggugccaggaaaga

SEQ ID NO: 85208 - RNA, 22 nt, Human
uguccaaugcccuuuccacaug

SEQ ID NO: 85209 - RNA, 22 nt, Human
uguccacaucacucacuuguca

SEQ ID NO: 85210 - RNA, 22 nt, Human
uguccaccguucagcaccagag

SEQ ID NO: 85211 - RNA, 22 nt, Human
uguccacuuugucagugucaua

SEQ ID NO: 85212 - RNA, 22 nt, Human
uguccagagucacagagcucaa

SEQ ID NO: 85213 - RNA, 22 nt, Human
uguccagcugaaggcagccuca

SEQ ID NO: 85214 - RNA, 22 nt, Human
uguccaggcacugggacucuag

SEQ ID NO: 85215 - RNA, 22 nt, Human
uguccaggcggccuugccuguu

SEQ ID NO: 85216 - RNA, 20 nt, Human
uguccaggggaucguuggcc

SEQ ID NO: 85217 - RNA, 22 nt, Human
uguccagguggccucugcugcu

SEQ ID NO: 85218 - RNA, 19 nt, Human
uguccagugaugucaagga

SEQ ID NO: 85219 - RNA, 22 nt, Human
ugucccaggccucauguugcca

SEQ ID NO: 85220 - RNA, 22 nt, Human
ugucccauggacacaacuucuu

SEQ ID NO: 85221 - RNA, 22 nt, Human
uguccccaagguucagcccaca

SEQ ID NO: 85222 - RNA, 22 nt, Human
uguccccagguccucugccguc

SEQ ID NO: 85223 - RNA, 22 nt, Human
ugucccucauugacgcugugcc

SEQ ID NO: 85224 - RNA, 22 nt, Human
ugucccugauccacuggacccc

SEQ ID NO: 85225 - RNA, 22 nt, Human
ugucccugccugcccacucugu

SEQ ID NO: 85226 - RNA, 22 nt, Human
ugucccugcuguacuuagagca

SEQ ID NO: 85227 - RNA, 22 nt, Human
ugucccuggagcuucugucccc

SEQ ID NO: 85228 - RNA, 22 nt, Human
uguccucagauaugucuacucu

SEQ ID NO: 85229 - RNA, 22 nt, Human
uguccuccaggaccugcagggc

SEQ ID NO: 85230 - RNA, 22 nt, Human
uguccuggagacacaagguggu

SEQ ID NO: 85231 - RNA, 22 nt, Human
uguccuggagugcuugggggaa

SEQ ID NO: 85232 - RNA, 22 nt, Human
uguccuggaguuauaaugccug

SEQ ID NO: 85233 - RNA, 22 nt, Human
uguccugggaaugggaugcagu

SEQ ID NO: 85234 - RNA, 22 nt, Human
uguccuggggcgacuuggggcc

SEQ ID NO: 85235 - RNA, 22 nt, Human
uguccugggucaaauccugguc

SEQ ID NO: 85236 - RNA, 19 nt, Human
uguccuguccugcucugac

SEQ ID NO: 85237 - RNA, 22 nt, Human
uguccugugcacuguagcaugu

SEQ ID NO: 85238 - RNA, 22 nt, Human
uguccuguuauauguuggguag

SEQ ID NO: 85239 - RNA, 22 nt, Human
uguccuguucuugcuguguccu

SEQ ID NO: 85240 - RNA, 22 nt, Human
uguccuuaaggagcuuaauguc

SEQ ID NO: 85241 - RNA, 22 nt, Human
uguccuuagaagaagugaaaga

SEQ ID NO: 85242 - RNA, 22 nt, Human
uguccuuauauuguggaagggg

SEQ ID NO: 85243 - RNA, 22 nt, Human
uguccuuuguguaucuauagua

SEQ ID NO: 85244 - RNA, 22 nt, Human
uguccuuuucuuuagugcagcu

SEQ ID NO: 85245 - RNA, 22 nt, Human
uguccuuuuucuuaggaaauau

SEQ ID NO: 85246 - RNA, 22 nt, Human
ugucuaaaugcaauggauuucc

SEQ ID NO: 85247 - RNA, 22 nt, Human
ugucuaacccaguggcaggagg

SEQ ID NO: 85248 - RNA, 22 nt, Human
ugucuaaugaauuaauuaauua

SEQ ID NO: 85249 - RNA, 22 nt, Human
ugucuacaaacguguacacauu

SEQ ID NO: 85250 - RNA, 22 nt, Human
ugucuacugcugacacuaacag

SEQ ID NO: 85251 - RNA, 22 nt, Human
ugucuagacauuagcuucagcu

SEQ ID NO: 85252 - RNA, 22 nt, Human
ugucuagggagcugcucaggcu

SEQ ID NO: 85253 - RNA, 22 nt, Human
ugucuagggcgagaauguguag

SEQ ID NO: 85254 - RNA, 22 nt, Human
ugucuaggucuagguuggcaau

SEQ ID NO: 85255 - RNA, 22 nt, Human
ugucuauaccugauacagaguu

SEQ ID NO: 85256 - RNA, 22 nt, Human
ugucuauagccugauuuguugg

SEQ ID NO: 85257 - RNA, 23 nt, Human
ugucuaugagaaguucaggcuag

SEQ ID NO: 85258 - RNA, 22 nt, Human
ugucuauuuuuacuggaccaug

SEQ ID NO: 85259 - RNA, 21 nt, Human
ugucucaaucagaagucauua

SEQ ID NO: 85260 - RNA, 22 nt, Human
ugucucagaggcaggaagagcc

SEQ ID NO: 85261 - RNA, 22 nt, Human
ugucucagauacgccaucaagg

SEQ ID NO: 85262 - RNA, 22 nt, Human
ugucucaggcccaagccaguaa

SEQ ID NO: 85263 - RNA, 22 nt, Human
ugucucagggcagcagcagggg

SEQ ID NO: 85264 - RNA, 22 nt, Human
ugucucaguauacgaaacacuu

SEQ ID NO: 85265 - RNA, 19 nt, Human
ugucucagugucccuuccu

SEQ ID NO: 85266 - RNA, 22 nt, Human
ugucucaguucccuucucugga

SEQ ID NO: 85267 - RNA, 18 nt, Human
ugucucaguucugcuaug

SEQ ID NO: 85268 - RNA, 20 nt, Human
ugucuccagggcugagugga

SEQ ID NO: 85269 - RNA, 23 nt, Human
ugucuccaucucauuacuugggg

SEQ ID NO: 85270 - RNA, 22 nt, Human
ugucuccauggugaagcagggu

SEQ ID NO: 85271 - RNA, 22 nt, Human
ugucuccuacugccuguggauc

SEQ ID NO: 85272 - RNA, 19 nt, Human
ugucuccuccccgccgucu

SEQ ID NO: 85273 - RNA, 22 nt, Human
ugucuccugagagcuggacaga

SEQ ID NO: 85274 - RNA, 21 nt, Human
ugucuccuguuggcacauggc

SEQ ID NO: 85275 - RNA, 22 nt, Human
ugucucuccugaugaucuggug

SEQ ID NO: 85276 - RNA, 22 nt, Human
ugucucugugacuccuuccgcc

SEQ ID NO: 85277 - RNA, 22 nt, Human
ugucucuucagcccauggcuuc

SEQ ID NO: 85278 - RNA, 18 nt, Human
ugucucuucuuauguggg

SEQ ID NO: 85279 - RNA, 22 nt, Human
ugucugaagcagccagugcugu

SEQ ID NO: 85280 - RNA, 22 nt, Human
ugucugaaggcagguggagaac

SEQ ID NO: 85281 - RNA, 22 nt, Human
ugucugaaggccugaccuacau

SEQ ID NO: 85282 - RNA, 22 nt, Human
ugucugaauucaagaaauucaa

SEQ ID NO: 85283 - RNA, 22 nt, Human
ugucugaauuuuggaaucaagu

SEQ ID NO: 85284 - RNA, 22 nt, Human
ugucugagcaccugugcugaac

SEQ ID NO: 85285 - RNA, 22 nt, Human
ugucugaggaagucagcccuuu

SEQ ID NO: 85286 - RNA, 22 nt, Human
ugucugagugugccugggcauu

SEQ ID NO: 85287 - RNA, 22 nt, Human
ugucugcaaaguccagcacagg

SEQ ID NO: 85288 - RNA, 22 nt, Human
ugucugcagugccacaguggga

SEQ ID NO: 85289 - RNA, 22 nt, Human
ugucugccugucucugugcaaa

SEQ ID NO: 85290 - RNA, 22 nt, Human
ugucugcuacuugguucuacca

SEQ ID NO: 85291 - RNA, 20 nt, Human
ugucugcugagcugcugccc

SEQ ID NO: 85292 - RNA, 19 nt, Human
ugucugcugaugacucuau

SEQ ID NO: 85293 - RNA, 22 nt, Human
ugucuggacagagauucucaau

SEQ ID NO: 85294 - RNA, 23 nt, Human
ugucuggagccugagcaggugcu

SEQ ID NO: 85295 - RNA, 20 nt, Human
ugucuggauguuuaagcaga

SEQ ID NO: 85296 - RNA, 22 nt, Human
ugucuggcauaguugcucccug

SEQ ID NO: 85297 - RNA, 22 nt, Human
ugucugucaucagggauauccu

SEQ ID NO: 85298 - RNA, 22 nt, Human
ugucuguccccugccuugaggg

SEQ ID NO: 85299 - RNA, 22 nt, Human
ugucuguccugcuuccuuggac

SEQ ID NO: 85300 - RNA, 22 nt, Human
ugucugucuuuagugagauugc

SEQ ID NO: 85301 - RNA, 22 nt, Human
ugucuuaauaugugcauucugu

SEQ ID NO: 85302 - RNA, 22 nt, Human
ugucuuacagcaaucuguucug

SEQ ID NO: 85303 - RNA, 23 nt, Human
ugucuuaucuagcuucuagaggc

SEQ ID NO: 85304 - RNA, 22 nt, Human
ugucuucaaauauugaaauccu

SEQ ID NO: 85305 - RNA, 22 nt, Human
ugucuucacaugauaagccauu

SEQ ID NO: 85306 - RNA, 22 nt, Human
ugucuucagaauuaagaguaug

SEQ ID NO: 85307 - RNA, 22 nt, Human
ugucuucagcagucaucugggg

SEQ ID NO: 85308 - RNA, 22 nt, Human
ugucuucaggaguaaauaucau

SEQ ID NO: 85309 - RNA, 22 nt, Human
ugucuucaucuccaugcacaga

SEQ ID NO: 85310 - RNA, 22 nt, Human
ugucuugauugaagagauagaa

SEQ ID NO: 85311 - RNA, 22 nt, Human
ugucuuggccacuaggagugcc

SEQ ID NO: 85312 - RNA, 22 nt, Human
ucugggugugguaucuuagcca

SEQ ID NO: 85313 - RNA, 22 nt, Human
ucuggguuauuaugauggcuac

SEQ ID NO: 85314 - RNA, 22 nt, Human
ucugguaaccuuuaucccuccu

SEQ ID NO: 85315 - RNA, 22 nt, Human
ucugguaacucagaagaaagga

SEQ ID NO: 85316 - RNA, 22 nt, Human
ucuggucccugugucaccucuc

SEQ ID NO: 85317 - RNA, 22 nt, Human
ucugguccugaagucaacuuca

SEQ ID NO: 85318 - RNA, 22 nt, Human
ucuggucuccaggagugguggu

SEQ ID NO: 85319 - RNA, 22 nt, Human
ucugguuucccaguuccuccgu

SEQ ID NO: 85320 - RNA, 22 nt, Human
ucuguaaacacccguaagcuuu

SEQ ID NO: 85321 - RNA, 22 nt, Human
ucuguaaaucuacuaagagcuc

SEQ ID NO: 85322 - RNA, 22 nt, Human
ucuguaaucagaguagcagaua

SEQ ID NO: 85323 - RNA, 22 nt, Human
ucuguacaaaggcuauuuggag

SEQ ID NO: 85324 - RNA, 22 nt, Human
ucuguacacuucagcaugcauc

SEQ ID NO: 85325 - RNA, 22 nt, Human
ucuguagcaagugagaggcauu

SEQ ID NO: 85326 - RNA, 23 nt, Human
ucuguaggcagcaugccacucuc

SEQ ID NO: 85327 - RNA, 22 nt, Human
ucuguaggcuuacgcggcuucu

SEQ ID NO: 85328 - RNA, 22 nt, Human
ucuguagguuaaaaguagacaa

SEQ ID NO: 85329 - RNA, 22 nt, Human
ucuguagucugugccauagcug

SEQ ID NO: 85330 - RNA, 22 nt, Human
ucuguaucguaaucaugucugg

SEQ ID NO: 85331 - RNA, 22 nt, Human
ucuguauugagaaagccggaca

SEQ ID NO: 85332 - RNA, 22 nt, Human
ucugucaaaugggcauaaggau

SEQ ID NO: 85333 - RNA, 22 nt, Human
ucugucaacaugucaaagggcu

SEQ ID NO: 85334 - RNA, 22 nt, Human
ucugucacaauuugcuuacucu

SEQ ID NO: 85335 - RNA, 22 nt, Human
ucugucaccauucagcuugaau

SEQ ID NO: 85336 - RNA, 22 nt, Human
ucugucacccagagugcagugg

SEQ ID NO: 85337 - RNA, 22 nt, Human
ucugucacccgagcaggcgaga

SEQ ID NO: 85338 - RNA, 22 nt, Human
ucugucaccgagggcauccaaa

SEQ ID NO: 85339 - RNA, 19 nt, Human
ucugucacuggggguauuc

SEQ ID NO: 85340 - RNA, 21 nt, Human
ucugucagaaaagcugaggcu

SEQ ID NO: 85341 - RNA, 22 nt, Human
ucugucauugcaauaaaauuuc

SEQ ID NO: 85342 - RNA, 22 nt, Human
ucugucauuucauucauaugaa

SEQ ID NO: 85343 - RNA, 23 nt, Human
ucuguccacgcgaggcccuugcu

SEQ ID NO: 85344 - RNA, 22 nt, Human
ucuguccagcucuggggcucac

SEQ ID NO: 85345 - RNA, 22 nt, Human
ucuguccaggcuuacuauauau

SEQ ID NO: 85346 - RNA, 22 nt, Human
ucuguccaggucagccuacauu

SEQ ID NO: 85347 - RNA, 22 nt, Human
ucuguccauuuacagauaugca

SEQ ID NO: 85348 - RNA, 22 nt, Human
ucuguccauuuuccauuuuggc

SEQ ID NO: 85349 - RNA, 18 nt, Human
ucuguccuuccauucuuc

SEQ ID NO: 85350 - RNA, 22 nt, Human
ucugucucaaguucuugcacuc

SEQ ID NO: 85351 - RNA, 22 nt, Human
ucugucuccucugaggugccag

SEQ ID NO: 85352 - RNA, 18 nt, Human
ucugucucuguccuugcu

SEQ ID NO: 85353 - RNA, 22 nt, Human
ucugucucuuuguucugugagu

SEQ ID NO: 85354 - RNA, 22 nt, Human
ucugucugacuaccaugaggca

SEQ ID NO: 85355 - RNA, 22 nt, Human
ucugucugagggagugacauuu

SEQ ID NO: 85356 - RNA, 22 nt, Human
ucugucugguccaggaagaugu

SEQ ID NO: 85357 - RNA, 22 nt, Human
ucugucuguaguuuuacaugau

SEQ ID NO: 85358 - RNA, 17 nt, Human
ucugucugugguccacu

SEQ ID NO: 85359 - RNA, 21 nt, Human
ucugucuuccucagccuaagg

SEQ ID NO: 85360 - RNA, 22 nt, Human
ucugucuucuucauugccuaua

SEQ ID NO: 85361 - RNA, 22 nt, Human
ucugucuuugagaucucagccu

SEQ ID NO: 85362 - RNA, 22 nt, Human
ucugugaaaucacccagguuua

SEQ ID NO: 85363 - RNA, 22 nt, Human
ucugugaagcucugaacagcag

SEQ ID NO: 85364 - RNA, 22 nt, Human
ucugugagaaccagugccaggg

SEQ ID NO: 85365 - RNA, 22 nt, Human
ucugugauaguuuuucagcuau

SEQ ID NO: 85366 - RNA, 22 nt, Human
ucugugcaauaguuuguuuuac

SEQ ID NO: 85367 - RNA, 22 nt, Human
ucugugcaggaagucauuauga

SEQ ID NO: 85368 - RNA, 22 nt, Human
ucugugcagggaccccaagagu

SEQ ID NO: 85369 - RNA, 20 nt, Human
ucugugcaguggaggggcag

SEQ ID NO: 85370 - RNA, 22 nt, Human
uccuugagaggacagagccaua

SEQ ID NO: 85371 - RNA, 22 nt, Human
uccuugagauuaauuaaucacc

SEQ ID NO: 85372 - RNA, 23 nt, Human
uccuugagugucccccaagaguc

SEQ ID NO: 85373 - RNA, 22 nt, Human
uccuugcacauuaucugggaaa

SEQ ID NO: 85374 - RNA, 22 nt, Human
uccuugcagacaucucucuuca

SEQ ID NO: 85375 - RNA, 22 nt, Human
uccuugcagcaggaacccacuu

SEQ ID NO: 85376 - RNA, 21 nt, Human
uccuugcuauuuuccucagcu

SEQ ID NO: 85377 - RNA, 22 nt, Human
uccuuggagcucuccaagggau

SEQ ID NO: 85378 - RNA, 22 nt, Human
uccuuggagucaugauggaggu

SEQ ID NO: 85379 - RNA, 22 nt, Human
uccuuggcaagacacagcacag

SEQ ID NO: 85380 - RNA, 22 nt, Human
uccuuggcaagcugcaauggga

SEQ ID NO: 85381 - RNA, 22 nt, Human
uccuuggccuaaggagaagagg

SEQ ID NO: 85382 - RNA, 22 nt, Human
uccuuggccuggguggggucuc

SEQ ID NO: 85383 - RNA, 22 nt, Human
uccuuggcuuucuggagcuucu

SEQ ID NO: 85384 - RNA, 22 nt, Human
uccuugggucagugagugaggu

SEQ ID NO: 85385 - RNA, 22 nt, Human
uccuuguaaaggagcucuaaca

SEQ ID NO: 85386 - RNA, 22 nt, Human
uccuuuaucugcucagaaagua

SEQ ID NO: 85387 - RNA, 22 nt, Human
uccuuuaugugaguuguuuccc

SEQ ID NO: 85388 - RNA, 22 nt, Human
uccuuuccaugcuucuagaggc

SEQ ID NO: 85389 - RNA, 22 nt, Human
uccuuucuaucuuggguaucua

SEQ ID NO: 85390 - RNA, 22 nt, Human
uccuuucuccgggggacuguug

SEQ ID NO: 85391 - RNA, 22 nt, Human
uccuuucuuuucuaugggccca

SEQ ID NO: 85392 - RNA, 19 nt, Human
uccuuugaauaucaguuga

SEQ ID NO: 85393 - RNA, 22 nt, Human
uccuuuggagcuugacugguag

SEQ ID NO: 85394 - RNA, 22 nt, Human
uccuuugguaguuuucuuaaag

SEQ ID NO: 85395 - RNA, 22 nt, Human
uccuuuuuaagucguuguggua

SEQ ID NO: 85396 - RNA, 22 nt, Human
uccuuuuuauaguuagagaaac

SEQ ID NO: 85397 - RNA, 22 nt, Human
uccuuuuucucacacaacgaac

SEQ ID NO: 85398 - RNA, 22 nt, Human
ucgaaauaauuuagaauauaga

SEQ ID NO: 85399 - RNA, 22 nt, Human
ucgaagguuauugucuuuacgu

SEQ ID NO: 85400 - RNA, 22 nt, Human
ucgauagaaaagagcugcaggg

SEQ ID NO: 85401 - RNA, 22 nt, Human
ucgauuuguuugggggagaagu

SEQ ID NO: 85402 - RNA, 22 nt, Human
ucgcgcccccaagcgucauugg

SEQ ID NO: 85403 - RNA, 22 nt, Human
ucggagaguucaugaagacccg

SEQ ID NO: 85404 - RNA, 22 nt, Human
ucggagaguuggaaguagcaga

SEQ ID NO: 85405 - RNA, 22 nt, Human
ucggagcgucacuggcuggagg

SEQ ID NO: 85406 - RNA, 20 nt, Human
ucggcuggacacugugcacu

SEQ ID NO: 85407 - RNA, 22 nt, Human
ucgggacgguggcauuugugcc

SEQ ID NO: 85408 - RNA, 22 nt, Human
ucgggcucgcucuccuagcgga

SEQ ID NO: 85409 - RNA, 22 nt, Human
ucgggguagacgccagcucgga

SEQ ID NO: 85410 - RNA, 22 nt, Human
ucggugcgcgaggcgcgguccc

SEQ ID NO: 85411 - RNA, 22 nt, Human
ucgugaggcucugcaucgcaca

SEQ ID NO: 85412 - RNA, 22 nt, Human
ucguggaugcgcagggcggccu

SEQ ID NO: 85413 - RNA, 22 nt, Human
ucgugucagaucagagguuccu

SEQ ID NO: 85414 - RNA, 22 nt, Human
ucguuuuagguggacauugugu

SEQ ID NO: 85415 - RNA, 23 nt, Human
ucuaaaauucaucauuuacguuc

SEQ ID NO: 85416 - RNA, 22 nt, Human
ucuaaacacuaagucuugaugc

SEQ ID NO: 85417 - RNA, 22 nt, Human
ucuaaacauuaugauaguagag

SEQ ID NO: 85418 - RNA, 22 nt, Human
ucuaaacauugguauggagcag

SEQ ID NO: 85419 - RNA, 22 nt, Human
ucuaaacuaggguuaaaggaaa

SEQ ID NO: 85420 - RNA, 22 nt, Human
ucuaaagacacuuuuuacaggg

SEQ ID NO: 85421 - RNA, 22 nt, Human
ugugcucuugucugugacuaac

SEQ ID NO: 85422 - RNA, 22 nt, Human
ugugcugagugaucccauuccu

SEQ ID NO: 85423 - RNA, 22 nt, Human
ugugcugcugugaauaagaccu

SEQ ID NO: 85424 - RNA, 22 nt, Human
ugugcugggagauagagggagg

SEQ ID NO: 85425 - RNA, 22 nt, Human
ugugcugguacaugugaggaug

SEQ ID NO: 85426 - RNA, 22 nt, Human
ugugcuucaucacuucucaguu

SEQ ID NO: 85427 - RNA, 22 nt, Human
ugugcuucuugcagcuccugua

SEQ ID NO: 85428 - RNA, 22 nt, Human
uguggaaagucaaguuccagga

SEQ ID NO: 85429 - RNA, 22 nt, Human
uguggaacaccuagaaugggua

SEQ ID NO: 85430 - RNA, 22 nt, Human
uguggaagaacacuggccaggc

SEQ ID NO: 85431 - RNA, 22 nt, Human
uguggaaugcuccuaagugaau

SEQ ID NO: 85432 - RNA, 22 nt, Human
uguggaauguccucagcauccu

SEQ ID NO: 85433 - RNA, 22 nt, Human
uguggacuagagaauucuguug

SEQ ID NO: 85434 - RNA, 22 nt, Human
uguggacuaguguuuggauuuu

SEQ ID NO: 85435 - RNA, 22 nt, Human
uguggacugugcugccacagug

SEQ ID NO: 85436 - RNA, 22 nt, Human
uguggagaagaaggccacugca

SEQ ID NO: 85437 - RNA, 22 nt, Human
uguggagacuauagccauaaca

SEQ ID NO: 85438 - RNA, 22 nt, Human
uguggagaugugagcaagggga

SEQ ID NO: 85439 - RNA, 22 nt, Human
uguggagcagcgucacagccuu

SEQ ID NO: 85440 - RNA, 22 nt, Human
uguggaguggucugaaggcucc

SEQ ID NO: 85441 - RNA, 22 nt, Human
uguggauaaugcacuauccaua

SEQ ID NO: 85442 - RNA, 22 nt, Human
uguggcacauacacaggagggc

SEQ ID NO: 85443 - RNA, 22 nt, Human
uguggcagaacugggacucaaa

SEQ ID NO: 85444 - RNA, 22 nt, Human
uguggcagacaagauucuaugu

SEQ ID NO: 85445 - RNA, 22 nt, Human
uguggcagcuggagguggagaa

SEQ ID NO: 85446 - RNA, 22 nt, Human
uguggcaggaagagcuucugag

SEQ ID NO: 85447 - RNA, 20 nt, Human
uguggcaggaugagggcgga

SEQ ID NO: 85448 - RNA, 22 nt, Human
uguggcaggaugcggaagaugc

SEQ ID NO: 85449 - RNA, 22 nt, Human
uguggcaggcauucugaggcug

SEQ ID NO: 85450 - RNA, 22 nt, Human
uguggcagucucacuggagggc

SEQ ID NO: 85451 - RNA, 22 nt, Human
uguggcauacacaugagguggu

SEQ ID NO: 85452 - RNA, 22 nt, Human
uguggccagccacaggcauggu

SEQ ID NO: 85453 - RNA, 22 nt, Human
uguggccagggggccauguccc

SEQ ID NO: 85454 - RNA, 22 nt, Human
uguggccucaaggcugcccuca

SEQ ID NO: 85455 - RNA, 22 nt, Human
uguggccuccccacuucugggg

SEQ ID NO: 85456 - RNA, 22 nt, Human
uguggccucuaagcucacgaag

SEQ ID NO: 85457 - RNA, 22 nt, Human
uguggccugauuuugcaucucu

SEQ ID NO: 85458 - RNA, 22 nt, Human
uguggccugggaaaugaguguu

SEQ ID NO: 85459 - RNA, 19 nt, Human
uguggccuggggacaggcc

SEQ ID NO: 85460 - RNA, 22 nt, Human
uguggcuccacuccacauuaau

SEQ ID NO: 85461 - RNA, 22 nt, Human
uguggcucggccagcugcugaa

SEQ ID NO: 85462 - RNA, 22 nt, Human
uguggcucucagauccuccaau

SEQ ID NO: 85463 - RNA, 22 nt, Human
uguggcucugccuggcaguauu

SEQ ID NO: 85464 - RNA, 22 nt, Human
uguggcugacuccuggucccca

SEQ ID NO: 85465 - RNA, 22 nt, Human
uguggcugcaaaggaaggcugc

SEQ ID NO: 85466 - RNA, 22 nt, Human
uguggcugcagacacuggagcc

SEQ ID NO: 85467 - RNA, 22 nt, Human
uguggcugggaagaagguaacu

SEQ ID NO: 85468 - RNA, 22 nt, Human
uguggcuguggaugcuuuccag

SEQ ID NO: 85469 - RNA, 22 nt, Human
uguggcuuaagaaugccuuuaa

SEQ ID NO: 85470 - RNA, 22 nt, Human
uguggcuuccacgauggucacc

SEQ ID NO: 85471 - RNA, 22 nt, Human
ugugggacagggacagcaagag

SEQ ID NO: 85472 - RNA, 22 nt, Human
ugugggaggauucagaauuggg

SEQ ID NO: 85473 - RNA, 22 nt, Human
ugugggaugguuuugccagaau

SEQ ID NO: 85474 - RNA, 22 nt, Human
ugugggcagcuggagcuguuca

SEQ ID NO: 85475 - RNA, 22 nt, Human
ugugggcccuaggcaccuuguc

SEQ ID NO: 85476 - RNA, 20 nt, Human
ugugggcccuuggcuggcaa

SEQ ID NO: 85477 - RNA, 22 nt, Human
ugugggcucccccucacucugu

SEQ ID NO: 85478 - RNA, 19 nt, Human
uguggggagucagggggcu

SEQ ID NO: 85479 - RNA, 22 nt, Human
uguggggcugugguguucuucu

SEQ ID NO: 85480 - RNA, 22 nt, Human
ugugggugaugaauuuguucuu

SEQ ID NO: 85481 - RNA, 22 nt, Human
uguggguguucucacuuagaua

SEQ ID NO: 85482 - RNA, 22 nt, Human
ugugguagagggcagaugggca

SEQ ID NO: 85483 - RNA, 22 nt, Human
ugugguagucucagggcaguau

SEQ ID NO: 85484 - RNA, 22 nt, Human
uguggucuccugucuuggccuu

SEQ ID NO: 85485 - RNA, 22 nt, Human
uguggucuuggaagaaguugcu

SEQ ID NO: 85486 - RNA, 22 nt, Human
ucugugcaguucuugucuugac

SEQ ID NO: 85487 - RNA, 20 nt, Human
ucugugcaguuuaggaaggc

SEQ ID NO: 85488 - RNA, 22 nt, Human
ucugugcauccuuaacgccugc

SEQ ID NO: 85489 - RNA, 22 nt, Human
ucugugcauuguaacaacuaaa

SEQ ID NO: 85490 - RNA, 22 nt, Human
ucugugccaagcuuauaucugu

SEQ ID NO: 85491 - RNA, 22 nt, Human
ucugugcccucggugcugggcc

SEQ ID NO: 85492 - RNA, 22 nt, Human
ucugugccucaucugguucagg

SEQ ID NO: 85493 - RNA, 22 nt, Human
ucugugccuuuaagaagcucau

SEQ ID NO: 85494 - RNA, 22 nt, Human
ucugugcuaaugcuucacaaua

SEQ ID NO: 85495 - RNA, 22 nt, Human
ucugugcuagcacgcagcaagg

SEQ ID NO: 85496 - RNA, 22 nt, Human
ucugugcucaugcaugugaauu

SEQ ID NO: 85497 - RNA, 22 nt, Human
ucugugcucauucagucauuca

SEQ ID NO: 85498 - RNA, 21 nt, Human
ucugugcugccgucaacaucc

SEQ ID NO: 85499 - RNA, 22 nt, Human
ucugugcuuaacuacucacccc

SEQ ID NO: 85500 - RNA, 22 nt, Human
ucugugcuuucccugccuucuu

SEQ ID NO: 85501 - RNA, 21 nt, Human
ucugugcuuuuuuggcuccua

SEQ ID NO: 85502 - RNA, 22 nt, Human
ucuguggaagauuccaggcguu

SEQ ID NO: 85503 - RNA, 19 nt, Human
ucuguggcaccugggaggg

SEQ ID NO: 85504 - RNA, 22 nt, Human
ucuguggcacgauugcacugca

SEQ ID NO: 85505 - RNA, 20 nt, Human
ucuguggcagguggcgcuug

SEQ ID NO: 85506 - RNA, 22 nt, Human
ucuguggcaugaggaaauaggc

SEQ ID NO: 85507 - RNA, 22 nt, Human
ucuguggcccaagugauggcug

SEQ ID NO: 85508 - RNA, 19 nt, Human
ucuguggccuucccugaug

SEQ ID NO: 85509 - RNA, 22 nt, Human
ucuguggcugguaauugcaugu

SEQ ID NO: 85510 - RNA, 22 nt, Human
ucuguggcugucuuuccagagg

SEQ ID NO: 85511 - RNA, 22 nt, Human
ucuguggcugugcugggccaga

SEQ ID NO: 85512 - RNA, 22 nt, Human
ucuguggcuugggccugccugu

SEQ ID NO: 85513 - RNA, 22 nt, Human
ucuguguaagaccagugcuggg

SEQ ID NO: 85514 - RNA, 22 nt, Human
ucuguguacgcaggcgugcgcg

SEQ ID NO: 85515 - RNA, 22 nt, Human
ucugugucagaagauaucaugg

SEQ ID NO: 85516 - RNA, 22 nt, Human
ucugugucagcagcacucagcc

SEQ ID NO: 85517 - RNA, 22 nt, Human
ucugugucucaaucccaugcug

SEQ ID NO: 85518 - RNA, 22 nt, Human
ucugugucuguuacuucacugc

SEQ ID NO: 85519 - RNA, 22 nt, Human
ucugugugaccauaagccagcu

SEQ ID NO: 85520 - RNA, 22 nt, Human
ucugugugcccuaaagccugcu

SEQ ID NO: 85521 - RNA, 22 nt, Human
ucugugugugccuguuaauauu

SEQ ID NO: 85522 - RNA, 22 nt, Human
ucuguuaaaaguggaauaauag

SEQ ID NO: 85523 - RNA, 22 nt, Human
ucuguuagagagguaguucuug

SEQ ID NO: 85524 - RNA, 22 nt, Human
ucuguuauauagauaaugugug

SEQ ID NO: 85525 - RNA, 22 nt, Human
ucuguuaugcauaagcaucagu

SEQ ID NO: 85526 - RNA, 22 nt, Human
ucuguuauggaaguuuccuuuu

SEQ ID NO: 85527 - RNA, 17 nt, Human
ucuguucaagugagagg

SEQ ID NO: 85528 - RNA, 22 nt, Human
ucuguucaguugauguaguuuu

SEQ ID NO: 85529 - RNA, 22 nt, Human
ucuguucaguuguaccuucccc

SEQ ID NO: 85530 - RNA, 22 nt, Human
uccugucucaguguauuugcag

SEQ ID NO: 85531 - RNA, 22 nt, Human
uccugucugucuuuggucccuu

SEQ ID NO: 85532 - RNA, 22 nt, Human
uccugugaccagcuuccaugcu

SEQ ID NO: 85533 - RNA, 22 nt, Human
uccugugaguagauaguauugu

SEQ ID NO: 85534 - RNA, 22 nt, Human
uccuguggagaggacuggaggu

SEQ ID NO: 85535 - RNA, 18 nt, Human
uccuguggcccagaguuu

SEQ ID NO: 85536 - RNA, 22 nt, Human
uccugugggcucucggccucca

SEQ ID NO: 85537 - RNA, 22 nt, Human
uccuguggggaaaagccuaucu

SEQ ID NO: 85538 - RNA, 22 nt, Human
uccuguggucuggaaggaaugg

SEQ ID NO: 85539 - RNA, 22 nt, Human
uccugugugucagaugcacagu

SEQ ID NO: 85540 - RNA, 22 nt, Human
uccuguguucuagguauggucu

SEQ ID NO: 85541 - RNA, 22 nt, Human
uccuguuaguguuagacuuccc

SEQ ID NO: 85542 - RNA, 22 nt, Human
uccuguuguucgccugcgaugg

SEQ ID NO: 85543 - RNA, 22 nt, Human
uccuguuucaacccuuacacug

SEQ ID NO: 85544 - RNA, 22 nt, Human
uccuuaaauauuuacuguuaac

SEQ ID NO: 85545 - RNA, 22 nt, Human
uccuuaaaugugaucuagauuu

SEQ ID NO: 85546 - RNA, 22 nt, Human
uccuuaauauggaagaguucuc

SEQ ID NO: 85547 - RNA, 22 nt, Human
uccuuacacuggggaaggugua

SEQ ID NO: 85548 - RNA, 22 nt, Human
uccuuacagguuacagaaagca

SEQ ID NO: 85549 - RNA, 22 nt, Human
uccuuagagacaagaccaguuu

SEQ ID NO: 85550 - RNA, 22 nt, Human
uccuuagcaacacuguuauaau

SEQ ID NO: 85551 - RNA, 22 nt, Human
uccuuagccggagcagcucauc

SEQ ID NO: 85552 - RNA, 18 nt, Human
uccuuagcugagcuuguc

SEQ ID NO: 85553 - RNA, 22 nt, Human
uccuuagcuuacaagucuucug

SEQ ID NO: 85554 - RNA, 22 nt, Human
uccuuauaucuauaguuuugca

SEQ ID NO: 85555 - RNA, 22 nt, Human
uccuuauaucuucagagaagca

SEQ ID NO: 85556 - RNA, 22 nt, Human
uccuucaacuuuuuacuugccc

SEQ ID NO: 85557 - RNA, 22 nt, Human
uccuucaccuuagcccuccuag

SEQ ID NO: 85558 - RNA, 22 nt, Human
uccuucagauuccugcuucugg

SEQ ID NO: 85559 - RNA, 22 nt, Human
uccuucagggcugaccacaggc

SEQ ID NO: 85560 - RNA, 17 nt, Human
uccuucagugccucugc

SEQ ID NO: 85561 - RNA, 22 nt, Human
uccuucagugucccgcucaggu

SEQ ID NO: 85562 - RNA, 22 nt, Human
uccuucaguuaucacaguacug

SEQ ID NO: 85563 - RNA, 19 nt, Human
uccuuccccccagcacaga

SEQ ID NO: 85564 - RNA, 22 nt, Human
uccuuccugcaggccaaguccu

SEQ ID NO: 85565 - RNA, 23 nt, Human
uccuuccuuugagaggcuccauc

SEQ ID NO: 85566 - RNA, 22 nt, Human
uccuucuaccagcuggauaccu

SEQ ID NO: 85567 - RNA, 22 nt, Human
uccuucuauuuguuuauguggc

SEQ ID NO: 85568 - RNA, 19 nt, Human
uccuucuccggccaccccg

SEQ ID NO: 85569 - RNA, 22 nt, Human
uccuucuccuccuugagugaca

SEQ ID NO: 85570 - RNA, 20 nt, Human
uccuugaaagugggguauau

SEQ ID NO: 85571 - RNA, 22 nt, Human
uccuugaacagagggccugggu

SEQ ID NO: 85572 - RNA, 22 nt, Human
uccuugaagcaacgugcagaca

SEQ ID NO: 85573 - RNA, 22 nt, Human
uccuuggagguguucaucugcc

SEQ ID NO: 85574 - RNA, 22 nt, Human
uccuuggcacacucggaucuga

SEQ ID NO: 85575 - RNA, 22 nt, Human
uccuuggcagcagggagcauga

SEQ ID NO: 85576 - RNA, 22 nt, Human
uccuugggaaacaucauguaau

SEQ ID NO: 85577 - RNA, 22 nt, Human
uccuuggggacgcugacaucgu

SEQ ID NO: 85578 - RNA, 19 nt, Human
uccuugugacugugugaaa

SEQ ID NO: 85579 - RNA, 22 nt, Human
uccuuguugcugcagucaccug

SEQ ID NO: 85580 - RNA, 22 nt, Human
uccuuuaaagaacugugcuuuu

SEQ ID NO: 85581 - RNA, 22 nt, Human
uccuuuaacuaguuaccauguu

SEQ ID NO: 85582 - RNA, 18 nt, Human
uccuuucaccccuucucu

SEQ ID NO: 85583 - RNA, 22 nt, Human
uccuuuccagccucaccucagc

SEQ ID NO: 85584 - RNA, 22 nt, Human
uccuuucccuuuccauccuggc

SEQ ID NO: 85585 - RNA, 22 nt, Human
uccuuucucccagguuaguugu

SEQ ID NO: 85586 - RNA, 22 nt, Human
uccuuucuccuuccgacuucau

SEQ ID NO: 85587 - RNA, 22 nt, Human
uccuuucugggccucagugacu

SEQ ID NO: 85588 - RNA, 22 nt, Human
uccuuucugugcugucaggucc

SEQ ID NO: 85589 - RNA, 19 nt, Human
uccuuucuguuccugagau

SEQ ID NO: 85590 - RNA, 22 nt, Human
uccuuugguuguagacaggaau

SEQ ID NO: 85591 - RNA, 22 nt, Human
uccuuuguggaaauacuugugg

SEQ ID NO: 85592 - RNA, 22 nt, Human
uccuuuguuaaggagguuuguu

SEQ ID NO: 85593 - RNA, 22 nt, Human
uccuuuguucgggugugcuguc

SEQ ID NO: 85594 - RNA, 22 nt, Human
uccuuuucucuaguaagcuuua

SEQ ID NO: 85595 - RNA, 22 nt, Human
uccuuuuugguccaaggugacc

SEQ ID NO: 85596 - RNA, 22 nt, Human
ucgaaauacuguuuccccuuua

SEQ ID NO: 85597 - RNA, 22 nt, Human
ucgaacucauagucguagcugu

SEQ ID NO: 85598 - RNA, 22 nt, Human
ucgaggcagugcgcuggcuguu

SEQ ID NO: 85599 - RNA, 19 nt, Human
ucgagucaagacacuaggc

SEQ ID NO: 85600 - RNA, 21 nt, Human
uguggucuuuuaguuccauca

SEQ ID NO: 85601 - RNA, 22 nt, Human
uguggugugucucacaaaugca

SEQ ID NO: 85602 - RNA, 22 nt, Human
ugugguuuuucaguugcuggag

SEQ ID NO: 85603 - RNA, 22 nt, Human
uguguaaaagauuaguuuacua

SEQ ID NO: 85604 - RNA, 22 nt, Human
uguguaaagcuuguuccagaaa

SEQ ID NO: 85605 - RNA, 22 nt, Human
uguguaacaaucuacacuuagg

SEQ ID NO: 85606 - RNA, 21 nt, Human
uguguaauuuuuuaaauggcc

SEQ ID NO: 85607 - RNA, 22 nt, Human
uguguacacaugacaggcaccc

SEQ ID NO: 85608 - RNA, 22 nt, Human
uguguacaggacagaaaggagg

SEQ ID NO: 85609 - RNA, 22 nt, Human
uguguacauugccuuuuaaagg

SEQ ID NO: 85610 - RNA, 22 nt, Human
uguguacucaauugagccauuu

SEQ ID NO: 85611 - RNA, 22 nt, Human
uguguacuugaaagggcagguc

SEQ ID NO: 85612 - RNA, 22 nt, Human
uguguacuugcugaucuuaucu

SEQ ID NO: 85613 - RNA, 22 nt, Human
uguguagaaagaucuccaagau

SEQ ID NO: 85614 - RNA, 22 nt, Human
uguguagugauuuucuuccaac

SEQ ID NO: 85615 - RNA, 22 nt, Human
uguguauaacucuuaauucauu

SEQ ID NO: 85616 - RNA, 22 nt, Human
uguguauaagugagaaugcugu

SEQ ID NO: 85617 - RNA, 22 nt, Human
uguguauaauuagaccauuuac

SEQ ID NO: 85618 - RNA, 22 nt, Human
uguguauacauacauacacacg

SEQ ID NO: 85619 - RNA, 22 nt, Human
uguguaugcauacacacauaga

SEQ ID NO: 85620 - RNA, 22 nt, Human
uguguauguaagcaugugcaua

SEQ ID NO: 85621 - RNA, 22 nt, Human
uguguauguuuugagguugcua

SEQ ID NO: 85622 - RNA, 22 nt, Human
ugugucaaauuguuuuacacag

SEQ ID NO: 85623 - RNA, 22 nt, Human
ugugucaaccuguggccgggug

SEQ ID NO: 85624 - RNA, 21 nt, Human
ugugucacuaacuagaggcua

SEQ ID NO: 85625 - RNA, 22 nt, Human
ugugucagaaaucagugccucg

SEQ ID NO: 85626 - RNA, 22 nt, Human
ugugucagaaguacuuuuggaa

SEQ ID NO: 85627 - RNA, 22 nt, Human
ugugucagauuuaggcucaaac

SEQ ID NO: 85628 - RNA, 22 nt, Human
ugugucagcaggggagggaacu

SEQ ID NO: 85629 - RNA, 21 nt, Human
ugugucagucuuuggaagcaa

SEQ ID NO: 85630 - RNA, 23 nt, Human
ugugucauaaaauuaaaacuuca

SEQ ID NO: 85631 - RNA, 22 nt, Human
ugugucauauuaguauugagag

SEQ ID NO: 85632 - RNA, 22 nt, Human
ugugucaugugugaggcucccu

SEQ ID NO: 85633 - RNA, 22 nt, Human
uguguccaacccagggacaagu

SEQ ID NO: 85634 - RNA, 22 nt, Human
uguguccacgcacuggcaugau

SEQ ID NO: 85635 - RNA, 22 nt, Human
uguguccaucugacaggagagg

SEQ ID NO: 85636 - RNA, 22 nt, Human
ugugucccuuggaaccucagcu

SEQ ID NO: 85637 - RNA, 22 nt, Human
uguguccucaugagguuugcag

SEQ ID NO: 85638 - RNA, 22 nt, Human
uguguccucauguggcagagag

SEQ ID NO: 85639 - RNA, 22 nt, Human
uguugcgaugaagagcuucacg

SEQ ID NO: 85640 - RNA, 22 nt, Human
uguugcuacucucccugggagg

SEQ ID NO: 85641 - RNA, 22 nt, Human
uguuggaaaggccaggcugugg

SEQ ID NO: 85642 - RNA, 22 nt, Human
uguuggaauaagugcuugaagg

SEQ ID NO: 85643 - RNA, 19 nt, Human
uguuggaggugcugaauua

SEQ ID NO: 85644 - RNA, 22 nt, Human
uguuggcacuaucucauguuuu

SEQ ID NO: 85645 - RNA, 22 nt, Human
uguuggcagugcuacagucagu

SEQ ID NO: 85646 - RNA, 22 nt, Human
uguuguacucaacagaugaauu

SEQ ID NO: 85647 - RNA, 22 nt, Human
uguuguagcuugacagcagcca

SEQ ID NO: 85648 - RNA, 21 nt, Human
uguuguuuuauggcuaugaau

SEQ ID NO: 85649 - RNA, 22 nt, Human
uguuguuuucucauggagaaua

SEQ ID NO: 85650 - RNA, 22 nt, Human
uguuuaaauagaacauacugca

SEQ ID NO: 85651 - RNA, 22 nt, Human
uguuuaacuaguuuucacacuu

SEQ ID NO: 85652 - RNA, 21 nt, Human
uguuuaaguacuccuuucugg

SEQ ID NO: 85653 - RNA, 22 nt, Human
uguuuaauaauucuaugauagu

SEQ ID NO: 85654 - RNA, 22 nt, Human
uguuuacaaggaguuuauauug

SEQ ID NO: 85655 - RNA, 22 nt, Human
uguuuacacaauagucucucuc

SEQ ID NO: 85656 - RNA, 22 nt, Human
uguuuacagcacugcacacugc

SEQ ID NO: 85657 - RNA, 22 nt, Human
uguuuacauauuuggucucaga

SEQ ID NO: 85658 - RNA, 22 nt, Human
uguuuacuaugauguaaccuau

SEQ ID NO: 85659 - RNA, 21 nt, Human
uguuuacucccugcaagcacg

SEQ ID NO: 85660 - RNA, 22 nt, Human
uguuuagaugcaaagucucaca

SEQ ID NO: 85661 - RNA, 22 nt, Human
uguuuauagggucugucacuug

SEQ ID NO: 85662 - RNA, 22 nt, Human
uguuuauucauggcuaaugaaa

SEQ ID NO: 85663 - RNA, 22 nt, Human
uguuuauuuucaggauggauug

SEQ ID NO: 85664 - RNA, 22 nt, Human
uguuucaacuguuaagauaugc

SEQ ID NO: 85665 - RNA, 22 nt, Human
uguuucaaguuugcucaaagga

SEQ ID NO: 85666 - RNA, 22 nt, Human
uguuucacugaaagccuuacua

SEQ ID NO: 85667 - RNA, 22 nt, Human
uguuucaggaccuaucuuuuag

SEQ ID NO: 85668 - RNA, 22 nt, Human
uguuucaguccacuuaggcagc

SEQ ID NO: 85669 - RNA, 22 nt, Human
uguuucagucccuguguucaau

SEQ ID NO: 85670 - RNA, 22 nt, Human
uguuuccuaagugucucugaag

SEQ ID NO: 85671 - RNA, 22 nt, Human
uguuucuagagaaaauauuuac

SEQ ID NO: 85672 - RNA, 22 nt, Human
uguuucuaggucaauaauuuuu

SEQ ID NO: 85673 - RNA, 22 nt, Human
uguuucuguaugaucaauauug

SEQ ID NO: 85674 - RNA, 19 nt, Human
uguuucuuccuccaucuga

SEQ ID NO: 85675 - RNA, 22 nt, Human
uguuucuugauaaagcagaaaa

SEQ ID NO: 85676 - RNA, 22 nt, Human
uguuucuugggugcucacauca

SEQ ID NO: 85677 - RNA, 22 nt, Human
uguuugaaaaguggagauuuau

SEQ ID NO: 85678 - RNA, 22 nt, Human
uguuugaacugaauaacauagu

SEQ ID NO: 85679 - RNA, 22 nt, Human
uguuugaauaacuuggauauau

SEQ ID NO: 85680 - RNA, 22 nt, Human
uguuugaugacgacauuguaga

SEQ ID NO: 85681 - RNA, 22 nt, Human
uguuugcaaccccuugugagaa

SEQ ID NO: 85682 - RNA, 22 nt, Human
uguuugcauuguuaauucaguc

SEQ ID NO: 85683 - RNA, 22 nt, Human
uguuugcuguuuucuccaauga

SEQ ID NO: 85684 - RNA, 22 nt, Human
uguuugguuccagagggccucu

SEQ ID NO: 85685 - RNA, 17 nt, Human
uguuugguugauuggug

SEQ ID NO: 85686 - RNA, 22 nt, Human
uguuuguacucaaagccaugag

SEQ ID NO: 85687 - RNA, 22 nt, Human
uguuuuaagggucaacugucac

SEQ ID NO: 85688 - RNA, 22 nt, Human
uguuuucagucauauagcaggu

SEQ ID NO: 85689 - RNA, 22 nt, Human
uguuuucaugguuaugugucua

SEQ ID NO: 85690 - RNA, 22 nt, Human
uguuuuccuccugguuucugcc

SEQ ID NO: 85691 - RNA, 21 nt, Human
uguuuucuaaagggcggauca

SEQ ID NO: 85692 - RNA, 22 nt, Human
uguuuucugaugguuaaugagu

SEQ ID NO: 85693 - RNA, 22 nt, Human
uguuuucuguguagagaucaca

SEQ ID NO: 85694 - RNA, 23 nt, Human
uguuuucuuguccugguauaauu

SEQ ID NO: 85695 - RNA, 22 nt, Human
uguuuuguagcuaauagcuauu

SEQ ID NO: 85696 - RNA, 22 nt, Human
uguuuuguucacugcauugucc

SEQ ID NO: 85697 - RNA, 22 nt, Human
uguuuuuaaaauguccugguua

SEQ ID NO: 85698 - RNA, 22 nt, Human
uguuuuuacugugauccagaaa

SEQ ID NO: 85699 - RNA, 22 nt, Human
uguuuuuaucucuguguacaac

SEQ ID NO: 85700 - RNA, 22 nt, Human
uguuuuuccaugugcagaacaa

SEQ ID NO: 85701 - RNA, 22 nt, Human
uguuuuugucuccuugucugcu

SEQ ID NO: 85702 - RNA, 22 nt, Human
uguuuuuuccuuaugcaaucug

SEQ ID NO: 85703 - RNA, 22 nt, Human
uguuuuuuuauauaccugaagu

SEQ ID NO: 85704 - RNA, 22 nt, Human
uuaaaacugcaaauccuacuga

SEQ ID NO: 85705 - RNA, 22 nt, Human
uuaaaagagcagcccagcauau

SEQ ID NO: 85706 - RNA, 22 nt, Human
uuaaaaggcaucauaggugaau

SEQ ID NO: 85707 - RNA, 22 nt, Human
uuaaaagggauguuaucuguaa

SEQ ID NO: 85708 - RNA, 23 nt, Human
uuaaaaguggagagagaagcugg

SEQ ID NO: 85709 - RNA, 22 nt, Human
uuaaaaucacagucacccagua

SEQ ID NO: 85710 - RNA, 22 nt, Human
uuaaaaugaauauugauuagca

SEQ ID NO: 85711 - RNA, 21 nt, Human
uuaaaaugaggaagugguggc

SEQ ID NO: 85712 - RNA, 22 nt, Human
uuaaaauuauggcccauuugga

SEQ ID NO: 85713 - RNA, 22 nt, Human
uuaaaauuuccccaccauguau

SEQ ID NO: 85714 - RNA, 22 nt, Human
uuaaacacacugagauuuaugu

SEQ ID NO: 85715 - RNA, 22 nt, Human
ucuucaguauuuggauaacauu

SEQ ID NO: 85716 - RNA, 22 nt, Human
ucuucagugaauggcaagaucu

SEQ ID NO: 85717 - RNA, 22 nt, Human
ucuucagugcauguuaccuaua

SEQ ID NO: 85718 - RNA, 22 nt, Human
ucuucauacaauuucagacauc

SEQ ID NO: 85719 - RNA, 18 nt, Human
ucuucaucuccugagcug

SEQ ID NO: 85720 - RNA, 22 nt, Human
ucuucaugaaauugauugcuua

SEQ ID NO: 85721 - RNA, 22 nt, Human
ucuucaugcaccucacagcuag

SEQ ID NO: 85722 - RNA, 23 nt, Human
ucuucaugcccaggccuuggugc

SEQ ID NO: 85723 - RNA, 23 nt, Human
ucuucauggccaucugguucuuc

SEQ ID NO: 85724 - RNA, 22 nt, Human
ucuucaugucuugccugauaua

SEQ ID NO: 85725 - RNA, 22 nt, Human
ucuucauguuaguuggguuuuc

SEQ ID NO: 85726 - RNA, 22 nt, Human
ucuucauuuuauagcaucugug

SEQ ID NO: 85727 - RNA, 22 nt, Human
ucuuccaaaugaauaugguuuu

SEQ ID NO: 85728 - RNA, 22 nt, Human
ucuuccaagguugcacacuauc

SEQ ID NO: 85729 - RNA, 22 nt, Human
ucuuccaauaccuagauuuugg

SEQ ID NO: 85730 - RNA, 22 nt, Human
ucuuccagcuguaggaccuagg

SEQ ID NO: 85731 - RNA, 18 nt, Human
ucuuccagcuucuggagg

SEQ ID NO: 85732 - RNA, 22 nt, Human
ucuuccaggcccugccacagcu

SEQ ID NO: 85733 - RNA, 22 nt, Human
ucuuccaggcuagaguuguugc

SEQ ID NO: 85734 - RNA, 22 nt, Human
ucuucccaaugcaaaguaggac

SEQ ID NO: 85735 - RNA, 22 nt, Human
ucuucccagaccuuacauguga

SEQ ID NO: 85736 - RNA, 22 nt, Human
ucuuccuagaaggaagaaaucu

SEQ ID NO: 85737 - RNA, 22 nt, Human
ucuuccuaugccaacauucugu

SEQ ID NO: 85738 - RNA, 22 nt, Human
ucuuccucaugaauucucguau

SEQ ID NO: 85739 - RNA, 21 nt, Human
ucuuccuccacagcgugccac

SEQ ID NO: 85740 - RNA, 23 nt, Human
ucuuccugaacuaucaggcacau

SEQ ID NO: 85741 - RNA, 22 nt, Human
ucuuccuugccuugcuucauca

SEQ ID NO: 85742 - RNA, 22 nt, Human
ucuucuacuauaauaauuuucu

SEQ ID NO: 85743 - RNA, 22 nt, Human
ucuucucauagcuaguucuucc

SEQ ID NO: 85744 - RNA, 22 nt, Human
ucuucuccagugcuucugcaca

SEQ ID NO: 85745 - RNA, 22 nt, Human
ucuucucuacaccagcagcccc

SEQ ID NO: 85746 - RNA, 17 nt, Human
ucuucucuuccagucuu

SEQ ID NO: 85747 - RNA, 22 nt, Human
ucuucugaagguaggaagcauu

SEQ ID NO: 85748 - RNA, 22 nt, Human
uuacacugacagcugaaaagca

SEQ ID NO: 85749 - RNA, 22 nt, Human
uuacacuuaggguuugucagag

SEQ ID NO: 85750 - RNA, 22 nt, Human
uuacacuuaucuagagccaugg

SEQ ID NO: 85751 - RNA, 22 nt, Human
uuacacuucugaaagccuaggu

SEQ ID NO: 85752 - RNA, 22 nt, Human
uuacacuugaaaacaggauuua

SEQ ID NO: 85753 - RNA, 22 nt, Human
uuacacuuuaaauccagcuugu

SEQ ID NO: 85754 - RNA, 22 nt, Human
uuacacuuuugacaaaccugag

SEQ ID NO: 85755 - RNA, 22 nt, Human
uuacagaaaagggcuuuaagag

SEQ ID NO: 85756 - RNA, 22 nt, Human
uuacagaaaggaaggacugacu

SEQ ID NO: 85757 - RNA, 20 nt, Human
uuacagaaaugauguuauuu

SEQ ID NO: 85758 - RNA, 22 nt, Human
uuacagaagagaaagaauucag

SEQ ID NO: 85759 - RNA, 21 nt, Human
uuacagaauccaugggaaguc

SEQ ID NO: 85760 - RNA, 22 nt, Human
uuacagacaaacuguguuaagu

SEQ ID NO: 85761 - RNA, 22 nt, Human
uuacagagccucauuuuagaga

SEQ ID NO: 85762 - RNA, 22 nt, Human
uuacagagcucauuucuaaggg

SEQ ID NO: 85763 - RNA, 17 nt, Human
uuacagagguaauuaag

SEQ ID NO: 85764 - RNA, 22 nt, Human
uuacagaugggguugcaauaaa

SEQ ID NO: 85765 - RNA, 22 nt, Human
uuacagauguaggaacugaagu

SEQ ID NO: 85766 - RNA, 19 nt, Human
uuacagauguggaaauuga

SEQ ID NO: 85767 - RNA, 22 nt, Human
uuacagauguuucaggaauacu

SEQ ID NO: 85768 - RNA, 22 nt, Human
uuacagauucaagcucuuugaa

SEQ ID NO: 85769 - RNA, 22 nt, Human
uuacagcacagugcuuuuacug

SEQ ID NO: 85770 - RNA, 17 nt, Human
uuacagcagcaauagag

SEQ ID NO: 85771 - RNA, 22 nt, Human
uuacagcagcagggacagacua

SEQ ID NO: 85772 - RNA, 22 nt, Human
uuacagcuuacauuuuaccuug

SEQ ID NO: 85773 - RNA, 21 nt, Human
uuacagguaacacuuccuuuc

SEQ ID NO: 85774 - RNA, 22 nt, Human
uuacagguacuugcugcugaaa

SEQ ID NO: 85775 - RNA, 22 nt, Human
uuacaggucaguuugacugaau

SEQ ID NO: 85776 - RNA, 21 nt, Human
uuacaggucauccaagucacc

SEQ ID NO: 85777 - RNA, 22 nt, Human
uuacaguacagaaaauaacaga

SEQ ID NO: 85778 - RNA, 22 nt, Human
uuacaguaugaucaacuuuuca

SEQ ID NO: 85779 - RNA, 22 nt, Human
uuacagugagggugacauuuac

SEQ ID NO: 85780 - RNA, 22 nt, Human
uuacagugcucuucaagacuuc

SEQ ID NO: 85781 - RNA, 20 nt, Human
uuacagugggaccuuccuga

SEQ ID NO: 85782 - RNA, 22 nt, Human
uuacaguuagguguguaguggu

SEQ ID NO: 85783 - RNA, 22 nt, Human
uuacaguuuaccaagaauauug

SEQ ID NO: 85784 - RNA, 22 nt, Human
uuacauaccucauagacucagg

SEQ ID NO: 85785 - RNA, 22 nt, Human
uuacauauuauccaaaacugcu

SEQ ID NO: 85786 - RNA, 22 nt, Human
uuacaucagcaagaguguaugu

SEQ ID NO: 85787 - RNA, 22 nt, Human
uuacaucauggaggguauugaa

SEQ ID NO: 85788 - RNA, 22 nt, Human
uuacaugagguuaauuaagcau

SEQ ID NO: 85789 - RNA, 22 nt, Human
uuacaugcuuagagaugcaugc

SEQ ID NO: 85790 - RNA, 22 nt, Human
uuacaugggccauuuagacaug

SEQ ID NO: 85791 - RNA, 22 nt, Human
uuacaugggcuugugaguccuu

SEQ ID NO: 85792 - RNA, 21 nt, Human
uuacaugguuuaucauaugga

SEQ ID NO: 85793 - RNA, 22 nt, Human
uuacauguaaucuaaaauaauu

SEQ ID NO: 85794 - RNA, 23 nt, Human
uuacaugugugcacacauucugg

SEQ ID NO: 85795 - RNA, 22 nt, Human
uuacauguuuacggauacacuu

SEQ ID NO: 85796 - RNA, 22 nt, Human
uuacauguuuauggggguacau

SEQ ID NO: 85797 - RNA, 22 nt, Human
uuacauuaagccaauggauucu

SEQ ID NO: 85798 - RNA, 22 nt, Human
uuacauucuuaucucaguuauu

SEQ ID NO: 85799 - RNA, 22 nt, Human
uuacauuucccccuuggaggcu

SEQ ID NO: 85800 - RNA, 22 nt, Human
uuacauuuuaguuaaccuguga

SEQ ID NO: 85801 - RNA, 22 nt, Human
uuaccaauucagacaucucuuc

SEQ ID NO: 85802 - RNA, 22 nt, Human
uuaccacaaaacaguuagaagu

SEQ ID NO: 85803 - RNA, 22 nt, Human
uuaccaguuuugccauuugcua

SEQ ID NO: 85804 - RNA, 22 nt, Human
uuaccauaguacuaucaguuua

SEQ ID NO: 85805 - RNA, 22 nt, Human
uuaccauucaaguucucuccuu

SEQ ID NO: 85806 - RNA, 22 nt, Human
uuacccagugaagccgaggcag

SEQ ID NO: 85807 - RNA, 22 nt, Human
uuacccagugugguuuauagca

SEQ ID NO: 85808 - RNA, 22 nt, Human
uuaccugugucaguauaugaga

SEQ ID NO: 85809 - RNA, 22 nt, Human
uuaccuugaagagcuugagggc

SEQ ID NO: 85810 - RNA, 22 nt, Human
uuacuagccaugugugagaaga

SEQ ID NO: 85811 - RNA, 22 nt, Human
uuacuagcugagggaacuuggg

SEQ ID NO: 85812 - RNA, 19 nt, Human
uuacucacauuuagauucc

SEQ ID NO: 85813 - RNA, 22 nt, Human
uuacucagucucccauacauug

SEQ ID NO: 85814 - RNA, 22 nt, Human
uuacucuuaauggcaacaacug

SEQ ID NO: 85815 - RNA, 22 nt, Human
uuacugaaauaaugaaacacau

SEQ ID NO: 85816 - RNA, 22 nt, Human
uuacugcaacauaauguagucu

SEQ ID NO: 85817 - RNA, 22 nt, Human
uuacugcacgugggacauauau

SEQ ID NO: 85818 - RNA, 22 nt, Human
uuacuguaugagugugguaguc

SEQ ID NO: 85819 - RNA, 22 nt, Human
uuacuguuuugguaccucauug

SEQ ID NO: 85820 - RNA, 22 nt, Human
uuacuuaaaaauucuaagcccc

SEQ ID NO: 85821 - RNA, 22 nt, Human
uuacuuacaaaggcaaaggaag

SEQ ID NO: 85822 - RNA, 22 nt, Human
uuacuucagauuguggaaggca

SEQ ID NO: 85823 - RNA, 19 nt, Human
uuacuucaggagugaaauu

SEQ ID NO: 85824 - RNA, 22 nt, Human
uuacuucuuacaaaagaaauau

SEQ ID NO: 85825 - RNA, 22 nt, Human
uuacuucuugucucaugccuau

SEQ ID NO: 85826 - RNA, 22 nt, Human
uuacuugacauaaaugaguuua

SEQ ID NO: 85827 - RNA, 22 nt, Human
uuacuugaugauguauaaaguc

SEQ ID NO: 85828 - RNA, 21 nt, Human
uuacuuuagaaauugccuuuu

SEQ ID NO: 85829 - RNA, 22 nt, Human
uuacuuugaugaucaaugagcg

SEQ ID NO: 85830 - RNA, 22 nt, Human
uuacuuuggauggucaagaaag

SEQ ID NO: 85831 - RNA, 22 nt, Human
uuacuuuggcaaacuccugccc

SEQ ID NO: 85832 - RNA, 22 nt, Human
uuacuuuggguccugcuuauaa

SEQ ID NO: 85833 - RNA, 22 nt, Human
uuacuuuucuauucgauaugug

SEQ ID NO: 85834 - RNA, 22 nt, Human
uuagaaaaauguucaguaguuu

SEQ ID NO: 85835 - RNA, 22 nt, Human
uuagaaaacauaagugguaaag

SEQ ID NO: 85836 - RNA, 22 nt, Human
uuagaaaauggaggugggaggg

SEQ ID NO: 85837 - RNA, 22 nt, Human
uuagaaaauuugcuucuuugga

SEQ ID NO: 85838 - RNA, 22 nt, Human
uuagaaacaaaauaguuauuug

SEQ ID NO: 85839 - RNA, 20 nt, Human
uuagaaagagcgugauaaga

SEQ ID NO: 85840 - RNA, 22 nt, Human
uuagaaaggagcuuauuucuuu

SEQ ID NO: 85841 - RNA, 22 nt, Human
uuagaaagguuuugcucugaaa

SEQ ID NO: 85842 - RNA, 22 nt, Human
uuagaaauauggugcugccgcc

SEQ ID NO: 85843 - RNA, 22 nt, Human
uuagaaaugucacagaucugau

SEQ ID NO: 85844 - RNA, 22 nt, Human
uuagaacaaagccaccagguga

SEQ ID NO: 85845 - RNA, 22 nt, Human
uuagaacaauauucucccuaca

SEQ ID NO: 85846 - RNA, 21 nt, Human
uuagaacacuugcucuuggaa

SEQ ID NO: 85847 - RNA, 19 nt, Human
ucuccaguugcuuucaggg

SEQ ID NO: 85848 - RNA, 19 nt, Human
ucuccaguuuauucuucca

SEQ ID NO: 85849 - RNA, 22 nt, Human
ucuccauacuugccuuuggccu

SEQ ID NO: 85850 - RNA, 22 nt, Human
ucuccauggauuuggaaaugau

SEQ ID NO: 85851 - RNA, 22 nt, Human
ucucccacgguacaggauaaac

SEQ ID NO: 85852 - RNA, 22 nt, Human
ucucccagaggaucccagugga

SEQ ID NO: 85853 - RNA, 22 nt, Human
ucucccaggugggugccuggag

SEQ ID NO: 85854 - RNA, 22 nt, Human
ucuccccaaccauggcacucac

SEQ ID NO: 85855 - RNA, 22 nt, Human
ucuccccaguauggauucucug

SEQ ID NO: 85856 - RNA, 22 nt, Human
ucuccccuagugcauuaaagug

SEQ ID NO: 85857 - RNA, 22 nt, Human
uuagaaucagaagagagguauu

SEQ ID NO: 85858 - RNA, 22 nt, Human
uuagaaucagguguuauaauca

SEQ ID NO: 85859 - RNA, 22 nt, Human
uuagaauccaugguugcagugg

SEQ ID NO: 85860 - RNA, 22 nt, Human
uuagacaagggcuccuuaaaag

SEQ ID NO: 85861 - RNA, 22 nt, Human
uuagacaggauguaugaaagcu

SEQ ID NO: 85862 - RNA, 22 nt, Human
uuagacauagaauauugucuag

SEQ ID NO: 85863 - RNA, 22 nt, Human
uuagacaucagugcuucucagc

SEQ ID NO: 85864 - RNA, 21 nt, Human
uuagacuuggguuuuuccugg

SEQ ID NO: 85865 - RNA, 22 nt, Human
uuagagaaauucugguaaugua

SEQ ID NO: 85866 - RNA, 22 nt, Human
uuagagaagaugaaccaucguu

SEQ ID NO: 85867 - RNA, 22 nt, Human
uuagagaagcuguaauuauuca

SEQ ID NO: 85868 - RNA, 23 nt, Human
uuagagaugauuaaaaaaucuug

SEQ ID NO: 85869 - RNA, 22 nt, Human
uuagagaugucccaaaaugaag

SEQ ID NO: 85870 - RNA, 22 nt, Human
uuagagauuugucugauaguag

SEQ ID NO: 85871 - RNA, 17 nt, Human
uuagagcuacauguuga

SEQ ID NO: 85872 - RNA, 22 nt, Human
uuagagcuucccaauuaaaacg

SEQ ID NO: 85873 - RNA, 22 nt, Human
uuagaggcaugauucaguaaag

SEQ ID NO: 85874 - RNA, 22 nt, Human
uuagaguguagcaggaagaggc

SEQ ID NO: 85875 - RNA, 20 nt, Human
uuagaguuagcuguuaugca

SEQ ID NO: 85876 - RNA, 22 nt, Human
uuagaguuaggauuugucuuua

SEQ ID NO: 85877 - RNA, 22 nt, Human
uuagaguucagcaugacuuuga

SEQ ID NO: 85878 - RNA, 22 nt, Human
uuagauaacaguagaauaucaa

SEQ ID NO: 85879 - RNA, 22 nt, Human
uuagauacauucucauuuguuu

SEQ ID NO: 85880 - RNA, 22 nt, Human
uuagaugugcaggacuuuuauc

SEQ ID NO: 85881 - RNA, 22 nt, Human
uuagauguggacuuauguuauu

SEQ ID NO: 85882 - RNA, 22 nt, Human
uuagcaaaccuggacuacagau

SEQ ID NO: 85883 - RNA, 22 nt, Human
uuagcaaacucuguuagauucu

SEQ ID NO: 85884 - RNA, 22 nt, Human
uuagcaaaguuugccaucuagu

SEQ ID NO: 85885 - RNA, 22 nt, Human
uuagcaacacccauuugugugc

SEQ ID NO: 85886 - RNA, 22 nt, Human
uuagcaagaaagauugcagcac

SEQ ID NO: 85887 - RNA, 22 nt, Human
uuagcaagauaacaguaauuuu

SEQ ID NO: 85888 - RNA, 22 nt, Human
uuagcaauccuaggcuggauca

SEQ ID NO: 85889 - RNA, 22 nt, Human
uuagcacuggauuucaucagaa

SEQ ID NO: 85890 - RNA, 22 nt, Human
uuagcaggaagaguuggcugga

SEQ ID NO: 85891 - RNA, 22 nt, Human
uuagcaguucauugauuaucgu

SEQ ID NO: 85892 - RNA, 22 nt, Human
uuagcauucugccuccuauauc

SEQ ID NO: 85893 - RNA, 22 nt, Human
uuagcauuucuggaaucacaag

SEQ ID NO: 85894 - RNA, 22 nt, Human
uuagcauuuucugggcugaaau

SEQ ID NO: 85895 - RNA, 22 nt, Human
uuagccaaacaggugaaauuga

SEQ ID NO: 85896 - RNA, 19 nt, Human
uuagccauccacagugaaa

SEQ ID NO: 85897 - RNA, 22 nt, Human
uuagccaugcccuagaagagga

SEQ ID NO: 85898 - RNA, 22 nt, Human
uuagccauuuuauacaagugua

SEQ ID NO: 85899 - RNA, 22 nt, Human
uuagcugacugugugauuuggc

SEQ ID NO: 85900 - RNA, 22 nt, Human
uuagcugagauuaagugaacuu

SEQ ID NO: 85901 - RNA, 22 nt, Human
uuagcugcauuaucaaaguuau

SEQ ID NO: 85902 - RNA, 22 nt, Human
uuagcugcugauuaaauauguu

SEQ ID NO: 85903 - RNA, 22 nt, Human
uuagcuuuagagccauuacugg

SEQ ID NO: 85904 - RNA, 22 nt, Human
uuagcuuuccuacuaauaaaua

SEQ ID NO: 85905 - RNA, 20 nt, Human
uuagcuuuggcaauagugac

SEQ ID NO: 85906 - RNA, 22 nt, Human
uuaggaaacaguagccuuugcu

SEQ ID NO: 85907 - RNA, 22 nt, Human
uuaggaaacgcugcuauugacu

SEQ ID NO: 85908 - RNA, 22 nt, Human
uuaggaaagcauuguguaaaag

SEQ ID NO: 85909 - RNA, 22 nt, Human
uuaggaaaggaacauugaaacg

SEQ ID NO: 85910 - RNA, 22 nt, Human
uuaggaaauuaugguuucagau

SEQ ID NO: 85911 - RNA, 22 nt, Human
uuaggaacuucugucucagugu

SEQ ID NO: 85912 - RNA, 22 nt, Human
uuaggaagaaggaggcaguauu

SEQ ID NO: 85913 - RNA, 22 nt, Human
uuaggaaguguguccagaagcg

SEQ ID NO: 85914 - RNA, 22 nt, Human
uuaggaaucaaauuccgaaagg

SEQ ID NO: 85915 - RNA, 22 nt, Human
uuaggaguccagaugucuuggg

SEQ ID NO: 85916 - RNA, 23 nt, Human
uuaggcacuuaguagggccagag

SEQ ID NO: 85917 - RNA, 22 nt, Human
uuaggcauccugucccuggauu

SEQ ID NO: 85918 - RNA, 22 nt, Human
uuaggcaugcaagauuaagcuc

SEQ ID NO: 85919 - RNA, 22 nt, Human
uuagggaagcauggaggagaug

SEQ ID NO: 85920 - RNA, 22 nt, Human
uuagggaaggcugcugucagcu

SEQ ID NO: 85921 - RNA, 22 nt, Human
uuagggacagcucuguagguga

SEQ ID NO: 85922 - RNA, 22 nt, Human
uuagggagcucaguccucagau

SEQ ID NO: 85923 - RNA, 19 nt, Human
uuagguauuauugcuuucc

SEQ ID NO: 85924 - RNA, 22 nt, Human
uuaggucuguuuauaaaacagu

SEQ ID NO: 85925 - RNA, 22 nt, Human
uuaguacauucacugugguagg

SEQ ID NO: 85926 - RNA, 22 nt, Human
uuaguacauugauucauuaugu

SEQ ID NO: 85927 - RNA, 22 nt, Human
uuaguacugauagggucaauca

SEQ ID NO: 85928 - RNA, 22 nt, Human
uuaguaggagagcuuguucauu

SEQ ID NO: 85929 - RNA, 22 nt, Human
uuaguauuaggaucauauuuga

SEQ ID NO: 85930 - RNA, 22 nt, Human
uuagucacuucuuccuucauca

SEQ ID NO: 85931 - RNA, 22 nt, Human
uuagucaggaccuuuugguuuc

SEQ ID NO: 85932 - RNA, 22 nt, Human
uuagucuucucauaguaaaacu

SEQ ID NO: 85933 - RNA, 22 nt, Human
uuagugaaaagaaaaugagugg

SEQ ID NO: 85934 - RNA, 17 nt, Human
uuaguguaucuguuuug

SEQ ID NO: 85935 - RNA, 22 nt, Human
uuagugugcauggaugccucaa

SEQ ID NO: 85936 - RNA, 22 nt, Human
uuaguguguccaguucugaaaa

SEQ ID NO: 85937 - RNA, 22 nt, Human
uuaguguguuaaugaguauauc

SEQ ID NO: 85938 - RNA, 22 nt, Human
uuaguguguuauauaccaagcu

SEQ ID NO: 85939 - RNA, 22 nt, Human
uuaguuaaaauucugcugacau

SEQ ID NO: 85940 - RNA, 22 nt, Human
uuaguuagaauaauacaaguaa

SEQ ID NO: 85941 - RNA, 22 nt, Human
uuaguucuugggugaacuuuug

SEQ ID NO: 85942 - RNA, 22 nt, Human
uuaguuuccuguggugugaagu

SEQ ID NO: 85943 - RNA, 22 nt, Human
uuaguuuucccaucuuuauggu

SEQ ID NO: 85944 - RNA, 22 nt, Human
uuauaacuuuggauaugacaag

SEQ ID NO: 85945 - RNA, 22 nt, Human
uuauacacugcagaaccagcau

SEQ ID NO: 85946 - RNA, 22 nt, Human
uuauacagcauugcuagugaug

SEQ ID NO: 85947 - RNA, 22 nt, Human
uuauacaguuuauacuuagaau

SEQ ID NO: 85948 - RNA, 22 nt, Human
uuauagaacgguucugugcaaa

SEQ ID NO: 85949 - RNA, 22 nt, Human
uuauagaauguuuccaaugccu

SEQ ID NO: 85950 - RNA, 22 nt, Human
uuauagcagcaugauuuacaau

SEQ ID NO: 85951 - RNA, 22 nt, Human
uuauagcaggugacuaaugagu

SEQ ID NO: 85952 - RNA, 22 nt, Human
uuauaggccaucuaaguaauuu

SEQ ID NO: 85953 - RNA, 22 nt, Human
uuauaggcuuaguucugugugu

SEQ ID NO: 85954 - RNA, 22 nt, Human
uuauaguauuagguacucaaca

SEQ ID NO: 85955 - RNA, 22 nt, Human
uuauauaaagauaacuuuucuu

SEQ ID NO: 85956 - RNA, 22 nt, Human
uuauccaacaugacuuaugucc

SEQ ID NO: 85957 - RNA, 22 nt, Human
uuauccuggauuauauauguga

SEQ ID NO: 85958 - RNA, 22 nt, Human
uuauccugguggccccuaaauc

SEQ ID NO: 85959 - RNA, 22 nt, Human
uuaucguacgcuucagaaauuu

SEQ ID NO: 85960 - RNA, 22 nt, Human
uuaucuacguauuuaaacucuu

SEQ ID NO: 85961 - RNA, 22 nt, Human
ucuggagaguccugcucacguc

SEQ ID NO: 85962 - RNA, 22 nt, Human
ucuggagccacaaaccucagcu

SEQ ID NO: 85963 - RNA, 21 nt, Human
ucuggagcccuaagcugagaa

SEQ ID NO: 85964 - RNA, 22 nt, Human
ucuggagcuggagggcaaggca

SEQ ID NO: 85965 - RNA, 22 nt, Human
ucuggagcuuguuucagauggu

SEQ ID NO: 85966 - RNA, 22 nt, Human
ucuggggauggucuacuuucug

SEQ ID NO: 85967 - RNA, 22 nt, Human
ucuggggucaccuggggugcuu

SEQ ID NO: 85968 - RNA, 19 nt, Human
ucugggguguggccuggca

SEQ ID NO: 85969 - RNA, 22 nt, Human
ucuggguaaucagggcugggag

SEQ ID NO: 85970 - RNA, 19 nt, Human
ucuggguauuuggaagaug

SEQ ID NO: 85971 - RNA, 22 nt, Human
ucugggucacugugggagggca

SEQ ID NO: 85972 - RNA, 22 nt, Human
ucuggguccccgaggaaggaga

SEQ ID NO: 85973 - RNA, 22 nt, Human
ucugggucuaucccaugccuuu

SEQ ID NO: 85974 - RNA, 22 nt, Human
ucugggucuaugaucucacuuc

SEQ ID NO: 85975 - RNA, 22 nt, Human
ucugggucuauuccuacuguga

SEQ ID NO: 85976 - RNA, 22 nt, Human
ucugggucuuaguuuucuugau

SEQ ID NO: 85977 - RNA, 21 nt, Human
ucugggugcuaguguuugcuu

SEQ ID NO: 85978 - RNA, 22 nt, Human
ucuggguggcagugauggcgug

SEQ ID NO: 85979 - RNA, 22 nt, Human
ucuggguggugucuuccaagac

SEQ ID NO: 85980 - RNA, 22 nt, Human
ucuggguucuugaugcuaccuu

SEQ ID NO: 85981 - RNA, 17 nt, Human
ucuggguuuaaauccca

SEQ ID NO: 85982 - RNA, 22 nt, Human
ucugguaauaggcaauagcuug

SEQ ID NO: 85983 - RNA, 22 nt, Human
ucuggucaucggaaagaucaaa

SEQ ID NO: 85984 - RNA, 20 nt, Human
ucugguccaggucuucaugg

SEQ ID NO: 85985 - RNA, 22 nt, Human
ucugguccccauuccagguggg

SEQ ID NO: 85986 - RNA, 22 nt, Human
ucuggugguauacaucuaggag

SEQ ID NO: 85987 - RNA, 22 nt, Human
ucugguggugggccacaagcau

SEQ ID NO: 85988 - RNA, 22 nt, Human
ucuggugucaggcuguccucgg

SEQ ID NO: 85989 - RNA, 22 nt, Human
ucuggugucaguauucuuugaa

SEQ ID NO: 85990 - RNA, 22 nt, Human
ucuguaaaacuucuuuguaaau

SEQ ID NO: 85991 - RNA, 22 nt, Human
ucuguaaagacuccaaaagcca

SEQ ID NO: 85992 - RNA, 20 nt, Human
ucuguaaagacuccagaagc

SEQ ID NO: 85993 - RNA, 22 nt, Human
ucuguaaagucuguguaaaguc

SEQ ID NO: 85994 - RNA, 22 nt, Human
ucuguaaauccugcucagcaac

SEQ ID NO: 85995 - RNA, 22 nt, Human
ucuguaaucaagauauuugaga

SEQ ID NO: 85996 - RNA, 20 nt, Human
ucuguaauuaugccaucacu

SEQ ID NO: 85997 - RNA, 23 nt, Human
ucuguacaauugagaagagaaca

SEQ ID NO: 85998 - RNA, 22 nt, Human
ucuguacaccaggggccauucu

SEQ ID NO: 85999 - RNA, 20 nt, Human
ucuguacacucaucuucugc

SEQ ID NO: 86000 - RNA, 22 nt, Human
ucuguaccucacaugcaccauc

SEQ ID NO: 86001 - RNA, 21 nt, Human
ucuguacuuugcuuccaugcu

SEQ ID NO: 86002 - RNA, 22 nt, Human
ucuguacuuuuauuuuggcacu

SEQ ID NO: 86003 - RNA, 22 nt, Human
ucuguagagacgaauguguuau

SEQ ID NO: 86004 - RNA, 22 nt, Human
ucuguagcuucuugagaggcca

SEQ ID NO: 86005 - RNA, 22 nt, Human
ucuguaggguaguaguggagau

SEQ ID NO: 86006 - RNA, 22 nt, Human
ucuguaguagguuguaguucuu

SEQ ID NO: 86007 - RNA, 22 nt, Human
ucuguauaaaguaccgguggca

SEQ ID NO: 86008 - RNA, 22 nt, Human
ucuguaucacccguucccagaa

SEQ ID NO: 86009 - RNA, 22 nt, Human
ucugucaaaugagcaaguaacu

SEQ ID NO: 86010 - RNA, 22 nt, Human
ucugucacauacacuuuucagg

SEQ ID NO: 86011 - RNA, 22 nt, Human
ucugucacuauuggccagaaca

SEQ ID NO: 86012 - RNA, 22 nt, Human
ucugucacucuagagauggcag

SEQ ID NO: 86013 - RNA, 22 nt, Human
ucugucacuuuuauuuacugaa

SEQ ID NO: 86014 - RNA, 22 nt, Human
ucugucagccccucagcuguca

SEQ ID NO: 86015 - RNA, 19 nt, Human
ucugucagugcaucaccuc

SEQ ID NO: 86016 - RNA, 22 nt, Human
ucugucauaaacacacacaagc

SEQ ID NO: 86017 - RNA, 22 nt, Human
ucugucaucuguucagugcuca

SEQ ID NO: 86018 - RNA, 22 nt, Human
ucugucauguuuccauuacaug

SEQ ID NO: 86019 - RNA, 22 nt, Human
ucugucauuucaauaugguuaa

SEQ ID NO: 86020 - RNA, 22 nt, Human
ucugucauuuuguaucuacaug

SEQ ID NO: 86021 - RNA, 22 nt, Human
ucuguccaagacaccauagugg

SEQ ID NO: 86022 - RNA, 22 nt, Human
ucuguccagagguccuggagac

SEQ ID NO: 86023 - RNA, 22 nt, Human
ucuguccaugcuuuucucucac

SEQ ID NO: 86024 - RNA, 22 nt, Human
ucuguccauuuggaguuggaag

SEQ ID NO: 86025 - RNA, 22 nt, Human
ucuguccuccacacuguaaguu

SEQ ID NO: 86026 - RNA, 22 nt, Human
ucuguccuccggagcucccagu

SEQ ID NO: 86027 - RNA, 20 nt, Human
ucuguccuuucugcuaaggc

SEQ ID NO: 86028 - RNA, 20 nt, Human
ucugucucugagcuagacuu

SEQ ID NO: 86029 - RNA, 22 nt, Human
ucugucugacaggguaugaacu

SEQ ID NO: 86030 - RNA, 22 nt, Human
ucugucugaggaguuuuugacc

SEQ ID NO: 86031 - RNA, 22 nt, Human
ucugucugcgcuugcccuggug

SEQ ID NO: 86032 - RNA, 22 nt, Human
ucugucugggugccucgaguac

SEQ ID NO: 86033 - RNA, 21 nt, Human
ucugucugguuuuagaguggc

SEQ ID NO: 86034 - RNA, 23 nt, Human
ucugucuguguaugugcagaaag

SEQ ID NO: 86035 - RNA, 17 nt, Human
ucugucuugacugucac

SEQ ID NO: 86036 - RNA, 22 nt, Human
ucugucuuuagaggccugugcu

SEQ ID NO: 86037 - RNA, 22 nt, Human
ucugugaacaucacauugacag

SEQ ID NO: 86038 - RNA, 22 nt, Human
ucugugacauugaacaucuaca

SEQ ID NO: 86039 - RNA, 22 nt, Human
ucugugacucauaucuguagau

SEQ ID NO: 86040 - RNA, 22 nt, Human
ucugugauagguggcauaguga

SEQ ID NO: 86041 - RNA, 17 nt, Human
ucugugauaguguagau

SEQ ID NO: 86042 - RNA, 22 nt, Human
ucugugcaagaccaacuuucaa

SEQ ID NO: 86043 - RNA, 22 nt, Human
ucugugcacaauaggcauuuuu

SEQ ID NO: 86044 - RNA, 20 nt, Human
ucugugcaccugcuacaagg

SEQ ID NO: 86045 - RNA, 22 nt, Human
ucugugcacuaacauuccuggu

SEQ ID NO: 86046 - RNA, 22 nt, Human
ucugugcagaacucacagaagg

SEQ ID NO: 86047 - RNA, 22 nt, Human
ucugugcagaaucaaggagcuu

SEQ ID NO: 86048 - RNA, 22 nt, Human
ucugugcagacauggggaagcc

SEQ ID NO: 86049 - RNA, 15 nt, Human
ucugugcagcaaggg

SEQ ID NO: 86050 - RNA, 20 nt, Human
ucugugcauugccugcuggu

SEQ ID NO: 86051 - RNA, 22 nt, Human
ucugugcauuucaggaccugaa

SEQ ID NO: 86052 - RNA, 22 nt, Human
ucugugccaccucuccaguguc

SEQ ID NO: 86053 - RNA, 23 nt, Human
ucugugccaguuuccaugucugu

SEQ ID NO: 86054 - RNA, 22 nt, Human
ucugugccaugcccgucuacca

SEQ ID NO: 86055 - RNA, 22 nt, Human
ucugugcuaauuuauccuuccu

SEQ ID NO: 86056 - RNA, 22 nt, Human
ucugugcugagcucugagaugu

SEQ ID NO: 86057 - RNA, 22 nt, Human
ucugugcugcaggagucugcau

SEQ ID NO: 86058 - RNA, 22 nt, Human
ucuguggaguugaggaagguug

SEQ ID NO: 86059 - RNA, 18 nt, Human
ucuguggcagcagugcac

SEQ ID NO: 86060 - RNA, 22 nt, Human
ucuguggccuccuuccacuuac

SEQ ID NO: 86061 - RNA, 22 nt, Human
ucuguggcuaucauacugaagg

SEQ ID NO: 86062 - RNA, 22 nt, Human
ucuguggcuuccuauuucuugg

SEQ ID NO: 86063 - RNA, 22 nt, Human
ucuguggcuucuauuuaacuuu

SEQ ID NO: 86064 - RNA, 22 nt, Human
ucuguggcuuucguguaagaug

SEQ ID NO: 86065 - RNA, 22 nt, Human
ucuguggcuuucuuauguugua

SEQ ID NO: 86066 - RNA, 22 nt, Human
ucugugggggugucuuaaccua

SEQ ID NO: 86067 - RNA, 22 nt, Human
ucuguggguagagugaguacuu

SEQ ID NO: 86068 - RNA, 22 nt, Human
ucuguguauaggguugugcgcu

SEQ ID NO: 86069 - RNA, 22 nt, Human
ucugugucccuucuaauuucag

SEQ ID NO: 86070 - RNA, 23 nt, Human
ucuguguccuccuggaccacaga

SEQ ID NO: 86071 - RNA, 22 nt, Human
ucugugucugguugggccagua

SEQ ID NO: 86072 - RNA, 18 nt, Human
ucuguguucugucauugc

SEQ ID NO: 86073 - RNA, 22 nt, Human
ucuguguugauaauuuuggaga

SEQ ID NO: 86074 - RNA, 22 nt, Human
ucuguguuuaaaagauaugucc

SEQ ID NO: 86075 - RNA, 22 nt, Human
ucuguguuuuacuccaauuaua

SEQ ID NO: 86076 - RNA, 22 nt, Human
ugaggugguccaaagacuguuu

SEQ ID NO: 86077 - RNA, 22 nt, Human
ugaggugguuacuguggugcuc

SEQ ID NO: 86078 - RNA, 22 nt, Human
ugaggugguuuguaucacuggg

SEQ ID NO: 86079 - RNA, 22 nt, Human
ugagguucaguucuuggccaca

SEQ ID NO: 86080 - RNA, 22 nt, Human
ugaguaaaagugaaucuuaugu

SEQ ID NO: 86081 - RNA, 22 nt, Human
ugaguaaagggccagauaguaa

SEQ ID NO: 86082 - RNA, 22 nt, Human
ugaguaacacaguaugcuuaca

SEQ ID NO: 86083 - RNA, 18 nt, Human
ucugcacuccugagagag

SEQ ID NO: 86084 - RNA, 22 nt, Human
ucugcagaaacugugacuaugu

SEQ ID NO: 86085 - RNA, 22 nt, Human
ucugcagaagaauuaaggacag

SEQ ID NO: 86086 - RNA, 22 nt, Human
ucugcagaagccauggccuugc

SEQ ID NO: 86087 - RNA, 22 nt, Human
ucugcagaaguggcugggccac

SEQ ID NO: 86088 - RNA, 22 nt, Human
ucugcagagguaauuuacagau

SEQ ID NO: 86089 - RNA, 22 nt, Human
ucugcagcacuuaauguuucgu

SEQ ID NO: 86090 - RNA, 20 nt, Human
ucugcagcacuugacaaugu

SEQ ID NO: 86091 - RNA, 22 nt, Human
ucugcagcuucuugccagagag

SEQ ID NO: 86092 - RNA, 22 nt, Human
ucugcagcuugcacaggcaggc

SEQ ID NO: 86093 - RNA, 22 nt, Human
ucugcagcuuuccccugauuua

SEQ ID NO: 86094 - RNA, 22 nt, Human
ucugcaggacugaggccuguuu

SEQ ID NO: 86095 - RNA, 22 nt, Human
ucugcaggaucagagccagagg

SEQ ID NO: 86096 - RNA, 22 nt, Human
ucugcaggauggaugcucagaa

SEQ ID NO: 86097 - RNA, 22 nt, Human
ucugcaggcauuuuugguuguc

SEQ ID NO: 86098 - RNA, 22 nt, Human
ucugcaggcuuggaguggcagc

SEQ ID NO: 86099 - RNA, 22 nt, Human
ucugcagggcccuuggcuccug

SEQ ID NO: 86100 - RNA, 22 nt, Human
ucugcagguaagcguucuugga

SEQ ID NO: 86101 - RNA, 19 nt, Human
ucugcauggcaggaagaga

SEQ ID NO: 86102 - RNA, 22 nt, Human
ucugcauugucccagaagugac

SEQ ID NO: 86103 - RNA, 22 nt, Human
ucugccacaugagggcacagca

SEQ ID NO: 86104 - RNA, 22 nt, Human
ucugccaccuucauccuccacu

SEQ ID NO: 86105 - RNA, 20 nt, Human
ucugccacgucuggugacug

SEQ ID NO: 86106 - RNA, 22 nt, Human
ucugccacuagugguuaccuua

SEQ ID NO: 86107 - RNA, 20 nt, Human
ucugccacuuuuucugucac

SEQ ID NO: 86108 - RNA, 22 nt, Human
ucugccagcccugugagucuug

SEQ ID NO: 86109 - RNA, 22 nt, Human
ucugccagguggggagaggcca

SEQ ID NO: 86110 - RNA, 22 nt, Human
ucugccagugccagaguacaua

SEQ ID NO: 86111 - RNA, 22 nt, Human
ucugccaguuagaaacugguua

SEQ ID NO: 86112 - RNA, 22 nt, Human
ucugccaugcuaacuucaguau

SEQ ID NO: 86113 - RNA, 22 nt, Human
ucugcccaccagcgguugcaua

SEQ ID NO: 86114 - RNA, 22 nt, Human
ucugcccacugcucugcugccc

SEQ ID NO: 86115 - RNA, 22 nt, Human
ucugcccagccagacccaaggu

SEQ ID NO: 86116 - RNA, 22 nt, Human
ucugcccagcuaaaaaugggag

SEQ ID NO: 86117 - RNA, 22 nt, Human
ucugcccagggacccacaggga

SEQ ID NO: 86118 - RNA, 19 nt, Human
ucugcccaguugucugccc

SEQ ID NO: 86119 - RNA, 22 nt, Human
ucugcccaguuugugcucaggu

SEQ ID NO: 86120 - RNA, 22 nt, Human
ucugcccauucuuagagucuag

SEQ ID NO: 86121 - RNA, 22 nt, Human
ucugccccugcugggcacagag

SEQ ID NO: 86122 - RNA, 22 nt, Human
ucugcccuaauucagugcuuag

SEQ ID NO: 86123 - RNA, 22 nt, Human
ucugcccucaggguaaugauca

SEQ ID NO: 86124 - RNA, 18 nt, Human
ucugcccugccauucacu

SEQ ID NO: 86125 - RNA, 22 nt, Human
ucugcccuuggcucucuuguug

SEQ ID NO: 86126 - RNA, 22 nt, Human
ucugccgugcgaggucccacca

SEQ ID NO: 86127 - RNA, 22 nt, Human
ucugccuccugcuugucccgac

SEQ ID NO: 86128 - RNA, 22 nt, Human
ucugccucgcuaacagcagcca

SEQ ID NO: 86129 - RNA, 22 nt, Human
ucugccucuuucaggccuggca

SEQ ID NO: 86130 - RNA, 22 nt, Human
ucugccugcugccugggggcuc

SEQ ID NO: 86131 - RNA, 22 nt, Human
ucugccuggcucauggcaguga

SEQ ID NO: 86132 - RNA, 22 nt, Human
ucugccugugcuguguuuucau

SEQ ID NO: 86133 - RNA, 22 nt, Human
ucugccugugguggaggaaguu

SEQ ID NO: 86134 - RNA, 22 nt, Human
ucugccuguugagccuaaggcc

SEQ ID NO: 86135 - RNA, 20 nt, Human
ucugccuuaugaccuucgcc

SEQ ID NO: 86136 - RNA, 22 nt, Human
ucugccuugccgaauuccaggc

SEQ ID NO: 86137 - RNA, 22 nt, Human
ucugccuuucucaagggcaaaa

SEQ ID NO: 86138 - RNA, 22 nt, Human
ucugcguccaucugccugcuug

SEQ ID NO: 86139 - RNA, 22 nt, Human
ucugcucagccgaucugcuccg

SEQ ID NO: 86140 - RNA, 22 nt, Human
ucugcucagggagggucacuac

SEQ ID NO: 86141 - RNA, 22 nt, Human
ucugcucagguuaccuagcuag

SEQ ID NO: 86142 - RNA, 22 nt, Human
ucugcucuaguugcuuccugcc

SEQ ID NO: 86143 - RNA, 22 nt, Human
ucugcucuccauacuuccgcac

SEQ ID NO: 86144 - RNA, 22 nt, Human
ucugcucugagagggccaucag

SEQ ID NO: 86145 - RNA, 17 nt, Human
ucugcucugccaaucca

SEQ ID NO: 86146 - RNA, 22 nt, Human
ucugcucugggccagcuauuaa

SEQ ID NO: 86147 - RNA, 22 nt, Human
ucugcucuguacugcacuggcc

SEQ ID NO: 86148 - RNA, 22 nt, Human
ucugcucuguggcuucagcuaa

SEQ ID NO: 86149 - RNA, 22 nt, Human
ucugcugaacuugcugcccaga

SEQ ID NO: 86150 - RNA, 22 nt, Human
ucugcugacauuuaugaauaga

SEQ ID NO: 86151 - RNA, 22 nt, Human
ucugcugcagcaggauucucug

SEQ ID NO: 86152 - RNA, 22 nt, Human
ucugcugccaccuuguggugag

SEQ ID NO: 86153 - RNA, 22 nt, Human
ucugcugccaugcagagcagua

SEQ ID NO: 86154 - RNA, 22 nt, Human
ucugcugccucgguguggguac

SEQ ID NO: 86155 - RNA, 22 nt, Human
ucugcugcugcagcuacacuau

SEQ ID NO: 86156 - RNA, 22 nt, Human
ucugcuggccuuagcaggucua

SEQ ID NO: 86157 - RNA, 22 nt, Human
ucugcuggugaugaccucauaa

SEQ ID NO: 86158 - RNA, 22 nt, Human
ucugcuguaaagaauuucugcc

SEQ ID NO: 86159 - RNA, 22 nt, Human
ucugcuucugugaaggcagucu

SEQ ID NO: 86160 - RNA, 22 nt, Human
ucugcuuuagugcaaagucuua

SEQ ID NO: 86161 - RNA, 22 nt, Human
ucugcuuuauuacacuagccaa

SEQ ID NO: 86162 - RNA, 22 nt, Human
ucugcuuucuugcgcagaugug

SEQ ID NO: 86163 - RNA, 22 nt, Human
ucugcuuugaccuucuugaugc

SEQ ID NO: 86164 - RNA, 22 nt, Human
ucugcuuugcugccuccugauc

SEQ ID NO: 86165 - RNA, 22 nt, Human
ucuggaagcuggaguccaggaa

SEQ ID NO: 86166 - RNA, 22 nt, Human
ucuggaagguuggcucccaguu

SEQ ID NO: 86167 - RNA, 22 nt, Human
ucuggaagugauguucauagug

SEQ ID NO: 86168 - RNA, 22 nt, Human
ucuggaauaggacaaaaccaaa

SEQ ID NO: 86169 - RNA, 22 nt, Human
ucuggaauagguccugaguauu

SEQ ID NO: 86170 - RNA, 22 nt, Human
ucuggaaugauuuccuuccccu

SEQ ID NO: 86171 - RNA, 22 nt, Human
ucuggacuaacagcagccucag

SEQ ID NO: 86172 - RNA, 22 nt, Human
ucuggacuauaggcugccaagu

SEQ ID NO: 86173 - RNA, 20 nt, Human
ucuggacucuaagguauauu

SEQ ID NO: 86174 - RNA, 20 nt, Human
ucuggacugucagacaggga

SEQ ID NO: 86175 - RNA, 22 nt, Human
ucuggacuugaaucagaguaga

SEQ ID NO: 86176 - RNA, 22 nt, Human
ucuggacuuucggugcaagagu

SEQ ID NO: 86177 - RNA, 22 nt, Human
ucuggagaaaguugaguuugug

SEQ ID NO: 86178 - RNA, 22 nt, Human
ucuggagaacuugcaagaggau

SEQ ID NO: 86179 - RNA, 22 nt, Human
ucuggagaagcagugagaguca

SEQ ID NO: 86180 - RNA, 22 nt, Human
ucuggagauaagcagcaaugaa

SEQ ID NO: 86181 - RNA, 22 nt, Human
ucuggagcaacagagcaggaca

SEQ ID NO: 86182 - RNA, 22 nt, Human
ucuggagccuuggaugggaaag

SEQ ID NO: 86183 - RNA, 22 nt, Human
ucuggagcgaggucccugucug

SEQ ID NO: 86184 - RNA, 21 nt, Human
ucuggagcugcaggcugggca

SEQ ID NO: 86185 - RNA, 22 nt, Human
ucuucuuuggaugaaagaauau

SEQ ID NO: 86186 - RNA, 21 nt, Human
ucuugaaaauuguagcaguuu

SEQ ID NO: 86187 - RNA, 22 nt, Human
ucuugaaacauaugaguaagug

SEQ ID NO: 86188 - RNA, 22 nt, Human
ucuugaagucacacagaaagug

SEQ ID NO: 86189 - RNA, 22 nt, Human
ucuugacauucaaucauguaua

SEQ ID NO: 86190 - RNA, 22 nt, Human
ucuugagaagcggcugucucag

SEQ ID NO: 86191 - RNA, 22 nt, Human
ucuugagagauauacuacugaa

SEQ ID NO: 86192 - RNA, 22 nt, Human
ucuugaggucaucaucugaaac

SEQ ID NO: 86193 - RNA, 22 nt, Human
ucuugagugcgcuuggguguuc

SEQ ID NO: 86194 - RNA, 22 nt, Human
ucuugauuacaaauaacaucau

SEQ ID NO: 86195 - RNA, 22 nt, Human
ucuugcacuucaugaauauguu

SEQ ID NO: 86196 - RNA, 22 nt, Human
ucuugcagaaauaaguuuaaau

SEQ ID NO: 86197 - RNA, 19 nt, Human
ucuugcagccccagcaggc

SEQ ID NO: 86198 - RNA, 22 nt, Human
ugauuagauugagucaaccuug

SEQ ID NO: 86199 - RNA, 23 nt, Human
ugauuaggucuacucuuggcucc

SEQ ID NO: 86200 - RNA, 22 nt, Human
ugauuauauucuaacuucauaa

SEQ ID NO: 86201 - RNA, 22 nt, Human
ugauucaaauauuguguaugau

SEQ ID NO: 86202 - RNA, 17 nt, Human
ugauucaacuagaaacu

SEQ ID NO: 86203 - RNA, 22 nt, Human
ugauucaagauugguuagcugu

SEQ ID NO: 86204 - RNA, 18 nt, Human
ugauucaaguugcccucc

SEQ ID NO: 86205 - RNA, 22 nt, Human
ugauucaauuaucugaugcuuu

SEQ ID NO: 86206 - RNA, 22 nt, Human
ugauucaguacuuucucuaacu

SEQ ID NO: 86207 - RNA, 22 nt, Human
ugauucauauguaacaucccug

SEQ ID NO: 86208 - RNA, 22 nt, Human
ugauuccacucugaggaucgua

SEQ ID NO: 86209 - RNA, 22 nt, Human
ugauucuagguccauuauuugc

SEQ ID NO: 86210 - RNA, 22 nt, Human
ugauucucauuaucuuggggug

SEQ ID NO: 86211 - RNA, 22 nt, Human
ugauucucuuagaugauguguu

SEQ ID NO: 86212 - RNA, 22 nt, Human
ugauucucuuguaagcuauguu

SEQ ID NO: 86213 - RNA, 22 nt, Human
ugauucugagggagcauucugc

SEQ ID NO: 86214 - RNA, 22 nt, Human
ugauucugccacguacuggcug

SEQ ID NO: 86215 - RNA, 22 nt, Human
ugauucuguaaacaugucuuua

SEQ ID NO: 86216 - RNA, 22 nt, Human
ugauucugucuccuucacuccg

SEQ ID NO: 86217 - RNA, 22 nt, Human
ugauucuuuggagagcuauaua

SEQ ID NO: 86218 - RNA, 22 nt, Human
ugauugaagaggugaggaaguu

SEQ ID NO: 86219 - RNA, 22 nt, Human
ugauugaagcuagaacaaccau

SEQ ID NO: 86220 - RNA, 21 nt, Human
ugauugauauuugcaaacaga

SEQ ID NO: 86221 - RNA, 22 nt, Human
ugauugcugaauuuuaggaacu

SEQ ID NO: 86222 - RNA, 22 nt, Human
ugauuguauagggguuauuaau

SEQ ID NO: 86223 - RNA, 22 nt, Human
ugauuuacccguaacuauuucu

SEQ ID NO: 86224 - RNA, 22 nt, Human
ugauuuacuucuggauaaaucc

SEQ ID NO: 86225 - RNA, 19 nt, Human
ugauuuagggauccggcac

SEQ ID NO: 86226 - RNA, 22 nt, Human
ugauuuaugaccaaguuagaau

SEQ ID NO: 86227 - RNA, 22 nt, Human
ugauuuccaauaaggagaaugu

SEQ ID NO: 86228 - RNA, 21 nt, Human
ugauuuccagaaaauuggccc

SEQ ID NO: 86229 - RNA, 23 nt, Human
ugauuuccagugagucaguggga

SEQ ID NO: 86230 - RNA, 22 nt, Human
ugauuuccaugaagcugaaggc

SEQ ID NO: 86231 - RNA, 22 nt, Human
ugauuuccccagucuugcugcu

SEQ ID NO: 86232 - RNA, 22 nt, Human
ugauuuccuagcugacaugaaa

SEQ ID NO: 86233 - RNA, 22 nt, Human
ugauuuccuaggucuggagaag

SEQ ID NO: 86234 - RNA, 22 nt, Human
ugauuucucauauuguucaaaa

SEQ ID NO: 86235 - RNA, 20 nt, Human
ugauuucucuucuauuccuu

SEQ ID NO: 86236 - RNA, 21 nt, Human
ugauuucugccaaguucacua

SEQ ID NO: 86237 - RNA, 22 nt, Human
ugauuugaauuuuaaaacacug

SEQ ID NO: 86238 - RNA, 22 nt, Human
ugauuugagguacauaaaucca

SEQ ID NO: 86239 - RNA, 22 nt, Human
ugauuuguuuagugccaaguuu

SEQ ID NO: 86240 - RNA, 22 nt, Human
ugauuuucaugggugaucuuug

SEQ ID NO: 86241 - RNA, 22 nt, Human
ugauuuucuccauuguaaauuc

SEQ ID NO: 86242 - RNA, 22 nt, Human
ugauuuugucauguuucugaua

SEQ ID NO: 86243 - RNA, 22 nt, Human
ugcaaaaugacuucugaaaaga

SEQ ID NO: 86244 - RNA, 22 nt, Human
ugcaaacaacuguuuaaugcug

SEQ ID NO: 86245 - RNA, 22 nt, Human
ugcaaacaauuuccuauaaagu

SEQ ID NO: 86246 - RNA, 20 nt, Human
ugcaaacacagaguguauga

SEQ ID NO: 86247 - RNA, 22 nt, Human
ugcaaacaggcauuucacaaac

SEQ ID NO: 86248 - RNA, 22 nt, Human
ugcaaacaguuaagaugcaggc

SEQ ID NO: 86249 - RNA, 22 nt, Human
ugcaaacauccgacugaaagcc

SEQ ID NO: 86250 - RNA, 22 nt, Human
ugcaaacuauugguagagaugg

SEQ ID NO: 86251 - RNA, 23 nt, Human
ugcaaagaaaucugggucauugu

SEQ ID NO: 86252 - RNA, 22 nt, Human
ugcaaagaacuaagcagccuua

SEQ ID NO: 86253 - RNA, 22 nt, Human
ugcaaagaagccacagucccag

SEQ ID NO: 86254 - RNA, 22 nt, Human
ugcaaagaugaaauauuaaagg

SEQ ID NO: 86255 - RNA, 22 nt, Human
ugcaaagccacaaugaaaucag

SEQ ID NO: 86256 - RNA, 22 nt, Human
ugcaaagggcuuugcauacaga

SEQ ID NO: 86257 - RNA, 22 nt, Human
ugcaaauaaauuucuguucauu

SEQ ID NO: 86258 - RNA, 23 nt, Human
ugcaaauaccaugcuguccuguc

SEQ ID NO: 86259 - RNA, 22 nt, Human
ugcaaauagccugaugaaagaa

SEQ ID NO: 86260 - RNA, 22 nt, Human
ugcaaauauuccaugcuguuca

SEQ ID NO: 86261 - RNA, 22 nt, Human
ugcaaauauuuccuuauagcca

SEQ ID NO: 86262 - RNA, 22 nt, Human
ugcaaauccuguuuggaguaag

SEQ ID NO: 86263 - RNA, 19 nt, Human
ugcaaaugcuguugagaau

SEQ ID NO: 86264 - RNA, 22 nt, Human
ugcaaaugggcaucuccaagug

SEQ ID NO: 86265 - RNA, 19 nt, Human
ugcaaauucuaaaaacuga

SEQ ID NO: 86266 - RNA, 22 nt, Human
ugcaaauuggugaggaccacuu

SEQ ID NO: 86267 - RNA, 22 nt, Human
ugcaaauuuauauggugacugc

SEQ ID NO: 86268 - RNA, 22 nt, Human
ugcaaauuucuuuaguacauaa

SEQ ID NO: 86269 - RNA, 22 nt, Human
ugcaaauuugagcagacuguuc

SEQ ID NO: 86270 - RNA, 22 nt, Human
ugcaacaaggccucauuucuug

SEQ ID NO: 86271 - RNA, 22 nt, Human
ugcaacaggcugugacauggaa

SEQ ID NO: 86272 - RNA, 22 nt, Human
ugcaacuaggagguucuuagcu

SEQ ID NO: 86273 - RNA, 17 nt, Human
ugcaagaagauuaggaa

SEQ ID NO: 86274 - RNA, 22 nt, Human
ugcaagacuccucacuuucucu

SEQ ID NO: 86275 - RNA, 22 nt, Human
ugcaagagacagacaugacuca

SEQ ID NO: 86276 - RNA, 22 nt, Human
ugcaagagacauggguugugug

SEQ ID NO: 86277 - RNA, 22 nt, Human
ugcaagagauucaaaccauaaa

SEQ ID NO: 86278 - RNA, 22 nt, Human
ugcaagagcagaaagaacugag

SEQ ID NO: 86279 - RNA, 22 nt, Human
ugcaagaggguguucaguuugu

SEQ ID NO: 86280 - RNA, 22 nt, Human
ugcaagcuuggcugauguugau

SEQ ID NO: 86281 - RNA, 20 nt, Human
ugcaaggaagcaggcaagug

SEQ ID NO: 86282 - RNA, 22 nt, Human
ugcaaggcagcaccagcucuug

SEQ ID NO: 86283 - RNA, 22 nt, Human
ugcaaggcccagacaagagcuc

SEQ ID NO: 86284 - RNA, 22 nt, Human
ugcaaggcugcagagggugcua

SEQ ID NO: 86285 - RNA, 19 nt, Human
ugcaagugucuuggacaag

SEQ ID NO: 86286 - RNA, 22 nt, Human
ugcaauaacccaguaucuguga

SEQ ID NO: 86287 - RNA, 22 nt, Human
ugcaauaaguuguguuaucacu

SEQ ID NO: 86288 - RNA, 22 nt, Human
ugcaauacauacuuagacccag

SEQ ID NO: 86289 - RNA, 22 nt, Human
ugcaauacucaucauuggagau

SEQ ID NO: 86290 - RNA, 22 nt, Human
ugcaaucagguaccauuugauu

SEQ ID NO: 86291 - RNA, 20 nt, Human
ugcaauguccauguuccagg

SEQ ID NO: 86292 - RNA, 22 nt, Human
ugcaauuaugggcaauuuuuaa

SEQ ID NO: 86293 - RNA, 22 nt, Human
ugcaauuucaaauaucagaaag

SEQ ID NO: 86294 - RNA, 22 nt, Human
uucuaccucaguuucccacuua

SEQ ID NO: 86295 - RNA, 22 nt, Human
uucuacuucugacacuguuugu

SEQ ID NO: 86296 - RNA, 22 nt, Human
uucuacuuucucugucauuaaa

SEQ ID NO: 86297 - RNA, 22 nt, Human
uucuacuuuggacauaaaggac

SEQ ID NO: 86298 - RNA, 16 nt, Human
uucuagaaaagaaggu

SEQ ID NO: 86299 - RNA, 22 nt, Human
uucuagaaauccguaagugaau

SEQ ID NO: 86300 - RNA, 22 nt, Human
uucuagagaacucgagugccuu

SEQ ID NO: 86301 - RNA, 22 nt, Human
uucuagaggggagauacuagua

SEQ ID NO: 86302 - RNA, 22 nt, Human
uucuagaugauaaaccagcagc

SEQ ID NO: 86303 - RNA, 22 nt, Human
uucuagcaugccuuuuagcaca

SEQ ID NO: 86304 - RNA, 22 nt, Human
uucuagcuguugcuguuuauag

SEQ ID NO: 86305 - RNA, 22 nt, Human
uucuagcuuuuugcaccaaggu

SEQ ID NO: 86306 - RNA, 22 nt, Human
uucuaggacccugcgugagaac

SEQ ID NO: 86307 - RNA, 22 nt, Human
uucuaguccuagaaacuacaug

SEQ ID NO: 86308 - RNA, 22 nt, Human
uucuagucuauggcuagauagu

SEQ ID NO: 86309 - RNA, 22 nt, Human
uucuaguucccacauaguugcc

SEQ ID NO: 86310 - RNA, 22 nt, Human
uucuaguucccucuggaaugua

SEQ ID NO: 86311 - RNA, 22 nt, Human
uucuaguucuuaggaacagaca

SEQ ID NO: 86312 - RNA, 20 nt, Human
uucuaguuuggaguuauuaa

SEQ ID NO: 86313 - RNA, 22 nt, Human
uucuaguuuugccacaggauac

SEQ ID NO: 86314 - RNA, 22 nt, Human
uucuauaagacucauauuucuu

SEQ ID NO: 86315 - RNA, 22 nt, Human
uucuauacaaagauuucucaca

SEQ ID NO: 86316 - RNA, 19 nt, Human
uucuaugauuaacaugaga

SEQ ID NO: 86317 - RNA, 20 nt, Human
uucuauggaccaguauauuu

SEQ ID NO: 86318 - RNA, 22 nt, Human
uucuauugacauucacuguaac

SEQ ID NO: 86319 - RNA, 22 nt, Human
uucuauugcacacaaauaauua

SEQ ID NO: 86320 - RNA, 22 nt, Human
uucuauugggaagugugagagu

SEQ ID NO: 86321 - RNA, 22 nt, Human
uucuauugggcagcauugcuuc

SEQ ID NO: 86322 - RNA, 22 nt, Human
uucuauuucuuaaucuuggcug

SEQ ID NO: 86323 - RNA, 22 nt, Human
uucuauuuuuguggaacuguag

SEQ ID NO: 86324 - RNA, 22 nt, Human
uucucacaaauccauccaggag

SEQ ID NO: 86325 - RNA, 22 nt, Human
uucucacaguaccuaacaugua

SEQ ID NO: 86326 - RNA, 22 nt, Human
uucucagaaaauguagagaaaa

SEQ ID NO: 86327 - RNA, 22 nt, Human
uucucagagugaccaagucuuu

SEQ ID NO: 86328 - RNA, 22 nt, Human
uucucagauauuuguauggaac

SEQ ID NO: 86329 - RNA, 22 nt, Human
uucucagauccaucagaagucc

SEQ ID NO: 86330 - RNA, 22 nt, Human
ucuucaaagaauuuuaguaauu

SEQ ID NO: 86331 - RNA, 22 nt, Human
ucuucaaauccuacagugucug

SEQ ID NO: 86332 - RNA, 22 nt, Human
ucuucaaaugaguguggauuau

SEQ ID NO: 86333 - RNA, 22 nt, Human
ucuucaaugcauucucuuguuu

SEQ ID NO: 86334 - RNA, 22 nt, Human
ucuucaauuagauuuaccaauu

SEQ ID NO: 86335 - RNA, 23 nt, Human
ucuucacagggcuucccaugugc

SEQ ID NO: 86336 - RNA, 22 nt, Human
ucuucacauauuccuugagcua

SEQ ID NO: 86337 - RNA, 22 nt, Human
ucuucacauggaacaugaagcu

SEQ ID NO: 86338 - RNA, 22 nt, Human
ucuucacauuuuagugguuugu

SEQ ID NO: 86339 - RNA, 22 nt, Human
ucuucacugugaauuuguucuu

SEQ ID NO: 86340 - RNA, 22 nt, Human
ucuucagacuguuguucuuuug

SEQ ID NO: 86341 - RNA, 22 nt, Human
ucuucagagauguaacauaugg

SEQ ID NO: 86342 - RNA, 22 nt, Human
ucuucagagugagcagugucau

SEQ ID NO: 86343 - RNA, 20 nt, Human
ucuucagaugcuuuuggagu

SEQ ID NO: 86344 - RNA, 22 nt, Human
ucuucagauugcacugagcaag

SEQ ID NO: 86345 - RNA, 22 nt, Human
ucuucagcaacuccccaaucug

SEQ ID NO: 86346 - RNA, 22 nt, Human
ucuucagcuguagucauuguuc

SEQ ID NO: 86347 - RNA, 22 nt, Human
ucuucaggcucuggcugccuuu

SEQ ID NO: 86348 - RNA, 22 nt, Human
ucuucagguagugaguggggug

SEQ ID NO: 86349 - RNA, 22 nt, Human
ucuucagucaauccagauguuu

SEQ ID NO: 86350 - RNA, 23 nt, Human
ucuucagugagaccagcaaggcc

SEQ ID NO: 86351 - RNA, 22 nt, Human
ucuucagugcaccugaugucuu

SEQ ID NO: 86352 - RNA, 22 nt, Human
ucuucaguuguaaaaguguugg

SEQ ID NO: 86353 - RNA, 22 nt, Human
ucuucaguugucauacugccuu

SEQ ID NO: 86354 - RNA, 22 nt, Human
ucuucaugaccucuguguuuua

SEQ ID NO: 86355 - RNA, 22 nt, Human
ucuucaugccaaaugaguuuug

SEQ ID NO: 86356 - RNA, 22 nt, Human
ucuucauguauacucaugguac

SEQ ID NO: 86357 - RNA, 22 nt, Human
ucuucauguauuugacaaccau

SEQ ID NO: 86358 - RNA, 22 nt, Human
ucuucauuccguagauauuuau

SEQ ID NO: 86359 - RNA, 22 nt, Human
ucuucauuuuacaggcagaccu

SEQ ID NO: 86360 - RNA, 22 nt, Human
ucuuccagaaguguuuucagaa

SEQ ID NO: 86361 - RNA, 22 nt, Human
ucuuccagaaugcauucucuuu

SEQ ID NO: 86362 - RNA, 22 nt, Human
ucuuccagauacuuccugacuu

SEQ ID NO: 86363 - RNA, 22 nt, Human
ucuuccagaugcagaugcuucu

SEQ ID NO: 86364 - RNA, 22 nt, Human
ucuuccagcccuucuaauggua

SEQ ID NO: 86365 - RNA, 22 nt, Human
ucuuccagcuucuagaggaugc

SEQ ID NO: 86366 - RNA, 20 nt, Human
ucuuccagcuucugguagaa

SEQ ID NO: 86367 - RNA, 22 nt, Human
ucuuccagcuucugguggcugc

SEQ ID NO: 86368 - RNA, 22 nt, Human
ucuuccagucuguaggacuagg

SEQ ID NO: 86369 - RNA, 22 nt, Human
ucuucccagaggaggugccagc

SEQ ID NO: 86370 - RNA, 22 nt, Human
ucuucccuaaucaccaucuuca

SEQ ID NO: 86371 - RNA, 22 nt, Human
ucuuccucccuacagagcucag

SEQ ID NO: 86372 - RNA, 22 nt, Human
ucuuccucuagaucugaggccc

SEQ ID NO: 86373 - RNA, 22 nt, Human
ucuuccugaaacccuguuccag

SEQ ID NO: 86374 - RNA, 22 nt, Human
ucuuccuucuuugaugacaagg

SEQ ID NO: 86375 - RNA, 22 nt, Human
ucuuccuuuuguaccuucugaa

SEQ ID NO: 86376 - RNA, 22 nt, Human
ucuucgcuuacuguguaaggag

SEQ ID NO: 86377 - RNA, 22 nt, Human
ucuucuaguaggccaagaagcu

SEQ ID NO: 86378 - RNA, 22 nt, Human
ucuucucaguuucucuaggaug

SEQ ID NO: 86379 - RNA, 22 nt, Human
ucuucucccagggucgcccaag

SEQ ID NO: 86380 - RNA, 22 nt, Human
ucuucucccaucggccgcaggg

SEQ ID NO: 86381 - RNA, 22 nt, Human
ucuucucccaucuccaggcagg

SEQ ID NO: 86382 - RNA, 22 nt, Human
ucuucuccuuugccauguguuu

SEQ ID NO: 86383 - RNA, 22 nt, Human
ucuucucucauguaggagggaa

SEQ ID NO: 86384 - RNA, 22 nt, Human
ucuucuguccuaagucaaagca

SEQ ID NO: 86385 - RNA, 22 nt, Human
ucuucuuccucauuuauacaua

SEQ ID NO: 86386 - RNA, 22 nt, Human
ucuucuuccuccacagggccca

SEQ ID NO: 86387 - RNA, 22 nt, Human
ucuucuuugaaucauagugacc

SEQ ID NO: 86388 - RNA, 22 nt, Human
ucuucuuuuauuucaagggugu

SEQ ID NO: 86389 - RNA, 21 nt, Human
ucuugaaaaguuagauucucu

SEQ ID NO: 86390 - RNA, 22 nt, Human
ucuugaaaauugagguugaagg

SEQ ID NO: 86391 - RNA, 22 nt, Human
ucuugaaagcauuuucuucauc

SEQ ID NO: 86392 - RNA, 22 nt, Human
ucuugaagucuuaugguuuaaa

SEQ ID NO: 86393 - RNA, 22 nt, Human
ucuugaauuguacucccauaag

SEQ ID NO: 86394 - RNA, 22 nt, Human
ucuugacaacuauacuacuuac

SEQ ID NO: 86395 - RNA, 22 nt, Human
ucuugagaaauaauuaaacaug

SEQ ID NO: 86396 - RNA, 20 nt, Human
ucuugagaacaauuucuggc

SEQ ID NO: 86397 - RNA, 22 nt, Human
ucuugagucuaaucugaacuuu

SEQ ID NO: 86398 - RNA, 22 nt, Human
ucuugauuaauaccuuagcccu

SEQ ID NO: 86399 - RNA, 22 nt, Human
ucuugauugguuguauagcuac

SEQ ID NO: 86400 - RNA, 22 nt, Human
ucuugauuguuuucugaccuua

SEQ ID NO: 86401 - RNA, 22 nt, Human
ucuugauuugaauugcaguugu

SEQ ID NO: 86402 - RNA, 22 nt, Human
ucuugauuuugugaauaaguug

SEQ ID NO: 86403 - RNA, 22 nt, Human
ugagaggcagaauggugccugc

SEQ ID NO: 86404 - RNA, 22 nt, Human
ugagaggccccagcucuuggcc

SEQ ID NO: 86405 - RNA, 22 nt, Human
ugagagggcccagagcacacca

SEQ ID NO: 86406 - RNA, 22 nt, Human
ugagagugguucagcucagaag

SEQ ID NO: 86407 - RNA, 18 nt, Human
ugagagugugugcucuug

SEQ ID NO: 86408 - RNA, 22 nt, Human
ugagaguuccuccucuuuccac

SEQ ID NO: 86409 - RNA, 22 nt, Human
ugagaguuuugacgcuuguaac

SEQ ID NO: 86410 - RNA, 21 nt, Human
ugagauaaauuuccuuacuac

SEQ ID NO: 86411 - RNA, 22 nt, Human
ugagauaacaaaauuaucuuca

SEQ ID NO: 86412 - RNA, 22 nt, Human
ugagauaauuaaaucaaaaccu

SEQ ID NO: 86413 - RNA, 22 nt, Human
ugagauaguauguagcaccuga

SEQ ID NO: 86414 - RNA, 22 nt, Human
ugagauccccaggaaggacaac

SEQ ID NO: 86415 - RNA, 22 nt, Human
ugagaucucugccuauauggau

SEQ ID NO: 86416 - RNA, 22 nt, Human
ugagaucugugcauguuaguua

SEQ ID NO: 86417 - RNA, 22 nt, Human
ugagaucuucgcucuucacaga

SEQ ID NO: 86418 - RNA, 22 nt, Human
ugagaugcaggagaugggacug

SEQ ID NO: 86419 - RNA, 21 nt, Human
ugagaugcuagaaggcaggga

SEQ ID NO: 86420 - RNA, 22 nt, Human
ugagaugcugggaacaaggaag

SEQ ID NO: 86421 - RNA, 22 nt, Human
ugagauggaaggugaggcagua

SEQ ID NO: 86422 - RNA, 22 nt, Human
ugagauggagccacugcacucu

SEQ ID NO: 86423 - RNA, 22 nt, Human
ugagauggaguuuuggggauau

SEQ ID NO: 86424 - RNA, 22 nt, Human
ugagaugggaugugcacuuggc

SEQ ID NO: 86425 - RNA, 22 nt, Human
ugagauggggagggcugcagaa

SEQ ID NO: 86426 - RNA, 22 nt, Human
ugagauggguggggagcucagg

SEQ ID NO: 86427 - RNA, 19 nt, Human
ugagauuucuuaggugauu

SEQ ID NO: 86428 - RNA, 22 nt, Human
ugagauuuggguuguuuaacau

SEQ ID NO: 86429 - RNA, 22 nt, Human
ugagauuuucagcaucacuuca

SEQ ID NO: 86430 - RNA, 22 nt, Human
ugagcaaggagcagucuuucuu

SEQ ID NO: 86431 - RNA, 22 nt, Human
ugagcaauuaacagagucuaaa

SEQ ID NO: 86432 - RNA, 22 nt, Human
ugagcacagcuuucacuagaaa

SEQ ID NO: 86433 - RNA, 22 nt, Human
ugagcaccuacuguauuccagg

SEQ ID NO: 86434 - RNA, 22 nt, Human
ugagcaccuggaccagauucug

SEQ ID NO: 86435 - RNA, 22 nt, Human
ugagcacuuuaaaauauuccca

SEQ ID NO: 86436 - RNA, 22 nt, Human
ugagcagaggaggcugccaacu

SEQ ID NO: 86437 - RNA, 18 nt, Human
ugagcagaguaaggcuuu

SEQ ID NO: 86438 - RNA, 22 nt, Human
ugagcagcaggaucuucuggua

SEQ ID NO: 86439 - RNA, 22 nt, Human
ugagcagcuuguuccgaguguu

SEQ ID NO: 86440 - RNA, 22 nt, Human
ugagcaggacugaccggccuua

SEQ ID NO: 86441 - RNA, 22 nt, Human
ugagcaggcaaacaaugguuau

SEQ ID NO: 86442 - RNA, 22 nt, Human
ugagcaggcgcagcaggagguc

SEQ ID NO: 86443 - RNA, 22 nt, Human
ugagcaggucaagacuccagcu

SEQ ID NO: 86444 - RNA, 21 nt, Human
ugagcaggugcagggaagugg

SEQ ID NO: 86445 - RNA, 22 nt, Human
uucucaggaacucagugucagc

SEQ ID NO: 86446 - RNA, 22 nt, Human
uucucaggccccugccuggacu

SEQ ID NO: 86447 - RNA, 22 nt, Human
uucucaggccuuugggauggga

SEQ ID NO: 86448 - RNA, 22 nt, Human
uucucagggcccuguguuagcu

SEQ ID NO: 86449 - RNA, 22 nt, Human
uucucaguaugugacgaggacc

SEQ ID NO: 86450 - RNA, 22 nt, Human
uucucauacaggaucucuuauu

SEQ ID NO: 86451 - RNA, 18 nt, Human
uucucauaccucacuuag

SEQ ID NO: 86452 - RNA, 22 nt, Human
uucucauagaugcuauagacag

SEQ ID NO: 86453 - RNA, 21 nt, Human
uucucaugggauaaguacaug

SEQ ID NO: 86454 - RNA, 22 nt, Human
uucucauggugucuuuauacau

SEQ ID NO: 86455 - RNA, 19 nt, Human
uucucauuccuuuccacuu

SEQ ID NO: 86456 - RNA, 22 nt, Human
uucucauucugacucaguguag

SEQ ID NO: 86457 - RNA, 22 nt, Human
uucuccaaggauacaguccugu

SEQ ID NO: 86458 - RNA, 20 nt, Human
uucuccacaggguggaggag

SEQ ID NO: 86459 - RNA, 22 nt, Human
uucuccacccacucuuuuguug

SEQ ID NO: 86460 - RNA, 22 nt, Human
uucuccagacaacagaggguga

SEQ ID NO: 86461 - RNA, 22 nt, Human
uucuccagacacaaaaucuaag

SEQ ID NO: 86462 - RNA, 22 nt, Human
uucuccagacccuccugcagac

SEQ ID NO: 86463 - RNA, 19 nt, Human
uucuccagccugaccugag

SEQ ID NO: 86464 - RNA, 21 nt, Human
uucuccagggggagcucucuc

SEQ ID NO: 86465 - RNA, 22 nt, Human
uucuccaguuauauuauguuaa

SEQ ID NO: 86466 - RNA, 22 nt, Human
uucuccauuuaacuuccuuaug

SEQ ID NO: 86467 - RNA, 22 nt, Human
uucuccucacugcagccuuuca

SEQ ID NO: 86468 - RNA, 22 nt, Human
uucuccucagcaaggcagcuuu

SEQ ID NO: 86469 - RNA, 22 nt, Human
uucuccucugcaaugacuggca

SEQ ID NO: 86470 - RNA, 22 nt, Human
uucuccugaguucccaggucua

SEQ ID NO: 86471 - RNA, 22 nt, Human
uucuccugcccuuggacuucca

SEQ ID NO: 86472 - RNA, 22 nt, Human
uucuccuuauucauaguugucu

SEQ ID NO: 86473 - RNA, 22 nt, Human
uucucuaagccuuaguuucuuc

SEQ ID NO: 86474 - RNA, 22 nt, Human
uucucuaagcuggcugaggucu

SEQ ID NO: 86475 - RNA, 22 nt, Human
uucucuaggaguucugggauca

SEQ ID NO: 86476 - RNA, 22 nt, Human
uucucuagugcaaauuguuuga

SEQ ID NO: 86477 - RNA, 22 nt, Human
uucucucugagagcaucuggaa

SEQ ID NO: 86478 - RNA, 22 nt, Human
uucucucuggaccugggaugcg

SEQ ID NO: 86479 - RNA, 22 nt, Human
uucucucuguggucccauuuug

SEQ ID NO: 86480 - RNA, 22 nt, Human
uucucucuguuauggauuuuac

SEQ ID NO: 86481 - RNA, 22 nt, Human
uucucugaaggccaugcucacu

SEQ ID NO: 86482 - RNA, 22 nt, Human
uucucugaagguuguggaacua

SEQ ID NO: 86483 - RNA, 22 nt, Human
uucucugcagcuccuggcuggg

SEQ ID NO: 86484 - RNA, 22 nt, Human
uucucugcucucacauacagaa

SEQ ID NO: 86485 - RNA, 22 nt, Human
uucucuggaacugaaacaagau

SEQ ID NO: 86486 - RNA, 22 nt, Human
uucucuggaaggcucuacggga

SEQ ID NO: 86487 - RNA, 19 nt, Human
uucucuggacuagaugcug

SEQ ID NO: 86488 - RNA, 22 nt, Human
uucucuggccugaggcgaggcc

SEQ ID NO: 86489 - RNA, 22 nt, Human
uucucuggcgcgcugugcuaug

SEQ ID NO: 86490 - RNA, 22 nt, Human
uucucuggcgguguguuuuccu

SEQ ID NO: 86491 - RNA, 22 nt, Human
uucucugggcuuuucggauccg

SEQ ID NO: 86492 - RNA, 22 nt, Human
uucucuggggacuugguuggag

SEQ ID NO: 86493 - RNA, 22 nt, Human
uucucuggguuaggggaacuau

SEQ ID NO: 86494 - RNA, 18 nt, Human
uucucugguggauguuau

SEQ ID NO: 86495 - RNA, 19 nt, Human
uucucugugcuagacucug

SEQ ID NO: 86496 - RNA, 22 nt, Human
uucucuguggauugggugagag

SEQ ID NO: 86497 - RNA, 22 nt, Human
uucucuuagcuguaaagucaau

SEQ ID NO: 86498 - RNA, 22 nt, Human
uucucuuaguauugcuaguuua

SEQ ID NO: 86499 - RNA, 22 nt, Human
uucucuucuguucagugcccaa

SEQ ID NO: 86500 - RNA, 23 nt, Human
uucucuuuagauuuacauuacuc

SEQ ID NO: 86501 - RNA, 22 nt, Human
uucucuuucugcugggcuggaa

SEQ ID NO: 86502 - RNA, 22 nt, Human
uucucuuuugugaugugagaug

SEQ ID NO: 86503 - RNA, 22 nt, Human
uucugaaccauugagcacugcc

SEQ ID NO: 86504 - RNA, 22 nt, Human
uucugaagggcuaagugucuau

SEQ ID NO: 86505 - RNA, 22 nt, Human
uucugaauggcaagcauuaggc

SEQ ID NO: 86506 - RNA, 22 nt, Human
uucugaauuucuguguaucuua

SEQ ID NO: 86507 - RNA, 17 nt, Human
uucugacccuagagcuc

SEQ ID NO: 86508 - RNA, 22 nt, Human
uucugagaaggcuguggacaca

SEQ ID NO: 86509 - RNA, 22 nt, Human
uucugagaaugcuucuggaauc

SEQ ID NO: 86510 - RNA, 22 nt, Human
uucugagacaauugagagucua

SEQ ID NO: 86511 - RNA, 22 nt, Human
uucugagagagccucucauguu

SEQ ID NO: 86512 - RNA, 23 nt, Human
uucuuacaaggcuggcccacuug

SEQ ID NO: 86513 - RNA, 22 nt, Human
uucuuacaaguaugacguagca

SEQ ID NO: 86514 - RNA, 22 nt, Human
uucuuacaaguauuccaggucc

SEQ ID NO: 86515 - RNA, 22 nt, Human
uucuuacauuagucugugcuuu

SEQ ID NO: 86516 - RNA, 22 nt, Human
uucuuaguucaacuaaaauuua

SEQ ID NO: 86517 - RNA, 22 nt, Human
uucuuauaagauaggccucagg

SEQ ID NO: 86518 - RNA, 22 nt, Human
uucuuauuuuccugaggaagaa

SEQ ID NO: 86519 - RNA, 22 nt, Human
uucuucaaagaugucuguugga

SEQ ID NO: 86520 - RNA, 22 nt, Human
uucuucaaugugcccuguuuuc

SEQ ID NO: 86521 - RNA, 22 nt, Human
uucuucagauccuacaagucug

SEQ ID NO: 86522 - RNA, 22 nt, Human
uucuucagauggugagaccucc

SEQ ID NO: 86523 - RNA, 21 nt, Human
uucuucaggccaaugcucauu

SEQ ID NO: 86524 - RNA, 22 nt, Human
uucuucagucccacuagccaca

SEQ ID NO: 86525 - RNA, 22 nt, Human
uucuucagugacaaaggcaaaa

SEQ ID NO: 86526 - RNA, 21 nt, Human
uucuucaugaugauuaauggc

SEQ ID NO: 86527 - RNA, 22 nt, Human
uucuucaugcuguugcugcuug

SEQ ID NO: 86528 - RNA, 21 nt, Human
uucuuccuaaauacagaucuc

SEQ ID NO: 86529 - RNA, 22 nt, Human
uucuuccucagcagggcugccu

SEQ ID NO: 86530 - RNA, 22 nt, Human
uucuuccuugguuuccuggaua

SEQ ID NO: 86531 - RNA, 22 nt, Human
uucuucuaaaugugcuuauuaa

SEQ ID NO: 86532 - RNA, 19 nt, Human
uucuucuaccucuaccacu

SEQ ID NO: 86533 - RNA, 23 nt, Human
uucuucucaauuaguugauucag

SEQ ID NO: 86534 - RNA, 22 nt, Human
uucuucucagggucccacaugg

SEQ ID NO: 86535 - RNA, 22 nt, Human
uucuucuccuaaggagaguccu

SEQ ID NO: 86536 - RNA, 22 nt, Human
uucuucucucauagauuaaggu

SEQ ID NO: 86537 - RNA, 22 nt, Human
uucuucuguuggcagagcauac

SEQ ID NO: 86538 - RNA, 22 nt, Human
uucuucuucuggcugcaccugg

SEQ ID NO: 86539 - RNA, 20 nt, Human
uucuugauuugauccugguu

SEQ ID NO: 86540 - RNA, 22 nt, Human
uucuuggccaccagaucucacu

SEQ ID NO: 86541 - RNA, 22 nt, Human
uucuugggaauuuuuccaacac

SEQ ID NO: 86542 - RNA, 22 nt, Human
uucuugggugugaccagucuga

SEQ ID NO: 86543 - RNA, 22 nt, Human
uucuuguuccaugaaagacaga

SEQ ID NO: 86544 - RNA, 22 nt, Human
uucuuguucugguucuguuagc

SEQ ID NO: 86545 - RNA, 22 nt, Human
uucuuguuuugcccaaguugua

SEQ ID NO: 86546 - RNA, 22 nt, Human
uucuuuaaaugaauucucugua

SEQ ID NO: 86547 - RNA, 22 nt, Human
uucuuucagaacacaagugauu

SEQ ID NO: 86548 - RNA, 20 nt, Human
uucuuucaucuacacguugu

SEQ ID NO: 86549 - RNA, 22 nt, Human
uucuuuccccauggaguucgga

SEQ ID NO: 86550 - RNA, 22 nt, Human
uucuuucccuuccagcagcucc

SEQ ID NO: 86551 - RNA, 22 nt, Human
uucuuuccucccagccuuugga

SEQ ID NO: 86552 - RNA, 22 nt, Human
uucuuucugaauacaguugagu

SEQ ID NO: 86553 - RNA, 22 nt, Human
uucuuucugggaagaguucaga

SEQ ID NO: 86554 - RNA, 22 nt, Human
uucuuucugggguccuucggcu

SEQ ID NO: 86555 - RNA, 22 nt, Human
uucuuucuuggggaacacacuc

SEQ ID NO: 86556 - RNA, 22 nt, Human
uucuuugaauagauguucccag

SEQ ID NO: 86557 - RNA, 22 nt, Human
uucuuugaguuaguacagucca

SEQ ID NO: 86558 - RNA, 22 nt, Human
uucuuuggcauuuccuguaugu

SEQ ID NO: 86559 - RNA, 22 nt, Human
uucuuuggcugccagucuggag

SEQ ID NO: 86560 - RNA, 22 nt, Human
uucuuugggcucagagagggag

SEQ ID NO: 86561 - RNA, 22 nt, Human
ugccaauuagagacauccaucu

SEQ ID NO: 86562 - RNA, 22 nt, Human
ugccacacaauuacugcugcua

SEQ ID NO: 86563 - RNA, 22 nt, Human
ugccacaccaacaucuuucagc

SEQ ID NO: 86564 - RNA, 22 nt, Human
ugccacagagacuuucauugua

SEQ ID NO: 86565 - RNA, 22 nt, Human
ugccacaggcaaucccugcacg

SEQ ID NO: 86566 - RNA, 22 nt, Human
ugccacaggguccucaggccag

SEQ ID NO: 86567 - RNA, 22 nt, Human
ugccaccaggagaaccagugca

SEQ ID NO: 86568 - RNA, 22 nt, Human
ugccaccccucugcacccucag

SEQ ID NO: 86569 - RNA, 22 nt, Human
ugccacccuggcggcagccugc

SEQ ID NO: 86570 - RNA, 22 nt, Human
ugccaccuggacaaccuuaugc

SEQ ID NO: 86571 - RNA, 22 nt, Human
ugccacugggcaugcagauguc

SEQ ID NO: 86572 - RNA, 22 nt, Human
ugccagaacagcucaucuggcc

SEQ ID NO: 86573 - RNA, 19 nt, Human
ugccagagauacucccaga

SEQ ID NO: 86574 - RNA, 23 nt, Human
ugccagaggcagucacaguggug

SEQ ID NO: 86575 - RNA, 22 nt, Human
ugccagaguuacaugaggguca

SEQ ID NO: 86576 - RNA, 22 nt, Human
ugccagcacaaguuaagagauc

SEQ ID NO: 86577 - RNA, 19 nt, Human
ugccagcauuaggcugaag

SEQ ID NO: 86578 - RNA, 22 nt, Human
ugccagcccaccuuggggccuc

SEQ ID NO: 86579 - RNA, 22 nt, Human
ugccagccuggccugagucuuu

SEQ ID NO: 86580 - RNA, 17 nt, Human
ugccagccugucccagg

SEQ ID NO: 86581 - RNA, 22 nt, Human
ugccagcuagagaagcuagaaa

SEQ ID NO: 86582 - RNA, 19 nt, Human
ugccagcucacaggagcuc

SEQ ID NO: 86583 - RNA, 22 nt, Human
ugccaggagagugcaugcaggg

SEQ ID NO: 86584 - RNA, 22 nt, Human
ugccaggaggggacaccuccuc

SEQ ID NO: 86585 - RNA, 22 nt, Human
ugccaggauauaagagugcgau

SEQ ID NO: 86586 - RNA, 22 nt, Human
ugccaggcauauggccucuuug

SEQ ID NO: 86587 - RNA, 22 nt, Human
ugccaggcauguaguagacuug

SEQ ID NO: 86588 - RNA, 22 nt, Human
ugccaggccacguagcuucaag

SEQ ID NO: 86589 - RNA, 22 nt, Human
ugccaggcccugugcuggaugc

SEQ ID NO: 86590 - RNA, 22 nt, Human
ugccaggcuguccugggccugg

SEQ ID NO: 86591 - RNA, 23 nt, Human
ugccagggcccugugugcaaugc

SEQ ID NO: 86592 - RNA, 22 nt, Human
ugccagucucacccuggguccu

SEQ ID NO: 86593 - RNA, 22 nt, Human
ugccagugaaacauggaagaau

SEQ ID NO: 86594 - RNA, 22 nt, Human
ugccagugcuugugucugagca

SEQ ID NO: 86595 - RNA, 22 nt, Human
ugccauacuauaaggcugucaa

SEQ ID NO: 86596 - RNA, 22 nt, Human
ugccauagcaaugguaagcuga

SEQ ID NO: 86597 - RNA, 22 nt, Human
ugccauauuauugagcauauua

SEQ ID NO: 86598 - RNA, 22 nt, Human
ugccauauugcaaagugucugc

SEQ ID NO: 86599 - RNA, 21 nt, Human
ugccaucucugugggaccagg

SEQ ID NO: 86600 - RNA, 22 nt, Human
ugccaucugcacccaccugccc

SEQ ID NO: 86601 - RNA, 22 nt, Human
ugccaugcccaccucccuucug

SEQ ID NO: 86602 - RNA, 22 nt, Human
ugccauuuacugagauuagaag

SEQ ID NO: 86603 - RNA, 22 nt, Human
ugccauuucucaaauaugacua

SEQ ID NO: 86604 - RNA, 21 nt, Human
ugccauuuuaaccaagugugc

SEQ ID NO: 86605 - RNA, 22 nt, Human
ugcccaaguccuccaccgaggu

SEQ ID NO: 86606 - RNA, 22 nt, Human
ugcccacaccugggggaggcug

SEQ ID NO: 86607 - RNA, 22 nt, Human
ugcccacaucugcuuauuucau

SEQ ID NO: 86608 - RNA, 22 nt, Human
ugcccaccuuuacugugauuua

SEQ ID NO: 86609 - RNA, 22 nt, Human
ugcccacuggauaaugcaaacu

SEQ ID NO: 86610 - RNA, 22 nt, Human
ugcccagcagggagcuaccugg

SEQ ID NO: 86611 - RNA, 22 nt, Human
ugcccagccccuaucccuggga

SEQ ID NO: 86612 - RNA, 22 nt, Human
ugcccagcgcccacauucuguc

SEQ ID NO: 86613 - RNA, 22 nt, Human
ugcccagcuauuccuuucuuag

SEQ ID NO: 86614 - RNA, 22 nt, Human
ugcccagcuucuuacuuuuaaa

SEQ ID NO: 86615 - RNA, 19 nt, Human
ugcccaggccagguugggc

SEQ ID NO: 86616 - RNA, 22 nt, Human
ugcccagggauaagccuagaga

SEQ ID NO: 86617 - RNA, 22 nt, Human
ugcccagucuccgggccagccc

SEQ ID NO: 86618 - RNA, 21 nt, Human
ugcccaugagcagaagucacc

SEQ ID NO: 86619 - RNA, 22 nt, Human
ugccccaggugcugagguugga

SEQ ID NO: 86620 - RNA, 22 nt, Human
ugccccucagggaacggguauc

SEQ ID NO: 86621 - RNA, 22 nt, Human
ugaagccauuacuguguuaggg

SEQ ID NO: 86622 - RNA, 22 nt, Human
ugaagcuacaaaagauuauugc

SEQ ID NO: 86623 - RNA, 22 nt, Human
ugaagcuagcaggaagagcagg

SEQ ID NO: 86624 - RNA, 22 nt, Human
ugaagcuaguauuaacucagau

SEQ ID NO: 86625 - RNA, 22 nt, Human
ugaagcuauugguaaggaagug

SEQ ID NO: 86626 - RNA, 22 nt, Human
ugaagcuguaggcaugggcagc

SEQ ID NO: 86627 - RNA, 22 nt, Human
ugaagcugugggcaguggagcc

SEQ ID NO: 86628 - RNA, 22 nt, Human
ugaaggaaugaguauacuguuu

SEQ ID NO: 86629 - RNA, 22 nt, Human
ugaaggaauggaggaucagagc

SEQ ID NO: 86630 - RNA, 21 nt, Human
ugaaggagaggaccgagugcu

SEQ ID NO: 86631 - RNA, 22 nt, Human
ugaaggcacaguuuaaccagua

SEQ ID NO: 86632 - RNA, 22 nt, Human
ugaaggcacguggguggauacu

SEQ ID NO: 86633 - RNA, 22 nt, Human
ugaaggcagugauuuuguuugg

SEQ ID NO: 86634 - RNA, 22 nt, Human
ugaaggcauugaugaaggaauc

SEQ ID NO: 86635 - RNA, 22 nt, Human
ugaaggccacuuccugugagcu

SEQ ID NO: 86636 - RNA, 22 nt, Human
ugaaggccagggauuugcagcc

SEQ ID NO: 86637 - RNA, 22 nt, Human
ugaaggcccagccacagaaugg

SEQ ID NO: 86638 - RNA, 22 nt, Human
ugaaggcuguuggauggggaag

SEQ ID NO: 86639 - RNA, 22 nt, Human
ugaaggcuuucuccccucuggu

SEQ ID NO: 86640 - RNA, 22 nt, Human
ugaaggugaccugacaguggcu

SEQ ID NO: 86641 - RNA, 20 nt, Human
ugaaggugacuccuuucuug

SEQ ID NO: 86642 - RNA, 22 nt, Human
ugaagguggaagggugguucug

SEQ ID NO: 86643 - RNA, 22 nt, Human
ugaagguggggcuuaggaaucu

SEQ ID NO: 86644 - RNA, 22 nt, Human
ugaaguauccaucuuguucuag

SEQ ID NO: 86645 - RNA, 22 nt, Human
ugaagucagggauuccaugaag

SEQ ID NO: 86646 - RNA, 22 nt, Human
ugaagucucuguuuucucauuu

SEQ ID NO: 86647 - RNA, 22 nt, Human
ugaaguggacccuggacagacc

SEQ ID NO: 86648 - RNA, 22 nt, Human
ugaaguuagaacuaugaggaua

SEQ ID NO: 86649 - RNA, 22 nt, Human
ugaaguucacugagaguucacc

SEQ ID NO: 86650 - RNA, 22 nt, Human
ugaaguuuaagguuagauaagu

SEQ ID NO: 86651 - RNA, 22 nt, Human
ugaaguuuaauuuuggacauga

SEQ ID NO: 86652 - RNA, 22 nt, Human
ugaaguuucacgcgucauucaa

SEQ ID NO: 86653 - RNA, 22 nt, Human
ugaauaaacuaugaggaggaau

SEQ ID NO: 86654 - RNA, 22 nt, Human
ugaauaagaauuauuauaauga

SEQ ID NO: 86655 - RNA, 22 nt, Human
ugaauaauccacagucauucau

SEQ ID NO: 86656 - RNA, 22 nt, Human
ugaauaaucuuggguauuaaua

SEQ ID NO: 86657 - RNA, 22 nt, Human
ugaauaauuaugggaguccuaa

SEQ ID NO: 86658 - RNA, 19 nt, Human
ugaauacagagauacagaa

SEQ ID NO: 86659 - RNA, 22 nt, Human
ugaauacuauuucauaaugugg

SEQ ID NO: 86660 - RNA, 22 nt, Human
ugaauagagcugcaguggacau

SEQ ID NO: 86661 - RNA, 22 nt, Human
ugaauagauggugacaguauga

SEQ ID NO: 86662 - RNA, 21 nt, Human
ugaauagggccagaaccaaag

SEQ ID NO: 86663 - RNA, 22 nt, Human
ugaauaguaagagaauauuugc

SEQ ID NO: 86664 - RNA, 22 nt, Human
ugaauaguucuacuacuugaca

SEQ ID NO: 86665 - RNA, 22 nt, Human
ugaauauguuccucacaaguuc

SEQ ID NO: 86666 - RNA, 23 nt, Human
ugaaucaauuaugggauucaaug

SEQ ID NO: 86667 - RNA, 22 nt, Human
ugaaucaugccacugagcuccc

SEQ ID NO: 86668 - RNA, 22 nt, Human
ugaaucauggauaaauagcuua

SEQ ID NO: 86669 - RNA, 22 nt, Human
ugaauccuaguugaagauaagg

SEQ ID NO: 86670 - RNA, 22 nt, Human
ugaaucuauguugccccauaau

SEQ ID NO: 86671 - RNA, 22 nt, Human
ugaaucuggaucuaugaucaau

SEQ ID NO: 86672 - RNA, 22 nt, Human
ugaaugaacuaaaucauaguuc

SEQ ID NO: 86673 - RNA, 22 nt, Human
ugaaugaauccuaacaaagaca

SEQ ID NO: 86674 - RNA, 21 nt, Human
ugagcaggugcugcuuuuaug

SEQ ID NO: 86675 - RNA, 22 nt, Human
ugagcauuaccugaggccacug

SEQ ID NO: 86676 - RNA, 22 nt, Human
ugagcauuggaucaaaugacuu

SEQ ID NO: 86677 - RNA, 22 nt, Human
ugagccaagaucaugccguugu

SEQ ID NO: 86678 - RNA, 22 nt, Human
ugagccaagcagcuucccaggg

SEQ ID NO: 86679 - RNA, 22 nt, Human
ugagccagcaggccuccagugg

SEQ ID NO: 86680 - RNA, 22 nt, Human
ugagccagccuugcagcugugc

SEQ ID NO: 86681 - RNA, 22 nt, Human
ugagccagcuccuugccuguca

SEQ ID NO: 86682 - RNA, 22 nt, Human
ugagccaggcacugcuccugga

SEQ ID NO: 86683 - RNA, 20 nt, Human
ugagccaggcuaggaagggc

SEQ ID NO: 86684 - RNA, 22 nt, Human
ugagccaggcucaagugauccu

SEQ ID NO: 86685 - RNA, 22 nt, Human
ugagccaggguuuccggcugcu

SEQ ID NO: 86686 - RNA, 22 nt, Human
ugagccaguggaagauggcagu

SEQ ID NO: 86687 - RNA, 22 nt, Human
ugagcccaggaggcagagguug

SEQ ID NO: 86688 - RNA, 23 nt, Human
ugagcccaguuuucccucuugcc

SEQ ID NO: 86689 - RNA, 22 nt, Human
ugagcccugaccuagccuggcc

SEQ ID NO: 86690 - RNA, 20 nt, Human
ugagccugcuguaggaggcc

SEQ ID NO: 86691 - RNA, 22 nt, Human
ugagccugggcuuucucuggag

SEQ ID NO: 86692 - RNA, 22 nt, Human
ugagccuggguggucgaggcug

SEQ ID NO: 86693 - RNA, 22 nt, Human
ugagccugguugcagugucugg

SEQ ID NO: 86694 - RNA, 22 nt, Human
ugagccuguggggugacaacca

SEQ ID NO: 86695 - RNA, 20 nt, Human
ugagccuugaggagugacug

SEQ ID NO: 86696 - RNA, 22 nt, Human
ugagcucaagcaauucacccgc

SEQ ID NO: 86697 - RNA, 22 nt, Human
ugagcucuaagauccccucaag

SEQ ID NO: 86698 - RNA, 22 nt, Human
ugagcucucagggacagacuau

SEQ ID NO: 86699 - RNA, 22 nt, Human
ugagcugauggcaucccuguuu

SEQ ID NO: 86700 - RNA, 22 nt, Human
ugagcugcaagaaaauuucagu

SEQ ID NO: 86701 - RNA, 22 nt, Human
ugagcugcagugagcugagaug

SEQ ID NO: 86702 - RNA, 19 nt, Human
ugagcugcugcugcccauc

SEQ ID NO: 86703 - RNA, 22 nt, Human
ugagcuggaggacaggagggua

SEQ ID NO: 86704 - RNA, 22 nt, Human
ugagcuggagucgugagcaaag

SEQ ID NO: 86705 - RNA, 22 nt, Human
ugagcuggagucuguggcuccu

SEQ ID NO: 86706 - RNA, 22 nt, Human
ugagcuggauccaacuccguuu

SEQ ID NO: 86707 - RNA, 19 nt, Human
ugagcuggcugagccucuc

SEQ ID NO: 86708 - RNA, 22 nt, Human
ugagcugggaguggugaugagg

SEQ ID NO: 86709 - RNA, 22 nt, Human
ugagcugguucuugaggcauga

SEQ ID NO: 86710 - RNA, 22 nt, Human
ugagcuguacuccuccccaggg

SEQ ID NO: 86711 - RNA, 22 nt, Human
ugagcuguauauuguuuuaaua

SEQ ID NO: 86712 - RNA, 22 nt, Human
ugagcugugucuuggugagagu

SEQ ID NO: 86713 - RNA, 22 nt, Human
ugagcugugugacauugagcca

SEQ ID NO: 86714 - RNA, 22 nt, Human
ugagcuuacgugggaacagacu

SEQ ID NO: 86715 - RNA, 22 nt, Human
ugagcuuacuucuguacacaga

SEQ ID NO: 86716 - RNA, 22 nt, Human
ugagcuucaaaguuggaucuga

SEQ ID NO: 86717 - RNA, 17 nt, Human
ugagcuucaaucaggug

SEQ ID NO: 86718 - RNA, 22 nt, Human
ugagcuuccucccugcauccau

SEQ ID NO: 86719 - RNA, 22 nt, Human
ugagcuuucauguaugaaaaga

SEQ ID NO: 86720 - RNA, 22 nt, Human
ugagcuuuguuguuaguauauu

SEQ ID NO: 86721 - RNA, 22 nt, Human
ugaggaaagaaaggcaugcaug

SEQ ID NO: 86722 - RNA, 22 nt, Human
ugaggaagaacaagaauuuaga

SEQ ID NO: 86723 - RNA, 22 nt, Human
ugaggaagccaaacagcuacac

SEQ ID NO: 86724 - RNA, 22 nt, Human
ugaggaaggaauugagguuuua

SEQ ID NO: 86725 - RNA, 22 nt, Human
ugaggaagggcacacggacccu

SEQ ID NO: 86726 - RNA, 23 nt, Human
ugaggaaguaauuguaaaggucu

SEQ ID NO: 86727 - RNA, 22 nt, Human
ugaggaaugcugagcagaggaa

SEQ ID NO: 86728 - RNA, 22 nt, Human
ugaggacaaucccuaacucaga

SEQ ID NO: 86729 - RNA, 19 nt, Human
ugaggagcagcugguugau

SEQ ID NO: 86730 - RNA, 22 nt, Human
uggccagguguggguucucaga

SEQ ID NO: 86731 - RNA, 22 nt, Human
uggccagucuuagcugugccug

SEQ ID NO: 86732 - RNA, 22 nt, Human
uggccagugucggaggccagga

SEQ ID NO: 86733 - RNA, 22 nt, Human
uggccagugugugcugccggcu

SEQ ID NO: 86734 - RNA, 22 nt, Human
uggccaguguuggcuagggaca

SEQ ID NO: 86735 - RNA, 22 nt, Human
uggccaguugaagacaaugcuc

SEQ ID NO: 86736 - RNA, 22 nt, Human
uggcccaaagcagcccagcagg

SEQ ID NO: 86737 - RNA, 22 nt, Human
uggcccaagucugcuagaagag

SEQ ID NO: 86738 - RNA, 19 nt, Human
uggcccagaugguccuggg

SEQ ID NO: 86739 - RNA, 22 nt, Human
uggcccagcacuccaaguaggg

SEQ ID NO: 86740 - RNA, 22 nt, Human
uggcccaggaggccagagggca

SEQ ID NO: 86741 - RNA, 22 nt, Human
uggccccacagggccuuuucag

SEQ ID NO: 86742 - RNA, 22 nt, Human
uggccccaucaagggaugaguu

SEQ ID NO: 86743 - RNA, 22 nt, Human
uggccccccagagcuggaggac

SEQ ID NO: 86744 - RNA, 22 nt, Human
uggccccuggcacacggaggau

SEQ ID NO: 86745 - RNA, 22 nt, Human
uggcccucugcaagauucugga

SEQ ID NO: 86746 - RNA, 22 nt, Human
uggcccugaaggccuugagcau

SEQ ID NO: 86747 - RNA, 22 nt, Human
uggcccugaaucaaggccagca

SEQ ID NO: 86748 - RNA, 22 nt, Human
uggcccugaggggcugugcccc

SEQ ID NO: 86749 - RNA, 22 nt, Human
uggcccugcagaacuagccugg

SEQ ID NO: 86750 - RNA, 22 nt, Human
uggcccugccacucacugcuga

SEQ ID NO: 86751 - RNA, 22 nt, Human
uggcccugcccucuucaucuuu

SEQ ID NO: 86752 - RNA, 22 nt, Human
uggcccugccgcacuauccuca

SEQ ID NO: 86753 - RNA, 22 nt, Human
uggcccugcuggacacgccugc

SEQ ID NO: 86754 - RNA, 21 nt, Human
uggcccuggccacggcugcca

SEQ ID NO: 86755 - RNA, 22 nt, Human
uggcccuggguggaauguccca

SEQ ID NO: 86756 - RNA, 22 nt, Human
uggcccuuguucaaauauguca

SEQ ID NO: 86757 - RNA, 22 nt, Human
uggccucaaucuguccuccagc

SEQ ID NO: 86758 - RNA, 22 nt, Human
uggccucagauuauugcacagu

SEQ ID NO: 86759 - RNA, 22 nt, Human
uggccucucuaccaggcagccu

SEQ ID NO: 86760 - RNA, 22 nt, Human
uggccucugcacugggcucccc

SEQ ID NO: 86761 - RNA, 22 nt, Human
uggccucuggcugaggacuaac

SEQ ID NO: 86762 - RNA, 22 nt, Human
uggccucuuaaggaugacacaa

SEQ ID NO: 86763 - RNA, 22 nt, Human
uggccucuuaggacauccucua

SEQ ID NO: 86764 - RNA, 22 nt, Human
uggccugaguugucugcaggcc

SEQ ID NO: 86765 - RNA, 22 nt, Human
uggccugcaagcuaaaaaucua

SEQ ID NO: 86766 - RNA, 22 nt, Human
uggccugcagaggcuguggggc

SEQ ID NO: 86767 - RNA, 22 nt, Human
uggccugcagcucucagggaag

SEQ ID NO: 86768 - RNA, 22 nt, Human
uggccugccacugccacgccac

SEQ ID NO: 86769 - RNA, 22 nt, Human
uggccugcccagagcagcucug

SEQ ID NO: 86770 - RNA, 22 nt, Human
ugguacaauggcaucuaucuau

SEQ ID NO: 86771 - RNA, 22 nt, Human
ugguacaauuaaaauaauuuug

SEQ ID NO: 86772 - RNA, 17 nt, Human
ugguacaggcugaggga

SEQ ID NO: 86773 - RNA, 22 nt, Human
ugguacauggguagguaucucu

SEQ ID NO: 86774 - RNA, 22 nt, Human
ugguaccagcuguguguucacu

SEQ ID NO: 86775 - RNA, 22 nt, Human
ugguaccauguugcuuugauuu

SEQ ID NO: 86776 - RNA, 22 nt, Human
ugguagcaacaucucaguggcu

SEQ ID NO: 86777 - RNA, 22 nt, Human
ugguaggagggaaaugcggguu

SEQ ID NO: 86778 - RNA, 22 nt, Human
ugguauaaguaaucauaauugc

SEQ ID NO: 86779 - RNA, 22 nt, Human
ugguauaauacaguaaguguug

SEQ ID NO: 86780 - RNA, 22 nt, Human
ugguauaugcauggagguauca

SEQ ID NO: 86781 - RNA, 22 nt, Human
ugguaucaaacaauuaauuaga

SEQ ID NO: 86782 - RNA, 22 nt, Human
ugguaugaccguggugcaagca

SEQ ID NO: 86783 - RNA, 22 nt, Human
ugguauguaauaaguguucuaa

SEQ ID NO: 86784 - RNA, 22 nt, Human
ugguauuucagcuuuuguaucu

SEQ ID NO: 86785 - RNA, 22 nt, Human
ugguauuugucauucgaguucu

SEQ ID NO: 86786 - RNA, 22 nt, Human
uggucaaaaacucucaguggac

SEQ ID NO: 86787 - RNA, 22 nt, Human
uggucaaaaaggccuagacaca

SEQ ID NO: 86788 - RNA, 22 nt, Human
uggucaaaagaaagcucagaac

SEQ ID NO: 86789 - RNA, 22 nt, Human
uggucaaaagcuacuaugaaug

SEQ ID NO: 86790 - RNA, 22 nt, Human
uggucaaaugccaaucuguagu

SEQ ID NO: 86791 - RNA, 22 nt, Human
uggucaaauuuagucucuggaa

SEQ ID NO: 86792 - RNA, 22 nt, Human
uggucaagauuacacacuggug

SEQ ID NO: 86793 - RNA, 22 nt, Human
uggucagagaaguagggacaau

SEQ ID NO: 86794 - RNA, 22 nt, Human
uggucagcguuugucagagcag

SEQ ID NO: 86795 - RNA, 23 nt, Human
uggucagugccuugcauguggga

SEQ ID NO: 86796 - RNA, 22 nt, Human
uggucauguaguagagacagcu

SEQ ID NO: 86797 - RNA, 22 nt, Human
uggucauuuuuauuucaguugc

SEQ ID NO: 86798 - RNA, 22 nt, Human
ugguccagacauuucugaggua

SEQ ID NO: 86799 - RNA, 22 nt, Human
ugguccagaugccuuggcuuua

SEQ ID NO: 86800 - RNA, 20 nt, Human
ugguccaggaccuggugucc

SEQ ID NO: 86801 - RNA, 22 nt, Human
uggucccuagcacagcuguccu

SEQ ID NO: 86802 - RNA, 22 nt, Human
uggucccuaggaaagcaguguu

SEQ ID NO: 86803 - RNA, 22 nt, Human
uggucccugaucuaaugucuca

SEQ ID NO: 86804 - RNA, 22 nt, Human
uggucccuuucuacugagcaca

SEQ ID NO: 86805 - RNA, 20 nt, Human
ugguccucacagguccuccc

SEQ ID NO: 86806 - RNA, 22 nt, Human
ugguccugagcaccagccugac

SEQ ID NO: 86807 - RNA, 23 nt, Human
ugguccugccaacggugccccuc

SEQ ID NO: 86808 - RNA, 22 nt, Human
ugguccuggagaguguuccaua

SEQ ID NO: 86809 - RNA, 22 nt, Human
ugguccuggugcaagugcauuu

SEQ ID NO: 86810 - RNA, 23 nt, Human
ugguccugguugaggugggcccc

SEQ ID NO: 86811 - RNA, 20 nt, Human
ugguccugucccacccacuc

SEQ ID NO: 86812 - RNA, 22 nt, Human
ugguccuguguucuuccugccu

SEQ ID NO: 86813 - RNA, 22 nt, Human
ugguccuucguggugcaguucu

SEQ ID NO: 86814 - RNA, 22 nt, Human
ugguccuucucugccugcagug

SEQ ID NO: 86815 - RNA, 22 nt, Human
ugguccuucuugaagagugagu

SEQ ID NO: 86816 - RNA, 22 nt, Human
ugguccuuguaggcauuugagc

SEQ ID NO: 86817 - RNA, 22 nt, Human
uggucuaaauauggcucuaaau

SEQ ID NO: 86818 - RNA, 19 nt, Human
uggucuaaaugugugcccc

SEQ ID NO: 86819 - RNA, 22 nt, Human
uggucuaagagccuaacugcug

SEQ ID NO: 86820 - RNA, 23 nt, Human
uggucucagccugugagagcuga

SEQ ID NO: 86821 - RNA, 22 nt, Human
uggucucucuccugcaacaacu

SEQ ID NO: 86822 - RNA, 22 nt, Human
uggucucugagccuuccugugg

SEQ ID NO: 86823 - RNA, 22 nt, Human
uggucucugugcucgggcaugg

SEQ ID NO: 86824 - RNA, 22 nt, Human
uggucugaacuaagacaguagu

SEQ ID NO: 86825 - RNA, 22 nt, Human
uggucugacuacaauaggaaga

SEQ ID NO: 86826 - RNA, 22 nt, Human
uggucugacuugcuuuggacag

SEQ ID NO: 86827 - RNA, 23 nt, Human
uggucugacuuguagcugugaga

SEQ ID NO: 86828 - RNA, 22 nt, Human
uggucugauauuuuuucuuacc

SEQ ID NO: 86829 - RNA, 22 nt, Human
uggucugauuucuuucuggagu

SEQ ID NO: 86830 - RNA, 20 nt, Human
uggucuggagccagugagga

SEQ ID NO: 86831 - RNA, 22 nt, Human
uggucugguuauuucuuaauga

SEQ ID NO: 86832 - RNA, 22 nt, Human
uggucuuagcuggaaggaggga

SEQ ID NO: 86833 - RNA, 22 nt, Human
uggucuucuuuguugcuauuau

SEQ ID NO: 86834 - RNA, 22 nt, Human
uggucuuuaagguagcugucau

SEQ ID NO: 86835 - RNA, 22 nt, Human
uggugacacgaaguuugcuauc

SEQ ID NO: 86836 - RNA, 22 nt, Human
uggugagagcagaccuucuuuu

SEQ ID NO: 86837 - RNA, 22 nt, Human
uggugagaugcagcaacagaca

SEQ ID NO: 86838 - RNA, 22 nt, Human
uggugaggaagaccugcuccug

SEQ ID NO: 86839 - RNA, 22 nt, Human
uggggguguccuggugcacaca

SEQ ID NO: 86840 - RNA, 22 nt, Human
uggggucagcaggccuggccug

SEQ ID NO: 86841 - RNA, 22 nt, Human
uggggucccacucagcuccccu

SEQ ID NO: 86842 - RNA, 22 nt, Human
uggggugggcaugcgcuguccu

SEQ ID NO: 86843 - RNA, 22 nt, Human
ugggguggugggaaccaaguag

SEQ ID NO: 86844 - RNA, 22 nt, Human
uggguaaaaugaguuaggagaa

SEQ ID NO: 86845 - RNA, 22 nt, Human
uggguaaacaauguuugccuaa

SEQ ID NO: 86846 - RNA, 22 nt, Human
uggguagcagggcugagcugug

SEQ ID NO: 86847 - RNA, 22 nt, Human
uggguaggaccagaaaugcacu

SEQ ID NO: 86848 - RNA, 22 nt, Human
uggguaggccaggaagcagugu

SEQ ID NO: 86849 - RNA, 22 nt, Human
ugggucacaaaggccagaugau

SEQ ID NO: 86850 - RNA, 22 nt, Human
ugggucaccacuucagaggaga

SEQ ID NO: 86851 - RNA, 22 nt, Human
ugggucaggcugggaguccuga

SEQ ID NO: 86852 - RNA, 22 nt, Human
ugggucaguuugggggccagcc

SEQ ID NO: 86853 - RNA, 22 nt, Human
uggguccaguguccuggcuaug

SEQ ID NO: 86854 - RNA, 22 nt, Human
ugggucccucuggaguaguaca

SEQ ID NO: 86855 - RNA, 22 nt, Human
uggguccucugagagggcagcg

SEQ ID NO: 86856 - RNA, 20 nt, Human
uggguccugcacauucucca

SEQ ID NO: 86857 - RNA, 22 nt, Human
uggguccugcacugcaagcacc

SEQ ID NO: 86858 - RNA, 20 nt, Human
uggguccugcuucuuccuga

SEQ ID NO: 86859 - RNA, 22 nt, Human
uggguccuggaaggcgacaggu

SEQ ID NO: 86860 - RNA, 22 nt, Human
uggguccuggcuuugucagggu

SEQ ID NO: 86861 - RNA, 20 nt, Human
uggguccugugggagaagaa

SEQ ID NO: 86862 - RNA, 20 nt, Human
ugggucugcuuggcuucagu

SEQ ID NO: 86863 - RNA, 22 nt, Human
ugggucuguagggcuguccaau

SEQ ID NO: 86864 - RNA, 22 nt, Human
ugggugaaaauuuugguggcac

SEQ ID NO: 86865 - RNA, 22 nt, Human
ugggugaccccagaagaggauc

SEQ ID NO: 86866 - RNA, 22 nt, Human
ugggugaggaugaugaggcagc

SEQ ID NO: 86867 - RNA, 22 nt, Human
ugggugcaggucuugugccagg

SEQ ID NO: 86868 - RNA, 22 nt, Human
ugggugcaugugagcacgugca

SEQ ID NO: 86869 - RNA, 22 nt, Human
ugggugccaaccucugguggcc

SEQ ID NO: 86870 - RNA, 20 nt, Human
ugggugccugccacggggcc

SEQ ID NO: 86871 - RNA, 22 nt, Human
ugggugcucugcuucccugcac

SEQ ID NO: 86872 - RNA, 17 nt, Human
ugggugcugggaugagg

SEQ ID NO: 86873 - RNA, 22 nt, Human
uggguggcacuucuggggucca

SEQ ID NO: 86874 - RNA, 22 nt, Human
uggguggcagcuucagcauguu

SEQ ID NO: 86875 - RNA, 22 nt, Human
ugggugguuuaugaguggguuu

SEQ ID NO: 86876 - RNA, 22 nt, Human
uggguuaaaaguugaaugaauu

SEQ ID NO: 86877 - RNA, 22 nt, Human
uggguucccugacagcgaugcu

SEQ ID NO: 86878 - RNA, 22 nt, Human
uggguucuuaaagggcuagguu

SEQ ID NO: 86879 - RNA, 22 nt, Human
uggguucuuucacuucucaguu

SEQ ID NO: 86880 - RNA, 22 nt, Human
uggguuuaaacucaacucuaaa

SEQ ID NO: 86881 - RNA, 22 nt, Human
ugguaaaauauuacaaggcacu

SEQ ID NO: 86882 - RNA, 22 nt, Human
ugguaaagaaaugucagggcag

SEQ ID NO: 86883 - RNA, 22 nt, Human
ugguaaagaaggcuagaucuga

SEQ ID NO: 86884 - RNA, 19 nt, Human
ugguaaagacuguccccca

SEQ ID NO: 86885 - RNA, 20 nt, Human
ugguaaaggagggcuggagg

SEQ ID NO: 86886 - RNA, 22 nt, Human
ugguaaagugcucuaacuucau

SEQ ID NO: 86887 - RNA, 22 nt, Human
ugguaaaguguacugaauauga

SEQ ID NO: 86888 - RNA, 22 nt, Human
ugguaaauauguccauucucuu

SEQ ID NO: 86889 - RNA, 22 nt, Human
ugguaaaugucuaacaaucacu

SEQ ID NO: 86890 - RNA, 22 nt, Human
ugguaaauuauuuuuauauccc

SEQ ID NO: 86891 - RNA, 22 nt, Human
ugguaaggacuuaguuaucaau

SEQ ID NO: 86892 - RNA, 22 nt, Human
ugguaagguuccagaucuagaa

SEQ ID NO: 86893 - RNA, 22 nt, Human
ugguaagguucuacaguguuga

SEQ ID NO: 86894 - RNA, 22 nt, Human
ugguaauuauggauacuuaaau

SEQ ID NO: 86895 - RNA, 22 nt, Human
ugguaauugagaugucuuuucu

SEQ ID NO: 86896 - RNA, 22 nt, Human
ugguacaaaaguaauugcguga

SEQ ID NO: 86897 - RNA, 22 nt, Human
ugguacaacuguauuaggcaaa

SEQ ID NO: 86898 - RNA, 22 nt, Human
ugguacaagauguucuaacuga

SEQ ID NO: 86899 - RNA, 22 nt, Human
ugguacaaggguugggagacag

SEQ ID NO: 86900 - RNA, 22 nt, Human
ugguacauaaauggauguuuuc

SEQ ID NO: 86901 - RNA, 22 nt, Human
ugguaccaugacaaaugucagg

SEQ ID NO: 86902 - RNA, 22 nt, Human
ugguaccugaaugaagggagga

SEQ ID NO: 86903 - RNA, 22 nt, Human
ugguacugagaauagcgucuac

SEQ ID NO: 86904 - RNA, 22 nt, Human
ugguaggauagugacuuauaug

SEQ ID NO: 86905 - RNA, 22 nt, Human
ugguagugacucccccagggcu

SEQ ID NO: 86906 - RNA, 22 nt, Human
ugguauauuuugcucuauggug

SEQ ID NO: 86907 - RNA, 22 nt, Human
ugguaucagagccaucuguauu

SEQ ID NO: 86908 - RNA, 22 nt, Human
ugguaucguguuggcacucagu

SEQ ID NO: 86909 - RNA, 22 nt, Human
ugguauggucaaagccugugua

SEQ ID NO: 86910 - RNA, 22 nt, Human
ugguauguaaauuguaacucaa

SEQ ID NO: 86911 - RNA, 22 nt, Human
ugguauucuuucuguagaucau

SEQ ID NO: 86912 - RNA, 22 nt, Human
ugguauuuaauauaugagaguu

SEQ ID NO: 86913 - RNA, 22 nt, Human
uggucaaagaccaggaaaugcu

SEQ ID NO: 86914 - RNA, 22 nt, Human
uggucaaguuaagauaagguga

SEQ ID NO: 86915 - RNA, 22 nt, Human
uggucagaacucagcgugcuug

SEQ ID NO: 86916 - RNA, 22 nt, Human
uggucagaaggaagggcuccua

SEQ ID NO: 86917 - RNA, 22 nt, Human
uggucagaugcugaguggaucu

SEQ ID NO: 86918 - RNA, 22 nt, Human
uuaaggcugauaagucagauau

SEQ ID NO: 86919 - RNA, 22 nt, Human
uuaaggcuguggggauuacugc

SEQ ID NO: 86920 - RNA, 22 nt, Human
uuaagggccauuauggaugggu

SEQ ID NO: 86921 - RNA, 22 nt, Human
uuaagguagucagccucugugu

SEQ ID NO: 86922 - RNA, 17 nt, Human
uuaagguggaucagcac

SEQ ID NO: 86923 - RNA, 22 nt, Human
uuaaguaagaccuuaugucuug

SEQ ID NO: 86924 - RNA, 22 nt, Human
uuaaguacaggguuagugacgg

SEQ ID NO: 86925 - RNA, 22 nt, Human
uuaaguauauccauuugacugg

SEQ ID NO: 86926 - RNA, 22 nt, Human
uuaagucacuggacuugccuag

SEQ ID NO: 86927 - RNA, 22 nt, Human
uuaagucacuuaucuaaagaca

SEQ ID NO: 86928 - RNA, 22 nt, Human
uuaagucauuucugauuauaga

SEQ ID NO: 86929 - RNA, 22 nt, Human
uuaagugagcuugaauaaucuu

SEQ ID NO: 86930 - RNA, 22 nt, Human
uuaaguguagugcuaagggcag

SEQ ID NO: 86931 - RNA, 22 nt, Human
uuaagugucauaauuuccaaga

SEQ ID NO: 86932 - RNA, 22 nt, Human
uuaaguguuuaguaagagaugu

SEQ ID NO: 86933 - RNA, 22 nt, Human
uuaaguugugaauaauccaguc

SEQ ID NO: 86934 - RNA, 18 nt, Human
uuaaguuuuacugcuuua

SEQ ID NO: 86935 - RNA, 22 nt, Human
uuaauaaacaggugcagcugaa

SEQ ID NO: 86936 - RNA, 22 nt, Human
uuaauacaacuguugucacugg

SEQ ID NO: 86937 - RNA, 22 nt, Human
uuaauacaagcauaugcacaca

SEQ ID NO: 86938 - RNA, 22 nt, Human
uuaauacacuauaugaucacau

SEQ ID NO: 86939 - RNA, 22 nt, Human
uuaauagauuugauuuuaaagg

SEQ ID NO: 86940 - RNA, 22 nt, Human
uuaauagugcuaaaccauugac

SEQ ID NO: 86941 - RNA, 22 nt, Human
uuaauauguugaaauuuauuag

SEQ ID NO: 86942 - RNA, 22 nt, Human
uuaaucaaauuuacaacccagu

SEQ ID NO: 86943 - RNA, 22 nt, Human
uuaaucacagcucugccaugag

SEQ ID NO: 86944 - RNA, 22 nt, Human
uuaaugaaacauugacuaugau

SEQ ID NO: 86945 - RNA, 22 nt, Human
uuaaugaccuggaagaagugau

SEQ ID NO: 86946 - RNA, 22 nt, Human
uuaaugauuuggaacccuuuaa

SEQ ID NO: 86947 - RNA, 22 nt, Human
uuaaugcagaaaucaaacugac

SEQ ID NO: 86948 - RNA, 22 nt, Human
ugggcaggagagaagcuaaaga

SEQ ID NO: 86949 - RNA, 22 nt, Human
ugggcaggugcuauuuuccaug

SEQ ID NO: 86950 - RNA, 22 nt, Human
ugggcagucaucagcacaccgg

SEQ ID NO: 86951 - RNA, 22 nt, Human
ugggcaguugcuccucagaccc

SEQ ID NO: 86952 - RNA, 22 nt, Human
ugggcaucguucccuuggcuau

SEQ ID NO: 86953 - RNA, 22 nt, Human
ugggcaugaguggacagagaag

SEQ ID NO: 86954 - RNA, 22 nt, Human
ugggccaccugcuuuuuugcau

SEQ ID NO: 86955 - RNA, 22 nt, Human
ugggccagaaguaugcauguuu

SEQ ID NO: 86956 - RNA, 22 nt, Human
ugggccagauccauggcaauaa

SEQ ID NO: 86957 - RNA, 22 nt, Human
ugggccagcugaagugccgccc

SEQ ID NO: 86958 - RNA, 22 nt, Human
ugggccaggauuucaagacccu

SEQ ID NO: 86959 - RNA, 22 nt, Human
ugggcccaagagagucuccaac

SEQ ID NO: 86960 - RNA, 22 nt, Human
ugggcccaagugcaaugcagug

SEQ ID NO: 86961 - RNA, 22 nt, Human
ugggcccaucauugcugugggc

SEQ ID NO: 86962 - RNA, 22 nt, Human
ugggccccuugguuuccugagc

SEQ ID NO: 86963 - RNA, 21 nt, Human
ugggccucaaguggguggcag

SEQ ID NO: 86964 - RNA, 22 nt, Human
ugggccucaccuucuuggcagc

SEQ ID NO: 86965 - RNA, 21 nt, Human
ugggccucaggcagcugugac

SEQ ID NO: 86966 - RNA, 22 nt, Human
ugggccuccaauuccagcggga

SEQ ID NO: 86967 - RNA, 22 nt, Human
ugggccuccugcccuggccuag

SEQ ID NO: 86968 - RNA, 22 nt, Human
ugggccuccuuuccauucagag

SEQ ID NO: 86969 - RNA, 23 nt, Human
ugggccucuccacccuuuucugu

SEQ ID NO: 86970 - RNA, 22 nt, Human
ugggccucugccacgcuccccc

SEQ ID NO: 86971 - RNA, 20 nt, Human
ugggccucuggugccucugg

SEQ ID NO: 86972 - RNA, 20 nt, Human
ugggccugagccugugggcu

SEQ ID NO: 86973 - RNA, 22 nt, Human
ugggccugauuuaucaucuuca

SEQ ID NO: 86974 - RNA, 19 nt, Human
ugggccugcaucugggucu

SEQ ID NO: 86975 - RNA, 22 nt, Human
ugggccuggacaaggccacuag

SEQ ID NO: 86976 - RNA, 23 nt, Human
ugggccuggccucccaguccagc

SEQ ID NO: 86977 - RNA, 22 nt, Human
ugggccugggcuccuguccucu

SEQ ID NO: 86978 - RNA, 22 nt, Human
ugggccuggggcagcccaaauc

SEQ ID NO: 86979 - RNA, 22 nt, Human
ugggccugugaugcugggcuau

SEQ ID NO: 86980 - RNA, 22 nt, Human
ugggccuguggggaucuugaag

SEQ ID NO: 86981 - RNA, 22 nt, Human
ugggccuguugggguugaguua

SEQ ID NO: 86982 - RNA, 22 nt, Human
ugggcgaggcccagggcugcgu

SEQ ID NO: 86983 - RNA, 21 nt, Human
ugggcgcuugaccucugcacu

SEQ ID NO: 86984 - RNA, 22 nt, Human
ugggcgggcaggagcgcaccug

SEQ ID NO: 86985 - RNA, 22 nt, Human
ugggcuaauucuuugauuguuu

SEQ ID NO: 86986 - RNA, 22 nt, Human
ugggcuauuaggaccaggccau

SEQ ID NO: 86987 - RNA, 22 nt, Human
ugggcucaagugaugcuccugu

SEQ ID NO: 86988 - RNA, 22 nt, Human
ugggcucagccucagucugugg

SEQ ID NO: 86989 - RNA, 22 nt, Human
ugggcucagugggagaaagggc

SEQ ID NO: 86990 - RNA, 22 nt, Human
ugggcucauguuuauacauauc

SEQ ID NO: 86991 - RNA, 22 nt, Human
ugggcucauguuucuuugagga

SEQ ID NO: 86992 - RNA, 19 nt, Human
ugggcucauucaggugguu

SEQ ID NO: 86993 - RNA, 22 nt, Human
ugggcuccaauuuguccuuuca

SEQ ID NO: 86994 - RNA, 22 nt, Human
ugggcuccguugccuggggcag

SEQ ID NO: 86995 - RNA, 22 nt, Human
ugggcuccucgucacucgcugu

SEQ ID NO: 86996 - RNA, 22 nt, Human
ugggcuccuugggagcaaguga

SEQ ID NO: 86997 - RNA, 22 nt, Human
ugggcucucacacauguucuga

SEQ ID NO: 86998 - RNA, 22 nt, Human
ugggcucucucaccuggaggcu

SEQ ID NO: 86999 - RNA, 22 nt, Human
ugggcucucuuuaccucauaac

SEQ ID NO: 87000 - RNA, 22 nt, Human
ugggcucuggaauugaguggcc

SEQ ID NO: 87001 - RNA, 22 nt, Human
ugggcugcacugcucuuuaucg

SEQ ID NO: 87002 - RNA, 22 nt, Human
ugggcugcagagcccggccuuc

SEQ ID NO: 87003 - RNA, 22 nt, Human
ugggcugcccaagguggccaug

SEQ ID NO: 87004 - RNA, 22 nt, Human
ugggcugccggcaggcucugcc

SEQ ID NO: 87005 - RNA, 22 nt, Human
ugggcugcugcggugcucuugg

SEQ ID NO: 87006 - RNA, 22 nt, Human
ugggcuggcugaacuucaaccu

SEQ ID NO: 87007 - RNA, 22 nt, Human
ugggcuuccuggagccugugcu

SEQ ID NO: 87008 - RNA, 23 nt, Human
ugggcuucugagaaagcaccuaa

SEQ ID NO: 87009 - RNA, 22 nt, Human
ugggcuucugauguugagugcu

SEQ ID NO: 87010 - RNA, 22 nt, Human
ugggcuucuggaguggggcaga

SEQ ID NO: 87011 - RNA, 22 nt, Human
ugggcuuugagcucggucaccu

SEQ ID NO: 87012 - RNA, 22 nt, Human
uggggaaaagcguuaggaguuc

SEQ ID NO: 87013 - RNA, 22 nt, Human
uggggaaaaugcuuguagucag

SEQ ID NO: 87014 - RNA, 22 nt, Human
uggggaaacuauuuccuugucc

SEQ ID NO: 87015 - RNA, 22 nt, Human
uggggaagcacuuugaacuuaa

SEQ ID NO: 87016 - RNA, 17 nt, Human
uggggaagcucagauuu

SEQ ID NO: 87017 - RNA, 22 nt, Human
uggggacccggacuccuggguc

SEQ ID NO: 87018 - RNA, 22 nt, Human
uggggagaggaauuugaaugau

SEQ ID NO: 87019 - RNA, 23 nt, Human
uggggagaguuacccuggaagcg

SEQ ID NO: 87020 - RNA, 22 nt, Human
uggggaggaagucagauuucag

SEQ ID NO: 87021 - RNA, 22 nt, Human
uggggaucauaaauugauggag

SEQ ID NO: 87022 - RNA, 16 nt, Human
uggggauggggaagag

SEQ ID NO: 87023 - RNA, 22 nt, Human
uggggcacuuaugaugugccac

SEQ ID NO: 87024 - RNA, 22 nt, Human
uggggcagccacauagacaaca

SEQ ID NO: 87025 - RNA, 22 nt, Human
uggggcagggaugggaaacuau

SEQ ID NO: 87026 - RNA, 22 nt, Human
uggggcaugugaaccuggaugu

SEQ ID NO: 87027 - RNA, 22 nt, Human
uggggccaagaaggucucaugu

SEQ ID NO: 87028 - RNA, 23 nt, Human
uggggccaagugaggaagggucu

SEQ ID NO: 87029 - RNA, 22 nt, Human
uggggccugaaagguucucgcc

SEQ ID NO: 87030 - RNA, 22 nt, Human
uggggccugcacaggcugaaug

SEQ ID NO: 87031 - RNA, 22 nt, Human
uggggcuaaacacgccuggccu

SEQ ID NO: 87032 - RNA, 22 nt, Human
uggggcucaccuaggcuggaag

SEQ ID NO: 87033 - RNA, 22 nt, Human
uuacaugcagagggaagggaga

SEQ ID NO: 87034 - RNA, 22 nt, Human
uuacaugcaggucagacugcau

SEQ ID NO: 87035 - RNA, 22 nt, Human
uuacaugguaaacacucuuuua

SEQ ID NO: 87036 - RNA, 22 nt, Human
uuacauguacugguuugacuua

SEQ ID NO: 87037 - RNA, 22 nt, Human
uuacauguggugugaagaagag

SEQ ID NO: 87038 - RNA, 22 nt, Human
uuacauguuuaugugguacaug

SEQ ID NO: 87039 - RNA, 22 nt, Human
uuacauucaauuucuagaggua

SEQ ID NO: 87040 - RNA, 22 nt, Human
uuacauucccagugugcagcau

SEQ ID NO: 87041 - RNA, 22 nt, Human
uuacauucuuggaaucuuguuu

SEQ ID NO: 87042 - RNA, 22 nt, Human
uuacauuuggcuauguccucua

SEQ ID NO: 87043 - RNA, 22 nt, Human
uuacauuuugggguaaggauaa

SEQ ID NO: 87044 - RNA, 22 nt, Human
uuaccaaugugcuuuugcuaca

SEQ ID NO: 87045 - RNA, 22 nt, Human
uuaccagaugggggacuaugag

SEQ ID NO: 87046 - RNA, 22 nt, Human
uuaccauaaaguuuaucuuucu

SEQ ID NO: 87047 - RNA, 22 nt, Human
uuaccugagcggauuuguugca

SEQ ID NO: 87048 - RNA, 22 nt, Human
uuaccugcaacucccaugguga

SEQ ID NO: 87049 - RNA, 22 nt, Human
uuaccuguaaaacugcgauaua

SEQ ID NO: 87050 - RNA, 22 nt, Human
uuacuaaggacucuaaguucua

SEQ ID NO: 87051 - RNA, 23 nt, Human
uuacuacacaaguaacgauuccc

SEQ ID NO: 87052 - RNA, 18 nt, Human
uuacuacagcacuuucuu

SEQ ID NO: 87053 - RNA, 22 nt, Human
uuacuaggccaguuuucacuuu

SEQ ID NO: 87054 - RNA, 22 nt, Human
uuacuaguauaugucaagcaac

SEQ ID NO: 87055 - RNA, 22 nt, Human
uuacuaguggagaaacugaggc

SEQ ID NO: 87056 - RNA, 22 nt, Human
uuacuauaugcguggcaggugc

SEQ ID NO: 87057 - RNA, 22 nt, Human
uguacagacuguauuuacaagu

SEQ ID NO: 87058 - RNA, 22 nt, Human
uguacagauaucaggagugagg

SEQ ID NO: 87059 - RNA, 22 nt, Human
uguacaggaggccacauuggaa

SEQ ID NO: 87060 - RNA, 22 nt, Human
uguacagggugcagcgagcgga

SEQ ID NO: 87061 - RNA, 22 nt, Human
uguacaguacauguguagugau

SEQ ID NO: 87062 - RNA, 22 nt, Human
uguacagugccaugcaguuugc

SEQ ID NO: 87063 - RNA, 22 nt, Human
uguacauagaucuugaaaauua

SEQ ID NO: 87064 - RNA, 22 nt, Human
uguacaugugucuguauaucuu

SEQ ID NO: 87065 - RNA, 22 nt, Human
uguaccaagacaaaucagaaac

SEQ ID NO: 87066 - RNA, 22 nt, Human
uguaccagaugucuaaagccau

SEQ ID NO: 87067 - RNA, 22 nt, Human
uguaccauaauguguauuuuaa

SEQ ID NO: 87068 - RNA, 22 nt, Human
uguaccuggagagcucuuggcc

SEQ ID NO: 87069 - RNA, 19 nt, Human
uguaccugggucauggugc

SEQ ID NO: 87070 - RNA, 22 nt, Human
uguacuguauucaucuuuaacu

SEQ ID NO: 87071 - RNA, 22 nt, Human
uguacuugaacuugacuguaga

SEQ ID NO: 87072 - RNA, 22 nt, Human
uguagaaccuguuuauuauaga

SEQ ID NO: 87073 - RNA, 22 nt, Human
uguagaggaggaaacugaggcu

SEQ ID NO: 87074 - RNA, 22 nt, Human
uguagaugagucagggugcacc

SEQ ID NO: 87075 - RNA, 22 nt, Human
uguagaugagucagggugcaug

SEQ ID NO: 87076 - RNA, 19 nt, Human
uguagcuagugucuaucca

SEQ ID NO: 87077 - RNA, 22 nt, Human
uguagcuauagaggcuguaccu

SEQ ID NO: 87078 - RNA, 18 nt, Human
uguagcuggaggccaggc

SEQ ID NO: 87079 - RNA, 22 nt, Human
uguagcuucagucugaucucau

SEQ ID NO: 87080 - RNA, 22 nt, Human
uguagcuuuauauuguguuggg

SEQ ID NO: 87081 - RNA, 22 nt, Human
uguaggaaaaacaaugaucugc

SEQ ID NO: 87082 - RNA, 20 nt, Human
uguaggaaggacccugucug

SEQ ID NO: 87083 - RNA, 22 nt, Human
uguaggaauggauucuagaagg

SEQ ID NO: 87084 - RNA, 22 nt, Human
uguaggacauguacuuguaaca

SEQ ID NO: 87085 - RNA, 22 nt, Human
uguaggaguccaaucaggagac

SEQ ID NO: 87086 - RNA, 22 nt, Human
uguaggauuuucaccagaccuu

SEQ ID NO: 87087 - RNA, 22 nt, Human
uguaggcacauguauauauccc

SEQ ID NO: 87088 - RNA, 22 nt, Human
uguaggcauauucauagaguug

SEQ ID NO: 87089 - RNA, 23 nt, Human
uguaggcuaagucccauaaauca

SEQ ID NO: 87090 - RNA, 22 nt, Human
uguaggucacagucccuauccc

SEQ ID NO: 87091 - RNA, 22 nt, Human
uguaggucucagugucugagcu

SEQ ID NO: 87092 - RNA, 22 nt, Human
uguaguaagugcgcaauaaaua

SEQ ID NO: 87093 - RNA, 22 nt, Human
uguaguguuucucagauauuug

SEQ ID NO: 87094 - RNA, 22 nt, Human
uguauaaaccauggacagcuuu

SEQ ID NO: 87095 - RNA, 22 nt, Human
uguauaaauuuaaauuccugcu

SEQ ID NO: 87096 - RNA, 22 nt, Human
uguauacaaauuggaaucagau

SEQ ID NO: 87097 - RNA, 22 nt, Human
uguauacaagucguguaaacuu

SEQ ID NO: 87098 - RNA, 21 nt, Human
uguauacacacauauauguac

SEQ ID NO: 87099 - RNA, 22 nt, Human
uguauacacguaccuuuucuuu

SEQ ID NO: 87100 - RNA, 22 nt, Human
uguauacacuaugcuauauggu

SEQ ID NO: 87101 - RNA, 22 nt, Human
uguauacauguguguucacgca

SEQ ID NO: 87102 - RNA, 22 nt, Human
uguauacauguguucaugcaug

SEQ ID NO: 87103 - RNA, 22 nt, Human
uguauacauuuaacuagauaga

SEQ ID NO: 87104 - RNA, 22 nt, Human
uguauaguuucuuaguuacuga

SEQ ID NO: 87105 - RNA, 22 nt, Human
uguauauaagcauuuacuuguu

SEQ ID NO: 87106 - RNA, 22 nt, Human
uguauaugcacuuuccuuaucc

SEQ ID NO: 87107 - RNA, 22 nt, Human
uguauaugugauguacauguac

SEQ ID NO: 87108 - RNA, 22 nt, Human
uguauauucugccuaaaagcuu

SEQ ID NO: 87109 - RNA, 22 nt, Human
uguauauuguucugucucuuca

SEQ ID NO: 87110 - RNA, 22 nt, Human
uguaucaaaccaaauuaauucu

SEQ ID NO: 87111 - RNA, 22 nt, Human
uguaucuuagugugaaaauauu

SEQ ID NO: 87112 - RNA, 22 nt, Human
uguaugaaagaacaagggcuua

SEQ ID NO: 87113 - RNA, 23 nt, Human
uguaugaauaugccacaguuuaa

SEQ ID NO: 87114 - RNA, 22 nt, Human
uguaugaauauguauuuucaua

SEQ ID NO: 87115 - RNA, 22 nt, Human
uguaugaaugggaaaaggaaac

SEQ ID NO: 87116 - RNA, 22 nt, Human
uguaugaggcauacaucaggca

SEQ ID NO: 87117 - RNA, 22 nt, Human
uguaugcaaauuuauuagcaca

SEQ ID NO: 87118 - RNA, 22 nt, Human
uguaugcacauauauagguaca

SEQ ID NO: 87119 - RNA, 22 nt, Human
uguaugcaccauuguauuaccu

SEQ ID NO: 87120 - RNA, 22 nt, Human
uguaugcagcaaaacaauuagu

SEQ ID NO: 87121 - RNA, 17 nt, Human
uguaugcauaaaauuua

SEQ ID NO: 87122 - RNA, 17 nt, Human
uguaugcauaugcuuuu

SEQ ID NO: 87123 - RNA, 22 nt, Human
uguaugcuugaguguguauacu

SEQ ID NO: 87124 - RNA, 22 nt, Human
uguaugcuuugguuguuucucu

SEQ ID NO: 87125 - RNA, 22 nt, Human
uguauguaaaguuuguaauaga

SEQ ID NO: 87126 - RNA, 22 nt, Human
uguauguauguauguauuuggg

SEQ ID NO: 87127 - RNA, 22 nt, Human
uguauguggcuacuuuucuugc

SEQ ID NO: 87128 - RNA, 22 nt, Human
uguauguguauguacauaugca

SEQ ID NO: 87129 - RNA, 22 nt, Human
uguauguguccuaauucaagca

SEQ ID NO: 87130 - RNA, 22 nt, Human
uguauguuucuaaaugauugcu

SEQ ID NO: 87131 - RNA, 22 nt, Human
uguauuagagcauauaauuuga

SEQ ID NO: 87132 - RNA, 22 nt, Human
uguauuaggagauuccauguuu

SEQ ID NO: 87133 - RNA, 22 nt, Human
uguauucagugauuucacaaua

SEQ ID NO: 87134 - RNA, 22 nt, Human
uguauucuaaauacaucuuacc

SEQ ID NO: 87135 - RNA, 22 nt, Human
uguauugaggauucauuuuugu

SEQ ID NO: 87136 - RNA, 22 nt, Human
uguauuuaagcuuuaccuaaaa

SEQ ID NO: 87137 - RNA, 22 nt, Human
uguauuuaguccagucucucau

SEQ ID NO: 87138 - RNA, 22 nt, Human
uguauuuauauuagaaugguug

SEQ ID NO: 87139 - RNA, 22 nt, Human
uguauuucaauuuuagcaccaa

SEQ ID NO: 87140 - RNA, 20 nt, Human
uguauuucaugcauuccugg

SEQ ID NO: 87141 - RNA, 22 nt, Human
uguauuucugcuuucucuagua

SEQ ID NO: 87142 - RNA, 22 nt, Human
uguauuugaguuaugaaagaga

SEQ ID NO: 87143 - RNA, 22 nt, Human
uguauuugguguauuuaaugag

SEQ ID NO: 87144 - RNA, 22 nt, Human
uguauuugugauaacgaccuga

SEQ ID NO: 87145 - RNA, 22 nt, Human
uguauuuguuguuaaauggaga

SEQ ID NO: 87146 - RNA, 22 nt, Human
uguauuuuuaggaaugcgcuau

SEQ ID NO: 87147 - RNA, 22 nt, Human
ugucaaaaauaagagagauugu

SEQ ID NO: 87148 - RNA, 22 nt, Human
ugucaaagcaaggauuaaaugu

SEQ ID NO: 87149 - RNA, 22 nt, Human
ugucaaauaguagaaagauggc

SEQ ID NO: 87150 - RNA, 22 nt, Human
ugucaacaacagcauuuucuau

SEQ ID NO: 87151 - RNA, 22 nt, Human
ugucaacacaccuaucucaauu

SEQ ID NO: 87152 - RNA, 22 nt, Human
ugucaacaccaaagccucccag

SEQ ID NO: 87153 - RNA, 22 nt, Human
ugucaacagauacuagagagcu

SEQ ID NO: 87154 - RNA, 22 nt, Human
ugucaacagaucucaaagcugg

SEQ ID NO: 87155 - RNA, 22 nt, Human
ugucaacauuuaucaaguuauu

SEQ ID NO: 87156 - RNA, 23 nt, Human
ugucaaguauagcaggcccuccc

SEQ ID NO: 87157 - RNA, 22 nt, Human
ugucaauaguuuugaguucucu

SEQ ID NO: 87158 - RNA, 22 nt, Human
ugucaaugaagucauccuugug

SEQ ID NO: 87159 - RNA, 22 nt, Human
ugucacaaaaaucaguaauugc

SEQ ID NO: 87160 - RNA, 22 nt, Human
ugucacaaggccaugaaaagaa

SEQ ID NO: 87161 - RNA, 22 nt, Human
ugucacagagcaacuauuucuu

SEQ ID NO: 87162 - RNA, 21 nt, Human
ugucacagauucucagcuugc

SEQ ID NO: 87163 - RNA, 22 nt, Human
ugucacagugcacagcuaagaa

SEQ ID NO: 87164 - RNA, 22 nt, Human
ugucacauaggcaaaauguuuu

SEQ ID NO: 87165 - RNA, 22 nt, Human
ugucacauguuuaauguggacu

SEQ ID NO: 87166 - RNA, 17 nt, Human
uuauugcagugcugaag

SEQ ID NO: 87167 - RNA, 22 nt, Human
uuauugcauagauuaugccaua

SEQ ID NO: 87168 - RNA, 22 nt, Human
uuauugccugauugaggucauu

SEQ ID NO: 87169 - RNA, 22 nt, Human
uuauugcuagugucauuucaca

SEQ ID NO: 87170 - RNA, 22 nt, Human
uuauugcuaugaugauguguag

SEQ ID NO: 87171 - RNA, 22 nt, Human
uuauugggucccaacaaguugc

SEQ ID NO: 87172 - RNA, 17 nt, Human
uuauugucaagguucca

SEQ ID NO: 87173 - RNA, 22 nt, Human
uuauugugucuugguuuaucuu

SEQ ID NO: 87174 - RNA, 22 nt, Human
uuauuguuagugagacuguaga

SEQ ID NO: 87175 - RNA, 22 nt, Human
uuauuguuuaaagccauguaaa

SEQ ID NO: 87176 - RNA, 22 nt, Human
uuauuguuuacuaguuugcaga

SEQ ID NO: 87177 - RNA, 22 nt, Human
uuauuguuuggguauaauuuga

SEQ ID NO: 87178 - RNA, 22 nt, Human
uuauuuaaaauguagguuggga

SEQ ID NO: 87179 - RNA, 22 nt, Human
uuauuuauggcacuguuggugg

SEQ ID NO: 87180 - RNA, 22 nt, Human
uuauuucauguaaaauuuaugu

SEQ ID NO: 87181 - RNA, 22 nt, Human
uuauuucccugaggguugcagg

SEQ ID NO: 87182 - RNA, 22 nt, Human
uuauuugaaucuggcuagagaa

SEQ ID NO: 87183 - RNA, 22 nt, Human
uuauuugauuaguaaaccugua

SEQ ID NO: 87184 - RNA, 22 nt, Human
uuauuuggauuuagcuuaucaa

SEQ ID NO: 87185 - RNA, 22 nt, Human
uuauuuguaaagguccauagua

SEQ ID NO: 87186 - RNA, 22 nt, Human
uuauuuguaaggcagggccagu

SEQ ID NO: 87187 - RNA, 22 nt, Human
uuauuuugagagaaugugugcu

SEQ ID NO: 87188 - RNA, 22 nt, Human
uuauuuugccacaggugaccuu

SEQ ID NO: 87189 - RNA, 22 nt, Human
uucaaaagacucagauguagcg

SEQ ID NO: 87190 - RNA, 22 nt, Human
uucaaaagcgguccaggaagau

SEQ ID NO: 87191 - RNA, 22 nt, Human
uucaaaauccgggaggcgcccc

SEQ ID NO: 87192 - RNA, 22 nt, Human
uucaaaaugcacaaagggcuag

SEQ ID NO: 87193 - RNA, 22 nt, Human
uucaaacaaaacucuuuccuau

SEQ ID NO: 87194 - RNA, 22 nt, Human
uucaaacaguugcacaacuuau

SEQ ID NO: 87195 - RNA, 22 nt, Human
uucaaacucuugcucugcuagu

SEQ ID NO: 87196 - RNA, 21 nt, Human
uucaaagagugggcauuguca

SEQ ID NO: 87197 - RNA, 23 nt, Human
uucaaagaucuucugaaaucugu

SEQ ID NO: 87198 - RNA, 22 nt, Human
uucaaagauuagcauacgcaau

SEQ ID NO: 87199 - RNA, 22 nt, Human
uucaaagauuuucccaaagcuc

SEQ ID NO: 87200 - RNA, 23 nt, Human
uucaaagcuuaagcucuuuccac

SEQ ID NO: 87201 - RNA, 17 nt, Human
uucaaagcuuaucaagg

SEQ ID NO: 87202 - RNA, 22 nt, Human
uucaaaguaaaaauguguucac

SEQ ID NO: 87203 - RNA, 22 nt, Human
uucaaagugcauguuccucaga

SEQ ID NO: 87204 - RNA, 22 nt, Human
uucaaauacauucuuugccacu

SEQ ID NO: 87205 - RNA, 22 nt, Human
uucaaaucccugcuccacuauu

SEQ ID NO: 87206 - RNA, 22 nt, Human
uucaaauccugcuuaugcuacc

SEQ ID NO: 87207 - RNA, 22 nt, Human
uucaaaugauggcaguccuggc

SEQ ID NO: 87208 - RNA, 22 nt, Human
uucaaaugguuagacuguuagc

SEQ ID NO: 87209 - RNA, 22 nt, Human
uucaacaaauauuuauugagcu

SEQ ID NO: 87210 - RNA, 22 nt, Human
uucaacaaugaaagcuaaggaa

SEQ ID NO: 87211 - RNA, 22 nt, Human
uucaacagcuuccaaagugugu

SEQ ID NO: 87212 - RNA, 22 nt, Human
uucaacaucuuggagcuggaac

SEQ ID NO: 87213 - RNA, 22 nt, Human
uucaacauuuaucaguuuauca

SEQ ID NO: 87214 - RNA, 22 nt, Human
uucaacccaaguucuccauuuu

SEQ ID NO: 87215 - RNA, 22 nt, Human
uucaacuagaggugauuuugcc

SEQ ID NO: 87216 - RNA, 22 nt, Human
uucaacuuuaggcaaagaaaac

SEQ ID NO: 87217 - RNA, 22 nt, Human
uucaagaaucuuccugaccacu

SEQ ID NO: 87218 - RNA, 22 nt, Human
uucaagauaauaggaaugaaaa

SEQ ID NO: 87219 - RNA, 22 nt, Human
uucaagaugacccagucacacg

SEQ ID NO: 87220 - RNA, 22 nt, Human
uucaagaugccagggacgcggc

SEQ ID NO: 87221 - RNA, 22 nt, Human
uucaagauggcugcaaauacuu

SEQ ID NO: 87222 - RNA, 22 nt, Human
uucaagaugucuucacaauagu

SEQ ID NO: 87223 - RNA, 22 nt, Human
uucaagcagggauuggugaugg

SEQ ID NO: 87224 - RNA, 22 nt, Human
uucaaguagcuaaauuagcugc

SEQ ID NO: 87225 - RNA, 22 nt, Human
uucaaguauauuuaacaucgua

SEQ ID NO: 87226 - RNA, 22 nt, Human
uucaagucaaggaaagaggucu

SEQ ID NO: 87227 - RNA, 21 nt, Human
uucaagucucuaggacuucuc

SEQ ID NO: 87228 - RNA, 22 nt, Human
uucaagucuguuucauugcaug

SEQ ID NO: 87229 - RNA, 22 nt, Human
uucaagugaggcugucuuuaga

SEQ ID NO: 87230 - RNA, 22 nt, Human
uucaaguuagagauauauuuag

SEQ ID NO: 87231 - RNA, 22 nt, Human
uucaaguucuaguguucacuuc

SEQ ID NO: 87232 - RNA, 20 nt, Human
uucaaguugggucucuggcu

SEQ ID NO: 87233 - RNA, 22 nt, Human
uucaaguuuucagaauagccac

SEQ ID NO: 87234 - RNA, 22 nt, Human
uucaaguuuuuaaaggcaguua

SEQ ID NO: 87235 - RNA, 21 nt, Human
uucaauacuauuucaauaguc

SEQ ID NO: 87236 - RNA, 22 nt, Human
uucaaucauuagaaucucaggc

SEQ ID NO: 87237 - RNA, 22 nt, Human
uucaaucauuuuuacauagucc

SEQ ID NO: 87238 - RNA, 22 nt, Human
uucaaugcauauagauauagaa

SEQ ID NO: 87239 - RNA, 22 nt, Human
uucaaugccuagaacuuagcau

SEQ ID NO: 87240 - RNA, 22 nt, Human
uucaaugucuauguacauuuua

SEQ ID NO: 87241 - RNA, 22 nt, Human
uucaauguuucuuaucaaguug

SEQ ID NO: 87242 - RNA, 22 nt, Human
uucaauuuagugauguuguugg

SEQ ID NO: 87243 - RNA, 22 nt, Human
uucaauuuugcagaggaaugca

SEQ ID NO: 87244 - RNA, 22 nt, Human
uucacaaaaaugcugaacaguu

SEQ ID NO: 87245 - RNA, 22 nt, Human
uucacaaacaccagaauggcua

SEQ ID NO: 87246 - RNA, 22 nt, Human
uucacaaagcugguuccuucug

SEQ ID NO: 87247 - RNA, 22 nt, Human
uucacaacugccauagccagug

SEQ ID NO: 87248 - RNA, 19 nt, Human
uucacaagugaugucucuc

SEQ ID NO: 87249 - RNA, 22 nt, Human
uucacaauagcuggcaucaucu

SEQ ID NO: 87250 - RNA, 22 nt, Human
uucacaauaggagcaugcaaau

SEQ ID NO: 87251 - RNA, 22 nt, Human
uucacacagcaacuguaugaau

SEQ ID NO: 87252 - RNA, 22 nt, Human
uucacagaagaggucacauuuc

SEQ ID NO: 87253 - RNA, 22 nt, Human
uucacagaauugucuugacugg

SEQ ID NO: 87254 - RNA, 22 nt, Human
uucacagacauugcagacugaa

SEQ ID NO: 87255 - RNA, 22 nt, Human
uucacagacuuuccauagauug

SEQ ID NO: 87256 - RNA, 22 nt, Human
uucacagagaguaugcagagaa

SEQ ID NO: 87257 - RNA, 22 nt, Human
uucacagagcacugccaaguac

SEQ ID NO: 87258 - RNA, 22 nt, Human
uucacagagcuuguucauggcc

SEQ ID NO: 87259 - RNA, 18 nt, Human
uucacagauccacaggaa

SEQ ID NO: 87260 - RNA, 22 nt, Human
uucacagaugagaaaauugagg

SEQ ID NO: 87261 - RNA, 21 nt, Human
uucacagaugggaaaacugag

SEQ ID NO: 87262 - RNA, 22 nt, Human
uucacagauguauuggaacucc

SEQ ID NO: 87263 - RNA, 22 nt, Human
uucacagauugacuggauuccu

SEQ ID NO: 87264 - RNA, 22 nt, Human
uucacagcuaagagcuaaguaa

SEQ ID NO: 87265 - RNA, 22 nt, Human
ugucuaguuuuagcuuuuggag

SEQ ID NO: 87266 - RNA, 22 nt, Human
ugucuauucaauauccauuucu

SEQ ID NO: 87267 - RNA, 21 nt, Human
ugucucaagaaaggccucucc

SEQ ID NO: 87268 - RNA, 22 nt, Human
ugucucaagguuacucuaugau

SEQ ID NO: 87269 - RNA, 22 nt, Human
ugucucagguacaugcguccug

SEQ ID NO: 87270 - RNA, 22 nt, Human
ugucuccaacucacuguauacu

SEQ ID NO: 87271 - RNA, 22 nt, Human
ugucuccaggggcaggccagcc

SEQ ID NO: 87272 - RNA, 22 nt, Human
ugucuccauuuucaaguagcag

SEQ ID NO: 87273 - RNA, 19 nt, Human
ugucuccucaugcaagugu

SEQ ID NO: 87274 - RNA, 22 nt, Human
ugucuccugcaggggugugggc

SEQ ID NO: 87275 - RNA, 22 nt, Human
uuccucagcuguuugggcucau

SEQ ID NO: 87276 - RNA, 22 nt, Human
uuccucaggcugcuuucacaua

SEQ ID NO: 87277 - RNA, 22 nt, Human
uuccucagugcccccauacggu

SEQ ID NO: 87278 - RNA, 22 nt, Human
uuccuccuacgcuuaucacuuu

SEQ ID NO: 87279 - RNA, 22 nt, Human
uuccucuccucacaugagucac

SEQ ID NO: 87280 - RNA, 22 nt, Human
uuccucuggggccaggccaaca

SEQ ID NO: 87281 - RNA, 22 nt, Human
uuccugaagucaaagaucuaaa

SEQ ID NO: 87282 - RNA, 22 nt, Human
uuccugaggugauucuaaugug

SEQ ID NO: 87283 - RNA, 22 nt, Human
uuccugauaaugagauuuuccc

SEQ ID NO: 87284 - RNA, 22 nt, Human
uuccugcaaaacuacuaguagc

SEQ ID NO: 87285 - RNA, 22 nt, Human
uuccugccccugagagcuccca

SEQ ID NO: 87286 - RNA, 22 nt, Human
uuccugcccugccugugccacu

SEQ ID NO: 87287 - RNA, 22 nt, Human
uuccuggcacacuccugaaugu

SEQ ID NO: 87288 - RNA, 22 nt, Human
uuccuggcaccaccacuucuag

SEQ ID NO: 87289 - RNA, 22 nt, Human
uuccuggcacccuuguuagccu

SEQ ID NO: 87290 - RNA, 22 nt, Human
uuccuggcagaggccccgacag

SEQ ID NO: 87291 - RNA, 22 nt, Human
uuccuggccucucucugagcag

SEQ ID NO: 87292 - RNA, 22 nt, Human
uuccuggcgccacggagccggu

SEQ ID NO: 87293 - RNA, 20 nt, Human
uuccuggcucuaggaccuug

SEQ ID NO: 87294 - RNA, 22 nt, Human
uuccuggcucucuguugcacag

SEQ ID NO: 87295 - RNA, 22 nt, Human
uuccuggcuggcgguuuuggug

SEQ ID NO: 87296 - RNA, 22 nt, Human
uuccuggcuugucacaucuacg

SEQ ID NO: 87297 - RNA, 22 nt, Human
uuccuggcuuuugggcuaauuc

SEQ ID NO: 87298 - RNA, 22 nt, Human
uuccugggcaggacgagagucu

SEQ ID NO: 87299 - RNA, 22 nt, Human
uuccugggcucuggcuggccua

SEQ ID NO: 87300 - RNA, 22 nt, Human
uuccugggcuuuccccucuggu

SEQ ID NO: 87301 - RNA, 21 nt, Human
uuccuggggaaggagcugccu

SEQ ID NO: 87302 - RNA, 22 nt, Human
uuccuggggacuuaccgucauu

SEQ ID NO: 87303 - RNA, 22 nt, Human
uuccuggggcuuagcaauggag

SEQ ID NO: 87304 - RNA, 22 nt, Human
uuccuggggugaagauauuuuu

SEQ ID NO: 87305 - RNA, 22 nt, Human
uuccuggguucccucucauucu

SEQ ID NO: 87306 - RNA, 22 nt, Human
uuccuggucugugccauucaga

SEQ ID NO: 87307 - RNA, 22 nt, Human
uuccugguuggauucugauuaa

SEQ ID NO: 87308 - RNA, 22 nt, Human
uuccugguuuauaccuguauca

SEQ ID NO: 87309 - RNA, 20 nt, Human
uuccuguaaccggcagcugc

SEQ ID NO: 87310 - RNA, 22 nt, Human
uuccuguaucugcuucuuacua

SEQ ID NO: 87311 - RNA, 22 nt, Human
uuccuguaugucagugaagagc

SEQ ID NO: 87312 - RNA, 22 nt, Human
uuccugugaagaucugggugcu

SEQ ID NO: 87313 - RNA, 22 nt, Human
uuccugugccucaggucucagc

SEQ ID NO: 87314 - RNA, 22 nt, Human
uuccugugcuuaauucucacug

SEQ ID NO: 87315 - RNA, 22 nt, Human
uuccugugcuuauucuucucug

SEQ ID NO: 87316 - RNA, 22 nt, Human
uuccugugguguuucccagaca

SEQ ID NO: 87317 - RNA, 22 nt, Human
uuccugugucccgggcacccug

SEQ ID NO: 87318 - RNA, 22 nt, Human
uuccugugugcucucauuuagu

SEQ ID NO: 87319 - RNA, 22 nt, Human
uuccuguucaggaaaguugugu

SEQ ID NO: 87320 - RNA, 22 nt, Human
uuccuuaauaucccuuuuggaa

SEQ ID NO: 87321 - RNA, 22 nt, Human
uuccuuacauucauauggcuuc

SEQ ID NO: 87322 - RNA, 22 nt, Human
uuccuuagacagagguggucau

SEQ ID NO: 87323 - RNA, 22 nt, Human
uuccuuagauccuucaaucacg

SEQ ID NO: 87324 - RNA, 22 nt, Human
uuccuuagcagaccugguaucc

SEQ ID NO: 87325 - RNA, 22 nt, Human
uuccuuagcugucccuggaaau

SEQ ID NO: 87326 - RNA, 19 nt, Human
uguuuucaagugggauuau

SEQ ID NO: 87327 - RNA, 22 nt, Human
uguuuucacaaugaugucagau

SEQ ID NO: 87328 - RNA, 22 nt, Human
uguuuucauggagaugguggcg

SEQ ID NO: 87329 - RNA, 22 nt, Human
uguuuucauuugauguaacaaa

SEQ ID NO: 87330 - RNA, 22 nt, Human
uguuuucugauucucguguggu

SEQ ID NO: 87331 - RNA, 22 nt, Human
uguuuucuuccuaauugcucau

SEQ ID NO: 87332 - RNA, 22 nt, Human
uguuuuggaacaaaagcuauuc

SEQ ID NO: 87333 - RNA, 22 nt, Human
uguuuuguccuuuucuauauac

SEQ ID NO: 87334 - RNA, 22 nt, Human
uguuuuguuagcacucugggaa

SEQ ID NO: 87335 - RNA, 17 nt, Human
uguuuuuucccuguucu

SEQ ID NO: 87336 - RNA, 22 nt, Human
uuaaaaauauguagggcccgau

SEQ ID NO: 87337 - RNA, 22 nt, Human
uuaaaagucugaugauuuacau

SEQ ID NO: 87338 - RNA, 22 nt, Human
uuaaaauagccagugccccucu

SEQ ID NO: 87339 - RNA, 22 nt, Human
uuaaaauccaguguugguggau

SEQ ID NO: 87340 - RNA, 22 nt, Human
uuaaaaucuaaagcaguugucu

SEQ ID NO: 87341 - RNA, 22 nt, Human
uuaaaauguacaggggaaagug

SEQ ID NO: 87342 - RNA, 23 nt, Human
uuaaaauguggucucucccuagu

SEQ ID NO: 87343 - RNA, 22 nt, Human
uuaaacaccacagcagucccua

SEQ ID NO: 87344 - RNA, 22 nt, Human
uuaaacagguuuuugaauggcc

SEQ ID NO: 87345 - RNA, 22 nt, Human
uuaaaccauaguuuaacauaag

SEQ ID NO: 87346 - RNA, 22 nt, Human
uuaaacuauagcuugaugugaa

SEQ ID NO: 87347 - RNA, 22 nt, Human
uuaaacugcagacucaguguuc

SEQ ID NO: 87348 - RNA, 22 nt, Human
uuaaagaauagugccccuauug

SEQ ID NO: 87349 - RNA, 22 nt, Human
uuaaagaggcaugggaauguau

SEQ ID NO: 87350 - RNA, 22 nt, Human
uuaaagagguaguuagguuuaa

SEQ ID NO: 87351 - RNA, 22 nt, Human
uuaaagaugcagcuuuagagaa

SEQ ID NO: 87352 - RNA, 22 nt, Human
uuaaagauucugaggcugauua

SEQ ID NO: 87353 - RNA, 22 nt, Human
uuaaagcaaaaacuaggaugga

SEQ ID NO: 87354 - RNA, 22 nt, Human
uuaaagcaaguagaagccugag

SEQ ID NO: 87355 - RNA, 22 nt, Human
uuaaagcaucacacuauuaauu

SEQ ID NO: 87356 - RNA, 22 nt, Human
uuaaagcauccugucagucugu

SEQ ID NO: 87357 - RNA, 22 nt, Human
uuaaagccaucuagauuuugag

SEQ ID NO: 87358 - RNA, 21 nt, Human
uuaaagcuaugguagugggcu

SEQ ID NO: 87359 - RNA, 17 nt, Human
uuaaaggaugcucucuc

SEQ ID NO: 87360 - RNA, 22 nt, Human
uuaaaguaaucugugugaauuu

SEQ ID NO: 87361 - RNA, 22 nt, Human
uuaaaguuucagaaacuugguc

SEQ ID NO: 87362 - RNA, 22 nt, Human
uuaaauagcucuuguagaagaa

SEQ ID NO: 87363 - RNA, 22 nt, Human
uuaaaugaacgagauaugcaac

SEQ ID NO: 87364 - RNA, 22 nt, Human
uuaaaugcucacauaaagguag

SEQ ID NO: 87365 - RNA, 22 nt, Human
uuaaauggggaugaguagaugg

SEQ ID NO: 87366 - RNA, 22 nt, Human
uuaaaugucaauagauugcuug

SEQ ID NO: 87367 - RNA, 22 nt, Human
uuaaaugugauuucauuuaugu

SEQ ID NO: 87368 - RNA, 22 nt, Human
uuaaaugugccuaaaccuguaa

SEQ ID NO: 87369 - RNA, 22 nt, Human
uuaaauguuuaaucuaacuuga

SEQ ID NO: 87370 - RNA, 22 nt, Human
uuaaauuauugagggauuguca

SEQ ID NO: 87371 - RNA, 22 nt, Human
uuaaauuuuagaaacagacucu

SEQ ID NO: 87372 - RNA, 22 nt, Human
uuaacacaucccugcucuaccc

SEQ ID NO: 87373 - RNA, 22 nt, Human
uuaacacuaucugucauaauua

SEQ ID NO: 87374 - RNA, 22 nt, Human
uuaacacuugaacucuacaugu

SEQ ID NO: 87375 - RNA, 23 nt, Human
uuaacaggaucucgggcaagagg

SEQ ID NO: 87376 - RNA, 22 nt, Human
uuaacaguaaagaauugugcaa

SEQ ID NO: 87377 - RNA, 22 nt, Human
uuaacauuuaguguaccccugu

SEQ ID NO: 87378 - RNA, 22 nt, Human
uuaaccagguccuuugaaaaca

SEQ ID NO: 87379 - RNA, 22 nt, Human
uuaaccuguuaugcccccagag

SEQ ID NO: 87380 - RNA, 22 nt, Human
uuaacgaauugugcauaauucc

SEQ ID NO: 87381 - RNA, 22 nt, Human
uuaacuauuauuagcaucuuug

SEQ ID NO: 87382 - RNA, 22 nt, Human
uuaacucucccuccuuacaucc

SEQ ID NO: 87383 - RNA, 22 nt, Human
uuaacugagaggaucugaguag

SEQ ID NO: 87384 - RNA, 22 nt, Human
uuacaguuacugguacuguuaa

SEQ ID NO: 87385 - RNA, 22 nt, Human
uuacaguuagaaucugaugaaa

SEQ ID NO: 87386 - RNA, 22 nt, Human
uuacaguuuacauaagaauugu

SEQ ID NO: 87387 - RNA, 22 nt, Human
uuacaguuuauccaggaagagc

SEQ ID NO: 87388 - RNA, 22 nt, Human
uuacauaaaaguucacguaggc

SEQ ID NO: 87389 - RNA, 22 nt, Human
uuacauacuuacuagaucuaug

SEQ ID NO: 87390 - RNA, 22 nt, Human
uuacaucacuuuacuuaauaau

SEQ ID NO: 87391 - RNA, 22 nt, Human
uuacaucagaaucacccaggaa

SEQ ID NO: 87392 - RNA, 22 nt, Human
uuacaucauugagacauacaua

SEQ ID NO: 87393 - RNA, 22 nt, Human
uuacaucuaaacugugaacaau

SEQ ID NO: 87394 - RNA, 19 nt, Human
uuacaucugcaacacuggu

SEQ ID NO: 87395 - RNA, 19 nt, Human
uuacaugacauaugaagga

SEQ ID NO: 87396 - RNA, 22 nt, Human
uuacaugguuuauuuaccuaag

SEQ ID NO: 87397 - RNA, 22 nt, Human
uuacauguggagucugauugca

SEQ ID NO: 87398 - RNA, 22 nt, Human
uuacauucaaggaacucauucu

SEQ ID NO: 87399 - RNA, 22 nt, Human
uuacauucagaaagauuugagu

SEQ ID NO: 87400 - RNA, 22 nt, Human
uuacauucauugaagugauuca

SEQ ID NO: 87401 - RNA, 22 nt, Human
uuacauuguccagaaauuauug

SEQ ID NO: 87402 - RNA, 22 nt, Human
uuaccaagcucugcauguuaag

SEQ ID NO: 87403 - RNA, 22 nt, Human
uuaccacacuuauuuacauugg

SEQ ID NO: 87404 - RNA, 22 nt, Human
uuaccacagugcaugacuucug

SEQ ID NO: 87405 - RNA, 22 nt, Human
uuaccauuauuagguggacuug

SEQ ID NO: 87406 - RNA, 22 nt, Human
uuaccauuccaugacaucagga

SEQ ID NO: 87407 - RNA, 22 nt, Human
uuaccauuuuauaaguuaaagu

SEQ ID NO: 87408 - RNA, 22 nt, Human
uuacccagcccugcccagaugu

SEQ ID NO: 87409 - RNA, 22 nt, Human
uuacccaggaaagaaaugguau

SEQ ID NO: 87410 - RNA, 22 nt, Human
uuacccagggaccaagagaaac

SEQ ID NO: 87411 - RNA, 22 nt, Human
uuaccuaaaauagcucaauuua

SEQ ID NO: 87412 - RNA, 22 nt, Human
uuaccugguguuuaugguccau

SEQ ID NO: 87413 - RNA, 22 nt, Human
uuaccuguguguuugauacaua

SEQ ID NO: 87414 - RNA, 22 nt, Human
uuacgaauguuagauugcaucu

SEQ ID NO: 87415 - RNA, 22 nt, Human
uuacgaguuugcaauuuuaaau

SEQ ID NO: 87416 - RNA, 22 nt, Human
uuacuaagagaaguaaauauuu

SEQ ID NO: 87417 - RNA, 22 nt, Human
uuacuaaguuuuaugcaacuua

SEQ ID NO: 87418 - RNA, 22 nt, Human
uuacuacagagagagcuccagu

SEQ ID NO: 87419 - RNA, 20 nt, Human
uuacucauaggaccacaagc

SEQ ID NO: 87420 - RNA, 22 nt, Human
uuacucauugcuggaucuagaa

SEQ ID NO: 87421 - RNA, 22 nt, Human
uuacugaaaguauacauuucug

SEQ ID NO: 87422 - RNA, 22 nt, Human
uuacugaacccuacuuuuacag

SEQ ID NO: 87423 - RNA, 22 nt, Human
uuacugaggguguaucuuagug

SEQ ID NO: 87424 - RNA, 22 nt, Human
uuacugaucccccaggugaccc

SEQ ID NO: 87425 - RNA, 21 nt, Human
uuacuggcagcagaaaccuga

SEQ ID NO: 87426 - RNA, 22 nt, Human
uuacuguaaaggucacauggug

SEQ ID NO: 87427 - RNA, 22 nt, Human
uuacuguacuagugagacuagg

SEQ ID NO: 87428 - RNA, 22 nt, Human
uuacuguuccucucucaaagag

SEQ ID NO: 87429 - RNA, 22 nt, Human
uuacuguugguguauccauagc

SEQ ID NO: 87430 - RNA, 22 nt, Human
uuacuuacagacaguagacucu

SEQ ID NO: 87431 - RNA, 21 nt, Human
uuacuucugcuuguuauuguc

SEQ ID NO: 87432 - RNA, 22 nt, Human
uuacuugaaaaccaccaguauu

SEQ ID NO: 87433 - RNA, 22 nt, Human
uuacuugaaaggaaauuaaggu

SEQ ID NO: 87434 - RNA, 19 nt, Human
uuacuuggcaaagucaguc

SEQ ID NO: 87435 - RNA, 22 nt, Human
uuacuugguguucugcccagga

SEQ ID NO: 87436 - RNA, 22 nt, Human
uuacuuuaagggugucuuauua

SEQ ID NO: 87437 - RNA, 22 nt, Human
uuacuuuagaaauagucaucaa

SEQ ID NO: 87438 - RNA, 22 nt, Human
uuacuuuagggauguuuugcuu

SEQ ID NO: 87439 - RNA, 22 nt, Human
uuacuuuaugugauggauuagu

SEQ ID NO: 87440 - RNA, 21 nt, Human
uuacuuuugcaccaaccuaau

SEQ ID NO: 87441 - RNA, 23 nt, Human
uuacuuuugcaccaaccuaauau

SEQ ID NO: 87442 - RNA, 21 nt, Human
uuacuuuugcagcaaccuaau

SEQ ID NO: 87443 - RNA, 22 nt, Human
uuagaaaaaacgucuucuagug

SEQ ID NO: 87444 - RNA, 22 nt, Human
uguggggcucccuggcagccug

SEQ ID NO: 87445 - RNA, 22 nt, Human
uguggggguacacguacacaug

SEQ ID NO: 87446 - RNA, 22 nt, Human
uguggguggagugauauuagcu

SEQ ID NO: 87447 - RNA, 22 nt, Human
uguggucccaaggcaacuggaa

SEQ ID NO: 87448 - RNA, 22 nt, Human
ugugguccucucaacugaaggu

SEQ ID NO: 87449 - RNA, 22 nt, Human
uguggugccgagagucuggacg

SEQ ID NO: 87450 - RNA, 22 nt, Human
ugugguggggucugguauucca

SEQ ID NO: 87451 - RNA, 19 nt, Human
uguguaaagucugugguca

SEQ ID NO: 87452 - RNA, 22 nt, Human
uguguaaauggacugugaauua

SEQ ID NO: 87453 - RNA, 22 nt, Human
uguguaaauggcaucucucagc

SEQ ID NO: 87454 - RNA, 22 nt, Human
uguguaaauuauuuuuaaugau

SEQ ID NO: 87455 - RNA, 17 nt, Human
uguguaaguugcauaga

SEQ ID NO: 87456 - RNA, 22 nt, Human
uguguacaagccugaguacaga

SEQ ID NO: 87457 - RNA, 22 nt, Human
uguguagcuuucuucugugggg

SEQ ID NO: 87458 - RNA, 22 nt, Human
uguguaggauuuccuggagccu

SEQ ID NO: 87459 - RNA, 20 nt, Human
uguguauaaauauauguuuc

SEQ ID NO: 87460 - RNA, 22 nt, Human
uguguauacgaguaugaauaug

SEQ ID NO: 87461 - RNA, 23 nt, Human
uguguauguaucuaugcauaggu

SEQ ID NO: 87462 - RNA, 21 nt, Human
uguguauguccaaugcccuac

SEQ ID NO: 87463 - RNA, 22 nt, Human
uguguaugucuguaugcacaca

SEQ ID NO: 87464 - RNA, 22 nt, Human
uguguauucagcaagcgaaaca

SEQ ID NO: 87465 - RNA, 22 nt, Human
ugugucaacaacagccuuggau

SEQ ID NO: 87466 - RNA, 22 nt, Human
ugugucagaaggcaauggggau

SEQ ID NO: 87467 - RNA, 22 nt, Human
ugugucagcauccuuugggaca

SEQ ID NO: 87468 - RNA, 22 nt, Human
ugugucaggagauagcaaaggg

SEQ ID NO: 87469 - RNA, 22 nt, Human
ugugucaggccuuaucgguggc

SEQ ID NO: 87470 - RNA, 22 nt, Human
ugugucauugccaugaaaaggc

SEQ ID NO: 87471 - RNA, 20 nt, Human
uguguccaucaucugggcac

SEQ ID NO: 87472 - RNA, 22 nt, Human
uguguccauucaggcacugacc

SEQ ID NO: 87473 - RNA, 22 nt, Human
uguguccuacugaggagcuccu

SEQ ID NO: 87474 - RNA, 22 nt, Human
uguguccuccagggagauguaa

SEQ ID NO: 87475 - RNA, 22 nt, Human
uguguccugguguuaauuuuau

SEQ ID NO: 87476 - RNA, 22 nt, Human
uguguccuguccccuugcugcu

SEQ ID NO: 87477 - RNA, 23 nt, Human
uguguccuuaacuguauauacua

SEQ ID NO: 87478 - RNA, 22 nt, Human
uguguccuuccaguuuuuccug

SEQ ID NO: 87479 - RNA, 22 nt, Human
ugugucuaggcucaugcuugcu

SEQ ID NO: 87480 - RNA, 22 nt, Human
ugugucucaagucagagcauca

SEQ ID NO: 87481 - RNA, 22 nt, Human
ugugucugcacugaguccucac

SEQ ID NO: 87482 - RNA, 22 nt, Human
ugugucugcccuuaguacaucu

SEQ ID NO: 87483 - RNA, 22 nt, Human
ugugucuggauagguaauggau

SEQ ID NO: 87484 - RNA, 22 nt, Human
ugugucuguuuugcucaccauu

SEQ ID NO: 87485 - RNA, 22 nt, Human
ugugucuuaaguuccaagacau

SEQ ID NO: 87486 - RNA, 22 nt, Human
ugugucuuacauaauuacaugu

SEQ ID NO: 87487 - RNA, 22 nt, Human
ugugugaagcacucugggugau

SEQ ID NO: 87488 - RNA, 22 nt, Human
ugugugaauagcaguggcuggu

SEQ ID NO: 87489 - RNA, 22 nt, Human
ugugugaauuacgcguguccug

SEQ ID NO: 87490 - RNA, 22 nt, Human
ugugugauuccacuuauauggg

SEQ ID NO: 87491 - RNA, 22 nt, Human
ugugugauugcacuuauaugag

SEQ ID NO: 87492 - RNA, 22 nt, Human
ugugugcaagugacauuagaaa

SEQ ID NO: 87493 - RNA, 22 nt, Human
ugucagugucugagguuuuaua

SEQ ID NO: 87494 - RNA, 22 nt, Human
ugucaguuaaaugagguacaag

SEQ ID NO: 87495 - RNA, 22 nt, Human
ugucaguucaauuauaguaauu

SEQ ID NO: 87496 - RNA, 22 nt, Human
ugucaguucugguuggcuccca

SEQ ID NO: 87497 - RNA, 22 nt, Human
ugucauaaucaguuuugcaugu

SEQ ID NO: 87498 - RNA, 22 nt, Human
ugucauauccuccuuaaaggug

SEQ ID NO: 87499 - RNA, 22 nt, Human
ugucaucuucaucauaaguaaa

SEQ ID NO: 87500 - RNA, 22 nt, Human
ugucaucuuggucuggaauaag

SEQ ID NO: 87501 - RNA, 22 nt, Human
ugucaugcagguuuguuauaga

SEQ ID NO: 87502 - RNA, 22 nt, Human
ugucaugccauuuaaaauguuu

SEQ ID NO: 87503 - RNA, 22 nt, Human
ugucauggagcuuauauuccag

SEQ ID NO: 87504 - RNA, 22 nt, Human
ugucauggcacuagaguggggu

SEQ ID NO: 87505 - RNA, 17 nt, Human
ugucauggcuaugguug

SEQ ID NO: 87506 - RNA, 22 nt, Human
ugucaugggguuguuuuguaca

SEQ ID NO: 87507 - RNA, 22 nt, Human
ugucauguaaagaguaaauggu

SEQ ID NO: 87508 - RNA, 22 nt, Human
ugucauguaaccuuucugagcc

SEQ ID NO: 87509 - RNA, 22 nt, Human
ugucauguagcauuuuaugucu

SEQ ID NO: 87510 - RNA, 22 nt, Human
ugucaugucuguaaauacacca

SEQ ID NO: 87511 - RNA, 22 nt, Human
ugucauuaugaggauuacaaua

SEQ ID NO: 87512 - RNA, 22 nt, Human
ugucauuauuugccuacugacu

SEQ ID NO: 87513 - RNA, 22 nt, Human
ugucauugguacaaauugauug

SEQ ID NO: 87514 - RNA, 20 nt, Human
ugucauuguuucuaggaccu

SEQ ID NO: 87515 - RNA, 22 nt, Human
ugucauuuaauagauaugaugg

SEQ ID NO: 87516 - RNA, 22 nt, Human
ugucauuuauucucuuauucua

SEQ ID NO: 87517 - RNA, 22 nt, Human
ugucauuucacaauaucacuca

SEQ ID NO: 87518 - RNA, 22 nt, Human
ugucauuuuauguauguggucu

SEQ ID NO: 87519 - RNA, 22 nt, Human
ugucauuuucauccuaaggagc

SEQ ID NO: 87520 - RNA, 22 nt, Human
ugucauuuucuaaucuguuguc

SEQ ID NO: 87521 - RNA, 22 nt, Human
ugucauuuucugguuaguuaau

SEQ ID NO: 87522 - RNA, 22 nt, Human
ugucauuuugucucacugcuau

SEQ ID NO: 87523 - RNA, 22 nt, Human
uguccaggaauugacccugcaa

SEQ ID NO: 87524 - RNA, 22 nt, Human
uguccagggauggggucaggga

SEQ ID NO: 87525 - RNA, 22 nt, Human
uguccagguuagcuucaaacac

SEQ ID NO: 87526 - RNA, 22 nt, Human
uguccagugauucucaugagcc

SEQ ID NO: 87527 - RNA, 22 nt, Human
uguccauaccuuuaccugugua

SEQ ID NO: 87528 - RNA, 22 nt, Human
uguccauggauagagcugcucg

SEQ ID NO: 87529 - RNA, 18 nt, Human
uguccauguuguuccuga

SEQ ID NO: 87530 - RNA, 17 nt, Human
uguccauuugccuggag

SEQ ID NO: 87531 - RNA, 19 nt, Human
ugucccagacuccgugucu

SEQ ID NO: 87532 - RNA, 22 nt, Human
ugucccagauacuggacauaga

SEQ ID NO: 87533 - RNA, 22 nt, Human
ugucccagcacuuugggagucu

SEQ ID NO: 87534 - RNA, 22 nt, Human
ugucccaggcugaaguacagug

SEQ ID NO: 87535 - RNA, 22 nt, Human
ugucccagguccuagaugacca

SEQ ID NO: 87536 - RNA, 22 nt, Human
ugucccaguucccaggguugcu

SEQ ID NO: 87537 - RNA, 22 nt, Human
ugucccaguuggguauugaauu

SEQ ID NO: 87538 - RNA, 22 nt, Human
ugucccaguuuugcagguuaga

SEQ ID NO: 87539 - RNA, 22 nt, Human
uguccccagcacucacucucca

SEQ ID NO: 87540 - RNA, 20 nt, Human
uguccccuagaucccagcuc

SEQ ID NO: 87541 - RNA, 22 nt, Human
ugucccuggaacuauggcucca

SEQ ID NO: 87542 - RNA, 22 nt, Human
uguccuagaguacauuccacug

SEQ ID NO: 87543 - RNA, 22 nt, Human
uguccuagauccagcugugcug

SEQ ID NO: 87544 - RNA, 22 nt, Human
uggagauguaaagcaaggcuua

SEQ ID NO: 87545 - RNA, 22 nt, Human
uggagcagaggcugagguuggg

SEQ ID NO: 87546 - RNA, 22 nt, Human
uggagcagcacaagaaagggga

SEQ ID NO: 87547 - RNA, 22 nt, Human
uggagcagccaugaugacagag

SEQ ID NO: 87548 - RNA, 22 nt, Human
uggagcaggaaacaucuagagg

SEQ ID NO: 87549 - RNA, 18 nt, Human
uggagcaggaagccuggc

SEQ ID NO: 87550 - RNA, 22 nt, Human
uggagcaggacggggaguggua

SEQ ID NO: 87551 - RNA, 22 nt, Human
uggagccaaaaagggaaggaga

SEQ ID NO: 87552 - RNA, 22 nt, Human
uggagccacucacuaucugagu

SEQ ID NO: 87553 - RNA, 22 nt, Human
uggagccauaacccuuucguac

SEQ ID NO: 87554 - RNA, 22 nt, Human
uggagcccagacacuggcauug

SEQ ID NO: 87555 - RNA, 22 nt, Human
uggagccuguguuucugcccag

SEQ ID NO: 87556 - RNA, 22 nt, Human
uggagcucagcgggugguuucu

SEQ ID NO: 87557 - RNA, 20 nt, Human
uggagcuccagcguccaugu

SEQ ID NO: 87558 - RNA, 22 nt, Human
uggagcucuggaaguucuaagc

SEQ ID NO: 87559 - RNA, 22 nt, Human
uggagcugaacuuugaggccag

SEQ ID NO: 87560 - RNA, 23 nt, Human
uggagcugacagucagagggagg

SEQ ID NO: 87561 - RNA, 22 nt, Human
uggagcugacucacaccagcua

SEQ ID NO: 87562 - RNA, 22 nt, Human
uggagcugaggggaaugcugag

SEQ ID NO: 87563 - RNA, 22 nt, Human
uggagcuggaagaauguagacg

SEQ ID NO: 87564 - RNA, 22 nt, Human
uggagcuggaagacagugauau

SEQ ID NO: 87565 - RNA, 22 nt, Human
uggagcuggaauuucugggccu

SEQ ID NO: 87566 - RNA, 22 nt, Human
uggagcuggcuuguggaaguug

SEQ ID NO: 87567 - RNA, 23 nt, Human
uggagcugggauuugauuugauu

SEQ ID NO: 87568 - RNA, 22 nt, Human
uggagcugggguuugaaucugg

SEQ ID NO: 87569 - RNA, 22 nt, Human
uggagcugguucuggggaagcu

SEQ ID NO: 87570 - RNA, 20 nt, Human
uggagcuguaaucuugucug

SEQ ID NO: 87571 - RNA, 22 nt, Human
uggagcugucacucagaaccaa

SEQ ID NO: 87572 - RNA, 20 nt, Human
uggagcugugguaaggagca

SEQ ID NO: 87573 - RNA, 18 nt, Human
uggaggaaaaaucucaug

SEQ ID NO: 87574 - RNA, 22 nt, Human
uggaggaaaauuacuggggucu

SEQ ID NO: 87575 - RNA, 22 nt, Human
uggaggaaucagggcuuaggcu

SEQ ID NO: 87576 - RNA, 22 nt, Human
uggaggagaccauuccacucag

SEQ ID NO: 87577 - RNA, 19 nt, Human
uggaggagaggaaaaguca

SEQ ID NO: 87578 - RNA, 22 nt, Human
uggaggaggaugcauuuguugu

SEQ ID NO: 87579 - RNA, 22 nt, Human
uggaggaugagugugggcucug

SEQ ID NO: 87580 - RNA, 22 nt, Human
uggaggcaacugaagauguagu

SEQ ID NO: 87581 - RNA, 22 nt, Human
uggaggcaccacuggcugcccg

SEQ ID NO: 87582 - RNA, 20 nt, Human
uggaggcagagccagaggga

SEQ ID NO: 87583 - RNA, 22 nt, Human
uggaggcagccgugaaccaccu

SEQ ID NO: 87584 - RNA, 22 nt, Human
uggaggcaguuuaagucugaga

SEQ ID NO: 87585 - RNA, 16 nt, Human
uggaggcaucuggccc

SEQ ID NO: 87586 - RNA, 22 nt, Human
uggaggccagagguacugggac

SEQ ID NO: 87587 - RNA, 22 nt, Human
uggaggcccacacuggguagau

SEQ ID NO: 87588 - RNA, 19 nt, Human
uggagggguuugaaugugg

SEQ ID NO: 87589 - RNA, 22 nt, Human
uggaggucgcgcgggugcugca

SEQ ID NO: 87590 - RNA, 22 nt, Human
uggaggucuccugguauugacc

SEQ ID NO: 87591 - RNA, 22 nt, Human
uggaggucucugucugggcagg

SEQ ID NO: 87592 - RNA, 22 nt, Human
uggagguggaguuggaaacuga

SEQ ID NO: 87593 - RNA, 22 nt, Human
uggagguguggagucaaaggga

SEQ ID NO: 87594 - RNA, 22 nt, Human
uggaguaagagccaccagccaa

SEQ ID NO: 87595 - RNA, 22 nt, Human
uggaguaaguaugccuuggugg

SEQ ID NO: 87596 - RNA, 22 nt, Human
uggagucacuuccauaugggaa

SEQ ID NO: 87597 - RNA, 22 nt, Human
uggagucagcuagaccuguguu

SEQ ID NO: 87598 - RNA, 22 nt, Human
uggaguccccgagaggccugca

SEQ ID NO: 87599 - RNA, 22 nt, Human
uggauaaaaucuguaaggcuca

SEQ ID NO: 87600 - RNA, 22 nt, Human
uggaucaugugaugucaggagu

SEQ ID NO: 87601 - RNA, 22 nt, Human
uggauccagcugcuccuaugag

SEQ ID NO: 87602 - RNA, 22 nt, Human
uggaucucggcaaugcgggacu

SEQ ID NO: 87603 - RNA, 22 nt, Human
uuguugcauaaaguaggaaaua

SEQ ID NO: 87604 - RNA, 22 nt, Human
uuguugcauuucaaguaugaga

SEQ ID NO: 87605 - RNA, 22 nt, Human
uuguugccaaauguaaaauaug

SEQ ID NO: 87606 - RNA, 22 nt, Human
uuguuguagacgcgaagugacu

SEQ ID NO: 87607 - RNA, 22 nt, Human
uuguuuaaaagaaaucauagaa

SEQ ID NO: 87608 - RNA, 22 nt, Human
uuguuuaagccacccaaucugu

SEQ ID NO: 87609 - RNA, 22 nt, Human
uuguuuaauaucgugaaguacu

SEQ ID NO: 87610 - RNA, 22 nt, Human
uuguuuacaaguuacucagucu

SEQ ID NO: 87611 - RNA, 23 nt, Human
uuguuuaccguaggacuuuuaac

SEQ ID NO: 87612 - RNA, 22 nt, Human
uuguuuacuaagaaccugguca

SEQ ID NO: 87613 - RNA, 22 nt, Human
uuguuuauguaauuggcacacu

SEQ ID NO: 87614 - RNA, 22 nt, Human
uuguuucaaauauuucagaaua

SEQ ID NO: 87615 - RNA, 22 nt, Human
uuguuucaugaguguaaaggga

SEQ ID NO: 87616 - RNA, 22 nt, Human
uuguuucuccagucuaggaaaa

SEQ ID NO: 87617 - RNA, 22 nt, Human
uuguuucuccuggugccugaua

SEQ ID NO: 87618 - RNA, 22 nt, Human
uuguuucucuggucuugaguga

SEQ ID NO: 87619 - RNA, 20 nt, Human
uuguuucugcuauuuucuaa

SEQ ID NO: 87620 - RNA, 22 nt, Human
uuguuucuucauuuagaagcuu

SEQ ID NO: 87621 - RNA, 22 nt, Human
uuguuugcccacaacuauuaag

SEQ ID NO: 87622 - RNA, 22 nt, Human
uuguuuggaacuuggugccacc

SEQ ID NO: 87623 - RNA, 18 nt, Human
uuguuuuaagacucuguc

SEQ ID NO: 87624 - RNA, 22 nt, Human
uuguuuuaagccagucugccua

SEQ ID NO: 87625 - RNA, 22 nt, Human
uuguuuuaaugagggagguuga

SEQ ID NO: 87626 - RNA, 22 nt, Human
uuguuuuccugggauaccaacc

SEQ ID NO: 87627 - RNA, 22 nt, Human
uuguuuucuuguauauagccuc

SEQ ID NO: 87628 - RNA, 22 nt, Human
uuguuuugcuaaagggucauca

SEQ ID NO: 87629 - RNA, 22 nt, Human
uuguuuuggagaugagcuaaaa

SEQ ID NO: 87630 - RNA, 23 nt, Human
uuguuuuuagagguggcaugaga

SEQ ID NO: 87631 - RNA, 22 nt, Human
uuuaaaaggcagcuucuuuugu

SEQ ID NO: 87632 - RNA, 22 nt, Human
uuuaaaagggguauuaagucca

SEQ ID NO: 87633 - RNA, 22 nt, Human
uuuaaacauaucuguugaggga

SEQ ID NO: 87634 - RNA, 22 nt, Human
uuuaaacaucuuguugccuuaa

SEQ ID NO: 87635 - RNA, 17 nt, Human
uuuaaacuacuacaagg

SEQ ID NO: 87636 - RNA, 22 nt, Human
uuuaaagagaaugugaaggagu

SEQ ID NO: 87637 - RNA, 22 nt, Human
uuuaaauaggacuccugggggu

SEQ ID NO: 87638 - RNA, 22 nt, Human
uuuaaauguucaugauacugaa

SEQ ID NO: 87639 - RNA, 22 nt, Human
uuuaaauuauaguuaaugucug

SEQ ID NO: 87640 - RNA, 22 nt, Human
uuuaaauucugucugccgcuua

SEQ ID NO: 87641 - RNA, 22 nt, Human
uuuaacauguucaagaaacaua

SEQ ID NO: 87642 - RNA, 22 nt, Human
uuuaaccagaaagguacucauc

SEQ ID NO: 87643 - RNA, 22 nt, Human
uuuaagacccacagggaaguug

SEQ ID NO: 87644 - RNA, 22 nt, Human
uuuaagaugguauuuuauaaag

SEQ ID NO: 87645 - RNA, 19 nt, Human
uuuaagcaauaguaucuug

SEQ ID NO: 87646 - RNA, 22 nt, Human
uuuaagcuaaugucauaauuag

SEQ ID NO: 87647 - RNA, 22 nt, Human
uuuaaggaaaaaauguacuuag

SEQ ID NO: 87648 - RNA, 22 nt, Human
uuuaaggaggggcucacguggg

SEQ ID NO: 87649 - RNA, 21 nt, Human
uuuaaggccagcaggagguga

SEQ ID NO: 87650 - RNA, 22 nt, Human
uuuaagugaugaaaugcagaua

SEQ ID NO: 87651 - RNA, 15 nt, Human
uuuaauauggaguua

SEQ ID NO: 87652 - RNA, 22 nt, Human
uuuaauauuucuuuccugaagc

SEQ ID NO: 87653 - RNA, 22 nt, Human
uuucaguugcagugguugucua

SEQ ID NO: 87654 - RNA, 22 nt, Human
uuucaguuucauggcacagcua

SEQ ID NO: 87655 - RNA, 22 nt, Human
uuucaguuugaaggaaaggcca

SEQ ID NO: 87656 - RNA, 23 nt, Human
uuucaguuuggaccagccccgac

SEQ ID NO: 87657 - RNA, 22 nt, Human
uuucauaaacaguagaagacua

SEQ ID NO: 87658 - RNA, 22 nt, Human
uuucauaaugucacagucaaaa

SEQ ID NO: 87659 - RNA, 23 nt, Human
uuucauaugguguggaugaagaa

SEQ ID NO: 87660 - RNA, 22 nt, Human
uuucaucugugcugccaagacu

SEQ ID NO: 87661 - RNA, 22 nt, Human
uuucaucuugauucuauauggc

SEQ ID NO: 87662 - RNA, 22 nt, Human
uuucaugagauuccuccacauc

SEQ ID NO: 87663 - RNA, 22 nt, Human
uuucauguaaucauuuaggugg

SEQ ID NO: 87664 - RNA, 22 nt, Human
uuucaugucugaauucuuuagu

SEQ ID NO: 87665 - RNA, 23 nt, Human
uuucauguuggcaugacugacuu

SEQ ID NO: 87666 - RNA, 19 nt, Human
uuucauguuuuuggugaga

SEQ ID NO: 87667 - RNA, 22 nt, Human
uuucauucagcacccugaggug

SEQ ID NO: 87668 - RNA, 22 nt, Human
uuucauucauuauacaguagag

SEQ ID NO: 87669 - RNA, 22 nt, Human
uuucauugaacuaaagaaucug

SEQ ID NO: 87670 - RNA, 22 nt, Human
uuucauugccauaaggugggau

SEQ ID NO: 87671 - RNA, 22 nt, Human
uuucauugccuuuggaaggucu

SEQ ID NO: 87672 - RNA, 22 nt, Human
uuucauuggcucccugaugaau

SEQ ID NO: 87673 - RNA, 22 nt, Human
uuuccaaaaguuuguucugugc

SEQ ID NO: 87674 - RNA, 22 nt, Human
uuuccaaaaugaaucuaaugca

SEQ ID NO: 87675 - RNA, 22 nt, Human
uuuccaaacccagcgagcuaca

SEQ ID NO: 87676 - RNA, 22 nt, Human
uuuccaaaggaguaccacgcau

SEQ ID NO: 87677 - RNA, 22 nt, Human
uuuccaaaguugccauaagcuu

SEQ ID NO: 87678 - RNA, 18 nt, Human
uuuccaagaagagagcuc

SEQ ID NO: 87679 - RNA, 22 nt, Human
uuuccaauaaagugucauuguu

SEQ ID NO: 87680 - RNA, 22 nt, Human
uuuccaauaaggucaccuuccu

SEQ ID NO: 87681 - RNA, 22 nt, Human
uuuccacccagagcauuuguuu

SEQ ID NO: 87682 - RNA, 22 nt, Human
uuuccacuccuauugcaucuca

SEQ ID NO: 87683 - RNA, 22 nt, Human
uuuccacugggcacggggccag

SEQ ID NO: 87684 - RNA, 22 nt, Human
uuuccagaaauaccauuuggug

SEQ ID NO: 87685 - RNA, 22 nt, Human
uuuccagagcaugucugcucag

SEQ ID NO: 87686 - RNA, 22 nt, Human
uuuccagagggugcucagggcg

SEQ ID NO: 87687 - RNA, 22 nt, Human
uuuccaggaaguaaggauaauc

SEQ ID NO: 87688 - RNA, 22 nt, Human
uuuccaggagaaagagagccuu

SEQ ID NO: 87689 - RNA, 22 nt, Human
uuuccagguauuaauacuguau

SEQ ID NO: 87690 - RNA, 22 nt, Human
uuuccagucccuggauuuaacc

SEQ ID NO: 87691 - RNA, 22 nt, Human
uuuccagugauggggucuggcu

SEQ ID NO: 87692 - RNA, 22 nt, Human
uuuccauauuuaaucaaaauaa

SEQ ID NO: 87693 - RNA, 22 nt, Human
uuuccauguguacuggccagaa

SEQ ID NO: 87694 - RNA, 22 nt, Human
uuucccaaguguaaacauggca

SEQ ID NO: 87695 - RNA, 22 nt, Human
uuucccaaugaguccuugagca

SEQ ID NO: 87696 - RNA, 23 nt, Human
uuucccacccucucucauugcug

SEQ ID NO: 87697 - RNA, 21 nt, Human
uuucccagcagagauagcugg

SEQ ID NO: 87698 - RNA, 19 nt, Human
uuucccagcccuugcugug

SEQ ID NO: 87699 - RNA, 22 nt, Human
uuucccaggcccucagggcugc

SEQ ID NO: 87700 - RNA, 22 nt, Human
uuucccaucuuagcagauuaaa

SEQ ID NO: 87701 - RNA, 17 nt, Human
uuucccuccuuccacuc

SEQ ID NO: 87702 - RNA, 22 nt, Human
uuucccucucaucucuauuauu

SEQ ID NO: 87703 - RNA, 22 nt, Human
uuucccuucuuuccugaguaau

SEQ ID NO: 87704 - RNA, 22 nt, Human
uuucccuuguuccuuccucuga

SEQ ID NO: 87705 - RNA, 19 nt, Human
uuuccuaaaaagcugugcu

SEQ ID NO: 87706 - RNA, 22 nt, Human
uuuccuaacacaaugcaugaga

SEQ ID NO: 87707 - RNA, 22 nt, Human
uuuccuacugcccuauacacac

SEQ ID NO: 87708 - RNA, 22 nt, Human
uuuccucacacagaagaucuug

SEQ ID NO: 87709 - RNA, 22 nt, Human
uuuccucacuucaugagaguuu

SEQ ID NO: 87710 - RNA, 22 nt, Human
uuuccucauuuaucugcuggga

SEQ ID NO: 87711 - RNA, 22 nt, Human
uuuccucugacugcuccccugc

SEQ ID NO: 87712 - RNA, 22 nt, Human
uuugacaacagcaaaugucaca

SEQ ID NO: 87713 - RNA, 22 nt, Human
uuugacaacguuguugugagga

SEQ ID NO: 87714 - RNA, 22 nt, Human
uuugacaacugugcaguuugua

SEQ ID NO: 87715 - RNA, 22 nt, Human
uuugacaauuagguagaaaaag

SEQ ID NO: 87716 - RNA, 22 nt, Human
uuugacaccaggagagaaaaca

SEQ ID NO: 87717 - RNA, 22 nt, Human
uuugacacugggagugugggug

SEQ ID NO: 87718 - RNA, 22 nt, Human
uuugacagaaaguuauuauuuu

SEQ ID NO: 87719 - RNA, 22 nt, Human
uuugacagacauuuacuacauu

SEQ ID NO: 87720 - RNA, 19 nt, Human
uuugacagaguuugagcau

SEQ ID NO: 87721 - RNA, 22 nt, Human
uuugacagauccuuaacucagc

SEQ ID NO: 87722 - RNA, 22 nt, Human
uuugacagcauauccucauauu

SEQ ID NO: 87723 - RNA, 22 nt, Human
uuugacagggugaugagguggu

SEQ ID NO: 87724 - RNA, 22 nt, Human
uuugacaguacucuguaggauc

SEQ ID NO: 87725 - RNA, 22 nt, Human
uuugacaguccccugauguuug

SEQ ID NO: 87726 - RNA, 22 nt, Human
uuugacagugacgccuguauga

SEQ ID NO: 87727 - RNA, 20 nt, Human
uuugacauauacaguucagg

SEQ ID NO: 87728 - RNA, 22 nt, Human
uuugacaucaauacccuagaau

SEQ ID NO: 87729 - RNA, 22 nt, Human
uuugacauuggcuuauucuguu

SEQ ID NO: 87730 - RNA, 20 nt, Human
uuugacucaggccuuuagcc

SEQ ID NO: 87731 - RNA, 22 nt, Human
uuugacucauuaaagucuccgu

SEQ ID NO: 87732 - RNA, 22 nt, Human
uuugacuccacuccuaacuccu

SEQ ID NO: 87733 - RNA, 19 nt, Human
uuugacuccucauuuuuau

SEQ ID NO: 87734 - RNA, 21 nt, Human
uuugacuccucauuuuuauau

SEQ ID NO: 87735 - RNA, 22 nt, Human
uuugagaaaaccagaaagaucu

SEQ ID NO: 87736 - RNA, 22 nt, Human
uuugagaacccuguauuuuaag

SEQ ID NO: 87737 - RNA, 22 nt, Human
uuugagaagaguuugagguauu

SEQ ID NO: 87738 - RNA, 22 nt, Human
uuugagaagauaggggaauacu

SEQ ID NO: 87739 - RNA, 22 nt, Human
uuugagaagcauggcuguauuc

SEQ ID NO: 87740 - RNA, 22 nt, Human
uuugagaagcugucuugggcuc

SEQ ID NO: 87741 - RNA, 22 nt, Human
uuugagauggagucuugcucug

SEQ ID NO: 87742 - RNA, 22 nt, Human
uuugaggaagaucggagggaaa

SEQ ID NO: 87743 - RNA, 22 nt, Human
uuugaguagugagacuaggcag

SEQ ID NO: 87744 - RNA, 22 nt, Human
uuugauaacagugaauaucaug

SEQ ID NO: 87745 - RNA, 22 nt, Human
uuugauaguugauuaaauucca

SEQ ID NO: 87746 - RNA, 22 nt, Human
uuugaucaugaagaggauaaac

SEQ ID NO: 87747 - RNA, 22 nt, Human
uuugaucucccagacuaaggag

SEQ ID NO: 87748 - RNA, 22 nt, Human
uuuguaaaggccugaauuucag

SEQ ID NO: 87749 - RNA, 22 nt, Human
uuuguaaauagcaguacucaug

SEQ ID NO: 87750 - RNA, 22 nt, Human
uuuguaaccuaaagcaccagau

SEQ ID NO: 87751 - RNA, 22 nt, Human
uuuguaagcaaaaaguccauuc

SEQ ID NO: 87752 - RNA, 22 nt, Human
uuuguaaggaauauucuuggug

SEQ ID NO: 87753 - RNA, 22 nt, Human
uuuguaaggcuaaauaauauuc

SEQ ID NO: 87754 - RNA, 22 nt, Human
uuuguacaauuagcagaggcua

SEQ ID NO: 87755 - RNA, 22 nt, Human
uuuguacacaggauguuauaau

SEQ ID NO: 87756 - RNA, 22 nt, Human
uuuguacacaggucauucaggg

SEQ ID NO: 87757 - RNA, 22 nt, Human
uuuguacacugucuacuaugaa

SEQ ID NO: 87758 - RNA, 22 nt, Human
uuuguacaggugcaggcauuug

SEQ ID NO: 87759 - RNA, 22 nt, Human
uuuguacauucaaaugucccau

SEQ ID NO: 87760 - RNA, 22 nt, Human
uuuguaccugugggaauacaga

SEQ ID NO: 87761 - RNA, 23 nt, Human
uuuguacugcauuaugagacaca

SEQ ID NO: 87762 - RNA, 22 nt, Human
uuuguagaacuguagaacaaug

SEQ ID NO: 87763 - RNA, 22 nt, Human
uuuguagaauaauaucuuucug

SEQ ID NO: 87764 - RNA, 22 nt, Human
uuuguagacuaccaguaauugu

SEQ ID NO: 87765 - RNA, 22 nt, Human
uuuguagauuuucucuccagua

SEQ ID NO: 87766 - RNA, 22 nt, Human
uuuguauaaauuggagcaaugu

SEQ ID NO: 87767 - RNA, 22 nt, Human
uuuguaugaacugguauguagg

SEQ ID NO: 87768 - RNA, 22 nt, Human
uuuguauuacaaagucacagua

SEQ ID NO: 87769 - RNA, 22 nt, Human
uuugucaaagaucagaugcuuu

SEQ ID NO: 87770 - RNA, 20 nt, Human
uuugucaacugcauccagca

SEQ ID NO: 87771 - RNA, 22 nt, Human
uuugucaccaguggcuuuggua

SEQ ID NO: 87772 - RNA, 22 nt, Human
uuugucauauagacuauuguga

SEQ ID NO: 87773 - RNA, 22 nt, Human
uuugucauguuuuguaaugucu

SEQ ID NO: 87774 - RNA, 22 nt, Human
uuugucauuucccugauuaaag

SEQ ID NO: 87775 - RNA, 22 nt, Human
uuuguccuauaauccucuuaca

SEQ ID NO: 87776 - RNA, 22 nt, Human
uuugucuuauccaaucucucag

SEQ ID NO: 87777 - RNA, 22 nt, Human
uuugucuucauccuucgagcug

SEQ ID NO: 87778 - RNA, 22 nt, Human
uuugucuuggccucaguuuucu

SEQ ID NO: 87779 - RNA, 22 nt, Human
uuugucuuuccccuccucauug

SEQ ID NO: 87780 - RNA, 23 nt, Human
uuugugaaaguguugagaggaga

SEQ ID NO: 87781 - RNA, 22 nt, Human
uuugugaacuuaggcaauuagg

SEQ ID NO: 87782 - RNA, 22 nt, Human
uuugugaauaagagaaugacag

SEQ ID NO: 87783 - RNA, 22 nt, Human
uuugugaauggaauccacagac

SEQ ID NO: 87784 - RNA, 22 nt, Human
uuugugcaagacaugcuaagag

SEQ ID NO: 87785 - RNA, 22 nt, Human
uuugugcaagagggccaccuua

SEQ ID NO: 87786 - RNA, 19 nt, Human
uuugugcagcaacauuaau

SEQ ID NO: 87787 - RNA, 22 nt, Human
uuugugcauggguauggccaau

SEQ ID NO: 87788 - RNA, 22 nt, Human
uuugugcauucaaguaggagcc

SEQ ID NO: 87789 - RNA, 22 nt, Human
uuuguggcaggagcggagaccg

SEQ ID NO: 87790 - RNA, 22 nt, Human
uuuguguaccuuguacauuugu

SEQ ID NO: 87791 - RNA, 22 nt, Human
uuugugugcuugguauugaaga

SEQ ID NO: 87792 - RNA, 22 nt, Human
uuuguguggcguuggccggcgg

SEQ ID NO: 87793 - RNA, 22 nt, Human
uuugugugugcucacauagaug

SEQ ID NO: 87794 - RNA, 22 nt, Human
uuuguguuguacuucugugcau

SEQ ID NO: 87795 - RNA, 22 nt, Human
uuuguguuuaauacaaggaccu

SEQ ID NO: 87796 - RNA, 22 nt, Human
uuuguucacauuuaggacucuc

SEQ ID NO: 87797 - RNA, 22 nt, Human
uuuguucaccuagcaaacuuuu

SEQ ID NO: 87798 - RNA, 23 nt, Human
uuuguucacuccugggaaagaca

SEQ ID NO: 87799 - RNA, 22 nt, Human
uuuguucacugagcaaugauua

SEQ ID NO: 87800 - RNA, 22 nt, Human
uuuguucaugccuauauucuca

SEQ ID NO: 87801 - RNA, 22 nt, Human
uuuguucauuaguacaguugua

SEQ ID NO: 87802 - RNA, 17 nt, Human
uuuguucguuaguccgg

SEQ ID NO: 87803 - RNA, 22 nt, Human
uuuguucugaagcaaguaggga

SEQ ID NO: 87804 - RNA, 22 nt, Human
uuuguucuugcaacaguuauua

SEQ ID NO: 87805 - RNA, 22 nt, Human
uuuguugggagaaacauuauuu

SEQ ID NO: 87806 - RNA, 18 nt, Human
uuuguuggguugccuuua

SEQ ID NO: 87807 - RNA, 22 nt, Human
uuuguuuacucauucauugaug

SEQ ID NO: 87808 - RNA, 22 nt, Human
uuuguuuagagaauugaagcag

SEQ ID NO: 87809 - RNA, 22 nt, Human
uuuguuuagaugguaaaucagu

SEQ ID NO: 87810 - RNA, 22 nt, Human
uuuguuuaucaaggucuagcau

SEQ ID NO: 87811 - RNA, 22 nt, Human
uuuguuucgcagccucucucug

SEQ ID NO: 87812 - RNA, 22 nt, Human
uuuguuugccacacaaaacagu

SEQ ID NO: 87813 - RNA, 22 nt, Human
uuuuaaacuauagcuggaugcu

SEQ ID NO: 87814 - RNA, 22 nt, Human
uuuuaaacugcagaauuuagaa

SEQ ID NO: 87815 - RNA, 22 nt, Human
uuuuaaaggauacucuugucua

SEQ ID NO: 87816 - RNA, 22 nt, Human
uuuuaaugggcgacuauuaugg

SEQ ID NO: 87817 - RNA, 22 nt, Human
uuuuaaugugcucugcaaugau

SEQ ID NO: 87818 - RNA, 22 nt, Human
uuuuaauuuugcaaaucuggug

SEQ ID NO: 87819 - RNA, 22 nt, Human
uuuuacaagcugagucguuaaa

SEQ ID NO: 87820 - RNA, 22 nt, Human
uuuuacaccuguuaacucuaag

SEQ ID NO: 87821 - RNA, 22 nt, Human
uuuuacauugggaaaugccucu

SEQ ID NO: 87822 - RNA, 22 nt, Human
uuuuaccugaaccacacaguau

SEQ ID NO: 87823 - RNA, 22 nt, Human
uuuuagaaauacugauuuagug

SEQ ID NO: 87824 - RNA, 22 nt, Human
uuuuagaagugccuauccuaug

SEQ ID NO: 87825 - RNA, 22 nt, Human
uuuuagaaucagguugucuggg

SEQ ID NO: 87826 - RNA, 22 nt, Human
uuuuagacuccaucugauucag

SEQ ID NO: 87827 - RNA, 22 nt, Human
uuuuagacuuguauguaaagcc

SEQ ID NO: 87828 - RNA, 22 nt, Human
uuuuagauugggaaauguaaag

SEQ ID NO: 87829 - RNA, 20 nt, Human
uuuuagcagaaagaaagcuc

SEQ ID NO: 87830 - RNA, 22 nt, Human
uuuuaguuguaguuggugagga

SEQ ID NO: 87831 - RNA, 22 nt, Human
uuuuaguuuggauuucuaaagc

SEQ ID NO: 87832 - RNA, 22 nt, Human
uuuuauaaagagagucaguugg

SEQ ID NO: 87833 - RNA, 22 nt, Human
uuuuauaagcaagaaagggaaa

SEQ ID NO: 87834 - RNA, 22 nt, Human
uuuuaucagcagggauaacaag

SEQ ID NO: 87835 - RNA, 22 nt, Human
uuuuaucugcuucauuaguuga

SEQ ID NO: 87836 - RNA, 22 nt, Human
uuuuaucugugacaucuggcag

SEQ ID NO: 87837 - RNA, 22 nt, Human
uuuuaugcaaguuaugauuaaa

SEQ ID NO: 87838 - RNA, 22 nt, Human
uuuuauuaucuuugaaugggac

SEQ ID NO: 87839 - RNA, 22 nt, Human
uuuuauucaaauaguucacacu

SEQ ID NO: 87840 - RNA, 22 nt, Human
uuuuauucauagggauggagag

SEQ ID NO: 87841 - RNA, 23 nt, Human
uuuuauugauauguagcuguugu

SEQ ID NO: 87842 - RNA, 21 nt, Human
uuuuauugaugaauggccacu

SEQ ID NO: 87843 - RNA, 22 nt, Human
uuuucaccauagacacuggucc

SEQ ID NO: 87844 - RNA, 22 nt, Human
uuuucagaggccuaagagguuu

SEQ ID NO: 87845 - RNA, 22 nt, Human
uuuucaggugcaguaaucauau

SEQ ID NO: 87846 - RNA, 22 nt, Human
uuuucaguggcuugcauauguu

SEQ ID NO: 87847 - RNA, 22 nt, Human
uuuucaguugugcucucuaguu

SEQ ID NO: 87848 - RNA, 22 nt, Human
uuuucaguuuuccagguagccg

SEQ ID NO: 87849 - RNA, 22 nt, Human
uuuucaugaggaaauacugccc

SEQ ID NO: 87850 - RNA, 22 nt, Human
uuuucauggccaccgcaaguga

SEQ ID NO: 87851 - RNA, 22 nt, Human
uuuucauuuacauuagggaaga

SEQ ID NO: 87852 - RNA, 19 nt, Human
uuuuccacagaaauauguu

SEQ ID NO: 87853 - RNA, 22 nt, Human
uuuuccacagcaccauaagauu

SEQ ID NO: 87854 - RNA, 22 nt, Human
uuuucccagagcuguccucaag

SEQ ID NO: 87855 - RNA, 22 nt, Human
acagugagcgguagugauugcu

SEQ ID NO: 87856 - RNA, 22 nt, Human
acagugauaaaauuucacaugu

SEQ ID NO: 87857 - RNA, 22 nt, Human
acagugaugagccggcugaggc

SEQ ID NO: 87858 - RNA, 22 nt, Human
acagugauucugcaaaccauau

SEQ ID NO: 87859 - RNA, 22 nt, Human
acagugcacauccugagugauu

SEQ ID NO: 87860 - RNA, 22 nt, Human
acagugcagggcgggaagaagg

SEQ ID NO: 87861 - RNA, 22 nt, Human
acagugcagggugggaagaagg

SEQ ID NO: 87862 - RNA, 22 nt, Human
acagugcaggucucaacaauua

SEQ ID NO: 87863 - RNA, 22 nt, Human
acagugcgggcugcgguggguc

SEQ ID NO: 87864 - RNA, 22 nt, Human
acagugcuucugauaugaugcc

SEQ ID NO: 87865 - RNA, 22 nt, Human
acaguggaaaugugggagggga

SEQ ID NO: 87866 - RNA, 20 nt, Human
acaguggaaauugaugucug

SEQ ID NO: 87867 - RNA, 22 nt, Human
acaguggaauggugggccugca

SEQ ID NO: 87868 - RNA, 22 nt, Human
acaguggaugugauguccaggu

SEQ ID NO: 87869 - RNA, 22 nt, Human
acaguggcagucguguucucua

SEQ ID NO: 87870 - RNA, 22 nt, Human
acagugggacagugacggggga

SEQ ID NO: 87871 - RNA, 22 nt, Human
acaguguacuaaauaguaagag

SEQ ID NO: 87872 - RNA, 22 nt, Human
acccugccugacaacagaggau

SEQ ID NO: 87873 - RNA, 22 nt, Human
acccugcuuggccccacuucua

SEQ ID NO: 87874 - RNA, 22 nt, Human
acccugcuuuaugccguccucu

SEQ ID NO: 87875 - RNA, 22 nt, Human
acccugggaacuggaaacugga

SEQ ID NO: 87876 - RNA, 22 nt, Human
acccugggaccuggagguggau

SEQ ID NO: 87877 - RNA, 22 nt, Human
acccugggcuuggccugcucag

SEQ ID NO: 87878 - RNA, 22 nt, Human
acccugggugagaggcaaacag

SEQ ID NO: 87879 - RNA, 22 nt, Human
acccuggguucccgcagcacca

SEQ ID NO: 87880 - RNA, 18 nt, Human
acccuuuccaaacugcag

SEQ ID NO: 87881 - RNA, 22 nt, Human
acccuuucuuacucacacgcuc

SEQ ID NO: 87882 - RNA, 22 nt, Human
acccuuugucaagcacagaaga

SEQ ID NO: 87883 - RNA, 21 nt, Human
acccuuuguuuaugaaucagc

SEQ ID NO: 87884 - RNA, 22 nt, Human
accggguaggugucaacucuga

SEQ ID NO: 87885 - RNA, 21 nt, Human
accgucaguacuaguauugac

SEQ ID NO: 87886 - RNA, 22 nt, Human
accuaagaaauccagagauuuc

SEQ ID NO: 87887 - RNA, 22 nt, Human
accuaauaaagguaaauucugu

SEQ ID NO: 87888 - RNA, 22 nt, Human
accuacauacggaaauauuuac

SEQ ID NO: 87889 - RNA, 22 nt, Human
accuacauggcuuuaaguaagu

SEQ ID NO: 87890 - RNA, 23 nt, Human
accuagaaauacguuuuacaugg

SEQ ID NO: 87891 - RNA, 21 nt, Human
accucaagcaacaaccaaggu

SEQ ID NO: 87892 - RNA, 22 nt, Human
accucaaggaaaaucuagacag

SEQ ID NO: 87893 - RNA, 22 nt, Human
accucagagaccucucaggugc

SEQ ID NO: 87894 - RNA, 22 nt, Human
accucagaggccagggaucuag

SEQ ID NO: 87895 - RNA, 22 nt, Human
accucagagggauguuacaggc

SEQ ID NO: 87896 - RNA, 22 nt, Human
accucaggauguggacacagaa

SEQ ID NO: 87897 - RNA, 22 nt, Human
accuccagcuuuuuagagacau

SEQ ID NO: 87898 - RNA, 16 nt, Human
accuccagucaagggu

SEQ ID NO: 87899 - RNA, 22 nt, Human
accuccauggcucaguuucaga

SEQ ID NO: 87900 - RNA, 22 nt, Human
accuccccacaugguagugagu

SEQ ID NO: 87901 - RNA, 18 nt, Human
accuccccauuuucugaa

SEQ ID NO: 87902 - RNA, 22 nt, Human
accuccccucaccaaucugguu

SEQ ID NO: 87903 - RNA, 22 nt, Human
accuccccugacucgaaaccca

SEQ ID NO: 87904 - RNA, 22 nt, Human
accucccucgccguccacucug

SEQ ID NO: 87905 - RNA, 20 nt, Human
accucccucuguggguggga

SEQ ID NO: 87906 - RNA, 22 nt, Human
accuccuccaaggagccauagg

SEQ ID NO: 87907 - RNA, 22 nt, Human
accucugccaagaugugcuccc

SEQ ID NO: 87908 - RNA, 22 nt, Human
accucuggacacugcauccuuc

SEQ ID NO: 87909 - RNA, 22 nt, Human
accucuggccuucaggcaucau

SEQ ID NO: 87910 - RNA, 22 nt, Human
accugaauugucauaucuuauu

SEQ ID NO: 87911 - RNA, 22 nt, Human
accugaauuugaaauguuuauu

SEQ ID NO: 87912 - RNA, 22 nt, Human
accugagaaugggggcaugugu

SEQ ID NO: 87913 - RNA, 22 nt, Human
accugagagcuauaagguuuua

SEQ ID NO: 87914 - RNA, 22 nt, Human
accugaggacuggaugguagaa

SEQ ID NO: 87915 - RNA, 22 nt, Human
accugaggcuguuagucuaggu

SEQ ID NO: 87916 - RNA, 22 nt, Human
accugagggcccaaacuuggua

SEQ ID NO: 87917 - RNA, 22 nt, Human
accugcaagcauuacacuucua

SEQ ID NO: 87918 - RNA, 22 nt, Human
accugcacagccccagaaugcc

SEQ ID NO: 87919 - RNA, 22 nt, Human
accugcagcuaaagauguaggg

SEQ ID NO: 87920 - RNA, 22 nt, Human
accugcaggcacaggugugcgc

SEQ ID NO: 87921 - RNA, 22 nt, Human
accugcaggggugcucucuggg

SEQ ID NO: 87922 - RNA, 22 nt, Human
accugcagguguuuccacacuu

SEQ ID NO: 87923 - RNA, 22 nt, Human
accugcaguggccacuccuaau

SEQ ID NO: 87924 - RNA, 20 nt, Human
accugccacagagaaaggua

SEQ ID NO: 87925 - RNA, 22 nt, Human
accugccagaauccaagccaca

SEQ ID NO: 87926 - RNA, 22 nt, Human
accugccagaaugcuaguccug

SEQ ID NO: 87927 - RNA, 22 nt, Human
accugcccacacuuccuuccca

SEQ ID NO: 87928 - RNA, 22 nt, Human
accugcccacauauauauguau

SEQ ID NO: 87929 - RNA, 22 nt, Human
accugcccacuucccaugacau

SEQ ID NO: 87930 - RNA, 22 nt, Human
accugcccagacucagauccua

SEQ ID NO: 87931 - RNA, 22 nt, Human
accugcccuggaggaagauauu

SEQ ID NO: 87932 - RNA, 22 nt, Human
accugccuaucagcugccugcu

SEQ ID NO: 87933 - RNA, 22 nt, Human
accugccuauggagccacaugg

SEQ ID NO: 87934 - RNA, 22 nt, Human
accugcuagaagcaaaugucug

SEQ ID NO: 87935 - RNA, 23 nt, Human
accugcuccaugucaccuucacu

SEQ ID NO: 87936 - RNA, 22 nt, Human
accugcugaggagggggaauua

SEQ ID NO: 87937 - RNA, 22 nt, Human
accugcuuuguaguguuugcug

SEQ ID NO: 87938 - RNA, 22 nt, Human
accuggacaccugcugucaucu

SEQ ID NO: 87939 - RNA, 22 nt, Human
accuggacuugaauccugacuu

SEQ ID NO: 87940 - RNA, 22 nt, Human
accuggagaaagccucucccug

SEQ ID NO: 87941 - RNA, 22 nt, Human
accuggaggcagagguugcagu

SEQ ID NO: 87942 - RNA, 22 nt, Human
accuggagucauuugaggagua

SEQ ID NO: 87943 - RNA, 22 nt, Human
accuggcacacacuggggagug

SEQ ID NO: 87944 - RNA, 22 nt, Human
accuggcacauucuaccacagu

SEQ ID NO: 87945 - RNA, 22 nt, Human
accuggcacuacaggcaccugu

SEQ ID NO: 87946 - RNA, 20 nt, Human
accuggcucucaggagcaac

SEQ ID NO: 87947 - RNA, 23 nt, Human
accuggcugcucaaccugcaggg

SEQ ID NO: 87948 - RNA, 22 nt, Human
accuggcuuccaaucuaggagc

SEQ ID NO: 87949 - RNA, 22 nt, Human
accugggaaagccguggaaagg

SEQ ID NO: 87950 - RNA, 22 nt, Human
accugggaguaugcagugguga

SEQ ID NO: 87951 - RNA, 22 nt, Human
accugguaaccugccugacuaa

SEQ ID NO: 87952 - RNA, 22 nt, Human
accugguuugucucaucaccac

SEQ ID NO: 87953 - RNA, 22 nt, Human
accugucaacccaucaccuagg

SEQ ID NO: 87954 - RNA, 22 nt, Human
accugucaucccggcugcaccg

SEQ ID NO: 87955 - RNA, 22 nt, Human
accugucugggcuacauuugca

SEQ ID NO: 87956 - RNA, 22 nt, Human
accugugucuccucuguguucu

SEQ ID NO: 87957 - RNA, 22 nt, Human
accuguuuucagaaaaugcaga

SEQ ID NO: 87958 - RNA, 22 nt, Human
accuuaaaugugacauagucua

SEQ ID NO: 87959 - RNA, 22 nt, Human
accuuagcuguuaaaacuaagu

SEQ ID NO: 87960 - RNA, 22 nt, Human
accuuauuaaaaugaugaugua

SEQ ID NO: 87961 - RNA, 22 nt, Human
accuuauucuugcccuuagaug

SEQ ID NO: 87962 - RNA, 22 nt, Human
accuuauuuggaaauauaauua

SEQ ID NO: 87963 - RNA, 22 nt, Human
accuucaaacuagauagaaguu

SEQ ID NO: 87964 - RNA, 22 nt, Human
acaugcaagcagccgugcagau

SEQ ID NO: 87965 - RNA, 22 nt, Human
acaugcaauauugagacuuucu

SEQ ID NO: 87966 - RNA, 22 nt, Human
acaugcacacgauucagucugg

SEQ ID NO: 87967 - RNA, 22 nt, Human
acaugcacccaguuacacucuc

SEQ ID NO: 87968 - RNA, 22 nt, Human
acaugcagaauucuuagagagc

SEQ ID NO: 87969 - RNA, 22 nt, Human
acaugcaggaaaaugcacagau

SEQ ID NO: 87970 - RNA, 20 nt, Human
acaugcaguggucauuucag

SEQ ID NO: 87971 - RNA, 22 nt, Human
acaugcauaaacuacuucuuau

SEQ ID NO: 87972 - RNA, 22 nt, Human
acaugcauacaagcacauguag

SEQ ID NO: 87973 - RNA, 22 nt, Human
acaugcauacugcugccaacgc

SEQ ID NO: 87974 - RNA, 19 nt, Human
acaugcauauggacaguug

SEQ ID NO: 87975 - RNA, 22 nt, Human
acaugcaucuccaggcucauuu

SEQ ID NO: 87976 - RNA, 22 nt, Human
acaugcaucucugggacacaug

SEQ ID NO: 87977 - RNA, 22 nt, Human
acaugcaugcuuuggugggugu

SEQ ID NO: 87978 - RNA, 22 nt, Human
acaugcaugugaauauggacac

SEQ ID NO: 87979 - RNA, 22 nt, Human
acaugcauguuguguagggggg

SEQ ID NO: 87980 - RNA, 22 nt, Human
acaugccaagauccucgucuuu

SEQ ID NO: 87981 - RNA, 22 nt, Human
acaugccagcacugcuuuucag

SEQ ID NO: 87982 - RNA, 22 nt, Human
acaugccagccucagcagcagu

SEQ ID NO: 87983 - RNA, 22 nt, Human
acaugcuaauggagaugccaag

SEQ ID NO: 87984 - RNA, 22 nt, Human
acaugcuaauugcaaagucuug

SEQ ID NO: 87985 - RNA, 22 nt, Human
acaugcuacacagagcuccucg

SEQ ID NO: 87986 - RNA, 22 nt, Human
acaugcucuccaaggacagagc

SEQ ID NO: 87987 - RNA, 22 nt, Human
acagggcugaggcuggcuucuu

SEQ ID NO: 87988 - RNA, 22 nt, Human
acagggcuggcguugggacaga

SEQ ID NO: 87989 - RNA, 22 nt, Human
acagggcuuagaaaucuguugc

SEQ ID NO: 87990 - RNA, 21 nt, Human
acagggcuucagggaggguua

SEQ ID NO: 87991 - RNA, 19 nt, Human
acagggcuuggccugacau

SEQ ID NO: 87992 - RNA, 22 nt, Human
acaggggaccuaggacccucgg

SEQ ID NO: 87993 - RNA, 22 nt, Human
acaggggcaggcaggacccuuu

SEQ ID NO: 87994 - RNA, 19 nt, Human
acaggggccuuuccagggu

SEQ ID NO: 87995 - RNA, 22 nt, Human
acagggggucccauggccugga

SEQ ID NO: 87996 - RNA, 22 nt, Human
acagggugacuuugugacagau

SEQ ID NO: 87997 - RNA, 22 nt, Human
acaggguugaagagcauaaagu

SEQ ID NO: 87998 - RNA, 22 nt, Human
acaggguuguggccuuaaaggc

SEQ ID NO: 87999 - RNA, 22 nt, Human
acagguacaagggauuaggaug

SEQ ID NO: 88000 - RNA, 22 nt, Human
acagguaccggucagauuacgg

SEQ ID NO: 88001 - RNA, 22 nt, Human
acaggucuggucugggugggac

SEQ ID NO: 88002 - RNA, 22 nt, Human
acaggucugugugcacagugcu

SEQ ID NO: 88003 - RNA, 22 nt, Human
acaggugaccugcucauaugaa

SEQ ID NO: 88004 - RNA, 18 nt, Human
acaggugauaucuugaga

SEQ ID NO: 88005 - RNA, 22 nt, Human
acaggugcaugcuaccaugucu

SEQ ID NO: 88006 - RNA, 22 nt, Human
acagguggagugguuagcaggc

SEQ ID NO: 88007 - RNA, 22 nt, Human
acaggugggcuuaagagucggc

SEQ ID NO: 88008 - RNA, 22 nt, Human
acagguguccaacauuuaccuu

SEQ ID NO: 88009 - RNA, 22 nt, Human
acagguguugacucacaggccc

SEQ ID NO: 88010 - RNA, 20 nt, Human
acagguucauucugugugac

SEQ ID NO: 88011 - RNA, 22 nt, Human
acagguuuagcucuuaguaguc

SEQ ID NO: 88012 - RNA, 22 nt, Human
acaguaaacaaugcagcaaauu

SEQ ID NO: 88013 - RNA, 18 nt, Human
acaguaaagaaaggaauu

SEQ ID NO: 88014 - RNA, 22 nt, Human
acaguaaagccuucugguugac

SEQ ID NO: 88015 - RNA, 22 nt, Human
acaguaacaccuacucuguccc

SEQ ID NO: 88016 - RNA, 17 nt, Human
acaguaacuauguuaug

SEQ ID NO: 88017 - RNA, 22 nt, Human
acaguaacucuuuuacccuccu

SEQ ID NO: 88018 - RNA, 22 nt, Human
acaguaauauugaugcucguca

SEQ ID NO: 88019 - RNA, 22 nt, Human
acaguaaucugggaacuuguua

SEQ ID NO: 88020 - RNA, 22 nt, Human
acaguaaugauaaccagcauuu

SEQ ID NO: 88021 - RNA, 22 nt, Human
acaguaaugauucugagucucu

SEQ ID NO: 88022 - RNA, 22 nt, Human
acaguacaaaacccaccagagg

SEQ ID NO: 88023 - RNA, 22 nt, Human
acaguacagcugaaacuuuagu

SEQ ID NO: 88024 - RNA, 22 nt, Human
acaguacauagaucucuacccu

SEQ ID NO: 88025 - RNA, 22 nt, Human
acaguaccaggccaaaccauga

SEQ ID NO: 88026 - RNA, 22 nt, Human
acaguaccugcucucaagcaaa

SEQ ID NO: 88027 - RNA, 22 nt, Human
acaguacugaguacugaguugg

SEQ ID NO: 88028 - RNA, 22 nt, Human
acaguacuguguuaacugaacc

SEQ ID NO: 88029 - RNA, 22 nt, Human
acaguagaaacaggcaggcaga

SEQ ID NO: 88030 - RNA, 22 nt, Human
acaguagauggcucagagacag

SEQ ID NO: 88031 - RNA, 22 nt, Human
acaguagauugguaugauguca

SEQ ID NO: 88032 - RNA, 22 nt, Human
acaguaggaauagauguagaua

SEQ ID NO: 88033 - RNA, 22 nt, Human
acaguaguccuuuauuuugguu

SEQ ID NO: 88034 - RNA, 22 nt, Human
acaguagugcucaaucaguguu

SEQ ID NO: 88035 - RNA, 22 nt, Human
acaguauaacuccaugccaccc

SEQ ID NO: 88036 - RNA, 22 nt, Human
acagucaaucagaacagcaugu

SEQ ID NO: 88037 - RNA, 19 nt, Human
acagucagggaauaaagac

SEQ ID NO: 88038 - RNA, 20 nt, Human
acagucagggaauagaaaaa

SEQ ID NO: 88039 - RNA, 22 nt, Human
acagucagggcuuacucaggga

SEQ ID NO: 88040 - RNA, 22 nt, Human
acagucauuagauacaaugucu

SEQ ID NO: 88041 - RNA, 20 nt, Human
acaguccugcacugguguuu

SEQ ID NO: 88042 - RNA, 22 nt, Human
acaguccuguugucaaagcaau

SEQ ID NO: 88043 - RNA, 22 nt, Human
acagucuggaggcugcuucauu

SEQ ID NO: 88044 - RNA, 22 nt, Human
acagucuggcagguguugaaag

SEQ ID NO: 88045 - RNA, 22 nt, Human
acagucuucccuuauuccacuc

SEQ ID NO: 88046 - RNA, 22 nt, Human
acagucuuucuacauucugugc

SEQ ID NO: 88047 - RNA, 22 nt, Human
acagugaaaaguagcuaacaca

SEQ ID NO: 88048 - RNA, 22 nt, Human
acagugaauccaaauuccuacc

SEQ ID NO: 88049 - RNA, 22 nt, Human
acagugacguuuauuugagacg

SEQ ID NO: 88050 - RNA, 22 nt, Human
acagugagauccaagggcaggc

SEQ ID NO: 88051 - RNA, 22 nt, Human
acagugaggacagggacugugu

SEQ ID NO: 88052 - RNA, 22 nt, Human
acagugaugggggugcaggaag

SEQ ID NO: 88053 - RNA, 22 nt, Human
acagugauugggguaucugcag

SEQ ID NO: 88054 - RNA, 22 nt, Human
acagugauuucauccuucuggg

SEQ ID NO: 88055 - RNA, 22 nt, Human
acagugauuucugcaagggcuc

SEQ ID NO: 88056 - RNA, 22 nt, Human
acagugauuuuaggauagaugg

SEQ ID NO: 88057 - RNA, 22 nt, Human
acagugcucaugugacauggug

SEQ ID NO: 88058 - RNA, 22 nt, Human
acagugcugaacgacauggaag

SEQ ID NO: 88059 - RNA, 22 nt, Human
acagugcugaucuagacugacc

SEQ ID NO: 88060 - RNA, 18 nt, Human
acagugcugucacugcuu

SEQ ID NO: 88061 - RNA, 22 nt, Human
acaguggaaagaaacgaauuag

SEQ ID NO: 88062 - RNA, 22 nt, Human
acaguggagaaggcaugaggcu

SEQ ID NO: 88063 - RNA, 22 nt, Human
acaguggaggccauaugguccu

SEQ ID NO: 88064 - RNA, 22 nt, Human
acaguggaugacauccuuuugc

SEQ ID NO: 88065 - RNA, 22 nt, Human
acaguggcaguauuagggcaga

SEQ ID NO: 88066 - RNA, 22 nt, Human
acaguggcuuuugugucugcag

SEQ ID NO: 88067 - RNA, 22 nt, Human
acaguggggucuuaauagaaca

SEQ ID NO: 88068 - RNA, 22 nt, Human
acagugguaggauaacuguuuu

SEQ ID NO: 88069 - RNA, 22 nt, Human
acaguggugagugacugauagg

SEQ ID NO: 88070 - RNA, 18 nt, Human
acagugguuugaugugcu

SEQ ID NO: 88071 - RNA, 22 nt, Human
acaguguaauaugggagucagu

SEQ ID NO: 88072 - RNA, 20 nt, Human
acaguguaauauucacauuc

SEQ ID NO: 88073 - RNA, 22 nt, Human
acucaggcuacaacgcguggcu

SEQ ID NO: 88074 - RNA, 22 nt, Human
acucaggcuacaggggcagaag

SEQ ID NO: 88075 - RNA, 19 nt, Human
acucaggcuuccucugagg

SEQ ID NO: 88076 - RNA, 22 nt, Human
acucaguggcacuuuggaauuu

SEQ ID NO: 88077 - RNA, 22 nt, Human
acucaguuaucauguguccaca

SEQ ID NO: 88078 - RNA, 22 nt, Human
acucauauacuguuguuuuuaa

SEQ ID NO: 88079 - RNA, 22 nt, Human
acucaucagauuagauuagggc

SEQ ID NO: 88080 - RNA, 22 nt, Human
acucaucuucccuccuggaggg

SEQ ID NO: 88081 - RNA, 22 nt, Human
acucauuuuauaacacuguagu

SEQ ID NO: 88082 - RNA, 22 nt, Human
acuccaaaaccugcggcuuggu

SEQ ID NO: 88083 - RNA, 22 nt, Human
acuccaaggccacaugcauucc

SEQ ID NO: 88084 - RNA, 22 nt, Human
acuccacaccacgggggccgcc

SEQ ID NO: 88085 - RNA, 22 nt, Human
acuccaggcaucugcuucugcu

SEQ ID NO: 88086 - RNA, 22 nt, Human
acuccagggcuucuaugauggu

SEQ ID NO: 88087 - RNA, 20 nt, Human
acuccagguggcaugaggac

SEQ ID NO: 88088 - RNA, 22 nt, Human
acuccagguguguuggacucua

SEQ ID NO: 88089 - RNA, 22 nt, Human
acucccagguugccuggcaggc

SEQ ID NO: 88090 - RNA, 22 nt, Human
acuccccaaaacuaaccaugca

SEQ ID NO: 88091 - RNA, 21 nt, Human
acucccugcauaagugauuua

SEQ ID NO: 88092 - RNA, 22 nt, Human
acucccuguacuugccucucuu

SEQ ID NO: 88093 - RNA, 22 nt, Human
acuccgggagccaggagaggcu

SEQ ID NO: 88094 - RNA, 22 nt, Human
acuccucagccagcaucaggga

SEQ ID NO: 88095 - RNA, 22 nt, Human
acuccuggggauccauuccuuu

SEQ ID NO: 88096 - RNA, 22 nt, Human
acuccugggugcugaccagcgu

SEQ ID NO: 88097 - RNA, 22 nt, Human
acuccugugagguagguggcaa

SEQ ID NO: 88098 - RNA, 22 nt, Human
acuccugugggcauggcacccc

SEQ ID NO: 88099 - RNA, 22 nt, Human
acuccuguguggcugggagguu

SEQ ID NO: 88100 - RNA, 22 nt, Human
acucgcggcggacggcggccag

SEQ ID NO: 88101 - RNA, 23 nt, Human
acucguggaauucucugcgaucg

SEQ ID NO: 88102 - RNA, 22 nt, Human
acaguucaagacaucaguauga

SEQ ID NO: 88103 - RNA, 22 nt, Human
acaguucaagucuuagacaaca

SEQ ID NO: 88104 - RNA, 21 nt, Human
acaguucaugauaacuccauc

SEQ ID NO: 88105 - RNA, 22 nt, Human
acaguucccgucuugcacagcu

SEQ ID NO: 88106 - RNA, 22 nt, Human
acaguucuagcuuuuacauuuu

SEQ ID NO: 88107 - RNA, 21 nt, Human
acaguucugccggcaucuuuc

SEQ ID NO: 88108 - RNA, 22 nt, Human
acaguucuguccuagacuucgu

SEQ ID NO: 88109 - RNA, 22 nt, Human
acaguuguuuuccagauauguu

SEQ ID NO: 88110 - RNA, 22 nt, Human
acaguuuacagggauuugagcu

SEQ ID NO: 88111 - RNA, 22 nt, Human
acaguuuauaaaaauaaugagg

SEQ ID NO: 88112 - RNA, 22 nt, Human
acaguuuaucgauucaccuacc

SEQ ID NO: 88113 - RNA, 21 nt, Human
acaguuuauuagaguaagugc

SEQ ID NO: 88114 - RNA, 22 nt, Human
acaguuugaauaauuuagauag

SEQ ID NO: 88115 - RNA, 22 nt, Human
acaguuuggcaaaugucccaca

SEQ ID NO: 88116 - RNA, 22 nt, Human
acaguuuguguuggccaugggc

SEQ ID NO: 88117 - RNA, 22 nt, Human
acauaacaaucauaggacauag

SEQ ID NO: 88118 - RNA, 22 nt, Human
acauaacacucuucucuaguga

SEQ ID NO: 88119 - RNA, 22 nt, Human
acauaagugcacaauaaauauu

SEQ ID NO: 88120 - RNA, 22 nt, Human
acauaauaaaaauaacagcuca

SEQ ID NO: 88121 - RNA, 22 nt, Human
acauaauagcauuucuaauuug

SEQ ID NO: 88122 - RNA, 22 nt, Human
acauacaaauagagcuguagua

SEQ ID NO: 88123 - RNA, 22 nt, Human
acauacauaugacaacuuuccu

SEQ ID NO: 88124 - RNA, 22 nt, Human
acauacaucaaguaucacaaga

SEQ ID NO: 88125 - RNA, 23 nt, Human
acauacauggagauaaagugaug

SEQ ID NO: 88126 - RNA, 22 nt, Human
acauacauggauucauggauuc

SEQ ID NO: 88127 - RNA, 22 nt, Human
acauacauggugcuuucuuggu

SEQ ID NO: 88128 - RNA, 22 nt, Human
acauacaugguucucagcccuu

SEQ ID NO: 88129 - RNA, 22 nt, Human
acauaccaucuccuggaaagcu

SEQ ID NO: 88130 - RNA, 22 nt, Human
acauacuuagaguaaacaagua

SEQ ID NO: 88131 - RNA, 22 nt, Human
acauagaaauuuauuucuuaca

SEQ ID NO: 88132 - RNA, 23 nt, Human
acauagaacagaauauauuugug

SEQ ID NO: 88133 - RNA, 22 nt, Human
acauagaacuucccagugagca

SEQ ID NO: 88134 - RNA, 22 nt, Human
acauagaacuucgaugucuuuu

SEQ ID NO: 88135 - RNA, 22 nt, Human
acauagaguucaauuuucaguc

SEQ ID NO: 88136 - RNA, 22 nt, Human
acauagcaagugcucaauaaau

SEQ ID NO: 88137 - RNA, 22 nt, Human
acauagcagaggacugagcaga

SEQ ID NO: 88138 - RNA, 22 nt, Human
acauaggcagagcuuuaaagcu

SEQ ID NO: 88139 - RNA, 22 nt, Human
acauaguucagagcagcagacc

SEQ ID NO: 88140 - RNA, 22 nt, Human
acauauaugcgugggcucaugg

SEQ ID NO: 88141 - RNA, 22 nt, Human
acauauaugcugggacugugac

SEQ ID NO: 88142 - RNA, 20 nt, Human
acauaucaugguagaguccu

SEQ ID NO: 88143 - RNA, 22 nt, Human
acauauguguuguacaugcaug

SEQ ID NO: 88144 - RNA, 22 nt, Human
acauauuaacugcacuacacua

SEQ ID NO: 88145 - RNA, 23 nt, Human
acauauugaaugcugagaauuuu

SEQ ID NO: 88146 - RNA, 22 nt, Human
acauauuggcuuagcucuguga

SEQ ID NO: 88147 - RNA, 22 nt, Human
acaucacagagcccagauaaag

SEQ ID NO: 88148 - RNA, 21 nt, Human
acaucagaguugugaagguag

SEQ ID NO: 88149 - RNA, 22 nt, Human
acaucaguccaccacugcaguu

SEQ ID NO: 88150 - RNA, 22 nt, Human
acaucaucgugcacauacauaa

SEQ ID NO: 88151 - RNA, 22 nt, Human
acaucaugagagacuuaaauug

SEQ ID NO: 88152 - RNA, 22 nt, Human
acaucauuguccguugucauga

SEQ ID NO: 88153 - RNA, 22 nt, Human
acaucauuuucuucaguguuug

SEQ ID NO: 88154 - RNA, 22 nt, Human
acauccacuauccuugcuuguu

SEQ ID NO: 88155 - RNA, 22 nt, Human
acauccagaucucagcauggcu

SEQ ID NO: 88156 - RNA, 21 nt, Human
acauccaggguccucacugcc

SEQ ID NO: 88157 - RNA, 22 nt, Human
acauccauguuguaauguuccu

SEQ ID NO: 88158 - RNA, 22 nt, Human
acauccugaagucagucauuug

SEQ ID NO: 88159 - RNA, 22 nt, Human
acauccuugauuauguaaggau

SEQ ID NO: 88160 - RNA, 22 nt, Human
acaucgagucugaguugcuaug

SEQ ID NO: 88161 - RNA, 22 nt, Human
acaucgauggucagccgaggag

SEQ ID NO: 88162 - RNA, 22 nt, Human
acaucguguaucacugaaccuu

SEQ ID NO: 88163 - RNA, 22 nt, Human
acaucucaugaaugauaaauca

SEQ ID NO: 88164 - RNA, 22 nt, Human
acaucucuggguccuccaugca

SEQ ID NO: 88165 - RNA, 22 nt, Human
acaucugaggagaccagccucu

SEQ ID NO: 88166 - RNA, 22 nt, Human
acaucugauuacaugagaauau

SEQ ID NO: 88167 - RNA, 22 nt, Human
acaucuggaaaguuacuugaga

SEQ ID NO: 88168 - RNA, 22 nt, Human
acaucuguaaucuagucaaccc

SEQ ID NO: 88169 - RNA, 22 nt, Human
acaucuguuuaacgaaggcauu

SEQ ID NO: 88170 - RNA, 22 nt, Human
acaucuucacugguuucuggaa

SEQ ID NO: 88171 - RNA, 22 nt, Human
acaucuuuauacuaguccuuga

SEQ ID NO: 88172 - RNA, 22 nt, Human
acaucuuuguuucuuaguguau

SEQ ID NO: 88173 - RNA, 22 nt, Human
acaugaaaacugguuccuucag

SEQ ID NO: 88174 - RNA, 22 nt, Human
acaugaaaagacuaucugauua

SEQ ID NO: 88175 - RNA, 22 nt, Human
acaugaaaccugagucuaacuc

SEQ ID NO: 88176 - RNA, 22 nt, Human
acaugaaacuguugcauuagaa

SEQ ID NO: 88177 - RNA, 22 nt, Human
acaugaaaguuauucugaguug

SEQ ID NO: 88178 - RNA, 22 nt, Human
acaugaacacugcuugccacau

SEQ ID NO: 88179 - RNA, 20 nt, Human
acaugaacagggcuacagca

SEQ ID NO: 88180 - RNA, 22 nt, Human
acaugaauauaugaaguucaac

SEQ ID NO: 88181 - RNA, 22 nt, Human
acaugaaugaagacuuuacaau

SEQ ID NO: 88182 - RNA, 22 nt, Human
acugccugugucccuucagugc

SEQ ID NO: 88183 - RNA, 22 nt, Human
acugccuucugcucaggguuca

SEQ ID NO: 88184 - RNA, 22 nt, Human
acugccuugaaagauuguugag

SEQ ID NO: 88185 - RNA, 20 nt, Human
acugccuuuagguauccuug

SEQ ID NO: 88186 - RNA, 22 nt, Human
acugcguggggagcugugacua

SEQ ID NO: 88187 - RNA, 22 nt, Human
acugcuauugaugucacacuuu

SEQ ID NO: 88188 - RNA, 22 nt, Human
acugcucaaggaucugguaggg

SEQ ID NO: 88189 - RNA, 22 nt, Human
acugcugagagcaaucccaaac

SEQ ID NO: 88190 - RNA, 22 nt, Human
acugcugagcacacaagagugu

SEQ ID NO: 88191 - RNA, 22 nt, Human
acugcugauuuuaggacuguua

SEQ ID NO: 88192 - RNA, 23 nt, Human
acugcugucuuugaagugcuuga

SEQ ID NO: 88193 - RNA, 22 nt, Human
acugcuuacccggccugacuuc

SEQ ID NO: 88194 - RNA, 22 nt, Human
acugcuucacugcgucuuaucu

SEQ ID NO: 88195 - RNA, 23 nt, Human
acugcuuuauucaugaggcucuc

SEQ ID NO: 88196 - RNA, 22 nt, Human
acugcuuuugaucucuucugua

SEQ ID NO: 88197 - RNA, 22 nt, Human
acuggaaaauucaaaugggguc

SEQ ID NO: 88198 - RNA, 22 nt, Human
acuggaaaguauucuuucacug

SEQ ID NO: 88199 - RNA, 21 nt, Human
acuggaagugggucaggaagu

SEQ ID NO: 88200 - RNA, 22 nt, Human
acuggacagguucaugguuuua

SEQ ID NO: 88201 - RNA, 22 nt, Human
acuggaggauuccuggaaggcg

SEQ ID NO: 88202 - RNA, 22 nt, Human
acuggaggccccucccagugaa

SEQ ID NO: 88203 - RNA, 20 nt, Human
acuggaguacccuagagaag

SEQ ID NO: 88204 - RNA, 22 nt, Human
acuggaucagaaucugauuuuu

SEQ ID NO: 88205 - RNA, 22 nt, Human
acuggcacaagaagagucgugg

SEQ ID NO: 88206 - RNA, 22 nt, Human
acuggcagagguuggacaccau

SEQ ID NO: 88207 - RNA, 19 nt, Human
acuggcagggcugcggugg

SEQ ID NO: 88208 - RNA, 22 nt, Human
acuggcaguuugagaaugcauu

SEQ ID NO: 88209 - RNA, 21 nt, Human
acuggccaccacuggcagggg

SEQ ID NO: 88210 - RNA, 22 nt, Human
acuggccagaacuaagucacau

SEQ ID NO: 88211 - RNA, 22 nt, Human
acuggccaggcgaaccacacug

SEQ ID NO: 88212 - RNA, 22 nt, Human
acuggccagguucaaaauacag

SEQ ID NO: 88213 - RNA, 22 nt, Human
acuggcugauauggcuaggaag

SEQ ID NO: 88214 - RNA, 22 nt, Human
acuggcugccuccaaagugugc

SEQ ID NO: 88215 - RNA, 20 nt, Human
acuggcugccuggaaugcgc

SEQ ID NO: 88216 - RNA, 22 nt, Human
acuggcugcguuccugugagac

SEQ ID NO: 88217 - RNA, 22 nt, Human
acuggcuggaguugccaaggcu

SEQ ID NO: 88218 - RNA, 22 nt, Human
acuggcuggccgcgcucuucgc

SEQ ID NO: 88219 - RNA, 21 nt, Human
acuggcugguggcuaagaauc

SEQ ID NO: 88220 - RNA, 22 nt, Human
acuggcuguguaaccucaggca

SEQ ID NO: 88221 - RNA, 18 nt, Human
acuggcuuuagcaucaga

SEQ ID NO: 88222 - RNA, 22 nt, Human
acugggaagagagaauucuguc

SEQ ID NO: 88223 - RNA, 23 nt, Human
acugggaaguuuggagagacgca

SEQ ID NO: 88224 - RNA, 22 nt, Human
acugggacuguaugugcuggac

SEQ ID NO: 88225 - RNA, 22 nt, Human
acugggagagcgaccagauucu

SEQ ID NO: 88226 - RNA, 22 nt, Human
acugggagucaugaggaaggag

SEQ ID NO: 88227 - RNA, 22 nt, Human
acugggauuacaggugggaguc

SEQ ID NO: 88228 - RNA, 22 nt, Human
acugggcaauaaauucagagaa

SEQ ID NO: 88229 - RNA, 22 nt, Human
acugggcagggaaggagaccga

SEQ ID NO: 88230 - RNA, 23 nt, Human
acugggccagcuacuuagcacug

SEQ ID NO: 88231 - RNA, 22 nt, Human
acugggcccagugguguggcug

SEQ ID NO: 88232 - RNA, 22 nt, Human
acugggcccauauacucagucu

SEQ ID NO: 88233 - RNA, 22 nt, Human
acugggccuugccauggcagcc

SEQ ID NO: 88234 - RNA, 22 nt, Human
acugggccuugugugucucauc

SEQ ID NO: 88235 - RNA, 22 nt, Human
acugggcucaagugauuguccu

SEQ ID NO: 88236 - RNA, 22 nt, Human
acugggcuccagaugugauacg

SEQ ID NO: 88237 - RNA, 23 nt, Human
acugggcugaaauuaaagguguc

SEQ ID NO: 88238 - RNA, 23 nt, Human
acugggcugaaauuuuucauggc

SEQ ID NO: 88239 - RNA, 22 nt, Human
acugggcugcuugagugccuuc

SEQ ID NO: 88240 - RNA, 22 nt, Human
acugggcugguuaguuuuacua

SEQ ID NO: 88241 - RNA, 22 nt, Human
acugggcuuaugcuguggagua

SEQ ID NO: 88242 - RNA, 22 nt, Human
acugggcuuauuucuugugaac

SEQ ID NO: 88243 - RNA, 22 nt, Human
acugggcuucacuuggcacauc

SEQ ID NO: 88244 - RNA, 23 nt, Human
acugggucuaucuccagagaaga

SEQ ID NO: 88245 - RNA, 22 nt, Human
acuggguguaaaggacuuaagc

SEQ ID NO: 88246 - RNA, 22 nt, Human
acugguaaauuaugcgacuuug

SEQ ID NO: 88247 - RNA, 22 nt, Human
acugguacucagcuggcacuca

SEQ ID NO: 88248 - RNA, 22 nt, Human
acugguggcccucaguguucuc

SEQ ID NO: 88249 - RNA, 22 nt, Human
acugguugaagaaaagcuagua

SEQ ID NO: 88250 - RNA, 22 nt, Human
acugguuugucuauugucauuc

SEQ ID NO: 88251 - RNA, 22 nt, Human
acugguuuuggaaaucaguaca

SEQ ID NO: 88252 - RNA, 22 nt, Human
accuuuauggagaacuugggau

SEQ ID NO: 88253 - RNA, 22 nt, Human
accuuucugcaaguucugggac

SEQ ID NO: 88254 - RNA, 21 nt, Human
accuuuggaaagacccuggga

SEQ ID NO: 88255 - RNA, 22 nt, Human
accuuuggauaaucuuuguguu

SEQ ID NO: 88256 - RNA, 22 nt, Human
accuuuuauguaaauauauguu

SEQ ID NO: 88257 - RNA, 22 nt, Human
acgaaggaaugugcuugagcau

SEQ ID NO: 88258 - RNA, 22 nt, Human
acgaauaagagauaaagcaagg

SEQ ID NO: 88259 - RNA, 22 nt, Human
acgaugaugaaagagaacauuc

SEQ ID NO: 88260 - RNA, 22 nt, Human
acgcaguuuguggacauuuuuu

SEQ ID NO: 88261 - RNA, 22 nt, Human
acgcaugguaaauccacugacu

SEQ ID NO: 88262 - RNA, 22 nt, Human
acgcuuuuacuauuuugagcuc

SEQ ID NO: 88263 - RNA, 22 nt, Human
acggaaaacccugagcaaacuu

SEQ ID NO: 88264 - RNA, 22 nt, Human
acggaguauuuacaagaggaaa

SEQ ID NO: 88265 - RNA, 20 nt, Human
acgggcugggacccaugcac

SEQ ID NO: 88266 - RNA, 22 nt, Human
acggggcuagagaagguuucuu

SEQ ID NO: 88267 - RNA, 22 nt, Human
acgggugguaaugagaaaagga

SEQ ID NO: 88268 - RNA, 22 nt, Human
acgucaucguugucaucgucau

SEQ ID NO: 88269 - RNA, 22 nt, Human
acgugugugacauugggaacgu

SEQ ID NO: 88270 - RNA, 22 nt, Human
acuaaaaacuacugccaauagc

SEQ ID NO: 88271 - RNA, 22 nt, Human
acuaaaacaguggcuaguagac

SEQ ID NO: 88272 - RNA, 22 nt, Human
acuaaagaagccaaaguuuucu

SEQ ID NO: 88273 - RNA, 22 nt, Human
acuaaaguaucuccuauuucau

SEQ ID NO: 88274 - RNA, 22 nt, Human
acuaaauaguuuugacagaaca

SEQ ID NO: 88275 - RNA, 22 nt, Human
acuaaaugaacuauuaauacuu

SEQ ID NO: 88276 - RNA, 22 nt, Human
acuaacauuuguguaugucuug

SEQ ID NO: 88277 - RNA, 22 nt, Human
acuaacuucugagaaccaauug

SEQ ID NO: 88278 - RNA, 22 nt, Human
acuaagaccuaaaauugugaau

SEQ ID NO: 88279 - RNA, 21 nt, Human
acuaagagaucucugucucau

SEQ ID NO: 88280 - RNA, 22 nt, Human
acuaagaugcaggaaaugcuag

SEQ ID NO: 88281 - RNA, 22 nt, Human
acuaaggaauaugacaaacuca

SEQ ID NO: 88282 - RNA, 23 nt, Human
acuaaggcuucuuuaagacagag

SEQ ID NO: 88283 - RNA, 22 nt, Human
acuaaguaguuuguuccucuuu

SEQ ID NO: 88284 - RNA, 22 nt, Human
acuacaauacucuuaguaaaag

SEQ ID NO: 88285 - RNA, 22 nt, Human
acuacauuucucaguaccugaa

SEQ ID NO: 88286 - RNA, 22 nt, Human
acuacugaauauuaguucugaa

SEQ ID NO: 88287 - RNA, 22 nt, Human
acuagaaaguuuccagaguuau

SEQ ID NO: 88288 - RNA, 22 nt, Human
acuagaaauuacucagaauaaa

SEQ ID NO: 88289 - RNA, 22 nt, Human
acuagaaccagaggaggcaggu

SEQ ID NO: 88290 - RNA, 22 nt, Human
acuagacugggccagucaaauu

SEQ ID NO: 88291 - RNA, 22 nt, Human
agaauucugacaauagaauugg

SEQ ID NO: 88292 - RNA, 22 nt, Human
agaauucuggaguugggaggaa

SEQ ID NO: 88293 - RNA, 21 nt, Human
agaauucuuaaguauucuaau

SEQ ID NO: 88294 - RNA, 23 nt, Human
agaauuguaaauagaauauaccu

SEQ ID NO: 88295 - RNA, 22 nt, Human
agaauuguugggguaauaaaag

SEQ ID NO: 88296 - RNA, 22 nt, Human
agaauuuagcuccuuggucaua

SEQ ID NO: 88297 - RNA, 22 nt, Human
agaauuuaugacaacgauagcc

SEQ ID NO: 88298 - RNA, 22 nt, Human
agaauuucaaaaggaagccagc

SEQ ID NO: 88299 - RNA, 23 nt, Human
agaauuucuaacucuagcucugu

SEQ ID NO: 88300 - RNA, 22 nt, Human
agaauuuguaaaagauaagaca

SEQ ID NO: 88301 - RNA, 23 nt, Human
agacaaaagccucagucuuaggc

SEQ ID NO: 88302 - RNA, 20 nt, Human
agacaaaaugacuucaugca

SEQ ID NO: 88303 - RNA, 23 nt, Human
agacaaacuuccuucacugcacc

SEQ ID NO: 88304 - RNA, 22 nt, Human
agacaaagacagcaucucaggu

SEQ ID NO: 88305 - RNA, 22 nt, Human
agacaaaugaacaaauauguga

SEQ ID NO: 88306 - RNA, 22 nt, Human
agacaacuagaaaacuagacag

SEQ ID NO: 88307 - RNA, 21 nt, Human
agacaacugugacuauucccu

SEQ ID NO: 88308 - RNA, 22 nt, Human
agacaaggcaaggcggccagau

SEQ ID NO: 88309 - RNA, 22 nt, Human
agacaaguucugugggucaccu

SEQ ID NO: 88310 - RNA, 22 nt, Human
agacaauacauuuauucccuuu

SEQ ID NO: 88311 - RNA, 21 nt, Human
agacaaugcuguaaaauucag

SEQ ID NO: 88312 - RNA, 22 nt, Human
agacaauguuuggucuacacuu

SEQ ID NO: 88313 - RNA, 22 nt, Human
agacaauuucaaaguaauauua

SEQ ID NO: 88314 - RNA, 22 nt, Human
agacacagaugguaccugagcc

SEQ ID NO: 88315 - RNA, 22 nt, Human
agacacagauuuuggaaaagau

SEQ ID NO: 88316 - RNA, 22 nt, Human
agacacagcuaccauaauacca

SEQ ID NO: 88317 - RNA, 21 nt, Human
agacacagggguugcuggggu

SEQ ID NO: 88318 - RNA, 22 nt, Human
agacacaguuugggauggguug

SEQ ID NO: 88319 - RNA, 22 nt, Human
agacaccuaauagaugaauuca

SEQ ID NO: 88320 - RNA, 22 nt, Human
agacacugagcauuuuccuagc

SEQ ID NO: 88321 - RNA, 22 nt, Human
agacacugauguucagcucaau

SEQ ID NO: 88322 - RNA, 19 nt, Human
agacacuggauggaaaaug

SEQ ID NO: 88323 - RNA, 22 nt, Human
agacacuguucucacaugcuug

SEQ ID NO: 88324 - RNA, 22 nt, Human
agacacuuauuuagugggaguu

SEQ ID NO: 88325 - RNA, 22 nt, Human
agacacuuucagaaguguuugc

SEQ ID NO: 88326 - RNA, 22 nt, Human
agacagaaauaggagaaaccag

SEQ ID NO: 88327 - RNA, 22 nt, Human
agacagacacaugguaacagau

SEQ ID NO: 88328 - RNA, 22 nt, Human
agacagacguagugugagagua

SEQ ID NO: 88329 - RNA, 21 nt, Human
agacagacugccugacccacg

SEQ ID NO: 88330 - RNA, 22 nt, Human
agacagacuuugaucuggaugu

SEQ ID NO: 88331 - RNA, 19 nt, Human
agacagagcucaguggguu

SEQ ID NO: 88332 - RNA, 22 nt, Human
agacagcaauaugggagacgga

SEQ ID NO: 88333 - RNA, 22 nt, Human
agacagcacuuuuguauggggg

SEQ ID NO: 88334 - RNA, 22 nt, Human
agacagcagaaacuagagcacu

SEQ ID NO: 88335 - RNA, 22 nt, Human
agacagcagggagcaggauuca

SEQ ID NO: 88336 - RNA, 22 nt, Human
agacagcgaggacagaggggug

SEQ ID NO: 88337 - RNA, 22 nt, Human
agacagcucuggguuccacacu

SEQ ID NO: 88338 - RNA, 22 nt, Human
agacagcugcucgcagagcuau

SEQ ID NO: 88339 - RNA, 22 nt, Human
agacagcugggaguguccuucu

SEQ ID NO: 88340 - RNA, 22 nt, Human
agacaggacacaagcugcauaa

SEQ ID NO: 88341 - RNA, 20 nt, Human
agacaggagcccccauucag

SEQ ID NO: 88342 - RNA, 22 nt, Human
agacaggcuuggaaaaaaccuc

SEQ ID NO: 88343 - RNA, 22 nt, Human
agacaggcuuugcuguauauca

SEQ ID NO: 88344 - RNA, 22 nt, Human
agacagggucuugaucagagcu

SEQ ID NO: 88345 - RNA, 21 nt, Human
agacaguaacucuucuacucc

SEQ ID NO: 88346 - RNA, 22 nt, Human
agacaguaauaaaauagguaag

SEQ ID NO: 88347 - RNA, 22 nt, Human
agacagugacuuagugaccaga

SEQ ID NO: 88348 - RNA, 22 nt, Human
agacagugagaaugaguugaaa

SEQ ID NO: 88349 - RNA, 22 nt, Human
agacauaagcgagcaucacagg

SEQ ID NO: 88350 - RNA, 22 nt, Human
agacauagggaggcauauaaau

SEQ ID NO: 88351 - RNA, 22 nt, Human
agacaucagcuugugugcaggg

SEQ ID NO: 88352 - RNA, 23 nt, Human
agacaucaggaugguggcuggga

SEQ ID NO: 88353 - RNA, 22 nt, Human
agacauccuggggagggcaaug

SEQ ID NO: 88354 - RNA, 22 nt, Human
agacaugacagauaguugcuag

SEQ ID NO: 88355 - RNA, 22 nt, Human
agacaugagaaacccaccagag

SEQ ID NO: 88356 - RNA, 22 nt, Human
agacauggagaaggagccagug

SEQ ID NO: 88357 - RNA, 20 nt, Human
agacaugguagugauucagg

SEQ ID NO: 88358 - RNA, 22 nt, Human
agacauuuauucacacauuuau

SEQ ID NO: 88359 - RNA, 22 nt, Human
agacauuuauugaacaccuagc

SEQ ID NO: 88360 - RNA, 22 nt, Human
agacauuuuaacaucuggguuu

SEQ ID NO: 88361 - RNA, 23 nt, Human
agacauuuuaauaaggacuuuuu

SEQ ID NO: 88362 - RNA, 22 nt, Human
agacauuuuacauucuuccauu

SEQ ID NO: 88363 - RNA, 22 nt, Human
agacauuuugcauucccugaag

SEQ ID NO: 88364 - RNA, 22 nt, Human
agaccaagaaaggaugaggauc

SEQ ID NO: 88365 - RNA, 22 nt, Human
agaccaagacuauaaugagagg

SEQ ID NO: 88366 - RNA, 22 nt, Human
agaccaggaaggccuacagaua

SEQ ID NO: 88367 - RNA, 22 nt, Human
agaccagggguugaguccuagc

SEQ ID NO: 88368 - RNA, 22 nt, Human
agaccaggucuuuauggcucca

SEQ ID NO: 88369 - RNA, 22 nt, Human
agaccaugggcuccugggacau

SEQ ID NO: 88370 - RNA, 22 nt, Human
agagcuguuuauugaugucaca

SEQ ID NO: 88371 - RNA, 22 nt, Human
agaggaaaaugaguuccagaau

SEQ ID NO: 88372 - RNA, 22 nt, Human
agaggaaguaaucaggaccugc

SEQ ID NO: 88373 - RNA, 22 nt, Human
agaggaauggagacuaaacgcu

SEQ ID NO: 88374 - RNA, 22 nt, Human
agaggacagacggaaagugcca

SEQ ID NO: 88375 - RNA, 22 nt, Human
agaggagcuuuuggaaaaggcc

SEQ ID NO: 88376 - RNA, 20 nt, Human
agaggaggauuauuuuauuc

SEQ ID NO: 88377 - RNA, 22 nt, Human
agaggaggcuggguccagauaa

SEQ ID NO: 88378 - RNA, 22 nt, Human
agaggagguccuuuucugaugu

SEQ ID NO: 88379 - RNA, 22 nt, Human
agaggauccuaagaagauauga

SEQ ID NO: 88380 - RNA, 22 nt, Human
agaggaugauuuuaaggacacu

SEQ ID NO: 88381 - RNA, 22 nt, Human
agaggauucacugcagaagaca

SEQ ID NO: 88382 - RNA, 22 nt, Human
agaggauugaucaaacacugca

SEQ ID NO: 88383 - RNA, 22 nt, Human
agaggcaacauggggaacagau

SEQ ID NO: 88384 - RNA, 22 nt, Human
agaggcaagggaccuuucuggg

SEQ ID NO: 88385 - RNA, 22 nt, Human
agaggcaaugaaagcagucucu

SEQ ID NO: 88386 - RNA, 22 nt, Human
agaggcacccgcgcgcggccau

SEQ ID NO: 88387 - RNA, 22 nt, Human
agaggcacuaagggaagagcag

SEQ ID NO: 88388 - RNA, 22 nt, Human
agaggcacuccagccacugguc

SEQ ID NO: 88389 - RNA, 17 nt, Human
agaggcagauacuugga

SEQ ID NO: 88390 - RNA, 23 nt, Human
agaggcaggaguggcuugcccgg

SEQ ID NO: 88391 - RNA, 21 nt, Human
agaggcaggcauuaaguacac

SEQ ID NO: 88392 - RNA, 22 nt, Human
agaggcaguauacaauccgagc

SEQ ID NO: 88393 - RNA, 19 nt, Human
agaggcagucuccaacagg

SEQ ID NO: 88394 - RNA, 22 nt, Human
agaggccaaagaaucuacaaga

SEQ ID NO: 88395 - RNA, 22 nt, Human
agaggccaggcagcccaaggug

SEQ ID NO: 88396 - RNA, 22 nt, Human
agaggccaugcuagaggccugg

SEQ ID NO: 88397 - RNA, 22 nt, Human
agaggccccaggugagcaugcc

SEQ ID NO: 88398 - RNA, 22 nt, Human
agaggcccucucucuccugaug

SEQ ID NO: 88399 - RNA, 22 nt, Human
agaggccuaaccaagauguccu

SEQ ID NO: 88400 - RNA, 22 nt, Human
agagccucugucauggagagaa

SEQ ID NO: 88401 - RNA, 22 nt, Human
agagccugaggccaggaaaaug

SEQ ID NO: 88402 - RNA, 22 nt, Human
agagccugcaguggagaccuug

SEQ ID NO: 88403 - RNA, 22 nt, Human
agagccugcaucaggcuugggg

SEQ ID NO: 88404 - RNA, 22 nt, Human
agagccugcuaccucauuccag

SEQ ID NO: 88405 - RNA, 22 nt, Human
agagccuggaccugggcucuga

SEQ ID NO: 88406 - RNA, 22 nt, Human
agagccuguaacaucuuucuua

SEQ ID NO: 88407 - RNA, 22 nt, Human
agagccuguacuuuucugugaa

SEQ ID NO: 88408 - RNA, 22 nt, Human
agagccugucaauuguaaagag

SEQ ID NO: 88409 - RNA, 22 nt, Human
agagccugugauugucaucacc

SEQ ID NO: 88410 - RNA, 22 nt, Human
agagccuugaagaucuggaaaa

SEQ ID NO: 88411 - RNA, 22 nt, Human
agauauguuacugcaucauggg

SEQ ID NO: 88412 - RNA, 22 nt, Human
agauauuaccagcagucuaugc

SEQ ID NO: 88413 - RNA, 22 nt, Human
agauauucuagaaccuaguaga

SEQ ID NO: 88414 - RNA, 22 nt, Human
agauauugugcauacugcuguu

SEQ ID NO: 88415 - RNA, 22 nt, Human
agauauuuugugugauguuuca

SEQ ID NO: 88416 - RNA, 22 nt, Human
agaucaaagccaugagagauuu

SEQ ID NO: 88417 - RNA, 22 nt, Human
agaucaaggacaugaagaggcu

SEQ ID NO: 88418 - RNA, 22 nt, Human
agaucaaggugucagcaggcuu

SEQ ID NO: 88419 - RNA, 22 nt, Human
agaucacagcccccagaugcca

SEQ ID NO: 88420 - RNA, 22 nt, Human
agaucagacacggcuugugacg

SEQ ID NO: 88421 - RNA, 22 nt, Human
agaucagacuuugugacuagga

SEQ ID NO: 88422 - RNA, 22 nt, Human
agaucauauuguaacuuuauug

SEQ ID NO: 88423 - RNA, 22 nt, Human
agaucauuaaccaccuguucug

SEQ ID NO: 88424 - RNA, 22 nt, Human
agaucauuuggcagaagcaacg

SEQ ID NO: 88425 - RNA, 22 nt, Human
agauccauuuuggugucaacuc

SEQ ID NO: 88426 - RNA, 21 nt, Human
agauccuggggucuggggagg

SEQ ID NO: 88427 - RNA, 22 nt, Human
agaucgauuucauauccucuua

SEQ ID NO: 88428 - RNA, 22 nt, Human
agaucggcuuugcagaccucau

SEQ ID NO: 88429 - RNA, 22 nt, Human
agaucucaccucuguguauuau

SEQ ID NO: 88430 - RNA, 22 nt, Human
agaucugaccuaaccccaccac

SEQ ID NO: 88431 - RNA, 22 nt, Human
agaucugaggguccaagggagg

SEQ ID NO: 88432 - RNA, 22 nt, Human
agaugacagccaaggagaugaa

SEQ ID NO: 88433 - RNA, 23 nt, Human
agaugagccaacaccuccaugcc

SEQ ID NO: 88434 - RNA, 21 nt, Human
agaugaggauacugaggccua

SEQ ID NO: 88435 - RNA, 22 nt, Human
agaugaguaaauggagucuucc

SEQ ID NO: 88436 - RNA, 22 nt, Human
agaugagugagagcaucaacuu

SEQ ID NO: 88437 - RNA, 22 nt, Human
agaugauuaugauagcacuguu

SEQ ID NO: 88438 - RNA, 22 nt, Human
agaugcaaccucugcuuaacaa

SEQ ID NO: 88439 - RNA, 22 nt, Human
agaugcagacuugguucaggca

SEQ ID NO: 88440 - RNA, 22 nt, Human
agaugcagaguugcuuaagcau

SEQ ID NO: 88441 - RNA, 22 nt, Human
agaugcagauuuggauucagga

SEQ ID NO: 88442 - RNA, 22 nt, Human
agaugcagugguuaacaauaca

SEQ ID NO: 88443 - RNA, 22 nt, Human
agaugccagcuuacacugggaa

SEQ ID NO: 88444 - RNA, 22 nt, Human
agaugccuaaaucugggcaagg

SEQ ID NO: 88445 - RNA, 21 nt, Human
agaugcugaugcugcaggucc

SEQ ID NO: 88446 - RNA, 22 nt, Human
agaugcugcuccacaggccagg

SEQ ID NO: 88447 - RNA, 17 nt, Human
agaugcuggccacaugu

SEQ ID NO: 88448 - RNA, 22 nt, Human
agaugcuggggccccucggaug

SEQ ID NO: 88449 - RNA, 22 nt, Human
agaugcugugaggaagcuagga

SEQ ID NO: 88450 - RNA, 21 nt, Human
agaugcugugcuccaggagca

SEQ ID NO: 88451 - RNA, 22 nt, Human
agauggagucucacucuuguug

SEQ ID NO: 88452 - RNA, 22 nt, Human
agauggaguuaguaccagaguc

SEQ ID NO: 88453 - RNA, 19 nt, Human
agauggcaaaaugcaaaga

SEQ ID NO: 88454 - RNA, 17 nt, Human
agauggccucuaagauu

SEQ ID NO: 88455 - RNA, 21 nt, Human
agauggcucccaggucucugg

SEQ ID NO: 88456 - RNA, 22 nt, Human
agauggcugauggcaggagcca

SEQ ID NO: 88457 - RNA, 22 nt, Human
agauggcugggccccaccccag

SEQ ID NO: 88458 - RNA, 22 nt, Human
agauggcugggcucguccgcag

SEQ ID NO: 88459 - RNA, 20 nt, Human
agauggcugucauuucuguc

SEQ ID NO: 88460 - RNA, 22 nt, Human
agauggcuuccuucucacugug

SEQ ID NO: 88461 - RNA, 22 nt, Human
agauggggcagaauggagccau

SEQ ID NO: 88462 - RNA, 22 nt, Human
agauggggcugaaaguuccaau

SEQ ID NO: 88463 - RNA, 22 nt, Human
agaugggugccuucuuucuuua

SEQ ID NO: 88464 - RNA, 22 nt, Human
agaugguagacuauggaacgua

SEQ ID NO: 88465 - RNA, 22 nt, Human
agauggucaaggauacuguuca

SEQ ID NO: 88466 - RNA, 22 nt, Human
agauggucugguuauuuuuagu

SEQ ID NO: 88467 - RNA, 22 nt, Human
agauggugagggcagaaguaac

SEQ ID NO: 88468 - RNA, 22 nt, Human
agaugguggacuaucugacuug

SEQ ID NO: 88469 - RNA, 22 nt, Human
agaugguguuuccccaggugga

SEQ ID NO: 88470 - RNA, 22 nt, Human
agaugguuuugucuuuaugauu

SEQ ID NO: 88471 - RNA, 22 nt, Human
agauguaccagguauuacagga

SEQ ID NO: 88472 - RNA, 22 nt, Human
agaugucagcaggguugguuuc

SEQ ID NO: 88473 - RNA, 19 nt, Human
agaugucuauuugacuauc

SEQ ID NO: 88474 - RNA, 22 nt, Human
agaugugacugggcaaguuacu

SEQ ID NO: 88475 - RNA, 22 nt, Human
agaugugagaaucaagugacca

SEQ ID NO: 88476 - RNA, 22 nt, Human
agauguggaaagaaguuagaag

SEQ ID NO: 88477 - RNA, 22 nt, Human
agauguguuucuaguuccugca

SEQ ID NO: 88478 - RNA, 22 nt, Human
agauguuuauaacucaugagug

SEQ ID NO: 88479 - RNA, 22 nt, Human
agauguuuuagaguuugacuug

SEQ ID NO: 88480 - RNA, 20 nt, Human
agauguuuugaagucuugga

SEQ ID NO: 88481 - RNA, 22 nt, Human
agauucaaagugaagaacuuaa

SEQ ID NO: 88482 - RNA, 22 nt, Human
agauucagaaaauucucuguuc

SEQ ID NO: 88483 - RNA, 22 nt, Human
agauucaggcaugucuucauuu

SEQ ID NO: 88484 - RNA, 22 nt, Human
agauucauuaggagacauucag

SEQ ID NO: 88485 - RNA, 22 nt, Human
agauuccucagucaugaagccu

SEQ ID NO: 88486 - RNA, 22 nt, Human
agauucucgguccgggcagccc

SEQ ID NO: 88487 - RNA, 22 nt, Human
agauugaauaaccaccuuuuuc

SEQ ID NO: 88488 - RNA, 22 nt, Human
agauugucauugacgaugagca

SEQ ID NO: 88489 - RNA, 23 nt, Human
agauuguuauucccaguucaugu

SEQ ID NO: 88490 - RNA, 22 nt, Human
agauuuaaagcaguauucgcaa

SEQ ID NO: 88491 - RNA, 22 nt, Human
agauuuacaaaggauuugcuuu

SEQ ID NO: 88492 - RNA, 19 nt, Human
agauuuaccucauauaguu

SEQ ID NO: 88493 - RNA, 20 nt, Human
agauuuaccuuugagccuuc

SEQ ID NO: 88494 - RNA, 22 nt, Human
agauuuacugagaacugauuac

SEQ ID NO: 88495 - RNA, 22 nt, Human
agauuuacuggagucuuuggug

SEQ ID NO: 88496 - RNA, 22 nt, Human
agauuuagugguggaauuuugg

SEQ ID NO: 88497 - RNA, 22 nt, Human
agauuucccacuccauguauug

SEQ ID NO: 88498 - RNA, 22 nt, Human
agauuuccuaugguaauuauag

SEQ ID NO: 88499 - RNA, 22 nt, Human
agauuuccucuuuuguaaagug

SEQ ID NO: 88500 - RNA, 22 nt, Human
agauuuccugcacugccuuuga

SEQ ID NO: 88501 - RNA, 22 nt, Human
agauuucugucaccuucuaugc

SEQ ID NO: 88502 - RNA, 22 nt, Human
agauuugauaaaaguagcaguu

SEQ ID NO: 88503 - RNA, 22 nt, Human
agauuugcggcuuuacuuugca

SEQ ID NO: 88504 - RNA, 22 nt, Human
agauuuguauagaugugguuga

SEQ ID NO: 88505 - RNA, 22 nt, Human
agauuugucagcucagucuuua

SEQ ID NO: 88506 - RNA, 22 nt, Human
agauuuuaguguagaggacuug

SEQ ID NO: 88507 - RNA, 22 nt, Human
agauuuuauagauaauuuccca

SEQ ID NO: 88508 - RNA, 22 nt, Human
agcaaaagauagauuaacaaga

SEQ ID NO: 88509 - RNA, 22 nt, Human
aggcugcaggucugggucaugu

SEQ ID NO: 88510 - RNA, 22 nt, Human
aggcugcagugcagguaggauu

SEQ ID NO: 88511 - RNA, 22 nt, Human
aggcugcccugccgccaguggg

SEQ ID NO: 88512 - RNA, 22 nt, Human
aggcugccuagguucaacaccu

SEQ ID NO: 88513 - RNA, 22 nt, Human
aggcugccucugcaggaucccu

SEQ ID NO: 88514 - RNA, 22 nt, Human
aggcugccuggcugugagugaa

SEQ ID NO: 88515 - RNA, 22 nt, Human
aggcugcugccuuggagagugu

SEQ ID NO: 88516 - RNA, 22 nt, Human
aggcugcuggcaggcguggacg

SEQ ID NO: 88517 - RNA, 22 nt, Human
aggcugcuucaauggauaagau

SEQ ID NO: 88518 - RNA, 22 nt, Human
aggcugcuucuuguccuuggca

SEQ ID NO: 88519 - RNA, 22 nt, Human
aggcugcuuucauggccgcccc

SEQ ID NO: 88520 - RNA, 22 nt, Human
aggcuggaaaucacuagauucc

SEQ ID NO: 88521 - RNA, 22 nt, Human
aggcuggacccgacaccugccc

SEQ ID NO: 88522 - RNA, 19 nt, Human
aggcuggagacaccaggcc

SEQ ID NO: 88523 - RNA, 22 nt, Human
aggcuggagacccgccaagaaa

SEQ ID NO: 88524 - RNA, 22 nt, Human
aggcuggagguuuguugcggcu

SEQ ID NO: 88525 - RNA, 19 nt, Human
aggcuggaugcccaucuua

SEQ ID NO: 88526 - RNA, 22 nt, Human
aggcuggccuauuucuuuaucg

SEQ ID NO: 88527 - RNA, 22 nt, Human
aggcuggcggugacugcucuga

SEQ ID NO: 88528 - RNA, 22 nt, Human
aggcuggcgucaggggcuguac

SEQ ID NO: 88529 - RNA, 22 nt, Human
aggcuggcuuugguagcauggu

SEQ ID NO: 88530 - RNA, 22 nt, Human
aggcugggaaauguagucuucc

SEQ ID NO: 88531 - RNA, 22 nt, Human
aggcugggaaauguauuccagc

SEQ ID NO: 88532 - RNA, 22 nt, Human
aggcugggcuccgcccaacucc

SEQ ID NO: 88533 - RNA, 20 nt, Human
aggcugggguguuuugccca

SEQ ID NO: 88534 - RNA, 22 nt, Human
aggcuggugcuuccuagggcag

SEQ ID NO: 88535 - RNA, 20 nt, Human
aggcugucauuucuggcagg

SEQ ID NO: 88536 - RNA, 21 nt, Human
aggcuguccuuugccagcccu

SEQ ID NO: 88537 - RNA, 22 nt, Human
aggcugucuuccucccucuugg

SEQ ID NO: 88538 - RNA, 19 nt, Human
aggcugugagggaggacuc

SEQ ID NO: 88539 - RNA, 22 nt, Human
aggcugugaguaguucuuguug

SEQ ID NO: 88540 - RNA, 22 nt, Human
aggcugugaucucaugauuugu

SEQ ID NO: 88541 - RNA, 22 nt, Human
aggcugugggacaguuaggaga

SEQ ID NO: 88542 - RNA, 22 nt, Human
aggcuguggugcugaaggaggg

SEQ ID NO: 88543 - RNA, 22 nt, Human
aggcuguggugggcuuugagcc

SEQ ID NO: 88544 - RNA, 22 nt, Human
aggcuguguaaagugcuuuccc

SEQ ID NO: 88545 - RNA, 22 nt, Human
aggcuguguucugcccucuccc

SEQ ID NO: 88546 - RNA, 22 nt, Human
aggcuguugagccccagcaagu

SEQ ID NO: 88547 - RNA, 22 nt, Human
aggcuuaaccugaucacaugag

SEQ ID NO: 88548 - RNA, 22 nt, Human
aggcuuaaugaguuaaaucacu

SEQ ID NO: 88549 - RNA, 22 nt, Human
aggcuuauagcuuauauuuaag

SEQ ID NO: 88550 - RNA, 22 nt, Human
aggcuuauuaauaugauucugc

SEQ ID NO: 88551 - RNA, 20 nt, Human
aggcuucaaccauacaccuu

SEQ ID NO: 88552 - RNA, 22 nt, Human
aggcuucaaggaccugagggaa

SEQ ID NO: 88553 - RNA, 22 nt, Human
aggcuucaagguucuuggcagg

SEQ ID NO: 88554 - RNA, 22 nt, Human
aggcuucaccugcaccugagcu

SEQ ID NO: 88555 - RNA, 19 nt, Human
aggcuucaggccacaugcu

SEQ ID NO: 88556 - RNA, 22 nt, Human
aggcuucagggcuuuugagggu

SEQ ID NO: 88557 - RNA, 23 nt, Human
aggcuucauccauauuuauugcc

SEQ ID NO: 88558 - RNA, 19 nt, Human
aggcuucauccugggcagc

SEQ ID NO: 88559 - RNA, 22 nt, Human
aggcuucuaggaaacuuucugg

SEQ ID NO: 88560 - RNA, 22 nt, Human
aggcuucuaggguuggcagcgg

SEQ ID NO: 88561 - RNA, 22 nt, Human
aggcuucuccacauaaaguuac

SEQ ID NO: 88562 - RNA, 22 nt, Human
aggcuucugcuguauuaacacu

SEQ ID NO: 88563 - RNA, 22 nt, Human
aggcuucugggauucccuuggu

SEQ ID NO: 88564 - RNA, 22 nt, Human
aggcuucugugagcucauacaa

SEQ ID NO: 88565 - RNA, 22 nt, Human
agcccugcauaaaucaguuggu

SEQ ID NO: 88566 - RNA, 16 nt, Human
agcccugccguguacu

SEQ ID NO: 88567 - RNA, 23 nt, Human
agcccugcugagacccagcuccc

SEQ ID NO: 88568 - RNA, 22 nt, Human
agcccugcugccugaauuagcu

SEQ ID NO: 88569 - RNA, 22 nt, Human
agcccuggaagccacaguccua

SEQ ID NO: 88570 - RNA, 22 nt, Human
agcccuggcccggcugugcuuu

SEQ ID NO: 88571 - RNA, 22 nt, Human
agcccugggaggccagcuugua

SEQ ID NO: 88572 - RNA, 22 nt, Human
agcccuggggcuggugcuuacc

SEQ ID NO: 88573 - RNA, 22 nt, Human
agcccugguagccugcugccau

SEQ ID NO: 88574 - RNA, 22 nt, Human
agcccugucucucacuccaggu

SEQ ID NO: 88575 - RNA, 22 nt, Human
agcccuguuuaugccacaucau

SEQ ID NO: 88576 - RNA, 21 nt, Human
agcccuuaggacauaagagag

SEQ ID NO: 88577 - RNA, 22 nt, Human
agcccuucaaccugccuacucc

SEQ ID NO: 88578 - RNA, 22 nt, Human
agccgagcucugagcagggccu

SEQ ID NO: 88579 - RNA, 22 nt, Human
agccuaggguucugaugucacu

SEQ ID NO: 88580 - RNA, 22 nt, Human
agccuauuccaggaugagcuca

SEQ ID NO: 88581 - RNA, 22 nt, Human
agccucagggcucugcgcagac

SEQ ID NO: 88582 - RNA, 22 nt, Human
agccucagugucaccaucuacc

SEQ ID NO: 88583 - RNA, 22 nt, Human
agccuccaucccaugcacaaag

SEQ ID NO: 88584 - RNA, 22 nt, Human
agccucccuaugcaccuucagg

SEQ ID NO: 88585 - RNA, 22 nt, Human
agccucuccagagccuggcaga

SEQ ID NO: 88586 - RNA, 22 nt, Human
agccucucuguuagucacuggg

SEQ ID NO: 88587 - RNA, 22 nt, Human
agccucucuuaucccuucaaag

SEQ ID NO: 88588 - RNA, 22 nt, Human
agccucugacugucagcaaggu

SEQ ID NO: 88589 - RNA, 22 nt, Human
agccucugauggcucccaagga

SEQ ID NO: 88590 - RNA, 22 nt, Human
agccucugcacgggcacgggug

SEQ ID NO: 88591 - RNA, 22 nt, Human
agccucugggggagcugggagc

SEQ ID NO: 88592 - RNA, 22 nt, Human
agccucugucaagcuuuucaaa

SEQ ID NO: 88593 - RNA, 22 nt, Human
agccucuuauucuccaggacuu

SEQ ID NO: 88594 - RNA, 23 nt, Human
agccucuuuucuccugcccugca

SEQ ID NO: 88595 - RNA, 22 nt, Human
agccugagagccaagcugugca

SEQ ID NO: 88596 - RNA, 22 nt, Human
agccugcuuccucagggaacaa

SEQ ID NO: 88597 - RNA, 22 nt, Human
agccuggaagaaccugaagucu

SEQ ID NO: 88598 - RNA, 22 nt, Human
agccuggagaggcgccauacac

SEQ ID NO: 88599 - RNA, 22 nt, Human
agccuggagcuugaguuaugag

SEQ ID NO: 88600 - RNA, 22 nt, Human
agccuggaguucccaggagaag

SEQ ID NO: 88601 - RNA, 22 nt, Human
agccuggauucgugcauccaca

SEQ ID NO: 88602 - RNA, 22 nt, Human
agccuggccacucagggccuga

SEQ ID NO: 88603 - RNA, 21 nt, Human
agccuggcccagggggaggcu

SEQ ID NO: 88604 - RNA, 22 nt, Human
agccuggcuuagcucucucacu

SEQ ID NO: 88605 - RNA, 17 nt, Human
agccugggaaggaguga

SEQ ID NO: 88606 - RNA, 22 nt, Human
agccugggcaacaacacagcga

SEQ ID NO: 88607 - RNA, 22 nt, Human
agccugggcaacuccauucacu

SEQ ID NO: 88608 - RNA, 22 nt, Human
agccugggcccugccucuucuc

SEQ ID NO: 88609 - RNA, 22 nt, Human
agccuggggcacuucuccaaac

SEQ ID NO: 88610 - RNA, 22 nt, Human
agccuguccagaggacagggcu

SEQ ID NO: 88611 - RNA, 22 nt, Human
agccugugacauugacuaugaa

SEQ ID NO: 88612 - RNA, 22 nt, Human
agccuguguccucaucugcagc

SEQ ID NO: 88613 - RNA, 22 nt, Human
agccuuagauaaaugcuagcuc

SEQ ID NO: 88614 - RNA, 22 nt, Human
agccuucuaggaugucaucugc

SEQ ID NO: 88615 - RNA, 22 nt, Human
agccuucucugaaauucuguuu

SEQ ID NO: 88616 - RNA, 22 nt, Human
agccuugaaccaauuguuuagc

SEQ ID NO: 88617 - RNA, 22 nt, Human
agccuugaguucaagugcuggc

SEQ ID NO: 88618 - RNA, 22 nt, Human
agccacaugagugagccaucuu

SEQ ID NO: 88619 - RNA, 22 nt, Human
agccacccauucccgagcccua

SEQ ID NO: 88620 - RNA, 20 nt, Human
agccaccucauuucccuacc

SEQ ID NO: 88621 - RNA, 22 nt, Human
agccaccucuaucuugggcucc

SEQ ID NO: 88622 - RNA, 22 nt, Human
agccaccucugugcaggccucg

SEQ ID NO: 88623 - RNA, 22 nt, Human
agccaccuucuccaaggccuag

SEQ ID NO: 88624 - RNA, 22 nt, Human
agccacucagugcuguauugac

SEQ ID NO: 88625 - RNA, 22 nt, Human
agccacugcccuuagccauuug

SEQ ID NO: 88626 - RNA, 22 nt, Human
agccacuggccugggcagcucu

SEQ ID NO: 88627 - RNA, 22 nt, Human
agccacugguaaacugguagga

SEQ ID NO: 88628 - RNA, 22 nt, Human
agccacuguaaggggaauugcc

SEQ ID NO: 88629 - RNA, 19 nt, Human
agccagaacuaguguuucu

SEQ ID NO: 88630 - RNA, 20 nt, Human
agccagaagaaggcuggaga

SEQ ID NO: 88631 - RNA, 22 nt, Human
agccagagaguguuggagaugu

SEQ ID NO: 88632 - RNA, 22 nt, Human
agccagagauccaucccuagga

SEQ ID NO: 88633 - RNA, 22 nt, Human
agccagagcagggaauuggaca

SEQ ID NO: 88634 - RNA, 22 nt, Human
agccagagcugaugucauucuc

SEQ ID NO: 88635 - RNA, 22 nt, Human
agccagaguugaaugugagucu

SEQ ID NO: 88636 - RNA, 23 nt, Human
agccagauuucuuugcagggcag

SEQ ID NO: 88637 - RNA, 22 nt, Human
agccagcaggaacgucuagguu

SEQ ID NO: 88638 - RNA, 19 nt, Human
agccagcaggccucugagc

SEQ ID NO: 88639 - RNA, 22 nt, Human
agccagcagggcuuagaggaca

SEQ ID NO: 88640 - RNA, 22 nt, Human
agccagcaucuugcuucuugag

SEQ ID NO: 88641 - RNA, 20 nt, Human
agccagccacuuccugcucc

SEQ ID NO: 88642 - RNA, 22 nt, Human
agccagccgggggaccacagug

SEQ ID NO: 88643 - RNA, 22 nt, Human
agccagcuaccggggcuccugg

SEQ ID NO: 88644 - RNA, 22 nt, Human
agccagcugccuuucacaucug

SEQ ID NO: 88645 - RNA, 22 nt, Human
agccagcuguccucccuuuccu

SEQ ID NO: 88646 - RNA, 22 nt, Human
agccaggacaucucuagcugcu

SEQ ID NO: 88647 - RNA, 21 nt, Human
agccaggcaagcacccccacu

SEQ ID NO: 88648 - RNA, 17 nt, Human
agccaggcauaugaagu

SEQ ID NO: 88649 - RNA, 22 nt, Human
agccaggccuuagggagaggca

SEQ ID NO: 88650 - RNA, 22 nt, Human
agccaggcggggcagguuuccu

SEQ ID NO: 88651 - RNA, 22 nt, Human
agccaggcuaaaugagccauga

SEQ ID NO: 88652 - RNA, 20 nt, Human
agccaggcucaagcuccccc

SEQ ID NO: 88653 - RNA, 22 nt, Human
agccaggcucaaggccugcucc

SEQ ID NO: 88654 - RNA, 22 nt, Human
agccagggaagaggccuaccuc

SEQ ID NO: 88655 - RNA, 22 nt, Human
agccagggaaggauaacaagaa

SEQ ID NO: 88656 - RNA, 22 nt, Human
agccagggaggauuacacccca

SEQ ID NO: 88657 - RNA, 23 nt, Human
agccagggcacugguggagauug

SEQ ID NO: 88658 - RNA, 22 nt, Human
agccagggcugcgagcagacag

SEQ ID NO: 88659 - RNA, 23 nt, Human
agccaggggaucuugggcccugg

SEQ ID NO: 88660 - RNA, 22 nt, Human
agccaggggauucaucagggac

SEQ ID NO: 88661 - RNA, 22 nt, Human
agccagugcaacagcagugaag

SEQ ID NO: 88662 - RNA, 22 nt, Human
agccagugccagucaugccugc

SEQ ID NO: 88663 - RNA, 22 nt, Human
agccaguguuaagugacugguu

SEQ ID NO: 88664 - RNA, 22 nt, Human
agccaguuuaagcaggaggggu

SEQ ID NO: 88665 - RNA, 21 nt, Human
agccauccugaauggugccau

SEQ ID NO: 88666 - RNA, 22 nt, Human
agccaugcaccuuacucuugcu

SEQ ID NO: 88667 - RNA, 22 nt, Human
agccaugucacauauggucauc

SEQ ID NO: 88668 - RNA, 22 nt, Human
agccaugugucuuuauucuguu

SEQ ID NO: 88669 - RNA, 22 nt, Human
agcccaaaccugcgagcagagc

SEQ ID NO: 88670 - RNA, 22 nt, Human
agcccaagcauaggagggaggc

SEQ ID NO: 88671 - RNA, 22 nt, Human
agcccagagccucuccuaaagg

SEQ ID NO: 88672 - RNA, 22 nt, Human
agcccagagggguuugaggacu

SEQ ID NO: 88673 - RNA, 22 nt, Human
agcccagcaaagggagguucag

SEQ ID NO: 88674 - RNA, 22 nt, Human
agcccagcaguaagauuagaga

SEQ ID NO: 88675 - RNA, 22 nt, Human
agcccagcuccuccacagaaua

SEQ ID NO: 88676 - RNA, 22 nt, Human
agcccagcugcuauguaccugg

SEQ ID NO: 88677 - RNA, 22 nt, Human
agcccagcuuccuucugucucu

SEQ ID NO: 88678 - RNA, 22 nt, Human
agcccagcuuugaaccauauca

SEQ ID NO: 88679 - RNA, 22 nt, Human
agcccaggcagagggaugcuug

SEQ ID NO: 88680 - RNA, 22 nt, Human
agcccagggacagggcggaugu

SEQ ID NO: 88681 - RNA, 22 nt, Human
agcccagggcuaauaggaacca

SEQ ID NO: 88682 - RNA, 22 nt, Human
agcccagguucuaaagccaaac

SEQ ID NO: 88683 - RNA, 22 nt, Human
agcccagugggccgaggcgggg

SEQ ID NO: 88684 - RNA, 22 nt, Human
agcccuggaccuuagcccccac

SEQ ID NO: 88685 - RNA, 22 nt, Human
agcccugggcaccugugagggg

SEQ ID NO: 88686 - RNA, 22 nt, Human
agcccuggggcuggucuuggaa

SEQ ID NO: 88687 - RNA, 22 nt, Human
agcccuggggugcagaaccaug

SEQ ID NO: 88688 - RNA, 22 nt, Human
agcccuguagauuuaggagagu

SEQ ID NO: 88689 - RNA, 22 nt, Human
agcccuguucuguuuuaguagc

SEQ ID NO: 88690 - RNA, 22 nt, Human
agcccuuaguacauuucucaag

SEQ ID NO: 88691 - RNA, 22 nt, Human
agcccuugcagacugucagcau

SEQ ID NO: 88692 - RNA, 22 nt, Human
agcccuugguauuuuccgaucc

SEQ ID NO: 88693 - RNA, 22 nt, Human
agccggccauguggucuugugc

SEQ ID NO: 88694 - RNA, 22 nt, Human
agccuaaugcuuuucccaaagu

SEQ ID NO: 88695 - RNA, 22 nt, Human
agccuagaagaaguggcuacuu

SEQ ID NO: 88696 - RNA, 22 nt, Human
agccuaggagguuggggcugca

SEQ ID NO: 88697 - RNA, 22 nt, Human
agccuaggggguccugggccac

SEQ ID NO: 88698 - RNA, 22 nt, Human
agccuaggucugggucuagcag

SEQ ID NO: 88699 - RNA, 22 nt, Human
agccuagguuuccgauucucuu

SEQ ID NO: 88700 - RNA, 22 nt, Human
agccuauucaucugaucuugaa

SEQ ID NO: 88701 - RNA, 22 nt, Human
agccucagcacgcagcucugug

SEQ ID NO: 88702 - RNA, 22 nt, Human
agccucaguuucaggccuccuc

SEQ ID NO: 88703 - RNA, 22 nt, Human
agccuccaaaugucaggucccg

SEQ ID NO: 88704 - RNA, 22 nt, Human
agccucucacugucacccuccc

SEQ ID NO: 88705 - RNA, 22 nt, Human
agccucucagagugcugggauu

SEQ ID NO: 88706 - RNA, 22 nt, Human
agccucucugaugugacagcua

SEQ ID NO: 88707 - RNA, 22 nt, Human
agccucugugacucacagguca

SEQ ID NO: 88708 - RNA, 21 nt, Human
agccugaaucccaccaguuca

SEQ ID NO: 88709 - RNA, 22 nt, Human
agccugagcugccugccgccuc

SEQ ID NO: 88710 - RNA, 22 nt, Human
agccugauuuugauaauuauau

SEQ ID NO: 88711 - RNA, 22 nt, Human
agccugcaggaugggcagcacc

SEQ ID NO: 88712 - RNA, 22 nt, Human
agccugccucagacucaggaua

SEQ ID NO: 88713 - RNA, 22 nt, Human
agccuggacagcuacggagaac

SEQ ID NO: 88714 - RNA, 22 nt, Human
agccuggaggaggaguugagca

SEQ ID NO: 88715 - RNA, 22 nt, Human
agccuggaggccaggagacagu

SEQ ID NO: 88716 - RNA, 18 nt, Human
agccuggaggguugaagu

SEQ ID NO: 88717 - RNA, 22 nt, Human
agccuggagguaaugaggaaac

SEQ ID NO: 88718 - RNA, 22 nt, Human
agccuggauccuaggcucagcu

SEQ ID NO: 88719 - RNA, 23 nt, Human
agccuggcaccugcagaucggag

SEQ ID NO: 88720 - RNA, 22 nt, Human
agccuggcggucgucggucagg

SEQ ID NO: 88721 - RNA, 22 nt, Human
agccuggcugggaagagccucu

SEQ ID NO: 88722 - RNA, 22 nt, Human
agccuggcuguaaccucauggu

SEQ ID NO: 88723 - RNA, 22 nt, Human
agccugggggcgcagaaaccgg

SEQ ID NO: 88724 - RNA, 22 nt, Human
agccugguguggggcugcagag

SEQ ID NO: 88725 - RNA, 22 nt, Human
agccugucugucuccaaagcug

SEQ ID NO: 88726 - RNA, 22 nt, Human
agccugugaaaucucugccacu

SEQ ID NO: 88727 - RNA, 22 nt, Human
aaacuucuugcugcauuuucug

SEQ ID NO: 88728 - RNA, 22 nt, Human
aaacuugaacccagcucaggcu

SEQ ID NO: 88729 - RNA, 22 nt, Human
aaacuugaggcaaugaaggugu

SEQ ID NO: 88730 - RNA, 20 nt, Human
aaacuugauggcauagaaua

SEQ ID NO: 88731 - RNA, 22 nt, Human
aaacuugcgucaugucaugaaa

SEQ ID NO: 88732 - RNA, 22 nt, Human
aaacuuguucucuugugccuau

SEQ ID NO: 88733 - RNA, 22 nt, Human
aaacuuucauguaucucuuuca

SEQ ID NO: 88734 - RNA, 22 nt, Human
aaacuuuuccugcucuuguccu

SEQ ID NO: 88735 - RNA, 22 nt, Human
aaacuuuuuauucuaaugucua

SEQ ID NO: 88736 - RNA, 22 nt, Human
aaacuuuuucuuagguaugucu

SEQ ID NO: 88737 - RNA, 21 nt, Human
aaagaaaucucccauugguag

SEQ ID NO: 88738 - RNA, 22 nt, Human
aaagaacaaauuagcuguuuua

SEQ ID NO: 88739 - RNA, 21 nt, Human
aaagaacaggcagauguucuu

SEQ ID NO: 88740 - RNA, 22 nt, Human
aaagaacuaaugugcaagguuu

SEQ ID NO: 88741 - RNA, 22 nt, Human
aaagaacuaccuguaugauauu

SEQ ID NO: 88742 - RNA, 22 nt, Human
aaagaagcauaggcuagacuuc

SEQ ID NO: 88743 - RNA, 22 nt, Human
aaagaaggaccuggaggaggau

SEQ ID NO: 88744 - RNA, 22 nt, Human
aaagaaggggucuacauccaau

SEQ ID NO: 88745 - RNA, 22 nt, Human
aaagaauacccugggucauaaa

SEQ ID NO: 88746 - RNA, 22 nt, Human
aaagaauacuccuuuugccuug

SEQ ID NO: 88747 - RNA, 22 nt, Human
aaagaaucagaagucucaaaca

SEQ ID NO: 88748 - RNA, 22 nt, Human
aaagaaucguguguaguuugaa

SEQ ID NO: 88749 - RNA, 22 nt, Human
aaagacacaaauguagaccaaa

SEQ ID NO: 88750 - RNA, 22 nt, Human
aaagacacauaugcuuaaccca

SEQ ID NO: 88751 - RNA, 22 nt, Human
aaagacagauggcaaggaugau

SEQ ID NO: 88752 - RNA, 22 nt, Human
aaagacauuagauuaacguaca

SEQ ID NO: 88753 - RNA, 22 nt, Human
aaagacuaaaugaaugagcuca

SEQ ID NO: 88754 - RNA, 22 nt, Human
aaagacuagcauuuauauguac

SEQ ID NO: 88755 - RNA, 22 nt, Human
aaagacucaauuguucccuaau

SEQ ID NO: 88756 - RNA, 22 nt, Human
aaagacugaggggaaagugaug

SEQ ID NO: 88757 - RNA, 22 nt, Human
aaagacuuggcuuaugauuugc

SEQ ID NO: 88758 - RNA, 22 nt, Human
aaagacuugggugaaguaauuu

SEQ ID NO: 88759 - RNA, 22 nt, Human
aaagacuuuagguuagaggcau

SEQ ID NO: 88760 - RNA, 22 nt, Human
aaagacuuucaccuagcaaaga

SEQ ID NO: 88761 - RNA, 22 nt, Human
aaagagaaacuuagaagccuga

SEQ ID NO: 88762 - RNA, 22 nt, Human
aaagagacaccaaagacucuag

SEQ ID NO: 88763 - RNA, 22 nt, Human
aaagagccagcuaccucaguuu

SEQ ID NO: 88764 - RNA, 20 nt, Human
aaagagcccuuggagcaggc

SEQ ID NO: 88765 - RNA, 22 nt, Human
aaagagccgcugaugucagccc

SEQ ID NO: 88766 - RNA, 22 nt, Human
aaagagcucuuacucuagugua

SEQ ID NO: 88767 - RNA, 22 nt, Human
aaagagcugggacuuaaagugc

SEQ ID NO: 88768 - RNA, 22 nt, Human
aaagagcuuuagaaaucucaga

SEQ ID NO: 88769 - RNA, 22 nt, Human
aaagagcuuuccacacuaguca

SEQ ID NO: 88770 - RNA, 22 nt, Human
aaagaggcaaucaauguagcaa

SEQ ID NO: 88771 - RNA, 22 nt, Human
aaagagggacaggcgcagacac

SEQ ID NO: 88772 - RNA, 22 nt, Human
aaagaggggacuguuaauucca

SEQ ID NO: 88773 - RNA, 22 nt, Human
aaagagucguguuccagguuug

SEQ ID NO: 88774 - RNA, 22 nt, Human
aaagaguuacacaguuucagaa

SEQ ID NO: 88775 - RNA, 22 nt, Human
aaagaguucuuguagcuuugag

SEQ ID NO: 88776 - RNA, 22 nt, Human
aaagaucagucugaagcaacau

SEQ ID NO: 88777 - RNA, 22 nt, Human
aaagaucauucucugguccaga

SEQ ID NO: 88778 - RNA, 19 nt, Human
aaagaucugggauugagac

SEQ ID NO: 88779 - RNA, 22 nt, Human
aaagaucuguguuaacucaagg

SEQ ID NO: 88780 - RNA, 22 nt, Human
aaagaugaccguaugucagagc

SEQ ID NO: 88781 - RNA, 22 nt, Human
aaagaugaucuacaaguucauu

SEQ ID NO: 88782 - RNA, 22 nt, Human
aaagauggcccaugaucucuug

SEQ ID NO: 88783 - RNA, 22 nt, Human
aaagauguccaaguaaaguuaa

SEQ ID NO: 88784 - RNA, 19 nt, Human
aaagauguccuuuugggcu

SEQ ID NO: 88785 - RNA, 22 nt, Human
aaagauguguaagaaauaaaca

SEQ ID NO: 88786 - RNA, 22 nt, Human
aaagauguuaauagcaccauuu

SEQ ID NO: 88787 - RNA, 23 nt, Human
aaagauguucccaaaguucacgu

SEQ ID NO: 88788 - RNA, 21 nt, Human
aaagauguuucuuuuccucac

SEQ ID NO: 88789 - RNA, 22 nt, Human
aaagauguuuuauaaguuaugg

SEQ ID NO: 88790 - RNA, 22 nt, Human
aaagauuaagguauuguuagcu

SEQ ID NO: 88791 - RNA, 22 nt, Human
aaagauuccuuuauucuccaag

SEQ ID NO: 88792 - RNA, 22 nt, Human
aaagauucgagcgauguauaaa

SEQ ID NO: 88793 - RNA, 22 nt, Human
aaagauuuaagaauaauuugug

SEQ ID NO: 88794 - RNA, 22 nt, Human
aaagauuucacaucccaagccu

SEQ ID NO: 88795 - RNA, 22 nt, Human
aaagauuugaguucugcuuaua

SEQ ID NO: 88796 - RNA, 22 nt, Human
aaagcaagaugcauccgucaag

SEQ ID NO: 88797 - RNA, 22 nt, Human
aaagcaagucucuacaaaguac

SEQ ID NO: 88798 - RNA, 22 nt, Human
aaagcaauaguaaugguaauag

SEQ ID NO: 88799 - RNA, 22 nt, Human
aaagcaaugaugguagacacgu

SEQ ID NO: 88800 - RNA, 22 nt, Human
aaagcaauugugguuuuuguca

SEQ ID NO: 88801 - RNA, 22 nt, Human
aaagcacuucaggagcaguuug

SEQ ID NO: 88802 - RNA, 22 nt, Human
aaagcagaggugauaugacuua

SEQ ID NO: 88803 - RNA, 22 nt, Human
aaagcagagguugcagugagcu

SEQ ID NO: 88804 - RNA, 22 nt, Human
aaagcagcaacagcuguuagaa

SEQ ID NO: 88805 - RNA, 22 nt, Human
aaagcagcagcaccugcauuuc

SEQ ID NO: 88806 - RNA, 22 nt, Human
aaagcagccacagagagagcgu

SEQ ID NO: 88807 - RNA, 22 nt, Human
aaagcagcugcucuggccuuga

SEQ ID NO: 88808 - RNA, 22 nt, Human
aaagcaggcagcaggcuggauu

SEQ ID NO: 88809 - RNA, 22 nt, Human
aaagcagggaugaggcuagagg

SEQ ID NO: 88810 - RNA, 22 nt, Human
aaagcagugcaccuuaauugau

SEQ ID NO: 88811 - RNA, 22 nt, Human
aaagcaucagaucugacacuuc

SEQ ID NO: 88812 - RNA, 22 nt, Human
aaagcaugcuacuuuauauagg

SEQ ID NO: 88813 - RNA, 22 nt, Human
aaagcauggcaugaagaacaug

SEQ ID NO: 88814 - RNA, 22 nt, Human
aaagcaugguuaaagacagugg

SEQ ID NO: 88815 - RNA, 22 nt, Human
aaagccacugcauguguaguau

SEQ ID NO: 88816 - RNA, 22 nt, Human
aaagccagagcaagcugucaca

SEQ ID NO: 88817 - RNA, 22 nt, Human
aaagccagaguguguuagagac

SEQ ID NO: 88818 - RNA, 22 nt, Human
aaagccagcucugagcugcacc

SEQ ID NO: 88819 - RNA, 22 nt, Human
aaagccagugguaugagagaaa

SEQ ID NO: 88820 - RNA, 22 nt, Human
aaagccaguucuuuuauauugg

SEQ ID NO: 88821 - RNA, 22 nt, Human
aaagccaguuucuggaaguacc

SEQ ID NO: 88822 - RNA, 22 nt, Human
aaagccaguuugucucuuuaaa

SEQ ID NO: 88823 - RNA, 22 nt, Human
aaagccuggguuccucacuauc

SEQ ID NO: 88824 - RNA, 22 nt, Human
aaagccuucaaguagauguaag

SEQ ID NO: 88825 - RNA, 22 nt, Human
aaagccuugcccgucacuggga

SEQ ID NO: 88826 - RNA, 22 nt, Human
aaagcuagaaggaaauuuuaug

SEQ ID NO: 88827 - RNA, 22 nt, Human
aaagcuauucaacacgaacaug

SEQ ID NO: 88828 - RNA, 22 nt, Human
aaagcuauuuauuacagagaau

SEQ ID NO: 88829 - RNA, 22 nt, Human
aaagcuauuuguuaugagagaa

SEQ ID NO: 88830 - RNA, 22 nt, Human
aaagcucugggaaugcuuaucu

SEQ ID NO: 88831 - RNA, 22 nt, Human
aaagcucuuaaugagauuaucc

SEQ ID NO: 88832 - RNA, 22 nt, Human
aaagcugcccagcugccuguuu

SEQ ID NO: 88833 - RNA, 22 nt, Human
aaagcugcccuacacggaagca

SEQ ID NO: 88834 - RNA, 22 nt, Human
aaagcugcccuugugaaacaag

SEQ ID NO: 88835 - RNA, 22 nt, Human
aaagcuggccucucaggcuuua

SEQ ID NO: 88836 - RNA, 22 nt, Human
aaaguggccauccucugcaucg

SEQ ID NO: 88837 - RNA, 21 nt, Human
aaagugguaaggauuauuuug

SEQ ID NO: 88838 - RNA, 22 nt, Human
aaaguggucugcaucccuucug

SEQ ID NO: 88839 - RNA, 22 nt, Human
aaaguguaggcuucaaagaggg

SEQ ID NO: 88840 - RNA, 22 nt, Human
aaaguguggcacaagucacauc

SEQ ID NO: 88841 - RNA, 21 nt, Human
aaaguguguggggaagaagga

SEQ ID NO: 88842 - RNA, 22 nt, Human
aaaguguuaugagaacuaagug

SEQ ID NO: 88843 - RNA, 21 nt, Human
aaaguguucagaccaguucug

SEQ ID NO: 88844 - RNA, 22 nt, Human
aaaguguugaagaaaauguuca

SEQ ID NO: 88845 - RNA, 22 nt, Human
aaaguguuuuugagcuguaguu

SEQ ID NO: 88846 - RNA, 22 nt, Human
aaaguuacacaucuaguaagug

SEQ ID NO: 88847 - RNA, 22 nt, Human
aaaguuacuaucacaaugaaau

SEQ ID NO: 88848 - RNA, 22 nt, Human
aaaguuagacagcaucauuucu

SEQ ID NO: 88849 - RNA, 22 nt, Human
aaaguuaguaaaaugggauaua

SEQ ID NO: 88850 - RNA, 22 nt, Human
aaaguucacuauguagcagcgu

SEQ ID NO: 88851 - RNA, 22 nt, Human
aaaguucuauuggauagugcug

SEQ ID NO: 88852 - RNA, 22 nt, Human
aaaguucugagacugauggcua

SEQ ID NO: 88853 - RNA, 22 nt, Human
aaaguucuggcauuuucugucu

SEQ ID NO: 88854 - RNA, 22 nt, Human
aaaguucuguagugcacugacu

SEQ ID NO: 88855 - RNA, 22 nt, Human
aaaguucuuucucuuauuuggu

SEQ ID NO: 88856 - RNA, 22 nt, Human
aaaguugaguaggguuugggcc

SEQ ID NO: 88857 - RNA, 22 nt, Human
aaaguuggauuucauccucaug

SEQ ID NO: 88858 - RNA, 22 nt, Human
aaaguuguucaguaagaaacuc

SEQ ID NO: 88859 - RNA, 22 nt, Human
aaaguuguuuccuaaggucuaa

SEQ ID NO: 88860 - RNA, 23 nt, Human
aaaguuugaagcaacaguaguug

SEQ ID NO: 88861 - RNA, 22 nt, Human
aaaguuuggauccagcaaaaga

SEQ ID NO: 88862 - RNA, 22 nt, Human
aaaguuugucacuuggcuagaa

SEQ ID NO: 88863 - RNA, 22 nt, Human
aaaguuuguuauaugauaagga

SEQ ID NO: 88864 - RNA, 22 nt, Human
aaaguuuucugccuucauuaga

SEQ ID NO: 88865 - RNA, 22 nt, Human
aaaguuuuuaagcaagacccuu

SEQ ID NO: 88866 - RNA, 22 nt, Human
aaauaaaggaacuguuuuccca

SEQ ID NO: 88867 - RNA, 22 nt, Human
aaauaagaaauucuucuuugca

SEQ ID NO: 88868 - RNA, 22 nt, Human
aaauaaguuagcagauuccagu

SEQ ID NO: 88869 - RNA, 22 nt, Human
aaauaauugaguuggucaauau

SEQ ID NO: 88870 - RNA, 21 nt, Human
aaauacagaaacuuguuuuca

SEQ ID NO: 88871 - RNA, 22 nt, Human
aaauacagaguugcuuaaaagc

SEQ ID NO: 88872 - RNA, 22 nt, Human
aaauacagauuccagggucuua

SEQ ID NO: 88873 - RNA, 22 nt, Human
aaauacauuagacggagaguua

SEQ ID NO: 88874 - RNA, 23 nt, Human
aaauaccugaauuagauauuauc

SEQ ID NO: 88875 - RNA, 22 nt, Human
aaauacgugcacauacauacau

SEQ ID NO: 88876 - RNA, 22 nt, Human
aaauacuagaauucagaguuga

SEQ ID NO: 88877 - RNA, 22 nt, Human
aaauacuauugaccaggucucu

SEQ ID NO: 88878 - RNA, 22 nt, Human
aaauacucucaauaaagaaagu

SEQ ID NO: 88879 - RNA, 22 nt, Human
aaauacugguuuuggagaugcu

SEQ ID NO: 88880 - RNA, 22 nt, Human
aaauacuguagauaauagaguu

SEQ ID NO: 88881 - RNA, 22 nt, Human
aaauacugugaauaaagguuuu

SEQ ID NO: 88882 - RNA, 22 nt, Human
aaauagacacaugcguucauau

SEQ ID NO: 88883 - RNA, 22 nt, Human
aaauagacacuuggacagacaa

SEQ ID NO: 88884 - RNA, 22 nt, Human
aaauagauuuccuagcauugga

SEQ ID NO: 88885 - RNA, 22 nt, Human
aaauagcauuguauuuagcuga

SEQ ID NO: 88886 - RNA, 22 nt, Human
aaauagcuacaugaucucuagg

SEQ ID NO: 88887 - RNA, 22 nt, Human
aaauagcuuuucauaauucuca

SEQ ID NO: 88888 - RNA, 23 nt, Human
aaauaggaguaucuggaucauga

SEQ ID NO: 88889 - RNA, 22 nt, Human
aaauaguuagcccugcauauau

SEQ ID NO: 88890 - RNA, 22 nt, Human
aaagcugggggcccuggucuag

SEQ ID NO: 88891 - RNA, 22 nt, Human
aaagcuuaagguagguacagag

SEQ ID NO: 88892 - RNA, 22 nt, Human
aaagcuuuguaaauaaacaggu

SEQ ID NO: 88893 - RNA, 22 nt, Human
aaaggaagugccacucuucuuc

SEQ ID NO: 88894 - RNA, 20 nt, Human
aaaggaauauaugaaguaua

SEQ ID NO: 88895 - RNA, 22 nt, Human
aaaggaaugagcuucuguuagg

SEQ ID NO: 88896 - RNA, 22 nt, Human
aaaggacuagguguugccaaaa

SEQ ID NO: 88897 - RNA, 22 nt, Human
aaaggacuggauauuaaagagu

SEQ ID NO: 88898 - RNA, 22 nt, Human
aaaggagaguagguuacuccau

SEQ ID NO: 88899 - RNA, 22 nt, Human
aaaggaggaauggagagaugcu

SEQ ID NO: 88900 - RNA, 22 nt, Human
aaaggauuaaauaaaugugcug

SEQ ID NO: 88901 - RNA, 22 nt, Human
aaaggcacaaauucagcauuuu

SEQ ID NO: 88902 - RNA, 22 nt, Human
aaaggcacagaagggaaaccaa

SEQ ID NO: 88903 - RNA, 22 nt, Human
aaaggcacuagaaguuaccuuu

SEQ ID NO: 88904 - RNA, 18 nt, Human
aaaggcagauuacuggga

SEQ ID NO: 88905 - RNA, 23 nt, Human
aaaggcaggccuaggacauauug

SEQ ID NO: 88906 - RNA, 18 nt, Human
aaaggcauauauagaagu

SEQ ID NO: 88907 - RNA, 22 nt, Human
aaaggcauggaacagauucucc

SEQ ID NO: 88908 - RNA, 22 nt, Human
aaaggcaugugcaacuacaaau

SEQ ID NO: 88909 - RNA, 22 nt, Human
aaaggcauuuuaauucuaaaga

SEQ ID NO: 88910 - RNA, 21 nt, Human
aaaggccauaaucacggagca

SEQ ID NO: 88911 - RNA, 22 nt, Human
aaaggccaugguuggaguguuu

SEQ ID NO: 88912 - RNA, 22 nt, Human
aaaggccauuacuugcuuuuag

SEQ ID NO: 88913 - RNA, 22 nt, Human
aaaggcuaguggauucauugau

SEQ ID NO: 88914 - RNA, 23 nt, Human
aaaggcuaucaaaguuuugcuga

SEQ ID NO: 88915 - RNA, 22 nt, Human
aaaggcuauugcugauaauguu

SEQ ID NO: 88916 - RNA, 22 nt, Human
aaaggcucuaacaaggagagag

SEQ ID NO: 88917 - RNA, 22 nt, Human
aaaggcuugguucuuugaugac

SEQ ID NO: 88918 - RNA, 22 nt, Human
aaagggcuuuauaucagugugu

SEQ ID NO: 88919 - RNA, 22 nt, Human
aaagguaacaguuauaaccagg

SEQ ID NO: 88920 - RNA, 22 nt, Human
aaagguaucauguccauacagu

SEQ ID NO: 88921 - RNA, 22 nt, Human
aaagguaugauacugugacaug

SEQ ID NO: 88922 - RNA, 22 nt, Human
aaaggucagacuuaggcugggc

SEQ ID NO: 88923 - RNA, 22 nt, Human
aaaggucuucucaaacauccca

SEQ ID NO: 88924 - RNA, 22 nt, Human
aaaggucuugucuugacagagu

SEQ ID NO: 88925 - RNA, 22 nt, Human
aaaggugccucuuacaaggcuu

SEQ ID NO: 88926 - RNA, 22 nt, Human
aaagguuaauguugucauguua

SEQ ID NO: 88927 - RNA, 22 nt, Human
aaagguuagacagcucugcaua

SEQ ID NO: 88928 - RNA, 22 nt, Human
aaagguuuauugcuaugguugu

SEQ ID NO: 88929 - RNA, 22 nt, Human
aaagguuuccgagcuuuaauuu

SEQ ID NO: 88930 - RNA, 22 nt, Human
aaagguuuuauucugagcucug

SEQ ID NO: 88931 - RNA, 22 nt, Human
aaagguuuucuaggguugaggg

SEQ ID NO: 88932 - RNA, 22 nt, Human
aaagguuuuucagcagggagau

SEQ ID NO: 88933 - RNA, 22 nt, Human
aaaguaagaccaagugaucauu

SEQ ID NO: 88934 - RNA, 22 nt, Human
aaaguacaggaaagccuagcca

SEQ ID NO: 88935 - RNA, 22 nt, Human
aaaguacuaaugaauauuuugc

SEQ ID NO: 88936 - RNA, 22 nt, Human
aaaguacugggauuacaggucu

SEQ ID NO: 88937 - RNA, 22 nt, Human
aaaguacuuugggcuauguuug

SEQ ID NO: 88938 - RNA, 22 nt, Human
aaaguagaggcauugaucaggu

SEQ ID NO: 88939 - RNA, 22 nt, Human
aaaguagauuucucauggcgaa

SEQ ID NO: 88940 - RNA, 22 nt, Human
aaaguagcuuaguugauauuuc

SEQ ID NO: 88941 - RNA, 22 nt, Human
aaaguauauaugcacuuuagaa

SEQ ID NO: 88942 - RNA, 22 nt, Human
aaaguauguuguggcuuuuaaa

SEQ ID NO: 88943 - RNA, 22 nt, Human
aaaguauucuugacuguuuuuc

SEQ ID NO: 88944 - RNA, 22 nt, Human
aaagucacauagcaucacuucu

SEQ ID NO: 88945 - RNA, 22 nt, Human
aagaauuggucacaugcuacaa

SEQ ID NO: 88946 - RNA, 22 nt, Human
aagacaacagagaugacagacu

SEQ ID NO: 88947 - RNA, 22 nt, Human
aagacaagcaucaaaucaggca

SEQ ID NO: 88948 - RNA, 22 nt, Human
aagacaaucuaaggggaauggu

SEQ ID NO: 88949 - RNA, 22 nt, Human
aagacacaauguagcccagcac

SEQ ID NO: 88950 - RNA, 22 nt, Human
aagacacuaagcuuucaggaua

SEQ ID NO: 88951 - RNA, 22 nt, Human
aagacacucauuaucacugguu

SEQ ID NO: 88952 - RNA, 22 nt, Human
aagacacugggggcugcagcca

SEQ ID NO: 88953 - RNA, 22 nt, Human
aagacacuuucuaaauagaagu

SEQ ID NO: 88954 - RNA, 17 nt, Human
aagacagaagccaugag

SEQ ID NO: 88955 - RNA, 22 nt, Human
aagacagaugcaaccugcuagc

SEQ ID NO: 88956 - RNA, 22 nt, Human
aagacaggaacauagcaaaucc

SEQ ID NO: 88957 - RNA, 22 nt, Human
aagacauaaaacagucagcgaa

SEQ ID NO: 88958 - RNA, 22 nt, Human
aagacaucagugaugacauuug

SEQ ID NO: 88959 - RNA, 22 nt, Human
aagacaugcaauuagcaaggaa

SEQ ID NO: 88960 - RNA, 22 nt, Human
aagacauugcaugauaaugcug

SEQ ID NO: 88961 - RNA, 22 nt, Human
aagacauuuaugaaaagugcug

SEQ ID NO: 88962 - RNA, 22 nt, Human
aagacauuuauuugaaucaauu

SEQ ID NO: 88963 - RNA, 22 nt, Human
aagacauuuugaaauuggaagc

SEQ ID NO: 88964 - RNA, 22 nt, Human
aagaccaucacagagacacuug

SEQ ID NO: 88965 - RNA, 22 nt, Human
aagacccuaccccuggagagga

SEQ ID NO: 88966 - RNA, 22 nt, Human
aagaccuaaaauucccucagau

SEQ ID NO: 88967 - RNA, 22 nt, Human
aagaccuugucuaaacauguag

SEQ ID NO: 88968 - RNA, 22 nt, Human
aagacuauaccaucuuaguuac

SEQ ID NO: 88969 - RNA, 22 nt, Human
aagacucaaggaacaacacagu

SEQ ID NO: 88970 - RNA, 22 nt, Human
aagacugaguucaaaucacagc

SEQ ID NO: 88971 - RNA, 22 nt, Human
aagacuguaugagacaauauaa

SEQ ID NO: 88972 - RNA, 22 nt, Human
aagacugucugggacaagauga

SEQ ID NO: 88973 - RNA, 22 nt, Human
aagacugucuuuucugagugac

SEQ ID NO: 88974 - RNA, 22 nt, Human
aagacuuucccucaucagaacg

SEQ ID NO: 88975 - RNA, 22 nt, Human
aagagaacagucaccaugcaca

SEQ ID NO: 88976 - RNA, 22 nt, Human
aagagacaagaauuccaacgcu

SEQ ID NO: 88977 - RNA, 22 nt, Human
aagagacaaugacacuugggag

SEQ ID NO: 88978 - RNA, 22 nt, Human
aagagacuauggugucuaugaa

SEQ ID NO: 88979 - RNA, 22 nt, Human
aagagacuuguccgaaguugua

SEQ ID NO: 88980 - RNA, 22 nt, Human
aagagacuuugcagugucccua

SEQ ID NO: 88981 - RNA, 22 nt, Human
aagagagaacacagcuugggca

SEQ ID NO: 88982 - RNA, 22 nt, Human
aagagagacaauagguagcauu

SEQ ID NO: 88983 - RNA, 22 nt, Human
aagagagagcauucuucuguua

SEQ ID NO: 88984 - RNA, 20 nt, Human
aagagaggaaguuauacuag

SEQ ID NO: 88985 - RNA, 22 nt, Human
aagagagucagucugagcacca

SEQ ID NO: 88986 - RNA, 22 nt, Human
aagagaugcuuuacaucggaug

SEQ ID NO: 88987 - RNA, 22 nt, Human
aagagauuucuguaaaauguaa

SEQ ID NO: 88988 - RNA, 22 nt, Human
aagagcagauuccuaguggagc

SEQ ID NO: 88989 - RNA, 22 nt, Human
aagagcaggcugcuguggagua

SEQ ID NO: 88990 - RNA, 22 nt, Human
aagagcaguguuuuacucagcu

SEQ ID NO: 88991 - RNA, 22 nt, Human
aagagccagcuagugaagaggc

SEQ ID NO: 88992 - RNA, 22 nt, Human
aagagccaggacagauccagcu

SEQ ID NO: 88993 - RNA, 22 nt, Human
aagagccauauaugcagcuaga

SEQ ID NO: 88994 - RNA, 22 nt, Human
aagagccuggcugcuaggcuca

SEQ ID NO: 88995 - RNA, 22 nt, Human
aagagcugauuaagucaugagg

SEQ ID NO: 88996 - RNA, 22 nt, Human
aagagcuggaagugaagauaac

SEQ ID NO: 88997 - RNA, 22 nt, Human
aagagcuggagcugcuacagga

SEQ ID NO: 88998 - RNA, 22 nt, Human
aagagcuggauggaaucuggga

SEQ ID NO: 88999 - RNA, 22 nt, Human
aagagcuggauugugcugcaga

SEQ ID NO: 89000 - RNA, 22 nt, Human
aagagcuggcccaaucugagca

SEQ ID NO: 89001 - RNA, 22 nt, Human
aagagcuguugucugcuuacug

SEQ ID NO: 89002 - RNA, 22 nt, Human
aagaggaaaugauugacuauau

SEQ ID NO: 89003 - RNA, 22 nt, Human
aagaggaacugggggcugaguc

SEQ ID NO: 89004 - RNA, 21 nt, Human
aagaggaagcauuauggcaua

SEQ ID NO: 89005 - RNA, 22 nt, Human
aagaggaauggguguguuuaug

SEQ ID NO: 89006 - RNA, 22 nt, Human
aagaggacuugugaagauguac

SEQ ID NO: 89007 - RNA, 22 nt, Human
aagaggagacuucagcaacuug

SEQ ID NO: 89008 - RNA, 22 nt, Human
aagaggagggcagauucaaggc

SEQ ID NO: 89009 - RNA, 22 nt, Human
aagaggcauaaaauuuauaugg

SEQ ID NO: 89010 - RNA, 22 nt, Human
aagaggccuggaggcagaggug

SEQ ID NO: 89011 - RNA, 22 nt, Human
aagaggcugaaugagaaaguac

SEQ ID NO: 89012 - RNA, 18 nt, Human
aagaggcuguucuguggg

SEQ ID NO: 89013 - RNA, 19 nt, Human
aagagggaaagugcuaugc

SEQ ID NO: 89014 - RNA, 22 nt, Human
aagagggaagucaccuggaggu

SEQ ID NO: 89015 - RNA, 22 nt, Human
aagagguaaccauagcaaccac

SEQ ID NO: 89016 - RNA, 17 nt, Human
aagagguaacuguacua

SEQ ID NO: 89017 - RNA, 21 nt, Human
aagaggucaaauuauaaaugg

SEQ ID NO: 89018 - RNA, 22 nt, Human
aagaggucacacuagguccuag

SEQ ID NO: 89019 - RNA, 22 nt, Human
aagaggugagaagcuacacuua

SEQ ID NO: 89020 - RNA, 22 nt, Human
aagagguggaacagcaauucgu

SEQ ID NO: 89021 - RNA, 22 nt, Human
aagagguuauuguucccagcuu

SEQ ID NO: 89022 - RNA, 22 nt, Human
aagagguucuaauuuaacuauc

SEQ ID NO: 89023 - RNA, 22 nt, Human
aagagguucuccuuggaguggg

SEQ ID NO: 89024 - RNA, 22 nt, Human
aagagguugucugugaugaguu

SEQ ID NO: 89025 - RNA, 22 nt, Human
aagagguuucaugauuuucuua

SEQ ID NO: 89026 - RNA, 22 nt, Human
aagaguaaagcaaagcacuugu

SEQ ID NO: 89027 - RNA, 22 nt, Human
aagaguaaauucaggacuuuaa

SEQ ID NO: 89028 - RNA, 22 nt, Human
aagaguauagcuuuaggauuga

SEQ ID NO: 89029 - RNA, 22 nt, Human
aagagucauagagacauugauu

SEQ ID NO: 89030 - RNA, 22 nt, Human
aagagucccaaaaugauucuua

SEQ ID NO: 89031 - RNA, 20 nt, Human
aagagucuuuacugagcuaa

SEQ ID NO: 89032 - RNA, 21 nt, Human
aagaguggcugaggaggugau

SEQ ID NO: 89033 - RNA, 22 nt, Human
aagagugugagguugugcuuuu

SEQ ID NO: 89034 - RNA, 22 nt, Human
aagaguuauauaauguguaguu

SEQ ID NO: 89035 - RNA, 22 nt, Human
aagaguuuccaguuguggcuca

SEQ ID NO: 89036 - RNA, 22 nt, Human
aagaguuucuuuauuaaccuuu

SEQ ID NO: 89037 - RNA, 22 nt, Human
aagaguuugggcaagucauaaa

SEQ ID NO: 89038 - RNA, 22 nt, Human
aagaguuuucuauaaucuuggc

SEQ ID NO: 89039 - RNA, 22 nt, Human
aagauaaugugucugucuuugc

SEQ ID NO: 89040 - RNA, 22 nt, Human
aacauguaucgcuuuuuaauau

SEQ ID NO: 89041 - RNA, 22 nt, Human
aacaugucuggguauucacaag

SEQ ID NO: 89042 - RNA, 22 nt, Human
aacauguugcuuuaauaauauu

SEQ ID NO: 89043 - RNA, 22 nt, Human
aacauuaauuacagucaaacau

SEQ ID NO: 89044 - RNA, 21 nt, Human
aacauuaguaauuugacuuuu

SEQ ID NO: 89045 - RNA, 16 nt, Human
aacauucauaugagug

SEQ ID NO: 89046 - RNA, 22 nt, Human
aacauucuauuuugcuaaaaca

SEQ ID NO: 89047 - RNA, 22 nt, Human
aacauucugguucuaaaaaccu

SEQ ID NO: 89048 - RNA, 22 nt, Human
aacauucugucaauugaugacc

SEQ ID NO: 89049 - RNA, 22 nt, Human
aacauucuuaagauuugugucu

SEQ ID NO: 89050 - RNA, 22 nt, Human
aacauucuucaaauaucacucu

SEQ ID NO: 89051 - RNA, 22 nt, Human
aacauucuuuagcucuuccugc

SEQ ID NO: 89052 - RNA, 22 nt, Human
aacauugaguuagggagcguau

SEQ ID NO: 89053 - RNA, 22 nt, Human
aacauugaguucuacuuccauu

SEQ ID NO: 89054 - RNA, 22 nt, Human
aacccuggggcugcucugccug

SEQ ID NO: 89055 - RNA, 22 nt, Human
aaccggagugauucccaccucu

SEQ ID NO: 89056 - RNA, 22 nt, Human
aaccguuuuaccauuuguaacu

SEQ ID NO: 89057 - RNA, 22 nt, Human
aaccuaagugcuguugaacguu

SEQ ID NO: 89058 - RNA, 23 nt, Human
aaccuagacuacuuacuaugugg

SEQ ID NO: 89059 - RNA, 22 nt, Human
aaccuaugaacucuuggugugc

SEQ ID NO: 89060 - RNA, 22 nt, Human
aaccucaaacucuugggcuuaa

SEQ ID NO: 89061 - RNA, 22 nt, Human
aaccucuuugugaaugucauga

SEQ ID NO: 89062 - RNA, 23 nt, Human
aaccugaacuagggucuugcaua

SEQ ID NO: 89063 - RNA, 22 nt, Human
aaccugaauuuaauugaaauga

SEQ ID NO: 89064 - RNA, 22 nt, Human
aaccugagcgcguugcuuucua

SEQ ID NO: 89065 - RNA, 22 nt, Human
aaccugagucuuuugauuugcu

SEQ ID NO: 89066 - RNA, 22 nt, Human
aaccuggcccuaaucccaguag

SEQ ID NO: 89067 - RNA, 22 nt, Human
aaccuggcugcaaagaagggga

SEQ ID NO: 89068 - RNA, 22 nt, Human
aaccuguaaauccaaacaaucu

SEQ ID NO: 89069 - RNA, 22 nt, Human
aaccuucacuugcuucauuuga

SEQ ID NO: 89070 - RNA, 22 nt, Human
aaccuugaauacuuaaauacau

SEQ ID NO: 89071 - RNA, 22 nt, Human
aaccuugagggaugagguagug

SEQ ID NO: 89072 - RNA, 22 nt, Human
aacggcuguggcuggcggcagc

SEQ ID NO: 89073 - RNA, 22 nt, Human
aacgucauugauugaugguagu

SEQ ID NO: 89074 - RNA, 23 nt, Human
aacguccucaacaggauugcacc

SEQ ID NO: 89075 - RNA, 22 nt, Human
aacguuuuaucgugugcucuuc

SEQ ID NO: 89076 - RNA, 18 nt, Human
aacuaaagaucuuuaagc

SEQ ID NO: 89077 - RNA, 22 nt, Human
aacuaaaguaaccaaggauauc

SEQ ID NO: 89078 - RNA, 22 nt, Human
aacuaaaucuggcauuuagagc

SEQ ID NO: 89079 - RNA, 21 nt, Human
aacuaaggaacugaaaaaugg

SEQ ID NO: 89080 - RNA, 21 nt, Human
aacuacaguuguuccuucauu

SEQ ID NO: 89081 - RNA, 22 nt, Human
aacuacauuguccuuucugaag

SEQ ID NO: 89082 - RNA, 23 nt, Human
aacuaccacaacucuugagaugc

SEQ ID NO: 89083 - RNA, 22 nt, Human
aacuacuauucuuuuccaaacu

SEQ ID NO: 89084 - RNA, 22 nt, Human
aacuagaaccacuuguauuucc

SEQ ID NO: 89085 - RNA, 22 nt, Human
aacuagcagcuaagacauaauu

SEQ ID NO: 89086 - RNA, 22 nt, Human
aacuaguuuagcuuuuuaagac

SEQ ID NO: 89087 - RNA, 22 nt, Human
aacuaguuuuagcucuagcaac

SEQ ID NO: 89088 - RNA, 22 nt, Human
aacuauacucuguaaaugugcu

SEQ ID NO: 89089 - RNA, 22 nt, Human
aacuaucacaaacagagugucu

SEQ ID NO: 89090 - RNA, 21 nt, Human
aacuauggaggaaauaagucc

SEQ ID NO: 89091 - RNA, 22 nt, Human
aacuaugguauucugauguuuc

SEQ ID NO: 89092 - RNA, 22 nt, Human
aacuauguuaauaaguuucauu

SEQ ID NO: 89093 - RNA, 22 nt, Human
aacuauucuguggacucuuaua

SEQ ID NO: 89094 - RNA, 22 nt, Human
aacucacacaaguauugccugc

SEQ ID NO: 89095 - RNA, 22 nt, Human
aacucacagcuguuuggauuag

SEQ ID NO: 89096 - RNA, 22 nt, Human
aacucagaauagggugcagggc

SEQ ID NO: 89097 - RNA, 22 nt, Human
aacucagauaugauagcaggag

SEQ ID NO: 89098 - RNA, 22 nt, Human
aacucagucauaaagcgaaugc

SEQ ID NO: 89099 - RNA, 22 nt, Human
aacucaguguguuucuuaguau

SEQ ID NO: 89100 - RNA, 22 nt, Human
aacucaguuacauauuagaaua

SEQ ID NO: 89101 - RNA, 22 nt, Human
aacuccagcucacacagugacc

SEQ ID NO: 89102 - RNA, 22 nt, Human
aacuccuaugacccacugaacu

SEQ ID NO: 89103 - RNA, 22 nt, Human
aacuccuuaaugcauuucagag

SEQ ID NO: 89104 - RNA, 22 nt, Human
aacucuagugcuccuuggagga

SEQ ID NO: 89105 - RNA, 22 nt, Human
aacucugcagugacuuauaaag

SEQ ID NO: 89106 - RNA, 22 nt, Human
aacucugccagguuucaggagc

SEQ ID NO: 89107 - RNA, 22 nt, Human
aacucugcuuauaguuugucca

SEQ ID NO: 89108 - RNA, 22 nt, Human
aacucuuuggucucaggaaagg

SEQ ID NO: 89109 - RNA, 22 nt, Human
aacucuuuuuuuaaguguagcc

SEQ ID NO: 89110 - RNA, 22 nt, Human
aacugaaacuuaggaaguaauc

SEQ ID NO: 89111 - RNA, 22 nt, Human
aacugaacagaacucagagauu

SEQ ID NO: 89112 - RNA, 20 nt, Human
aacugagaguucaggaggag

SEQ ID NO: 89113 - RNA, 22 nt, Human
aacugagccccugcacuuguga

SEQ ID NO: 89114 - RNA, 22 nt, Human
aacugcaaaauaaucaaguugu

SEQ ID NO: 89115 - RNA, 22 nt, Human
aacugcaagaguaaaugucuag

SEQ ID NO: 89116 - RNA, 22 nt, Human
aacugcaaguggggcuugucau

SEQ ID NO: 89117 - RNA, 22 nt, Human
aacugcaauaacuugugcacca

SEQ ID NO: 89118 - RNA, 22 nt, Human
aacugcagagaacaucuggguu

SEQ ID NO: 89119 - RNA, 22 nt, Human
aacugcaguuacuuuugcacca

SEQ ID NO: 89120 - RNA, 22 nt, Human
aacugcauuuaacaaauacucu

SEQ ID NO: 89121 - RNA, 22 nt, Human
aacugcuaacugguuugauacu

SEQ ID NO: 89122 - RNA, 22 nt, Human
aacugcuuugugagcuuucugg

SEQ ID NO: 89123 - RNA, 22 nt, Human
aacugcuuuuugaucucaggag

SEQ ID NO: 89124 - RNA, 22 nt, Human
aacuggaauagcacaggaaaag

SEQ ID NO: 89125 - RNA, 22 nt, Human
aacuggaucaguugagggaggc

SEQ ID NO: 89126 - RNA, 22 nt, Human
aacuggauuaacuggcucaaau

SEQ ID NO: 89127 - RNA, 22 nt, Human
aacuggauuuugaugagcaguu

SEQ ID NO: 89128 - RNA, 22 nt, Human
aacugguagcugauuaaguaua

SEQ ID NO: 89129 - RNA, 21 nt, Human
aacugguucaauucaacuaga

SEQ ID NO: 89130 - RNA, 22 nt, Human
aacuguaagagaauaaaugugu

SEQ ID NO: 89131 - RNA, 22 nt, Human
aacuguaauuuuuacauaguaa

SEQ ID NO: 89132 - RNA, 22 nt, Human
aacuguagcaaagaacagcucu

SEQ ID NO: 89133 - RNA, 22 nt, Human
aacugucuugccuacucagcau

SEQ ID NO: 89134 - RNA, 22 nt, Human
aacugugggagaaggcgaugug

SEQ ID NO: 89135 - RNA, 22 nt, Human
aacugugggaugcauuaauuca

SEQ ID NO: 89136 - RNA, 22 nt, Human
aacuguguccuuagcucucacu

SEQ ID NO: 89137 - RNA, 22 nt, Human
aacuguuggaggauuauuuugc

SEQ ID NO: 89138 - RNA, 22 nt, Human
aacuguuucagaaauauuguug

SEQ ID NO: 89139 - RNA, 22 nt, Human
aacuguuuuucacgugucucau

SEQ ID NO: 89140 - RNA, 22 nt, Human
aacuguuuuuuacuagaggacu

SEQ ID NO: 89141 - RNA, 22 nt, Human
aacuuaaacccacucauguaga

SEQ ID NO: 89142 - RNA, 22 nt, Human
aacuuauugaacauucucgaau

SEQ ID NO: 89143 - RNA, 22 nt, Human
aacuucaagcuucgucccuucg

SEQ ID NO: 89144 - RNA, 22 nt, Human
aacuucagagcugugugguuug

SEQ ID NO: 89145 - RNA, 22 nt, Human
aacuucauggguucaaagcugg

SEQ ID NO: 89146 - RNA, 22 nt, Human
aacuuccaggccuugaauuauu

SEQ ID NO: 89147 - RNA, 22 nt, Human
aacuuccuucuaguucauaugu

SEQ ID NO: 89148 - RNA, 22 nt, Human
aacuucuaaucuguacaguuuu

SEQ ID NO: 89149 - RNA, 22 nt, Human
aacuucugggcuguccaaaacu

SEQ ID NO: 89150 - RNA, 22 nt, Human
aacuugaaccacagaagcugcc

SEQ ID NO: 89151 - RNA, 22 nt, Human
aacuugaauucugccauucaga

SEQ ID NO: 89152 - RNA, 22 nt, Human
aacuugcuucaacuuauuucac

SEQ ID NO: 89153 - RNA, 22 nt, Human
aacuuggcuaccagcguuaaau

SEQ ID NO: 89154 - RNA, 22 nt, Human
aacuuguaaugaaaggcaauag

SEQ ID NO: 89155 - RNA, 20 nt, Human
aacuuguucuaccuguuuca

SEQ ID NO: 89156 - RNA, 22 nt, Human
aacuuuaaagaggaggcuuggg

SEQ ID NO: 89157 - RNA, 22 nt, Human
aacugcauuagcuaacgugagu

SEQ ID NO: 89158 - RNA, 22 nt, Human
aacugcauucagaaagcucacu

SEQ ID NO: 89159 - RNA, 22 nt, Human
aacugcauuguacuaaacuugu

SEQ ID NO: 89160 - RNA, 22 nt, Human
aacugcucauuugagaguaugc

SEQ ID NO: 89161 - RNA, 22 nt, Human
aacugcuguggccuaguacuua

SEQ ID NO: 89162 - RNA, 21 nt, Human
aacugcuucccaucuuagggc

SEQ ID NO: 89163 - RNA, 22 nt, Human
aaguguuuccgggagacuuggu

SEQ ID NO: 89164 - RNA, 22 nt, Human
aaguuacacagaguuggaggcu

SEQ ID NO: 89165 - RNA, 22 nt, Human
aaguuacaguuacagaauggag

SEQ ID NO: 89166 - RNA, 22 nt, Human
aaguuagaaauaagggcucucc

SEQ ID NO: 89167 - RNA, 23 nt, Human
aaguuaguuucaauaaagcaauu

SEQ ID NO: 89168 - RNA, 22 nt, Human
aaguuauugcagcaauccaagu

SEQ ID NO: 89169 - RNA, 22 nt, Human
aaguuauuuuucaagauccuuu

SEQ ID NO: 89170 - RNA, 22 nt, Human
aaguucaagagugacauauuag

SEQ ID NO: 89171 - RNA, 22 nt, Human
aaguucaagaucaagguuccag

SEQ ID NO: 89172 - RNA, 22 nt, Human
aaguucaaggaagccuccaguu

SEQ ID NO: 89173 - RNA, 22 nt, Human
aaguucacagaagauuccaauu

SEQ ID NO: 89174 - RNA, 22 nt, Human
aaguuccugggccaaguccagg

SEQ ID NO: 89175 - RNA, 22 nt, Human
aaguuccuuagccuuagggcuu

SEQ ID NO: 89176 - RNA, 22 nt, Human
aaguucguaggugagcugcugc

SEQ ID NO: 89177 - RNA, 22 nt, Human
aaguucuaacaggaggucucuu

SEQ ID NO: 89178 - RNA, 22 nt, Human
aaguucuaaggugcauuauucu

SEQ ID NO: 89179 - RNA, 22 nt, Human
aaguucuaugaaucuacuccaa

SEQ ID NO: 89180 - RNA, 22 nt, Human
aaguucuauugucacuuuauua

SEQ ID NO: 89181 - RNA, 22 nt, Human
aaguucugggguaaugagaauu

SEQ ID NO: 89182 - RNA, 23 nt, Human
aaguucuuagguugauacuaaug

SEQ ID NO: 89183 - RNA, 23 nt, Human
aaguucuuuuagaugucuucgug

SEQ ID NO: 89184 - RNA, 22 nt, Human
aaguugauagcauguuaagcuc

SEQ ID NO: 89185 - RNA, 20 nt, Human
aaguugcagagaguugucuu

SEQ ID NO: 89186 - RNA, 21 nt, Human
aaguugucucuuuugguuccu

SEQ ID NO: 89187 - RNA, 22 nt, Human
aaguuguuguugagguggguaa

SEQ ID NO: 89188 - RNA, 22 nt, Human
aaguuuaagguggaaguggugg

SEQ ID NO: 89189 - RNA, 22 nt, Human
aaguuuaggccaaauuagauuu

SEQ ID NO: 89190 - RNA, 22 nt, Human
aaguuuaguauuagggaaaagu

SEQ ID NO: 89191 - RNA, 22 nt, Human
aaguuucaugauguaauuauug

SEQ ID NO: 89192 - RNA, 22 nt, Human
aaguuucuggaccuuaccugcu

SEQ ID NO: 89193 - RNA, 22 nt, Human
aaguuugagagccuuuaguaua

SEQ ID NO: 89194 - RNA, 20 nt, Human
aaguuugccccaggaaauug

SEQ ID NO: 89195 - RNA, 20 nt, Human
aaguuuggagucaggagacc

SEQ ID NO: 89196 - RNA, 22 nt, Human
aaguacuucuagauggauaauc

SEQ ID NO: 89197 - RNA, 22 nt, Human
aaguacuuuaggauauguaacu

SEQ ID NO: 89198 - RNA, 21 nt, Human
aaguagaagggagaaggguua

SEQ ID NO: 89199 - RNA, 23 nt, Human
aaguagauaacacuguucugaga

SEQ ID NO: 89200 - RNA, 22 nt, Human
aaguagugugcuccagcgguga

SEQ ID NO: 89201 - RNA, 22 nt, Human
aaguaguugucccugaggaacg

SEQ ID NO: 89202 - RNA, 22 nt, Human
aaguauacugaagguauccagg

SEQ ID NO: 89203 - RNA, 22 nt, Human
aaguauacuuaggcauaauggu

SEQ ID NO: 89204 - RNA, 22 nt, Human
aaguaugcaaaucgucuuagaa

SEQ ID NO: 89205 - RNA, 22 nt, Human
aaguaugugauacauguuaauu

SEQ ID NO: 89206 - RNA, 22 nt, Human
aaguauucuacaaagaaauuga

SEQ ID NO: 89207 - RNA, 22 nt, Human
aaguauucuggcagucauucag

SEQ ID NO: 89208 - RNA, 22 nt, Human
aagucaagauaaaggugcuggc

SEQ ID NO: 89209 - RNA, 22 nt, Human
aagucaaguacuacaggaaaca

SEQ ID NO: 89210 - RNA, 22 nt, Human
aagucaaucacaugcacacuga

SEQ ID NO: 89211 - RNA, 22 nt, Human
aagucacaaagugcuguacaug

SEQ ID NO: 89212 - RNA, 22 nt, Human
aagucacauucugagguauugg

SEQ ID NO: 89213 - RNA, 22 nt, Human
aagucacuggcaaaagcugcag

SEQ ID NO: 89214 - RNA, 22 nt, Human
aagucacugugaaaggugaagc

SEQ ID NO: 89215 - RNA, 22 nt, Human
aagucacuugauuguugacaga

SEQ ID NO: 89216 - RNA, 22 nt, Human
aagucagaaauuauucaggaau

SEQ ID NO: 89217 - RNA, 22 nt, Human
aagucagagaugccaaagauua

SEQ ID NO: 89218 - RNA, 22 nt, Human
aagucaugaguccucuucugug

SEQ ID NO: 89219 - RNA, 22 nt, Human
aagucauguggaagaauaaccu

SEQ ID NO: 89220 - RNA, 22 nt, Human
aaguccaagaggaaagguuucc

SEQ ID NO: 89221 - RNA, 21 nt, Human
aaguccaauaccuaaggcucc

SEQ ID NO: 89222 - RNA, 23 nt, Human
aaguccagaaggagaacugggag

SEQ ID NO: 89223 - RNA, 22 nt, Human
aaguccauagguuucaugaggg

SEQ ID NO: 89224 - RNA, 22 nt, Human
aaguccauaguuugcauuaggg

SEQ ID NO: 89225 - RNA, 22 nt, Human
aagucccuuuaaucagugccuu

SEQ ID NO: 89226 - RNA, 22 nt, Human
aaguccuaaacacacacaaggc

SEQ ID NO: 89227 - RNA, 22 nt, Human
aaguccuaauuuuaggaggaga

SEQ ID NO: 89228 - RNA, 22 nt, Human
aaguccugaaacuucuuucuga

SEQ ID NO: 89229 - RNA, 22 nt, Human
aaguccugaagacacagaaaag

SEQ ID NO: 89230 - RNA, 22 nt, Human
aaguccugggcauuugaacagg

SEQ ID NO: 89231 - RNA, 22 nt, Human
aaguccugggugagaacugucc

SEQ ID NO: 89232 - RNA, 22 nt, Human
aaguccuuauguggaggggcua

SEQ ID NO: 89233 - RNA, 22 nt, Human
aaguccuucccaagcauguacc

SEQ ID NO: 89234 - RNA, 22 nt, Human
aaguccuucuuuauaugagagu

SEQ ID NO: 89235 - RNA, 22 nt, Human
aaguccuuggagaauagaaagg

SEQ ID NO: 89236 - RNA, 22 nt, Human
aagucguggcaggcuugcacga

SEQ ID NO: 89237 - RNA, 22 nt, Human
aagucuaaguuuguaacuugga

SEQ ID NO: 89238 - RNA, 22 nt, Human
aagucucauccguguagcucca

SEQ ID NO: 89239 - RNA, 22 nt, Human
aagucucucauggcugacagca

SEQ ID NO: 89240 - RNA, 22 nt, Human
aagucucugauguguguuaggu

SEQ ID NO: 89241 - RNA, 22 nt, Human
aagucucuggcaaaugaucuug

SEQ ID NO: 89242 - RNA, 22 nt, Human
aagucucugguugcuugcaugg

SEQ ID NO: 89243 - RNA, 22 nt, Human
aagucucuuuggguacuuuauu

SEQ ID NO: 89244 - RNA, 22 nt, Human
aagucugagagaaacucucuca

SEQ ID NO: 89245 - RNA, 22 nt, Human
aagucugaucauuucuucuaua

SEQ ID NO: 89246 - RNA, 22 nt, Human
aagugaagaaauacaugagaau

SEQ ID NO: 89247 - RNA, 22 nt, Human
aagugaauagccuauuuacuag

SEQ ID NO: 89248 - RNA, 22 nt, Human
aagugaauguuugguagcagug

SEQ ID NO: 89249 - RNA, 22 nt, Human
aagugacacauggcacuucuau

SEQ ID NO: 89250 - RNA, 22 nt, Human
aagugaggccuaggcacugggu

SEQ ID NO: 89251 - RNA, 22 nt, Human
aagugagguuucugcuuucaga

SEQ ID NO: 89252 - RNA, 22 nt, Human
aagugaguggccuggagaggug

SEQ ID NO: 89253 - RNA, 22 nt, Human
aagugaguucagcauucacucg

SEQ ID NO: 89254 - RNA, 22 nt, Human
aagugauaccuaggaaaucaag

SEQ ID NO: 89255 - RNA, 22 nt, Human
aagugauacguguuuauuucca

SEQ ID NO: 89256 - RNA, 22 nt, Human
aagugauucugauguguuucuu

SEQ ID NO: 89257 - RNA, 22 nt, Human
aagugauuuguacaaaaugucg

SEQ ID NO: 89258 - RNA, 23 nt, Human
aagugcaagugaaaggcacaguu

SEQ ID NO: 89259 - RNA, 22 nt, Human
aagugcaggucucagcuacucu

SEQ ID NO: 89260 - RNA, 22 nt, Human
aagugcauacacuaguuaauug

SEQ ID NO: 89261 - RNA, 22 nt, Human
aagugcauaguaauggagucaa

SEQ ID NO: 89262 - RNA, 22 nt, Human
aagugcaucacuacucauuaca

SEQ ID NO: 89263 - RNA, 22 nt, Human
aagugcaugguauggucuccau

SEQ ID NO: 89264 - RNA, 22 nt, Human
aagugcauuagauagaaugaug

SEQ ID NO: 89265 - RNA, 22 nt, Human
aagugccaucauagcauggcug

SEQ ID NO: 89266 - RNA, 22 nt, Human
aagugccugggcaacauagcaa

SEQ ID NO: 89267 - RNA, 23 nt, Human
aagugcuaaguacuguaaucauc

SEQ ID NO: 89268 - RNA, 22 nt, Human
aagugcugaaugaagacacaaa

SEQ ID NO: 89269 - RNA, 22 nt, Human
aagugcugagacuacaggcaug

SEQ ID NO: 89270 - RNA, 22 nt, Human
aagugcuuaaaaggguggucua

SEQ ID NO: 89271 - RNA, 22 nt, Human
aagugcuuggauugcagguaug

SEQ ID NO: 89272 - RNA, 22 nt, Human
aagucagaauaauguuucuuuu

SEQ ID NO: 89273 - RNA, 22 nt, Human
aagucagacagcugagcugccu

SEQ ID NO: 89274 - RNA, 22 nt, Human
aagucagaccuuguugauagcu

SEQ ID NO: 89275 - RNA, 22 nt, Human
aagucagagaucaaggugucua

SEQ ID NO: 89276 - RNA, 22 nt, Human
aagucagagcaacugagacauu

SEQ ID NO: 89277 - RNA, 22 nt, Human
aagucagauaggugaguccaaa

SEQ ID NO: 89278 - RNA, 21 nt, Human
aagucagucaguucuauacua

SEQ ID NO: 89279 - RNA, 22 nt, Human
aagucagugaaaaggcaucauc

SEQ ID NO: 89280 - RNA, 22 nt, Human
aagucaucuugagucuaagauu

SEQ ID NO: 89281 - RNA, 22 nt, Human
aaguccagacuccuuugcgugg

SEQ ID NO: 89282 - RNA, 22 nt, Human
aaguccagcagugcuuguugau

SEQ ID NO: 89283 - RNA, 22 nt, Human
aaguccagcauuuggguagauu

SEQ ID NO: 89284 - RNA, 22 nt, Human
aaguccagcucuaaauaucuga

SEQ ID NO: 89285 - RNA, 22 nt, Human
aaguccaugaucaagauguggc

SEQ ID NO: 89286 - RNA, 22 nt, Human
aaguccauucuuccagccagcu

SEQ ID NO: 89287 - RNA, 22 nt, Human
aagucccaucugccuccaugua

SEQ ID NO: 89288 - RNA, 20 nt, Human
aagucccuaagucucuggcc

SEQ ID NO: 89289 - RNA, 22 nt, Human
aaguccugagaccagaaaaugg

SEQ ID NO: 89290 - RNA, 22 nt, Human
aaguccugccagcaaauguaua

SEQ ID NO: 89291 - RNA, 22 nt, Human
aaguccuugaagaaacaguucu

SEQ ID NO: 89292 - RNA, 22 nt, Human
aaguccuuuauccuaaaagguc

SEQ ID NO: 89293 - RNA, 22 nt, Human
aagucuaggacaggaagucuau

SEQ ID NO: 89294 - RNA, 22 nt, Human
aagucuaguauccuucuugacu

SEQ ID NO: 89295 - RNA, 22 nt, Human
aagucucuaagacugugccauc

SEQ ID NO: 89296 - RNA, 22 nt, Human
aagucucugacucacacaaugu

SEQ ID NO: 89297 - RNA, 22 nt, Human
aagucucuggugaugcaggaaa

SEQ ID NO: 89298 - RNA, 22 nt, Human
aagucucuuaguaauauccaac

SEQ ID NO: 89299 - RNA, 22 nt, Human
aagucucuuccucugccaaaga

SEQ ID NO: 89300 - RNA, 22 nt, Human
aagucucuuuaccucuccaggc

SEQ ID NO: 89301 - RNA, 22 nt, Human
aagucugacuagaaucucuccc

SEQ ID NO: 89302 - RNA, 22 nt, Human
aagucugccuaaccuucauguu

SEQ ID NO: 89303 - RNA, 22 nt, Human
aagucugggccuccuucccaga

SEQ ID NO: 89304 - RNA, 22 nt, Human
aagucuggggagaaaaggcuaa

SEQ ID NO: 89305 - RNA, 22 nt, Human
aagucuguuugagugucacacu

SEQ ID NO: 89306 - RNA, 22 nt, Human
aagucuuaaccaaauaaauguu

SEQ ID NO: 89307 - RNA, 22 nt, Human
aagucuuacauaauaguuugga

SEQ ID NO: 89308 - RNA, 22 nt, Human
aagucuuaggcauuuuauuucu

SEQ ID NO: 89309 - RNA, 22 nt, Human
aaguuuggggagaauuucauuu

SEQ ID NO: 89310 - RNA, 22 nt, Human
aaguuuguucauucauucaucc

SEQ ID NO: 89311 - RNA, 21 nt, Human
aaguuuguucuuguauagucu

SEQ ID NO: 89312 - RNA, 22 nt, Human
aaguuuguuuuagucuaaugau

SEQ ID NO: 89313 - RNA, 22 nt, Human
aaguuuuauuggaacauagcca

SEQ ID NO: 89314 - RNA, 22 nt, Human
aaguuuugaaauacugaagugu

SEQ ID NO: 89315 - RNA, 21 nt, Human
aauaaaacaguuggugucaau

SEQ ID NO: 89316 - RNA, 22 nt, Human
aauaaacaaaucuuuccugugg

SEQ ID NO: 89317 - RNA, 22 nt, Human
aauaaagacucagaggcccagg

SEQ ID NO: 89318 - RNA, 22 nt, Human
aauaaaguguauucuuugucau

SEQ ID NO: 89319 - RNA, 22 nt, Human
aauaaaugaacaaagcagguug

SEQ ID NO: 89320 - RNA, 22 nt, Human
aauaacagaaacuugagcauca

SEQ ID NO: 89321 - RNA, 22 nt, Human
aauaacuucaguucuuacauua

SEQ ID NO: 89322 - RNA, 22 nt, Human
aauaagaaagagucagcuucag

SEQ ID NO: 89323 - RNA, 22 nt, Human
aauaagacacacaacugucaag

SEQ ID NO: 89324 - RNA, 22 nt, Human
aauaagaugugcuugaguuugg

SEQ ID NO: 89325 - RNA, 19 nt, Human
aauaagcuuggguaaaacu

SEQ ID NO: 89326 - RNA, 22 nt, Human
aauaagugaguuuagcaaguuu

SEQ ID NO: 89327 - RNA, 22 nt, Human
aauaauaagauacuaagggagu

SEQ ID NO: 89328 - RNA, 22 nt, Human
aauaaucucacuuuauguggaa

SEQ ID NO: 89329 - RNA, 22 nt, Human
aauaaugagacagcuuauuuaa

SEQ ID NO: 89330 - RNA, 22 nt, Human
aauaaugucugcuauuuuaaaa

SEQ ID NO: 89331 - RNA, 22 nt, Human
aauaauguugacgauagucuua

SEQ ID NO: 89332 - RNA, 22 nt, Human
aauaauuauuugagagcagacc

SEQ ID NO: 89333 - RNA, 22 nt, Human
aauaauugucaacuaugcuaca

SEQ ID NO: 89334 - RNA, 22 nt, Human
aauacaaucaaauucacuagca

SEQ ID NO: 89335 - RNA, 22 nt, Human
aauacagaggcuuccaguaaaa

SEQ ID NO: 89336 - RNA, 22 nt, Human
aauacagaggggucacaauuca

SEQ ID NO: 89337 - RNA, 22 nt, Human
aauacaguaauuuugaugaguu

SEQ ID NO: 89338 - RNA, 22 nt, Human
aauacagucuuacuagaaaauc

SEQ ID NO: 89339 - RNA, 22 nt, Human
aauacauaauaaguuuugucug

SEQ ID NO: 89340 - RNA, 22 nt, Human
aauacauguuuucuacuauucu

SEQ ID NO: 89341 - RNA, 22 nt, Human
aauaccaugauaauuaauucau

SEQ ID NO: 89342 - RNA, 17 nt, Human
aauaccugccaauucua

SEQ ID NO: 89343 - RNA, 22 nt, Human
aauaccuuuccugccauucacu

SEQ ID NO: 89344 - RNA, 22 nt, Human
aauacgugguuacucuauagag

SEQ ID NO: 89345 - RNA, 22 nt, Human
aauacugaauuaguugagacaa

SEQ ID NO: 89346 - RNA, 22 nt, Human
aauacugagaucccacaaagca

SEQ ID NO: 89347 - RNA, 22 nt, Human
aauacugcauacaguuucucau

SEQ ID NO: 89348 - RNA, 22 nt, Human
aauacugucuuucacagauauu

SEQ ID NO: 89349 - RNA, 22 nt, Human
aauacuuaugugaccucauuuu

SEQ ID NO: 89350 - RNA, 17 nt, Human
aauacuuccaacuagug

SEQ ID NO: 89351 - RNA, 22 nt, Human
aauacuugucagaugaauaaga

SEQ ID NO: 89352 - RNA, 22 nt, Human
aauacuuuccuauauaaggugc

SEQ ID NO: 89353 - RNA, 22 nt, Human
aauacuuugccaaguucgaaga

SEQ ID NO: 89354 - RNA, 22 nt, Human
aauacuuuugaacugaaaggca

SEQ ID NO: 89355 - RNA, 22 nt, Human
aauagaauguaaucuaauacau

SEQ ID NO: 89356 - RNA, 22 nt, Human
aauagagucaguucuacauucu

SEQ ID NO: 89357 - RNA, 19 nt, Human
aauagauuaauuauccucu

SEQ ID NO: 89358 - RNA, 22 nt, Human
aauagauucaugguuaagagca

SEQ ID NO: 89359 - RNA, 22 nt, Human
aauagcaaacacugguaaaguu

SEQ ID NO: 89360 - RNA, 22 nt, Human
aauagcaguuaaaaaucagccc

SEQ ID NO: 89361 - RNA, 22 nt, Human
aauagccaaagugcauuuauga

SEQ ID NO: 89362 - RNA, 20 nt, Human
aauagcugagggcaagagua

SEQ ID NO: 89363 - RNA, 21 nt, Human
aauagcugaggucacccagcc

SEQ ID NO: 89364 - RNA, 22 nt, Human
aauagcuuaugggauagauguu

SEQ ID NO: 89365 - RNA, 22 nt, Human
aauagcuuauugacagugaauu

SEQ ID NO: 89366 - RNA, 22 nt, Human
aauagcuuucucaugacuucac

SEQ ID NO: 89367 - RNA, 22 nt, Human
aauagcuuuggucaccaucugg

SEQ ID NO: 89368 - RNA, 22 nt, Human
aauagcuuuuguaugaugaaau

SEQ ID NO: 89369 - RNA, 22 nt, Human
aauaggaagucacaucaaggga

SEQ ID NO: 89370 - RNA, 22 nt, Human
aauaggcaguuggauaugcaag

SEQ ID NO: 89371 - RNA, 22 nt, Human
aauaguccugauuuaaucuggg

SEQ ID NO: 89372 - RNA, 22 nt, Human
aauagugaacaggaacaugcuu

SEQ ID NO: 89373 - RNA, 22 nt, Human
aauagugcuuuuguacauagga

SEQ ID NO: 89374 - RNA, 22 nt, Human
aauaguuguaguaucuaucucg

SEQ ID NO: 89375 - RNA, 22 nt, Human
aauauagcauuguaugacugug

SEQ ID NO: 89376 - RNA, 22 nt, Human
aauauaguucugguauuguuaa

SEQ ID NO: 89377 - RNA, 22 nt, Human
aauaucaacaguguccuucuaa

SEQ ID NO: 89378 - RNA, 23 nt, Human
aauaucaaggugauguucccaga

SEQ ID NO: 89379 - RNA, 22 nt, Human
aauaucaucucucuuuucugca

SEQ ID NO: 89380 - RNA, 22 nt, Human
aauauccagguagaugucuucu

SEQ ID NO: 89381 - RNA, 22 nt, Human
acagacuggagcccuuuugccc

SEQ ID NO: 89382 - RNA, 22 nt, Human
acagacugggguggggaauagg

SEQ ID NO: 89383 - RNA, 22 nt, Human
acagacugucaugacacuauau

SEQ ID NO: 89384 - RNA, 22 nt, Human
acagacugucccaccacaugga

SEQ ID NO: 89385 - RNA, 22 nt, Human
acagagaaacuaaggaguuugg

SEQ ID NO: 89386 - RNA, 22 nt, Human
acagagaaagugggcugaagau

SEQ ID NO: 89387 - RNA, 22 nt, Human
acagagacaauauuuguaaagu

SEQ ID NO: 89388 - RNA, 23 nt, Human
acagagacaaugguuucaucuug

SEQ ID NO: 89389 - RNA, 22 nt, Human
acagagacacggaagcuaaaga

SEQ ID NO: 89390 - RNA, 22 nt, Human
acagagacaggcagacagucuu

SEQ ID NO: 89391 - RNA, 22 nt, Human
acagagacuaagcuuuucauca

SEQ ID NO: 89392 - RNA, 20 nt, Human
acagagacugagacacuugc

SEQ ID NO: 89393 - RNA, 22 nt, Human
acagagacugggaugccugccu

SEQ ID NO: 89394 - RNA, 22 nt, Human
acagagagggagugauaaaucc

SEQ ID NO: 89395 - RNA, 20 nt, Human
acagagauccucucuuuauc

SEQ ID NO: 89396 - RNA, 22 nt, Human
acagagcaacuuuauuucaugg

SEQ ID NO: 89397 - RNA, 22 nt, Human
acagagcacauagauuggaguu

SEQ ID NO: 89398 - RNA, 17 nt, Human
acagagcacaucaagau

SEQ ID NO: 89399 - RNA, 22 nt, Human
acagagcaguucuggagcuggc

SEQ ID NO: 89400 - RNA, 22 nt, Human
acagagcaugauggaagaucga

SEQ ID NO: 89401 - RNA, 22 nt, Human
acagagccacuuuggugccuac

SEQ ID NO: 89402 - RNA, 22 nt, Human
acagagcuaaauuucaauccca

SEQ ID NO: 89403 - RNA, 22 nt, Human
acagagcuuaggaugacuccca

SEQ ID NO: 89404 - RNA, 22 nt, Human
acagagcuucccagccugagca

SEQ ID NO: 89405 - RNA, 22 nt, Human
acagaggaaggcugagcugccc

SEQ ID NO: 89406 - RNA, 22 nt, Human
acagaggcagugugagauacug

SEQ ID NO: 89407 - RNA, 21 nt, Human
acagaggcauacagcuuaagg

SEQ ID NO: 89408 - RNA, 22 nt, Human
acagagggggccuuggagugca

SEQ ID NO: 89409 - RNA, 22 nt, Human
acagagguaggacaugagauau

SEQ ID NO: 89410 - RNA, 22 nt, Human
acagaguacagacaaaggucag

SEQ ID NO: 89411 - RNA, 22 nt, Human
acagaguagcucaagaagauug

SEQ ID NO: 89412 - RNA, 22 nt, Human
acagagucauucauuguccagu

SEQ ID NO: 89413 - RNA, 22 nt, Human
acagagucucaaaccuacaaag

SEQ ID NO: 89414 - RNA, 22 nt, Human
acagaguguuuuuaaguauauu

SEQ ID NO: 89415 - RNA, 22 nt, Human
acagaguuaaaguggaguuuaa

SEQ ID NO: 89416 - RNA, 22 nt, Human
acagaguuaauggauaggcagg

SEQ ID NO: 89417 - RNA, 22 nt, Human
acagauaaauuuauaggagugu

SEQ ID NO: 89418 - RNA, 22 nt, Human
acagauaauuuaauuaaugcau

SEQ ID NO: 89419 - RNA, 22 nt, Human
acagauacaaauauacaaauac

SEQ ID NO: 89420 - RNA, 22 nt, Human
acagauagaugauaauggcuuu

SEQ ID NO: 89421 - RNA, 22 nt, Human
acagauauaugauuguguaaau

SEQ ID NO: 89422 - RNA, 22 nt, Human
acagauauguuggguucuuguu

SEQ ID NO: 89423 - RNA, 22 nt, Human
acagauauuaugguuucuccuu

SEQ ID NO: 89424 - RNA, 22 nt, Human
acagauauuuggggaaagacgu

SEQ ID NO: 89425 - RNA, 22 nt, Human
acagaugagaagcugcauucaa

SEQ ID NO: 89426 - RNA, 22 nt, Human
acagaugagacuccaggaccuu

SEQ ID NO: 89427 - RNA, 22 nt, Human
acagaugaggaaacagggucag

SEQ ID NO: 89428 - RNA, 22 nt, Human
acagaugaggaauuuauuuggu

SEQ ID NO: 89429 - RNA, 22 nt, Human
acagaugagguguuuggagagc

SEQ ID NO: 89430 - RNA, 22 nt, Human
acagaugaugugcacagauaga

SEQ ID NO: 89431 - RNA, 22 nt, Human
acagauggagcuacuagguaaa

SEQ ID NO: 89432 - RNA, 22 nt, Human
acagauguaaucuauucacauu

SEQ ID NO: 89433 - RNA, 22 nt, Human
acagauguaccuuagugauggg

SEQ ID NO: 89434 - RNA, 22 nt, Human
acagauguggaguuugcaugau

SEQ ID NO: 89435 - RNA, 22 nt, Human
acagauguuagcaaugaugaug

SEQ ID NO: 89436 - RNA, 22 nt, Human
acagauuuauugaagcugcugc

SEQ ID NO: 89437 - RNA, 22 nt, Human
acagauuugacugguaccuggc

SEQ ID NO: 89438 - RNA, 22 nt, Human
acagauuugaucugagaacaaa

SEQ ID NO: 89439 - RNA, 22 nt, Human
acagauuuguucuuuugggcua

SEQ ID NO: 89440 - RNA, 22 nt, Human
acagauuuuaaauuuguaguug

SEQ ID NO: 89441 - RNA, 22 nt, Human
acagauuuugguauuugcaaug

SEQ ID NO: 89442 - RNA, 22 nt, Human
acagauuuuucagcuccugugu

SEQ ID NO: 89443 - RNA, 22 nt, Human
acagcaagaccccuagcauggu

SEQ ID NO: 89444 - RNA, 22 nt, Human
acagcaaucugagagacauagu

SEQ ID NO: 89445 - RNA, 22 nt, Human
acagcacaaucugagucccaga

SEQ ID NO: 89446 - RNA, 22 nt, Human
acagcacuuauucagcacagug

SEQ ID NO: 89447 - RNA, 22 nt, Human
acagcacuuggguuuuccuguu

SEQ ID NO: 89448 - RNA, 22 nt, Human
acagcagacagucggcuuccug

SEQ ID NO: 89449 - RNA, 22 nt, Human
acagcagaccacuacuaguagg

SEQ ID NO: 89450 - RNA, 22 nt, Human
acagcagagaacuuuagagggu

SEQ ID NO: 89451 - RNA, 21 nt, Human
acagcagagaucaagacuaag

SEQ ID NO: 89452 - RNA, 22 nt, Human
acagcagaggaaaagucugaua

SEQ ID NO: 89453 - RNA, 22 nt, Human
acagcagagugugagauagcca

SEQ ID NO: 89454 - RNA, 22 nt, Human
acagcagcaauagcagugacau

SEQ ID NO: 89455 - RNA, 22 nt, Human
acagcagccagccacugugagc

SEQ ID NO: 89456 - RNA, 20 nt, Human
acagcagccuugcuagaaac

SEQ ID NO: 89457 - RNA, 22 nt, Human
acagcagcgucaacuuaaaauu

SEQ ID NO: 89458 - RNA, 22 nt, Human
acagcagcuugcgugucugguc

SEQ ID NO: 89459 - RNA, 22 nt, Human
acaagcagaagguggggucuua

SEQ ID NO: 89460 - RNA, 22 nt, Human
acaagcaguaaaggccacaguc

SEQ ID NO: 89461 - RNA, 22 nt, Human
acaagcuuccaggugaugcuga

SEQ ID NO: 89462 - RNA, 22 nt, Human
acaaggaacaagcauguaguuu

SEQ ID NO: 89463 - RNA, 22 nt, Human
acaaggcuguuggucacaaacc

SEQ ID NO: 89464 - RNA, 22 nt, Human
acaaggcuuauaguugcuuuuu

SEQ ID NO: 89465 - RNA, 22 nt, Human
acaaggcuuuggaggguucuua

SEQ ID NO: 89466 - RNA, 22 nt, Human
acaagguaucaucuuggaagca

SEQ ID NO: 89467 - RNA, 22 nt, Human
acaagguauccacauuaaaugu

SEQ ID NO: 89468 - RNA, 22 nt, Human
acaaguauuuaagguuaguaua

SEQ ID NO: 89469 - RNA, 22 nt, Human
acaagugugugcaguuuguaaa

SEQ ID NO: 89470 - RNA, 22 nt, Human
acaaguguugcauuuugccauu

SEQ ID NO: 89471 - RNA, 22 nt, Human
acaaguuaccaaaaaagauuca

SEQ ID NO: 89472 - RNA, 22 nt, Human
acaaguuagguuuuaauccaaa

SEQ ID NO: 89473 - RNA, 22 nt, Human
acaaguucauggugcuuuccug

SEQ ID NO: 89474 - RNA, 22 nt, Human
acaaguuucauuguuuagaacc

SEQ ID NO: 89475 - RNA, 22 nt, Human
acaauaacuucuguuuccuugc

SEQ ID NO: 89476 - RNA, 22 nt, Human
acaauaauguauugccaaaagu

SEQ ID NO: 89477 - RNA, 22 nt, Human
acaauagaguucucauaggaca

SEQ ID NO: 89478 - RNA, 20 nt, Human
acaauagauuugagcaaagu

SEQ ID NO: 89479 - RNA, 22 nt, Human
acaauauaguccaugagcaugc

SEQ ID NO: 89480 - RNA, 22 nt, Human
acaauauuguacccagaaguuu

SEQ ID NO: 89481 - RNA, 22 nt, Human
acaaucagcacugaguuuaucu

SEQ ID NO: 89482 - RNA, 22 nt, Human
acaaucaguauuuagacccagg

SEQ ID NO: 89483 - RNA, 22 nt, Human
acaaucauuccguucacaacag

SEQ ID NO: 89484 - RNA, 22 nt, Human
acaaucauuggcuucauuacaa

SEQ ID NO: 89485 - RNA, 18 nt, Human
acaaucugaaaccuguca

SEQ ID NO: 89486 - RNA, 22 nt, Human
acaaugaacacacaaggaauuc

SEQ ID NO: 89487 - RNA, 22 nt, Human
acaaugaaccaaauuuaccaau

SEQ ID NO: 89488 - RNA, 22 nt, Human
acaaugaguuugauguaguuug

SEQ ID NO: 89489 - RNA, 22 nt, Human
acaaugcauaccuagcagcuca

SEQ ID NO: 89490 - RNA, 22 nt, Human
aauucaguugacagcuaaugcc

SEQ ID NO: 89491 - RNA, 22 nt, Human
aauucauccaugaacaauucca

SEQ ID NO: 89492 - RNA, 22 nt, Human
aauuccaaaucaacuagucuag

SEQ ID NO: 89493 - RNA, 20 nt, Human
aauuccagcaugauauuuau

SEQ ID NO: 89494 - RNA, 22 nt, Human
aauuccagcuaggaaaagcuuc

SEQ ID NO: 89495 - RNA, 22 nt, Human
aauuccaggaugcaggaggugc

SEQ ID NO: 89496 - RNA, 22 nt, Human
aauuccaggguuagcucauuug

SEQ ID NO: 89497 - RNA, 22 nt, Human
aauuccauaucugugauuauua

SEQ ID NO: 89498 - RNA, 22 nt, Human
aauucccacuauaugccaagca

SEQ ID NO: 89499 - RNA, 22 nt, Human
aauucccauuugcagaaaauca

SEQ ID NO: 89500 - RNA, 22 nt, Human
aauucuacauugguucacauuu

SEQ ID NO: 89501 - RNA, 22 nt, Human
aauucuagcccaggcaaaacua

SEQ ID NO: 89502 - RNA, 22 nt, Human
aauucuauaggcaagcuauuuu

SEQ ID NO: 89503 - RNA, 22 nt, Human
aauucugaaagauuccuuauuc

SEQ ID NO: 89504 - RNA, 22 nt, Human
aauucugaggagggaagaggaa

SEQ ID NO: 89505 - RNA, 22 nt, Human
aauucugaugagucagagaaag

SEQ ID NO: 89506 - RNA, 22 nt, Human
aauucuuaaucccauaaaguga

SEQ ID NO: 89507 - RNA, 22 nt, Human
aauugaacaaguaauagaagag

SEQ ID NO: 89508 - RNA, 20 nt, Human
aauugaagcagaggagaggc

SEQ ID NO: 89509 - RNA, 22 nt, Human
aauugagugcagccagcccagu

SEQ ID NO: 89510 - RNA, 18 nt, Human
aauugcauuuguuuccuu

SEQ ID NO: 89511 - RNA, 22 nt, Human
aauugcccauauuugagaauga

SEQ ID NO: 89512 - RNA, 22 nt, Human
aauugcccuuacaguaaucaga

SEQ ID NO: 89513 - RNA, 22 nt, Human
aauugcuaaagauuauguuuuc

SEQ ID NO: 89514 - RNA, 22 nt, Human
aauugcuuagagaauccaggua

SEQ ID NO: 89515 - RNA, 22 nt, Human
aauugcuuaguugcaacuaugc

SEQ ID NO: 89516 - RNA, 22 nt, Human
aauugcuuaugccaggugagag

SEQ ID NO: 89517 - RNA, 22 nt, Human
aauugcuucccaagggaggucu

SEQ ID NO: 89518 - RNA, 22 nt, Human
aauugcuugaugacuaguaauu

SEQ ID NO: 89519 - RNA, 22 nt, Human
aauugcuuuugggggcaguuac

SEQ ID NO: 89520 - RNA, 22 nt, Human
aauuggaaaaugcuacauauca

SEQ ID NO: 89521 - RNA, 22 nt, Human
aauuggcaagcaaguuauccag

SEQ ID NO: 89522 - RNA, 22 nt, Human
aauuggcauagcauacaauuca

SEQ ID NO: 89523 - RNA, 22 nt, Human
aauuggcuuccauuuucuguuu

SEQ ID NO: 89524 - RNA, 22 nt, Human
aauuguaacuacauugagaaca

SEQ ID NO: 89525 - RNA, 22 nt, Human
aauuguacauaaaccauuuggc

SEQ ID NO: 89526 - RNA, 22 nt, Human
aauuguacauauuuaugagcga

SEQ ID NO: 89527 - RNA, 22 nt, Human
aauugucuugaaagcaacacuu

SEQ ID NO: 89528 - RNA, 22 nt, Human
aauugucuuuaucacaguucaa

SEQ ID NO: 89529 - RNA, 22 nt, Human
aauuuaagagcauagcuccaac

SEQ ID NO: 89530 - RNA, 22 nt, Human
aauuuaaucaaguucugcucug

SEQ ID NO: 89531 - RNA, 21 nt, Human
aauuuagucaacagacugugg

SEQ ID NO: 89532 - RNA, 19 nt, Human
aauuuaguucuuguuuaga

SEQ ID NO: 89533 - RNA, 22 nt, Human
aauuuauuauauccuaggggaa

SEQ ID NO: 89534 - RNA, 22 nt, Human
aauuucaaacuaauaggaacca

SEQ ID NO: 89535 - RNA, 22 nt, Human
aauuucaaagcucacuggcaua

SEQ ID NO: 89536 - RNA, 22 nt, Human
aauuucaagucuugaagaagua

SEQ ID NO: 89537 - RNA, 22 nt, Human
aauuucacagcuggucuauggg

SEQ ID NO: 89538 - RNA, 22 nt, Human
aauuucacuguggagcacauuu

SEQ ID NO: 89539 - RNA, 22 nt, Human
aauuucagaacuaucugggagu

SEQ ID NO: 89540 - RNA, 22 nt, Human
aauuucagauauuaaagaauga

SEQ ID NO: 89541 - RNA, 22 nt, Human
aauuuccagaccccauccacag

SEQ ID NO: 89542 - RNA, 22 nt, Human
aauuucuaauugaaucucucuu

SEQ ID NO: 89543 - RNA, 22 nt, Human
aauuugaugaguuuguaagucu

SEQ ID NO: 89544 - RNA, 22 nt, Human
aauuuggagcuuuguuucuaga

SEQ ID NO: 89545 - RNA, 22 nt, Human
aauuuggggagguucagacucu

SEQ ID NO: 89546 - RNA, 22 nt, Human
aauuuggugucuuaguuucccu

SEQ ID NO: 89547 - RNA, 22 nt, Human
aauuuguacaaaauguuuauaa

SEQ ID NO: 89548 - RNA, 22 nt, Human
aauuuguauaaaaugguguuuu

SEQ ID NO: 89549 - RNA, 22 nt, Human
aauuuguguuaguccacguuca

SEQ ID NO: 89550 - RNA, 22 nt, Human
aauuuguguuauaccugcuccu

SEQ ID NO: 89551 - RNA, 22 nt, Human
aauuuguuauaacuugggcuga

SEQ ID NO: 89552 - RNA, 22 nt, Human
aauuuuaagcauaugacugguu

SEQ ID NO: 89553 - RNA, 22 nt, Human
aauuuuaucucuaagcaggcuu

SEQ ID NO: 89554 - RNA, 22 nt, Human
aauuuuauuaacuggauguagc

SEQ ID NO: 89555 - RNA, 22 nt, Human
aauuuucugccuagcaaaaacu

SEQ ID NO: 89556 - RNA, 22 nt, Human
acaaaaagggagaugagguaga

SEQ ID NO: 89557 - RNA, 21 nt, Human
acaaaagaagcugccuuuuaa

SEQ ID NO: 89558 - RNA, 22 nt, Human
acaaaagaauaagaugagucau

SEQ ID NO: 89559 - RNA, 22 nt, Human
acaaaagcacugcagaguaagc

SEQ ID NO: 89560 - RNA, 22 nt, Human
acaaaauagaguucuccccugg

SEQ ID NO: 89561 - RNA, 22 nt, Human
acaaaaucaaaggagugauuca

SEQ ID NO: 89562 - RNA, 22 nt, Human
acaaaauuaccuaguuauuuuc

SEQ ID NO: 89563 - RNA, 22 nt, Human
acaaacuaaaauucuuuauuga

SEQ ID NO: 89564 - RNA, 22 nt, Human
acaaagaaggaauuggucuuua

SEQ ID NO: 89565 - RNA, 22 nt, Human
acaaaggcagagaauucaacau

SEQ ID NO: 89566 - RNA, 22 nt, Human
acaaaggcagccaaucaucugc

SEQ ID NO: 89567 - RNA, 22 nt, Human
acaaagggggacugcagagggu

SEQ ID NO: 89568 - RNA, 22 nt, Human
acaaagguggaccauguggcuu

SEQ ID NO: 89569 - RNA, 23 nt, Human
acaaaguaauuccugcuuccaaa

SEQ ID NO: 89570 - RNA, 22 nt, Human
acaaaguagucaaaguagauga

SEQ ID NO: 89571 - RNA, 22 nt, Human
acaaagucacaauaauuaaccu

SEQ ID NO: 89572 - RNA, 22 nt, Human
acaaagucuuuuacaacaguca

SEQ ID NO: 89573 - RNA, 22 nt, Human
acaaagugaaaagcaucgaauu

SEQ ID NO: 89574 - RNA, 22 nt, Human
acaaagugaauugcaucgaguu

SEQ ID NO: 89575 - RNA, 22 nt, Human
acaaaguguuuucugaaggccu

SEQ ID NO: 89576 - RNA, 22 nt, Human
acagcagcuugucuguucuuua

SEQ ID NO: 89577 - RNA, 22 nt, Human
acagcaggcccauacuggaagg

SEQ ID NO: 89578 - RNA, 17 nt, Human
acagcagggaaguguug

SEQ ID NO: 89579 - RNA, 22 nt, Human
acagcagggggagcuguuggac

SEQ ID NO: 89580 - RNA, 22 nt, Human
acagcagggguggaauaaacgu

SEQ ID NO: 89581 - RNA, 19 nt, Human
acagcagguguggggauaa

SEQ ID NO: 89582 - RNA, 22 nt, Human
acagcagugcacagagaacccu

SEQ ID NO: 89583 - RNA, 22 nt, Human
acagcaguggugcacugagcca

SEQ ID NO: 89584 - RNA, 22 nt, Human
acagcauaaucacuucuuucuu

SEQ ID NO: 89585 - RNA, 22 nt, Human
acagcaucccugaagauaacca

SEQ ID NO: 89586 - RNA, 22 nt, Human
acagcaugagagaugaacauuc

SEQ ID NO: 89587 - RNA, 22 nt, Human
acagcauugcuccaucucaaga

SEQ ID NO: 89588 - RNA, 22 nt, Human
acagcauuuaaagaaaaugaac

SEQ ID NO: 89589 - RNA, 22 nt, Human
acagccaagucuucuauuucag

SEQ ID NO: 89590 - RNA, 22 nt, Human
acagccagaggugguccugggu

SEQ ID NO: 89591 - RNA, 22 nt, Human
acagccagaucugagagaucuu

SEQ ID NO: 89592 - RNA, 21 nt, Human
acagccaggaacaugaggggc

SEQ ID NO: 89593 - RNA, 22 nt, Human
acagccaggaggaacucaguga

SEQ ID NO: 89594 - RNA, 22 nt, Human
acagccaggcccagcacgcagg

SEQ ID NO: 89595 - RNA, 22 nt, Human
acagccagguaaaggcauggca

SEQ ID NO: 89596 - RNA, 22 nt, Human
acagccaguccucccacagggu

SEQ ID NO: 89597 - RNA, 22 nt, Human
acagccagugacuggacaagcu

SEQ ID NO: 89598 - RNA, 22 nt, Human
acagcccagcucuuucucugca

SEQ ID NO: 89599 - RNA, 22 nt, Human
ugucacauccauuuugcaagua

SEQ ID NO: 89600 - RNA, 22 nt, Human
ugucacaugacacaaauaucua

SEQ ID NO: 89601 - RNA, 22 nt, Human
ugucacauugaauaugauuuau

SEQ ID NO: 89602 - RNA, 22 nt, Human
ugucaccaccggaagaaacugc

SEQ ID NO: 89603 - RNA, 22 nt, Human
ugucaccagcugcuccucagga

SEQ ID NO: 89604 - RNA, 22 nt, Human
ugucaccaugccagcuucugcc

SEQ ID NO: 89605 - RNA, 22 nt, Human
ugucaccuggaaaucacucuaa

SEQ ID NO: 89606 - RNA, 22 nt, Human
ugucaccuugcagggcuggggc

SEQ ID NO: 89607 - RNA, 22 nt, Human
ugucacuuugccuucuggacuu

SEQ ID NO: 89608 - RNA, 22 nt, Human
ugucagaggcucagggucucag

SEQ ID NO: 89609 - RNA, 20 nt, Human
ugucagcaauuaggagaaaa

SEQ ID NO: 89610 - RNA, 22 nt, Human
ugucagcaauucuggcuuacuc

SEQ ID NO: 89611 - RNA, 22 nt, Human
ugucagcacaucuguaaucaca

SEQ ID NO: 89612 - RNA, 22 nt, Human
ugucagcaccauggguagugau

SEQ ID NO: 89613 - RNA, 22 nt, Human
ugucagcagaaaucuggucugc

SEQ ID NO: 89614 - RNA, 22 nt, Human
ugucagcaggacauuaaaagcu

SEQ ID NO: 89615 - RNA, 21 nt, Human
ugucagcucccuguccugugu

SEQ ID NO: 89616 - RNA, 22 nt, Human
ugucagcuggagauggcauggg

SEQ ID NO: 89617 - RNA, 22 nt, Human
ugucagggcaugcgguccagcc

SEQ ID NO: 89618 - RNA, 22 nt, Human
ugucagggcuggacacagcugc

SEQ ID NO: 89619 - RNA, 22 nt, Human
ugucaggucuaaaaugggucuc

SEQ ID NO: 89620 - RNA, 22 nt, Human
ugucaggugacacacuaggagc

SEQ ID NO: 89621 - RNA, 22 nt, Human
ugucagugaaaaauugugauag

SEQ ID NO: 89622 - RNA, 22 nt, Human
ugucagugaguuggguccugag

SEQ ID NO: 89623 - RNA, 19 nt, Human
ugucagugauacaugcuuu

SEQ ID NO: 89624 - RNA, 20 nt, Human
ugucagugccugaggcacag

SEQ ID NO: 89625 - RNA, 22 nt, Human
ugucaguggaccuggagaggcc

SEQ ID NO: 89626 - RNA, 22 nt, Human
ugucaguggucauaguagaaaa

SEQ ID NO: 89627 - RNA, 22 nt, Human
ugucaguguaacucuuauagca

SEQ ID NO: 89628 - RNA, 22 nt, Human
ugucagugucuaugaagaauuu

SEQ ID NO: 89629 - RNA, 22 nt, Human
ugucagugugcaccgggaggcc

SEQ ID NO: 89630 - RNA, 21 nt, Human
ugucaguucauguauaggcca

SEQ ID NO: 89631 - RNA, 22 nt, Human
ugucaguuuaguugaagaaaga

SEQ ID NO: 89632 - RNA, 22 nt, Human
ugucauaaguguuugcacccag

SEQ ID NO: 89633 - RNA, 22 nt, Human
ugucauauagauauuagacagg

SEQ ID NO: 89634 - RNA, 21 nt, Human
ugucauauuucaauacaguuu

SEQ ID NO: 89635 - RNA, 22 nt, Human
ugucaucauuugagagaagaaa

SEQ ID NO: 89636 - RNA, 22 nt, Human
ugucaucuacccguuaggcuuu

SEQ ID NO: 89637 - RNA, 22 nt, Human
ugucaucucacugauauagaug

SEQ ID NO: 89638 - RNA, 22 nt, Human
ugucaucucuugcaggaagccu

SEQ ID NO: 89639 - RNA, 22 nt, Human
ugucaucugauauuacuuauag

SEQ ID NO: 89640 - RNA, 18 nt, Human
ugucaucuguuuaaaacc

SEQ ID NO: 89641 - RNA, 22 nt, Human
ugucaucuucacugggucacaa

SEQ ID NO: 89642 - RNA, 22 nt, Human
ugucaucuuuuuaaagaagaga

SEQ ID NO: 89643 - RNA, 22 nt, Human
ugucaugaugugcacaccacag

SEQ ID NO: 89644 - RNA, 22 nt, Human
ugucauggacagauuagaugag

SEQ ID NO: 89645 - RNA, 22 nt, Human
ugucauggaggccuccccuaaa

SEQ ID NO: 89646 - RNA, 22 nt, Human
ugucauggcacugguaggagug

SEQ ID NO: 89647 - RNA, 22 nt, Human
ugucauggcguuguggggacua

SEQ ID NO: 89648 - RNA, 22 nt, Human
ugucaugggucuaaacauugau

SEQ ID NO: 89649 - RNA, 22 nt, Human
ugucauggucuguaaggagccc

SEQ ID NO: 89650 - RNA, 22 nt, Human
ugucauggugcuauuuaauuag

SEQ ID NO: 89651 - RNA, 22 nt, Human
ugucauguauaagacacugugu

SEQ ID NO: 89652 - RNA, 22 nt, Human
ugucauguggcaauuaaagcag

SEQ ID NO: 89653 - RNA, 22 nt, Human
ugucauuaaaaugcuucucaaa

SEQ ID NO: 89654 - RNA, 22 nt, Human
ugucauucauuuaaguauguuu

SEQ ID NO: 89655 - RNA, 22 nt, Human
ugucauuccuucaauguagaua

SEQ ID NO: 89656 - RNA, 18 nt, Human
ugucauugccagggaagc

SEQ ID NO: 89657 - RNA, 22 nt, Human
ugucauuuaaagcuuuccagau

SEQ ID NO: 89658 - RNA, 22 nt, Human
ugucauuuacuccauacccuca

SEQ ID NO: 89659 - RNA, 22 nt, Human
ugucauuuauuuugcugucugu

SEQ ID NO: 89660 - RNA, 22 nt, Human
ugucauuuuagugcaucacuca

SEQ ID NO: 89661 - RNA, 22 nt, Human
uguccaagaacagacugccagg

SEQ ID NO: 89662 - RNA, 22 nt, Human
uguccaccgguccugugauggg

SEQ ID NO: 89663 - RNA, 22 nt, Human
uguccagaucaaugcccacaug

SEQ ID NO: 89664 - RNA, 22 nt, Human
uguccagcggccuggcugcuga

SEQ ID NO: 89665 - RNA, 22 nt, Human
uguccaggacccuauucucacu

SEQ ID NO: 89666 - RNA, 22 nt, Human
uguccaggaguaaaaagaccug

SEQ ID NO: 89667 - RNA, 22 nt, Human
uuacaguuucuaguaauacuug

SEQ ID NO: 89668 - RNA, 22 nt, Human
uuacauaacgguaugaaaaaug

SEQ ID NO: 89669 - RNA, 22 nt, Human
uuacauaacuuuaaaaugccgu

SEQ ID NO: 89670 - RNA, 22 nt, Human
uuacauagguauguuugcuuug

SEQ ID NO: 89671 - RNA, 22 nt, Human
uuacauaguuaaauaguacagc

SEQ ID NO: 89672 - RNA, 22 nt, Human
uuacauauugucuauuguucaa

SEQ ID NO: 89673 - RNA, 22 nt, Human
uuacaucagaaggaaacagcgu

SEQ ID NO: 89674 - RNA, 22 nt, Human
uuacaucauguaacuggauaua

SEQ ID NO: 89675 - RNA, 17 nt, Human
uuacauccuucugaauu

SEQ ID NO: 89676 - RNA, 22 nt, Human
uuacaugacaaagcuuuggcuc

SEQ ID NO: 89677 - RNA, 22 nt, Human
uuacaugacucaauagaagggc

SEQ ID NO: 89678 - RNA, 22 nt, Human
uuacaugacugcccuugucagg

SEQ ID NO: 89679 - RNA, 22 nt, Human
uuacauggauguaaaaaaguua

SEQ ID NO: 89680 - RNA, 22 nt, Human
uuacaugguuguuggaaaugcu

SEQ ID NO: 89681 - RNA, 22 nt, Human
uuacauguacaaacaauucuua

SEQ ID NO: 89682 - RNA, 22 nt, Human
uuacauguauuuuggaaaaagu

SEQ ID NO: 89683 - RNA, 22 nt, Human
uuacauguucucauacacagag

SEQ ID NO: 89684 - RNA, 22 nt, Human
uuacauuagacccacuuucaug

SEQ ID NO: 89685 - RNA, 22 nt, Human
uuacauuaggucaagcugccaa

SEQ ID NO: 89686 - RNA, 21 nt, Human
uuacauucagaggaguggaag

SEQ ID NO: 89687 - RNA, 22 nt, Human
uuacauuuugcacagauguccc

SEQ ID NO: 89688 - RNA, 22 nt, Human
uuaccaaaucccgugcacauuc

SEQ ID NO: 89689 - RNA, 22 nt, Human
uuaccaaaugaaauagagauuu

SEQ ID NO: 89690 - RNA, 21 nt, Human
uuaccaauggcuucucuuucc

SEQ ID NO: 89691 - RNA, 22 nt, Human
uuaccacagugccugucuaaug

SEQ ID NO: 89692 - RNA, 22 nt, Human
uuaccaccuguaucacauuuuu

SEQ ID NO: 89693 - RNA, 22 nt, Human
uuaccauagaaacuuccuuuuu

SEQ ID NO: 89694 - RNA, 22 nt, Human
uuacccagagcacuugagcuuu

SEQ ID NO: 89695 - RNA, 22 nt, Human
uuaccuguuuuacaugcacaac

SEQ ID NO: 89696 - RNA, 22 nt, Human
uuaccuuguaaaacauauuccu

SEQ ID NO: 89697 - RNA, 22 nt, Human
uuaccuuuuaggcaagcaucuu

SEQ ID NO: 89698 - RNA, 22 nt, Human
uuacgaucauuucuaaaauaaa

SEQ ID NO: 89699 - RNA, 22 nt, Human
uuacgcagcugcuccaggaagc

SEQ ID NO: 89700 - RNA, 21 nt, Human
uuacuaaacaaaacaugcagg

SEQ ID NO: 89701 - RNA, 22 nt, Human
uuacuacaagauucuguuuuau

SEQ ID NO: 89702 - RNA, 22 nt, Human
uuacuacauuguaacacaguac

SEQ ID NO: 89703 - RNA, 22 nt, Human
uuacuacugcuuuacuacuggg

SEQ ID NO: 89704 - RNA, 22 nt, Human
uuacuauaguccagcccuuuuu

SEQ ID NO: 89705 - RNA, 20 nt, Human
uuacucaguuccugccaugc

SEQ ID NO: 89706 - RNA, 22 nt, Human
uuacucugaauguuucuacuga

SEQ ID NO: 89707 - RNA, 22 nt, Human
uuacugaaaauucuucaggauu

SEQ ID NO: 89708 - RNA, 22 nt, Human
uuacugaagguggauagugagu

SEQ ID NO: 89709 - RNA, 22 nt, Human
uuacugaggagcauaucugagu

SEQ ID NO: 89710 - RNA, 22 nt, Human
uuacugauacacauaagaauuu

SEQ ID NO: 89711 - RNA, 22 nt, Human
uuacugauggaacagagauaga

SEQ ID NO: 89712 - RNA, 22 nt, Human
uuacugaugguggagcugguau

SEQ ID NO: 89713 - RNA, 22 nt, Human
uuacugauuuuugggcccuacc

SEQ ID NO: 89714 - RNA, 22 nt, Human
uuacugcuaauucuguagguuu

SEQ ID NO: 89715 - RNA, 22 nt, Human
uuacuguagcuugacauauguc

SEQ ID NO: 89716 - RNA, 22 nt, Human
uuacuguguuuggcuuuagaug

SEQ ID NO: 89717 - RNA, 18 nt, Human
uuacuguuaucaaaacag

SEQ ID NO: 89718 - RNA, 22 nt, Human
uuacuuaaacagaaaugcagaa

SEQ ID NO: 89719 - RNA, 22 nt, Human
uuacuucuuuggccuucagcca

SEQ ID NO: 89720 - RNA, 22 nt, Human
uuacuugaaaugugauaagaga

SEQ ID NO: 89721 - RNA, 22 nt, Human
uuacuugauagggggauggggu

SEQ ID NO: 89722 - RNA, 22 nt, Human
uuacuugauguaugaugaguag

SEQ ID NO: 89723 - RNA, 20 nt, Human
uuacuugucucagcauggag

SEQ ID NO: 89724 - RNA, 22 nt, Human
uuacuuuagaucauacugugug

SEQ ID NO: 89725 - RNA, 22 nt, Human
uuacuuuauagaacacuggggg

SEQ ID NO: 89726 - RNA, 22 nt, Human
uuacuuuaucuccuagauucca

SEQ ID NO: 89727 - RNA, 22 nt, Human
uuacuuuccagcucuagcuuca

SEQ ID NO: 89728 - RNA, 18 nt, Human
uuacuuuguauagccuag

SEQ ID NO: 89729 - RNA, 22 nt, Human
uuacuuuguuugcacuucaccu

SEQ ID NO: 89730 - RNA, 22 nt, Human
uuacuuuugcaccaaacuaaua

SEQ ID NO: 89731 - RNA, 22 nt, Human
uuagaaacucaacucugggaau

SEQ ID NO: 89732 - RNA, 22 nt, Human
uuagaaagaacuuuagauauca

SEQ ID NO: 89733 - RNA, 21 nt, Human
uuagaaagcucacuacaguua

SEQ ID NO: 89734 - RNA, 22 nt, Human
uuagaaaggggugaaucaaugg

SEQ ID NO: 89735 - RNA, 22 nt, Human
uuagaaaucaccucugaagauc

SEQ ID NO: 89736 - RNA, 22 nt, Human
uuagaaaugauuucaccucuuu

SEQ ID NO: 89737 - RNA, 22 nt, Human
uuagaaaugcacccaagaccua

SEQ ID NO: 89738 - RNA, 22 nt, Human
uuagaaccagcauuuguccugg

SEQ ID NO: 89739 - RNA, 22 nt, Human
uuagaaccaggaacucuaauau

SEQ ID NO: 89740 - RNA, 22 nt, Human
uuagaacugaagaagauuaagg

SEQ ID NO: 89741 - RNA, 22 nt, Human
uuagaacuuuucaacuccauuc

SEQ ID NO: 89742 - RNA, 19 nt, Human
uuagaagccauagguacag

SEQ ID NO: 89743 - RNA, 22 nt, Human
uuagaagugggccuauaguccu

SEQ ID NO: 89744 - RNA, 22 nt, Human
uuagaaucuaacauucuuaucu

SEQ ID NO: 89745 - RNA, 22 nt, Human
uuagaaucuuguaucagaaguu

SEQ ID NO: 89746 - RNA, 22 nt, Human
uuauuugccagaauuucucuug

SEQ ID NO: 89747 - RNA, 22 nt, Human
uuauuugguuauuguaauuggg

SEQ ID NO: 89748 - RNA, 22 nt, Human
uuauuuuaccuuccucugagcu

SEQ ID NO: 89749 - RNA, 22 nt, Human
uuauuuucuccucagaaagugg

SEQ ID NO: 89750 - RNA, 22 nt, Human
uuauuuuguagcucugaucuuu

SEQ ID NO: 89751 - RNA, 17 nt, Human
uuauuuuuugggcugag

SEQ ID NO: 89752 - RNA, 22 nt, Human
uucaaaaagguauguucaaguc

SEQ ID NO: 89753 - RNA, 23 nt, Human
uucaaaacuggaaaaucagaugc

SEQ ID NO: 89754 - RNA, 22 nt, Human
uucaaaauuguucuaagcucug

SEQ ID NO: 89755 - RNA, 22 nt, Human
uucaaacaaaacuguucccaua

SEQ ID NO: 89756 - RNA, 22 nt, Human
uucaaacagaugacucugcucu

SEQ ID NO: 89757 - RNA, 22 nt, Human
uucaaacauucaaauaaaccgg

SEQ ID NO: 89758 - RNA, 22 nt, Human
uucaaaccuaucuaagaaauag

SEQ ID NO: 89759 - RNA, 22 nt, Human
uucaaacuaugacuucagcuac

SEQ ID NO: 89760 - RNA, 22 nt, Human
uucaaacugaggagaggauggc

SEQ ID NO: 89761 - RNA, 22 nt, Human
uucaaacuuaaggagcagcaga

SEQ ID NO: 89762 - RNA, 20 nt, Human
uucaaagacccucaggucca

SEQ ID NO: 89763 - RNA, 22 nt, Human
uucaaagauaauguagcauuuu

SEQ ID NO: 89764 - RNA, 22 nt, Human
uucaaagcagagggucaauaca

SEQ ID NO: 89765 - RNA, 22 nt, Human
uucaaaggaaaggcagugucaa

SEQ ID NO: 89766 - RNA, 22 nt, Human
uucaaaggcaggauagcagcug

SEQ ID NO: 89767 - RNA, 22 nt, Human
uucaaagucagccaucuggcua

SEQ ID NO: 89768 - RNA, 22 nt, Human
uucaaaguccugucagguagcc

SEQ ID NO: 89769 - RNA, 22 nt, Human
uucaaagugcuuuuaaccuuua

SEQ ID NO: 89770 - RNA, 22 nt, Human
uucaaagugugaccugacaagc

SEQ ID NO: 89771 - RNA, 21 nt, Human
uucaaaguuugccuaaagauu

SEQ ID NO: 89772 - RNA, 22 nt, Human
uucaaauccuagcccuguggcc

SEQ ID NO: 89773 - RNA, 22 nt, Human
uucaaaugcaaguuacuacuuu

SEQ ID NO: 89774 - RNA, 22 nt, Human
uucaaauuaccacauuugcuua

SEQ ID NO: 89775 - RNA, 22 nt, Human
uucaaauuugguaugcaagcca

SEQ ID NO: 89776 - RNA, 22 nt, Human
uugauacauagcacaguuuagg

SEQ ID NO: 89777 - RNA, 22 nt, Human
uugauacaugcucuagaguuga

SEQ ID NO: 89778 - RNA, 22 nt, Human
uugauacccaaguguuaugggu

SEQ ID NO: 89779 - RNA, 22 nt, Human
uugauagguuuuauguauaguu

SEQ ID NO: 89780 - RNA, 22 nt, Human
uugauauuuugcacgcuuggua

SEQ ID NO: 89781 - RNA, 22 nt, Human
uugaucagguugcuguggugua

SEQ ID NO: 89782 - RNA, 22 nt, Human
uugaucuugugauaguucaacu

SEQ ID NO: 89783 - RNA, 22 nt, Human
uugaucuuuauaauaguuuuga

SEQ ID NO: 89784 - RNA, 22 nt, Human
uugaugaugcacauuuauaauu

SEQ ID NO: 89785 - RNA, 22 nt, Human
uugaugauguuucugccuugcc

SEQ ID NO: 89786 - RNA, 22 nt, Human
uugauggacagggaccacuguc

SEQ ID NO: 89787 - RNA, 22 nt, Human
uugauguagaaccaagaucuuu

SEQ ID NO: 89788 - RNA, 22 nt, Human
uugauucaaaggggacaagugg

SEQ ID NO: 89789 - RNA, 20 nt, Human
uugauucaagggcugaugga

SEQ ID NO: 89790 - RNA, 22 nt, Human
uugauucagaaaaagauggaga

SEQ ID NO: 89791 - RNA, 22 nt, Human
uugauucauuuauugagugccu

SEQ ID NO: 89792 - RNA, 22 nt, Human
uugauucuggugacugauggaa

SEQ ID NO: 89793 - RNA, 23 nt, Human
uugauuuagcugggauugcaugc

SEQ ID NO: 89794 - RNA, 22 nt, Human
uugauuuauagaauguucaagc

SEQ ID NO: 89795 - RNA, 22 nt, Human
uugauuucaaaauauaugcuug

SEQ ID NO: 89796 - RNA, 23 nt, Human
uugauuucaaaugcagagaacac

SEQ ID NO: 89797 - RNA, 22 nt, Human
uugauuugauugaugaacuaag

SEQ ID NO: 89798 - RNA, 22 nt, Human
uugauuugggaauggucuggca

SEQ ID NO: 89799 - RNA, 22 nt, Human
uugauuuguaggaauggagacc

SEQ ID NO: 89800 - RNA, 21 nt, Human
uugauuuuaggaaguuuguca

SEQ ID NO: 89801 - RNA, 22 nt, Human
uugauuuucaauucauugacaa

SEQ ID NO: 89802 - RNA, 22 nt, Human
uugcaaaaccauccuaaguaaa

SEQ ID NO: 89803 - RNA, 22 nt, Human
uugcaaagacuggcuuaacagu

SEQ ID NO: 89804 - RNA, 22 nt, Human
uugcaaaggggaauaaagcaau

SEQ ID NO: 89805 - RNA, 22 nt, Human
uugcaaauaauagccugaaacu

SEQ ID NO: 89806 - RNA, 22 nt, Human
uugcaaaucucuuguguuuggu

SEQ ID NO: 89807 - RNA, 22 nt, Human
uugcaaaugugaguuuagacug

SEQ ID NO: 89808 - RNA, 22 nt, Human
uugcaacaucugaacauuuauc

SEQ ID NO: 89809 - RNA, 22 nt, Human
uugcaagaaauaaucgaauaga

SEQ ID NO: 89810 - RNA, 22 nt, Human
uugcaagauguuaccauuguua

SEQ ID NO: 89811 - RNA, 22 nt, Human
uugcaaggguguuuugaggugu

SEQ ID NO: 89812 - RNA, 22 nt, Human
uugcaaguuccuuaugagaauc

SEQ ID NO: 89813 - RNA, 22 nt, Human
uugcaauuaacauaugucaacu

SEQ ID NO: 89814 - RNA, 22 nt, Human
uugcaauugcuauggagagcgu

SEQ ID NO: 89815 - RNA, 22 nt, Human
uugcacagaaugacaauaugua

SEQ ID NO: 89816 - RNA, 22 nt, Human
uugcacagugguuuagagccug

SEQ ID NO: 89817 - RNA, 23 nt, Human
uugcacaguguauacacauauuu

SEQ ID NO: 89818 - RNA, 22 nt, Human
uugcacaguuugaagaugacuc

SEQ ID NO: 89819 - RNA, 22 nt, Human
uugcacauguugguucuugaaa

SEQ ID NO: 89820 - RNA, 22 nt, Human
uugcaccaaaugaguuaaaauu

SEQ ID NO: 89821 - RNA, 21 nt, Human
uugcaccaugauaaauucaga

SEQ ID NO: 89822 - RNA, 22 nt, Human
uugcaccauuucacuuccauua

SEQ ID NO: 89823 - RNA, 22 nt, Human
uugcaccccuugauugagccuu

SEQ ID NO: 89824 - RNA, 22 nt, Human
uugcacuagacacauuucaagu

SEQ ID NO: 89825 - RNA, 22 nt, Human
uugcacucaccacauuucaggu

SEQ ID NO: 89826 - RNA, 22 nt, Human
uugcacuccagcccgagcaaca

SEQ ID NO: 89827 - RNA, 22 nt, Human
uugcacuuuauagaaacuuuug

SEQ ID NO: 89828 - RNA, 22 nt, Human
uugcagaacuuaaagacagagu

SEQ ID NO: 89829 - RNA, 22 nt, Human
uugcagaagccuguuguuccug

SEQ ID NO: 89830 - RNA, 22 nt, Human
uugcagacuuacuucgagaaau

SEQ ID NO: 89831 - RNA, 22 nt, Human
uugcagagagguuaggaacuca

SEQ ID NO: 89832 - RNA, 22 nt, Human
uugcagagccaugaggcuggcu

SEQ ID NO: 89833 - RNA, 22 nt, Human
uugcagagugguugugaggauu

SEQ ID NO: 89834 - RNA, 22 nt, Human
uugcagcuccauuuuaauggcu

SEQ ID NO: 89835 - RNA, 22 nt, Human
uugcagcucucugaagguugca

SEQ ID NO: 89836 - RNA, 22 nt, Human
uugcagcugcaguaaauguuca

SEQ ID NO: 89837 - RNA, 22 nt, Human
uugcagcuggugguggccgugu

SEQ ID NO: 89838 - RNA, 22 nt, Human
uugcagcuuagugauguuaucu

SEQ ID NO: 89839 - RNA, 22 nt, Human
uugcagcuucuaccacuguuuc

SEQ ID NO: 89840 - RNA, 22 nt, Human
uugcaggacaaugauggucccu

SEQ ID NO: 89841 - RNA, 22 nt, Human
uugcagggauaaaacaagugaa

SEQ ID NO: 89842 - RNA, 23 nt, Human
uugcagggauggaguucaaaaug

SEQ ID NO: 89843 - RNA, 22 nt, Human
uugcagggcaggaccauggaca

SEQ ID NO: 89844 - RNA, 22 nt, Human
uugcagggcuggaacauggaau

SEQ ID NO: 89845 - RNA, 22 nt, Human
uugcaggggaaggagcagagcu

SEQ ID NO: 89846 - RNA, 22 nt, Human
uugcaggggagaggaacaaaca

SEQ ID NO: 89847 - RNA, 22 nt, Human
uugcaggguccuguggcucucc

SEQ ID NO: 89848 - RNA, 22 nt, Human
uugcagucacacucuaaaguag

SEQ ID NO: 89849 - RNA, 22 nt, Human
uugcaguuaaaaaucauuaguu

SEQ ID NO: 89850 - RNA, 22 nt, Human
uugcaguuguugccuucccuga

SEQ ID NO: 89851 - RNA, 22 nt, Human
uugcaguuguuuagaauaugug

SEQ ID NO: 89852 - RNA, 22 nt, Human
uugcaguuucuggaugccuucu

SEQ ID NO: 89853 - RNA, 22 nt, Human
uugcaguuugcuuuuaauggga

SEQ ID NO: 89854 - RNA, 22 nt, Human
uugcauaaaugcuuaaaauuug

SEQ ID NO: 89855 - RNA, 22 nt, Human
uugcauaacagccauuaaagua

SEQ ID NO: 89856 - RNA, 23 nt, Human
uugcauagacauccucauagauu

SEQ ID NO: 89857 - RNA, 22 nt, Human
uugcauauccuccaacacaugg

SEQ ID NO: 89858 - RNA, 22 nt, Human
uugcaucagaaaauaugggaag

SEQ ID NO: 89859 - RNA, 22 nt, Human
uugcaucagcaggcauaauugg

SEQ ID NO: 89860 - RNA, 23 nt, Human
uugcauccugacgucuauuuucu

SEQ ID NO: 89861 - RNA, 22 nt, Human
uucagaaugauuacauucuggu

SEQ ID NO: 89862 - RNA, 22 nt, Human
uucagacaaauuugaggaagcu

SEQ ID NO: 89863 - RNA, 19 nt, Human
uucagacagacuagguaua

SEQ ID NO: 89864 - RNA, 22 nt, Human
uucagacaguaagaaagagguu

SEQ ID NO: 89865 - RNA, 23 nt, Human
uucagacugccuucagcauuguc

SEQ ID NO: 89866 - RNA, 22 nt, Human
uucagagagaccaaguggcgug

SEQ ID NO: 89867 - RNA, 22 nt, Human
uucagagaguccaguaugcagu

SEQ ID NO: 89868 - RNA, 20 nt, Human
uucagagauagggucuuuaa

SEQ ID NO: 89869 - RNA, 22 nt, Human
uucagagaugacaccugguguu

SEQ ID NO: 89870 - RNA, 22 nt, Human
uucagagcaucucuaaagccag

SEQ ID NO: 89871 - RNA, 22 nt, Human
uucagagccacuucaagucuaa

SEQ ID NO: 89872 - RNA, 22 nt, Human
uucagagcccaaauggagauua

SEQ ID NO: 89873 - RNA, 22 nt, Human
uucagagcuggugucuacagcu

SEQ ID NO: 89874 - RNA, 22 nt, Human
uucagagcuuagaauggacuac

SEQ ID NO: 89875 - RNA, 22 nt, Human
uucagagggcuugcuauguaca

SEQ ID NO: 89876 - RNA, 22 nt, Human
uucagaggguuuuagggucaga

SEQ ID NO: 89877 - RNA, 22 nt, Human
uucagagguaagggucucagaa

SEQ ID NO: 89878 - RNA, 22 nt, Human
uucagaguacacagagaucuuc

SEQ ID NO: 89879 - RNA, 20 nt, Human
uucagagucagcaaaugcag

SEQ ID NO: 89880 - RNA, 22 nt, Human
uucagagucagggaucucagag

SEQ ID NO: 89881 - RNA, 18 nt, Human
uucagagucuggugagga

SEQ ID NO: 89882 - RNA, 22 nt, Human
uucagagugguaugaagugaug

SEQ ID NO: 89883 - RNA, 22 nt, Human
uucagauaaacuacaaauaauu

SEQ ID NO: 89884 - RNA, 22 nt, Human
uucagauaucauuaauuuagua

SEQ ID NO: 89885 - RNA, 23 nt, Human
uuggaauauauuguuugacauag

SEQ ID NO: 89886 - RNA, 20 nt, Human
uuggaaucaccuggagaggu

SEQ ID NO: 89887 - RNA, 22 nt, Human
uuggaauccugccucugcuacu

SEQ ID NO: 89888 - RNA, 21 nt, Human
uuggaaucucuucaucucugc

SEQ ID NO: 89889 - RNA, 22 nt, Human
uuggaaucugcaauuuaacaaa

SEQ ID NO: 89890 - RNA, 22 nt, Human
uuggaauuaauauuuguauaca

SEQ ID NO: 89891 - RNA, 22 nt, Human
uuggaauucaaguuguagcuua

SEQ ID NO: 89892 - RNA, 21 nt, Human
uuggaauuugggagcuaugug

SEQ ID NO: 89893 - RNA, 22 nt, Human
uuggaauuuuccagguacagug

SEQ ID NO: 89894 - RNA, 22 nt, Human
uuggacaguaaauugugcuuaa

SEQ ID NO: 89895 - RNA, 22 nt, Human
uuggaccaauuccugauauuuu

SEQ ID NO: 89896 - RNA, 22 nt, Human
uuggaccauugaccugaucuac

SEQ ID NO: 89897 - RNA, 22 nt, Human
uuggacuccucuuuccucuugg

SEQ ID NO: 89898 - RNA, 22 nt, Human
uuggacucugggauucuggauu

SEQ ID NO: 89899 - RNA, 22 nt, Human
uuggacugaaucuuucucacac

SEQ ID NO: 89900 - RNA, 22 nt, Human
uuggagccaugcccagcucucu

SEQ ID NO: 89901 - RNA, 22 nt, Human
uuggaggaaagaagguugauau

SEQ ID NO: 89902 - RNA, 22 nt, Human
uuggaggaaauugcuuuugugg

SEQ ID NO: 89903 - RNA, 22 nt, Human
uuggaggauaaggauauugauu

SEQ ID NO: 89904 - RNA, 22 nt, Human
uuggaggauugcucucagccca

SEQ ID NO: 89905 - RNA, 22 nt, Human
uuggaggcaaugggaaggaggc

SEQ ID NO: 89906 - RNA, 22 nt, Human
uuggagggucuuccacagccau

SEQ ID NO: 89907 - RNA, 22 nt, Human
uuggagguuauuaacacuggcc

SEQ ID NO: 89908 - RNA, 22 nt, Human
uuggagucauauggaauucaca

SEQ ID NO: 89909 - RNA, 22 nt, Human
uuggagucauuggccuggguga

SEQ ID NO: 89910 - RNA, 22 nt, Human
uuggaguccuugcugcuucacu

SEQ ID NO: 89911 - RNA, 22 nt, Human
uuggaucagaugauaucuuugu

SEQ ID NO: 89912 - RNA, 22 nt, Human
uuggaucuuaugaagguggcau

SEQ ID NO: 89913 - RNA, 19 nt, Human
uuggaugcuaccagguacc

SEQ ID NO: 89914 - RNA, 22 nt, Human
uuggaugggcauuaggaaaguc

SEQ ID NO: 89915 - RNA, 23 nt, Human
uuggcaaagccuaugaaguccuc

SEQ ID NO: 89916 - RNA, 22 nt, Human
uuggcaauucaccaaggcucgc

SEQ ID NO: 89917 - RNA, 22 nt, Human
uuggcacucucccugcacuggu

SEQ ID NO: 89918 - RNA, 22 nt, Human
uuggcacuucacgagacagcua

SEQ ID NO: 89919 - RNA, 22 nt, Human
uuggcacuuugaaugagcucag

SEQ ID NO: 89920 - RNA, 22 nt, Human
uuggcagacuggguccugggga

SEQ ID NO: 89921 - RNA, 22 nt, Human
uuggcagagaguaugcugaaga

SEQ ID NO: 89922 - RNA, 22 nt, Human
uuggcagagccccagccuugga

SEQ ID NO: 89923 - RNA, 22 nt, Human
uuggcagaggggccaccugccc

SEQ ID NO: 89924 - RNA, 22 nt, Human
uuggcagcagaguguggugcuc

SEQ ID NO: 89925 - RNA, 22 nt, Human
uuggcagcccugacccaauggg

SEQ ID NO: 89926 - RNA, 22 nt, Human
uuggcagcucuugauggcaccc

SEQ ID NO: 89927 - RNA, 22 nt, Human
uuggcagcuguuggaccuugac

SEQ ID NO: 89928 - RNA, 20 nt, Human
uuggcagcuucaggguacua

SEQ ID NO: 89929 - RNA, 22 nt, Human
uuggcagggccaggcucucucu

SEQ ID NO: 89930 - RNA, 22 nt, Human
uuggcagugaugcagcuuguuc

SEQ ID NO: 89931 - RNA, 22 nt, Human
uuggccaaaaaagucauuagaa

SEQ ID NO: 89932 - RNA, 22 nt, Human
uuggccaaggaaguagcaacgg

SEQ ID NO: 89933 - RNA, 22 nt, Human
uuggccaagggaucgagguugg

SEQ ID NO: 89934 - RNA, 22 nt, Human
uuggccaagggcucuuuaggcu

SEQ ID NO: 89935 - RNA, 22 nt, Human
uuggccagaucugaggauacug

SEQ ID NO: 89936 - RNA, 22 nt, Human
uuggcccagggucagcggcgcu

SEQ ID NO: 89937 - RNA, 22 nt, Human
uuggcccuuuaugggaugggca

SEQ ID NO: 89938 - RNA, 22 nt, Human
uuggccuaccugggaaugcugg

SEQ ID NO: 89939 - RNA, 22 nt, Human
uuggccuuuaaacuggacuuuc

SEQ ID NO: 89940 - RNA, 21 nt, Human
uuggccuuugucucagacacu

SEQ ID NO: 89941 - RNA, 22 nt, Human
uuggcgcccaggacgccgccgc

SEQ ID NO: 89942 - RNA, 22 nt, Human
uuggcuaugcuuguguucaguu

SEQ ID NO: 89943 - RNA, 22 nt, Human
uuggcucaaaacuuagauucca

SEQ ID NO: 89944 - RNA, 22 nt, Human
uuggcucacaaggacgguugcu

SEQ ID NO: 89945 - RNA, 22 nt, Human
uuggcucacaugauuauggagg

SEQ ID NO: 89946 - RNA, 22 nt, Human
uuggcucaggcuuucauuguaa

SEQ ID NO: 89947 - RNA, 22 nt, Human
uuggcucaugcuguuuugugca

SEQ ID NO: 89948 - RNA, 22 nt, Human
uuggcucccacuaacuccagca

SEQ ID NO: 89949 - RNA, 22 nt, Human
uuggcucuaggaaccaaaguga

SEQ ID NO: 89950 - RNA, 22 nt, Human
uuggcucugaaacccaagcucu

SEQ ID NO: 89951 - RNA, 22 nt, Human
uuggcucuggaacuauuucuga

SEQ ID NO: 89952 - RNA, 22 nt, Human
uuggcugaaagccaugagaccg

SEQ ID NO: 89953 - RNA, 22 nt, Human
uuggcugaagguuaagugcugg

SEQ ID NO: 89954 - RNA, 22 nt, Human
uuggcugaaugaggucaccuuu

SEQ ID NO: 89955 - RNA, 22 nt, Human
uuggcugagagaggaaaagggc

SEQ ID NO: 89956 - RNA, 22 nt, Human
uuggcugagagcugcucugcag

SEQ ID NO: 89957 - RNA, 22 nt, Human
uuggcugcuauuuccauauuua

SEQ ID NO: 89958 - RNA, 22 nt, Human
uuggcugguaagccaaaugaaa

SEQ ID NO: 89959 - RNA, 22 nt, Human
uuggcuguauguacaucuguua

SEQ ID NO: 89960 - RNA, 22 nt, Human
uuggcugugcagaucuugccua

SEQ ID NO: 89961 - RNA, 22 nt, Human
uuggcuguuuuauaggucaguu

SEQ ID NO: 89962 - RNA, 22 nt, Human
uuggcuuccaggaucucagcag

SEQ ID NO: 89963 - RNA, 22 nt, Human
uuggcuucccagagcuuacgcu

SEQ ID NO: 89964 - RNA, 22 nt, Human
uuggcuucucuuaacccuaaag

SEQ ID NO: 89965 - RNA, 22 nt, Human
uuggcuucuggcagucuggacg

SEQ ID NO: 89966 - RNA, 18 nt, Human
uuggcuucuuuccuuccu

SEQ ID NO: 89967 - RNA, 22 nt, Human
uuggcuuggagaguugaaaugu

SEQ ID NO: 89968 - RNA, 18 nt, Human
uuggcuuugagaacuggu

SEQ ID NO: 89969 - RNA, 22 nt, Human
uugggaaacaguauagcuaaca

SEQ ID NO: 89970 - RNA, 22 nt, Human
uugggaaagggauuaugaguag

SEQ ID NO: 89971 - RNA, 22 nt, Human
uugggacagaaaaggagaagau

SEQ ID NO: 89972 - RNA, 22 nt, Human
uugggagcuuggacuuagugug

SEQ ID NO: 89973 - RNA, 22 nt, Human
uugggaggucauaaaucuguuc

SEQ ID NO: 89974 - RNA, 22 nt, Human
uugggauacaucuugcugagcc

SEQ ID NO: 89975 - RNA, 22 nt, Human
uugggcaguagccucuuggugu

SEQ ID NO: 89976 - RNA, 22 nt, Human
uugggccaaauagcuauuuacu

SEQ ID NO: 89977 - RNA, 22 nt, Human
uugggccaaggcagaucuccaa

SEQ ID NO: 89978 - RNA, 22 nt, Human
uucauuaaguauaaaauguggu

SEQ ID NO: 89979 - RNA, 22 nt, Human
uucauuaguucugaagaugucu

SEQ ID NO: 89980 - RNA, 22 nt, Human
uucauucauguauugucuaugg

SEQ ID NO: 89981 - RNA, 19 nt, Human
uucauucucuuauuguugu

SEQ ID NO: 89982 - RNA, 22 nt, Human
uucauucuguuuggaaaggugg

SEQ ID NO: 89983 - RNA, 22 nt, Human
uucauucuugucuuuguauagu

SEQ ID NO: 89984 - RNA, 22 nt, Human
uucauucuuugaaucugaggua

SEQ ID NO: 89985 - RNA, 22 nt, Human
uucauugaaauacagucuugac

SEQ ID NO: 89986 - RNA, 22 nt, Human
uucauugaaauuaagcccaacu

SEQ ID NO: 89987 - RNA, 21 nt, Human
uucauugaacuauuuguggag

SEQ ID NO: 89988 - RNA, 22 nt, Human
uucauugaagcacaagugaucu

SEQ ID NO: 89989 - RNA, 22 nt, Human
uucauugacugguucguuaagu

SEQ ID NO: 89990 - RNA, 22 nt, Human
uucauugaguauagggguauac

SEQ ID NO: 89991 - RNA, 22 nt, Human
uucauugagugguuuauucuaa

SEQ ID NO: 89992 - RNA, 22 nt, Human
uucauugugaacacauucugcc

SEQ ID NO: 89993 - RNA, 22 nt, Human
uucauuugcacuggauuacugg

SEQ ID NO: 89994 - RNA, 22 nt, Human
uuggcccuggggccagcuucga

SEQ ID NO: 89995 - RNA, 22 nt, Human
uuggccuuaaccucucugugcc

SEQ ID NO: 89996 - RNA, 19 nt, Human
uuggccuuguuucauaucu

SEQ ID NO: 89997 - RNA, 22 nt, Human
uuggcgucuuuuccauggaaag

SEQ ID NO: 89998 - RNA, 20 nt, Human
uuggcucagauuuuuauggg

SEQ ID NO: 89999 - RNA, 22 nt, Human
uuggcucagcaucuuggugcca

SEQ ID NO: 90000 - RNA, 22 nt, Human
uuggcucagcugggacuguuga

SEQ ID NO: 90001 - RNA, 17 nt, Human
uuggcucuauugccucu

SEQ ID NO: 90002 - RNA, 22 nt, Human
uuggcugaccagaaccugcccc

SEQ ID NO: 90003 - RNA, 22 nt, Human
uuggcugaugcaagagcuuccu

SEQ ID NO: 90004 - RNA, 22 nt, Human
uuggcugcuaauggcugacagc

SEQ ID NO: 90005 - RNA, 22 nt, Human
uuggcugcuagaugguguuaga

SEQ ID NO: 90006 - RNA, 22 nt, Human
uuggcugcucagugauaugaga

SEQ ID NO: 90007 - RNA, 22 nt, Human
uuggcugcuggucuuuggauau

SEQ ID NO: 90008 - RNA, 22 nt, Human
uuggcugcuuuacucugacggg

SEQ ID NO: 90009 - RNA, 22 nt, Human
uuggcugguuucaagaaggcau

SEQ ID NO: 90010 - RNA, 22 nt, Human
uuggcugugaaagcuucucaaa

SEQ ID NO: 90011 - RNA, 22 nt, Human
uuggcuucuuuagucaguuugg

SEQ ID NO: 90012 - RNA, 22 nt, Human
uuggcuuucagaaucccuaucu

SEQ ID NO: 90013 - RNA, 22 nt, Human
uuggcuuucucuguaucugaau

SEQ ID NO: 90014 - RNA, 22 nt, Human
uuggcuuuuaugcagcuuaggu

SEQ ID NO: 90015 - RNA, 22 nt, Human
uugggaaauauggauuguuauu

SEQ ID NO: 90016 - RNA, 22 nt, Human
uugggaagaaacauguccauca

SEQ ID NO: 90017 - RNA, 22 nt, Human
uucuucaauuauuggaaagaaa

SEQ ID NO: 90018 - RNA, 22 nt, Human
uucuucagagaguagaagcaag

SEQ ID NO: 90019 - RNA, 22 nt, Human
uucuucagcccauaucuuccag

SEQ ID NO: 90020 - RNA, 22 nt, Human
uucuucaggaagagccuggacu

SEQ ID NO: 90021 - RNA, 21 nt, Human
uucuucaguuuaauauaaaau

SEQ ID NO: 90022 - RNA, 22 nt, Human
uucuucauggguucuuuuagga

SEQ ID NO: 90023 - RNA, 22 nt, Human
uucuucccagccagcacagccc

SEQ ID NO: 90024 - RNA, 22 nt, Human
uucuuccucacacucucaccca

SEQ ID NO: 90025 - RNA, 22 nt, Human
uucuucucggcugucagauagu

SEQ ID NO: 90026 - RNA, 20 nt, Human
uucuucucuaguuaucuuca

SEQ ID NO: 90027 - RNA, 22 nt, Human
uucuucugaaacauaaucaaua

SEQ ID NO: 90028 - RNA, 22 nt, Human
uucuucugacacugaugcugua

SEQ ID NO: 90029 - RNA, 22 nt, Human
uucuucuuaauguccugggaac

SEQ ID NO: 90030 - RNA, 22 nt, Human
uucuucuucauuucugacgaug

SEQ ID NO: 90031 - RNA, 22 nt, Human
uucuucuugaaacuuuagguug

SEQ ID NO: 90032 - RNA, 22 nt, Human
uucuugaaaauagccauguaca

SEQ ID NO: 90033 - RNA, 22 nt, Human
uucuugaugcuuguuuaaaggu

SEQ ID NO: 90034 - RNA, 22 nt, Human
uucuugauuagucucaugccaa

SEQ ID NO: 90035 - RNA, 22 nt, Human
uucuugcaggucacucacugag

SEQ ID NO: 90036 - RNA, 22 nt, Human
uucuugcaucacucugcuguuc

SEQ ID NO: 90037 - RNA, 22 nt, Human
uucuugcucaaugucuguuuaa

SEQ ID NO: 90038 - RNA, 22 nt, Human
uucuuggaaacugauuccuugu

SEQ ID NO: 90039 - RNA, 22 nt, Human
uucuuggcacagaugagauucu

SEQ ID NO: 90040 - RNA, 22 nt, Human
uucuuggcuguucauggucagg

SEQ ID NO: 90041 - RNA, 22 nt, Human
uucuuguaauuuggagaaauga

SEQ ID NO: 90042 - RNA, 22 nt, Human
uucuuguauauaaaaaucauuu

SEQ ID NO: 90043 - RNA, 22 nt, Human
uucuuguucuccucauuuagag

SEQ ID NO: 90044 - RNA, 20 nt, Human
uucuuuacgaccuuucugca

SEQ ID NO: 90045 - RNA, 22 nt, Human
uucuuuaucaguuacucauagg

SEQ ID NO: 90046 - RNA, 22 nt, Human
uucuuuauccuauuuguaggug

SEQ ID NO: 90047 - RNA, 22 nt, Human
uucuuuaugcuucuguuuaggc

SEQ ID NO: 90048 - RNA, 22 nt, Human
uucuuuauggaauggugauagu

SEQ ID NO: 90049 - RNA, 22 nt, Human
uucuuucccagaagauauguuu

SEQ ID NO: 90050 - RNA, 22 nt, Human
uucuuucccaguagaugugaaa

SEQ ID NO: 90051 - RNA, 22 nt, Human
uucuuucucaacaugaauguuu

SEQ ID NO: 90052 - RNA, 22 nt, Human
uucuuucucuguaaaaggaaaa

SEQ ID NO: 90053 - RNA, 22 nt, Human
uucuuugaaauacuguuuugcc

SEQ ID NO: 90054 - RNA, 19 nt, Human
uucuuugaguucuucugag

SEQ ID NO: 90055 - RNA, 23 nt, Human
uucuuuggaauugggcugcaagg

SEQ ID NO: 90056 - RNA, 22 nt, Human
uucuuugggcaauugcuggccc

SEQ ID NO: 90057 - RNA, 19 nt, Human
uucuuuggugguggugacc

SEQ ID NO: 90058 - RNA, 22 nt, Human
uucuuugguguuacccagcuca

SEQ ID NO: 90059 - RNA, 22 nt, Human
uucuuuguaaagccacaguccu

SEQ ID NO: 90060 - RNA, 22 nt, Human
uucuuuguuguacuuuccuaca

SEQ ID NO: 90061 - RNA, 22 nt, Human
uucuuuguuugauaaguaugcu

SEQ ID NO: 90062 - RNA, 22 nt, Human
uucuuuuaaaagagagcagaaa

SEQ ID NO: 90063 - RNA, 22 nt, Human
uucuuuuaauguucugaaguuu

SEQ ID NO: 90064 - RNA, 22 nt, Human
uucuuuuagaauuuccuaaggu

SEQ ID NO: 90065 - RNA, 22 nt, Human
uucuuuucaagaggggcaagga

SEQ ID NO: 90066 - RNA, 18 nt, Human
uucuuuucaugugaucuc

SEQ ID NO: 90067 - RNA, 22 nt, Human
uucuuuuccuacacagcgauuu

SEQ ID NO: 90068 - RNA, 22 nt, Human
uucuuuuuaaaguguguaugca

SEQ ID NO: 90069 - RNA, 22 nt, Human
uugaaaaccgugggaggcugaa

SEQ ID NO: 90070 - RNA, 22 nt, Human
uugaaaauaucacaggagcagc

SEQ ID NO: 90071 - RNA, 22 nt, Human
uugaaacauauacaaaguggug

SEQ ID NO: 90072 - RNA, 22 nt, Human
uugaaacucaucuuagugaugu

SEQ ID NO: 90073 - RNA, 22 nt, Human
uugaaacugucagcuuuuacgc

SEQ ID NO: 90074 - RNA, 22 nt, Human
uugaaacuuuaguaaacuaagg

SEQ ID NO: 90075 - RNA, 22 nt, Human
uugaaagacauuauuuauauau

SEQ ID NO: 90076 - RNA, 22 nt, Human
uugaaagaggcaaaguuugauc

SEQ ID NO: 90077 - RNA, 22 nt, Human
uugaaagauagugaagccagcc

SEQ ID NO: 90078 - RNA, 22 nt, Human
uugaaaggccuguuuauccagc

SEQ ID NO: 90079 - RNA, 22 nt, Human
uugaaaggguuaaagugguaaa

SEQ ID NO: 90080 - RNA, 22 nt, Human
uugaaaggugaacaugaugcac

SEQ ID NO: 90081 - RNA, 22 nt, Human
uugaaaguagcagcugcauaug

SEQ ID NO: 90082 - RNA, 22 nt, Human
uugaaaguccuucuugaguuac

SEQ ID NO: 90083 - RNA, 22 nt, Human
uugaaagugccaaguccuagug

SEQ ID NO: 90084 - RNA, 22 nt, Human
uugaaaguuaggauuuagcugg

SEQ ID NO: 90085 - RNA, 22 nt, Human
uugaaaguuaucuagauucuga

SEQ ID NO: 90086 - RNA, 22 nt, Human
uugaaauaucaaguuauuagug

SEQ ID NO: 90087 - RNA, 22 nt, Human
uugaaauauggauugaccuuga

SEQ ID NO: 90088 - RNA, 22 nt, Human
uugaaaucuuccacagcccaag

SEQ ID NO: 90089 - RNA, 22 nt, Human
uugaaaugcucuuuggaaucua

SEQ ID NO: 90090 - RNA, 22 nt, Human
uugaaauguaguccugccuuca

SEQ ID NO: 90091 - RNA, 22 nt, Human
uugaaauuggguguggcuguca

SEQ ID NO: 90092 - RNA, 22 nt, Human
uugaaccaggaacaauuagcuc

SEQ ID NO: 90093 - RNA, 22 nt, Human
uugaacucuggacccaugccag

SEQ ID NO: 90094 - RNA, 22 nt, Human
uugaacuguaagcaugucugcc

SEQ ID NO: 90095 - RNA, 22 nt, Human
uugaagaaauuauuuuauauag

SEQ ID NO: 90096 - RNA, 22 nt, Human
uugaagagaaucagaagguuga

SEQ ID NO: 90097 - RNA, 22 nt, Human
uugaagagucuuucuuuccccc

SEQ ID NO: 90098 - RNA, 22 nt, Human
uugaagagugccuuccagacau

SEQ ID NO: 90099 - RNA, 22 nt, Human
uugaagaugguagcaauuuccu

SEQ ID NO: 90100 - RNA, 22 nt, Human
uugaagcaaauucugugcagua

SEQ ID NO: 90101 - RNA, 22 nt, Human
uugaagcagcucaggaggcuua

SEQ ID NO: 90102 - RNA, 22 nt, Human
uugaagcaggaaaauuucuauu

SEQ ID NO: 90103 - RNA, 22 nt, Human
uuugagaacuuugguauuuucc

SEQ ID NO: 90104 - RNA, 22 nt, Human
uuugagaagcaucugguccacu

SEQ ID NO: 90105 - RNA, 22 nt, Human
uuugagaaggugacaaauucua

SEQ ID NO: 90106 - RNA, 22 nt, Human
uuugagaaugguaaguggaucg

SEQ ID NO: 90107 - RNA, 20 nt, Human
uuugagaccagucugcccaa

SEQ ID NO: 90108 - RNA, 22 nt, Human
uuugagcagcagaugcacuuag

SEQ ID NO: 90109 - RNA, 22 nt, Human
uuugagcuaugggcuuggauuu

SEQ ID NO: 90110 - RNA, 22 nt, Human
uuugagcuuguagcauugcuau

SEQ ID NO: 90111 - RNA, 18 nt, Human
uuugaggaaauguccuga

SEQ ID NO: 90112 - RNA, 22 nt, Human
uuugauauccuauacaaguaaa

SEQ ID NO: 90113 - RNA, 22 nt, Human
uuugauaucuugguauacagau

SEQ ID NO: 90114 - RNA, 22 nt, Human
uuugauuccuggggcagggcug

SEQ ID NO: 90115 - RNA, 21 nt, Human
uuugauucuuccucuccccag

SEQ ID NO: 90116 - RNA, 20 nt, Human
uuugauugccccucugacuu

SEQ ID NO: 90117 - RNA, 22 nt, Human
uuugauuuacuauaagcagcac

SEQ ID NO: 90118 - RNA, 22 nt, Human
uuugcaaaaugaggugaagagu

SEQ ID NO: 90119 - RNA, 22 nt, Human
uuugcaaacacuuaagaagaga

SEQ ID NO: 90120 - RNA, 22 nt, Human
uuugcaaaccggagcucugcaa

SEQ ID NO: 90121 - RNA, 22 nt, Human
uuugcaaauaccaugaaacuug

SEQ ID NO: 90122 - RNA, 22 nt, Human
uuugcaaauuagccacccuguu

SEQ ID NO: 90123 - RNA, 23 nt, Human
uuugcaaauuggacacaaccaca

SEQ ID NO: 90124 - RNA, 22 nt, Human
uuugcaaugugaaauuaaagaa

SEQ ID NO: 90125 - RNA, 22 nt, Human
uuugcacacacaauaacaaaug

SEQ ID NO: 90126 - RNA, 22 nt, Human
uuugcacuuaaauuuacaacac

SEQ ID NO: 90127 - RNA, 22 nt, Human
uuugcagaguaccugaagagga

SEQ ID NO: 90128 - RNA, 22 nt, Human
uuugcagcaaggagagagcauu

SEQ ID NO: 90129 - RNA, 22 nt, Human
uuugcagcuaagcacaguaauu

SEQ ID NO: 90130 - RNA, 20 nt, Human
uuugcaggaaggaaauaggu

SEQ ID NO: 90131 - RNA, 19 nt, Human
uuugcagugguuccuuugu

SEQ ID NO: 90132 - RNA, 22 nt, Human
uugaccuggaaggugcuuccug

SEQ ID NO: 90133 - RNA, 22 nt, Human
uugacguccucgauggggaacu

SEQ ID NO: 90134 - RNA, 22 nt, Human
uugacuguuaagacuuggcucu

SEQ ID NO: 90135 - RNA, 22 nt, Human
uugagaaaagcuguguaaggau

SEQ ID NO: 90136 - RNA, 22 nt, Human
uugagaaaauaguucgaauguu

SEQ ID NO: 90137 - RNA, 22 nt, Human
uugagaaacaucuaaucuuugu

SEQ ID NO: 90138 - RNA, 22 nt, Human
uugagaaacucuggguuagaau

SEQ ID NO: 90139 - RNA, 23 nt, Human
uugagaacaggugugagaauggc

SEQ ID NO: 90140 - RNA, 22 nt, Human
uugagaacuacuuuauuauucu

SEQ ID NO: 90141 - RNA, 22 nt, Human
uugagaagaggcuuuguaggaa

SEQ ID NO: 90142 - RNA, 22 nt, Human
uugagacacuuugggcaucacu

SEQ ID NO: 90143 - RNA, 22 nt, Human
uugagacugagucucgcccugu

SEQ ID NO: 90144 - RNA, 22 nt, Human
uugagaggcuguugacauucug

SEQ ID NO: 90145 - RNA, 22 nt, Human
uugagauggagcuucacucuug

SEQ ID NO: 90146 - RNA, 22 nt, Human
uugagcaaagcagccauucauu

SEQ ID NO: 90147 - RNA, 22 nt, Human
uugagcaaguguacgagcaggc

SEQ ID NO: 90148 - RNA, 22 nt, Human
uugagcaaugucacugaggcuu

SEQ ID NO: 90149 - RNA, 22 nt, Human
uugagcugccuggcuguggcuc

SEQ ID NO: 90150 - RNA, 22 nt, Human
uugaggaaaggaauuuauuuua

SEQ ID NO: 90151 - RNA, 22 nt, Human
uugaggacagugcuuggggccc

SEQ ID NO: 90152 - RNA, 22 nt, Human
uugaggaggaacugugaggcaa

SEQ ID NO: 90153 - RNA, 21 nt, Human
uugaggagugagaguggguuu

SEQ ID NO: 90154 - RNA, 22 nt, Human
uugaggaguuaggauguuuaua

SEQ ID NO: 90155 - RNA, 23 nt, Human
uugaggcaaacucuuuucugaaa

SEQ ID NO: 90156 - RNA, 22 nt, Human
uugaggcagggcaugguggccc

SEQ ID NO: 90157 - RNA, 22 nt, Human
uugagggacagaggugcugucu

SEQ ID NO: 90158 - RNA, 22 nt, Human
uugagggagaaaguuggaguag

SEQ ID NO: 90159 - RNA, 22 nt, Human
uugagggauuuacagagguggg

SEQ ID NO: 90160 - RNA, 22 nt, Human
uugagggucuggaucugcugcu

SEQ ID NO: 90161 - RNA, 22 nt, Human
uugagguaaagcuacuaguuag

SEQ ID NO: 90162 - RNA, 22 nt, Human
uugagguaguacuuauuauugg

SEQ ID NO: 90163 - RNA, 22 nt, Human
uugagguauauucacauauauc

SEQ ID NO: 90164 - RNA, 22 nt, Human
uugagguaucugucuuuaauug

SEQ ID NO: 90165 - RNA, 22 nt, Human
uugaggucauauauauuuggca

SEQ ID NO: 90166 - RNA, 22 nt, Human
uugaggucccugccuugccuuc

SEQ ID NO: 90167 - RNA, 22 nt, Human
uugaggucucuacagaagagug

SEQ ID NO: 90168 - RNA, 22 nt, Human
uugaggucuggcaguagcguug

SEQ ID NO: 90169 - RNA, 22 nt, Human
uugaggucuucagcugacaccu

SEQ ID NO: 90170 - RNA, 22 nt, Human
uugaggucuugaguacugggga

SEQ ID NO: 90171 - RNA, 22 nt, Human
uugaguacaaacucagccugag

SEQ ID NO: 90172 - RNA, 22 nt, Human
uugaguguacuuuagucaucug

SEQ ID NO: 90173 - RNA, 22 nt, Human
uugaucaaaucagcuacugagg

SEQ ID NO: 90174 - RNA, 22 nt, Human
uugaucaagugggaaauaguaa

SEQ ID NO: 90175 - RNA, 22 nt, Human
uugaucccuggaaauugaaaug

SEQ ID NO: 90176 - RNA, 22 nt, Human
uugaucugccucauucuuguuc

SEQ ID NO: 90177 - RNA, 22 nt, Human
uugaugaguuauccauuugacu

SEQ ID NO: 90178 - RNA, 22 nt, Human
uugaugcacuauguaacuuaca

SEQ ID NO: 90179 - RNA, 22 nt, Human
uugauggcugugauuuacucag

SEQ ID NO: 90180 - RNA, 22 nt, Human
uugauguaaaagccuugguggc

SEQ ID NO: 90181 - RNA, 22 nt, Human
uugauguaaagugauucauggg

SEQ ID NO: 90182 - RNA, 22 nt, Human
uugauguaauacuuugcaacca

SEQ ID NO: 90183 - RNA, 22 nt, Human
uugauguagccuaagacagaac

SEQ ID NO: 90184 - RNA, 22 nt, Human
uugauuaaucccaugugaguag

SEQ ID NO: 90185 - RNA, 22 nt, Human
uugauuacaaaguagauacauu

SEQ ID NO: 90186 - RNA, 22 nt, Human
uugauuacuauguguugaaagc

SEQ ID NO: 90187 - RNA, 22 nt, Human
uugauuagugaaacaugccuag

SEQ ID NO: 90188 - RNA, 22 nt, Human
uugauucaaccacuuaauaauc

SEQ ID NO: 90189 - RNA, 22 nt, Human
uugauucauauagauaugcgug

SEQ ID NO: 90190 - RNA, 22 nt, Human
uugauucauggacaggccaggu

SEQ ID NO: 90191 - RNA, 22 nt, Human
uugauucuaaaauaggaggaaa

SEQ ID NO: 90192 - RNA, 22 nt, Human
uugauucuacuuaaaacauaug

SEQ ID NO: 90193 - RNA, 22 nt, Human
uugauucuaugagguaagcuau

SEQ ID NO: 90194 - RNA, 22 nt, Human
uugauucugauccugucuggag

SEQ ID NO: 90195 - RNA, 22 nt, Human
uugauucugauccuuugcuagc

SEQ ID NO: 90196 - RNA, 22 nt, Human
uugauucugaugaaaguccauu

SEQ ID NO: 90197 - RNA, 22 nt, Human
uugauucuuagcuggugauaau

SEQ ID NO: 90198 - RNA, 23 nt, Human
uugauucuuucagggaccuagau

SEQ ID NO: 90199 - RNA, 22 nt, Human
uugauucuuugagaccgugaua

SEQ ID NO: 90200 - RNA, 22 nt, Human
uugauuugauuguaauggcucu

SEQ ID NO: 90201 - RNA, 22 nt, Human
uugauuuuaaaauagugacacu

SEQ ID NO: 90202 - RNA, 22 nt, Human
uugauuuugccugaucugagag

SEQ ID NO: 90203 - RNA, 22 nt, Human
uugauuuuuccagcuucuagag

SEQ ID NO: 90204 - RNA, 22 nt, Human
uugcaaaaacugcaauuacuuu

SEQ ID NO: 90205 - RNA, 22 nt, Human
uugcaaaaucauuucucaggau

SEQ ID NO: 90206 - RNA, 22 nt, Human
uugcaaagagucauguaaguca

SEQ ID NO: 90207 - RNA, 22 nt, Human
uugcaaagugucaugcaaagua

SEQ ID NO: 90208 - RNA, 22 nt, Human
uugcaaaguucccuacacaugu

SEQ ID NO: 90209 - RNA, 20 nt, Human
uugcaaauaucgugggucag

SEQ ID NO: 90210 - RNA, 22 nt, Human
uugcaaaucagaaguauagauu

SEQ ID NO: 90211 - RNA, 22 nt, Human
uugcaaaugugguuagggcuuu

SEQ ID NO: 90212 - RNA, 22 nt, Human
gaaugaacaaggauguucaucc

SEQ ID NO: 90213 - RNA, 22 nt, Human
gaaugaguagaguauaaacaaa

SEQ ID NO: 90214 - RNA, 22 nt, Human
gaaugaguauucuuuauaggau

SEQ ID NO: 90215 - RNA, 22 nt, Human
gaaugcaaauauauggaucagu

SEQ ID NO: 90216 - RNA, 22 nt, Human
gaaugcacucacccaucacuca

SEQ ID NO: 90217 - RNA, 22 nt, Human
gaaugcagugacggaggcuuac

SEQ ID NO: 90218 - RNA, 22 nt, Human
gaaugcauucucuuagcaucua

SEQ ID NO: 90219 - RNA, 22 nt, Human
gaaugcuacuugacucagcuca

SEQ ID NO: 90220 - RNA, 22 nt, Human
gaauggcauugucagccuuuau

SEQ ID NO: 90221 - RNA, 21 nt, Human
gaauggcucgcgcgccacacu

SEQ ID NO: 90222 - RNA, 19 nt, Human
gaaugggaaugggaaagcu

SEQ ID NO: 90223 - RNA, 19 nt, Human
gaauggguucuguagggag

SEQ ID NO: 90224 - RNA, 22 nt, Human
gaauguaagugggcagaagaca

SEQ ID NO: 90225 - RNA, 22 nt, Human
gaaugucuauguaaccgagggg

SEQ ID NO: 90226 - RNA, 19 nt, Human
gaaugucuccuacuucuga

SEQ ID NO: 90227 - RNA, 21 nt, Human
gaaugucugccuucacaauga

SEQ ID NO: 90228 - RNA, 22 nt, Human
gaaugucuuauugcucguugua

SEQ ID NO: 90229 - RNA, 22 nt, Human
gaaugucuucaaaacuagacug

SEQ ID NO: 90230 - RNA, 22 nt, Human
gaaugugugacucuauugagca

SEQ ID NO: 90231 - RNA, 22 nt, Human
gaauguuaaugcacuucuagcu

SEQ ID NO: 90232 - RNA, 22 nt, Human
gaauguuauguauccagucaca

SEQ ID NO: 90233 - RNA, 22 nt, Human
gaauguuauugaacuacgagcu

SEQ ID NO: 90234 - RNA, 20 nt, Human
gaauguuucacuugcuccau

SEQ ID NO: 90235 - RNA, 22 nt, Human
gaauguuuuucauuggugacuc

SEQ ID NO: 90236 - RNA, 22 nt, Human
gaauuaacuggcaguuagugcu

SEQ ID NO: 90237 - RNA, 22 nt, Human
gaauuacagaguuguuaaguca

SEQ ID NO: 90238 - RNA, 22 nt, Human
gaauuacauaauaaaaugagag

SEQ ID NO: 90239 - RNA, 22 nt, Human
gaauuacauuuguguuacugca

SEQ ID NO: 90240 - RNA, 22 nt, Human
gaauuagacaugcuuugcuuuu

SEQ ID NO: 90241 - RNA, 22 nt, Human
gaauuaggugcauguuuacaaa

SEQ ID NO: 90242 - RNA, 22 nt, Human
gaauucaagugcaaugguauau

SEQ ID NO: 90243 - RNA, 22 nt, Human
gaauucaguuaucuaauucaag

SEQ ID NO: 90244 - RNA, 22 nt, Human
gaauucauuagggaagcuaucu

SEQ ID NO: 90245 - RNA, 22 nt, Human
gaauucuaggguaaauauccua

SEQ ID NO: 90246 - RNA, 22 nt, Human
gaauucuagucacacacauuca

SEQ ID NO: 90247 - RNA, 22 nt, Human
gaauucuucugucuuuaacuga

SEQ ID NO: 90248 - RNA, 22 nt, Human
cccagacauugcagggacuggu

SEQ ID NO: 90249 - RNA, 22 nt, Human
cccagacuccucuggcuggugg

SEQ ID NO: 90250 - RNA, 22 nt, Human
cccagagaucuacugagcccag

SEQ ID NO: 90251 - RNA, 22 nt, Human
cccagagcauaacguaucuuga

SEQ ID NO: 90252 - RNA, 22 nt, Human
cccagagcaugugcugccuuug

SEQ ID NO: 90253 - RNA, 22 nt, Human
cccagagccgcuccccuacuuc

SEQ ID NO: 90254 - RNA, 22 nt, Human
cccagagccucauucuguuggg

SEQ ID NO: 90255 - RNA, 22 nt, Human
cccagaggaggcaaagcucugu

SEQ ID NO: 90256 - RNA, 22 nt, Human
cccagaggcugaguugggagca

SEQ ID NO: 90257 - RNA, 22 nt, Human
cccagagggcugaggauaugaa

SEQ ID NO: 90258 - RNA, 22 nt, Human
cccagaggguggagguugcagu

SEQ ID NO: 90259 - RNA, 22 nt, Human
cccagaggucugaaaagguuga

SEQ ID NO: 90260 - RNA, 22 nt, Human
cccagaggugcuucagaggugc

SEQ ID NO: 90261 - RNA, 22 nt, Human
cccagagguuccuuagggacca

SEQ ID NO: 90262 - RNA, 22 nt, Human
cccagaguggacgguggccccu

SEQ ID NO: 90263 - RNA, 22 nt, Human
cccagcagauggcuaugugcua

SEQ ID NO: 90264 - RNA, 22 nt, Human
cccagcagggucucugugucua

SEQ ID NO: 90265 - RNA, 22 nt, Human
cccagcaguacccaagcccuug

SEQ ID NO: 90266 - RNA, 22 nt, Human
cccagcauggagugaggacuca

SEQ ID NO: 90267 - RNA, 22 nt, Human
cccagcauuucugggcugcacu

SEQ ID NO: 90268 - RNA, 22 nt, Human
cccagcccccgagugucuggaa

SEQ ID NO: 90269 - RNA, 20 nt, Human
cccagcccgggccgcgcucg

SEQ ID NO: 90270 - RNA, 22 nt, Human
cccagccucagcuuuacuucca

SEQ ID NO: 90271 - RNA, 22 nt, Human
cccagccucugggcucacccaa

SEQ ID NO: 90272 - RNA, 22 nt, Human
cccagccugugacagccguccu

SEQ ID NO: 90273 - RNA, 22 nt, Human
cccagccuuugcuuccugguuc

SEQ ID NO: 90274 - RNA, 22 nt, Human
cccagcucaagcagagagcuaa

SEQ ID NO: 90275 - RNA, 22 nt, Human
cccagcucucgcacuuacuagc

SEQ ID NO: 90276 - RNA, 19 nt, Human
cccagcucucguggugugc

SEQ ID NO: 90277 - RNA, 22 nt, Human
cccagcucucucaguucugcuu

SEQ ID NO: 90278 - RNA, 22 nt, Human
cccagcucuggaagguggggga

SEQ ID NO: 90279 - RNA, 22 nt, Human
cccagcugauuuuugcagagau

SEQ ID NO: 90280 - RNA, 23 nt, Human
cccagcuggaaguuagaggacca

SEQ ID NO: 90281 - RNA, 19 nt, Human
cccagcuguucuuccacca

SEQ ID NO: 90282 - RNA, 22 nt, Human
cccagcuugcucaccauuccca

SEQ ID NO: 90283 - RNA, 22 nt, Human
cccaggaaagaauuuagagcca

SEQ ID NO: 90284 - RNA, 22 nt, Human
cccaggaaaugggcucuugccu

SEQ ID NO: 90285 - RNA, 22 nt, Human
cccaggaaccuaccagcucgag

SEQ ID NO: 90286 - RNA, 22 nt, Human
cccaggaacuccagagcuccuc

SEQ ID NO: 90287 - RNA, 22 nt, Human
cccaggaagcggagauugcaga

SEQ ID NO: 90288 - RNA, 22 nt, Human
cccaggaauuggaggcugcagu

SEQ ID NO: 90289 - RNA, 22 nt, Human
cccaggaccgcgcggcugagcg

SEQ ID NO: 90290 - RNA, 22 nt, Human
cccaggagagaggggauaaagc

SEQ ID NO: 90291 - RNA, 19 nt, Human
cccaggagcaguauugaug

SEQ ID NO: 90292 - RNA, 22 nt, Human
cccaggagccaucugucuuggc

SEQ ID NO: 90293 - RNA, 22 nt, Human
cccaggaggcagagauagcagu

SEQ ID NO: 90294 - RNA, 22 nt, Human
cccaggaggcagauguugcagu

SEQ ID NO: 90295 - RNA, 22 nt, Human
cccaggaggucgaagcugcagu

SEQ ID NO: 90296 - RNA, 22 nt, Human
cccaggagguggaguucacagu

SEQ ID NO: 90297 - RNA, 21 nt, Human
cccaggaguccuauuuaaaug

SEQ ID NO: 90298 - RNA, 23 nt, Human
cccaggaguuucacugcaaaggu

SEQ ID NO: 90299 - RNA, 22 nt, Human
cccaggcagagagcuggugagc

SEQ ID NO: 90300 - RNA, 22 nt, Human
cccaggcagccccagaagcuug

SEQ ID NO: 90301 - RNA, 22 nt, Human
cccaggcaggagugugguggcu

SEQ ID NO: 90302 - RNA, 22 nt, Human
cccaggcagggacgugcucugg

SEQ ID NO: 90303 - RNA, 22 nt, Human
cccaggccccagggcuugucag

SEQ ID NO: 90304 - RNA, 22 nt, Human
cccaggccuggucugggccagu

SEQ ID NO: 90305 - RNA, 23 nt, Human
cccaggcuacaaauuaugcucug

SEQ ID NO: 90306 - RNA, 22 nt, Human
cccaggcucacuguccgcuucc

SEQ ID NO: 90307 - RNA, 22 nt, Human
cccaggcucuuaugugacuugc

SEQ ID NO: 90308 - RNA, 22 nt, Human
cccaggcuggaauuccaggccu

SEQ ID NO: 90309 - RNA, 22 nt, Human
cccagggaagccauuucugacu

SEQ ID NO: 90310 - RNA, 22 nt, Human
cccagggaaugacucuggccuu

SEQ ID NO: 90311 - RNA, 22 nt, Human
cccagggacagcuagguggggc

SEQ ID NO: 90312 - RNA, 22 nt, Human
cccagggcuugagucauccaug

SEQ ID NO: 90313 - RNA, 20 nt, Human
cccagggguuguggugagga

SEQ ID NO: 90314 - RNA, 22 nt, Human
cccaggguaaucaugugaagcc

SEQ ID NO: 90315 - RNA, 22 nt, Human
cccagguagugagaaauggagg

SEQ ID NO: 90316 - RNA, 21 nt, Human
cccaggucguggucuucccag

SEQ ID NO: 90317 - RNA, 22 nt, Human
cccaggucuccuucuuuagcug

SEQ ID NO: 90318 - RNA, 23 nt, Human
cccagguguggaggcgguggcag

SEQ ID NO: 90319 - RNA, 19 nt, Human
cccaguccuuguccugggc

SEQ ID NO: 90320 - RNA, 20 nt, Human
cccagugaagcauggaagag

SEQ ID NO: 90321 - RNA, 22 nt, Human
cccuuccuccucgccugucaga

SEQ ID NO: 90322 - RNA, 22 nt, Human
cccuuccuggaguacccucugu

SEQ ID NO: 90323 - RNA, 22 nt, Human
cccuuccuugugacuggugggg

SEQ ID NO: 90324 - RNA, 21 nt, Human
cccuucugcuccagcuuugcc

SEQ ID NO: 90325 - RNA, 22 nt, Human
cccuucuguaaaugcugacugg

SEQ ID NO: 90326 - RNA, 21 nt, Human
cccuucuugggucaaaguaua

SEQ ID NO: 90327 - RNA, 22 nt, Human
cccuuggggaugcugugucugg

SEQ ID NO: 90328 - RNA, 22 nt, Human
cccuugggugccagccacaagu

SEQ ID NO: 90329 - RNA, 22 nt, Human
cccuuuaaggaaaggaaggaug

SEQ ID NO: 90330 - RNA, 22 nt, Human
cccuuuaaguccuggaacaaag

SEQ ID NO: 90331 - RNA, 22 nt, Human
cccuuuccauggcucuccuagg

SEQ ID NO: 90332 - RNA, 22 nt, Human
cccuuucccuucuggcucaggg

SEQ ID NO: 90333 - RNA, 22 nt, Human
cccuuucuuccgugacuucugc

SEQ ID NO: 90334 - RNA, 22 nt, Human
cccuuuggcauuuccaggauau

SEQ ID NO: 90335 - RNA, 22 nt, Human
cccuuuggguuccccaagccug

SEQ ID NO: 90336 - RNA, 22 nt, Human
cccuuuuuuaugucaagcauug

SEQ ID NO: 90337 - RNA, 22 nt, Human
ccgaggacauugggcuucuguu

SEQ ID NO: 90338 - RNA, 22 nt, Human
ccgcgccacccauucccacuga

SEQ ID NO: 90339 - RNA, 22 nt, Human
ccggcucggcgaccaggcugaa

SEQ ID NO: 90340 - RNA, 22 nt, Human
ccgggagguggagauugcggug

SEQ ID NO: 90341 - RNA, 22 nt, Human
ccgggcgggggcucucgucacc

SEQ ID NO: 90342 - RNA, 22 nt, Human
ccgggggacuacugggaaacug

SEQ ID NO: 90343 - RNA, 22 nt, Human
ccgucugcagccuccaggaguu

SEQ ID NO: 90344 - RNA, 21 nt, Human
ccgugcucggcuauggaccac

SEQ ID NO: 90345 - RNA, 22 nt, Human
ccgugugcacgcgccggugcug

SEQ ID NO: 90346 - RNA, 22 nt, Human
ccuaaacagaacaaagaggcag

SEQ ID NO: 90347 - RNA, 22 nt, Human
ccuaaagaauuuucauagagcu

SEQ ID NO: 90348 - RNA, 19 nt, Human
ccuaaaguuugaacccugg

SEQ ID NO: 90349 - RNA, 22 nt, Human
ccuaacuucacuucauugaagu

SEQ ID NO: 90350 - RNA, 22 nt, Human
ccuaagauuggugugcacugug

SEQ ID NO: 90351 - RNA, 22 nt, Human
ccuaaguauuuucaguguuaac

SEQ ID NO: 90352 - RNA, 18 nt, Human
ccuaauaugagggguccu

SEQ ID NO: 90353 - RNA, 22 nt, Human
ccuacacaucucaccucacagg

SEQ ID NO: 90354 - RNA, 22 nt, Human
ccuacacaugaaugcgagaaau

SEQ ID NO: 90355 - RNA, 22 nt, Human
ccuacagacaaaccagugacua

SEQ ID NO: 90356 - RNA, 19 nt, Human
ccuacaugaguaagcuugg

SEQ ID NO: 90357 - RNA, 19 nt, Human
ccuacuuguuugagggaag

SEQ ID NO: 90358 - RNA, 22 nt, Human
ccuagaauguacuuaauagaug

SEQ ID NO: 90359 - RNA, 22 nt, Human
ccuagaauuauaaacuuauuag

SEQ ID NO: 90360 - RNA, 22 nt, Human
ccuagagugauugagagcauca

SEQ ID NO: 90361 - RNA, 23 nt, Human
ccuagauucaaagcuuauaauuc

SEQ ID NO: 90362 - RNA, 22 nt, Human
ccuagcagggaagcagugagga

SEQ ID NO: 90363 - RNA, 22 nt, Human
ccuagccccagauaucucacac

SEQ ID NO: 90364 - RNA, 18 nt, Human
ccuagccuccaagcucau

SEQ ID NO: 90365 - RNA, 22 nt, Human
gacagguaccggucagacuacg

SEQ ID NO: 90366 - RNA, 22 nt, Human
gacagguauuugagagcuggga

SEQ ID NO: 90367 - RNA, 22 nt, Human
gacaggugaaacagcaagguaa

SEQ ID NO: 90368 - RNA, 22 nt, Human
gacagguggguaccuuuaugga

SEQ ID NO: 90369 - RNA, 22 nt, Human
gacagguggguucucguaucug

SEQ ID NO: 90370 - RNA, 22 nt, Human
gacaguaaaugcagucuagcac

SEQ ID NO: 90371 - RNA, 22 nt, Human
gacaguaagguggcuucuucuu

SEQ ID NO: 90372 - RNA, 22 nt, Human
gacaguaguaaagcuaggacca

SEQ ID NO: 90373 - RNA, 22 nt, Human
gacaguauccagguggugaaga

SEQ ID NO: 90374 - RNA, 22 nt, Human
gacagucccccagcagcaaacc

SEQ ID NO: 90375 - RNA, 22 nt, Human
gacagucuggccuaaaggguua

SEQ ID NO: 90376 - RNA, 22 nt, Human
gacagugaacagguucccacug

SEQ ID NO: 90377 - RNA, 22 nt, Human
gacagugagagucuacacccuc

SEQ ID NO: 90378 - RNA, 22 nt, Human
gacagugaguaccucaaaggcc

SEQ ID NO: 90379 - RNA, 22 nt, Human
gacaguuaggacaacugacuuc

SEQ ID NO: 90380 - RNA, 22 nt, Human
gacaguuuagguucaaaucuca

SEQ ID NO: 90381 - RNA, 22 nt, Human
gacaguuuugcugaaauugagc

SEQ ID NO: 90382 - RNA, 22 nt, Human
gacauaaaauggaauucuguug

SEQ ID NO: 90383 - RNA, 22 nt, Human
gacauaaaauucaauaauuugu

SEQ ID NO: 90384 - RNA, 22 nt, Human
gacauaaaccuugagauauuaa

SEQ ID NO: 90385 - RNA, 22 nt, Human
gacauaaaugaaguuugacuau

SEQ ID NO: 90386 - RNA, 22 nt, Human
gacauaauccuccucaccuacu

SEQ ID NO: 90387 - RNA, 22 nt, Human
gacauacagcccucucccuggu

SEQ ID NO: 90388 - RNA, 22 nt, Human
gacauagucucugucuucaugg

SEQ ID NO: 90389 - RNA, 17 nt, Human
gacaucaguacuuacag

SEQ ID NO: 90390 - RNA, 22 nt, Human
gacaucauaucaggaggcaugu

SEQ ID NO: 90391 - RNA, 22 nt, Human
gacauccaucauuuccuguuga

SEQ ID NO: 90392 - RNA, 22 nt, Human
gacaucuggaggagaugaaugg

SEQ ID NO: 90393 - RNA, 22 nt, Human
gacaugaauguuauacuuuauu

SEQ ID NO: 90394 - RNA, 22 nt, Human
gacaugcaaugcagugguaagu

SEQ ID NO: 90395 - RNA, 22 nt, Human
gacaugcaguucucaaggguag

SEQ ID NO: 90396 - RNA, 22 nt, Human
gacaugcugaauaacuauauga

SEQ ID NO: 90397 - RNA, 22 nt, Human
gacauggcuucuaggaagcuuu

SEQ ID NO: 90398 - RNA, 22 nt, Human
gacaugugagagcucgguuuuc

SEQ ID NO: 90399 - RNA, 22 nt, Human
gacaugugcugucucuuaaauu

SEQ ID NO: 90400 - RNA, 22 nt, Human
gacauguugaagaauauuugga

SEQ ID NO: 90401 - RNA, 22 nt, Human
gacauuaaaugucuuaguugcc

SEQ ID NO: 90402 - RNA, 22 nt, Human
gacauuaauuucuuugguaauu

SEQ ID NO: 90403 - RNA, 22 nt, Human
gacauuagacuaauguagcauu

SEQ ID NO: 90404 - RNA, 22 nt, Human
gacauucaaguuugcaguuagg

SEQ ID NO: 90405 - RNA, 22 nt, Human
gacauucacagguaaacauucc

SEQ ID NO: 90406 - RNA, 22 nt, Human
gacauucauugaugucuuccuc

SEQ ID NO: 90407 - RNA, 19 nt, Human
gacauuccugacacuggcu

SEQ ID NO: 90408 - RNA, 22 nt, Human
gacauucugucaauguugacuc

SEQ ID NO: 90409 - RNA, 22 nt, Human
gacauugaaaauaauguguaga

SEQ ID NO: 90410 - RNA, 22 nt, Human
gacauugaacaaguuuccugac

SEQ ID NO: 90411 - RNA, 22 nt, Human
gacauuggcuguucauugggau

SEQ ID NO: 90412 - RNA, 20 nt, Human
gacauuguaauuaaugauga

SEQ ID NO: 90413 - RNA, 22 nt, Human
gacauugugguuauuaaauguu

SEQ ID NO: 90414 - RNA, 22 nt, Human
gacauuuaaauugcaggcagcc

SEQ ID NO: 90415 - RNA, 22 nt, Human
gacauuuagguagcuuccaguu

SEQ ID NO: 90416 - RNA, 22 nt, Human
gacauuuauuagaaaacuauca

SEQ ID NO: 90417 - RNA, 22 nt, Human
gaccaagauacagcaucauaga

SEQ ID NO: 90418 - RNA, 22 nt, Human
gaccaaggaagaggggagccag

SEQ ID NO: 90419 - RNA, 22 nt, Human
gaccacacuuuggaaaucacga

SEQ ID NO: 90420 - RNA, 22 nt, Human
gaccacagaagccuugauaggg

SEQ ID NO: 90421 - RNA, 22 nt, Human
gaccacugaaugcacuucuaau

SEQ ID NO: 90422 - RNA, 22 nt, Human
gaccacuggcgcugcgagaccc

SEQ ID NO: 90423 - RNA, 22 nt, Human
gaccagaaucuggacucugauu

SEQ ID NO: 90424 - RNA, 22 nt, Human
gaccagcuacuuguacaguuca

SEQ ID NO: 90425 - RNA, 22 nt, Human
gaccagcugauaaggcauauaa

SEQ ID NO: 90426 - RNA, 22 nt, Human
gaccagcugguccuguccuggg

SEQ ID NO: 90427 - RNA, 22 nt, Human
gaccagcuggugaaaaccaauu

SEQ ID NO: 90428 - RNA, 22 nt, Human
gaccaggcuguuccagucuaac

SEQ ID NO: 90429 - RNA, 22 nt, Human
gaccauuagcugcuauucagua

SEQ ID NO: 90430 - RNA, 22 nt, Human
ccuggaagagcugaaucaggca

SEQ ID NO: 90431 - RNA, 22 nt, Human
ccuggaaggugaugguacagca

SEQ ID NO: 90432 - RNA, 21 nt, Human
ccuggacuaaaaccaggccac

SEQ ID NO: 90433 - RNA, 22 nt, Human
ccuggacuugauauucucuuuc

SEQ ID NO: 90434 - RNA, 22 nt, Human
ccuggagaccagaggauacuuc

SEQ ID NO: 90435 - RNA, 22 nt, Human
ccuggagacccacuucugccaa

SEQ ID NO: 90436 - RNA, 22 nt, Human
ccuggagcaaaaaucuaaggag

SEQ ID NO: 90437 - RNA, 22 nt, Human
ccuggagcacauggcaggaggc

SEQ ID NO: 90438 - RNA, 22 nt, Human
ccuggagcacucucccuggcug

SEQ ID NO: 90439 - RNA, 22 nt, Human
ccuggagcaucaggaggaaggg

SEQ ID NO: 90440 - RNA, 20 nt, Human
ccuggagccuggaaggaguc

SEQ ID NO: 90441 - RNA, 22 nt, Human
ccuggagcucacugggagccgg

SEQ ID NO: 90442 - RNA, 22 nt, Human
ccuggagcuuggucacgcugcg

SEQ ID NO: 90443 - RNA, 22 nt, Human
ccuggagcuuuuccauccugga

SEQ ID NO: 90444 - RNA, 22 nt, Human
ccuggaggggaccaggaccagg

SEQ ID NO: 90445 - RNA, 18 nt, Human
ccuggaggucuucggggu

SEQ ID NO: 90446 - RNA, 22 nt, Human
ccuggagguggagguugcagug

SEQ ID NO: 90447 - RNA, 22 nt, Human
ccuggaguaccguggccaucca

SEQ ID NO: 90448 - RNA, 19 nt, Human
ccuggagucgcgcugccuc

SEQ ID NO: 90449 - RNA, 22 nt, Human
ccuggagugacagguguagccu

SEQ ID NO: 90450 - RNA, 22 nt, Human
ccuggagugggguccgugcaug

SEQ ID NO: 90451 - RNA, 18 nt, Human
ccuggaguguguuaggcu

SEQ ID NO: 90452 - RNA, 22 nt, Human
ccuggaucagagccagagaagc

SEQ ID NO: 90453 - RNA, 16 nt, Human
ccuggauccccugugg

SEQ ID NO: 90454 - RNA, 22 nt, Human
ccuggaucuaaggaagcuggga

SEQ ID NO: 90455 - RNA, 22 nt, Human
ccuggaucuccucuauucauau

SEQ ID NO: 90456 - RNA, 22 nt, Human
ccuggcacauagcaaccccucc

SEQ ID NO: 90457 - RNA, 22 nt, Human
ccuggcacaucuaacucacucu

SEQ ID NO: 90458 - RNA, 22 nt, Human
ccuggcaccuguguuuucugga

SEQ ID NO: 90459 - RNA, 22 nt, Human
ccuggcaccuucacagacuacu

SEQ ID NO: 90460 - RNA, 22 nt, Human
ccuggcacgaagggcugagguu

SEQ ID NO: 90461 - RNA, 21 nt, Human
ccuggcacuggccugcugagc

SEQ ID NO: 90462 - RNA, 22 nt, Human
ccuggcagaaagaguuacaccu

SEQ ID NO: 90463 - RNA, 23 nt, Human
ccuggcagcaaacgaggagguua

SEQ ID NO: 90464 - RNA, 22 nt, Human
ccuggcagcauugguagagauu

SEQ ID NO: 90465 - RNA, 22 nt, Human
ccuggcagcuccguggccuucc

SEQ ID NO: 90466 - RNA, 22 nt, Human
ccuggcagcuguuuggcuuggc

SEQ ID NO: 90467 - RNA, 20 nt, Human
ccuggcaggcggguuacuua

SEQ ID NO: 90468 - RNA, 22 nt, Human
ccuggcaggcuggggacagugc

SEQ ID NO: 90469 - RNA, 22 nt, Human
ccuggcagggcugcaguaaugg

SEQ ID NO: 90470 - RNA, 22 nt, Human
ccuggcaguucaucaaauggca

SEQ ID NO: 90471 - RNA, 22 nt, Human
ccuggccacagggcucugcauu

SEQ ID NO: 90472 - RNA, 22 nt, Human
ccuggccagcgccggcugcucg

SEQ ID NO: 90473 - RNA, 22 nt, Human
ccuggccagcuaauugcccauc

SEQ ID NO: 90474 - RNA, 22 nt, Human
ccuggccaggcuccaaguacug

SEQ ID NO: 90475 - RNA, 22 nt, Human
ccuggccagggucugggcugcu

SEQ ID NO: 90476 - RNA, 22 nt, Human
ccuggcccacauggcuucuccc

SEQ ID NO: 90477 - RNA, 19 nt, Human
ccuggcccugcugcgcggg

SEQ ID NO: 90478 - RNA, 21 nt, Human
ccuggcuccagaacuuccggu

SEQ ID NO: 90479 - RNA, 22 nt, Human
ccuggcucccugcacagggcuc

SEQ ID NO: 90480 - RNA, 22 nt, Human
ccuggcuccugccucugcaggg

SEQ ID NO: 90481 - RNA, 22 nt, Human
ccuggcucgcugaccucagggg

SEQ ID NO: 90482 - RNA, 22 nt, Human
ccuggcucuagaggccacuccu

SEQ ID NO: 90483 - RNA, 22 nt, Human
ccuggcucucugcagauccugg

SEQ ID NO: 90484 - RNA, 22 nt, Human
ccuggcucugagguaugccugg

SEQ ID NO: 90485 - RNA, 22 nt, Human
ccuggcucugcagccacuccag

SEQ ID NO: 90486 - RNA, 22 nt, Human
ccuggcucugcgugcagcuccg

SEQ ID NO: 90487 - RNA, 22 nt, Human
ccuggcucugguucccucagcu

SEQ ID NO: 90488 - RNA, 21 nt, Human
ccuggcucuguguuuauuaug

SEQ ID NO: 90489 - RNA, 22 nt, Human
ccuggcucuucagagguuccua

SEQ ID NO: 90490 - RNA, 22 nt, Human
ccuggcucuucgggaguuuguu

SEQ ID NO: 90491 - RNA, 22 nt, Human
ccuggcugaggggccaaggacc

SEQ ID NO: 90492 - RNA, 22 nt, Human
ccuggcugcccauggacccucu

SEQ ID NO: 90493 - RNA, 22 nt, Human
ccuggcugccuuguguugaucu

SEQ ID NO: 90494 - RNA, 19 nt, Human
ccuggcugcugugggaugc

SEQ ID NO: 90495 - RNA, 22 nt, Human
ccuggcuggcaagaucgugaag

SEQ ID NO: 90496 - RNA, 22 nt, Human
ccuggcugggguagaagugagg

SEQ ID NO: 90497 - RNA, 22 nt, Human
ccuggcugguugucugauucua

SEQ ID NO: 90498 - RNA, 19 nt, Human
ccuggcugugaagccugca

SEQ ID NO: 90499 - RNA, 23 nt, Human
ccuggcuguggauuugggccugc

SEQ ID NO: 90500 - RNA, 22 nt, Human
ccuggcugugugaccuuggcaa

SEQ ID NO: 90501 - RNA, 21 nt, Human
ccugagggugguugugaagau

SEQ ID NO: 90502 - RNA, 20 nt, Human
ccugaggguuuguguucuuu

SEQ ID NO: 90503 - RNA, 22 nt, Human
ccugagguggcugcagcacugc

SEQ ID NO: 90504 - RNA, 19 nt, Human
ccugaggugggguggaagg

SEQ ID NO: 90505 - RNA, 22 nt, Human
ccugaguaacauggugagaacc

SEQ ID NO: 90506 - RNA, 22 nt, Human
ccugaguccccucauucacucu

SEQ ID NO: 90507 - RNA, 22 nt, Human
ccugagugaauucccucacugu

SEQ ID NO: 90508 - RNA, 17 nt, Human
ccugagugggagaggaa

SEQ ID NO: 90509 - RNA, 22 nt, Human
ccugauuagggucuuucaaaug

SEQ ID NO: 90510 - RNA, 22 nt, Human
ccugcacagccggaccccugcu

SEQ ID NO: 90511 - RNA, 22 nt, Human
ccugcacagccuuggcugacac

SEQ ID NO: 90512 - RNA, 22 nt, Human
ccugcaccacaaggcuucagag

SEQ ID NO: 90513 - RNA, 22 nt, Human
ccugcaccacacucacugcuca

SEQ ID NO: 90514 - RNA, 22 nt, Human
ccugcagaccacacucaguccu

SEQ ID NO: 90515 - RNA, 22 nt, Human
ccugcagagcaggagaggcauc

SEQ ID NO: 90516 - RNA, 22 nt, Human
ccugcagcccuucaaaggcuga

SEQ ID NO: 90517 - RNA, 23 nt, Human
ccugcagcugcuggggcuccacc

SEQ ID NO: 90518 - RNA, 22 nt, Human
ccugcaggcugcaggccaguuc

SEQ ID NO: 90519 - RNA, 22 nt, Human
ccugcagucuacccaaugugug

SEQ ID NO: 90520 - RNA, 22 nt, Human
ccugcauccgaaagugaucaua

SEQ ID NO: 90521 - RNA, 22 nt, Human
ccugccacuucuugcuauggag

SEQ ID NO: 90522 - RNA, 22 nt, Human
ccugccagcccccauagagaca

SEQ ID NO: 90523 - RNA, 22 nt, Human
ccugccagcugugggccagccu

SEQ ID NO: 90524 - RNA, 22 nt, Human
ccugccagggccagaggccagc

SEQ ID NO: 90525 - RNA, 18 nt, Human
ccugccagucuggagcag

SEQ ID NO: 90526 - RNA, 22 nt, Human
ccugccaucagaaacacucaaa

SEQ ID NO: 90527 - RNA, 22 nt, Human
ccugccaugguagacuuccagg

SEQ ID NO: 90528 - RNA, 22 nt, Human
ccugcccagagccccuuucacu

SEQ ID NO: 90529 - RNA, 22 nt, Human
ccugcccaggagucucucugug

SEQ ID NO: 90530 - RNA, 22 nt, Human
ccugccccucaaggccuggugc

SEQ ID NO: 90531 - RNA, 22 nt, Human
ccugcccuaugaccagcuucac

SEQ ID NO: 90532 - RNA, 22 nt, Human
ccugccuauguaagugguuucu

SEQ ID NO: 90533 - RNA, 22 nt, Human
ccugccucccagagguccucua

SEQ ID NO: 90534 - RNA, 17 nt, Human
ccugccugagccauagc

SEQ ID NO: 90535 - RNA, 19 nt, Human
ccugccugagcugucccuc

SEQ ID NO: 90536 - RNA, 22 nt, Human
ccugccugauuccaggauggcu

SEQ ID NO: 90537 - RNA, 22 nt, Human
ccugccugcaaaaugggacaag

SEQ ID NO: 90538 - RNA, 22 nt, Human
ccugccugcaccuucucugggg

SEQ ID NO: 90539 - RNA, 22 nt, Human
ccugccuggagcugagugugga

SEQ ID NO: 90540 - RNA, 22 nt, Human
cgaaaauagaucuguuucccag

SEQ ID NO: 90541 - RNA, 21 nt, Human
cgaaguuugggcagagggguc

SEQ ID NO: 90542 - RNA, 22 nt, Human
cgacagcagaagaagcaagcca

SEQ ID NO: 90543 - RNA, 21 nt, Human
cgacaggagaggcagccagcc

SEQ ID NO: 90544 - RNA, 22 nt, Human
cgacccuacagacagugcugag

SEQ ID NO: 90545 - RNA, 22 nt, Human
cgacgggcucgguccgcuuccu

SEQ ID NO: 90546 - RNA, 22 nt, Human
cgagagccggaaggggcggugc

SEQ ID NO: 90547 - RNA, 22 nt, Human
cgagaggcuggacagggcuggg

SEQ ID NO: 90548 - RNA, 22 nt, Human
cgagaguuagcuaggagucaca

SEQ ID NO: 90549 - RNA, 22 nt, Human
cgagauccuucagagcgcggac

SEQ ID NO: 90550 - RNA, 22 nt, Human
cgagcagaagccugguggucug

SEQ ID NO: 90551 - RNA, 22 nt, Human
cgagcagaauggagggugccga

SEQ ID NO: 90552 - RNA, 22 nt, Human
cgagcagagcagagacgucugg

SEQ ID NO: 90553 - RNA, 22 nt, Human
cgagcaugaugacggcuguggc

SEQ ID NO: 90554 - RNA, 22 nt, Human
cgaggaaauauuuacaacugau

SEQ ID NO: 90555 - RNA, 22 nt, Human
cgaggccaccgugguuuccgag

SEQ ID NO: 90556 - RNA, 22 nt, Human
cgagguaguggcggccgcggcc

SEQ ID NO: 90557 - RNA, 22 nt, Human
cgagguauagggaggguaucuc

SEQ ID NO: 90558 - RNA, 22 nt, Human
cgagugucugcuaugggcugag

SEQ ID NO: 90559 - RNA, 22 nt, Human
cgaugcuggaaugacagcugcu

SEQ ID NO: 90560 - RNA, 20 nt, Human
cgauucaguggaguuugaaa

SEQ ID NO: 90561 - RNA, 22 nt, Human
cgauuuccgcuugaucugaucu

SEQ ID NO: 90562 - RNA, 22 nt, Human
cgcaacucagcaacuuaacugc

SEQ ID NO: 90563 - RNA, 22 nt, Human
cgcaauuaauucgggccacagu

SEQ ID NO: 90564 - RNA, 22 nt, Human
cgcaccacugaauuccagccug

SEQ ID NO: 90565 - RNA, 22 nt, Human
cgcagagggcaggcagugcugg

SEQ ID NO: 90566 - RNA, 20 nt, Human
cgcagcaguggaaguggaau

SEQ ID NO: 90567 - RNA, 22 nt, Human
cgcagccccaacaaaugggaca

SEQ ID NO: 90568 - RNA, 22 nt, Human
cgcagcuggauaucaugugccu

SEQ ID NO: 90569 - RNA, 22 nt, Human
cgcagcuucagggccaggaggg

SEQ ID NO: 90570 - RNA, 22 nt, Human
cgcaggcacagaguggacagcg

SEQ ID NO: 90571 - RNA, 22 nt, Human
cgcaggcugcagccaagaagag

SEQ ID NO: 90572 - RNA, 22 nt, Human
cgcaggcuggcgcggaguggca

SEQ ID NO: 90573 - RNA, 22 nt, Human
cgcaggugaaagaggcugggca

SEQ ID NO: 90574 - RNA, 22 nt, Human
cgccaggcuugguagcucaugc

SEQ ID NO: 90575 - RNA, 22 nt, Human
cgccccagaugcaagacaaaga

SEQ ID NO: 90576 - RNA, 22 nt, Human
cgccuucacaaggacaguauau

SEQ ID NO: 90577 - RNA, 22 nt, Human
cgccuucaggcccuuuuuguug

SEQ ID NO: 90578 - RNA, 22 nt, Human
cgcucuggagaauaguagcuuu

SEQ ID NO: 90579 - RNA, 22 nt, Human
cgcugauaaacgucacguuccc

SEQ ID NO: 90580 - RNA, 22 nt, Human
cgcugcagaagcguguucagga

SEQ ID NO: 90581 - RNA, 22 nt, Human
cgcugcagacgcgcuggcgaaa

SEQ ID NO: 90582 - RNA, 22 nt, Human
cgcugcagcuggcugcagggaa

SEQ ID NO: 90583 - RNA, 22 nt, Human
cgcugcaguuuauguguuccug

SEQ ID NO: 90584 - RNA, 22 nt, Human
cgcugccaggauccccugccgg

SEQ ID NO: 90585 - RNA, 22 nt, Human
cgcugggcagguccacuuguua

SEQ ID NO: 90586 - RNA, 22 nt, Human
cgcugggugcagugauuggcau

SEQ ID NO: 90587 - RNA, 22 nt, Human
cgcuucucuacucccagccagu

SEQ ID NO: 90588 - RNA, 21 nt, Human
cggaaaggacuagggcucaga

SEQ ID NO: 90589 - RNA, 22 nt, Human
cggagaggaccugcaacucgcu

SEQ ID NO: 90590 - RNA, 22 nt, Human
cggagaggugggggcagcaucu

SEQ ID NO: 90591 - RNA, 22 nt, Human
cggagcagaaggcgccgccggc

SEQ ID NO: 90592 - RNA, 21 nt, Human
cggagcugggcagggcauccc

SEQ ID NO: 90593 - RNA, 22 nt, Human
cggcagagcuuccugcucagcg

SEQ ID NO: 90594 - RNA, 22 nt, Human
cggcagcgguuggagguuguag

SEQ ID NO: 90595 - RNA, 22 nt, Human
cggcagugggcgccaggucucc

SEQ ID NO: 90596 - RNA, 22 nt, Human
cggccaggcacaguggcccacg

SEQ ID NO: 90597 - RNA, 22 nt, Human
cggccgcagcagugucggccca

SEQ ID NO: 90598 - RNA, 22 nt, Human
cggcgcaggcagaccgcgggcu

SEQ ID NO: 90599 - RNA, 22 nt, Human
cggcucagacuucccaagaaca

SEQ ID NO: 90600 - RNA, 21 nt, Human
cggcucagugccugcuccuuc

SEQ ID NO: 90601 - RNA, 22 nt, Human
cggcuccuccgcccuugcucac

SEQ ID NO: 90602 - RNA, 22 nt, Human
cggcugagacggccauagacac

SEQ ID NO: 90603 - RNA, 23 nt, Human
cggcugcucggccgaguccucgg

SEQ ID NO: 90604 - RNA, 22 nt, Human
cggcuggagcugagaaaggagc

SEQ ID NO: 90605 - RNA, 22 nt, Human
cggcuggagcuuugaaccugau

SEQ ID NO: 90606 - RNA, 22 nt, Human
cggcuucaguaauuccaugucc

SEQ ID NO: 90607 - RNA, 21 nt, Human
cggcuucauuuucuucugguu

SEQ ID NO: 90608 - RNA, 22 nt, Human
cggcuucucgggucggauuccg

SEQ ID NO: 90609 - RNA, 22 nt, Human
cggcuucugcccauucaguccu

SEQ ID NO: 90610 - RNA, 18 nt, Human
cggcuucugucaccuugc

SEQ ID NO: 90611 - RNA, 22 nt, Human
cggcuucuucgaggugucugcg

SEQ ID NO: 90612 - RNA, 22 nt, Human
cgggaagguggagguugcagug

SEQ ID NO: 90613 - RNA, 22 nt, Human
cgggcacugccuuuguugauuu

SEQ ID NO: 90614 - RNA, 22 nt, Human
ccuggcuguuugagcggggaau

SEQ ID NO: 90615 - RNA, 22 nt, Human
ccuggcuuccauauggcacaua

SEQ ID NO: 90616 - RNA, 22 nt, Human
ccuggcuucucugcauuguucu

SEQ ID NO: 90617 - RNA, 22 nt, Human
ccugggaagaccggcagugggg

SEQ ID NO: 90618 - RNA, 20 nt, Human
ccugggaaggcagccccagc

SEQ ID NO: 90619 - RNA, 22 nt, Human
ccugggaaggggaagagaauuc

SEQ ID NO: 90620 - RNA, 22 nt, Human
ccugggaaguuguggcugcagu

SEQ ID NO: 90621 - RNA, 22 nt, Human
ccugggaccucgcgggaagcgg

SEQ ID NO: 90622 - RNA, 21 nt, Human
ccugggagaauuggguguggc

SEQ ID NO: 90623 - RNA, 17 nt, Human
ccugggaggaguuauga

SEQ ID NO: 90624 - RNA, 19 nt, Human
ccugggaggcggagguugc

SEQ ID NO: 90625 - RNA, 22 nt, Human
ccugggaggcggagguugcagg

SEQ ID NO: 90626 - RNA, 22 nt, Human
ccugggagguggauguugcggu

SEQ ID NO: 90627 - RNA, 19 nt, Human
ccugggagucagcugaagg

SEQ ID NO: 90628 - RNA, 22 nt, Human
ccugggagugcacagguuucgu

SEQ ID NO: 90629 - RNA, 22 nt, Human
ccugggagugucagacuugcuu

SEQ ID NO: 90630 - RNA, 22 nt, Human
ccugggcaacauagugagaccc

SEQ ID NO: 90631 - RNA, 22 nt, Human
ccugggcaacauagugagaccu

SEQ ID NO: 90632 - RNA, 22 nt, Human
ccugggccuugaccucgugggc

SEQ ID NO: 90633 - RNA, 20 nt, Human
ccugggcucaaagcauccuc

SEQ ID NO: 90634 - RNA, 22 nt, Human
ccugggcucaagugauccuccu

SEQ ID NO: 90635 - RNA, 22 nt, Human
ccugggcucaagugaugguccc

SEQ ID NO: 90636 - RNA, 20 nt, Human
ccugggcuccaggagccccg

SEQ ID NO: 90637 - RNA, 22 nt, Human
ccugggcucgcgcacuucaccc

SEQ ID NO: 90638 - RNA, 22 nt, Human
ccugggcucugucagaauuggg

SEQ ID NO: 90639 - RNA, 22 nt, Human
ccugggcugcucauggggauga

SEQ ID NO: 90640 - RNA, 22 nt, Human
ccugggcugggcgucucauggg

SEQ ID NO: 90641 - RNA, 22 nt, Human
ccugggcuuucaaaaccagccu

SEQ ID NO: 90642 - RNA, 22 nt, Human
ccugggcuuucggcggcuuccu

SEQ ID NO: 90643 - RNA, 22 nt, Human
ccugggcuuugcuggcaaggcc

SEQ ID NO: 90644 - RNA, 22 nt, Human
ccuggggagaagagcuuccccc

SEQ ID NO: 90645 - RNA, 22 nt, Human
ccuggggagagaaagcccagcc

SEQ ID NO: 90646 - RNA, 20 nt, Human
ccugggguacacuggcaugu

SEQ ID NO: 90647 - RNA, 22 nt, Human
ccuggggucacuugcagccgca

SEQ ID NO: 90648 - RNA, 22 nt, Human
ccugggucaccaggcccaggca

SEQ ID NO: 90649 - RNA, 22 nt, Human
ccugggagagccaucuguggcc

SEQ ID NO: 90650 - RNA, 22 nt, Human
ccugggagccaagccucugugu

SEQ ID NO: 90651 - RNA, 22 nt, Human
ccugggaggcugugggucugcu

SEQ ID NO: 90652 - RNA, 22 nt, Human
ccugggagggcaagugcugaug

SEQ ID NO: 90653 - RNA, 22 nt, Human
ccugggagguggagguugcagc

SEQ ID NO: 90654 - RNA, 22 nt, Human
ccugggagguggagguugcagu

SEQ ID NO: 90655 - RNA, 22 nt, Human
ccugggagugugccaucucugu

SEQ ID NO: 90656 - RNA, 22 nt, Human
ccugggcaaaugccagagacaa

SEQ ID NO: 90657 - RNA, 22 nt, Human
ccugggcaaauuauguuacuca

SEQ ID NO: 90658 - RNA, 22 nt, Human
ccugggcaggccggacgcuggg

SEQ ID NO: 90659 - RNA, 22 nt, Human
ccugggcccucaccgccggugg

SEQ ID NO: 90660 - RNA, 22 nt, Human
ccugggcucaccaugccuugga

SEQ ID NO: 90661 - RNA, 22 nt, Human
ccugggcucugaggagggaguc

SEQ ID NO: 90662 - RNA, 22 nt, Human
ccugggcugcaugauggcauuu

SEQ ID NO: 90663 - RNA, 22 nt, Human
ccugggcuguaccugugcgcgg

SEQ ID NO: 90664 - RNA, 21 nt, Human
ccugggcugugguuuggagac

SEQ ID NO: 90665 - RNA, 22 nt, Human
ccugggcuugcaucugugcugg

SEQ ID NO: 90666 - RNA, 22 nt, Human
ccuggggaaucuugcaggggaa

SEQ ID NO: 90667 - RNA, 22 nt, Human
ccuggggaccugccucagcccu

SEQ ID NO: 90668 - RNA, 22 nt, Human
ccuggggcuuucuuuguaucau

SEQ ID NO: 90669 - RNA, 22 nt, Human
ccuggguacccuuggcggccuu

SEQ ID NO: 90670 - RNA, 22 nt, Human
ccuggguacgcagggcuccucu

SEQ ID NO: 90671 - RNA, 22 nt, Human
ccuggguccacccugugaagua

SEQ ID NO: 90672 - RNA, 19 nt, Human
ccuggguccacucagacua

SEQ ID NO: 90673 - RNA, 22 nt, Human
ccugggucuccuccugcuggcu

SEQ ID NO: 90674 - RNA, 19 nt, Human
ccugggucugcagcauuca

SEQ ID NO: 90675 - RNA, 22 nt, Human
ccugggucuugguucaugcucu

SEQ ID NO: 90676 - RNA, 22 nt, Human
ccugggugacagagugagaccu

SEQ ID NO: 90677 - RNA, 21 nt, Human
ccugggugggaccccucuucc

SEQ ID NO: 90678 - RNA, 22 nt, Human
ccugggugucaugggcagcugg

SEQ ID NO: 90679 - RNA, 22 nt, Human
ccuggguuaguaucuguuucca

SEQ ID NO: 90680 - RNA, 22 nt, Human
ccuggguuauuuuggucuagug

SEQ ID NO: 90681 - RNA, 22 nt, Human
ccuggucagagcagucaggauc

SEQ ID NO: 90682 - RNA, 22 nt, Human
ccuggucagguaacugggcuga

SEQ ID NO: 90683 - RNA, 22 nt, Human
ccuggucccauugcggcugccu

SEQ ID NO: 90684 - RNA, 22 nt, Human
ccuggugaauguucauggacug

SEQ ID NO: 90685 - RNA, 22 nt, Human
ccuggugcugcuaucaggggua

SEQ ID NO: 90686 - RNA, 22 nt, Human
ccugguggccuucagcccacaa

SEQ ID NO: 90687 - RNA, 22 nt, Human
ccugguggcuucuggguggacg

SEQ ID NO: 90688 - RNA, 22 nt, Human
ccuggugggcaggagugagacc

SEQ ID NO: 90689 - RNA, 20 nt, Human
ccugguguauuuccuggggu

SEQ ID NO: 90690 - RNA, 22 nt, Human
ccugguguggcugucacagagg

SEQ ID NO: 90691 - RNA, 22 nt, Human
ccugguguuaucauaggucaug

SEQ ID NO: 90692 - RNA, 22 nt, Human
ccugguguugccaaucugugcc

SEQ ID NO: 90693 - RNA, 22 nt, Human
ccugguuugggugccagugagu

SEQ ID NO: 90694 - RNA, 22 nt, Human
ccuguacaagagccaucuggau

SEQ ID NO: 90695 - RNA, 22 nt, Human
ccuguacacaauuccgaggaua

SEQ ID NO: 90696 - RNA, 22 nt, Human
ccuguacauggccaucuuuacc

SEQ ID NO: 90697 - RNA, 22 nt, Human
ccuguacauuagcugugaauug

SEQ ID NO: 90698 - RNA, 22 nt, Human
ccuguauggcuauuccuuggac

SEQ ID NO: 90699 - RNA, 22 nt, Human
ccuguauuagguagacaacuau

SEQ ID NO: 90700 - RNA, 22 nt, Human
ccuguauuauuuguaugugcug

SEQ ID NO: 90701 - RNA, 22 nt, Human
ccuguauucaauuuugugugau

SEQ ID NO: 90702 - RNA, 22 nt, Human
ccugucacgaugacugcacucu

SEQ ID NO: 90703 - RNA, 18 nt, Human
ccugucacguccaggccu

SEQ ID NO: 90704 - RNA, 22 nt, Human
ccugucacuguugcagccagcu

SEQ ID NO: 90705 - RNA, 22 nt, Human
ccugucagaugaaguaauugug

SEQ ID NO: 90706 - RNA, 22 nt, Human
ccugucagcugauggcuaugua

SEQ ID NO: 90707 - RNA, 22 nt, Human
ccugucaggguuugccucagaa

SEQ ID NO: 90708 - RNA, 22 nt, Human
ccugucauaauguccgauguca

SEQ ID NO: 90709 - RNA, 22 nt, Human
ccugucucuuucaaucugagag

SEQ ID NO: 90710 - RNA, 22 nt, Human
ccugucugaaggcagggggaug

SEQ ID NO: 90711 - RNA, 22 nt, Human
ccugucugagccagggugggca

SEQ ID NO: 90712 - RNA, 22 nt, Human
ccugucugcaagggguggaucc

SEQ ID NO: 90713 - RNA, 22 nt, Human
ccugucuggccaccagggcgau

SEQ ID NO: 90714 - RNA, 22 nt, Human
ccugucuggggacucccugggu

SEQ ID NO: 90715 - RNA, 22 nt, Human
ccugucuguaucgguucagagu

SEQ ID NO: 90716 - RNA, 22 nt, Human
ccugucuguccucucaugagcc

SEQ ID NO: 90717 - RNA, 22 nt, Human
ccugucuguccuuugcauucuu

SEQ ID NO: 90718 - RNA, 23 nt, Human
ccugucugugcuggguggacaca

SEQ ID NO: 90719 - RNA, 22 nt, Human
ccugucuguucugacuggucag

SEQ ID NO: 90720 - RNA, 22 nt, Human
ccugucuuagggaaagacugga

SEQ ID NO: 90721 - RNA, 17 nt, Human
ccugucuuguuucugcc

SEQ ID NO: 90722 - RNA, 22 nt, Human
ccugugaauccaucauuauuuc

SEQ ID NO: 90723 - RNA, 23 nt, Human
ccugugacacuguuugugguaag

SEQ ID NO: 90724 - RNA, 19 nt, Human
ccugugacuaucuuuguaa

SEQ ID NO: 90725 - RNA, 19 nt, Human
ccugugagaggacaggugu

SEQ ID NO: 90726 - RNA, 22 nt, Human
ccugugagucaaccccuccuug

SEQ ID NO: 90727 - RNA, 22 nt, Human
ccugugcagcccuugccaguuu

SEQ ID NO: 90728 - RNA, 21 nt, Human
ccugugccagucuauguguuc

SEQ ID NO: 90729 - RNA, 22 nt, Human
ccugugccauccugagcauccc

SEQ ID NO: 90730 - RNA, 22 nt, Human
ccugugcuucagcuggaggagg

SEQ ID NO: 90731 - RNA, 22 nt, Human
ccugugcuuuaggccucaaacu

SEQ ID NO: 90732 - RNA, 22 nt, Human
gagggagaaggacuaucaggcu

SEQ ID NO: 90733 - RNA, 22 nt, Human
gagggagagugauggaccauug

SEQ ID NO: 90734 - RNA, 22 nt, Human
gagggagccgccacagacuggg

SEQ ID NO: 90735 - RNA, 22 nt, Human
gagggagcuaugaauagaagaa

SEQ ID NO: 90736 - RNA, 22 nt, Human
gagggagcuugauggauguuug

SEQ ID NO: 90737 - RNA, 22 nt, Human
gagggagggacuagcauucucu

SEQ ID NO: 90738 - RNA, 22 nt, Human
gagggaguaacguacuacagug

SEQ ID NO: 90739 - RNA, 22 nt, Human
gagggagucugugcaaagaauu

SEQ ID NO: 90740 - RNA, 22 nt, Human
gagggauggugugagaggcuca

SEQ ID NO: 90741 - RNA, 22 nt, Human
gagggaugucaggggaccuugg

SEQ ID NO: 90742 - RNA, 22 nt, Human
gagggcaaaacagagaagaugu

SEQ ID NO: 90743 - RNA, 22 nt, Human
gagggcagagacagugauucac

SEQ ID NO: 90744 - RNA, 20 nt, Human
gagggcaggcacccauuuca

SEQ ID NO: 90745 - RNA, 22 nt, Human
gagggcauaguuaaauaggagg

SEQ ID NO: 90746 - RNA, 22 nt, Human
gagggccacguucagggcucuc

SEQ ID NO: 90747 - RNA, 22 nt, Human
gagggccaggcggagacaggcg

SEQ ID NO: 90748 - RNA, 22 nt, Human
gagggcucugaaaggaggucac

SEQ ID NO: 90749 - RNA, 23 nt, Human
gagggcucugagugcuugggcca

SEQ ID NO: 90750 - RNA, 22 nt, Human
gagggcugauaaaugcgcaugg

SEQ ID NO: 90751 - RNA, 22 nt, Human
gagggcugaugcuuacuuauuu

SEQ ID NO: 90752 - RNA, 22 nt, Human
gagggcugauguugccaccuca

SEQ ID NO: 90753 - RNA, 22 nt, Human
gagggcugcaaugagacagaga

SEQ ID NO: 90754 - RNA, 22 nt, Human
gagggcugcuggaaaaaugcag

SEQ ID NO: 90755 - RNA, 22 nt, Human
gagggcuguggggcaugaccag

SEQ ID NO: 90756 - RNA, 22 nt, Human
gaggggaaaguucugcacaagg

SEQ ID NO: 90757 - RNA, 16 nt, Human
gaggggagcaguaggc

SEQ ID NO: 90758 - RNA, 22 nt, Human
gagugccuuccccaugcuuugg

SEQ ID NO: 90759 - RNA, 22 nt, Human
gagugcguguuuggggaugugg

SEQ ID NO: 90760 - RNA, 22 nt, Human
gagugcugagcccacuuccuug

SEQ ID NO: 90761 - RNA, 22 nt, Human
gagugcugcuaaugcaagggug

SEQ ID NO: 90762 - RNA, 22 nt, Human
gagugcugcuugggauagugag

SEQ ID NO: 90763 - RNA, 22 nt, Human
gagugcuugcauauuuauuguc

SEQ ID NO: 90764 - RNA, 22 nt, Human
gagugcuuugucuuguaauucu

SEQ ID NO: 90765 - RNA, 22 nt, Human
gaguggcuauugauccgugaug

SEQ ID NO: 90766 - RNA, 22 nt, Human
gaguggcucccuggguuuggca

SEQ ID NO: 90767 - RNA, 22 nt, Human
gaguggcuccuuacaaguucca

SEQ ID NO: 90768 - RNA, 22 nt, Human
gaguggcugaguaagaggggag

SEQ ID NO: 90769 - RNA, 15 nt, Human
gaguggcuggugaaa

SEQ ID NO: 90770 - RNA, 20 nt, Human
gagugggccauggagugaga

SEQ ID NO: 90771 - RNA, 21 nt, Human
gagugggcugagauggggcug

SEQ ID NO: 90772 - RNA, 23 nt, Human
gaguggggagaaauugguuaaac

SEQ ID NO: 90773 - RNA, 22 nt, Human
gaguggggcccacugcugggug

SEQ ID NO: 90774 - RNA, 22 nt, Human
gaguggggcguggauccagcgu

SEQ ID NO: 90775 - RNA, 22 nt, Human
gaguggggucugggcaucaguc

SEQ ID NO: 90776 - RNA, 22 nt, Human
gagugggugacagaaggaggua

SEQ ID NO: 90777 - RNA, 22 nt, Human
gagugguaguuucuagaggugu

SEQ ID NO: 90778 - RNA, 22 nt, Human
gagugucacaggguaauuguuu

SEQ ID NO: 90779 - RNA, 21 nt, Human
gagugucagcaagagguuugg

SEQ ID NO: 90780 - RNA, 22 nt, Human
gagugucagcagggcagagcac

SEQ ID NO: 90781 - RNA, 22 nt, Human
gagugucagugccuggcuuguu

SEQ ID NO: 90782 - RNA, 22 nt, Human
gagugucagugcuuggggcuac

SEQ ID NO: 90783 - RNA, 22 nt, Human
gagugugguaugcucugaggcu

SEQ ID NO: 90784 - RNA, 22 nt, Human
gaguguguucuuuaugcuguga

SEQ ID NO: 90785 - RNA, 22 nt, Human
gaguguucccacaccccaguug

SEQ ID NO: 90786 - RNA, 22 nt, Human
gaguguuuuacucaaagaaaga

SEQ ID NO: 90787 - RNA, 22 nt, Human
gaguuaaaggaaaauaacuuua

SEQ ID NO: 90788 - RNA, 22 nt, Human
gaguuaaaguaccuuuguaugu

SEQ ID NO: 90789 - RNA, 22 nt, Human
gaguuaaugaggccaagggcag

SEQ ID NO: 90790 - RNA, 22 nt, Human
gaguuauaaccuaguuuaacug

SEQ ID NO: 90791 - RNA, 22 nt, Human
gaguuauuaauggcugaguuug

SEQ ID NO: 90792 - RNA, 19 nt, Human
gaguuauugccagggcaug

SEQ ID NO: 90793 - RNA, 22 nt, Human
gaguuauuucagaaggaaagau

SEQ ID NO: 90794 - RNA, 22 nt, Human
gaguuauuuugagcagaugguu

SEQ ID NO: 90795 - RNA, 22 nt, Human
gaguucaguguuucuaguagug

SEQ ID NO: 90796 - RNA, 22 nt, Human
gaguucuaaaggcagaacauaa

SEQ ID NO: 90797 - RNA, 22 nt, Human
gaguucuguuacgugucaccaa

SEQ ID NO: 90798 - RNA, 22 nt, Human
gaguucuuaggcaaacaacucu

SEQ ID NO: 90799 - RNA, 22 nt, Human
gaguucuucuauauaguaugag

SEQ ID NO: 90800 - RNA, 22 nt, Human
gaguuggcuacucucugaggcu

SEQ ID NO: 90801 - RNA, 22 nt, Human
gaguuggcuguucgaagguagc

SEQ ID NO: 90802 - RNA, 22 nt, Human
gaguuuaaauaacacauuucca

SEQ ID NO: 90803 - RNA, 22 nt, Human
gaguuuagccaauuuggucccc

SEQ ID NO: 90804 - RNA, 18 nt, Human
gaguuuagguuguagaau

SEQ ID NO: 90805 - RNA, 22 nt, Human
gaguuuauugucuuccaggcuu

SEQ ID NO: 90806 - RNA, 22 nt, Human
gaguuuggguggaaggagggua

SEQ ID NO: 90807 - RNA, 22 nt, Human
gaguuugugggaauggaguauu

SEQ ID NO: 90808 - RNA, 22 nt, Human
gaguuuuaaccucagcucucug

SEQ ID NO: 90809 - RNA, 22 nt, Human
gaguuuuuccaaggucacauga

SEQ ID NO: 90810 - RNA, 21 nt, Human
gauaaaaugggccuugguccu

SEQ ID NO: 90811 - RNA, 22 nt, Human
gauaaacauucuugcacaugug

SEQ ID NO: 90812 - RNA, 22 nt, Human
gauaaagggggaccaaaugacu

SEQ ID NO: 90813 - RNA, 22 nt, Human
gauaaauuaucagggguuuaaa

SEQ ID NO: 90814 - RNA, 22 nt, Human
gauaaauugcacuuuuucuuac

SEQ ID NO: 90815 - RNA, 22 nt, Human
gauaacaauaugaaguagauau

SEQ ID NO: 90816 - RNA, 22 nt, Human
gauaacauuuugaagugcuagu

SEQ ID NO: 90817 - RNA, 22 nt, Human
gauaagcacuauauaaguauuu

SEQ ID NO: 90818 - RNA, 22 nt, Human
gauaagcagcagccguuauagg

SEQ ID NO: 90819 - RNA, 22 nt, Human
gauaauccaagauugccucacu

SEQ ID NO: 90820 - RNA, 22 nt, Human
gauaauuuaagucuugggggcu

SEQ ID NO: 90821 - RNA, 22 nt, Human
gauaauuugauaccucaaucag

SEQ ID NO: 90822 - RNA, 22 nt, Human
gauaauuuuagucugaaaauug

SEQ ID NO: 90823 - RNA, 22 nt, Human
gauacaaaauauaaauggagag

SEQ ID NO: 90824 - RNA, 20 nt, Human
gauacacagcacagagggcc

SEQ ID NO: 90825 - RNA, 15 nt, Human
gauacacaugacugg

SEQ ID NO: 90826 - RNA, 22 nt, Human
gauacacaugcaugugcaugua

SEQ ID NO: 90827 - RNA, 22 nt, Human
gauacauuccauuucuacuuaa

SEQ ID NO: 90828 - RNA, 22 nt, Human
gauacauugaggguggaggacc

SEQ ID NO: 90829 - RNA, 22 nt, Human
gauacuugaggagaucaccaca

SEQ ID NO: 90830 - RNA, 22 nt, Human
gauagaaagaauauagauucca

SEQ ID NO: 90831 - RNA, 22 nt, Human
gauagagacuauaaugcucuuu

SEQ ID NO: 90832 - RNA, 22 nt, Human
gauagauaaaacuauauuuuca

SEQ ID NO: 90833 - RNA, 22 nt, Human
gauagcagcucuggggucagac

SEQ ID NO: 90834 - RNA, 23 nt, Human
gauaggcugguuaguguaucugu

SEQ ID NO: 90835 - RNA, 22 nt, Human
gauauacauagguuucuaugca

SEQ ID NO: 90836 - RNA, 22 nt, Human
gauaucaugggaagguguacuu

SEQ ID NO: 90837 - RNA, 22 nt, Human
gauauguaccaccucuuaaaag

SEQ ID NO: 90838 - RNA, 22 nt, Human
gauauucaaguggaauuauucu

SEQ ID NO: 90839 - RNA, 22 nt, Human
gauauuccugaaggacaggguu

SEQ ID NO: 90840 - RNA, 22 nt, Human
gauauucuaccugcugaccaag

SEQ ID NO: 90841 - RNA, 22 nt, Human
gauauugcaccucuaauacauu

SEQ ID NO: 90842 - RNA, 22 nt, Human
gauauugugaugaugucuuugg

SEQ ID NO: 90843 - RNA, 22 nt, Human
gauauuuucgcagggagaauuc

SEQ ID NO: 90844 - RNA, 22 nt, Human
gaucaacaacuuuugaauagcu

SEQ ID NO: 90845 - RNA, 22 nt, Human
gaucaaccacgccggguugcca

SEQ ID NO: 90846 - RNA, 22 nt, Human
gaucaaggcaguagggccagcu

SEQ ID NO: 90847 - RNA, 22 nt, Human
gaucaaugguguaacuuguccu

SEQ ID NO: 90848 - RNA, 22 nt, Human
gaucaccaguuguagguauuuu

SEQ ID NO: 90849 - RNA, 23 nt, Human
ccuguggcaaguagaugagauga

SEQ ID NO: 90850 - RNA, 22 nt, Human
ccuguggcacaugcagggauuc

SEQ ID NO: 90851 - RNA, 19 nt, Human
ccuguggcagaguggaaac

SEQ ID NO: 90852 - RNA, 22 nt, Human
ccuguggcugccacuuggguga

SEQ ID NO: 90853 - RNA, 22 nt, Human
ccuguggcugguaguaucguuu

SEQ ID NO: 90854 - RNA, 22 nt, Human
ccugugggagguucugugaguc

SEQ ID NO: 90855 - RNA, 22 nt, Human
ccugugggcuugaguguagggu

SEQ ID NO: 90856 - RNA, 22 nt, Human
ccuguggggccaucucagucac

SEQ ID NO: 90857 - RNA, 21 nt, Human
ccuguggucuggagggagcac

SEQ ID NO: 90858 - RNA, 21 nt, Human
ccuguggugccagaucgccag

SEQ ID NO: 90859 - RNA, 22 nt, Human
ccugugucaccggaacggagga

SEQ ID NO: 90860 - RNA, 22 nt, Human
ccugugucagccccugccucca

SEQ ID NO: 90861 - RNA, 22 nt, Human
ccugugucuuccccacuggugu

SEQ ID NO: 90862 - RNA, 22 nt, Human
ccugugucuuugccucaggguc

SEQ ID NO: 90863 - RNA, 22 nt, Human
ccugugugcacacgaggccaug

SEQ ID NO: 90864 - RNA, 22 nt, Human
ccugugugcugaugacgacaga

SEQ ID NO: 90865 - RNA, 22 nt, Human
ccuguguggccaggcuggaguc

SEQ ID NO: 90866 - RNA, 19 nt, Human
ccugugugggguagagauc

SEQ ID NO: 90867 - RNA, 22 nt, Human
cuccugggagcuguggcagagc

SEQ ID NO: 90868 - RNA, 21 nt, Human
cuccugggcuaagauauagug

SEQ ID NO: 90869 - RNA, 22 nt, Human
cuccugggcuaugucugcuugg

SEQ ID NO: 90870 - RNA, 22 nt, Human
cuccuggugacucccagauaaa

SEQ ID NO: 90871 - RNA, 23 nt, Human
cuccuggugcugcuaucaggggu

SEQ ID NO: 90872 - RNA, 22 nt, Human
cuccuggugcuggggcugccgc

SEQ ID NO: 90873 - RNA, 22 nt, Human
cuccugucaauaggcuccuggc

SEQ ID NO: 90874 - RNA, 22 nt, Human
cuaguagacagaaauguccagu

SEQ ID NO: 90875 - RNA, 22 nt, Human
cuagucacgucuuucaguuacc

SEQ ID NO: 90876 - RNA, 22 nt, Human
cuagucucuggaggucagggcu

SEQ ID NO: 90877 - RNA, 22 nt, Human
cuagugaaauuugcaaguaauu

SEQ ID NO: 90878 - RNA, 22 nt, Human
cuaguguuuauuaacauaauuc

SEQ ID NO: 90879 - RNA, 22 nt, Human
cuaguguuuauuaaucaugagg

SEQ ID NO: 90880 - RNA, 22 nt, Human
cuaguguuuggaagucauagcc

SEQ ID NO: 90881 - RNA, 22 nt, Human
cuauaacuggguauuagacuac

SEQ ID NO: 90882 - RNA, 22 nt, Human
cuauauuuggugagggaugucu

SEQ ID NO: 90883 - RNA, 22 nt, Human
cuaucauuuuacaugguuggug

SEQ ID NO: 90884 - RNA, 22 nt, Human
cuauccauauccugggcauggc

SEQ ID NO: 90885 - RNA, 22 nt, Human
cuaucuuuuguucauuuugagu

SEQ ID NO: 90886 - RNA, 22 nt, Human
cuaugaccccagcaugaauaag

SEQ ID NO: 90887 - RNA, 22 nt, Human
cuaugcagaauuuagugacuua

SEQ ID NO: 90888 - RNA, 22 nt, Human
cuauggucuggaccgagguccu

SEQ ID NO: 90889 - RNA, 22 nt, Human
cuauggugauagaaaucagaau

SEQ ID NO: 90890 - RNA, 22 nt, Human
cuauguuuaucuguauuucugu

SEQ ID NO: 90891 - RNA, 22 nt, Human
cuauuaaacacuacugugcacu

SEQ ID NO: 90892 - RNA, 22 nt, Human
cuauuaaauacucuucaaauug

SEQ ID NO: 90893 - RNA, 22 nt, Human
cuauuacugacuucuguauuua

SEQ ID NO: 90894 - RNA, 22 nt, Human
cuauuagguuggugcaaaagua

SEQ ID NO: 90895 - RNA, 22 nt, Human
cuauuauuagcaaaagguggau

SEQ ID NO: 90896 - RNA, 22 nt, Human
cuauuauuauccuaauuucugu

SEQ ID NO: 90897 - RNA, 22 nt, Human
cuauuauuuccucaucuauaaa

SEQ ID NO: 90898 - RNA, 22 nt, Human
cuauucaauuuugcuauuguag

SEQ ID NO: 90899 - RNA, 22 nt, Human
cuauucagguguccauuaaucc

SEQ ID NO: 90900 - RNA, 22 nt, Human
cuauucaguaagccaaaaccau

SEQ ID NO: 90901 - RNA, 22 nt, Human
cuauucugcuugaaauuauucu

SEQ ID NO: 90902 - RNA, 22 nt, Human
cuauucuguguauuuacuggcu

SEQ ID NO: 90903 - RNA, 22 nt, Human
cuauugaaaguguacaauucaa

SEQ ID NO: 90904 - RNA, 21 nt, Human
cuauuggaaaagaaaauauuu

SEQ ID NO: 90905 - RNA, 22 nt, Human
cuauuguuucuaugcucugagg

SEQ ID NO: 90906 - RNA, 22 nt, Human
cuauuuauguccaaguguuuua

SEQ ID NO: 90907 - RNA, 15 nt, Human
cuauuucauccuucu

SEQ ID NO: 90908 - RNA, 22 nt, Human
cuauuucuaaaccuauaaguga

SEQ ID NO: 90909 - RNA, 23 nt, Human
cuauuucucauaguucaggucuu

SEQ ID NO: 90910 - RNA, 22 nt, Human
cuauuuggauguuagccucagu

SEQ ID NO: 90911 - RNA, 22 nt, Human
cuauuuggccaagcugcccaca

SEQ ID NO: 90912 - RNA, 22 nt, Human
cuauuuucccauaugguugaca

SEQ ID NO: 90913 - RNA, 22 nt, Human
cucaaagacaaaaaucugaggu

SEQ ID NO: 90914 - RNA, 22 nt, Human
cucaaauaccucuccaugugac

SEQ ID NO: 90915 - RNA, 22 nt, Human
cucaaauauaagcuaaaugugg

SEQ ID NO: 90916 - RNA, 22 nt, Human
cucaacagcucugccauacucc

SEQ ID NO: 90917 - RNA, 23 nt, Human
cucaacauccauucuugcccuuc

SEQ ID NO: 90918 - RNA, 22 nt, Human
cucaagaaggaugagcuauugc

SEQ ID NO: 90919 - RNA, 22 nt, Human
cucaagaucaucaauauaccaa

SEQ ID NO: 90920 - RNA, 22 nt, Human
cucaagaugucagggcaccugc

SEQ ID NO: 90921 - RNA, 22 nt, Human
cucaaggaaagucuggagaaga

SEQ ID NO: 90922 - RNA, 20 nt, Human
cucaaguaagguuauaaggu

SEQ ID NO: 90923 - RNA, 22 nt, Human
cucaagucagaaauaaaagcau

SEQ ID NO: 90924 - RNA, 22 nt, Human
cucaagucugaguacuggcucu

SEQ ID NO: 90925 - RNA, 22 nt, Human
cucaagucugauggguuagguu

SEQ ID NO: 90926 - RNA, 22 nt, Human
cucacacugugccaaauccuuu

SEQ ID NO: 90927 - RNA, 22 nt, Human
cucacagauauuugcuucaggu

SEQ ID NO: 90928 - RNA, 22 nt, Human
cucacagauguucuccuuuagg

SEQ ID NO: 90929 - RNA, 22 nt, Human
cucacagcagcucugcgagaua

SEQ ID NO: 90930 - RNA, 22 nt, Human
cucacagcugcuucaggaucca

SEQ ID NO: 90931 - RNA, 22 nt, Human
cucacaggagaaagucaugguc

SEQ ID NO: 90932 - RNA, 22 nt, Human
cucacaggucaugugguggcuu

SEQ ID NO: 90933 - RNA, 20 nt, Human
cucacagucaaugcagaggu

SEQ ID NO: 90934 - RNA, 22 nt, Human
cucacaguuggcucauuaauga

SEQ ID NO: 90935 - RNA, 22 nt, Human
cucaccacagagccuguccagc

SEQ ID NO: 90936 - RNA, 22 nt, Human
cucacugugccuuuucccaaac

SEQ ID NO: 90937 - RNA, 22 nt, Human
cucacuuagcagguuaauauca

SEQ ID NO: 90938 - RNA, 22 nt, Human
cucagaaacggagcugccauuu

SEQ ID NO: 90939 - RNA, 22 nt, Human
cucagaaaggguugcugagggc

SEQ ID NO: 90940 - RNA, 22 nt, Human
cucagaaaggugccauuuaugu

SEQ ID NO: 90941 - RNA, 22 nt, Human
cucagaaagugacaggggggug

SEQ ID NO: 90942 - RNA, 22 nt, Human
cucagaaauuacaaaagggaca

SEQ ID NO: 90943 - RNA, 22 nt, Human
cucagaagaaucagcagcuauu

SEQ ID NO: 90944 - RNA, 22 nt, Human
cucagaauuacaucccauuuua

SEQ ID NO: 90945 - RNA, 22 nt, Human
cucagaauuuagggcucugagg

SEQ ID NO: 90946 - RNA, 21 nt, Human
cucagacagggaggcucuggg

SEQ ID NO: 90947 - RNA, 22 nt, Human
cucagacuagccuguaccgaca

SEQ ID NO: 90948 - RNA, 22 nt, Human
cucagacuggagccccaaggac

SEQ ID NO: 90949 - RNA, 21 nt, Human
cucagagaaaugucugggagc

SEQ ID NO: 90950 - RNA, 22 nt, Human
cucagagaagucuuugcuaaac

SEQ ID NO: 90951 - RNA, 22 nt, Human
cucagagagacaaugugggaca

SEQ ID NO: 90952 - RNA, 17 nt, Human
cucagagaggguaagua

SEQ ID NO: 90953 - RNA, 22 nt, Human
cucagagcccaggguacacccg

SEQ ID NO: 90954 - RNA, 22 nt, Human
cucagagcucagcuuuguuagu

SEQ ID NO: 90955 - RNA, 22 nt, Human
cucagagcucgugggaccuugg

SEQ ID NO: 90956 - RNA, 22 nt, Human
cucagagcugaggccagggaca

SEQ ID NO: 90957 - RNA, 22 nt, Human
cucagaggaggcagggugugcc

SEQ ID NO: 90958 - RNA, 22 nt, Human
cucagaggcaagcaaggagcug

SEQ ID NO: 90959 - RNA, 23 nt, Human
cucagaggccuguccaggguggu

SEQ ID NO: 90960 - RNA, 22 nt, Human
cucagagggucuccuccagaau

SEQ ID NO: 90961 - RNA, 22 nt, Human
cucagaggguugaaggugcucu

SEQ ID NO: 90962 - RNA, 22 nt, Human
cucagaguccccacaucugggu

SEQ ID NO: 90963 - RNA, 22 nt, Human
cucagagucccuucccucgugg

SEQ ID NO: 90964 - RNA, 22 nt, Human
cucagcaagacccccaccgugu

SEQ ID NO: 90965 - RNA, 22 nt, Human
cucagcaccccgacaggacauu

SEQ ID NO: 90966 - RNA, 22 nt, Human
cucagcacuuuggaaggcugau

SEQ ID NO: 90967 - RNA, 19 nt, Human
cucagcacuuuuacacagg

SEQ ID NO: 90968 - RNA, 23 nt, Human
cucagcagccugcugcagauaag

SEQ ID NO: 90969 - RNA, 17 nt, Human
cucagcagggcucacuu

SEQ ID NO: 90970 - RNA, 23 nt, Human
cucagcaggucaggccccuuccu

SEQ ID NO: 90971 - RNA, 22 nt, Human
cucagcaggucuuggguagggg

SEQ ID NO: 90972 - RNA, 22 nt, Human
cucagcaguaaacguccggaac

SEQ ID NO: 90973 - RNA, 22 nt, Human
cucagcccagcccaggaccagg

SEQ ID NO: 90974 - RNA, 22 nt, Human
cucagccugugaagagcagagg

SEQ ID NO: 90975 - RNA, 16 nt, Human
cucagcuaaggagagg

SEQ ID NO: 90976 - RNA, 17 nt, Human
cucccccccacgugucc

SEQ ID NO: 90977 - RNA, 22 nt, Human
cuccccuuccgccagcucuuga

SEQ ID NO: 90978 - RNA, 22 nt, Human
cucccucacacccuugcccaga

SEQ ID NO: 90979 - RNA, 22 nt, Human
cucccucaccaugacccgcugu

SEQ ID NO: 90980 - RNA, 22 nt, Human
cucccugaccuggauuccaggc

SEQ ID NO: 90981 - RNA, 22 nt, Human
cucccugaggacaggcccuguc

SEQ ID NO: 90982 - RNA, 22 nt, Human
cucccuggaggcccagaccugg

SEQ ID NO: 90983 - RNA, 22 nt, Human
cucccuggaggugagcuggcac

SEQ ID NO: 90984 - RNA, 22 nt, Human
cucccuggcuuuguccugaggc

SEQ ID NO: 90985 - RNA, 22 nt, Human
cucccuugcuucuggcauuuug

SEQ ID NO: 90986 - RNA, 22 nt, Human
cuccgaacaguggcuccaaggc

SEQ ID NO: 90987 - RNA, 22 nt, Human
cuccgcuuguguauaccuccaa

SEQ ID NO: 90988 - RNA, 22 nt, Human
cuccuacacauagaugcuuuca

SEQ ID NO: 90989 - RNA, 22 nt, Human
cuccuacauaacccagcgaacu

SEQ ID NO: 90990 - RNA, 19 nt, Human
cuccucagucccagagguc

SEQ ID NO: 90991 - RNA, 22 nt, Human
cucaggacuuucaaauagaaau

SEQ ID NO: 90992 - RNA, 22 nt, Human
cucaggagaugacagaagguau

SEQ ID NO: 90993 - RNA, 22 nt, Human
cucaggaggaugacugccuugg

SEQ ID NO: 90994 - RNA, 22 nt, Human
cucaggaggccauucucaaggu

SEQ ID NO: 90995 - RNA, 22 nt, Human
cucaggauagcugcgcagccug

SEQ ID NO: 90996 - RNA, 22 nt, Human
cucaggaugcaauuccaucaag

SEQ ID NO: 90997 - RNA, 22 nt, Human
cucaggauguacuacagaaggc

SEQ ID NO: 90998 - RNA, 22 nt, Human
cucaggaugucggugacuauug

SEQ ID NO: 90999 - RNA, 22 nt, Human
cucaggccugaguggcaguccc

SEQ ID NO: 91000 - RNA, 18 nt, Human
cucaggccuuucccugug

SEQ ID NO: 91001 - RNA, 22 nt, Human
cucaggcuaagaaggccaagug

SEQ ID NO: 91002 - RNA, 22 nt, Human
cucaggcucauaucccaucagc

SEQ ID NO: 91003 - RNA, 22 nt, Human
cucaggcuccagacuuccgucc

SEQ ID NO: 91004 - RNA, 22 nt, Human
cucaggcucuguacucccuuug

SEQ ID NO: 91005 - RNA, 22 nt, Human
cucaggcugcccugacagcccc

SEQ ID NO: 91006 - RNA, 22 nt, Human
cucaggcugugccaccugugug

SEQ ID NO: 91007 - RNA, 22 nt, Human
cucagggacuuggauccuggcc

SEQ ID NO: 91008 - RNA, 22 nt, Human
cucagggagguccugugcugaa

SEQ ID NO: 91009 - RNA, 22 nt, Human
cucagggaguagcacaugugga

SEQ ID NO: 91010 - RNA, 23 nt, Human
cucagggauagaaaggaagacag

SEQ ID NO: 91011 - RNA, 22 nt, Human
cucagggcaguauggcugagag

SEQ ID NO: 91012 - RNA, 22 nt, Human
cucagggcggcgggcagcccag

SEQ ID NO: 91013 - RNA, 22 nt, Human
cucagggcuggaaagccaggaa

SEQ ID NO: 91014 - RNA, 22 nt, Human
cucaggggaccuggcuccgagu

SEQ ID NO: 91015 - RNA, 22 nt, Human
cucaggguaaugaaagacgaau

SEQ ID NO: 91016 - RNA, 22 nt, Human
cucaggucacaggauggccagg

SEQ ID NO: 91017 - RNA, 22 nt, Human
cucaggucgcuauuucucuuac

SEQ ID NO: 91018 - RNA, 22 nt, Human
cucagucaguuuuugugagaga

SEQ ID NO: 91019 - RNA, 22 nt, Human
cucagucucuugggcugugaag

SEQ ID NO: 91020 - RNA, 19 nt, Human
cucagucuggcucugccug

SEQ ID NO: 91021 - RNA, 22 nt, Human
cucagugcaaccaaagugaucu

SEQ ID NO: 91022 - RNA, 22 nt, Human
cucagugcuacgguuaccauau

SEQ ID NO: 91023 - RNA, 22 nt, Human
cucagugcuuuggauccuggau

SEQ ID NO: 91024 - RNA, 20 nt, Human
cucaguguauucugggugcu

SEQ ID NO: 91025 - RNA, 22 nt, Human
cucagugucacguuuugccuua

SEQ ID NO: 91026 - RNA, 22 nt, Human
cucaguguuaaauauaagguau

SEQ ID NO: 91027 - RNA, 20 nt, Human
cucaguuuccucauggcuca

SEQ ID NO: 91028 - RNA, 22 nt, Human
cucaguuuccucuucuguugaa

SEQ ID NO: 91029 - RNA, 22 nt, Human
cucaguuucuucauauuguagg

SEQ ID NO: 91030 - RNA, 22 nt, Human
cucauaaaagcuuuguuuacac

SEQ ID NO: 91031 - RNA, 22 nt, Human
cucauacucccagccagcuguc

SEQ ID NO: 91032 - RNA, 22 nt, Human
cucauauauuucugcauucaau

SEQ ID NO: 91033 - RNA, 22 nt, Human
cucaucuaggauaaagcaucuu

SEQ ID NO: 91034 - RNA, 20 nt, Human
cucaucucugagccuccugg

SEQ ID NO: 91035 - RNA, 22 nt, Human
cucaucugauaaaucacucuua

SEQ ID NO: 91036 - RNA, 22 nt, Human
cucauguaagagagcauuaguu

SEQ ID NO: 91037 - RNA, 22 nt, Human
cucaugucuucacccauucuaa

SEQ ID NO: 91038 - RNA, 20 nt, Human
cucauguggcaccaggcacu

SEQ ID NO: 91039 - RNA, 22 nt, Human
cucaugugucugguaggagcuu

SEQ ID NO: 91040 - RNA, 22 nt, Human
cucauuaaaggaaaucaccugc

SEQ ID NO: 91041 - RNA, 22 nt, Human
cucauugauucagugcugcucu

SEQ ID NO: 91042 - RNA, 22 nt, Human
cucauuuauuucucccaaaaca

SEQ ID NO: 91043 - RNA, 22 nt, Human
cuccaaauacagucaucuuggg

SEQ ID NO: 91044 - RNA, 23 nt, Human
cuccaaauacucccaauuguuuu

SEQ ID NO: 91045 - RNA, 22 nt, Human
cuccaaggaagccccaagggau

SEQ ID NO: 91046 - RNA, 18 nt, Human
cuccaaggucucuggcuu

SEQ ID NO: 91047 - RNA, 22 nt, Human
cuccaaguauguuaaaaucuaa

SEQ ID NO: 91048 - RNA, 19 nt, Human
cuccaagugccaaggacag

SEQ ID NO: 91049 - RNA, 19 nt, Human
cuccaaguuaagagggagg

SEQ ID NO: 91050 - RNA, 22 nt, Human
cuccacagagaugcugauugua

SEQ ID NO: 91051 - RNA, 22 nt, Human
cuccacagguguacuguaccuu

SEQ ID NO: 91052 - RNA, 22 nt, Human
cuccacucaacaagcccagugu

SEQ ID NO: 91053 - RNA, 22 nt, Human
cuccacucaccgaggcagagca

SEQ ID NO: 91054 - RNA, 22 nt, Human
cuccacucaggugcuuaaguug

SEQ ID NO: 91055 - RNA, 22 nt, Human
cuccagaaauucaacagcaaau

SEQ ID NO: 91056 - RNA, 22 nt, Human
cuccagaagacccauccucaug

SEQ ID NO: 91057 - RNA, 22 nt, Human
cuccagaauuguccauuggaaa

SEQ ID NO: 91058 - RNA, 22 nt, Human
cuccagacagaucuucuagcag

SEQ ID NO: 91059 - RNA, 20 nt, Human
cuccagacuacagaagagcc

SEQ ID NO: 91060 - RNA, 22 nt, Human
cuccagagagaaaggaggccgc

SEQ ID NO: 91061 - RNA, 22 nt, Human
cuccagagaguccagcucuggg

SEQ ID NO: 91062 - RNA, 22 nt, Human
cuccagagauacacggucuugc

SEQ ID NO: 91063 - RNA, 22 nt, Human
cuccagaggaaagcacauagug

SEQ ID NO: 91064 - RNA, 22 nt, Human
cuccagagguccccgcggcacu

SEQ ID NO: 91065 - RNA, 22 nt, Human
cuccagauuccguuuauucagg

SEQ ID NO: 91066 - RNA, 22 nt, Human
cuccagauucuggaugacuggg

SEQ ID NO: 91067 - RNA, 22 nt, Human
cuccagccucaucuccuggcug

SEQ ID NO: 91068 - RNA, 22 nt, Human
cuccagcucgcgagcucugcuc

SEQ ID NO: 91069 - RNA, 22 nt, Human
cuccagcucuuaacugcggaag

SEQ ID NO: 91070 - RNA, 22 nt, Human
cuccaggaaaauagggaaugag

SEQ ID NO: 91071 - RNA, 22 nt, Human
cuccaggacaugacuuucuugc

SEQ ID NO: 91072 - RNA, 22 nt, Human
cuccaggacugaggacagagcu

SEQ ID NO: 91073 - RNA, 22 nt, Human
cuccaggcccacggccgcggcc

SEQ ID NO: 91074 - RNA, 22 nt, Human
cuccaggcccacgucgaggagg

SEQ ID NO: 91075 - RNA, 22 nt, Human
cuccaggcgccgcuuuugcagu

SEQ ID NO: 91076 - RNA, 22 nt, Human
cuccaggcgcuuaccaagcgcu

SEQ ID NO: 91077 - RNA, 22 nt, Human
cuccaggcuggggugcagguug

SEQ ID NO: 91078 - RNA, 22 nt, Human
cuccagggaaaggggcguccgc

SEQ ID NO: 91079 - RNA, 22 nt, Human
cuccagggagcuguggagguuu

SEQ ID NO: 91080 - RNA, 22 nt, Human
cuccagggagcuuggaaagacc

SEQ ID NO: 91081 - RNA, 20 nt, Human
cuccaggggaagagccuucc

SEQ ID NO: 91082 - RNA, 22 nt, Human
cuccagguaguuauuucaagaa

SEQ ID NO: 91083 - RNA, 22 nt, Human
cuccagguauuacuguuuuccc

SEQ ID NO: 91084 - RNA, 22 nt, Human
cuccagguuuuacaaggucuau

SEQ ID NO: 91085 - RNA, 22 nt, Human
uguggcauggcagaagggcaca

SEQ ID NO: 91086 - RNA, 22 nt, Human
uguggcaugguugcaaggacaa

SEQ ID NO: 91087 - RNA, 22 nt, Human
uguggcauuccaagacgcuuaa

SEQ ID NO: 91088 - RNA, 22 nt, Human
uguggcauugaauaaccuugga

SEQ ID NO: 91089 - RNA, 22 nt, Human
uguggccaaaauaaaaugaggu

SEQ ID NO: 91090 - RNA, 22 nt, Human
uguggccagcagguggcugugu

SEQ ID NO: 91091 - RNA, 22 nt, Human
uguggccaggaaaaggagaugg

SEQ ID NO: 91092 - RNA, 19 nt, Human
uguggccaugguucagcug

SEQ ID NO: 91093 - RNA, 22 nt, Human
uguggcccagaugagugugcua

SEQ ID NO: 91094 - RNA, 22 nt, Human
uguggccuuauuuguauggggg

SEQ ID NO: 91095 - RNA, 17 nt, Human
uguggccuucugagcuu

SEQ ID NO: 91096 - RNA, 22 nt, Human
uguggccuugcagccuggaggu

SEQ ID NO: 91097 - RNA, 22 nt, Human
uguggcucugcccccugguaag

SEQ ID NO: 91098 - RNA, 22 nt, Human
uguggcugaucaaagcgcucag

SEQ ID NO: 91099 - RNA, 22 nt, Human
uguggcugcaggcgauggagga

SEQ ID NO: 91100 - RNA, 22 nt, Human
uguggcugccacccugaagccg

SEQ ID NO: 91101 - RNA, 22 nt, Human
uguggcugggcuaauaggcaaa

SEQ ID NO: 91102 - RNA, 22 nt, Human
uguggcuggucuccgagcgucg

SEQ ID NO: 91103 - RNA, 22 nt, Human
uguggcuguguccaccugcugc

SEQ ID NO: 91104 - RNA, 22 nt, Human
uguggcuuuugcuagcuuugca

SEQ ID NO: 91105 - RNA, 22 nt, Human
ugugggaagagcaguggcagca

SEQ ID NO: 91106 - RNA, 22 nt, Human
ugugggaaucagccaggggggc

SEQ ID NO: 91107 - RNA, 22 nt, Human
ugugggaaugacgaggaagagg

SEQ ID NO: 91108 - RNA, 22 nt, Human
ugugggaaugcugaugggaucu

SEQ ID NO: 91109 - RNA, 22 nt, Human
ugugggacagggacagugauau

SEQ ID NO: 91110 - RNA, 22 nt, Human
ugugggaccucagagggucccc

SEQ ID NO: 91111 - RNA, 22 nt, Human
ugugggaggaacacagccagaa

SEQ ID NO: 91112 - RNA, 22 nt, Human
ugugggaggaauuagaauggga

SEQ ID NO: 91113 - RNA, 22 nt, Human
ugugggaggucuggaaggcucc

SEQ ID NO: 91114 - RNA, 22 nt, Human
ugugggcagauacacagacacg

SEQ ID NO: 91115 - RNA, 22 nt, Human
uguggggacccaugccaugggc

SEQ ID NO: 91116 - RNA, 22 nt, Human
uguggggaccuggcugccaccc

SEQ ID NO: 91117 - RNA, 22 nt, Human
uguggggaggcugcagugcugc

SEQ ID NO: 91118 - RNA, 22 nt, Human
uguggggaucuucuagcuuuuc

SEQ ID NO: 91119 - RNA, 22 nt, Human
ugugggguagcaguuuccgugu

SEQ ID NO: 91120 - RNA, 22 nt, Human
uguggggugugguccaggcauc

SEQ ID NO: 91121 - RNA, 22 nt, Human
ugugggucuuccaaagaagggc

SEQ ID NO: 91122 - RNA, 22 nt, Human
uguggguuuaagaggcagcaug

SEQ ID NO: 91123 - RNA, 22 nt, Human
uguggucagcuacuggucaucu

SEQ ID NO: 91124 - RNA, 22 nt, Human
uguggucuccccagugccagcu

SEQ ID NO: 91125 - RNA, 22 nt, Human
uguggucucguuauguugccca

SEQ ID NO: 91126 - RNA, 22 nt, Human
uguggugagaaacugguagauu

SEQ ID NO: 91127 - RNA, 18 nt, Human
ugugguggagcugccuuc

SEQ ID NO: 91128 - RNA, 22 nt, Human
ugugguggcuauucuggucuca

SEQ ID NO: 91129 - RNA, 22 nt, Human
uguggugguaaugagccagaug

SEQ ID NO: 91130 - RNA, 22 nt, Human
ugugguuuacuguggcgcugcu

SEQ ID NO: 91131 - RNA, 19 nt, Human
ugugguuucccggcggccu

SEQ ID NO: 91132 - RNA, 22 nt, Human
uggcuaagauuuaaauguuugc

SEQ ID NO: 91133 - RNA, 22 nt, Human
uggcuaagcuggggaggccugg

SEQ ID NO: 91134 - RNA, 22 nt, Human
uggcuaauggcauuuccugggu

SEQ ID NO: 91135 - RNA, 22 nt, Human
uggcuacaguggcauaucaaau

SEQ ID NO: 91136 - RNA, 22 nt, Human
uggcuacucaacauguacucau

SEQ ID NO: 91137 - RNA, 23 nt, Human
uggcuacuuuaugagguugagga

SEQ ID NO: 91138 - RNA, 22 nt, Human
uggcuagaauuggguucacagg

SEQ ID NO: 91139 - RNA, 22 nt, Human
uggcuagcccuuguggggagag

SEQ ID NO: 91140 - RNA, 22 nt, Human
uggcuaggaccucugcggagca

SEQ ID NO: 91141 - RNA, 22 nt, Human
uggcuaguaggugaguagugcu

SEQ ID NO: 91142 - RNA, 22 nt, Human
uggcuaugcaaaccugaggcug

SEQ ID NO: 91143 - RNA, 22 nt, Human
uggcuaugguauugauggguuu

SEQ ID NO: 91144 - RNA, 22 nt, Human
uggcucaccuucagaauauacc

SEQ ID NO: 91145 - RNA, 22 nt, Human
uggcucagaggggaagugguuu

SEQ ID NO: 91146 - RNA, 22 nt, Human
uggcucagcauucacuggucuu

SEQ ID NO: 91147 - RNA, 23 nt, Human
uggcucagcuaguuuuccauuuc

SEQ ID NO: 91148 - RNA, 22 nt, Human
uggcucaggagggaucuuugcu

SEQ ID NO: 91149 - RNA, 22 nt, Human
uggcucaggauaauuuucccaa

SEQ ID NO: 91150 - RNA, 22 nt, Human
uggcucagugaagagauaacuu

SEQ ID NO: 91151 - RNA, 22 nt, Human
uggcucagugcauucacaguaa

SEQ ID NO: 91152 - RNA, 22 nt, Human
uggcucaguuaggucagaaaca

SEQ ID NO: 91153 - RNA, 22 nt, Human
uggcucaguuccaucaucugga

SEQ ID NO: 91154 - RNA, 22 nt, Human
uggcucauauugagugauuucu

SEQ ID NO: 91155 - RNA, 22 nt, Human
uggcucaucuuuuuagacuuau

SEQ ID NO: 91156 - RNA, 22 nt, Human
uggcucauucuggggaagucag

SEQ ID NO: 91157 - RNA, 22 nt, Human
uggcucauucuuuagaauauac

SEQ ID NO: 91158 - RNA, 22 nt, Human
uggcuccaaaaacaaaugacau

SEQ ID NO: 91159 - RNA, 22 nt, Human
uggcuccaaaucaacugcuguu

SEQ ID NO: 91160 - RNA, 23 nt, Human
uggcuccaggagaagccagaagc

SEQ ID NO: 91161 - RNA, 22 nt, Human
uggcucccgcagacccugugcu

SEQ ID NO: 91162 - RNA, 22 nt, Human
uggcuccuaggauggugccugg

SEQ ID NO: 91163 - RNA, 22 nt, Human
uggcuccuuccgcagcaugccu

SEQ ID NO: 91164 - RNA, 22 nt, Human
uggcuccuuuccagccugguuu

SEQ ID NO: 91165 - RNA, 21 nt, Human
uggcucgauuuauagcauuuc

SEQ ID NO: 91166 - RNA, 22 nt, Human
uggcucucaggccugcugcguu

SEQ ID NO: 91167 - RNA, 20 nt, Human
uggcucucucuaguaagugg

SEQ ID NO: 91168 - RNA, 22 nt, Human
uggcucugaccagguagaggag

SEQ ID NO: 91169 - RNA, 22 nt, Human
uggcucugagacacaggcucuc

SEQ ID NO: 91170 - RNA, 23 nt, Human
uggcucugagagguucagaugcu

SEQ ID NO: 91171 - RNA, 21 nt, Human
uggcucugagccucauggcug

SEQ ID NO: 91172 - RNA, 22 nt, Human
uggcucugccaccuuucccuaa

SEQ ID NO: 91173 - RNA, 22 nt, Human
uggcucugccacuaacuuggua

SEQ ID NO: 91174 - RNA, 18 nt, Human
uggcucuggacuugcucc

SEQ ID NO: 91175 - RNA, 22 nt, Human
uggcucuggggacaguaagucc

SEQ ID NO: 91176 - RNA, 19 nt, Human
uggcucugucgaaggcaca

SEQ ID NO: 91177 - RNA, 22 nt, Human
uggcucugucgccguuuggaau

SEQ ID NO: 91178 - RNA, 22 nt, Human
uggcucuguggucuuagcaugc

SEQ ID NO: 91179 - RNA, 22 nt, Human
uggcucugugucucccagcagc

SEQ ID NO: 91180 - RNA, 22 nt, Human
uggcucuguugcucgcaguuuu

SEQ ID NO: 91181 - RNA, 22 nt, Human
uggcugaaagccuggccugcca

SEQ ID NO: 91182 - RNA, 22 nt, Human
uggcugaacuaaugugcuguuu

SEQ ID NO: 91183 - RNA, 22 nt, Human
uggcugaaucugcagcaggaag

SEQ ID NO: 91184 - RNA, 22 nt, Human
uggcugacaaauaggugcaguu

SEQ ID NO: 91185 - RNA, 21 nt, Human
uggcugacucuuccuaucauu

SEQ ID NO: 91186 - RNA, 22 nt, Human
uggcugagaccuucccaaauuc

SEQ ID NO: 91187 - RNA, 23 nt, Human
uggcugagcccacuaucuuggcc

SEQ ID NO: 91188 - RNA, 19 nt, Human
uggcugagcuggacugagg

SEQ ID NO: 91189 - RNA, 22 nt, Human
uggcugaggcuggagugcagug

SEQ ID NO: 91190 - RNA, 22 nt, Human
uggcugaggcuuuucuuaaaga

SEQ ID NO: 91191 - RNA, 22 nt, Human
uggcugagggggcaguucagga

SEQ ID NO: 91192 - RNA, 22 nt, Human
uggcugagggggcucugcucag

SEQ ID NO: 91193 - RNA, 22 nt, Human
uggcugaguaaguugugauaug

SEQ ID NO: 91194 - RNA, 22 nt, Human
uggcugaguuacgaacagagca

SEQ ID NO: 91195 - RNA, 22 nt, Human
uggcugaguuccuggcacacgg

SEQ ID NO: 91196 - RNA, 20 nt, Human
uggcugcacaccaggacagg

SEQ ID NO: 91197 - RNA, 22 nt, Human
uggcugcaguucacaggagcaa

SEQ ID NO: 91198 - RNA, 22 nt, Human
uggcugcaguugggcccucaga

SEQ ID NO: 91199 - RNA, 22 nt, Human
uggcugccaauggcuuggaaag

SEQ ID NO: 91200 - RNA, 22 nt, Human
uggcugccagcuccucgccuug

SEQ ID NO: 91201 - RNA, 22 nt, Human
ugggauggcauccugggccuug

SEQ ID NO: 91202 - RNA, 21 nt, Human
ugggaugggucugggaccagc

SEQ ID NO: 91203 - RNA, 22 nt, Human
ugggaugucuuuaggggaagag

SEQ ID NO: 91204 - RNA, 22 nt, Human
ugggauucaccaugggcuucag

SEQ ID NO: 91205 - RNA, 22 nt, Human
ugggcaaagucacauacaugau

SEQ ID NO: 91206 - RNA, 22 nt, Human
ugggcaaaugcuuuuuagucaa

SEQ ID NO: 91207 - RNA, 22 nt, Human
ugggcaagcucuggguggacac

SEQ ID NO: 91208 - RNA, 21 nt, Human
ugggcaaguuuggggguccuc

SEQ ID NO: 91209 - RNA, 22 nt, Human
ugggcaccuagcaacccuucuc

SEQ ID NO: 91210 - RNA, 22 nt, Human
ugggcaccugaggccuggcagg

SEQ ID NO: 91211 - RNA, 22 nt, Human
ugggcacuauggcucugugcac

SEQ ID NO: 91212 - RNA, 22 nt, Human
ugggcacucaggcugaggccgu

SEQ ID NO: 91213 - RNA, 22 nt, Human
ugggcacuguagcuggugcugg

SEQ ID NO: 91214 - RNA, 22 nt, Human
ugggcagacauugaguuuguuc

SEQ ID NO: 91215 - RNA, 22 nt, Human
ugggcagacgcuguuggaaggc

SEQ ID NO: 91216 - RNA, 22 nt, Human
ugggcagacgggagcuugccuu

SEQ ID NO: 91217 - RNA, 22 nt, Human
ugggcagacugagcccuguccc

SEQ ID NO: 91218 - RNA, 22 nt, Human
ugggcagagaguagaggcaacg

SEQ ID NO: 91219 - RNA, 22 nt, Human
ugggcagagaucuggaucaaac

SEQ ID NO: 91220 - RNA, 22 nt, Human
ugggcagagucauacaggagac

SEQ ID NO: 91221 - RNA, 22 nt, Human
ugggcagauguggcucuccuug

SEQ ID NO: 91222 - RNA, 22 nt, Human
ugggcagcagcaaagccagacu

SEQ ID NO: 91223 - RNA, 23 nt, Human
ugggcagcuucugcaugcccacc

SEQ ID NO: 91224 - RNA, 22 nt, Human
ugggcagggagcuggaaccaca

SEQ ID NO: 91225 - RNA, 22 nt, Human
ugggcagggaucucuuuugcaa

SEQ ID NO: 91226 - RNA, 22 nt, Human
ugggcagggucucuguuaucag

SEQ ID NO: 91227 - RNA, 22 nt, Human
ugggcagguuguuauuugacau

SEQ ID NO: 91228 - RNA, 22 nt, Human
ugggcagugagaaaggucaggu

SEQ ID NO: 91229 - RNA, 23 nt, Human
ugggcaucuccucugugccaggc

SEQ ID NO: 91230 - RNA, 22 nt, Human
ugggccacagcucacacaucca

SEQ ID NO: 91231 - RNA, 22 nt, Human
ugggccacauuccaaaccagcu

SEQ ID NO: 91232 - RNA, 22 nt, Human
ugggccacgugacccuuacccu

SEQ ID NO: 91233 - RNA, 23 nt, Human
ugggccacuauagaaaucucuca

SEQ ID NO: 91234 - RNA, 22 nt, Human
ugggccacucuucccugggucu

SEQ ID NO: 91235 - RNA, 22 nt, Human
ugggccacugcuccaaguagcu

SEQ ID NO: 91236 - RNA, 22 nt, Human
ugggccacugcugcggaaggcg

SEQ ID NO: 91237 - RNA, 22 nt, Human
ugggccacuugaaaguggaugu

SEQ ID NO: 91238 - RNA, 22 nt, Human
ugggccagagaguaagaaaggu

SEQ ID NO: 91239 - RNA, 22 nt, Human
ugggccagaggcauggagcuau

SEQ ID NO: 91240 - RNA, 22 nt, Human
ugggccagggcacccaguccag

SEQ ID NO: 91241 - RNA, 22 nt, Human
ugugaggguuuuaagggaauga

SEQ ID NO: 91242 - RNA, 22 nt, Human
ugugagugacaguucccuuggu

SEQ ID NO: 91243 - RNA, 22 nt, Human
ugugaucaggugaucaugugag

SEQ ID NO: 91244 - RNA, 22 nt, Human
ugugaucugccuuggaucugca

SEQ ID NO: 91245 - RNA, 22 nt, Human
ugugaugcuggagugcgaauau

SEQ ID NO: 91246 - RNA, 22 nt, Human
ugugauuacugaauagaaaaua

SEQ ID NO: 91247 - RNA, 22 nt, Human
ugugauucaagaaaguaaaaug

SEQ ID NO: 91248 - RNA, 22 nt, Human
ugugauucucagaagagggaag

SEQ ID NO: 91249 - RNA, 22 nt, Human
ugugauuucacuggugacaugu

SEQ ID NO: 91250 - RNA, 22 nt, Human
ugugcaacuccuuccacagaca

SEQ ID NO: 91251 - RNA, 22 nt, Human
ugugcaauaaucauagugauuu

SEQ ID NO: 91252 - RNA, 22 nt, Human
ugugcacauauacucauauucc

SEQ ID NO: 91253 - RNA, 22 nt, Human
ugugcacauucuaggacuagua

SEQ ID NO: 91254 - RNA, 22 nt, Human
ugugcagagcccacaggcagcu

SEQ ID NO: 91255 - RNA, 22 nt, Human
ugugcaguuucuauguugucca

SEQ ID NO: 91256 - RNA, 22 nt, Human
ugugcauguauugauuuguacc

SEQ ID NO: 91257 - RNA, 22 nt, Human
ugugcauguucucauuucuaac

SEQ ID NO: 91258 - RNA, 22 nt, Human
ugugccaagacuauauugugcu

SEQ ID NO: 91259 - RNA, 22 nt, Human
ugugccaggcacuugcccaggc

SEQ ID NO: 91260 - RNA, 21 nt, Human
ugugccagggauggggagccc

SEQ ID NO: 91261 - RNA, 22 nt, Human
ugugccagucauccagaugugu

SEQ ID NO: 91262 - RNA, 22 nt, Human
ugugccauugagagguuucaga

SEQ ID NO: 91263 - RNA, 22 nt, Human
ugugccauuucuauucugcagc

SEQ ID NO: 91264 - RNA, 22 nt, Human
ugugcccaucucccagcuugac

SEQ ID NO: 91265 - RNA, 22 nt, Human
ugugccucacccugcucuuggc

SEQ ID NO: 91266 - RNA, 18 nt, Human
ugugccucugcaggacgu

SEQ ID NO: 91267 - RNA, 22 nt, Human
ugugccugagucucggcccacc

SEQ ID NO: 91268 - RNA, 22 nt, Human
ugugccugauggucacguggcc

SEQ ID NO: 91269 - RNA, 22 nt, Human
ugugccuggaucucugugacaa

SEQ ID NO: 91270 - RNA, 22 nt, Human
ugugccuggcccagugguguca

SEQ ID NO: 91271 - RNA, 20 nt, Human
ugugccuggcuuuguccuga

SEQ ID NO: 91272 - RNA, 22 nt, Human
ugugccuguugguguagacaua

SEQ ID NO: 91273 - RNA, 22 nt, Human
ugugccuucccucugcugauuu

SEQ ID NO: 91274 - RNA, 22 nt, Human
ugugcgcgugcacgcauacuug

SEQ ID NO: 91275 - RNA, 22 nt, Human
ugugcguggauuccuguacuca

SEQ ID NO: 91276 - RNA, 22 nt, Human
ugugcgugggcacacacauaug

SEQ ID NO: 91277 - RNA, 22 nt, Human
ugugcucacucuaaauuaagau

SEQ ID NO: 91278 - RNA, 22 nt, Human
ugugcuccaucauccauaaucu

SEQ ID NO: 91279 - RNA, 22 nt, Human
ugugcucuaccucagugucauu

SEQ ID NO: 91280 - RNA, 22 nt, Human
ugugcucuugggcaauagcugc

SEQ ID NO: 91281 - RNA, 22 nt, Human
ugugcugacaagaucagaaggu

SEQ ID NO: 91282 - RNA, 22 nt, Human
ugugcugucaguaucaagggau

SEQ ID NO: 91283 - RNA, 22 nt, Human
ugugcugugggacucaggcucc

SEQ ID NO: 91284 - RNA, 22 nt, Human
ugugcuucagguugucgccacg

SEQ ID NO: 91285 - RNA, 22 nt, Human
ugugcuucucacaucacuguug

SEQ ID NO: 91286 - RNA, 22 nt, Human
ugugcuucucuuucucacuuaa

SEQ ID NO: 91287 - RNA, 22 nt, Human
ugugcuuugguuuuacaggaug

SEQ ID NO: 91288 - RNA, 22 nt, Human
ugugcuuuucucugcuccugga

SEQ ID NO: 91289 - RNA, 22 nt, Human
uguggaaaaaccacaaguuugg

SEQ ID NO: 91290 - RNA, 19 nt, Human
uguggaaaaaggagacauu

SEQ ID NO: 91291 - RNA, 22 nt, Human
uguggaaaagccccacaggacu

SEQ ID NO: 91292 - RNA, 22 nt, Human
uguggaaaguggucuaagcaca

SEQ ID NO: 91293 - RNA, 22 nt, Human
uguggaagaacuucuugcuugg

SEQ ID NO: 91294 - RNA, 22 nt, Human
uguggaagugccaaugacaaau

SEQ ID NO: 91295 - RNA, 22 nt, Human
uguggaauauuagauuagguug

SEQ ID NO: 91296 - RNA, 22 nt, Human
uguggacgucauuaaagcagug

SEQ ID NO: 91297 - RNA, 22 nt, Human
uguggacucgcauggcugaggc

SEQ ID NO: 91298 - RNA, 22 nt, Human
uguggagcacuguuccuggcau

SEQ ID NO: 91299 - RNA, 22 nt, Human
uguggagcucagaaguagcagu

SEQ ID NO: 91300 - RNA, 20 nt, Human
uguggaugagguaaggauag

SEQ ID NO: 91301 - RNA, 22 nt, Human
uguggcacuuacauccuaguuu

SEQ ID NO: 91302 - RNA, 22 nt, Human
uguggcagauacagaagaucaa

SEQ ID NO: 91303 - RNA, 21 nt, Human
uguggcagauguugggaggca

SEQ ID NO: 91304 - RNA, 22 nt, Human
uguggcagggauacugaggcag

SEQ ID NO: 91305 - RNA, 22 nt, Human
uguggcagggcgugacauuugg

SEQ ID NO: 91306 - RNA, 22 nt, Human
uguggccaggccccugauggug

SEQ ID NO: 91307 - RNA, 22 nt, Human
uguggccuccuguuccugggua

SEQ ID NO: 91308 - RNA, 23 nt, Human
uguggccugcagcucugguuugg

SEQ ID NO: 91309 - RNA, 22 nt, Human
uguggccuggaaggggcugcuc

SEQ ID NO: 91310 - RNA, 22 nt, Human
uguggcgagaacauuggaccau

SEQ ID NO: 91311 - RNA, 22 nt, Human
uguggcucuccuccugcugccc

SEQ ID NO: 91312 - RNA, 23 nt, Human
uguggcugagaaauugacaacuu

SEQ ID NO: 91313 - RNA, 19 nt, Human
uguggcugagcacuccuua

SEQ ID NO: 91314 - RNA, 21 nt, Human
uguggcugccucuggcccugg

SEQ ID NO: 91315 - RNA, 22 nt, Human
uguggcugcucaggugcagacc

SEQ ID NO: 91316 - RNA, 22 nt, Human
uguggcugugccgucacacgug

SEQ ID NO: 91317 - RNA, 22 nt, Human
uguggcugugguuuucauaaau

SEQ ID NO: 91318 - RNA, 22 nt, Human
ugugggaaaugggaguggaaga

SEQ ID NO: 91319 - RNA, 22 nt, Human
ugugggcaggagcacaagucag

SEQ ID NO: 91320 - RNA, 22 nt, Human
ugugggcccagauucugaggcu

SEQ ID NO: 91321 - RNA, 22 nt, Human
ugugggccugggaaggugacac

SEQ ID NO: 91322 - RNA, 20 nt, Human
ugugggccugugaagcggcg

SEQ ID NO: 91323 - RNA, 22 nt, Human
uguggggacugaguggaggcuu

SEQ ID NO: 91324 - RNA, 22 nt, Human
uguggggccaaagcccagccac

SEQ ID NO: 91325 - RNA, 22 nt, Human
uguggggcugucaggcaacugg

SEQ ID NO: 91326 - RNA, 22 nt, Human
uguggggcuuacaaaggcagau

SEQ ID NO: 91327 - RNA, 22 nt, Human
ugugggucauaguaucguguua

SEQ ID NO: 91328 - RNA, 22 nt, Human
uguggguccuccugugugcccg

SEQ ID NO: 91329 - RNA, 22 nt, Human
ugugggugguaaaauacaauga

SEQ ID NO: 91330 - RNA, 22 nt, Human
uguggguuuguaguuaaguucu

SEQ ID NO: 91331 - RNA, 19 nt, Human
uguggucucuguucucagg

SEQ ID NO: 91332 - RNA, 22 nt, Human
ugugguugaagguuauuacuua

SEQ ID NO: 91333 - RNA, 20 nt, Human
ugugguuuuugccaguugaa

SEQ ID NO: 91334 - RNA, 22 nt, Human
uguguaaaaucugauuaauacu

SEQ ID NO: 91335 - RNA, 22 nt, Human
uguguaaaaugagccuaaaguc

SEQ ID NO: 91336 - RNA, 22 nt, Human
uguguaaauuuauuuacauaaa

SEQ ID NO: 91337 - RNA, 22 nt, Human
uguguacaaacuaacaacauau

SEQ ID NO: 91338 - RNA, 23 nt, Human
uguguacacaauagaugagguuu

SEQ ID NO: 91339 - RNA, 22 nt, Human
uguguacacaaugauugcagag

SEQ ID NO: 91340 - RNA, 22 nt, Human
uguguacacagauaguaauggc

SEQ ID NO: 91341 - RNA, 22 nt, Human
uguguacacgagagguuauaua

SEQ ID NO: 91342 - RNA, 23 nt, Human
uguguacauacauauguacacac

SEQ ID NO: 91343 - RNA, 20 nt, Human
uguguagcaggugcugugcc

SEQ ID NO: 91344 - RNA, 22 nt, Human
uguguagcucauauuaguguua

SEQ ID NO: 91345 - RNA, 22 nt, Human
uguguauaaacaagagucugug

SEQ ID NO: 91346 - RNA, 22 nt, Human
uguguauacaacuuauaggagc

SEQ ID NO: 91347 - RNA, 22 nt, Human
uucacagcuccuuuuacucaac

SEQ ID NO: 91348 - RNA, 18 nt, Human
uucacaggaaaugucuuu

SEQ ID NO: 91349 - RNA, 22 nt, Human
uucacaggaauguaggggucuu

SEQ ID NO: 91350 - RNA, 18 nt, Human
uguuaggaagggcacaca

SEQ ID NO: 91351 - RNA, 22 nt, Human
uuugacaguguuggggcaggcu

SEQ ID NO: 91352 - RNA, 22 nt, Human
uuugacaucuaagaauucuuac

SEQ ID NO: 91353 - RNA, 22 nt, Human
uuugacaugaaguagcuuauaa

SEQ ID NO: 91354 - RNA, 22 nt, Human
uuugacauggaauaacucauuu

SEQ ID NO: 91355 - RNA, 22 nt, Human
uuugacauuauccuguuacugg

SEQ ID NO: 91356 - RNA, 22 nt, Human
uuugacucaagcccucauguua

SEQ ID NO: 91357 - RNA, 22 nt, Human
uuugacucagcaaauucacagg

SEQ ID NO: 91358 - RNA, 22 nt, Human
uuugacuccagagcccauuuuu

SEQ ID NO: 91359 - RNA, 22 nt, Human
uuugacucccaaacugugauuu

SEQ ID NO: 91360 - RNA, 22 nt, Human
uuugacucuagucauagaagug

SEQ ID NO: 91361 - RNA, 22 nt, Human
uuugacucuucuagcaagugug

SEQ ID NO: 91362 - RNA, 22 nt, Human
uuugacucuugucucuuguuag

SEQ ID NO: 91363 - RNA, 22 nt, Human
uuugacuuugggcucuaacuca

SEQ ID NO: 91364 - RNA, 22 nt, Human
uuugagaaacagacgaaagaca

SEQ ID NO: 91365 - RNA, 22 nt, Human
uuugagaaaggggauuuaauuc

SEQ ID NO: 91366 - RNA, 22 nt, Human
uuugagaaguaauucaagacau

SEQ ID NO: 91367 - RNA, 21 nt, Human
uuugagaauuggucagagugc

SEQ ID NO: 91368 - RNA, 22 nt, Human
uuugaguuuuaccuguauuacu

SEQ ID NO: 91369 - RNA, 22 nt, Human
uuugauaauacacaagagaaag

SEQ ID NO: 91370 - RNA, 22 nt, Human
uuugauacuuugugcaauuucu

SEQ ID NO: 91371 - RNA, 22 nt, Human
uuugauagggaaguaagaauga

SEQ ID NO: 91372 - RNA, 19 nt, Human
uuugauaucugaauuaugc

SEQ ID NO: 91373 - RNA, 22 nt, Human
uuugaucagcaagauaaauaga

SEQ ID NO: 91374 - RNA, 22 nt, Human
uuugauccguugcuggugagga

SEQ ID NO: 91375 - RNA, 22 nt, Human
uuugaucuaugcgugguuuccc

SEQ ID NO: 91376 - RNA, 22 nt, Human
uuugaugcuaagauuuaauaaa

SEQ ID NO: 91377 - RNA, 22 nt, Human
uuugauucuaaguucugucaac

SEQ ID NO: 91378 - RNA, 22 nt, Human
uuugauucucaauugcccucug

SEQ ID NO: 91379 - RNA, 20 nt, Human
uuugauuucacaaggccagu

SEQ ID NO: 91380 - RNA, 22 nt, Human
uuugcaaaauuauucccagcau

SEQ ID NO: 91381 - RNA, 18 nt, Human
uuugcaaaggaaguaugg

SEQ ID NO: 91382 - RNA, 22 nt, Human
uuugcaaauaaauaagugcucg

SEQ ID NO: 91383 - RNA, 22 nt, Human
uuugcaaaugcucugcagagcu

SEQ ID NO: 91384 - RNA, 22 nt, Human
uuugcaacagacucaucauuga

SEQ ID NO: 91385 - RNA, 22 nt, Human
uuugcaaguaucaaacauguca

SEQ ID NO: 91386 - RNA, 22 nt, Human
uuugcacagccuuucuggcugc

SEQ ID NO: 91387 - RNA, 22 nt, Human
uuugcagagugcagaagcaucu

SEQ ID NO: 91388 - RNA, 22 nt, Human
uuugcagccacagugccuugua

SEQ ID NO: 91389 - RNA, 22 nt, Human
uuugcaguagacaucuuauuuu

SEQ ID NO: 91390 - RNA, 22 nt, Human
uuugcagucaaauuugcuaaau

SEQ ID NO: 91391 - RNA, 22 nt, Human
uuugcagugauucuugcaguga

SEQ ID NO: 91392 - RNA, 22 nt, Human
uuugcaguguucaucaguauuu

SEQ ID NO: 91393 - RNA, 22 nt, Human
uuugcaguuucauugcugaaau

SEQ ID NO: 91394 - RNA, 22 nt, Human
uuugcauuacuugacuuuaguu

SEQ ID NO: 91395 - RNA, 22 nt, Human
uuugcauuccugccugcauuca

SEQ ID NO: 91396 - RNA, 22 nt, Human
uuugcauuguaauauuuaguuc

SEQ ID NO: 91397 - RNA, 22 nt, Human
uuugcauuguuucaaaagugaa

SEQ ID NO: 91398 - RNA, 22 nt, Human
uuugcauuuugauaagaucacu

SEQ ID NO: 91399 - RNA, 22 nt, Human
uuugcuaaugccucugaaauca

SEQ ID NO: 91400 - RNA, 22 nt, Human
uuuccagucucugccuccaagg

SEQ ID NO: 91401 - RNA, 22 nt, Human
uuuccagugagcaaauguagaa

SEQ ID NO: 91402 - RNA, 22 nt, Human
uuuccagugggccccuugaaau

SEQ ID NO: 91403 - RNA, 22 nt, Human
uuuccaguuguucuagaaagcu

SEQ ID NO: 91404 - RNA, 22 nt, Human
uuuccauauucugcgucugcca

SEQ ID NO: 91405 - RNA, 22 nt, Human
uuuccauauuuggucuuuggga

SEQ ID NO: 91406 - RNA, 22 nt, Human
uuuccauguuggugaaaugagg

SEQ ID NO: 91407 - RNA, 22 nt, Human
uuucccaagaccauagauggaa

SEQ ID NO: 91408 - RNA, 22 nt, Human
uuucccacacaguccacugcag

SEQ ID NO: 91409 - RNA, 22 nt, Human
uuucccagagguaugaauaagu

SEQ ID NO: 91410 - RNA, 22 nt, Human
uuucccagccuccuuugcagcu

SEQ ID NO: 91411 - RNA, 21 nt, Human
uuucccagcugaaaauaaaug

SEQ ID NO: 91412 - RNA, 19 nt, Human
uuucccagucccaggagug

SEQ ID NO: 91413 - RNA, 22 nt, Human
uuucccuuugcacucuacaauu

SEQ ID NO: 91414 - RNA, 22 nt, Human
uuuccuaaggcucauuuuaaaa

SEQ ID NO: 91415 - RNA, 22 nt, Human
uuuccuaagguagugauaauuu

SEQ ID NO: 91416 - RNA, 20 nt, Human
uuuccuaagugguuugcuga

SEQ ID NO: 91417 - RNA, 22 nt, Human
uuuccuagagucucuagaagaa

SEQ ID NO: 91418 - RNA, 22 nt, Human
uuuccuaugauauucuaugugu

SEQ ID NO: 91419 - RNA, 22 nt, Human
uuuccucacucaugucaucagu

SEQ ID NO: 91420 - RNA, 22 nt, Human
uuuccuccuagccuccagccgc

SEQ ID NO: 91421 - RNA, 22 nt, Human
uuuccucuuauacaguguuuau

SEQ ID NO: 91422 - RNA, 22 nt, Human
uuuccugagucagagacaccag

SEQ ID NO: 91423 - RNA, 22 nt, Human
uuuccugucuuuugugaaggau

SEQ ID NO: 91424 - RNA, 22 nt, Human
uuuccugugacuaaucuggaca

SEQ ID NO: 91425 - RNA, 22 nt, Human
uuuccuguucuaguuguugcca

SEQ ID NO: 91426 - RNA, 22 nt, Human
uuuccuguugccaucaagaaug

SEQ ID NO: 91427 - RNA, 22 nt, Human
uuuccuuaaaucuguuucuagu

SEQ ID NO: 91428 - RNA, 22 nt, Human
uuuccuucucagggagcuucaa

SEQ ID NO: 91429 - RNA, 22 nt, Human
uuuccuugcacauugguuucca

SEQ ID NO: 91430 - RNA, 22 nt, Human
uuuccuuuccaaaauucugccu

SEQ ID NO: 91431 - RNA, 22 nt, Human
uuuccuuucugguuuggucaua

SEQ ID NO: 91432 - RNA, 22 nt, Human
uuuccuuugcccaauacauguc

SEQ ID NO: 91433 - RNA, 22 nt, Human
uuuccuuugugcaggccuuggg

SEQ ID NO: 91434 - RNA, 22 nt, Human
uuuccuuuuaagcagucggccu

SEQ ID NO: 91435 - RNA, 22 nt, Human
uuucgagggccuuaaguauucc

SEQ ID NO: 91436 - RNA, 21 nt, Human
uuucgcauguguuaacuguga

SEQ ID NO: 91437 - RNA, 22 nt, Human
uuucuaaaugguggcugcauug

SEQ ID NO: 91438 - RNA, 22 nt, Human
uuucuaacguagacagggaggu

SEQ ID NO: 91439 - RNA, 21 nt, Human
uuucuaaggaggaagaaaaga

SEQ ID NO: 91440 - RNA, 22 nt, Human
uuucuaaggccagagacugcug

SEQ ID NO: 91441 - RNA, 21 nt, Human
uuucuaagugcuugguuuggg

SEQ ID NO: 91442 - RNA, 22 nt, Human
uuucuaauucuaacuggcagag

SEQ ID NO: 91443 - RNA, 22 nt, Human
uuucuacaacacuucugaaucu

SEQ ID NO: 91444 - RNA, 22 nt, Human
uuucuacagaagauacacugcu

SEQ ID NO: 91445 - RNA, 22 nt, Human
uuucuacagguugauggguuug

SEQ ID NO: 91446 - RNA, 22 nt, Human
uuucuacaugucaauccaaacc

SEQ ID NO: 91447 - RNA, 22 nt, Human
uuucuacaugucaguaacugau

SEQ ID NO: 91448 - RNA, 22 nt, Human
uuucuacuaagaaaguugauua

SEQ ID NO: 91449 - RNA, 22 nt, Human
uuucuacuuuggaaugcacuga

SEQ ID NO: 91450 - RNA, 22 nt, Human
uuucuagaaaccaagauauugu

SEQ ID NO: 91451 - RNA, 22 nt, Human
uuucuagaaaguucauguguuu

SEQ ID NO: 91452 - RNA, 17 nt, Human
uuucuagcugugaaccc

SEQ ID NO: 91453 - RNA, 22 nt, Human
uuucuaggcacagugucuuccc

SEQ ID NO: 91454 - RNA, 22 nt, Human
uuucuagggcucuugucuucug

SEQ ID NO: 91455 - RNA, 22 nt, Human
uuucuagucagccauaucuagu

SEQ ID NO: 91456 - RNA, 22 nt, Human
uuucuagucucgaucucuuaau

SEQ ID NO: 91457 - RNA, 22 nt, Human
uuucuauaaucuaccaugccag

SEQ ID NO: 91458 - RNA, 22 nt, Human
uuucuauucuggaucuguggca

SEQ ID NO: 91459 - RNA, 22 nt, Human
uuucuauuguaagucuccuaua

SEQ ID NO: 91460 - RNA, 22 nt, Human
uuucuauuuacagugcuaggua

SEQ ID NO: 91461 - RNA, 22 nt, Human
uuucucaaccucaacacuauuu

SEQ ID NO: 91462 - RNA, 22 nt, Human
uuucucaaggugucauguauuu

SEQ ID NO: 91463 - RNA, 22 nt, Human
uuucucaaguucagauauuuga

SEQ ID NO: 91464 - RNA, 22 nt, Human
uuucucagcucagcaucugggu

SEQ ID NO: 91465 - RNA, 19 nt, Human
uuucucaggaaguuugugu

SEQ ID NO: 91466 - RNA, 22 nt, Human
uuucucaguaauguccuggaau

SEQ ID NO: 91467 - RNA, 22 nt, Human
uuucucaguucucugcaaggag

SEQ ID NO: 91468 - RNA, 22 nt, Human
uuuuccaaauuagaaguagaga

SEQ ID NO: 91469 - RNA, 22 nt, Human
uuuuccaccuucuagagauugu

SEQ ID NO: 91470 - RNA, 20 nt, Human
uuuuccacuccucaaaacag

SEQ ID NO: 91471 - RNA, 22 nt, Human
uuuuccagagcugucucuugca

SEQ ID NO: 91472 - RNA, 21 nt, Human
uuuucccacugaaagcuccca

SEQ ID NO: 91473 - RNA, 22 nt, Human
uuuuccucaccuaacucaaggu

SEQ ID NO: 91474 - RNA, 22 nt, Human
uuuuccucugcagagcaguuag

SEQ ID NO: 91475 - RNA, 19 nt, Human
uuuuccugccucauuguuu

SEQ ID NO: 91476 - RNA, 22 nt, Human
uuuuccugccugucucuagagg

SEQ ID NO: 91477 - RNA, 22 nt, Human
uuuuccuggggcuucuggacuc

SEQ ID NO: 91478 - RNA, 22 nt, Human
uuuuccuguccaggcaauuauu

SEQ ID NO: 91479 - RNA, 18 nt, Human
uuuuccuuccaccuugaa

SEQ ID NO: 91480 - RNA, 20 nt, Human
uuuuccuucugaguauguug

SEQ ID NO: 91481 - RNA, 20 nt, Human
uuuuccuuguugccgcugcu

SEQ ID NO: 91482 - RNA, 22 nt, Human
uuuuccuuuggaagaugcauau

SEQ ID NO: 91483 - RNA, 22 nt, Human
uuuucuaaaauauccaggacag

SEQ ID NO: 91484 - RNA, 21 nt, Human
uuuucuccagcugugauuuua

SEQ ID NO: 91485 - RNA, 22 nt, Human
uuuucuccuuucuaggucacau

SEQ ID NO: 91486 - RNA, 22 nt, Human
uuuucucuuguuaauguacuga

SEQ ID NO: 91487 - RNA, 22 nt, Human
uuuucugcggugugaauggccu

SEQ ID NO: 91488 - RNA, 21 nt, Human
uuuucuggaguaugucuccuc

SEQ ID NO: 91489 - RNA, 22 nt, Human
uuuucuguggucagagcuugag

SEQ ID NO: 91490 - RNA, 22 nt, Human
uuuucuuaggugcuccaaguag

SEQ ID NO: 91491 - RNA, 22 nt, Human
uuuucuuuaaucugguggggug

SEQ ID NO: 91492 - RNA, 22 nt, Human
uuuugaaagaguccugcuacag

SEQ ID NO: 91493 - RNA, 22 nt, Human
uuuugaaagggugauuuggcuu

SEQ ID NO: 91494 - RNA, 22 nt, Human
uuuugcaauauguuccugaaua

SEQ ID NO: 91495 - RNA, 22 nt, Human
uuuugcaaugagaugcuuguca

SEQ ID NO: 91496 - RNA, 22 nt, Human
uuuugcagaaugggaagguagu

SEQ ID NO: 91497 - RNA, 22 nt, Human
uuuugcagccacaucugaccug

SEQ ID NO: 91498 - RNA, 22 nt, Human
uuuugcaucuggugaagaccag

SEQ ID NO: 91499 - RNA, 22 nt, Human
uuuugcccuugcuagaucacug

SEQ ID NO: 91500 - RNA, 22 nt, Human
uuuugccgaagguaucugagau

SEQ ID NO: 91501 - RNA, 22 nt, Human
uuuugccuaagaaucucucuga

SEQ ID NO: 91502 - RNA, 22 nt, Human
uuuugccuaggguugacccguu

SEQ ID NO: 91503 - RNA, 22 nt, Human
uuuugccugcacuguauauaua

SEQ ID NO: 91504 - RNA, 22 nt, Human
uuuugcuugagugcacaaaaug

SEQ ID NO: 91505 - RNA, 22 nt, Human
uuuugcuuuuguaacacagugu

SEQ ID NO: 91506 - RNA, 22 nt, Human
uuuuggaacacagacauuagaa

SEQ ID NO: 91507 - RNA, 22 nt, Human
uuuuggaaccaacagugcaccu

SEQ ID NO: 91508 - RNA, 22 nt, Human
uuuuggaauuuauacaguaaug

SEQ ID NO: 91509 - RNA, 22 nt, Human
gcaugcuuuuauaucuguuuaa

SEQ ID NO: 91510 - RNA, 22 nt, Human
gcauggagaagugggaacaggu

SEQ ID NO: 91511 - RNA, 22 nt, Human
gcauggcaagaucaggagacca

SEQ ID NO: 91512 - RNA, 22 nt, Human
gcauggcagaacaccucgcccg

SEQ ID NO: 91513 - RNA, 22 nt, Human
gcauggccaggaaagguagaaa

SEQ ID NO: 91514 - RNA, 22 nt, Human
gcauggccuugcuguaguggua

SEQ ID NO: 91515 - RNA, 22 nt, Human
gcauggcucuggccucagugug

SEQ ID NO: 91516 - RNA, 22 nt, Human
gcaugguggagucugagcaggg

SEQ ID NO: 91517 - RNA, 22 nt, Human
gcaugucaugucauguaggaau

SEQ ID NO: 91518 - RNA, 22 nt, Human
gcauguggcccaaggaggcugu

SEQ ID NO: 91519 - RNA, 22 nt, Human
gcaugugggaacacuuaggcac

SEQ ID NO: 91520 - RNA, 22 nt, Human
gcauguggugggcuggccacuc

SEQ ID NO: 91521 - RNA, 20 nt, Human
gcauguguauggaaggggga

SEQ ID NO: 91522 - RNA, 22 nt, Human
gcauguguuauuucucuguggg

SEQ ID NO: 91523 - RNA, 22 nt, Human
gcauguguuauuuuauguauga

SEQ ID NO: 91524 - RNA, 22 nt, Human
gcauguuauguaucugcccagc

SEQ ID NO: 91525 - RNA, 22 nt, Human
gcauguuuugcaacaagugacc

SEQ ID NO: 91526 - RNA, 21 nt, Human
gcauuaaaagcaguuguuggu

SEQ ID NO: 91527 - RNA, 22 nt, Human
gcauuacacauagacauucguu

SEQ ID NO: 91528 - RNA, 22 nt, Human
gcauuacaggaauuuguuacug

SEQ ID NO: 91529 - RNA, 22 nt, Human
gcauuacaggcuguaagaugca

SEQ ID NO: 91530 - RNA, 20 nt, Human
gcauuagaguacuauaugcu

SEQ ID NO: 91531 - RNA, 22 nt, Human
gcauuauuaauagcugcaugag

SEQ ID NO: 91532 - RNA, 22 nt, Human
gcauucaggguucacggucaac

SEQ ID NO: 91533 - RNA, 18 nt, Human
gcauucaguagugaacaa

SEQ ID NO: 91534 - RNA, 22 nt, Human
gcauuccuacaggcugcuauga

SEQ ID NO: 91535 - RNA, 22 nt, Human
gcauuccuugguuuaaaacaag

SEQ ID NO: 91536 - RNA, 22 nt, Human
gcauucucucucuaaauguugu

SEQ ID NO: 91537 - RNA, 22 nt, Human
cucugcaggcacccaggguggg

SEQ ID NO: 91538 - RNA, 22 nt, Human
cucugcaggccuugaguguggu

SEQ ID NO: 91539 - RNA, 22 nt, Human
cucugcaggggaggcaugcacu

SEQ ID NO: 91540 - RNA, 22 nt, Human
cucugcaucaggcauuauggau

SEQ ID NO: 91541 - RNA, 22 nt, Human
cucugcaugccacaugagugac

SEQ ID NO: 91542 - RNA, 22 nt, Human
cucugcaugccuugcucagaca

SEQ ID NO: 91543 - RNA, 22 nt, Human
cucugccagccaaaauuuauga

SEQ ID NO: 91544 - RNA, 22 nt, Human
cucugccagccaaagucaucac

SEQ ID NO: 91545 - RNA, 19 nt, Human
cucugccauuugcugccug

SEQ ID NO: 91546 - RNA, 21 nt, Human
cucugcccagggccuccugcc

SEQ ID NO: 91547 - RNA, 22 nt, Human
cucugcccagugcccacaggag

SEQ ID NO: 91548 - RNA, 22 nt, Human
cucugcccgugccuuucccagu

SEQ ID NO: 91549 - RNA, 19 nt, Human
cucugccucccuccugggu

SEQ ID NO: 91550 - RNA, 18 nt, Human
cucugcuaaugggcagcu

SEQ ID NO: 91551 - RNA, 22 nt, Human
cucugcuacuguuaaaccauuu

SEQ ID NO: 91552 - RNA, 22 nt, Human
cucugcugcaggaaggcgugca

SEQ ID NO: 91553 - RNA, 22 nt, Human
cucugcugcccaggccugcuag

SEQ ID NO: 91554 - RNA, 20 nt, Human
cucugcugcgcaucccacuu

SEQ ID NO: 91555 - RNA, 22 nt, Human
cucugcuguuuuguauacaggc

SEQ ID NO: 91556 - RNA, 22 nt, Human
cucugcuuggaacagggguuug

SEQ ID NO: 91557 - RNA, 20 nt, Human
cucugcuuuccaccuuucag

SEQ ID NO: 91558 - RNA, 22 nt, Human
cucuggaaauggccauagucau

SEQ ID NO: 91559 - RNA, 22 nt, Human
cucuggaauguuuacaugcccu

SEQ ID NO: 91560 - RNA, 22 nt, Human
cucuggaauuaaggaagccugu

SEQ ID NO: 91561 - RNA, 22 nt, Human
cucuggacagcccuccaggaag

SEQ ID NO: 91562 - RNA, 22 nt, Human
cucuggagaacgcuauggaucu

SEQ ID NO: 91563 - RNA, 19 nt, Human
cucuggagcagacacugga

SEQ ID NO: 91564 - RNA, 22 nt, Human
cucuggagcauuucaccuacau

SEQ ID NO: 91565 - RNA, 22 nt, Human
cucuggagguggagguugcagu

SEQ ID NO: 91566 - RNA, 21 nt, Human
cucuggagucaagagcuucca

SEQ ID NO: 91567 - RNA, 22 nt, Human
cucuggaguccuguaucacucc

SEQ ID NO: 91568 - RNA, 22 nt, Human
cucuggaguggguggccgggag

SEQ ID NO: 91569 - RNA, 22 nt, Human
cucuggaguuagugaucugggc

SEQ ID NO: 91570 - RNA, 22 nt, Human
cucuggcaauugcugcugacuc

SEQ ID NO: 91571 - RNA, 19 nt, Human
cucuggccucuggaugcug

SEQ ID NO: 91572 - RNA, 22 nt, Human
cucuggccugcagauccaugcu

SEQ ID NO: 91573 - RNA, 22 nt, Human
cucuggcuccauuucccuaugu

SEQ ID NO: 91574 - RNA, 22 nt, Human
cucuggcucugacaguugaucc

SEQ ID NO: 91575 - RNA, 22 nt, Human
cucuggcuggcugggccucagu

SEQ ID NO: 91576 - RNA, 19 nt, Human
cucuggcuuccaaagcauc

SEQ ID NO: 91577 - RNA, 22 nt, Human
cucuggcuucuaccuugcaguu

SEQ ID NO: 91578 - RNA, 22 nt, Human
cucugggaaguagauuuggccu

SEQ ID NO: 91579 - RNA, 22 nt, Human
cucugggaaguggagacuucag

SEQ ID NO: 91580 - RNA, 21 nt, Human
cucugggacauuucuuagcag

SEQ ID NO: 91581 - RNA, 22 nt, Human
cucugggaccacgugacucugc

SEQ ID NO: 91582 - RNA, 22 nt, Human
cucugggaguggccacuucuca

SEQ ID NO: 91583 - RNA, 22 nt, Human
cucugggcaaagaugccucauc

SEQ ID NO: 91584 - RNA, 22 nt, Human
cucugggcaccaaagagcagcu

SEQ ID NO: 91585 - RNA, 22 nt, Human
cucugggcaggacgccaggccu

SEQ ID NO: 91586 - RNA, 20 nt, Human
cucugggcugcguugcaaac

SEQ ID NO: 91587 - RNA, 22 nt, Human
cucugggcuuguugaccugcac

SEQ ID NO: 91588 - RNA, 22 nt, Human
cucuggggaaauggauauguac

SEQ ID NO: 91589 - RNA, 17 nt, Human
cucuggggacaguucua

SEQ ID NO: 91590 - RNA, 22 nt, Human
cucuggguccuggggcuacaag

SEQ ID NO: 91591 - RNA, 17 nt, Human
cucugggugccugugug

SEQ ID NO: 91592 - RNA, 22 nt, Human
cucugggugucauggccucagc

SEQ ID NO: 91593 - RNA, 22 nt, Human
cucuggguguuaaugucagugu

SEQ ID NO: 91594 - RNA, 22 nt, Human
cucuggguucacugaggcucug

SEQ ID NO: 91595 - RNA, 22 nt, Human
cucuggucagugaauuccuagu

SEQ ID NO: 91596 - RNA, 21 nt, Human
cucugguccugucuggcaggc

SEQ ID NO: 91597 - RNA, 22 nt, Human
cucuggugucuccccuaagcua

SEQ ID NO: 91598 - RNA, 21 nt, Human
cucugguuugcauuggauuau

SEQ ID NO: 91599 - RNA, 22 nt, Human
cucuguaccuggcauagcaacc

SEQ ID NO: 91600 - RNA, 22 nt, Human
cucuguaccuuaaaagggcuuu

SEQ ID NO: 91601 - RNA, 22 nt, Human
cucuguccugguuuauacuggc

SEQ ID NO: 91602 - RNA, 22 nt, Human
cucugugccagucugcacucgg

SEQ ID NO: 91603 - RNA, 22 nt, Human
cucugugcucccaugcuaguaa

SEQ ID NO: 91604 - RNA, 22 nt, Human
cucugugggaagcuggguguga

SEQ ID NO: 91605 - RNA, 22 nt, Human
cucugugggaggaggaguaggc

SEQ ID NO: 91606 - RNA, 22 nt, Human
cucugugggccagagaggcccc

SEQ ID NO: 91607 - RNA, 22 nt, Human
cucuguguauccaaguucaggu

SEQ ID NO: 91608 - RNA, 22 nt, Human
cucugugucugaagcccuauuu

SEQ ID NO: 91609 - RNA, 22 nt, Human
cucuguguucagccuagcagaa

SEQ ID NO: 91610 - RNA, 18 nt, Human
cucuguguuggugugaag

SEQ ID NO: 91611 - RNA, 22 nt, Human
cucuguugucaguggaagcagc

SEQ ID NO: 91612 - RNA, 22 nt, Human
cucuguuucucagccuauuucc

SEQ ID NO: 91613 - RNA, 22 nt, Human
cucuguuuuucaauaguucuug

SEQ ID NO: 91614 - RNA, 22 nt, Human
cucuuaaagcuuccaguuucaa

SEQ ID NO: 91615 - RNA, 22 nt, Human
cucuuacaagcucccgauauaa

SEQ ID NO: 91616 - RNA, 22 nt, Human
cucuuagagaguuguugaucag

SEQ ID NO: 91617 - RNA, 22 nt, Human
cucuuagcugcuguucuuugag

SEQ ID NO: 91618 - RNA, 22 nt, Human
cucuuauugaugaaggugcuaa

SEQ ID NO: 91619 - RNA, 22 nt, Human
cugaggaugguguggucuucuc

SEQ ID NO: 91620 - RNA, 22 nt, Human
cugaggcaccuacagucucggg

SEQ ID NO: 91621 - RNA, 22 nt, Human
cugaggcacuaacaaggacaag

SEQ ID NO: 91622 - RNA, 22 nt, Human
cugaggcagagaaugaguuugu

SEQ ID NO: 91623 - RNA, 22 nt, Human
cugaggcagagagaacccgggc

SEQ ID NO: 91624 - RNA, 22 nt, Human
cugaggcaguuuaauuuuugaa

SEQ ID NO: 91625 - RNA, 22 nt, Human
cugaggcaucauggagaacagu

SEQ ID NO: 91626 - RNA, 22 nt, Human
cugaggcaugggaaguugggug

SEQ ID NO: 91627 - RNA, 22 nt, Human
cugaggcauguuacaggacaua

SEQ ID NO: 91628 - RNA, 22 nt, Human
cugaggccagaacccgacccug

SEQ ID NO: 91629 - RNA, 22 nt, Human
cugaggccagcugcagagcucu

SEQ ID NO: 91630 - RNA, 18 nt, Human
cugaggcccagagagggc

SEQ ID NO: 91631 - RNA, 19 nt, Human
cugaggcccauguaccaug

SEQ ID NO: 91632 - RNA, 22 nt, Human
cugaggccucucccacuccagc

SEQ ID NO: 91633 - RNA, 22 nt, Human
cugaggccucuuuccuuggcuu

SEQ ID NO: 91634 - RNA, 22 nt, Human
cugaggccugggggcguggacg

SEQ ID NO: 91635 - RNA, 22 nt, Human
cugaggcucugggugucacugu

SEQ ID NO: 91636 - RNA, 22 nt, Human
cugaggcuggggaagggaagug

SEQ ID NO: 91637 - RNA, 22 nt, Human
cugaggcuucucuaguucagcu

SEQ ID NO: 91638 - RNA, 22 nt, Human
cugagggaagggguacauggcu

SEQ ID NO: 91639 - RNA, 22 nt, Human
cugagggagaagucacgggcag

SEQ ID NO: 91640 - RNA, 22 nt, Human
cugagggagaagugaucucuac

SEQ ID NO: 91641 - RNA, 22 nt, Human
cugagggaggagaauugcuuga

SEQ ID NO: 91642 - RNA, 22 nt, Human
cugagggagggacuuugagacu

SEQ ID NO: 91643 - RNA, 22 nt, Human
cugagggaugggcugggccgcc

SEQ ID NO: 91644 - RNA, 22 nt, Human
cugagggcaccgacagagugga

SEQ ID NO: 91645 - RNA, 18 nt, Human
cugagggcagccccuggg

SEQ ID NO: 91646 - RNA, 22 nt, Human
cugagggcagugaugaagguga

SEQ ID NO: 91647 - RNA, 22 nt, Human
cugagggccuucuaugcugagc

SEQ ID NO: 91648 - RNA, 20 nt, Human
cugaggggucugacuuggac

SEQ ID NO: 91649 - RNA, 22 nt, Human
cugagggugcuauucuugccuu

SEQ ID NO: 91650 - RNA, 22 nt, Human
cugagguaaaauuucuauuuug

SEQ ID NO: 91651 - RNA, 23 nt, Human
gcauucugaugguucucugugau

SEQ ID NO: 91652 - RNA, 22 nt, Human
gcauucuugagguguggacuca

SEQ ID NO: 91653 - RNA, 22 nt, Human
gcauucuugguggagugcuaaa

SEQ ID NO: 91654 - RNA, 22 nt, Human
gcauucuuuuuaggagguuccu

SEQ ID NO: 91655 - RNA, 22 nt, Human
gcauugaaauggcaaaaagaga

SEQ ID NO: 91656 - RNA, 22 nt, Human
gcauugaagaucuuagacuagg

SEQ ID NO: 91657 - RNA, 22 nt, Human
gcauugcaacugacagaucauu

SEQ ID NO: 91658 - RNA, 22 nt, Human
gcauugguucaagguugugcag

SEQ ID NO: 91659 - RNA, 22 nt, Human
gcauugucaaaagugguaugac

SEQ ID NO: 91660 - RNA, 22 nt, Human
gcauuuacauggagcuaucuaa

SEQ ID NO: 91661 - RNA, 22 nt, Human
gcauuucagagaaaaucugcuu

SEQ ID NO: 91662 - RNA, 22 nt, Human
gcauuucaugccguggaagucc

SEQ ID NO: 91663 - RNA, 22 nt, Human
gcauuucauguaagucagacca

SEQ ID NO: 91664 - RNA, 22 nt, Human
gcauuuggaacuugguugagau

SEQ ID NO: 91665 - RNA, 22 nt, Human
gcauuuguuccgcuuugucauc

SEQ ID NO: 91666 - RNA, 22 nt, Human
gcauuuguugaguugccagcua

SEQ ID NO: 91667 - RNA, 22 nt, Human
gcauuuuucaucccucuugggu

SEQ ID NO: 91668 - RNA, 22 nt, Human
gcauuuuucucuccuauaggag

SEQ ID NO: 91669 - RNA, 22 nt, Human
gccaaacuacaaguuaaauuuu

SEQ ID NO: 91670 - RNA, 22 nt, Human
gccaaagcagucuugccucugc

SEQ ID NO: 91671 - RNA, 22 nt, Human
gccaaaguccacuugcuuucug

SEQ ID NO: 91672 - RNA, 22 nt, Human
gccaaaguccuccagccaugca

SEQ ID NO: 91673 - RNA, 22 nt, Human
gccaaauaccauuaaccagaaa

SEQ ID NO: 91674 - RNA, 22 nt, Human
gccaaauacuggaaucauagaa

SEQ ID NO: 91675 - RNA, 22 nt, Human
gccaaauaugguggacaguuug

SEQ ID NO: 91676 - RNA, 22 nt, Human
gccaaaucuggauuuagcaaga

SEQ ID NO: 91677 - RNA, 22 nt, Human
gccaacuggcugaucucaaagc

SEQ ID NO: 91678 - RNA, 20 nt, Human
gccaagaauaugcccgacuc

SEQ ID NO: 91679 - RNA, 22 nt, Human
gccaagaaugcgacagccguca

SEQ ID NO: 91680 - RNA, 22 nt, Human
gccaagccugggaagagcccau

SEQ ID NO: 91681 - RNA, 22 nt, Human
gccaagcuuugcaggaguguug

SEQ ID NO: 91682 - RNA, 22 nt, Human
gccaaggauaccagcugugaga

SEQ ID NO: 91683 - RNA, 22 nt, Human
gccaaggcugaggcccugggcu

SEQ ID NO: 91684 - RNA, 21 nt, Human
gccaaggggguagcuauuccu

SEQ ID NO: 91685 - RNA, 23 nt, Human
gccaaguagggggaaagcccgug

SEQ ID NO: 91686 - RNA, 22 nt, Human
gccaaugacagucucaguucug

SEQ ID NO: 91687 - RNA, 22 nt, Human
gccaauuuaucuuacucgugcu

SEQ ID NO: 91688 - RNA, 22 nt, Human
gccaauuuccugagguaaagcu

SEQ ID NO: 91689 - RNA, 22 nt, Human
gccacaggcuccagcaucagua

SEQ ID NO: 91690 - RNA, 22 nt, Human
gccacagggauuguuuugugag

SEQ ID NO: 91691 - RNA, 22 nt, Human
gccacagggcgagcggaggcca

SEQ ID NO: 91692 - RNA, 22 nt, Human
gccacagguacuaugggagaga

SEQ ID NO: 91693 - RNA, 22 nt, Human
gccacagguaggaaccuaccuc

SEQ ID NO: 91694 - RNA, 22 nt, Human
gccacaggugggcucugggaaa

SEQ ID NO: 91695 - RNA, 20 nt, Human
gccacaguuuucucacugca

SEQ ID NO: 91696 - RNA, 22 nt, Human
gccacauagaggaggauauuaa

SEQ ID NO: 91697 - RNA, 22 nt, Human
gccacaugcaauugcagcacgu

SEQ ID NO: 91698 - RNA, 19 nt, Human
gccacauucuuccaggugu

SEQ ID NO: 91699 - RNA, 22 nt, Human
gccaccaggagcccaguccaaa

SEQ ID NO: 91700 - RNA, 22 nt, Human
gccaccagggggcuccagugag

SEQ ID NO: 91701 - RNA, 22 nt, Human
gccaccagguucuggguuaagc

SEQ ID NO: 91702 - RNA, 22 nt, Human
gccaccaugucuggcugaguuu

SEQ ID NO: 91703 - RNA, 21 nt, Human
gccaccucaaucuucuagcgc

SEQ ID NO: 91704 - RNA, 22 nt, Human
gccaccucggcuuucucugcuc

SEQ ID NO: 91705 - RNA, 21 nt, Human
gccaccucgucucggagcagc

SEQ ID NO: 91706 - RNA, 22 nt, Human
gccacguagaagugccgcgaga

SEQ ID NO: 91707 - RNA, 22 nt, Human
gccacguugccacccgggugac

SEQ ID NO: 91708 - RNA, 22 nt, Human
gccacuauuuucccaccuuucu

SEQ ID NO: 91709 - RNA, 22 nt, Human
gccacugcacuccagcccaggc

SEQ ID NO: 91710 - RNA, 21 nt, Human
gccacugcacuccagccuggg

SEQ ID NO: 91711 - RNA, 20 nt, Human
gccacugugcuuacacugcu

SEQ ID NO: 91712 - RNA, 22 nt, Human
gccacuguuccaccaucuugau

SEQ ID NO: 91713 - RNA, 22 nt, Human
gccagaagcacaugagagguga

SEQ ID NO: 91714 - RNA, 22 nt, Human
gccagacacuccccugggcagg

SEQ ID NO: 91715 - RNA, 22 nt, Human
gccagagccacuuuugggugau

SEQ ID NO: 91716 - RNA, 22 nt, Human
gccagaggaacgcugcgcgccc

SEQ ID NO: 91717 - RNA, 22 nt, Human
gccagagucuucugacccugug

SEQ ID NO: 91718 - RNA, 22 nt, Human
gccagagugauguaacauauau

SEQ ID NO: 91719 - RNA, 22 nt, Human
gccagaugccguaaagaugggc

SEQ ID NO: 91720 - RNA, 22 nt, Human
gccagauuuacagauuugcccu

SEQ ID NO: 91721 - RNA, 22 nt, Human
gccagcaaguaucaccaaagcc

SEQ ID NO: 91722 - RNA, 22 nt, Human
gccagcagcccagaaggacuuu

SEQ ID NO: 91723 - RNA, 22 nt, Human
gccagcagcucuugggcgggca

SEQ ID NO: 91724 - RNA, 22 nt, Human
gccagcagcugugggguggcca

SEQ ID NO: 91725 - RNA, 22 nt, Human
gccagcagggcggagccaucua

SEQ ID NO: 91726 - RNA, 22 nt, Human
gccagcagguggagagaucaag

SEQ ID NO: 91727 - RNA, 22 nt, Human
gccagcauaguaagcagucauc

SEQ ID NO: 91728 - RNA, 20 nt, Human
cuggaagccuuuccagagca

SEQ ID NO: 91729 - RNA, 22 nt, Human
cuggaagcgucggaggaagggc

SEQ ID NO: 91730 - RNA, 22 nt, Human
cuggaaggagaaggaggcugug

SEQ ID NO: 91731 - RNA, 22 nt, Human
cuggaaggggcagucuuugggc

SEQ ID NO: 91732 - RNA, 22 nt, Human
cuggaagggggacagccacaca

SEQ ID NO: 91733 - RNA, 22 nt, Human
cuggaaggucuguccccacugc

SEQ ID NO: 91734 - RNA, 22 nt, Human
cuggaagguucuuugugugccu

SEQ ID NO: 91735 - RNA, 23 nt, Human
cuggaagugcuuuuauagcuuug

SEQ ID NO: 91736 - RNA, 22 nt, Human
cuggaagugggguuggcuugaa

SEQ ID NO: 91737 - RNA, 22 nt, Human
cuggaaguuuccuuccugguca

SEQ ID NO: 91738 - RNA, 22 nt, Human
cuggaaucuuuggagaaugugg

SEQ ID NO: 91739 - RNA, 22 nt, Human
cuggaaugcugguaaaauagca

SEQ ID NO: 91740 - RNA, 22 nt, Human
cuggaaugggagucagacagag

SEQ ID NO: 91741 - RNA, 22 nt, Human
cuggaauguagagacagcuuag

SEQ ID NO: 91742 - RNA, 22 nt, Human
cuggacaggaagaauugggagc

SEQ ID NO: 91743 - RNA, 22 nt, Human
cuggacaucagugugccuggcu

SEQ ID NO: 91744 - RNA, 22 nt, Human
cuggacccuguuucccuagguc

SEQ ID NO: 91745 - RNA, 22 nt, Human
cuggacucacuauggcuucaga

SEQ ID NO: 91746 - RNA, 22 nt, Human
cuggacucauccauagagguga

SEQ ID NO: 91747 - RNA, 21 nt, Human
cuggacugaggagacagucgc

SEQ ID NO: 91748 - RNA, 22 nt, Human
cuggacuuacuugcugaggacu

SEQ ID NO: 91749 - RNA, 22 nt, Human
cuggagaagagguaguauguag

SEQ ID NO: 91750 - RNA, 17 nt, Human
cuggagaagccugugga

SEQ ID NO: 91751 - RNA, 22 nt, Human
cuggagaauucuaugaaauauu

SEQ ID NO: 91752 - RNA, 22 nt, Human
cuggagaccucuccugagagug

SEQ ID NO: 91753 - RNA, 22 nt, Human
cuggagagaccgaaagaggcug

SEQ ID NO: 91754 - RNA, 22 nt, Human
cuggagagauccuccugaaaaa

SEQ ID NO: 91755 - RNA, 22 nt, Human
cuggagaggccccaagauauuu

SEQ ID NO: 91756 - RNA, 22 nt, Human
cuggagaggcugggaacagguu

SEQ ID NO: 91757 - RNA, 22 nt, Human
cuggagagggagcuguuggaag

SEQ ID NO: 91758 - RNA, 22 nt, Human
cuggagauaagcagucccaggc

SEQ ID NO: 91759 - RNA, 22 nt, Human
cuggagauuaaguucucagcca

SEQ ID NO: 91760 - RNA, 22 nt, Human
cuggagcagcagguggccaggg

SEQ ID NO: 91761 - RNA, 22 nt, Human
cuggagccacugggucuuguau

SEQ ID NO: 91762 - RNA, 22 nt, Human
cuggagccccaggcugugcaga

SEQ ID NO: 91763 - RNA, 22 nt, Human
cuggagccuagguugaccuggg

SEQ ID NO: 91764 - RNA, 22 nt, Human
cuggagccuucaccaggggaaa

SEQ ID NO: 91765 - RNA, 22 nt, Human
cuggagcuaauaauccaucuga

SEQ ID NO: 91766 - RNA, 22 nt, Human
cuggagcucuguguguuccuga

SEQ ID NO: 91767 - RNA, 22 nt, Human
cuggagcucuucugagugugcu

SEQ ID NO: 91768 - RNA, 22 nt, Human
cuggagcugguauagggacaaa

SEQ ID NO: 91769 - RNA, 22 nt, Human
cuggaggaauaauggcaucuug

SEQ ID NO: 91770 - RNA, 22 nt, Human
cuggaggagcauggacuggagu

SEQ ID NO: 91771 - RNA, 22 nt, Human
cuggaggcaaagcagaggcaug

SEQ ID NO: 91772 - RNA, 22 nt, Human
cuggaggcuggcuuccccuggc

SEQ ID NO: 91773 - RNA, 22 nt, Human
cuggagggaguuaggacccgga

SEQ ID NO: 91774 - RNA, 22 nt, Human
cuggaggggcuggcaugguagc

SEQ ID NO: 91775 - RNA, 19 nt, Human
cuggagguagaggguuagu

SEQ ID NO: 91776 - RNA, 22 nt, Human
cuggaggucauguaauauggaa

SEQ ID NO: 91777 - RNA, 22 nt, Human
cuggagguuggguccaggccag

SEQ ID NO: 91778 - RNA, 18 nt, Human
cuggagucacagugggga

SEQ ID NO: 91779 - RNA, 22 nt, Human
cuggaguccugcauuugcucuu

SEQ ID NO: 91780 - RNA, 22 nt, Human
cuggagucggcgccccaacaga

SEQ ID NO: 91781 - RNA, 22 nt, Human
cuggagucuccccaggagcgug

SEQ ID NO: 91782 - RNA, 22 nt, Human
cuggagugcaaugaacaagguc

SEQ ID NO: 91783 - RNA, 22 nt, Human
cuggaguguaaagagcauagaa

SEQ ID NO: 91784 - RNA, 22 nt, Human
cuggaguguuauggucaaguca

SEQ ID NO: 91785 - RNA, 20 nt, Human
cugcaagcagguuauuccag

SEQ ID NO: 91786 - RNA, 22 nt, Human
cugcaagccaagcugagagccu

SEQ ID NO: 91787 - RNA, 22 nt, Human
cugcaaggcugaauucagcuga

SEQ ID NO: 91788 - RNA, 22 nt, Human
cugcaagggaucuucagguagc

SEQ ID NO: 91789 - RNA, 23 nt, Human
cugcaagguacaagaugcuggau

SEQ ID NO: 91790 - RNA, 22 nt, Human
cugcacaaauuaaucaguuaau

SEQ ID NO: 91791 - RNA, 22 nt, Human
cugcacacaucgcacugcccgu

SEQ ID NO: 91792 - RNA, 22 nt, Human
cugcacagcugggcaagauaua

SEQ ID NO: 91793 - RNA, 22 nt, Human
cugcacagucauuuccucucaa

SEQ ID NO: 91794 - RNA, 22 nt, Human
cugcacaguuugauuucuugcu

SEQ ID NO: 91795 - RNA, 22 nt, Human
cugcacauguucaucaugacaa

SEQ ID NO: 91796 - RNA, 22 nt, Human
cugcaccaucuggagcaccucc

SEQ ID NO: 91797 - RNA, 22 nt, Human
cugcacugcugaucccaggucu

SEQ ID NO: 91798 - RNA, 21 nt, Human
cugcacugugauuuaaaaugu

SEQ ID NO: 91799 - RNA, 18 nt, Human
cugcacuguggguagcuc

SEQ ID NO: 91800 - RNA, 22 nt, Human
cugcagaacaauuccugcuguu

SEQ ID NO: 91801 - RNA, 22 nt, Human
cugcagaccucugagguccaug

SEQ ID NO: 91802 - RNA, 22 nt, Human
cugcagagaguaacugaaauau

SEQ ID NO: 91803 - RNA, 22 nt, Human
cugcagagagugccgggcagcc

SEQ ID NO: 91804 - RNA, 22 nt, Human
cugcagagaugaagaagguggc

SEQ ID NO: 91805 - RNA, 22 nt, Human
cugcagagcauaaaucugaaua

SEQ ID NO: 91806 - RNA, 22 nt, Human
cugcagagggguugaagggucc

SEQ ID NO: 91807 - RNA, 22 nt, Human
cugcagaggucuugcugauggu

SEQ ID NO: 91808 - RNA, 22 nt, Human
cugcagaugggcgauggggccu

SEQ ID NO: 91809 - RNA, 21 nt, Human
cugcagcaaaacuuugcuccu

SEQ ID NO: 91810 - RNA, 22 nt, Human
cugcagcaguacucagcagcca

SEQ ID NO: 91811 - RNA, 23 nt, Human
cugcagccgcguggggacgugga

SEQ ID NO: 91812 - RNA, 22 nt, Human
cugcagccuccugggguacaug

SEQ ID NO: 91813 - RNA, 22 nt, Human
cugcagcuaaggaaugugguug

SEQ ID NO: 91814 - RNA, 22 nt, Human
cugcagcuauauuuucccacag

SEQ ID NO: 91815 - RNA, 22 nt, Human
cugcagcugcaguucugagaga

SEQ ID NO: 91816 - RNA, 22 nt, Human
cugcagcuggcucaugggauau

SEQ ID NO: 91817 - RNA, 22 nt, Human
cugcagcuguagaggacagugg

SEQ ID NO: 91818 - RNA, 22 nt, Human
cugcagcugucucuacugggca

SEQ ID NO: 91819 - RNA, 22 nt, Human
cugcagcuuucgcuccaucagc

SEQ ID NO: 91820 - RNA, 21 nt, Human
cugcaggaugcugaagccagg

SEQ ID NO: 91821 - RNA, 22 nt, Human
cugcaggcccccuuccuggagu

SEQ ID NO: 91822 - RNA, 22 nt, Human
cugcaggcucgaagacacggau

SEQ ID NO: 91823 - RNA, 22 nt, Human
cugcaggcuuccagggcugugg

SEQ ID NO: 91824 - RNA, 22 nt, Human
cugcagggagguuccuuguucu

SEQ ID NO: 91825 - RNA, 22 nt, Human
cugcaggggaccaaagucugac

SEQ ID NO: 91826 - RNA, 22 nt, Human
cugcaggggcuggaguuggcuu

SEQ ID NO: 91827 - RNA, 21 nt, Human
cugcaggugcugccaucaggg

SEQ ID NO: 91828 - RNA, 22 nt, Human
cugcagguuuauuuucuuaccu

SEQ ID NO: 91829 - RNA, 20 nt, Human
cugcaguccccucugaauca

SEQ ID NO: 91830 - RNA, 22 nt, Human
cugcaguucuucuccucaaggc

SEQ ID NO: 91831 - RNA, 22 nt, Human
cugcaguugggugacccaauau

SEQ ID NO: 91832 - RNA, 23 nt, Human
cugcauauggagguuagcaacuc

SEQ ID NO: 91833 - RNA, 22 nt, Human
cugcaucacuggccaagggugu

SEQ ID NO: 91834 - RNA, 22 nt, Human
cugcaucaguggauaugauggu

SEQ ID NO: 91835 - RNA, 20 nt, Human
cugcaucaugguuaagaaca

SEQ ID NO: 91836 - RNA, 22 nt, Human
cugcaucucugugccagagggc

SEQ ID NO: 91837 - RNA, 22 nt, Human
cuggcauguguuuggcuccugu

SEQ ID NO: 91838 - RNA, 22 nt, Human
cuggcauucuuguuucuggaaa

SEQ ID NO: 91839 - RNA, 22 nt, Human
cuggccaagcacuggggucaaa

SEQ ID NO: 91840 - RNA, 22 nt, Human
cuggccaccaagagcuugcuca

SEQ ID NO: 91841 - RNA, 22 nt, Human
cuggccacugcgggccucugcc

SEQ ID NO: 91842 - RNA, 22 nt, Human
cuggccacuggagguggcaccc

SEQ ID NO: 91843 - RNA, 22 nt, Human
cuggccagaagcaccuuuggcg

SEQ ID NO: 91844 - RNA, 22 nt, Human
cuggccagacuacacaugugug

SEQ ID NO: 91845 - RNA, 22 nt, Human
cuggccagcauggcugaaguac

SEQ ID NO: 91846 - RNA, 22 nt, Human
cuggccagcauuuuugcuuuag

SEQ ID NO: 91847 - RNA, 22 nt, Human
cuggccaggcucucacgugguc

SEQ ID NO: 91848 - RNA, 22 nt, Human
cuggccagguuuugaacaguug

SEQ ID NO: 91849 - RNA, 22 nt, Human
cuggcccaggagagcaggcauu

SEQ ID NO: 91850 - RNA, 21 nt, Human
cuggcccagggaucugcauuu

SEQ ID NO: 91851 - RNA, 23 nt, Human
cuggcccaggugagagguuggug

SEQ ID NO: 91852 - RNA, 22 nt, Human
cuggccccaucuggagucugag

SEQ ID NO: 91853 - RNA, 22 nt, Human
cuggcccccacaccugucaggg

SEQ ID NO: 91854 - RNA, 22 nt, Human
cuggccccuguggcuaaaauca

SEQ ID NO: 91855 - RNA, 22 nt, Human
cuggcccuaugagccuccugau

SEQ ID NO: 91856 - RNA, 21 nt, Human
cuggccgaccccucugugcuc

SEQ ID NO: 91857 - RNA, 22 nt, Human
cuggccucauagccaagcugug

SEQ ID NO: 91858 - RNA, 22 nt, Human
cuggccucucugagcagggagc

SEQ ID NO: 91859 - RNA, 22 nt, Human
cuggccugagaaugcuacccuu

SEQ ID NO: 91860 - RNA, 22 nt, Human
cuggccugaucucaugcugucc

SEQ ID NO: 91861 - RNA, 22 nt, Human
cuggccugcagaucccaggguc

SEQ ID NO: 91862 - RNA, 22 nt, Human
cuggccuggagccucugggugg

SEQ ID NO: 91863 - RNA, 22 nt, Human
cuggccuggcagggagggcaug

SEQ ID NO: 91864 - RNA, 22 nt, Human
cuggccuggcaggggaccucua

SEQ ID NO: 91865 - RNA, 22 nt, Human
cuggccuggucuggccucucca

SEQ ID NO: 91866 - RNA, 22 nt, Human
cuggccuuguuccuccccaagu

SEQ ID NO: 91867 - RNA, 22 nt, Human
cuggccuuucgugagagcuggg

SEQ ID NO: 91868 - RNA, 22 nt, Human
cuggcgugaagguggccaugag

SEQ ID NO: 91869 - RNA, 22 nt, Human
cuggcuaaagagcaagaagaug

SEQ ID NO: 91870 - RNA, 22 nt, Human
cuggcuagcaccucagcucaga

SEQ ID NO: 91871 - RNA, 22 nt, Human
cuggcuaugugguuagacauaa

SEQ ID NO: 91872 - RNA, 22 nt, Human
cuggcucaauaaauauuagcug

SEQ ID NO: 91873 - RNA, 22 nt, Human
cuggcucacuagcccugcccug

SEQ ID NO: 91874 - RNA, 22 nt, Human
cuggcucagacagcugugcagu

SEQ ID NO: 91875 - RNA, 22 nt, Human
cuggcucauccagguguugcuc

SEQ ID NO: 91876 - RNA, 22 nt, Human
cuggcuccaccccaggaggaug

SEQ ID NO: 91877 - RNA, 22 nt, Human
cuggcucccguuguccuugaag

SEQ ID NO: 91878 - RNA, 22 nt, Human
cuggcucccucucccugaguca

SEQ ID NO: 91879 - RNA, 22 nt, Human
cuggcucccuggacauggggcc

SEQ ID NO: 91880 - RNA, 22 nt, Human
cuggcucuaucuccaaggcugg

SEQ ID NO: 91881 - RNA, 22 nt, Human
cuggcucucugauuucacauuc

SEQ ID NO: 91882 - RNA, 22 nt, Human
cuggcucuucuggguucugugu

SEQ ID NO: 91883 - RNA, 22 nt, Human
cuggcucuugcgacucagcuug

SEQ ID NO: 91884 - RNA, 22 nt, Human
cuggcucuuuccuagcuaggcu

SEQ ID NO: 91885 - RNA, 22 nt, Human
cuggcugaauccuagucucaua

SEQ ID NO: 91886 - RNA, 22 nt, Human
cuggcugaggucaccaguagcu

SEQ ID NO: 91887 - RNA, 22 nt, Human
cuggcugauuuucucacuucuc

SEQ ID NO: 91888 - RNA, 22 nt, Human
cuggcugcaggaaggagugggc

SEQ ID NO: 91889 - RNA, 22 nt, Human
cuggcugccuggagugagggag

SEQ ID NO: 91890 - RNA, 22 nt, Human
cuggcuggaacgccgaggcggc

SEQ ID NO: 91891 - RNA, 22 nt, Human
cuggcuggacuugugcauguca

SEQ ID NO: 91892 - RNA, 22 nt, Human
cuggcuggagcaggcaucuugu

SEQ ID NO: 91893 - RNA, 22 nt, Human
cuggcuggagcuguuguaggcu

SEQ ID NO: 91894 - RNA, 22 nt, Human
cuggcugguaauggaacgacag

SEQ ID NO: 91895 - RNA, 22 nt, Human
cuggcuggucaucagcaguacg

SEQ ID NO: 91896 - RNA, 22 nt, Human
cuggcugguuacuauuucuggu

SEQ ID NO: 91897 - RNA, 22 nt, Human
cuggcugguucccugcuccagg

SEQ ID NO: 91898 - RNA, 22 nt, Human
cuggcuguaugcuggccucaga

SEQ ID NO: 91899 - RNA, 22 nt, Human
cuggcugucuucugggagcugu

SEQ ID NO: 91900 - RNA, 22 nt, Human
cuggcugucuuggaggaaggag

SEQ ID NO: 91901 - RNA, 22 nt, Human
cuggcugugcugcaggcuuugg

SEQ ID NO: 91902 - RNA, 22 nt, Human
cugccugccuggagacagaugg

SEQ ID NO: 91903 - RNA, 18 nt, Human
cugccugcucuccagcuu

SEQ ID NO: 91904 - RNA, 22 nt, Human
cugccugcugacauucuuuaua

SEQ ID NO: 91905 - RNA, 22 nt, Human
cugccugcuucugagccagagg

SEQ ID NO: 91906 - RNA, 22 nt, Human
cugccuggagcauucugaaggu

SEQ ID NO: 91907 - RNA, 22 nt, Human
cugccuggcauagucuggucga

SEQ ID NO: 91908 - RNA, 22 nt, Human
cugccugggccaugcccagucc

SEQ ID NO: 91909 - RNA, 22 nt, Human
cugccuggguucaaguccuguu

SEQ ID NO: 91910 - RNA, 22 nt, Human
cugccuggugcggugcccaccc

SEQ ID NO: 91911 - RNA, 22 nt, Human
cugccuguaacuuucugaagca

SEQ ID NO: 91912 - RNA, 22 nt, Human
cugccuguggacacccuggagg

SEQ ID NO: 91913 - RNA, 22 nt, Human
cugccuguuuccucuugcuccc

SEQ ID NO: 91914 - RNA, 22 nt, Human
cugccuugaaaaugaagcuuua

SEQ ID NO: 91915 - RNA, 22 nt, Human
cugccuugaggagguuguggga

SEQ ID NO: 91916 - RNA, 22 nt, Human
cugccuugucuuguuuucaggg

SEQ ID NO: 91917 - RNA, 22 nt, Human
cugccuuugugaucaguucuuu

SEQ ID NO: 91918 - RNA, 22 nt, Human
cugcgcagcaaucagagaggag

SEQ ID NO: 91919 - RNA, 22 nt, Human
cugcggcucugcgggcagcugg

SEQ ID NO: 91920 - RNA, 22 nt, Human
cugcggcuggggacagcuguug

SEQ ID NO: 91921 - RNA, 22 nt, Human
cugcggugggcugggcuguccc

SEQ ID NO: 91922 - RNA, 22 nt, Human
cugcgugguaggacucaguucu

SEQ ID NO: 91923 - RNA, 22 nt, Human
cugcuagcccgccggccagcga

SEQ ID NO: 91924 - RNA, 22 nt, Human
cugcuaggguucagcagugccu

SEQ ID NO: 91925 - RNA, 18 nt, Human
cugcuccagucuggccag

SEQ ID NO: 91926 - RNA, 22 nt, Human
cugcuccuggucauccuccacu

SEQ ID NO: 91927 - RNA, 22 nt, Human
cugcuccugugggccaguggcc

SEQ ID NO: 91928 - RNA, 22 nt, Human
cugcucuagagagcauuaguca

SEQ ID NO: 91929 - RNA, 22 nt, Human
cugcucuauguccucacccagg

SEQ ID NO: 91930 - RNA, 19 nt, Human
cugcucuccuugacuugga

SEQ ID NO: 91931 - RNA, 22 nt, Human
cugcucugcaaggcacagugau

SEQ ID NO: 91932 - RNA, 22 nt, Human
cugcucuguuucuuagcugggu

SEQ ID NO: 91933 - RNA, 22 nt, Human
cugcucuucccacucacuccca

SEQ ID NO: 91934 - RNA, 22 nt, Human
cugcugacaaaauaaaaugcuc

SEQ ID NO: 91935 - RNA, 22 nt, Human
cugcugacuuacacuguuuauu

SEQ ID NO: 91936 - RNA, 22 nt, Human
cugcugagaaaagacugaggga

SEQ ID NO: 91937 - RNA, 22 nt, Human
cugcugagagccacguggcaca

SEQ ID NO: 91938 - RNA, 22 nt, Human
cugcugagagccccagcugaga

SEQ ID NO: 91939 - RNA, 22 nt, Human
cugcugagagcugaaggcugua

SEQ ID NO: 91940 - RNA, 22 nt, Human
cugcugagaugccaggagcucu

SEQ ID NO: 91941 - RNA, 22 nt, Human
cugcugagguggagauugcagu

SEQ ID NO: 91942 - RNA, 22 nt, Human
cugcugaucgaaucagucaccc

SEQ ID NO: 91943 - RNA, 22 nt, Human
cugcugcaggaugggcacucug

SEQ ID NO: 91944 - RNA, 18 nt, Human
cugcugcaggcacucagg

SEQ ID NO: 91945 - RNA, 22 nt, Human
cugcugccccugagcucagccu

SEQ ID NO: 91946 - RNA, 22 nt, Human
cugggagugaaaggagggcugc

SEQ ID NO: 91947 - RNA, 22 nt, Human
cugggcacacucugcuccagcu

SEQ ID NO: 91948 - RNA, 22 nt, Human
cugggcacagacccccugggcc

SEQ ID NO: 91949 - RNA, 22 nt, Human
cugggcacagcguugggcucuu

SEQ ID NO: 91950 - RNA, 22 nt, Human
cugggcaccaggcaugacaggg

SEQ ID NO: 91951 - RNA, 23 nt, Human
cugggcacccaguaccuaggccc

SEQ ID NO: 91952 - RNA, 22 nt, Human
cugggcagcuaccaccacugcu

SEQ ID NO: 91953 - RNA, 22 nt, Human
cugggcagcuccauaccaccca

SEQ ID NO: 91954 - RNA, 22 nt, Human
cugggcaggagggcucuaugga

SEQ ID NO: 91955 - RNA, 22 nt, Human
cugggcagguauacaaaaaaug

SEQ ID NO: 91956 - RNA, 22 nt, Human
cugggcaguaugaauauucaaa

SEQ ID NO: 91957 - RNA, 22 nt, Human
cugggcaguuuacauuccuacc

SEQ ID NO: 91958 - RNA, 22 nt, Human
cugggcaguuuuacaucauugc

SEQ ID NO: 91959 - RNA, 22 nt, Human
cugggcauauacgugcaaguca

SEQ ID NO: 91960 - RNA, 22 nt, Human
cugggccacaagccugugugau

SEQ ID NO: 91961 - RNA, 22 nt, Human
cugggccacuuccucaggggaa

SEQ ID NO: 91962 - RNA, 19 nt, Human
cugggccagaaucagcuca

SEQ ID NO: 91963 - RNA, 22 nt, Human
cugggccagcaacugcaaugga

SEQ ID NO: 91964 - RNA, 22 nt, Human
cugggccagucucggccgcucu

SEQ ID NO: 91965 - RNA, 22 nt, Human
cugggccaucucucugcaagug

SEQ ID NO: 91966 - RNA, 22 nt, Human
cugggcccacgagggcucuggg

SEQ ID NO: 91967 - RNA, 22 nt, Human
cugggccuagaggaagcugaca

SEQ ID NO: 91968 - RNA, 22 nt, Human
cugggccuaggauggaagggcc

SEQ ID NO: 91969 - RNA, 23 nt, Human
cugggccuauggucugaauccaa

SEQ ID NO: 91970 - RNA, 22 nt, Human
cugggccucaaucucagaguuu

SEQ ID NO: 91971 - RNA, 22 nt, Human
cugggccucacacccaccaaau

SEQ ID NO: 91972 - RNA, 22 nt, Human
cugggccucauccagccacaac

SEQ ID NO: 91973 - RNA, 22 nt, Human
cugggccucaugcacagagaug

SEQ ID NO: 91974 - RNA, 22 nt, Human
cugggccuccacgggccaucac

SEQ ID NO: 91975 - RNA, 22 nt, Human
cugggccuccucugcccaagcu

SEQ ID NO: 91976 - RNA, 22 nt, Human
cugggccucucagcucccgcgg

SEQ ID NO: 91977 - RNA, 22 nt, Human
cugggccugagcucugaagagu

SEQ ID NO: 91978 - RNA, 19 nt, Human
cugggccugcaugguuguu

SEQ ID NO: 91979 - RNA, 22 nt, Human
cugggccuggagcccacgagcc

SEQ ID NO: 91980 - RNA, 22 nt, Human
cugggccuggcguuccaggcug

SEQ ID NO: 91981 - RNA, 22 nt, Human
cugggccugguagggcuugaaa

SEQ ID NO: 91982 - RNA, 22 nt, Human
cugggccugucagggcuuuuug

SEQ ID NO: 91983 - RNA, 22 nt, Human
cugggccuucauugcucuccca

SEQ ID NO: 91984 - RNA, 22 nt, Human
cugggccuuggauugacacugu

SEQ ID NO: 91985 - RNA, 22 nt, Human
cugggcgugucuuccagcuggc

SEQ ID NO: 91986 - RNA, 22 nt, Human
cugggcuagaaggaccaggaug

SEQ ID NO: 91987 - RNA, 22 nt, Human
cugggcucaaauccuaucucca

SEQ ID NO: 91988 - RNA, 22 nt, Human
cugggcucaagaagucuucccu

SEQ ID NO: 91989 - RNA, 20 nt, Human
cugggcucaagugagccucc

SEQ ID NO: 91990 - RNA, 22 nt, Human
cugggcucagcccaugcugucc

SEQ ID NO: 91991 - RNA, 22 nt, Human
cugggcucaguggcucauggcu

SEQ ID NO: 91992 - RNA, 21 nt, Human
cugggcucaugguguuacaga

SEQ ID NO: 91993 - RNA, 18 nt, Human
cugggcucgagagauccu

SEQ ID NO: 91994 - RNA, 22 nt, Human
cugggcucuggggucccggugc

SEQ ID NO: 91995 - RNA, 22 nt, Human
cugggcugagccugggcugugu

SEQ ID NO: 91996 - RNA, 22 nt, Human
cugggcugagcuguggaaacuc

SEQ ID NO: 91997 - RNA, 22 nt, Human
cugggcugcagcgggagcgacg

SEQ ID NO: 91998 - RNA, 23 nt, Human
cugggcugcuugagucccuggcu

SEQ ID NO: 91999 - RNA, 22 nt, Human
cugggcugcuugcugaaggggu

SEQ ID NO: 92000 - RNA, 22 nt, Human
cugggcugucaguuuuguuuua

SEQ ID NO: 92001 - RNA, 23 nt, Human
cugggcuguccugaggucaccuc

SEQ ID NO: 92002 - RNA, 22 nt, Human
cugggcuguuuguucuggucuc

SEQ ID NO: 92003 - RNA, 22 nt, Human
cugggcuuaggaccuggugcgg

SEQ ID NO: 92004 - RNA, 22 nt, Human
cugggcuugcacugcagcgaga

SEQ ID NO: 92005 - RNA, 22 nt, Human
cugggcuuucaggcccuaaggc

SEQ ID NO: 92006 - RNA, 22 nt, Human
cuggggaccagugucuguuugu

SEQ ID NO: 92007 - RNA, 22 nt, Human
cuggggacgucgggcaguguuc

SEQ ID NO: 92008 - RNA, 22 nt, Human
cuggggcaucugacagauaaau

SEQ ID NO: 92009 - RNA, 22 nt, Human
cuggggccacaacggcgcacgc

SEQ ID NO: 92010 - RNA, 22 nt, Human
cuggggcuggugaggcaggcuc

SEQ ID NO: 92011 - RNA, 22 nt, Human
cuggggcuucaaugcuucggug

SEQ ID NO: 92012 - RNA, 22 nt, Human
cugggggccuuacggaacucca

SEQ ID NO: 92013 - RNA, 22 nt, Human
cuggggggcuacugacagagga

SEQ ID NO: 92014 - RNA, 22 nt, Human
cugggggugagcagcagcgacg

SEQ ID NO: 92015 - RNA, 22 nt, Human
cugggguaucugccacaacucu

SEQ ID NO: 92016 - RNA, 22 nt, Human
cuggggugaaggauuaccugag

SEQ ID NO: 92017 - RNA, 22 nt, Human
cugggguggaggagcuccccug

SEQ ID NO: 92018 - RNA, 22 nt, Human
cuggguaaguuccuaaggcuca

SEQ ID NO: 92019 - RNA, 22 nt, Human
cuggaacaguguuggagcuuga

SEQ ID NO: 92020 - RNA, 22 nt, Human
cuggaacccaggccuggaagcc

SEQ ID NO: 92021 - RNA, 22 nt, Human
cuggaagaccccccaggacuca

SEQ ID NO: 92022 - RNA, 22 nt, Human
cuggaagaguaauauaaauuag

SEQ ID NO: 92023 - RNA, 22 nt, Human
cuggaagaguccuaaacagaua

SEQ ID NO: 92024 - RNA, 22 nt, Human
cuggaaggcagagguugcagug

SEQ ID NO: 92025 - RNA, 22 nt, Human
cuggaagggaaaucucuuggca

SEQ ID NO: 92026 - RNA, 22 nt, Human
cuggaagggucagagugaugag

SEQ ID NO: 92027 - RNA, 18 nt, Human
cuggaaguuagucuuugg

SEQ ID NO: 92028 - RNA, 22 nt, Human
cuggaauaaacgaucuucagca

SEQ ID NO: 92029 - RNA, 19 nt, Human
cuggaaugagaacaugccc

SEQ ID NO: 92030 - RNA, 22 nt, Human
cuggaaugauugaaaaggaaug

SEQ ID NO: 92031 - RNA, 22 nt, Human
cuggaaugccucccugucagag

SEQ ID NO: 92032 - RNA, 22 nt, Human
cuggaaugggaaucaggaaaga

SEQ ID NO: 92033 - RNA, 20 nt, Human
cuggaauggguguggguuag

SEQ ID NO: 92034 - RNA, 22 nt, Human
cuggaauguaugggaacccaaa

SEQ ID NO: 92035 - RNA, 22 nt, Human
cuggaauguauguaucuuaaga

SEQ ID NO: 92036 - RNA, 19 nt, Human
cuggaauguggcuggugca

SEQ ID NO: 92037 - RNA, 22 nt, Human
cuggacaaccacucagccucag

SEQ ID NO: 92038 - RNA, 22 nt, Human
cuggacacaaacaucuccucug

SEQ ID NO: 92039 - RNA, 22 nt, Human
cuggacacacuggagucuggca

SEQ ID NO: 92040 - RNA, 22 nt, Human
cuggacacuggggaugcgcagu

SEQ ID NO: 92041 - RNA, 22 nt, Human
cuggacagaaaccaguccuggg

SEQ ID NO: 92042 - RNA, 22 nt, Human
cuggacagaaagggcugcugug

SEQ ID NO: 92043 - RNA, 22 nt, Human
cuggacauuucgcacccuucca

SEQ ID NO: 92044 - RNA, 22 nt, Human
cuggaccagaaaggacauggcu

SEQ ID NO: 92045 - RNA, 19 nt, Human
cuggaccuggaggcccgga

SEQ ID NO: 92046 - RNA, 22 nt, Human
cuggacuucucuucaaagacag

SEQ ID NO: 92047 - RNA, 20 nt, Human
cuggacuugcugcucaccug

SEQ ID NO: 92048 - RNA, 22 nt, Human
cuggacuuggggaggcuagauu

SEQ ID NO: 92049 - RNA, 22 nt, Human
cuggagaacuaguuaaacacgu

SEQ ID NO: 92050 - RNA, 22 nt, Human
cuggagaaguacugagacauuu

SEQ ID NO: 92051 - RNA, 22 nt, Human
cuggagagagaaaaagccuuaa

SEQ ID NO: 92052 - RNA, 22 nt, Human
cuggagaguaaucucuguguua

SEQ ID NO: 92053 - RNA, 22 nt, Human
cuggagcaggcuugucccagcu

SEQ ID NO: 92054 - RNA, 22 nt, Human
cuggagcagguuuaggaguccc

SEQ ID NO: 92055 - RNA, 22 nt, Human
cugucuuugguccugucuguua

SEQ ID NO: 92056 - RNA, 22 nt, Human
cugugaaucuugauguuauuuc

SEQ ID NO: 92057 - RNA, 22 nt, Human
cugugaaugcuaguaagagugc

SEQ ID NO: 92058 - RNA, 22 nt, Human
cugugaauguuauaucucaaug

SEQ ID NO: 92059 - RNA, 22 nt, Human
cugugaauugcaacaauugcaa

SEQ ID NO: 92060 - RNA, 22 nt, Human
cugugacagggaucagaaugca

SEQ ID NO: 92061 - RNA, 22 nt, Human
cugugacccaguuccuggcacc

SEQ ID NO: 92062 - RNA, 22 nt, Human
cugugacuagaccugcaggaga

SEQ ID NO: 92063 - RNA, 18 nt, Human
cugugacuccuagaucuc

SEQ ID NO: 92064 - RNA, 22 nt, Human
cugugacuuccacuacugauca

SEQ ID NO: 92065 - RNA, 22 nt, Human
cugugagauguuucugguuaga

SEQ ID NO: 92066 - RNA, 22 nt, Human
cugugaggcggaaaggacucuc

SEQ ID NO: 92067 - RNA, 22 nt, Human
cugugagggccagagucagggc

SEQ ID NO: 92068 - RNA, 22 nt, Human
cugugagggucacagccaugcc

SEQ ID NO: 92069 - RNA, 22 nt, Human
cugugaugacaggcagggccaa

SEQ ID NO: 92070 - RNA, 22 nt, Human
cugugcacacgugcccaacagu

SEQ ID NO: 92071 - RNA, 22 nt, Human
cugugcagcuggcuuccuggaa

SEQ ID NO: 92072 - RNA, 22 nt, Human
cugugcagcuuggcuucaggcc

SEQ ID NO: 92073 - RNA, 22 nt, Human
cugugcaguggcagcguguggg

SEQ ID NO: 92074 - RNA, 22 nt, Human
cugugcaguggggcucuggguu

SEQ ID NO: 92075 - RNA, 22 nt, Human
cugugcauguguucucugguaa

SEQ ID NO: 92076 - RNA, 22 nt, Human
cugugccaggcccagcugacuu

SEQ ID NO: 92077 - RNA, 22 nt, Human
cugugccaucuuuuugcuaccu

SEQ ID NO: 92078 - RNA, 22 nt, Human
cugugcccauaaucugguauuu

SEQ ID NO: 92079 - RNA, 22 nt, Human
cugugcccggcccagggcccug

SEQ ID NO: 92080 - RNA, 22 nt, Human
cugugcccucuuugcuggccuu

SEQ ID NO: 92081 - RNA, 22 nt, Human
cugugcccuguggcuggcaccu

SEQ ID NO: 92082 - RNA, 22 nt, Human
cugugcccuuuguccucgucuc

SEQ ID NO: 92083 - RNA, 22 nt, Human
cugugccuccagucucgcuucu

SEQ ID NO: 92084 - RNA, 22 nt, Human
cugugccuucuacuucacucua

SEQ ID NO: 92085 - RNA, 22 nt, Human
cugugcucuggcaucgcugcaa

SEQ ID NO: 92086 - RNA, 22 nt, Human
cugugcugcagacgcaguagcu

SEQ ID NO: 92087 - RNA, 23 nt, Human
cugugcugggucccaucuugggc

SEQ ID NO: 92088 - RNA, 22 nt, Human
cugugcugggugugcuuaugau

SEQ ID NO: 92089 - RNA, 22 nt, Human
cugugcuuagccaucacauuca

SEQ ID NO: 92090 - RNA, 22 nt, Human
cugugcuuccaggauggcagcu

SEQ ID NO: 92091 - RNA, 22 nt, Human
cuguggaaaauuuguauguaau

SEQ ID NO: 92092 - RNA, 22 nt, Human
cuguggaaagagccuuuggagg

SEQ ID NO: 92093 - RNA, 22 nt, Human
cuguggaaauaaacaaugcuaa

SEQ ID NO: 92094 - RNA, 22 nt, Human
cuguggaaucaucaggucuuac

SEQ ID NO: 92095 - RNA, 20 nt, Human
cuguggaauuuuaccaugcg

SEQ ID NO: 92096 - RNA, 22 nt, Human
cuguggagaugcagaccaggcc

SEQ ID NO: 92097 - RNA, 22 nt, Human
cuguggagcagggcagggucac

SEQ ID NO: 92098 - RNA, 22 nt, Human
cuguggaguccuggggaaugga

SEQ ID NO: 92099 - RNA, 23 nt, Human
cuguggaucuagagggggcccua

SEQ ID NO: 92100 - RNA, 22 nt, Human
cuguggcaccaauacauuuuuc

SEQ ID NO: 92101 - RNA, 22 nt, Human
cuguggcacucaagaagccucc

SEQ ID NO: 92102 - RNA, 22 nt, Human
cuguggcagaggugacaccucu

SEQ ID NO: 92103 - RNA, 20 nt, Human
cuguggcaucuugaaggagg

SEQ ID NO: 92104 - RNA, 22 nt, Human
cuguggcauugccgaggcuggc

SEQ ID NO: 92105 - RNA, 22 nt, Human
cuguggcauugugaggacugca

SEQ ID NO: 92106 - RNA, 17 nt, Human
cuguggccaccuggaug

SEQ ID NO: 92107 - RNA, 22 nt, Human
cuguggccagagcgccguugac

SEQ ID NO: 92108 - RNA, 15 nt, Human
cuguggcuaaccuaa

SEQ ID NO: 92109 - RNA, 22 nt, Human
cuguggcuaggaagcuguggga

SEQ ID NO: 92110 - RNA, 22 nt, Human
cuguggcucaaaaucccaugau

SEQ ID NO: 92111 - RNA, 22 nt, Human
cuguggcuccagugaaccaaug

SEQ ID NO: 92112 - RNA, 16 nt, Human
cuguggcucccagguu

SEQ ID NO: 92113 - RNA, 22 nt, Human
cuguggcucuuuaguugagcac

SEQ ID NO: 92114 - RNA, 19 nt, Human
cuguggcugaccucuggcc

SEQ ID NO: 92115 - RNA, 22 nt, Human
cuguggcugcgccaucgaaaac

SEQ ID NO: 92116 - RNA, 22 nt, Human
cuguggcuggaauaauaaaugu

SEQ ID NO: 92117 - RNA, 22 nt, Human
cuguggcuguauuuggccagag

SEQ ID NO: 92118 - RNA, 22 nt, Human
cuguggcuuugcagggcuuguu

SEQ ID NO: 92119 - RNA, 22 nt, Human
cuguggcuuugugucuauugua

SEQ ID NO: 92120 - RNA, 21 nt, Human
cugugggaccaagcacuggga

SEQ ID NO: 92121 - RNA, 22 nt, Human
cugugggagcacuggggaccga

SEQ ID NO: 92122 - RNA, 22 nt, Human
cugugggagcagcaccaaggac

SEQ ID NO: 92123 - RNA, 22 nt, Human
cugugggagggaaggcgcggcc

SEQ ID NO: 92124 - RNA, 22 nt, Human
cugugggccuagucuggccuag

SEQ ID NO: 92125 - RNA, 19 nt, Human
cugugggcggaggaggggc

SEQ ID NO: 92126 - RNA, 22 nt, Human
cuguguacccacgugggcaccc

SEQ ID NO: 92127 - RNA, 22 nt, Human
cuguguagccucaugugggcuu

SEQ ID NO: 92128 - RNA, 22 nt, Human
cuguguauugaaaaaggguuaa

SEQ ID NO: 92129 - RNA, 19 nt, Human
cugugucacauuuaugaaa

SEQ ID NO: 92130 - RNA, 22 nt, Human
cuguguccaauggccuuagcag

SEQ ID NO: 92131 - RNA, 22 nt, Human
cugugucccacacgagguguau

SEQ ID NO: 92132 - RNA, 22 nt, Human
cugugucccccucagccaggug

SEQ ID NO: 92133 - RNA, 22 nt, Human
cugugucuaaucaggucaguca

SEQ ID NO: 92134 - RNA, 22 nt, Human
cugugucucccaaggaggguca

SEQ ID NO: 92135 - RNA, 22 nt, Human
cugugucugccugggauccauu

SEQ ID NO: 92136 - RNA, 22 nt, Human
cugugucuucaauguacuggga

SEQ ID NO: 92137 - RNA, 22 nt, Human
cugugugcagggcacaauggaa

SEQ ID NO: 92138 - RNA, 22 nt, Human
cugugugccuccugugaucagg

SEQ ID NO: 92139 - RNA, 22 nt, Human
cuggggcugcagcgaucuucau

SEQ ID NO: 92140 - RNA, 22 nt, Human
cuggggcugcggacgggagccc

SEQ ID NO: 92141 - RNA, 19 nt, Human
cuggggcuuugguacugcc

SEQ ID NO: 92142 - RNA, 22 nt, Human
cugggggcaagcagacagcugu

SEQ ID NO: 92143 - RNA, 22 nt, Human
cugggggcaauggucagagugu

SEQ ID NO: 92144 - RNA, 22 nt, Human
cugggggcagcaagaagccaug

SEQ ID NO: 92145 - RNA, 22 nt, Human
cuggggggagcugcguccagca

SEQ ID NO: 92146 - RNA, 22 nt, Human
cuggggucagggaucagagagc

SEQ ID NO: 92147 - RNA, 22 nt, Human
cugggguccuugccauguguca

SEQ ID NO: 92148 - RNA, 22 nt, Human
cuggggugagcagaaacagggg

SEQ ID NO: 92149 - RNA, 22 nt, Human
cugggguggagauuggcaaucu

SEQ ID NO: 92150 - RNA, 22 nt, Human
cugggguggugcaggccucaug

SEQ ID NO: 92151 - RNA, 22 nt, Human
cuggguaccucaccgcugcugc

SEQ ID NO: 92152 - RNA, 22 nt, Human
cuggguagaagauuccucagga

SEQ ID NO: 92153 - RNA, 22 nt, Human
cugggucaaggaaugcuggugg

SEQ ID NO: 92154 - RNA, 22 nt, Human
cugggucaguggcaagcugggu

SEQ ID NO: 92155 - RNA, 22 nt, Human
cuggguccccucagugacacug

SEQ ID NO: 92156 - RNA, 22 nt, Human
cuggguccuggugcugaguucu

SEQ ID NO: 92157 - RNA, 19 nt, Human
cuggguccuguucuuuuac

SEQ ID NO: 92158 - RNA, 22 nt, Human
cugggucuaaaaauucucagau

SEQ ID NO: 92159 - RNA, 22 nt, Human
cugggucuggaggccaagggug

SEQ ID NO: 92160 - RNA, 22 nt, Human
cugggucuggccacaggaagua

SEQ ID NO: 92161 - RNA, 22 nt, Human
cugggucugucacuagauaaau

SEQ ID NO: 92162 - RNA, 22 nt, Human
cugggugaauuugaaggaaagg

SEQ ID NO: 92163 - RNA, 22 nt, Human
cugggugagcuggccagagggu

SEQ ID NO: 92164 - RNA, 22 nt, Human
gcuguuagucaguggaugcccc

SEQ ID NO: 92165 - RNA, 22 nt, Human
gcuguucaaaagccacaguuac

SEQ ID NO: 92166 - RNA, 22 nt, Human
gcuguucaagacuaggaaauuu

SEQ ID NO: 92167 - RNA, 22 nt, Human
gcuguucagaugcgauucagga

SEQ ID NO: 92168 - RNA, 22 nt, Human
gcuguucagggcacucaugggc

SEQ ID NO: 92169 - RNA, 22 nt, Human
gcuguucuguccccauggguaa

SEQ ID NO: 92170 - RNA, 22 nt, Human
gcuguucuuucagcccagggcu

SEQ ID NO: 92171 - RNA, 22 nt, Human
gcuguuggcgaggagcucagcu

SEQ ID NO: 92172 - RNA, 22 nt, Human
gcuguuggggccagcaggucau

SEQ ID NO: 92173 - RNA, 22 nt, Human
gcuguuuccauuuaagugaauc

SEQ ID NO: 92174 - RNA, 22 nt, Human
gcuguuucggguggagguggag

SEQ ID NO: 92175 - RNA, 22 nt, Human
gcuguuucugugguguauagcc

SEQ ID NO: 92176 - RNA, 22 nt, Human
gcuguuucuuuggcaaacugau

SEQ ID NO: 92177 - RNA, 22 nt, Human
gcuuaaacccaggaaguugugg

SEQ ID NO: 92178 - RNA, 22 nt, Human
gcuuacaaacaacagaaauuaa

SEQ ID NO: 92179 - RNA, 22 nt, Human
gcuuacagauaaugaggagacu

SEQ ID NO: 92180 - RNA, 22 nt, Human
gcuuagaacauguggauugcaa

SEQ ID NO: 92181 - RNA, 22 nt, Human
gcuuagaagauugacccugguu

SEQ ID NO: 92182 - RNA, 16 nt, Human
gcuuagugagagcaac

SEQ ID NO: 92183 - RNA, 22 nt, Human
gcuuauguuuugccauugaaga

SEQ ID NO: 92184 - RNA, 22 nt, Human
gcuuauuagguuauuucaagga

SEQ ID NO: 92185 - RNA, 20 nt, Human
gcuucaaagccauccuuuua

SEQ ID NO: 92186 - RNA, 22 nt, Human
gcuucaaauuaaggugaauccc

SEQ ID NO: 92187 - RNA, 22 nt, Human
gcuucacaacuucuuaauucuu

SEQ ID NO: 92188 - RNA, 22 nt, Human
gcuucacagaaucaauaguugg

SEQ ID NO: 92189 - RNA, 22 nt, Human
gcuucagaaaugaacacugucu

SEQ ID NO: 92190 - RNA, 22 nt, Human
gcuucagauuccucuucuguaa

SEQ ID NO: 92191 - RNA, 22 nt, Human
gcuucagcccaucccaguacau

SEQ ID NO: 92192 - RNA, 22 nt, Human
gcuucagccgggcacuuaauga

SEQ ID NO: 92193 - RNA, 22 nt, Human
gcuucaggcugaauuccuccua

SEQ ID NO: 92194 - RNA, 22 nt, Human
gcuucaggguuaugcaagagug

SEQ ID NO: 92195 - RNA, 22 nt, Human
gcuucauagcauucauugccug

SEQ ID NO: 92196 - RNA, 22 nt, Human
gcuucaugggugugcaaccugu

SEQ ID NO: 92197 - RNA, 22 nt, Human
gcuucauuucucucuguagacc

SEQ ID NO: 92198 - RNA, 22 nt, Human
gcuucauuuugcccucuggugg

SEQ ID NO: 92199 - RNA, 22 nt, Human
gcuuccaaaucuguucaaaaug

SEQ ID NO: 92200 - RNA, 22 nt, Human
gcuuccaagcgguagauagcau

SEQ ID NO: 92201 - RNA, 22 nt, Human
gcuuccaaugcuucuaucacau

SEQ ID NO: 92202 - RNA, 22 nt, Human
gcuuccagaaugacuaggaugu

SEQ ID NO: 92203 - RNA, 20 nt, Human
gcuuccagaggaggccccgu

SEQ ID NO: 92204 - RNA, 20 nt, Human
gcuuccaggagggcugauau

SEQ ID NO: 92205 - RNA, 22 nt, Human
gcuuccagggcucagucacugc

SEQ ID NO: 92206 - RNA, 22 nt, Human
gcuuccaggggcugugggcuga

SEQ ID NO: 92207 - RNA, 22 nt, Human
gcuuccaguaaguugcugccau

SEQ ID NO: 92208 - RNA, 23 nt, Human
gcuuccauucuaguuugcugugc

SEQ ID NO: 92209 - RNA, 23 nt, Human
gcuucccagacaauacugcuucc

SEQ ID NO: 92210 - RNA, 22 nt, Human
gcuucccagcagaggaaagacu

SEQ ID NO: 92211 - RNA, 22 nt, Human
gcuucccaggcgccugaccuuu

SEQ ID NO: 92212 - RNA, 22 nt, Human
gcuucccauuauggaaacucuu

SEQ ID NO: 92213 - RNA, 22 nt, Human
gcuuccugaguacacccucauc

SEQ ID NO: 92214 - RNA, 22 nt, Human
gcuuccugggacaggcuaugug

SEQ ID NO: 92215 - RNA, 22 nt, Human
gcuuccuuauuguugccauagu

SEQ ID NO: 92216 - RNA, 22 nt, Human
gcuuccuugguccuggucuaag

SEQ ID NO: 92217 - RNA, 22 nt, Human
gcuucgcugcuagcuaguuggu

SEQ ID NO: 92218 - RNA, 22 nt, Human
gcuucuauuauuuggagcugag

SEQ ID NO: 92219 - RNA, 22 nt, Human
gcuucucaauucucacccucca

SEQ ID NO: 92220 - RNA, 18 nt, Human
gcuucucauuucuaagca

SEQ ID NO: 92221 - RNA, 22 nt, Human
gcuucucucaggagcaucagcc

SEQ ID NO: 92222 - RNA, 22 nt, Human
gcuucucuucgccuagguccuu

SEQ ID NO: 92223 - RNA, 22 nt, Human
gcuucugcagccaaagaagccg

SEQ ID NO: 92224 - RNA, 22 nt, Human
gcuucugcaggguccucgcugu

SEQ ID NO: 92225 - RNA, 23 nt, Human
gcuucugccauuugcuagcugug

SEQ ID NO: 92226 - RNA, 22 nt, Human
gcuucugcgccuagccucaggu

SEQ ID NO: 92227 - RNA, 22 nt, Human
gcuucuggaagcauaugcaaga

SEQ ID NO: 92228 - RNA, 22 nt, Human
gcuucugggguucuggcaugcu

SEQ ID NO: 92229 - RNA, 22 nt, Human
gcuucuguggugaggucaccuu

SEQ ID NO: 92230 - RNA, 22 nt, Human
gcuucuguuaacuuauguuccc

SEQ ID NO: 92231 - RNA, 22 nt, Human
gcuucuguucaaggauauaagg

SEQ ID NO: 92232 - RNA, 22 nt, Human
gcuugaaaaugacucuugugaa

SEQ ID NO: 92233 - RNA, 22 nt, Human
gcuugaaaauucauagguauuu

SEQ ID NO: 92234 - RNA, 22 nt, Human
gcuugcauuuggaauagauuaa

SEQ ID NO: 92235 - RNA, 23 nt, Human
gcuugccugguguguggcugacc

SEQ ID NO: 92236 - RNA, 22 nt, Human
gcuugcucuuuagccauggcca

SEQ ID NO: 92237 - RNA, 19 nt, Human
gcuugcugcuagguaggga

SEQ ID NO: 92238 - RNA, 22 nt, Human
gcuugcuuauuugcccuucucc

SEQ ID NO: 92239 - RNA, 20 nt, Human
gcuuggaagccaccuguauu

SEQ ID NO: 92240 - RNA, 20 nt, Human
gcuuggaccuucugcucugu

SEQ ID NO: 92241 - RNA, 22 nt, Human
gcuuggagaugggggaugagcc

SEQ ID NO: 92242 - RNA, 20 nt, Human
gcuuggcauaggccacuuga

SEQ ID NO: 92243 - RNA, 22 nt, Human
gcuuggcauugaccauuaucau

SEQ ID NO: 92244 - RNA, 22 nt, Human
gcuuggcauuugcugggagcug

SEQ ID NO: 92245 - RNA, 22 nt, Human
gcuuggccagcagccgggaugc

SEQ ID NO: 92246 - RNA, 22 nt, Human
gcuuggcccugccgccuggguc

SEQ ID NO: 92247 - RNA, 22 nt, Human
gcuuggcugccuuuggauguug

SEQ ID NO: 92248 - RNA, 22 nt, Human
gcuuggcuggaaauagguugag

SEQ ID NO: 92249 - RNA, 22 nt, Human
gcuugggaagggcccuguguac

SEQ ID NO: 92250 - RNA, 19 nt, Human
gcuugggagagggagcuaa

SEQ ID NO: 92251 - RNA, 17 nt, Human
gcuugggcugccuguug

SEQ ID NO: 92252 - RNA, 22 nt, Human
gcuuggggagcucaguguccuu

SEQ ID NO: 92253 - RNA, 22 nt, Human
gcuuuaaauggcuugcccaagu

SEQ ID NO: 92254 - RNA, 20 nt, Human
gcuuuaagccaaaaugugaa

SEQ ID NO: 92255 - RNA, 22 nt, Human
gcuuuaaugaagucacgcaaag

SEQ ID NO: 92256 - RNA, 22 nt, Human
gcuuuacacagcugguucuugu

SEQ ID NO: 92257 - RNA, 22 nt, Human
gcuuuacugucuggaaaguuug

SEQ ID NO: 92258 - RNA, 22 nt, Human
gcuuuagaaauaucacugugga

SEQ ID NO: 92259 - RNA, 22 nt, Human
gcuuuagagaagaaagguugcu

SEQ ID NO: 92260 - RNA, 21 nt, Human
gcuuuagauuuagugagccag

SEQ ID NO: 92261 - RNA, 22 nt, Human
gcuuuaguuugucacuggcauu

SEQ ID NO: 92262 - RNA, 22 nt, Human
gcuuuaugcuacgauuucuagu

SEQ ID NO: 92263 - RNA, 18 nt, Human
gcuuuauuucuuggggaa

SEQ ID NO: 92264 - RNA, 20 nt, Human
gcuuucaagcuugucauugu

SEQ ID NO: 92265 - RNA, 22 nt, Human
gcuuucaaggaauuugguauuu

SEQ ID NO: 92266 - RNA, 22 nt, Human
gcuuucaugaaaauaaucuacu

SEQ ID NO: 92267 - RNA, 22 nt, Human
gcuuucccugcccucagaagga

SEQ ID NO: 92268 - RNA, 22 nt, Human
gcuuucuaaucuauuuccuuac

SEQ ID NO: 92269 - RNA, 22 nt, Human
gcuuucugauugcgaaaacaaa

SEQ ID NO: 92270 - RNA, 22 nt, Human
gcuuucugcucuguaaaauggg

SEQ ID NO: 92271 - RNA, 22 nt, Human
cuuauaaaguccaucugaacaa

SEQ ID NO: 92272 - RNA, 22 nt, Human
cuuauacagaucaagggaaaag

SEQ ID NO: 92273 - RNA, 22 nt, Human
cuuuuaaugggagcaguauuug

SEQ ID NO: 92274 - RNA, 22 nt, Human
cuuuuacaguggaccugccauu

SEQ ID NO: 92275 - RNA, 22 nt, Human
cuguacaucucugaggacagua

SEQ ID NO: 92276 - RNA, 18 nt, Human
cuguaccacccugagggc

SEQ ID NO: 92277 - RNA, 22 nt, Human
cuguacucaagguaaaccagga

SEQ ID NO: 92278 - RNA, 20 nt, Human
cuguagagcacaaguggagg

SEQ ID NO: 92279 - RNA, 22 nt, Human
cuguagcagcugaccuggcuaa

SEQ ID NO: 92280 - RNA, 22 nt, Human
cuguagcaguguuccagcauug

SEQ ID NO: 92281 - RNA, 23 nt, Human
cuguagcuaaaagcugggauuug

SEQ ID NO: 92282 - RNA, 22 nt, Human
cuguagcugggccucggcagug

SEQ ID NO: 92283 - RNA, 22 nt, Human
cuguauaacaucuuuuguuucc

SEQ ID NO: 92284 - RNA, 22 nt, Human
cuguauauaauguaugcauggg

SEQ ID NO: 92285 - RNA, 22 nt, Human
cuguauaucaugguuuugcagu

SEQ ID NO: 92286 - RNA, 22 nt, Human
cuguaugaggaucagacuggac

SEQ ID NO: 92287 - RNA, 22 nt, Human
cuguaugauuccauuucuauaa

SEQ ID NO: 92288 - RNA, 22 nt, Human
cuguaugucuugugaauuguag

SEQ ID NO: 92289 - RNA, 22 nt, Human
cuguaugugaaaaugucaagug

SEQ ID NO: 92290 - RNA, 22 nt, Human
cuguauguuggguaagcauugc

SEQ ID NO: 92291 - RNA, 22 nt, Human
cuguauuagccaggugcacaag

SEQ ID NO: 92292 - RNA, 22 nt, Human
cuguauuaguccauuugagcug

SEQ ID NO: 92293 - RNA, 22 nt, Human
cuguauucugggcagggaagga

SEQ ID NO: 92294 - RNA, 22 nt, Human
cuguauuucccacauucucuau

SEQ ID NO: 92295 - RNA, 22 nt, Human
cuguauuucuuggacaguugcu

SEQ ID NO: 92296 - RNA, 22 nt, Human
cuguauuuucaugccuacguac

SEQ ID NO: 92297 - RNA, 22 nt, Human
cugucaacacgggugugcgugc

SEQ ID NO: 92298 - RNA, 22 nt, Human
cugucacagguucaaacucccc

SEQ ID NO: 92299 - RNA, 22 nt, Human
cugucaccucugcccuuugccc

SEQ ID NO: 92300 - RNA, 22 nt, Human
cugucagagauggggagucaga

SEQ ID NO: 92301 - RNA, 22 nt, Human
cugucaggaagcugggcaucca

SEQ ID NO: 92302 - RNA, 22 nt, Human
cugucagguuggucucagagcu

SEQ ID NO: 92303 - RNA, 22 nt, Human
cugucagguuucccggcucacg

SEQ ID NO: 92304 - RNA, 22 nt, Human
cugucauuuaagacauucugga

SEQ ID NO: 92305 - RNA, 22 nt, Human
cugucauuugucugcucccucu

SEQ ID NO: 92306 - RNA, 22 nt, Human
cugucauuuuuuuagaacaccu

SEQ ID NO: 92307 - RNA, 22 nt, Human
cuguccaccuuugauaggcucu

SEQ ID NO: 92308 - RNA, 22 nt, Human
cuguccagaaagggggcaacaa

SEQ ID NO: 92309 - RNA, 22 nt, Human
cuguccagcgacuaggggaugg

SEQ ID NO: 92310 - RNA, 23 nt, Human
cuguccaggauucuugagagaac

SEQ ID NO: 92311 - RNA, 18 nt, Human
cuguccaguagacucugc

SEQ ID NO: 92312 - RNA, 22 nt, Human
cuguccauauucaagggguagg

SEQ ID NO: 92313 - RNA, 19 nt, Human
cugucccagacucugcucu

SEQ ID NO: 92314 - RNA, 22 nt, Human
cugucccauccuuacucuaccc

SEQ ID NO: 92315 - RNA, 22 nt, Human
cuguccccgcgaguccagagcu

SEQ ID NO: 92316 - RNA, 22 nt, Human
cugucccucaguucugggcaaa

SEQ ID NO: 92317 - RNA, 22 nt, Human
cuguccuaugaguacucacuag

SEQ ID NO: 92318 - RNA, 21 nt, Human
cuguccucagauguggacgag

SEQ ID NO: 92319 - RNA, 22 nt, Human
cuguccuccagacgacaguccc

SEQ ID NO: 92320 - RNA, 22 nt, Human
cuguccucuguccucagcagga

SEQ ID NO: 92321 - RNA, 22 nt, Human
cuguccugauggugccacuggu

SEQ ID NO: 92322 - RNA, 23 nt, Human
cuguccugccauccacagcggcc

SEQ ID NO: 92323 - RNA, 22 nt, Human
cuguccuggugcuggggauccc

SEQ ID NO: 92324 - RNA, 22 nt, Human
cuguccuguagcuccaucaguc

SEQ ID NO: 92325 - RNA, 21 nt, Human
cugucgcaggucgccccaccc

SEQ ID NO: 92326 - RNA, 22 nt, Human
cugucguguucacuguggccua

SEQ ID NO: 92327 - RNA, 22 nt, Human
cugucuccagggcaggugcagg

SEQ ID NO: 92328 - RNA, 22 nt, Human
cugucuccuccacugcauggga

SEQ ID NO: 92329 - RNA, 22 nt, Human
cugucucugauaagcucgaggg

SEQ ID NO: 92330 - RNA, 22 nt, Human
cugucucugucuuaacucccag

SEQ ID NO: 92331 - RNA, 22 nt, Human
cugucugcuaugcuuguuguca

SEQ ID NO: 92332 - RNA, 22 nt, Human
cugucugcucauaauggagggc

SEQ ID NO: 92333 - RNA, 22 nt, Human
cugucuggugucccugucuaca

SEQ ID NO: 92334 - RNA, 22 nt, Human
cugucuguaucccuguugguaa

SEQ ID NO: 92335 - RNA, 22 nt, Human
cugucugucccgucaccgcccc

SEQ ID NO: 92336 - RNA, 22 nt, Human
cugucuguccugaguucaacca

SEQ ID NO: 92337 - RNA, 22 nt, Human
cugucuuuuacuaucauuuacu

SEQ ID NO: 92338 - RNA, 22 nt, Human
cugugaauuuaaagcacacauc

SEQ ID NO: 92339 - RNA, 22 nt, Human
cugugaauuuuccaauauuccg

SEQ ID NO: 92340 - RNA, 22 nt, Human
cugugacagagcuugagugaga

SEQ ID NO: 92341 - RNA, 22 nt, Human
cugugaccuccaggaaggggug

SEQ ID NO: 92342 - RNA, 22 nt, Human
cugugaccuuagcaagggaaau

SEQ ID NO: 92343 - RNA, 22 nt, Human
cugugacugcagcaccaaguaa

SEQ ID NO: 92344 - RNA, 22 nt, Human
cugugacugggugacaguccuc

SEQ ID NO: 92345 - RNA, 22 nt, Human
cugugacuugccaaaggucauu

SEQ ID NO: 92346 - RNA, 22 nt, Human
cugugagaaaggugauggaggu

SEQ ID NO: 92347 - RNA, 22 nt, Human
cugugagagugguggccuaggc

SEQ ID NO: 92348 - RNA, 22 nt, Human
cugugagauaugcauaugcucu

SEQ ID NO: 92349 - RNA, 22 nt, Human
cugugagggcagggaccagagg

SEQ ID NO: 92350 - RNA, 22 nt, Human
cugugauuguuaguuccuauac

SEQ ID NO: 92351 - RNA, 22 nt, Human
cugugcaagcccaagauaaaac

SEQ ID NO: 92352 - RNA, 18 nt, Human
cugugcagcaaacugagc

SEQ ID NO: 92353 - RNA, 22 nt, Human
cugugccacugcccugccacgc

SEQ ID NO: 92354 - RNA, 22 nt, Human
cugugccaggcccgggugggug

SEQ ID NO: 92355 - RNA, 22 nt, Human
cugugccauccuagggcugcug

SEQ ID NO: 92356 - RNA, 22 nt, Human
cugugcccagcucccugacugc

SEQ ID NO: 92357 - RNA, 22 nt, Human
cugugccuaagaugcaugucuc

SEQ ID NO: 92358 - RNA, 22 nt, Human
cugugccuccaaguggucucug

SEQ ID NO: 92359 - RNA, 22 nt, Human
cugugccuuuguagcugugccu

SEQ ID NO: 92360 - RNA, 22 nt, Human
cugugcguaaguagccaaaaua

SEQ ID NO: 92361 - RNA, 17 nt, Human
cugugcucgagugaugg

SEQ ID NO: 92362 - RNA, 22 nt, Human
cugugcugaacaauucugcauu

SEQ ID NO: 92363 - RNA, 22 nt, Human
cugugcugaggaugcaguuucu

SEQ ID NO: 92364 - RNA, 22 nt, Human
cugugcuggauucugaggcuac

SEQ ID NO: 92365 - RNA, 22 nt, Human
cugugcugguccagggagcugg

SEQ ID NO: 92366 - RNA, 22 nt, Human
cugugcuucagagucagugcug

SEQ ID NO: 92367 - RNA, 22 nt, Human
cugugcuugacagugggaagca

SEQ ID NO: 92368 - RNA, 22 nt, Human
cugugcuuguguucauuguuaa

SEQ ID NO: 92369 - RNA, 19 nt, Human
cugugcuuuaaacuccuau

SEQ ID NO: 92370 - RNA, 22 nt, Human
cugugcuuucaggccgcugugu

SEQ ID NO: 92371 - RNA, 22 nt, Human
cuguggaaggccuguccugaaa

SEQ ID NO: 92372 - RNA, 21 nt, Human
cuguggaagggaacuagaggg

SEQ ID NO: 92373 - RNA, 22 nt, Human
cuguggaagguuuagauaggua

SEQ ID NO: 92374 - RNA, 22 nt, Human
cuguggagcuuguggcaguggg

SEQ ID NO: 92375 - RNA, 22 nt, Human
cuguggagugcuuggcucagug

SEQ ID NO: 92376 - RNA, 22 nt, Human
cuguggaguggggaguacuggu

SEQ ID NO: 92377 - RNA, 22 nt, Human
cuguggauuuaggcagagcuga

SEQ ID NO: 92378 - RNA, 22 nt, Human
cuguggcaggugucuggggcag

SEQ ID NO: 92379 - RNA, 20 nt, Human
cuguggcaucugucauggug

SEQ ID NO: 92380 - RNA, 22 nt, Human
cuguggcauuaauaaaagugca

SEQ ID NO: 92381 - RNA, 22 nt, Human
cuguggcauuuagagguugcgu

SEQ ID NO: 92382 - RNA, 22 nt, Human
gaaaugaaacaggcuuuuaagg

SEQ ID NO: 92383 - RNA, 22 nt, Human
gaaaugguaaacauuuuaaugg

SEQ ID NO: 92384 - RNA, 22 nt, Human
gaaaugguagaguaggaagauu

SEQ ID NO: 92385 - RNA, 22 nt, Human
gaaauggugugcugugcaauga

SEQ ID NO: 92386 - RNA, 20 nt, Human
gaaauguacacauuaccaca

SEQ ID NO: 92387 - RNA, 22 nt, Human
gaaaugucaagauauguuugga

SEQ ID NO: 92388 - RNA, 22 nt, Human
gaaaugucauagucuucaagcc

SEQ ID NO: 92389 - RNA, 22 nt, Human
gaaaugugcagaauguguuaga

SEQ ID NO: 92390 - RNA, 22 nt, Human
gaaaugugugacaaguuucaau

SEQ ID NO: 92391 - RNA, 22 nt, Human
gaaauguguuguucauuucuaa

SEQ ID NO: 92392 - RNA, 21 nt, Human
cuguggccuggcuagcaccgu

SEQ ID NO: 92393 - RNA, 22 nt, Human
cuguggccuuuguuggaggucc

SEQ ID NO: 92394 - RNA, 22 nt, Human
cuguggcucaauugccuacuga

SEQ ID NO: 92395 - RNA, 22 nt, Human
cuguggcucagcacggggucag

SEQ ID NO: 92396 - RNA, 22 nt, Human
cuguggcugaguuccuuauguu

SEQ ID NO: 92397 - RNA, 22 nt, Human
cuguggcugcagaccuuaaaca

SEQ ID NO: 92398 - RNA, 22 nt, Human
cuguggcugcguaggucuggca

SEQ ID NO: 92399 - RNA, 22 nt, Human
cuguggcuggccugucugacau

SEQ ID NO: 92400 - RNA, 22 nt, Human
cuguggcugugaaacuucucag

SEQ ID NO: 92401 - RNA, 22 nt, Human
cuguggcuucagcauucagagc

SEQ ID NO: 92402 - RNA, 22 nt, Human
cuguggcuucuagguccccgau

SEQ ID NO: 92403 - RNA, 22 nt, Human
cuguggcuucugcuugggccuc

SEQ ID NO: 92404 - RNA, 22 nt, Human
cugugggaacacugaggacuuc

SEQ ID NO: 92405 - RNA, 18 nt, Human
cugugggaaggcuuucua

SEQ ID NO: 92406 - RNA, 23 nt, Human
cugugggaagucggggagcgcgc

SEQ ID NO: 92407 - RNA, 22 nt, Human
cugugggacucugaggaaaagc

SEQ ID NO: 92408 - RNA, 22 nt, Human
cugugggagaagcuagcacagg

SEQ ID NO: 92409 - RNA, 22 nt, Human
cugugggauucaugacauuaau

SEQ ID NO: 92410 - RNA, 20 nt, Human
cugugggccucacuuggggu

SEQ ID NO: 92411 - RNA, 22 nt, Human
cugugggcuccugcagcucagg

SEQ ID NO: 92412 - RNA, 18 nt, Human
cugugggcuggugcauga

SEQ ID NO: 92413 - RNA, 22 nt, Human
cuguggggaagauagaaccgac

SEQ ID NO: 92414 - RNA, 22 nt, Human
cuguggggagcugaucagauca

SEQ ID NO: 92415 - RNA, 22 nt, Human
cuguggucaugaguccuuccau

SEQ ID NO: 92416 - RNA, 20 nt, Human
cuguggugagcaggagagua

SEQ ID NO: 92417 - RNA, 22 nt, Human
cuguguagagcggcugcgagcg

SEQ ID NO: 92418 - RNA, 22 nt, Human
cuguguaguauuuguacacaua

SEQ ID NO: 92419 - RNA, 20 nt, Human
cuguguagugcucagguaag

SEQ ID NO: 92420 - RNA, 22 nt, Human
cuguguccuuuaaaaaagacac

SEQ ID NO: 92421 - RNA, 22 nt, Human
cuguguccuuuuaguugcugug

SEQ ID NO: 92422 - RNA, 22 nt, Human
cugugucggacgugggcagcag

SEQ ID NO: 92423 - RNA, 22 nt, Human
cugugucucuccuuacaagacu

SEQ ID NO: 92424 - RNA, 22 nt, Human
cugugucugaauaacucugugu

SEQ ID NO: 92425 - RNA, 22 nt, Human
cugugucuucacauuugugugc

SEQ ID NO: 92426 - RNA, 22 nt, Human
cugugucuuccucugcccaggc

SEQ ID NO: 92427 - RNA, 22 nt, Human
cugugucuuuccuacuuugugg

SEQ ID NO: 92428 - RNA, 22 nt, Human
cugugugagcaucacuucagau

SEQ ID NO: 92429 - RNA, 22 nt, Human
cugugugcauaguugugcucaa

SEQ ID NO: 92430 - RNA, 22 nt, Human
cugugugccuagaggguggccg

SEQ ID NO: 92431 - RNA, 22 nt, Human
cugugugcucggauggacucgu

SEQ ID NO: 92432 - RNA, 23 nt, Human
cugugugugccgaggguggccac

SEQ ID NO: 92433 - RNA, 22 nt, Human
cugugugugucugcagcauacu

SEQ ID NO: 92434 - RNA, 22 nt, Human
cuguguucagugcuacugaguu

SEQ ID NO: 92435 - RNA, 22 nt, Human
cuguguuugacaggcggucucc

SEQ ID NO: 92436 - RNA, 22 nt, Human
cuguguuuuuggucugaucuau

SEQ ID NO: 92437 - RNA, 22 nt, Human
cuguuaaaagcacugccauccu

SEQ ID NO: 92438 - RNA, 23 nt, Human
cuguuaaauuccuuaagagcagg

SEQ ID NO: 92439 - RNA, 22 nt, Human
cuguuaagcaacaugaguaagu

SEQ ID NO: 92440 - RNA, 22 nt, Human
cuguuaauggaggacuacagga

SEQ ID NO: 92441 - RNA, 22 nt, Human
cuguuacuggacgcacgcagcu

SEQ ID NO: 92442 - RNA, 16 nt, Human
cuguuacuugacuguu

SEQ ID NO: 92443 - RNA, 23 nt, Human
cuguuauauucuagggagcugca

SEQ ID NO: 92444 - RNA, 22 nt, Human
cuguuauucaagacaaaggcag

SEQ ID NO: 92445 - RNA, 22 nt, Human
cuguuauuugagaguguugaau

SEQ ID NO: 92446 - RNA, 22 nt, Human
cuguuauuugcuggaagaguuu

SEQ ID NO: 92447 - RNA, 22 nt, Human
cuguucacacacuuguacucuc

SEQ ID NO: 92448 - RNA, 22 nt, Human
cuguucacagaauccuccccug

SEQ ID NO: 92449 - RNA, 18 nt, Human
cuguucagcugaacuaca

SEQ ID NO: 92450 - RNA, 22 nt, Human
cuguucauguugaggcauaggg

SEQ ID NO: 92451 - RNA, 22 nt, Human
cuguuccagaucaggacaccgu

SEQ ID NO: 92452 - RNA, 18 nt, Human
cuguucuagaacuccugu

SEQ ID NO: 92453 - RNA, 22 nt, Human
cuguucucuggcgguggcuguu

SEQ ID NO: 92454 - RNA, 22 nt, Human
cuguucuucuaguccacugaca

SEQ ID NO: 92455 - RNA, 22 nt, Human
cuguucuuuaguuccacugcaa

SEQ ID NO: 92456 - RNA, 22 nt, Human
cuguugcucccagggagagggu

SEQ ID NO: 92457 - RNA, 22 nt, Human
cuguugcucugaacaggucuug

SEQ ID NO: 92458 - RNA, 19 nt, Human
cuguugcuggggcucucuu

SEQ ID NO: 92459 - RNA, 22 nt, Human
cuguugguguugauuaaauagu

SEQ ID NO: 92460 - RNA, 22 nt, Human
cuguuguaucauuuguucacau

SEQ ID NO: 92461 - RNA, 22 nt, Human
cuguugucuucauugucauauc

SEQ ID NO: 92462 - RNA, 22 nt, Human
cuguugugaaauguccaucaac

SEQ ID NO: 92463 - RNA, 22 nt, Human
cuguuguuccgggagcugcagc

SEQ ID NO: 92464 - RNA, 22 nt, Human
cuguuuaaugagguguaacaac

SEQ ID NO: 92465 - RNA, 22 nt, Human
cuguuuacuuauugguaaagag

SEQ ID NO: 92466 - RNA, 22 nt, Human
cuguuuauagcagagcaagccu

SEQ ID NO: 92467 - RNA, 22 nt, Human
cuguuuaugaagcugugguuua

SEQ ID NO: 92468 - RNA, 22 nt, Human
cuguuuauuacguaauuaauau

SEQ ID NO: 92469 - RNA, 22 nt, Human
cuguuuauucucaucuaaaaug

SEQ ID NO: 92470 - RNA, 22 nt, Human
cuguuuauugagcaaucugcca

SEQ ID NO: 92471 - RNA, 22 nt, Human
cuguuucaaaacuaguacaaca

SEQ ID NO: 92472 - RNA, 22 nt, Human
cuguuucaaaggguacugugag

SEQ ID NO: 92473 - RNA, 22 nt, Human
cuguuucaauuugaggaucagc

SEQ ID NO: 92474 - RNA, 22 nt, Human
cuguuucaccacuggcucuuug

SEQ ID NO: 92475 - RNA, 22 nt, Human
cuguuucagaacuucuuaaaaa

SEQ ID NO: 92476 - RNA, 22 nt, Human
cuguuucccuccagggggugga

SEQ ID NO: 92477 - RNA, 22 nt, Human
cuguuuccuaccguuuuucauu

SEQ ID NO: 92478 - RNA, 22 nt, Human
cuguuuccugucuucucacuau

SEQ ID NO: 92479 - RNA, 22 nt, Human
cuguuuguccaacuugucccga

SEQ ID NO: 92480 - RNA, 17 nt, Human
cuguuuguucugggagc

SEQ ID NO: 92481 - RNA, 22 nt, Human
cuguuuuucagaagguaaggga

SEQ ID NO: 92482 - RNA, 22 nt, Human
cuguuuuugugcugugucuccc

SEQ ID NO: 92483 - RNA, 22 nt, Human
cuuaaacugaaagcuacaagau

SEQ ID NO: 92484 - RNA, 18 nt, Human
cuuaaacuguccccagua

SEQ ID NO: 92485 - RNA, 22 nt, Human
cuuaaagaguauuuaauauaau

SEQ ID NO: 92486 - RNA, 22 nt, Human
cuuaaaggagguuuuguuucca

SEQ ID NO: 92487 - RNA, 22 nt, Human
cuuaaagucuauccuuucuaga

SEQ ID NO: 92488 - RNA, 22 nt, Human
cuuaaauucuuaaugcccucau

SEQ ID NO: 92489 - RNA, 22 nt, Human
cuuaaauuuucaucuacaagaa

SEQ ID NO: 92490 - RNA, 20 nt, Human
cuuaacaauggcucugauga

SEQ ID NO: 92491 - RNA, 23 nt, Human
gaagcagaugucugaguaggcag

SEQ ID NO: 92492 - RNA, 22 nt, Human
gaagcagccacggggagacaga

SEQ ID NO: 92493 - RNA, 20 nt, Human
gaagcagcuucauguagaca

SEQ ID NO: 92494 - RNA, 22 nt, Human
gaagcagggagcagucuuugca

SEQ ID NO: 92495 - RNA, 22 nt, Human
gaagcaguagcaacugugucuu

SEQ ID NO: 92496 - RNA, 22 nt, Human
gaagcaguauccugacagcacc

SEQ ID NO: 92497 - RNA, 22 nt, Human
gaagcagucagcagcaccuuug

SEQ ID NO: 92498 - RNA, 22 nt, Human
gaagcaucagcaauggcuggaa

SEQ ID NO: 92499 - RNA, 21 nt, Human
gaagccaagacaggaucaagg

SEQ ID NO: 92500 - RNA, 22 nt, Human
gaagccaaguccucgaguuuca

SEQ ID NO: 92501 - RNA, 22 nt, Human
gaagccaagugcaaaugccuua

SEQ ID NO: 92502 - RNA, 22 nt, Human
gaagccacagggaaggagaaca

SEQ ID NO: 92503 - RNA, 22 nt, Human
gaagccacccuccuuccagccc

SEQ ID NO: 92504 - RNA, 20 nt, Human
gaagccagaggggaaaggag

SEQ ID NO: 92505 - RNA, 22 nt, Human
gaagccagccuugucugccucu

SEQ ID NO: 92506 - RNA, 22 nt, Human
gaagcccacguuuggugaugua

SEQ ID NO: 92507 - RNA, 22 nt, Human
gaagccccaaacccucgccauc

SEQ ID NO: 92508 - RNA, 23 nt, Human
gaagcccucauugguucuccaga

SEQ ID NO: 92509 - RNA, 22 nt, Human
cuuacgugauaacuucucaaaa

SEQ ID NO: 92510 - RNA, 22 nt, Human
cuuagaaagaguuuucuccccu

SEQ ID NO: 92511 - RNA, 22 nt, Human
cuuagaaauaaugguuucaguu

SEQ ID NO: 92512 - RNA, 18 nt, Human
cuuagaacaucauuccuu

SEQ ID NO: 92513 - RNA, 22 nt, Human
cuuagaagugggcuauaauuag

SEQ ID NO: 92514 - RNA, 22 nt, Human
cuuagaaugucuacucuuacca

SEQ ID NO: 92515 - RNA, 22 nt, Human
cuuagaauuuugccuacuacaa

SEQ ID NO: 92516 - RNA, 22 nt, Human
cuuagagccuuacucuucuugu

SEQ ID NO: 92517 - RNA, 22 nt, Human
cuuagcagaauuccaagcuuga

SEQ ID NO: 92518 - RNA, 22 nt, Human
cuuagcagauaaaaaccuucag

SEQ ID NO: 92519 - RNA, 22 nt, Human
cuuagcaguggguaccagggcu

SEQ ID NO: 92520 - RNA, 22 nt, Human
cuuagcccugagaguucugagc

SEQ ID NO: 92521 - RNA, 22 nt, Human
cuuagcuagaggcaauuauguu

SEQ ID NO: 92522 - RNA, 22 nt, Human
cuuagcuagugcucagcuguca

SEQ ID NO: 92523 - RNA, 22 nt, Human
cuuagcuucucugcaucugugu

SEQ ID NO: 92524 - RNA, 22 nt, Human
cuuagcuuuaaaagugagaucu

SEQ ID NO: 92525 - RNA, 22 nt, Human
cuuagcuuuguccuaggucucu

SEQ ID NO: 92526 - RNA, 22 nt, Human
cuuagcuuuguuuaacacaggg

SEQ ID NO: 92527 - RNA, 22 nt, Human
cuuaggaaauauauacuaaacu

SEQ ID NO: 92528 - RNA, 22 nt, Human
cuuaggaacacuuacugguacu

SEQ ID NO: 92529 - RNA, 22 nt, Human
cuuaggaugaguuuuugcguuu

SEQ ID NO: 92530 - RNA, 22 nt, Human
cuuaggcaaccaggucaaugcu

SEQ ID NO: 92531 - RNA, 22 nt, Human
cuuaggcaagcagagcccaucc

SEQ ID NO: 92532 - RNA, 22 nt, Human
cuuaggcagacugcugaugcag

SEQ ID NO: 92533 - RNA, 22 nt, Human
cuuagggaauugggaggaugcc

SEQ ID NO: 92534 - RNA, 22 nt, Human
cuuaguuuagguaaacccagca

SEQ ID NO: 92535 - RNA, 17 nt, Human
cuuauacuuuacggaag

SEQ ID NO: 92536 - RNA, 22 nt, Human
cuuauagaauguuuuuauaugu

SEQ ID NO: 92537 - RNA, 22 nt, Human
cuuaucagauuaucugggcugu

SEQ ID NO: 92538 - RNA, 19 nt, Human
cuuaugcagcugagcuugg

SEQ ID NO: 92539 - RNA, 22 nt, Human
cuuauggccugcccacaguagu

SEQ ID NO: 92540 - RNA, 22 nt, Human
cuuauguaaacuacagauaaua

SEQ ID NO: 92541 - RNA, 22 nt, Human
cuuauguauauuuggaacguac

SEQ ID NO: 92542 - RNA, 22 nt, Human
cuuauucagcacuugcucugua

SEQ ID NO: 92543 - RNA, 23 nt, Human
cuuauucauucauguagcccauu

SEQ ID NO: 92544 - RNA, 22 nt, Human
cuuauucuacuccacaagcucu

SEQ ID NO: 92545 - RNA, 22 nt, Human
cuuauugaaagccccugugccu

SEQ ID NO: 92546 - RNA, 22 nt, Human
cuuauugugagaugcgauaauu

SEQ ID NO: 92547 - RNA, 22 nt, Human
cuuauuguucagauagagauga

SEQ ID NO: 92548 - RNA, 18 nt, Human
cuuauuguuuaaauggcc

SEQ ID NO: 92549 - RNA, 22 nt, Human
cuuauuuaaugaggguuagaau

SEQ ID NO: 92550 - RNA, 22 nt, Human
cuuauuuugcugaugacccagg

SEQ ID NO: 92551 - RNA, 22 nt, Human
cuucaaaucccccugaguuuga

SEQ ID NO: 92552 - RNA, 22 nt, Human
cuucaaaugugauuuuaauaac

SEQ ID NO: 92553 - RNA, 22 nt, Human
cuucaacuucccuagaugucau

SEQ ID NO: 92554 - RNA, 22 nt, Human
cuucaagagaaugcagggaugu

SEQ ID NO: 92555 - RNA, 22 nt, Human
cuucaagauccauagauauugc

SEQ ID NO: 92556 - RNA, 22 nt, Human
cuucaaguugggcggcgggcag

SEQ ID NO: 92557 - RNA, 22 nt, Human
cuucaauaccugcguugcuagu

SEQ ID NO: 92558 - RNA, 22 nt, Human
cuucaauugccaccagcuagca

SEQ ID NO: 92559 - RNA, 23 nt, Human
cuucacaaucaaaaucaguucug

SEQ ID NO: 92560 - RNA, 22 nt, Human
cuucacaaucaccuuuucggaa

SEQ ID NO: 92561 - RNA, 22 nt, Human
cuucacagagucccugauuguu

SEQ ID NO: 92562 - RNA, 22 nt, Human
cuucacagccaacaugggcaca

SEQ ID NO: 92563 - RNA, 22 nt, Human
cuucacaguaaauccagaagaa

SEQ ID NO: 92564 - RNA, 22 nt, Human
cuucacaucucccuaaaacagc

SEQ ID NO: 92565 - RNA, 22 nt, Human
cuucacauguuggaguccuuug

SEQ ID NO: 92566 - RNA, 22 nt, Human
cuucacauuugcgaaggccaaa

SEQ ID NO: 92567 - RNA, 22 nt, Human
cuucaccuccuccucugugggc

SEQ ID NO: 92568 - RNA, 22 nt, Human
cuucacuaaucacugaacucca

SEQ ID NO: 92569 - RNA, 22 nt, Human
cuucacugugcuucaagcagcu

SEQ ID NO: 92570 - RNA, 22 nt, Human
cuucacuugcucaucaugcuau

SEQ ID NO: 92571 - RNA, 22 nt, Human
cuucagaagccugcagccuuug

SEQ ID NO: 92572 - RNA, 22 nt, Human
cuucagaauuccucagccucag

SEQ ID NO: 92573 - RNA, 22 nt, Human
cuucagagaacuugaucgcugc

SEQ ID NO: 92574 - RNA, 22 nt, Human
cuucagagaguccagggacugc

SEQ ID NO: 92575 - RNA, 22 nt, Human
cuucagagugacucagcaucuu

SEQ ID NO: 92576 - RNA, 22 nt, Human
cuucagauccuaauuugucuuu

SEQ ID NO: 92577 - RNA, 21 nt, Human
cuucagcaaauacuuggcagg

SEQ ID NO: 92578 - RNA, 23 nt, Human
cuucagcagaaacauaaauucuc

SEQ ID NO: 92579 - RNA, 22 nt, Human
cuucagcagaugcaaaaccccu

SEQ ID NO: 92580 - RNA, 19 nt, Human
cuucagcaucuccggagcu

SEQ ID NO: 92581 - RNA, 22 nt, Human
cuucagcaucuuuuucuugggg

SEQ ID NO: 92582 - RNA, 22 nt, Human
cuucagcccagccuccgccucc

SEQ ID NO: 92583 - RNA, 22 nt, Human
cuucagcuaggaucccugcagc

SEQ ID NO: 92584 - RNA, 22 nt, Human
cuucagggguguuaguuuugug

SEQ ID NO: 92585 - RNA, 22 nt, Human
cuucagggugacgcaggcugca

SEQ ID NO: 92586 - RNA, 22 nt, Human
cuucagugacauuccuucccuc

SEQ ID NO: 92587 - RNA, 18 nt, Human
cuucaguggcugcucugc

SEQ ID NO: 92588 - RNA, 22 nt, Human
cuucaguguucccaucuguaaa

SEQ ID NO: 92589 - RNA, 22 nt, Human
cuucaguguugccagggccuag

SEQ ID NO: 92590 - RNA, 22 nt, Human
cuucaguucuaaaguagaaugu

SEQ ID NO: 92591 - RNA, 22 nt, Human
cuucauaauuaccuugucugcc

SEQ ID NO: 92592 - RNA, 22 nt, Human
cuucaugccuguuuuuaaauuu

SEQ ID NO: 92593 - RNA, 22 nt, Human
cuucaugucggcggcucucggg

SEQ ID NO: 92594 - RNA, 22 nt, Human
cuucauuggcuuccauagaugc

SEQ ID NO: 92595 - RNA, 22 nt, Human
cuucauuuggagaacugugcuu

SEQ ID NO: 92596 - RNA, 18 nt, Human
cuucauuuguagaguucc

SEQ ID NO: 92597 - RNA, 22 nt, Human
cuuccagagcugggcugaccuu

SEQ ID NO: 92598 - RNA, 22 nt, Human
cuuccagcuuguggcgcuuucc

SEQ ID NO: 92599 - RNA, 23 nt, Human
cuuccaguacugcacacucaagg

SEQ ID NO: 92600 - RNA, 22 nt, Human
gaaccuuuuuccaaguaaacaa

SEQ ID NO: 92601 - RNA, 22 nt, Human
gaacuaaaagcuaacaucaggc

SEQ ID NO: 92602 - RNA, 22 nt, Human
gaacuaaauuugacagacaaca

SEQ ID NO: 92603 - RNA, 22 nt, Human
gaacucauuagccugcuuucag

SEQ ID NO: 92604 - RNA, 22 nt, Human
gaacuccagaugacucaggaac

SEQ ID NO: 92605 - RNA, 22 nt, Human
gaacucuagguaaaugagauau

SEQ ID NO: 92606 - RNA, 22 nt, Human
gaacugaagacuuuuacuguac

SEQ ID NO: 92607 - RNA, 22 nt, Human
gaacugcauugugguauauguu

SEQ ID NO: 92608 - RNA, 22 nt, Human
gaacugggaaugcugucccauc

SEQ ID NO: 92609 - RNA, 22 nt, Human
gaacuggucuuuuagguuuucu

SEQ ID NO: 92610 - RNA, 22 nt, Human
gaacuguauaggagcaguguuu

SEQ ID NO: 92611 - RNA, 22 nt, Human
gaacuguucccucacaggcugg

SEQ ID NO: 92612 - RNA, 23 nt, Human
gaacuguugaugaauagaauaua

SEQ ID NO: 92613 - RNA, 22 nt, Human
gaacuuggaacuggggcuacug

SEQ ID NO: 92614 - RNA, 22 nt, Human
gaacuuuaaucccuugggcuua

SEQ ID NO: 92615 - RNA, 22 nt, Human
gaacuuuaccauuuagguaacu

SEQ ID NO: 92616 - RNA, 22 nt, Human
gaacuuuaucaaaaguuguuua

SEQ ID NO: 92617 - RNA, 22 nt, Human
gaacuuuauuccagaagaaagc

SEQ ID NO: 92618 - RNA, 18 nt, Human
gaacuuuuggcuuugugu

SEQ ID NO: 92619 - RNA, 22 nt, Human
gaagaaagaucaaauaguuucc

SEQ ID NO: 92620 - RNA, 22 nt, Human
gaagaaagggaauuaacuugag

SEQ ID NO: 92621 - RNA, 22 nt, Human
gaagaacacuucaugauucauu

SEQ ID NO: 92622 - RNA, 22 nt, Human
gaagaacgucuuauaaauucac

SEQ ID NO: 92623 - RNA, 22 nt, Human
gaagaacugacaaacuagauca

SEQ ID NO: 92624 - RNA, 22 nt, Human
gaagaagcaggaguguguagca

SEQ ID NO: 92625 - RNA, 19 nt, Human
gaagaagcuugagaaguag

SEQ ID NO: 92626 - RNA, 17 nt, Human
gaagaaggaaucuagaa

SEQ ID NO: 92627 - RNA, 22 nt, Human
gaagaagucauucugucuuuca

SEQ ID NO: 92628 - RNA, 22 nt, Human
gaagaauauucuugaucuuaga

SEQ ID NO: 92629 - RNA, 22 nt, Human
gaagaaucaagcaguaauuugu

SEQ ID NO: 92630 - RNA, 21 nt, Human
gaagacaaaugggaauagcug

SEQ ID NO: 92631 - RNA, 22 nt, Human
gaagacaauucuggguggagga

SEQ ID NO: 92632 - RNA, 21 nt, Human
gaagacacauaaccucucucc

SEQ ID NO: 92633 - RNA, 22 nt, Human
gaagacaucguguggacuaaca

SEQ ID NO: 92634 - RNA, 22 nt, Human
gaagacauuaagucuaugucac

SEQ ID NO: 92635 - RNA, 22 nt, Human
gaagacuacuguugcacucaua

SEQ ID NO: 92636 - RNA, 22 nt, Human
gaagagagaacauuacauaaac

SEQ ID NO: 92637 - RNA, 22 nt, Human
gaagagagagugggguucugcg

SEQ ID NO: 92638 - RNA, 22 nt, Human
gaagagcuauguccagggagca

SEQ ID NO: 92639 - RNA, 22 nt, Human
gaagagcugcaguuuccugggc

SEQ ID NO: 92640 - RNA, 22 nt, Human
gaagagcugcucagaacaugau

SEQ ID NO: 92641 - RNA, 22 nt, Human
gaagagcugugauucaggcuua

SEQ ID NO: 92642 - RNA, 22 nt, Human
gaagaggcuuuccuagggcaag

SEQ ID NO: 92643 - RNA, 22 nt, Human
gaagagguucaacguggucauc

SEQ ID NO: 92644 - RNA, 22 nt, Human
gaagaguauauuuagugaaauc

SEQ ID NO: 92645 - RNA, 22 nt, Human
gaagaucugcagccucaggcga

SEQ ID NO: 92646 - RNA, 22 nt, Human
ggcagcucugcuccacaugagu

SEQ ID NO: 92647 - RNA, 19 nt, Human
ggcagcucuugucuucugc

SEQ ID NO: 92648 - RNA, 21 nt, Human
ggcagcugaccgcgcggugca

SEQ ID NO: 92649 - RNA, 22 nt, Human
ggcagcugagcauggcuaccuu

SEQ ID NO: 92650 - RNA, 22 nt, Human
ggcagcugauuagcaucaagga

SEQ ID NO: 92651 - RNA, 23 nt, Human
ggcagcugggcagcacucauggg

SEQ ID NO: 92652 - RNA, 22 nt, Human
ggcagcuggggcagugcccugu

SEQ ID NO: 92653 - RNA, 22 nt, Human
ggcagcuguaagaugagugaau

SEQ ID NO: 92654 - RNA, 22 nt, Human
ggcagcuguuggcucucuagga

SEQ ID NO: 92655 - RNA, 22 nt, Human
ggcagcuguuuguccuccuguu

SEQ ID NO: 92656 - RNA, 22 nt, Human
ggcagcuuacguuuugcuagug

SEQ ID NO: 92657 - RNA, 22 nt, Human
ggcagcuucggacggcuuauaa

SEQ ID NO: 92658 - RNA, 22 nt, Human
ggcagcuuguccuucaggagag

SEQ ID NO: 92659 - RNA, 22 nt, Human
ggcagcuuugcccucacugucc

SEQ ID NO: 92660 - RNA, 22 nt, Human
ggcaggaaaacaaugagccagg

SEQ ID NO: 92661 - RNA, 22 nt, Human
ggcaggaacacagauggugccg

SEQ ID NO: 92662 - RNA, 20 nt, Human
ggcaggaccccaguggcauc

SEQ ID NO: 92663 - RNA, 20 nt, Human
ggcaggacccgguagggagc

SEQ ID NO: 92664 - RNA, 22 nt, Human
ggcaggacucucaggaccaagc

SEQ ID NO: 92665 - RNA, 18 nt, Human
ggcaggagcaagaauagg

SEQ ID NO: 92666 - RNA, 22 nt, Human
ggcaggagcucagguugguucc

SEQ ID NO: 92667 - RNA, 22 nt, Human
ggcaggcaacggaccacuaguc

SEQ ID NO: 92668 - RNA, 22 nt, Human
ggcaggcaaugaggaugggaag

SEQ ID NO: 92669 - RNA, 22 nt, Human
ggcaggcacauuugggggccgu

SEQ ID NO: 92670 - RNA, 22 nt, Human
ggcaggcacugugcuaggcgcu

SEQ ID NO: 92671 - RNA, 22 nt, Human
ggcaggcagaggcugagacagg

SEQ ID NO: 92672 - RNA, 22 nt, Human
ggcaggcagauggcugcaccaa

SEQ ID NO: 92673 - RNA, 22 nt, Human
ggcaggcagccuccauccacag

SEQ ID NO: 92674 - RNA, 22 nt, Human
ggcaggcaguguggugugaaac

SEQ ID NO: 92675 - RNA, 22 nt, Human
ggcaggcauggccacucccuag

SEQ ID NO: 92676 - RNA, 22 nt, Human
ggcaggcauggggucugccauu

SEQ ID NO: 92677 - RNA, 22 nt, Human
ggcaggccugagaggcagggcu

SEQ ID NO: 92678 - RNA, 22 nt, Human
ggcaggcuagcacugauguccu

SEQ ID NO: 92679 - RNA, 18 nt, Human
ggcaggcucucuggguca

SEQ ID NO: 92680 - RNA, 22 nt, Human
ggcaggcucuuggccuuaugag

SEQ ID NO: 92681 - RNA, 22 nt, Human
ggcaggcuggcuuuguuccagg

SEQ ID NO: 92682 - RNA, 22 nt, Human
ggcaggcugggagucaucagag

SEQ ID NO: 92683 - RNA, 22 nt, Human
ggcaggcuugauauggggggac

SEQ ID NO: 92684 - RNA, 20 nt, Human
ggcaggcuuuauauggaggg

SEQ ID NO: 92685 - RNA, 18 nt, Human
ggcagggaaaagauaggg

SEQ ID NO: 92686 - RNA, 22 nt, Human
ggcagggacaggauaggguuuu

SEQ ID NO: 92687 - RNA, 22 nt, Human
ggcagggacuauguuucaugga

SEQ ID NO: 92688 - RNA, 22 nt, Human
ggcagggaggaggugaaaguga

SEQ ID NO: 92689 - RNA, 22 nt, Human
ggcagggcagcgcugauuaggg

SEQ ID NO: 92690 - RNA, 22 nt, Human
ggcagggcaggaaagucaggaa

SEQ ID NO: 92691 - RNA, 18 nt, Human
ggcaggggugaaccacag

SEQ ID NO: 92692 - RNA, 17 nt, Human
ggcagggugcuggguau

SEQ ID NO: 92693 - RNA, 22 nt, Human
ggcagguagccuagaggagguu

SEQ ID NO: 92694 - RNA, 22 nt, Human
ggcaggugccaguuggcuuggg

SEQ ID NO: 92695 - RNA, 22 nt, Human
ggcaggugcuugucgaaggccu

SEQ ID NO: 92696 - RNA, 22 nt, Human
ggcagguggaaggucuccauuc

SEQ ID NO: 92697 - RNA, 22 nt, Human
ggcagguggcacugcugcuccc

SEQ ID NO: 92698 - RNA, 22 nt, Human
ggcaggugggaacccuccccac

SEQ ID NO: 92699 - RNA, 22 nt, Human
ggcaggugguaaggauuucaua

SEQ ID NO: 92700 - RNA, 22 nt, Human
ggcaggugugagcuguaaagga

SEQ ID NO: 92701 - RNA, 22 nt, Human
ggcagguguggaguguuauuuu

SEQ ID NO: 92702 - RNA, 22 nt, Human
ggcagguguuuuuauauuaaag

SEQ ID NO: 92703 - RNA, 21 nt, Human
ggcaguaagauuuacuuuaag

SEQ ID NO: 92704 - RNA, 21 nt, Human
ggcaguaagccaaauccauuu

SEQ ID NO: 92705 - RNA, 22 nt, Human
ggcagucccaggcugcauguug

SEQ ID NO: 92706 - RNA, 22 nt, Human
ggcagucuuucccuugagcucu

SEQ ID NO: 92707 - RNA, 22 nt, Human
ggcagugaaugaaacagaggcu

SEQ ID NO: 92708 - RNA, 22 nt, Human
ggcagugagcuggagggaagga

SEQ ID NO: 92709 - RNA, 22 nt, Human
gacaggugagaugaggaacacc

SEQ ID NO: 92710 - RNA, 20 nt, Human
gacaggugcuaaagaggggc

SEQ ID NO: 92711 - RNA, 22 nt, Human
gacaguaacugagagauguaau

SEQ ID NO: 92712 - RNA, 22 nt, Human
gacaguauuuaacuaguucauu

SEQ ID NO: 92713 - RNA, 22 nt, Human
gacagucugggcacacaugaaa

SEQ ID NO: 92714 - RNA, 19 nt, Human
gacagugcaguuguaguac

SEQ ID NO: 92715 - RNA, 22 nt, Human
gacagugcauuuccuggcaugg

SEQ ID NO: 92716 - RNA, 22 nt, Human
gacaguggagccacguugggag

SEQ ID NO: 92717 - RNA, 22 nt, Human
gacagugugaacaucuaauagu

SEQ ID NO: 92718 - RNA, 22 nt, Human
gacaguuacccccaaaagaauu

SEQ ID NO: 92719 - RNA, 22 nt, Human
gacauaauaaucugaccuagau

SEQ ID NO: 92720 - RNA, 22 nt, Human
gacauacagcauggucuaugaa

SEQ ID NO: 92721 - RNA, 22 nt, Human
gacaucaauucagcauuuuaag

SEQ ID NO: 92722 - RNA, 22 nt, Human
gacaucauggagaggauaaaua

SEQ ID NO: 92723 - RNA, 22 nt, Human
gacaucaugucacuaacugcua

SEQ ID NO: 92724 - RNA, 22 nt, Human
gacaucauguucugcuaauagu

SEQ ID NO: 92725 - RNA, 22 nt, Human
gacaucugaauuuagcaguuuu

SEQ ID NO: 92726 - RNA, 22 nt, Human
gacaugaaccuaccauaaugau

SEQ ID NO: 92727 - RNA, 22 nt, Human
gacaugggaugagaugaagcau

SEQ ID NO: 92728 - RNA, 22 nt, Human
gacauguaaauggcaauuaugg

SEQ ID NO: 92729 - RNA, 22 nt, Human
gacaugugucugcaaguugauc

SEQ ID NO: 92730 - RNA, 22 nt, Human
gacauucaacuuugaugauuau

SEQ ID NO: 92731 - RNA, 20 nt, Human
gacauucauaguuauuacca

SEQ ID NO: 92732 - RNA, 22 nt, Human
gacauugacaguccuccuuaua

SEQ ID NO: 92733 - RNA, 22 nt, Human
gacauuuaaggcagucacuuaa

SEQ ID NO: 92734 - RNA, 22 nt, Human
gacauuuagcuguuuugcauuu

SEQ ID NO: 92735 - RNA, 22 nt, Human
gacauuuguaugacacuuuaaa

SEQ ID NO: 92736 - RNA, 22 nt, Human
gacauuuguuccucuaagugac

SEQ ID NO: 92737 - RNA, 22 nt, Human
gaccaaggccaggccagggcgu

SEQ ID NO: 92738 - RNA, 22 nt, Human
gaccaaggcccucagugggagg

SEQ ID NO: 92739 - RNA, 22 nt, Human
gaccacagacuggaaagagggc

SEQ ID NO: 92740 - RNA, 22 nt, Human
gaccacagagcacggccugcuu

SEQ ID NO: 92741 - RNA, 22 nt, Human
gaccaccagagguccgugggua

SEQ ID NO: 92742 - RNA, 22 nt, Human
gaccacugaugacaugaggaga

SEQ ID NO: 92743 - RNA, 22 nt, Human
gaccacuggggugagggccauc

SEQ ID NO: 92744 - RNA, 20 nt, Human
gaccagaucccuuaccagcu

SEQ ID NO: 92745 - RNA, 22 nt, Human
gaccagcucucugaagaaagag

SEQ ID NO: 92746 - RNA, 17 nt, Human
gaccaggagaaaccagg

SEQ ID NO: 92747 - RNA, 22 nt, Human
gaccaggagauuugagcuaggc

SEQ ID NO: 92748 - RNA, 22 nt, Human
gaccaggcccaggugcaaggga

SEQ ID NO: 92749 - RNA, 22 nt, Human
gaccaggcuaguucagagcuuc

SEQ ID NO: 92750 - RNA, 22 nt, Human
gaccagucauuacucaugcccu

SEQ ID NO: 92751 - RNA, 22 nt, Human
gacccagccugguuuuuauagg

SEQ ID NO: 92752 - RNA, 22 nt, Human
gacccaggccuggggcuuaagg

SEQ ID NO: 92753 - RNA, 22 nt, Human
gacccaggggcagggagaaagu

SEQ ID NO: 92754 - RNA, 22 nt, Human
gaccccaaacccuguauucuuc

SEQ ID NO: 92755 - RNA, 22 nt, Human
gaccccaacccuagagucugac

SEQ ID NO: 92756 - RNA, 22 nt, Human
gaccccagaggaaggggcgccg

SEQ ID NO: 92757 - RNA, 22 nt, Human
gaccccaucuggcugccccagg

SEQ ID NO: 92758 - RNA, 22 nt, Human
gacccuccuacuacccuggaaa

SEQ ID NO: 92759 - RNA, 22 nt, Human
gacccugagcaaaagcaguucu

SEQ ID NO: 92760 - RNA, 22 nt, Human
gacccugauaggaguagaagaa

SEQ ID NO: 92761 - RNA, 22 nt, Human
gacccuggaacuuucagcagag

SEQ ID NO: 92762 - RNA, 22 nt, Human
gacccuggagccgucugaggca

SEQ ID NO: 92763 - RNA, 22 nt, Human
gacccuggaguuaguccugugu

SEQ ID NO: 92764 - RNA, 22 nt, Human
gacccuggcagauaccgucaca

SEQ ID NO: 92765 - RNA, 22 nt, Human
gagaggcaggcgcugcaauggu

SEQ ID NO: 92766 - RNA, 22 nt, Human
gagaggcauggaacagauucuu

SEQ ID NO: 92767 - RNA, 22 nt, Human
gagaggccaaaaucccugcccc

SEQ ID NO: 92768 - RNA, 22 nt, Human
gagaggcccuguggucccagcu

SEQ ID NO: 92769 - RNA, 22 nt, Human
gagaggccugggcccgugagcu

SEQ ID NO: 92770 - RNA, 22 nt, Human
gagaggcuaugagguucugugu

SEQ ID NO: 92771 - RNA, 22 nt, Human
gagaggcuccgccacugcucag

SEQ ID NO: 92772 - RNA, 22 nt, Human
gagaggcugcauaugcacacug

SEQ ID NO: 92773 - RNA, 22 nt, Human
gagaggcuggguuggagaucga

SEQ ID NO: 92774 - RNA, 22 nt, Human
gagaggcugugugccauuguug

SEQ ID NO: 92775 - RNA, 22 nt, Human
gagagggauacugaguuuuggu

SEQ ID NO: 92776 - RNA, 22 nt, Human
gagagguaauuugaagugcaaa

SEQ ID NO: 92777 - RNA, 22 nt, Human
gagaggucggggacacugcaaa

SEQ ID NO: 92778 - RNA, 22 nt, Human
gagaggugaaaggauaguuuga

SEQ ID NO: 92779 - RNA, 22 nt, Human
gagaggugaaggcugcccuggg

SEQ ID NO: 92780 - RNA, 22 nt, Human
gagaggugaauguggaugccac

SEQ ID NO: 92781 - RNA, 22 nt, Human
gagagguguguuucagauaaga

SEQ ID NO: 92782 - RNA, 22 nt, Human
gagagucacugucugcauuucc

SEQ ID NO: 92783 - RNA, 22 nt, Human
gagaguggauggagcugcgaag

SEQ ID NO: 92784 - RNA, 22 nt, Human
gagagugucgggggccccagga

SEQ ID NO: 92785 - RNA, 22 nt, Human
gagaguucuugccuggguauua

SEQ ID NO: 92786 - RNA, 22 nt, Human
gagauaaugaugcuaacccagu

SEQ ID NO: 92787 - RNA, 22 nt, Human
gagauccuguaggcagcuaaga

SEQ ID NO: 92788 - RNA, 22 nt, Human
gagaugagugggggaucucuca

SEQ ID NO: 92789 - RNA, 22 nt, Human
gagaugcaagcaagucuauuuu

SEQ ID NO: 92790 - RNA, 15 nt, Human
gagaugcucucaggg

SEQ ID NO: 92791 - RNA, 22 nt, Human
gagaugcugucaggcuaucugu

SEQ ID NO: 92792 - RNA, 22 nt, Human
gagauggcaggugugugggaca

SEQ ID NO: 92793 - RNA, 21 nt, Human
gagauggcccaguagcgggcc

SEQ ID NO: 92794 - RNA, 22 nt, Human
gagaugggcgagaagguggacu

SEQ ID NO: 92795 - RNA, 22 nt, Human
gagauguuaacuacauagcuac

SEQ ID NO: 92796 - RNA, 22 nt, Human
gagauuagaguuguuucauugu

SEQ ID NO: 92797 - RNA, 22 nt, Human
gagauucucagaaguacuagga

SEQ ID NO: 92798 - RNA, 22 nt, Human
gagauuuagagagacuuaaaca

SEQ ID NO: 92799 - RNA, 22 nt, Human
gagauuucaccccucuuaaccu

SEQ ID NO: 92800 - RNA, 22 nt, Human
gagauuuuucaacaagaauagg

SEQ ID NO: 92801 - RNA, 22 nt, Human
gagcaaacaaaacugaugugac

SEQ ID NO: 92802 - RNA, 22 nt, Human
gagcaaauggagcuugucuacu

SEQ ID NO: 92803 - RNA, 22 nt, Human
gagcaacacgcaguaguauacg

SEQ ID NO: 92804 - RNA, 22 nt, Human
gagcaacuucaauaguacuauu

SEQ ID NO: 92805 - RNA, 22 nt, Human
gagcaagacccuggguucucuc

SEQ ID NO: 92806 - RNA, 22 nt, Human
gagcaagguagcucucuggggc

SEQ ID NO: 92807 - RNA, 22 nt, Human
gagcacagauugauuuaaaaua

SEQ ID NO: 92808 - RNA, 22 nt, Human
gagcacagcagggcucugggug

SEQ ID NO: 92809 - RNA, 22 nt, Human
gagcacagcugucuugcaagcu

SEQ ID NO: 92810 - RNA, 22 nt, Human
gagcacaggcugcugugaacug

SEQ ID NO: 92811 - RNA, 22 nt, Human
gagcaccugcuaaaugacaguu

SEQ ID NO: 92812 - RNA, 22 nt, Human
gagcagacgcugcagucuuggg

SEQ ID NO: 92813 - RNA, 22 nt, Human
gagcagagcuucucaaaguaaa

SEQ ID NO: 92814 - RNA, 22 nt, Human
gagcagcacuugaggcauguca

SEQ ID NO: 92815 - RNA, 22 nt, Human
gagcagcagguggggcuggcuu

SEQ ID NO: 92816 - RNA, 16 nt, Human
gagcagccugggccuu

SEQ ID NO: 92817 - RNA, 22 nt, Human
gagcagcucaggcacuuagcca

SEQ ID NO: 92818 - RNA, 22 nt, Human
gacaugcaacaauuuggcauuu

SEQ ID NO: 92819 - RNA, 22 nt, Human
gacaugcuaauuacugguucaa

SEQ ID NO: 92820 - RNA, 22 nt, Human
gacauggauacuugauaagggg

SEQ ID NO: 92821 - RNA, 22 nt, Human
gacauguauuaguacauauggu

SEQ ID NO: 92822 - RNA, 22 nt, Human
gacauucacaguuuccgauggu

SEQ ID NO: 92823 - RNA, 22 nt, Human
gacauucagacucacauggagg

SEQ ID NO: 92824 - RNA, 22 nt, Human
gacauucagguguucaaugcca

SEQ ID NO: 92825 - RNA, 22 nt, Human
gacauugaaguauuuuugucga

SEQ ID NO: 92826 - RNA, 22 nt, Human
gacauuuaauaguauuguggga

SEQ ID NO: 92827 - RNA, 22 nt, Human
gacauuuacugaauacugauua

SEQ ID NO: 92828 - RNA, 22 nt, Human
gacauuuagaagucuaauggcc

SEQ ID NO: 92829 - RNA, 22 nt, Human
gacauuuagaaguuagauucaa

SEQ ID NO: 92830 - RNA, 22 nt, Human
gacauuuaugaaggagauaugc

SEQ ID NO: 92831 - RNA, 22 nt, Human
gacauuuauuggauuuuacgag

SEQ ID NO: 92832 - RNA, 22 nt, Human
gacauuucaaucucauuauggg

SEQ ID NO: 92833 - RNA, 22 nt, Human
gaccaaaugaaaggauggaugg

SEQ ID NO: 92834 - RNA, 22 nt, Human
gaccacagaggugugggagaga

SEQ ID NO: 92835 - RNA, 22 nt, Human
gaccacagauuccuaaguggca

SEQ ID NO: 92836 - RNA, 22 nt, Human
gaccacagcagugcaagaggag

SEQ ID NO: 92837 - RNA, 22 nt, Human
gaccacagcuacaagggcaagg

SEQ ID NO: 92838 - RNA, 21 nt, Human
gaccacagggaaggucuugca

SEQ ID NO: 92839 - RNA, 22 nt, Human
gaccagaaaucaacacagaaug

SEQ ID NO: 92840 - RNA, 22 nt, Human
gaccaggacacaguggcaaggu

SEQ ID NO: 92841 - RNA, 22 nt, Human
gaccaggcuuccccagaccuca

SEQ ID NO: 92842 - RNA, 22 nt, Human
gaccaucuguuuaaagcagugu

SEQ ID NO: 92843 - RNA, 22 nt, Human
gaccauuucaggggcagggacu

SEQ ID NO: 92844 - RNA, 22 nt, Human
gaccauuuccaccaugggcaca

SEQ ID NO: 92845 - RNA, 22 nt, Human
gaccauuucuaggaaucagacu

SEQ ID NO: 92846 - RNA, 22 nt, Human
gaccauuuuuacagagcauuca

SEQ ID NO: 92847 - RNA, 18 nt, Human
gacccagcagaugggcuu

SEQ ID NO: 92848 - RNA, 22 nt, Human
gacccagcuaaccaggugggga

SEQ ID NO: 92849 - RNA, 18 nt, Human
gacccaggaaagaguccu

SEQ ID NO: 92850 - RNA, 22 nt, Human
gacccaggaagcuacuucuggu

SEQ ID NO: 92851 - RNA, 22 nt, Human
gacccaggcccaaggcugccag

SEQ ID NO: 92852 - RNA, 22 nt, Human
gacccaggguggucaccugaaa

SEQ ID NO: 92853 - RNA, 22 nt, Human
gacccaggguuucugcacaggg

SEQ ID NO: 92854 - RNA, 22 nt, Human
gacccagucacacuugugcuuu

SEQ ID NO: 92855 - RNA, 22 nt, Human
gacccagugggggccugaucug

SEQ ID NO: 92856 - RNA, 22 nt, Human
gacccauauaggacccuccaaa

SEQ ID NO: 92857 - RNA, 22 nt, Human
gaccccaggcagaucagggggu

SEQ ID NO: 92858 - RNA, 18 nt, Human
gaccccgggaucugucga

SEQ ID NO: 92859 - RNA, 22 nt, Human
gacccggcuccaggcccagcag

SEQ ID NO: 92860 - RNA, 22 nt, Human
gacccguggcaggcugccugcu

SEQ ID NO: 92861 - RNA, 22 nt, Human
gacccuccugucuucuaaccaa

SEQ ID NO: 92862 - RNA, 22 nt, Human
gacccugacucuaaugcuuggc

SEQ ID NO: 92863 - RNA, 22 nt, Human
gacccuggcagguagccucaca

SEQ ID NO: 92864 - RNA, 22 nt, Human
gacccuggcugccgcggucugg

SEQ ID NO: 92865 - RNA, 22 nt, Human
gacccuggugggcacuggcacc

SEQ ID NO: 92866 - RNA, 22 nt, Human
gacccuuucacagcugcugggg

SEQ ID NO: 92867 - RNA, 22 nt, Human
gacccuuucugcaugcuuaucu

SEQ ID NO: 92868 - RNA, 22 nt, Human
gaccucaucugaacauaugcaa

SEQ ID NO: 92869 - RNA, 22 nt, Human
gaccuccagcggcccugcagag

SEQ ID NO: 92870 - RNA, 22 nt, Human
gaccuccguguacaccucccag

SEQ ID NO: 92871 - RNA, 22 nt, Human
gaccucucaggaaucucacaug

SEQ ID NO: 92872 - RNA, 22 nt, Human
gaccugaaagugugggcgaccu

SEQ ID NO: 92873 - RNA, 22 nt, Human
gaccugcccacucugaggacau

SEQ ID NO: 92874 - RNA, 22 nt, Human
gaccuggaggauccucuucuug

SEQ ID NO: 92875 - RNA, 23 nt, Human
gaccuggcuuugaaucuugacuc

SEQ ID NO: 92876 - RNA, 22 nt, Human
gaccugggguggaaggaaggca

SEQ ID NO: 92877 - RNA, 22 nt, Human
gaccuggugcagguggacagag

SEQ ID NO: 92878 - RNA, 22 nt, Human
gaccuucaguguguuucucaca

SEQ ID NO: 92879 - RNA, 22 nt, Human
gaccuucuugcuguguccuaac

SEQ ID NO: 92880 - RNA, 22 nt, Human
gaccuugguugagcuuccuaau

SEQ ID NO: 92881 - RNA, 22 nt, Human
gacgccucuucccugcugcacu

SEQ ID NO: 92882 - RNA, 22 nt, Human
gacggggcagccagcugguggc

SEQ ID NO: 92883 - RNA, 22 nt, Human
gacgugggucgccaucgauaug

SEQ ID NO: 92884 - RNA, 21 nt, Human
gagaaucaggaaggauugaug

SEQ ID NO: 92885 - RNA, 22 nt, Human
gagaaucucaggcacccagaag

SEQ ID NO: 92886 - RNA, 21 nt, Human
gagaaucuguuuucuugucuu

SEQ ID NO: 92887 - RNA, 22 nt, Human
gagaaugggaaugaaaguagca

SEQ ID NO: 92888 - RNA, 22 nt, Human
gagaauguggagccugugguug

SEQ ID NO: 92889 - RNA, 22 nt, Human
gagaauuugcuggcuucauugu

SEQ ID NO: 92890 - RNA, 22 nt, Human
gagacaauuucuaagaugcuuc

SEQ ID NO: 92891 - RNA, 22 nt, Human
gagacacaagaagacaugcaca

SEQ ID NO: 92892 - RNA, 22 nt, Human
gagacacacacaggagguggca

SEQ ID NO: 92893 - RNA, 22 nt, Human
gagacagaucucggcuccaugc

SEQ ID NO: 92894 - RNA, 20 nt, Human
gagacagcaaaagccucucc

SEQ ID NO: 92895 - RNA, 22 nt, Human
gagacaggccaggugguacuua

SEQ ID NO: 92896 - RNA, 22 nt, Human
gagacaucauaaugaaguuucc

SEQ ID NO: 92897 - RNA, 22 nt, Human
gagacccccugaguuauggccu

SEQ ID NO: 92898 - RNA, 22 nt, Human
gagaccugcagcuguagucugc

SEQ ID NO: 92899 - RNA, 22 nt, Human
gagacugaggucaccaggcugu

SEQ ID NO: 92900 - RNA, 22 nt, Human
gagacuuagagcuccuugaggg

SEQ ID NO: 92901 - RNA, 22 nt, Human
gagagaaaagggggaauugauu

SEQ ID NO: 92902 - RNA, 22 nt, Human
gagagacccagacaccaugcau

SEQ ID NO: 92903 - RNA, 22 nt, Human
gagagaccucagaaacaaucua

SEQ ID NO: 92904 - RNA, 22 nt, Human
gagagacugggcagggccggca

SEQ ID NO: 92905 - RNA, 22 nt, Human
gagagagaggugcugccaggca

SEQ ID NO: 92906 - RNA, 22 nt, Human
gagagauuaccacgcuuccuga

SEQ ID NO: 92907 - RNA, 22 nt, Human
gagagcaauggggacgggcagg

SEQ ID NO: 92908 - RNA, 22 nt, Human
gagagcccuacaaggcguuuug

SEQ ID NO: 92909 - RNA, 22 nt, Human
gagagcccugcauggcugauga

SEQ ID NO: 92910 - RNA, 21 nt, Human
gagagcuaacagugacagcuc

SEQ ID NO: 92911 - RNA, 22 nt, Human
gagagcuaggccacuggggcuu

SEQ ID NO: 92912 - RNA, 22 nt, Human
gagagcuauuuggcaagcauuu

SEQ ID NO: 92913 - RNA, 22 nt, Human
gagagcuccuucaggaagcuuc

SEQ ID NO: 92914 - RNA, 22 nt, Human
gagagcugauagaugagcuacu

SEQ ID NO: 92915 - RNA, 22 nt, Human
gagagcugcagccgagaggggg

SEQ ID NO: 92916 - RNA, 22 nt, Human
gagagcuggccagcuucaguau

SEQ ID NO: 92917 - RNA, 20 nt, Human
gagagcuggggaugaggcug

SEQ ID NO: 92918 - RNA, 22 nt, Human
gagagcugggggacuguggaug

SEQ ID NO: 92919 - RNA, 22 nt, Human
gagaggaaagaaccaaugaccc

SEQ ID NO: 92920 - RNA, 22 nt, Human
gagaggagacuuauccagauug

SEQ ID NO: 92921 - RNA, 22 nt, Human
gagaggccaccugacgagcagu

SEQ ID NO: 92922 - RNA, 22 nt, Human
gagaggccauggcugugcagug

SEQ ID NO: 92923 - RNA, 18 nt, Human
gagaggcccggcugugcc

SEQ ID NO: 92924 - RNA, 22 nt, Human
gagaggccugagaggcugcgga

SEQ ID NO: 92925 - RNA, 22 nt, Human
gagaggcuccaugaccccggca

SEQ ID NO: 92926 - RNA, 22 nt, Human
gagaggcugaaaucacaggagc

SEQ ID NO: 92927 - RNA, 22 nt, Human
gagcccugaacaacagcaggaa

SEQ ID NO: 92928 - RNA, 22 nt, Human
gagcccugagaguugugaggcc

SEQ ID NO: 92929 - RNA, 22 nt, Human
gagcccugcuuccaagggggca

SEQ ID NO: 92930 - RNA, 22 nt, Human
gagcccuguaggaaucucucaa

SEQ ID NO: 92931 - RNA, 22 nt, Human
gagcccuguucaggccuccuca

SEQ ID NO: 92932 - RNA, 22 nt, Human
gagcccuuuuccuagauacugu

SEQ ID NO: 92933 - RNA, 22 nt, Human
gagccuccuccuggugugccga

SEQ ID NO: 92934 - RNA, 22 nt, Human
gagccugaaauacaggucacug

SEQ ID NO: 92935 - RNA, 22 nt, Human
gagccugaugaaacaggcagac

SEQ ID NO: 92936 - RNA, 22 nt, Human
gagccugcaggccucggccuca

SEQ ID NO: 92937 - RNA, 22 nt, Human
gagccugugagccccaacucca

SEQ ID NO: 92938 - RNA, 22 nt, Human
gagccuuucuagauaauccagg

SEQ ID NO: 92939 - RNA, 22 nt, Human
gagcgauguggguauguagaag

SEQ ID NO: 92940 - RNA, 19 nt, Human
gagcgcagagggcagggga

SEQ ID NO: 92941 - RNA, 22 nt, Human
gagcgggaggaacggcucgggc

SEQ ID NO: 92942 - RNA, 22 nt, Human
gagcuaagaacugugccaggug

SEQ ID NO: 92943 - RNA, 22 nt, Human
gagcuaaggucacaagaagcag

SEQ ID NO: 92944 - RNA, 22 nt, Human
gagcuacacugauucauuuguu

SEQ ID NO: 92945 - RNA, 22 nt, Human
gagcuacagaguuugguguuca

SEQ ID NO: 92946 - RNA, 22 nt, Human
gagcuacaggcagcugagcccu

SEQ ID NO: 92947 - RNA, 22 nt, Human
gagcuacugaaauauugauuuu

SEQ ID NO: 92948 - RNA, 22 nt, Human
gagcuagacugggcucugaugu

SEQ ID NO: 92949 - RNA, 22 nt, Human
gagcuagagggagaagggcacu

SEQ ID NO: 92950 - RNA, 22 nt, Human
gagcuaggcuagggggagucgc

SEQ ID NO: 92951 - RNA, 22 nt, Human
gagcuauaauagagcuucagug

SEQ ID NO: 92952 - RNA, 22 nt, Human
gagcucagaggcgucuuugucc

SEQ ID NO: 92953 - RNA, 22 nt, Human
gagcucauucauucauugccug

SEQ ID NO: 92954 - RNA, 22 nt, Human
gagcuccagcaucucugccaaa

SEQ ID NO: 92955 - RNA, 22 nt, Human
gagcuccuauggucgguggcuc

SEQ ID NO: 92956 - RNA, 22 nt, Human
gagcuccucccaggguagcacu

SEQ ID NO: 92957 - RNA, 22 nt, Human
gagcuccugaaacguuccugcc

SEQ ID NO: 92958 - RNA, 22 nt, Human
gagcucuauguggcuggcaugu

SEQ ID NO: 92959 - RNA, 22 nt, Human
gagcucugguucaugaucuauu

SEQ ID NO: 92960 - RNA, 22 nt, Human
gagcucuguacacagagggugu

SEQ ID NO: 92961 - RNA, 22 nt, Human
gagcucuguguagccugagggu

SEQ ID NO: 92962 - RNA, 22 nt, Human
gagcucuuccuuucaggaggcc

SEQ ID NO: 92963 - RNA, 22 nt, Human
gagcucuugcuucuaguccagg

SEQ ID NO: 92964 - RNA, 22 nt, Human
gagcugaaauaugaagccaauu

SEQ ID NO: 92965 - RNA, 22 nt, Human
gagcugaacaucauggaaaggc

SEQ ID NO: 92966 - RNA, 22 nt, Human
gagcugaacgggaauuccccga

SEQ ID NO: 92967 - RNA, 22 nt, Human
gagcugaaguuuccauuuguac

SEQ ID NO: 92968 - RNA, 21 nt, Human
gagcugaauauguucuagggg

SEQ ID NO: 92969 - RNA, 22 nt, Human
gagcugaaucagagauauuauu

SEQ ID NO: 92970 - RNA, 22 nt, Human
gagcugaauuacggugagucau

SEQ ID NO: 92971 - RNA, 22 nt, Human
gagcugaauugcugccauuugc

SEQ ID NO: 92972 - RNA, 18 nt, Human
gagcugagaagaggaugc

SEQ ID NO: 92973 - RNA, 22 nt, Human
gagcugagacacacuuuggcaa

SEQ ID NO: 92974 - RNA, 22 nt, Human
gagcugagaucauguacacuag

SEQ ID NO: 92975 - RNA, 22 nt, Human
gagcugagcuuaacuccuugaa

SEQ ID NO: 92976 - RNA, 22 nt, Human
gagcugaggcucaggcuggcgu

SEQ ID NO: 92977 - RNA, 22 nt, Human
gagcugagggucuaggaggguu

SEQ ID NO: 92978 - RNA, 22 nt, Human
gagcugaggugauguggucguu

SEQ ID NO: 92979 - RNA, 22 nt, Human
gagcugaguaugaaggauguga

SEQ ID NO: 92980 - RNA, 22 nt, Human
gagcugaguguccuaggcaugg

SEQ ID NO: 92981 - RNA, 22 nt, Human
gagcugcacuggggguggaaug

SEQ ID NO: 92982 - RNA, 22 nt, Human
gagcugcagaagggguuuuccu

SEQ ID NO: 92983 - RNA, 22 nt, Human
gagcugcagacauagauaagcg

SEQ ID NO: 92984 - RNA, 22 nt, Human
gagcugcagaguaaccuuugca

SEQ ID NO: 92985 - RNA, 22 nt, Human
gagcugcaugcggaaaccuguu

SEQ ID NO: 92986 - RNA, 22 nt, Human
gagcugccuacauugccaagag

SEQ ID NO: 92987 - RNA, 22 nt, Human
gagcugcuugcccagaagcaga

SEQ ID NO: 92988 - RNA, 22 nt, Human
gagcuggaggaccaggacuggg

SEQ ID NO: 92989 - RNA, 22 nt, Human
gagcuggcaaugacuuguguau

SEQ ID NO: 92990 - RNA, 22 nt, Human
gagcuggcacagaaggaucuua

SEQ ID NO: 92991 - RNA, 22 nt, Human
gagcuggcaggaggcuccccga

SEQ ID NO: 92992 - RNA, 22 nt, Human
gagcugggccucagaacacagu

SEQ ID NO: 92993 - RNA, 22 nt, Human
gagcuggggcagcuuaggagug

SEQ ID NO: 92994 - RNA, 22 nt, Human
gagcuggggcggauacucagcu

SEQ ID NO: 92995 - RNA, 22 nt, Human
gagcuggucaguuucaggagag

SEQ ID NO: 92996 - RNA, 22 nt, Human
gagcuggucaguuucagggcca

SEQ ID NO: 92997 - RNA, 22 nt, Human
gagcuggugugugcccaagcac

SEQ ID NO: 92998 - RNA, 22 nt, Human
gagcuggugugugcccgagcac

SEQ ID NO: 92999 - RNA, 22 nt, Human
gagcuguccuaccaggaguccu

SEQ ID NO: 93000 - RNA, 22 nt, Human
gagcuguggucaacaggaaauu

SEQ ID NO: 93001 - RNA, 22 nt, Human
gagcuguguaugcaucauucug

SEQ ID NO: 93002 - RNA, 21 nt, Human
gagcuguuacucucucuggag

SEQ ID NO: 93003 - RNA, 22 nt, Human
gagcuguucugugauugaucua

SEQ ID NO: 93004 - RNA, 22 nt, Human
gaggcagcaucuauggugggaa

SEQ ID NO: 93005 - RNA, 22 nt, Human
gaggcagcaugguaccuuggag

SEQ ID NO: 93006 - RNA, 22 nt, Human
gaggcagcauucgcauagacag

SEQ ID NO: 93007 - RNA, 22 nt, Human
gaggcagccagagguucucauu

SEQ ID NO: 93008 - RNA, 22 nt, Human
gaggcagccucaguggaccucg

SEQ ID NO: 93009 - RNA, 22 nt, Human
gaggcagcgggucaggaccgug

SEQ ID NO: 93010 - RNA, 22 nt, Human
gaggcagcugggcuggugguuu

SEQ ID NO: 93011 - RNA, 22 nt, Human
gaggcagugcauugucuagggg

SEQ ID NO: 93012 - RNA, 22 nt, Human
gaggcaguguuuacugcccugu

SEQ ID NO: 93013 - RNA, 22 nt, Human
gaggcauaaaucacaguguuca

SEQ ID NO: 93014 - RNA, 22 nt, Human
gaggccaacuuuggagaacagg

SEQ ID NO: 93015 - RNA, 17 nt, Human
gaggccaaggcaggcgg

SEQ ID NO: 93016 - RNA, 22 nt, Human
gaggccaagggagaagaucucu

SEQ ID NO: 93017 - RNA, 22 nt, Human
gaggccaaguuggagaccaggu

SEQ ID NO: 93018 - RNA, 22 nt, Human
gaggccaaucaauagggcaaua

SEQ ID NO: 93019 - RNA, 22 nt, Human
gaggccacagcuaucagggaca

SEQ ID NO: 93020 - RNA, 21 nt, Human
gaggccacuaauaggggcaga

SEQ ID NO: 93021 - RNA, 22 nt, Human
gaggccacuuccuacuggagga

SEQ ID NO: 93022 - RNA, 22 nt, Human
gaggccagaaugagucucuggg

SEQ ID NO: 93023 - RNA, 22 nt, Human
gaggccagggaugcaaugagag

SEQ ID NO: 93024 - RNA, 22 nt, Human
gaggccaggggccuggagauga

SEQ ID NO: 93025 - RNA, 22 nt, Human
gaggccaggguaccaucaacau

SEQ ID NO: 93026 - RNA, 22 nt, Human
gaggccagugaaauguuauaaa

SEQ ID NO: 93027 - RNA, 22 nt, Human
gaggccagugugcuguguuuuc

SEQ ID NO: 93028 - RNA, 22 nt, Human
gaggccaugccuccugaucagu

SEQ ID NO: 93029 - RNA, 22 nt, Human
gaggcccagagagguugcauga

SEQ ID NO: 93030 - RNA, 22 nt, Human
gaggcccaguggagggccaugg

SEQ ID NO: 93031 - RNA, 19 nt, Human
gaggcccaugagggugcuc

SEQ ID NO: 93032 - RNA, 22 nt, Human
gaggcccuccagcugucagcug

SEQ ID NO: 93033 - RNA, 22 nt, Human
gaggcccucuugccacaaugaa

SEQ ID NO: 93034 - RNA, 22 nt, Human
gaggccuauaggcaagugcugc

SEQ ID NO: 93035 - RNA, 22 nt, Human
gaggccucaggcgugggaaggg

SEQ ID NO: 93036 - RNA, 22 nt, Human
gagcuuggugcugccuguuguc

SEQ ID NO: 93037 - RNA, 22 nt, Human
gagcuuuagcugagaccugcuu

SEQ ID NO: 93038 - RNA, 22 nt, Human
gagcuuuaggagaaggagguca

SEQ ID NO: 93039 - RNA, 22 nt, Human
gagcuuugcuggaagccugggg

SEQ ID NO: 93040 - RNA, 22 nt, Human
gagcuuuggggaagaauacaga

SEQ ID NO: 93041 - RNA, 22 nt, Human
gagcuuuguaaaaaacuugcac

SEQ ID NO: 93042 - RNA, 22 nt, Human
gagcuuugugcugguagguggu

SEQ ID NO: 93043 - RNA, 22 nt, Human
gagcuuuguuccgugguggcac

SEQ ID NO: 93044 - RNA, 22 nt, Human
gaggaaaagagacagguuauug

SEQ ID NO: 93045 - RNA, 22 nt, Human
gaggaaaaugcaacaggaaugc

SEQ ID NO: 93046 - RNA, 22 nt, Human
gaggaaaauggaguguaauuaa

SEQ ID NO: 93047 - RNA, 18 nt, Human
gaggaaacaaggcagagg

SEQ ID NO: 93048 - RNA, 22 nt, Human
gaggaaagaaccccagucaaua

SEQ ID NO: 93049 - RNA, 22 nt, Human
gaggaaagagucaaaucugaag

SEQ ID NO: 93050 - RNA, 22 nt, Human
gaggaaagcugguuuaaaguau

SEQ ID NO: 93051 - RNA, 22 nt, Human
gaggaaaucauuccagaaaagg

SEQ ID NO: 93052 - RNA, 22 nt, Human
gaggaaaucuuaggccccaacc

SEQ ID NO: 93053 - RNA, 21 nt, Human
gaggaaaugcucugguguuca

SEQ ID NO: 93054 - RNA, 22 nt, Human
gaggaacaagcugcuuuaucuu

SEQ ID NO: 93055 - RNA, 22 nt, Human
gaggaaccuccugaaaaguaua

SEQ ID NO: 93056 - RNA, 22 nt, Human
gaggaacugaguaccaugauuc

SEQ ID NO: 93057 - RNA, 22 nt, Human
gaggaagaagcaaaccagcuaa

SEQ ID NO: 93058 - RNA, 22 nt, Human
gaggaagaagggauuagaacuc

SEQ ID NO: 93059 - RNA, 22 nt, Human
gaggaagaauugguuauuggag

SEQ ID NO: 93060 - RNA, 22 nt, Human
gaggaagagagcucugccuugu

SEQ ID NO: 93061 - RNA, 22 nt, Human
gaggaagcauugacauaaucuc

SEQ ID NO: 93062 - RNA, 22 nt, Human
gaggaaggaaugcaguguaugc

SEQ ID NO: 93063 - RNA, 22 nt, Human
gaggaaggauuuaguuugaggg

SEQ ID NO: 93064 - RNA, 22 nt, Human
gaggaagggacuuuauuaucug

SEQ ID NO: 93065 - RNA, 22 nt, Human
gaggaagggcugccugccgggc

SEQ ID NO: 93066 - RNA, 22 nt, Human
gaggaagucucucuacaagaaa

SEQ ID NO: 93067 - RNA, 22 nt, Human
gaggaagugcguuaugccuuuu

SEQ ID NO: 93068 - RNA, 22 nt, Human
gaggaaugucagcacaggccuc

SEQ ID NO: 93069 - RNA, 22 nt, Human
gaggaauguuauuaaaggagcu

SEQ ID NO: 93070 - RNA, 22 nt, Human
gaggacacaugacuccagcagg

SEQ ID NO: 93071 - RNA, 22 nt, Human
gaggacagagccgccuggcaag

SEQ ID NO: 93072 - RNA, 22 nt, Human
gaggacagcuuagggcuuccug

SEQ ID NO: 93073 - RNA, 22 nt, Human
gaggacagugugaucugccagc

SEQ ID NO: 93074 - RNA, 22 nt, Human
gaggacuaacuuggcagacgca

SEQ ID NO: 93075 - RNA, 22 nt, Human
gaggacugcagaugggugcauc

SEQ ID NO: 93076 - RNA, 22 nt, Human
gaggagaaauuauccuuggugu

SEQ ID NO: 93077 - RNA, 22 nt, Human
gaggagaagcuaagaaacacag

SEQ ID NO: 93078 - RNA, 22 nt, Human
gaggagaagcuauuggaaggac

SEQ ID NO: 93079 - RNA, 22 nt, Human
gaggagacauauuuuugaagca

SEQ ID NO: 93080 - RNA, 22 nt, Human
gaggagagaagcuaacggugcu

SEQ ID NO: 93081 - RNA, 22 nt, Human
gaggagagaugguagauugggu

SEQ ID NO: 93082 - RNA, 22 nt, Human
gaggagcaagaaauagugccca

SEQ ID NO: 93083 - RNA, 22 nt, Human
gaggagcacaugaggcugaggg

SEQ ID NO: 93084 - RNA, 22 nt, Human
gaggagccaggaggucucccug

SEQ ID NO: 93085 - RNA, 22 nt, Human
gaggagccuggccccacaucca

SEQ ID NO: 93086 - RNA, 22 nt, Human
gaggagcucaugaaagcggugu

SEQ ID NO: 93087 - RNA, 22 nt, Human
gaggagcugcagggggagucua

SEQ ID NO: 93088 - RNA, 22 nt, Human
gaggagcugggcugagaggguc

SEQ ID NO: 93089 - RNA, 22 nt, Human
gaggagcuucagaggaaucuua

SEQ ID NO: 93090 - RNA, 22 nt, Human
gaggaggaaacccuguuccucu

SEQ ID NO: 93091 - RNA, 22 nt, Human
gaggaggaguauauauuagaau

SEQ ID NO: 93092 - RNA, 22 nt, Human
gaggaggcacuugagcagaugu

SEQ ID NO: 93093 - RNA, 22 nt, Human
gaggaggcagccuaucccuuag

SEQ ID NO: 93094 - RNA, 22 nt, Human
gaggaggcuggcgccgccugcc

SEQ ID NO: 93095 - RNA, 22 nt, Human
gaggaggcuuccgggaggcacg

SEQ ID NO: 93096 - RNA, 22 nt, Human
gaggagggagcuggaagcucuu

SEQ ID NO: 93097 - RNA, 22 nt, Human
gaggaggguuggccuuagguag

SEQ ID NO: 93098 - RNA, 22 nt, Human
gaggagguggaauuccaggaau

SEQ ID NO: 93099 - RNA, 22 nt, Human
gaggagguuccggguggagaag

SEQ ID NO: 93100 - RNA, 22 nt, Human
gaggagucuaguuuauggcuuc

SEQ ID NO: 93101 - RNA, 22 nt, Human
gaggauggauccgaccccuucc

SEQ ID NO: 93102 - RNA, 22 nt, Human
gaggcaagagaagccagcuuuc

SEQ ID NO: 93103 - RNA, 22 nt, Human
gaggcacaccagggagucuugu

SEQ ID NO: 93104 - RNA, 22 nt, Human
gaggcacaugacucaccaaugg

SEQ ID NO: 93105 - RNA, 22 nt, Human
gaggcaccagacauggccucau

SEQ ID NO: 93106 - RNA, 22 nt, Human
gaggcacugcugggccccugua

SEQ ID NO: 93107 - RNA, 22 nt, Human
gaggcagagaccuucaggaccu

SEQ ID NO: 93108 - RNA, 22 nt, Human
gaggcagagacuccaccuucag

SEQ ID NO: 93109 - RNA, 22 nt, Human
gaggcagcaaaauauaucauaa

SEQ ID NO: 93110 - RNA, 22 nt, Human
gaggcagcagaacauggaagag

SEQ ID NO: 93111 - RNA, 23 nt, Human
gaggcagcuccugcagugcccug

SEQ ID NO: 93112 - RNA, 22 nt, Human
gaggcagcugggauacaaggga

SEQ ID NO: 93113 - RNA, 22 nt, Human
gaggcagcuuaggguacugacu

SEQ ID NO: 93114 - RNA, 22 nt, Human
gaggcaggcacuguuaucagca

SEQ ID NO: 93115 - RNA, 22 nt, Human
gaggcaggcccugaaugaguca

SEQ ID NO: 93116 - RNA, 22 nt, Human
gaggcaggguguugauuacaga

SEQ ID NO: 93117 - RNA, 22 nt, Human
gaggcaguaauugugggcaaua

SEQ ID NO: 93118 - RNA, 19 nt, Human
gaggcaguagucaaagcuu

SEQ ID NO: 93119 - RNA, 22 nt, Human
gaggcaguggucugaugcaagg

SEQ ID NO: 93120 - RNA, 22 nt, Human
gaggcagugucgguggcaggau

SEQ ID NO: 93121 - RNA, 22 nt, Human
gaggcaguuccugagugacaag

SEQ ID NO: 93122 - RNA, 22 nt, Human
gaggcaguuugccaugccagga

SEQ ID NO: 93123 - RNA, 22 nt, Human
gaggcauaaguagaagagauug

SEQ ID NO: 93124 - RNA, 22 nt, Human
gaggcauggccugaggcuagga

SEQ ID NO: 93125 - RNA, 22 nt, Human
gaggccacagugucugggggcc

SEQ ID NO: 93126 - RNA, 22 nt, Human
gaggccacauuacuuggugggu

SEQ ID NO: 93127 - RNA, 22 nt, Human
gaggccacccuaugggucccag

SEQ ID NO: 93128 - RNA, 22 nt, Human
gaggccacgugcuuauguuucu

SEQ ID NO: 93129 - RNA, 22 nt, Human
gaggccagaguuccccgaguca

SEQ ID NO: 93130 - RNA, 22 nt, Human
gaggccagcgcgcagcacuuuu

SEQ ID NO: 93131 - RNA, 22 nt, Human
gaggccagcuacccaaggguca

SEQ ID NO: 93132 - RNA, 22 nt, Human
gaggccagcuaguccaggaagu

SEQ ID NO: 93133 - RNA, 22 nt, Human
gaggccaggggagucagcgucc

SEQ ID NO: 93134 - RNA, 22 nt, Human
gaggccauaagaaguucuuggg

SEQ ID NO: 93135 - RNA, 22 nt, Human
gaggcccacagggaguaccaag

SEQ ID NO: 93136 - RNA, 20 nt, Human
gaggcccagagaggugaagc

SEQ ID NO: 93137 - RNA, 22 nt, Human
gaggcccagcauucagggcagg

SEQ ID NO: 93138 - RNA, 22 nt, Human
gaggcccugaagacagcugggg

SEQ ID NO: 93139 - RNA, 22 nt, Human
gaggcccugguaggucagagug

SEQ ID NO: 93140 - RNA, 21 nt, Human
gaggccucagccucagcuccu

SEQ ID NO: 93141 - RNA, 22 nt, Human
gaggccucugucccaccaggga

SEQ ID NO: 93142 - RNA, 22 nt, Human
gaggccuggaauuccagccugg

SEQ ID NO: 93143 - RNA, 22 nt, Human
gauacacaaaagucuagugagg

SEQ ID NO: 93144 - RNA, 22 nt, Human
gauacacagggcuaagauggau

SEQ ID NO: 93145 - RNA, 22 nt, Human
gcaaacugauuuccaaguccgu

SEQ ID NO: 93146 - RNA, 22 nt, Human
gcaaacugcauucuauagcuug

SEQ ID NO: 93147 - RNA, 22 nt, Human
gcacagccagcaucugagggau

SEQ ID NO: 93148 - RNA, 22 nt, Human
gcacagcccugagcgcaugucu

SEQ ID NO: 93149 - RNA, 22 nt, Human
gcacagcucagcaugggaggac

SEQ ID NO: 93150 - RNA, 22 nt, Human
gcacagcucaguacucccucug

SEQ ID NO: 93151 - RNA, 22 nt, Human
gcacagcuccgcuuccucacac

SEQ ID NO: 93152 - RNA, 22 nt, Human
gcacaggaugauggguugaggg

SEQ ID NO: 93153 - RNA, 22 nt, Human
gcacaggccaugggaggacagc

SEQ ID NO: 93154 - RNA, 22 nt, Human
gcacagggagcaggucucuggu

SEQ ID NO: 93155 - RNA, 22 nt, Human
gcacagggcugccaggcggcuu

SEQ ID NO: 93156 - RNA, 17 nt, Human
gcacagugauauuauuu

SEQ ID NO: 93157 - RNA, 22 nt, Human
gcacagugcaccacuuugaaaa

SEQ ID NO: 93158 - RNA, 22 nt, Human
gcacaguggugaaagcaugggu

SEQ ID NO: 93159 - RNA, 22 nt, Human
gcacaguuaaagggucauguga

SEQ ID NO: 93160 - RNA, 22 nt, Human
gcacauacauauuagugucaca

SEQ ID NO: 93161 - RNA, 22 nt, Human
gcacaucuggagcucuguggaa

SEQ ID NO: 93162 - RNA, 22 nt, Human
gcacaugacuuugaggaaacca

SEQ ID NO: 93163 - RNA, 22 nt, Human
gcacaugguaggcauuugaugu

SEQ ID NO: 93164 - RNA, 18 nt, Human
gcacauguaagaguaaag

SEQ ID NO: 93165 - RNA, 17 nt, Human
gcacauguguucuuuua

SEQ ID NO: 93166 - RNA, 22 nt, Human
gcacauuuaacugagcucagga

SEQ ID NO: 93167 - RNA, 22 nt, Human
gcacauuugagacauccaggca

SEQ ID NO: 93168 - RNA, 22 nt, Human
gcaccaggaagcuguuauagca

SEQ ID NO: 93169 - RNA, 22 nt, Human
gcaccaggaggcccuucucauc

SEQ ID NO: 93170 - RNA, 22 nt, Human
gcaccaggcagcugagcaggcc

SEQ ID NO: 93171 - RNA, 22 nt, Human
gcaccaggcuuagagccccagg

SEQ ID NO: 93172 - RNA, 22 nt, Human
gcaccagggagggugugcuuca

SEQ ID NO: 93173 - RNA, 22 nt, Human
gcaccaggugcagccgggcccc

SEQ ID NO: 93174 - RNA, 22 nt, Human
gcaccaugauggagccucauua

SEQ ID NO: 93175 - RNA, 22 nt, Human
gcacccagagggcagggucucc

SEQ ID NO: 93176 - RNA, 22 nt, Human
gcacccagauagcaaggauuag

SEQ ID NO: 93177 - RNA, 22 nt, Human
gcacccaggcacuuuccuuucu

SEQ ID NO: 93178 - RNA, 22 nt, Human
gcacccaggccggcgacugcag

SEQ ID NO: 93179 - RNA, 22 nt, Human
gcacccaggcuugggcagcaac

SEQ ID NO: 93180 - RNA, 22 nt, Human
gcacccagggacuuggcuggcc

SEQ ID NO: 93181 - RNA, 22 nt, Human
gcacccagggcaggaagugagg

SEQ ID NO: 93182 - RNA, 22 nt, Human
gcacccaguuugucucaggguu

SEQ ID NO: 93183 - RNA, 22 nt, Human
gcacccaugcucuugucucagg

SEQ ID NO: 93184 - RNA, 22 nt, Human
gcacccauugugugcagcucug

SEQ ID NO: 93185 - RNA, 22 nt, Human
gcacccuagaguugccugagga

SEQ ID NO: 93186 - RNA, 22 nt, Human
gcacccucugagcuccgcuccg

SEQ ID NO: 93187 - RNA, 22 nt, Human
gcaccugccugggacugaagau

SEQ ID NO: 93188 - RNA, 22 nt, Human
gcaccugcuggggcugaugaga

SEQ ID NO: 93189 - RNA, 22 nt, Human
gcaccugcuggguguagaggcu

SEQ ID NO: 93190 - RNA, 22 nt, Human
gcaccuggcugcccagguggag

SEQ ID NO: 93191 - RNA, 22 nt, Human
gcaccugggguacacagcuaca

SEQ ID NO: 93192 - RNA, 22 nt, Human
gcaccuugggaagcgccaguug

SEQ ID NO: 93193 - RNA, 22 nt, Human
gcaccuuucuauauucaguggc

SEQ ID NO: 93194 - RNA, 22 nt, Human
gcacggcaagacggggccuccu

SEQ ID NO: 93195 - RNA, 22 nt, Human
gcacgugcacacauguguacaa

SEQ ID NO: 93196 - RNA, 22 nt, Human
gcacuaaaccaacauguaauaa

SEQ ID NO: 93197 - RNA, 22 nt, Human
gcacuagaaguacgccuuguaa

SEQ ID NO: 93198 - RNA, 22 nt, Human
gcacuaguguucuucaguaaua

SEQ ID NO: 93199 - RNA, 17 nt, Human
gcacucccccaccuccu

SEQ ID NO: 93200 - RNA, 22 nt, Human
gcacucuccuggcugccacagu

SEQ ID NO: 93201 - RNA, 22 nt, Human
gcacucugccaggucuccugau

SEQ ID NO: 93202 - RNA, 20 nt, Human
gcacugaaauucaauguuug

SEQ ID NO: 93203 - RNA, 17 nt, Human
gcacugaacaauccugu

SEQ ID NO: 93204 - RNA, 22 nt, Human
gcacugagcaccagccacagau

SEQ ID NO: 93205 - RNA, 22 nt, Human
gcacugagucugucaugcugca

SEQ ID NO: 93206 - RNA, 22 nt, Human
gcacugaugcaaaaaucacuca

SEQ ID NO: 93207 - RNA, 22 nt, Human
gcacugcagccucagauggugg

SEQ ID NO: 93208 - RNA, 22 nt, Human
gcacugccacauaaucucagca

SEQ ID NO: 93209 - RNA, 22 nt, Human
gcacugccuguguucaggguaa

SEQ ID NO: 93210 - RNA, 22 nt, Human
gcacuggaggguguaguugcug

SEQ ID NO: 93211 - RNA, 22 nt, Human
gcacuggauuuugaucugcaag

SEQ ID NO: 93212 - RNA, 22 nt, Human
gcacugggaaugagggcagcuu

SEQ ID NO: 93213 - RNA, 22 nt, Human
gcacugggaaugugagcagcug

SEQ ID NO: 93214 - RNA, 22 nt, Human
gcacugggagucuguggggguu

SEQ ID NO: 93215 - RNA, 22 nt, Human
gcacugggugugaggcagcguc

SEQ ID NO: 93216 - RNA, 22 nt, Human
gcacugguaucaccugagagcu

SEQ ID NO: 93217 - RNA, 22 nt, Human
gcacuggugugaaacaguagau

SEQ ID NO: 93218 - RNA, 22 nt, Human
gcacuguagugggggagaaaug

SEQ ID NO: 93219 - RNA, 22 nt, Human
gcacugugcuagguaucaggga

SEQ ID NO: 93220 - RNA, 20 nt, Human
gcacuguuacaaagcacacc

SEQ ID NO: 93221 - RNA, 22 nt, Human
gcacuguucucagagcauuaga

SEQ ID NO: 93222 - RNA, 22 nt, Human
gcacuuaggguauguacugggc

SEQ ID NO: 93223 - RNA, 22 nt, Human
gcacuucaccacuguccugguu

SEQ ID NO: 93224 - RNA, 22 nt, Human
gcacuucuauuuuuuucagugg

SEQ ID NO: 93225 - RNA, 22 nt, Human
gcacuucucgggggcgcugucu

SEQ ID NO: 93226 - RNA, 22 nt, Human
gcacuugaggacgacucagcug

SEQ ID NO: 93227 - RNA, 22 nt, Human
gcacuuggauauacaaaugaag

SEQ ID NO: 93228 - RNA, 22 nt, Human
gcacuuguuuuauguuccugag

SEQ ID NO: 93229 - RNA, 22 nt, Human
gcacuuuaaauguucacggaaa

SEQ ID NO: 93230 - RNA, 22 nt, Human
gcagaaauaugaugcauaaagg

SEQ ID NO: 93231 - RNA, 23 nt, Human
gcagaaauucucacacugaggcc

SEQ ID NO: 93232 - RNA, 22 nt, Human
gcagaacauggaaagagaacua

SEQ ID NO: 93233 - RNA, 22 nt, Human
gcagaaccauaaauucagguaa

SEQ ID NO: 93234 - RNA, 22 nt, Human
gcagaagcagaggagccuauga

SEQ ID NO: 93235 - RNA, 22 nt, Human
gcagaagggaauaaggagcuuu

SEQ ID NO: 93236 - RNA, 22 nt, Human
gcagaaggucuggcacuucagg

SEQ ID NO: 93237 - RNA, 21 nt, Human
gcagaaguggcuacaucucca

SEQ ID NO: 93238 - RNA, 22 nt, Human
gcagaaguuaaucgaaggccau

SEQ ID NO: 93239 - RNA, 22 nt, Human
gcagaauaauagaaaggcacac

SEQ ID NO: 93240 - RNA, 22 nt, Human
gcagaauguaggccuucagugu

SEQ ID NO: 93241 - RNA, 22 nt, Human
gcagaauucuacagaugauaaa

SEQ ID NO: 93242 - RNA, 22 nt, Human
gcagacacagggaaggcaagga

SEQ ID NO: 93243 - RNA, 22 nt, Human
gcagacacuugaggugggcuuu

SEQ ID NO: 93244 - RNA, 22 nt, Human
gcagacacuuuuauucugcaua

SEQ ID NO: 93245 - RNA, 22 nt, Human
gcagacagacugcagugauuuu

SEQ ID NO: 93246 - RNA, 23 nt, Human
gcagacagagcagacuaagacaa

SEQ ID NO: 93247 - RNA, 22 nt, Human
gcagacaggcccaguggaggga

SEQ ID NO: 93248 - RNA, 22 nt, Human
gcagacaggggcuuaggaaagg

SEQ ID NO: 93249 - RNA, 19 nt, Human
gcagacagguccagagagg

SEQ ID NO: 93250 - RNA, 22 nt, Human
gcagacaucaagcacaggccca

SEQ ID NO: 93251 - RNA, 22 nt, Human
gcagacaugaccaccaaccagg

SEQ ID NO: 93252 - RNA, 22 nt, Human
gcagaccagccccuggagcugc

SEQ ID NO: 93253 - RNA, 22 nt, Human
gcagaccucaggacaucauuag

SEQ ID NO: 93254 - RNA, 22 nt, Human
gcacaguauuuaguagaaugag

SEQ ID NO: 93255 - RNA, 22 nt, Human
gcacagugaugucagaauugga

SEQ ID NO: 93256 - RNA, 22 nt, Human
gcacaguugauuuaugcuggug

SEQ ID NO: 93257 - RNA, 22 nt, Human
gcacaguugugacaaccaucgc

SEQ ID NO: 93258 - RNA, 20 nt, Human
gcacaguuugggaaccaugg

SEQ ID NO: 93259 - RNA, 22 nt, Human
gcacauacccacugucaagcac

SEQ ID NO: 93260 - RNA, 22 nt, Human
gcacauacugcaaagauuacua

SEQ ID NO: 93261 - RNA, 22 nt, Human
gcacauccaaugauuguuuuga

SEQ ID NO: 93262 - RNA, 22 nt, Human
gcacaugagaagcuggcgaugc

SEQ ID NO: 93263 - RNA, 22 nt, Human
gcacaugaguuaagcuggggca

SEQ ID NO: 93264 - RNA, 22 nt, Human
gcacaugucuuauucacuguua

SEQ ID NO: 93265 - RNA, 22 nt, Human
gggggagaagauucugcugcuu

SEQ ID NO: 93266 - RNA, 22 nt, Human
gggggagcuacaggucccuugg

SEQ ID NO: 93267 - RNA, 22 nt, Human
gggggaggugaaugcaauaagg

SEQ ID NO: 93268 - RNA, 22 nt, Human
gggggcaggucuggaacuuuga

SEQ ID NO: 93269 - RNA, 22 nt, Human
gggggcaguaaccucaaagugu

SEQ ID NO: 93270 - RNA, 22 nt, Human
gggggcaguaaggauauggaaa

SEQ ID NO: 93271 - RNA, 20 nt, Human
gggggccagcagcagacgcc

SEQ ID NO: 93272 - RNA, 22 nt, Human
gggggccagucaucucccaaga

SEQ ID NO: 93273 - RNA, 23 nt, Human
gggggccguccuggggauuauag

SEQ ID NO: 93274 - RNA, 20 nt, Human
ggggggcuucagggccugug

SEQ ID NO: 93275 - RNA, 22 nt, Human
gggggugaggacaggagcacug

SEQ ID NO: 93276 - RNA, 22 nt, Human
gggguaggcaggugaucugauc

SEQ ID NO: 93277 - RNA, 22 nt, Human
gggguagggugauugugaagua

SEQ ID NO: 93278 - RNA, 21 nt, Human
gggguauaccuaugagauagu

SEQ ID NO: 93279 - RNA, 22 nt, Human
ggggucaagcucagaauccuag

SEQ ID NO: 93280 - RNA, 22 nt, Human
ggggugaguuagcgucggcuug

SEQ ID NO: 93281 - RNA, 22 nt, Human
ggggugcuagaguggggccacu

SEQ ID NO: 93282 - RNA, 22 nt, Human
gggguggccaaggacucugacc

SEQ ID NO: 93283 - RNA, 22 nt, Human
ggggugggagugccauccuuga

SEQ ID NO: 93284 - RNA, 22 nt, Human
ggggugugaguagagcugggga

SEQ ID NO: 93285 - RNA, 22 nt, Human
ggggugugucugacaaugguau

SEQ ID NO: 93286 - RNA, 22 nt, Human
gggguuaacaguauugcucaug

SEQ ID NO: 93287 - RNA, 22 nt, Human
gggguugaucacagaggggucu

SEQ ID NO: 93288 - RNA, 22 nt, Human
ggguaaugaacagguggcagag

SEQ ID NO: 93289 - RNA, 22 nt, Human
ggguacagagagaugagguaac

SEQ ID NO: 93290 - RNA, 20 nt, Human
ggguacagauaugcagugaa

SEQ ID NO: 93291 - RNA, 22 nt, Human
ggguacaguucuuccaguguca

SEQ ID NO: 93292 - RNA, 22 nt, Human
ggguauuaaaaugaaggagaaa

SEQ ID NO: 93293 - RNA, 22 nt, Human
gggucagagcaagacugggguc

SEQ ID NO: 93294 - RNA, 22 nt, Human
gggucagaguaagcaaggacaa

SEQ ID NO: 93295 - RNA, 22 nt, Human
gggucagcugcugggggcugac

SEQ ID NO: 93296 - RNA, 22 nt, Human
gggucaggaagaauucugccaa

SEQ ID NO: 93297 - RNA, 22 nt, Human
gggucagggcuggcugucguca

SEQ ID NO: 93298 - RNA, 22 nt, Human
ggguccaccugagcagcagccu

SEQ ID NO: 93299 - RNA, 22 nt, Human
ggguccagaguuuucccgcccu

SEQ ID NO: 93300 - RNA, 23 nt, Human
ggguccagccaauuccaaggaaa

SEQ ID NO: 93301 - RNA, 22 nt, Human
ggguccaggucuucaggcagag

SEQ ID NO: 93302 - RNA, 22 nt, Human
ggguccagguuuagucauuugu

SEQ ID NO: 93303 - RNA, 22 nt, Human
ggguccaguaguugguggccgu

SEQ ID NO: 93304 - RNA, 19 nt, Human
ggguccauggugucaagga

SEQ ID NO: 93305 - RNA, 19 nt, Human
gggucccacugcccgucug

SEQ ID NO: 93306 - RNA, 22 nt, Human
gggucccagcauaggggaagca

SEQ ID NO: 93307 - RNA, 22 nt, Human
gggucccaggucuggaaaagca

SEQ ID NO: 93308 - RNA, 18 nt, Human
ggguccccagcugcaggg

SEQ ID NO: 93309 - RNA, 22 nt, Human
gggucccuggaauuacuugaca

SEQ ID NO: 93310 - RNA, 20 nt, Human
ggguccugacuuggucuccu

SEQ ID NO: 93311 - RNA, 22 nt, Human
ggguccugcgugggcccaggac

SEQ ID NO: 93312 - RNA, 18 nt, Human
ggguccugugggagacag

SEQ ID NO: 93313 - RNA, 22 nt, Human
gggucucucagaaggcugcaau

SEQ ID NO: 93314 - RNA, 22 nt, Human
gggucucucaugcaguugcugu

SEQ ID NO: 93315 - RNA, 22 nt, Human
gggucugaccugggcacaccau

SEQ ID NO: 93316 - RNA, 22 nt, Human
gggucuggagauccgggugaag

SEQ ID NO: 93317 - RNA, 22 nt, Human
gggucugggcaggcgcuuccuc

SEQ ID NO: 93318 - RNA, 22 nt, Human
gggucuucugauauagguccag

SEQ ID NO: 93319 - RNA, 22 nt, Human
gggugacauagugauggggcau

SEQ ID NO: 93320 - RNA, 22 nt, Human
gggugagacagaaagagcaaaa

SEQ ID NO: 93321 - RNA, 19 nt, Human
gggugaggaagagcguugc

SEQ ID NO: 93322 - RNA, 22 nt, Human
gggugaggagcugccagucaug

SEQ ID NO: 93323 - RNA, 22 nt, Human
gggugcagcagagcuccucugu

SEQ ID NO: 93324 - RNA, 22 nt, Human
gggugcagugguucacgccugu

SEQ ID NO: 93325 - RNA, 22 nt, Human
gggugcccuggguaggucaguu

SEQ ID NO: 93326 - RNA, 23 nt, Human
gggugcugccuguagucaugcug

SEQ ID NO: 93327 - RNA, 21 nt, Human
gggugcuguggucaugcagga

SEQ ID NO: 93328 - RNA, 22 nt, Human
ggguggaagccagagaggucau

SEQ ID NO: 93329 - RNA, 22 nt, Human
ggguggagguggguuuugagau

SEQ ID NO: 93330 - RNA, 22 nt, Human
ggguggagugugaaaucuggcu

SEQ ID NO: 93331 - RNA, 22 nt, Human
ggguggcacugauaaugagacg

SEQ ID NO: 93332 - RNA, 22 nt, Human
ggguggcaucucucugagcugu

SEQ ID NO: 93333 - RNA, 22 nt, Human
ggguggccuucauagcucaggg

SEQ ID NO: 93334 - RNA, 22 nt, Human
ggguggcugacuguuuugugga

SEQ ID NO: 93335 - RNA, 22 nt, Human
ggguggcugagaacaggacccc

SEQ ID NO: 93336 - RNA, 21 nt, Human
gggugggaggacacagcaggc

SEQ ID NO: 93337 - RNA, 22 nt, Human
gggugggaugccgcugucucca

SEQ ID NO: 93338 - RNA, 22 nt, Human
gggugggauggcaggagccgcu

SEQ ID NO: 93339 - RNA, 22 nt, Human
gggugggccacugagcagcgug

SEQ ID NO: 93340 - RNA, 22 nt, Human
gggugggcccagcccagagaag

SEQ ID NO: 93341 - RNA, 22 nt, Human
gggugggccccagguaucugua

SEQ ID NO: 93342 - RNA, 22 nt, Human
ggguggggcccaggaaaucuau

SEQ ID NO: 93343 - RNA, 22 nt, Human
gggugggugguccgcagacaua

SEQ ID NO: 93344 - RNA, 21 nt, Human
ggguggucugcugaagaggga

SEQ ID NO: 93345 - RNA, 22 nt, Human
ggguggucuggcaggcuggaaa

SEQ ID NO: 93346 - RNA, 22 nt, Human
ggguguccuucuguggacucug

SEQ ID NO: 93347 - RNA, 21 nt, Human
ggguguggaaauuacauccug

SEQ ID NO: 93348 - RNA, 22 nt, Human
ggguguugauuuuacacuaaaa

SEQ ID NO: 93349 - RNA, 22 nt, Human
ggguuaaacaugcuauaugagu

SEQ ID NO: 93350 - RNA, 22 nt, Human
ggguuaaagagcccaauguaug

SEQ ID NO: 93351 - RNA, 22 nt, Human
ggguuaaagcaggaagcaucuu

SEQ ID NO: 93352 - RNA, 22 nt, Human
ggguuccuccaguuccuagagc

SEQ ID NO: 93353 - RNA, 19 nt, Human
ggguuguguggaagguauc

SEQ ID NO: 93354 - RNA, 22 nt, Human
ggguuucaugguucucacaaug

SEQ ID NO: 93355 - RNA, 19 nt, Human
gguaaaagugagcuucagg

SEQ ID NO: 93356 - RNA, 22 nt, Human
gguaaauuuuaugugaugaaac

SEQ ID NO: 93357 - RNA, 22 nt, Human
gguaacaaacuucugacuuaag

SEQ ID NO: 93358 - RNA, 22 nt, Human
gguaacaacccuacaaauccac

SEQ ID NO: 93359 - RNA, 22 nt, Human
gguaacugcaccuuuggccuga

SEQ ID NO: 93360 - RNA, 22 nt, Human
gguaacuuacagggccccuuua

SEQ ID NO: 93361 - RNA, 22 nt, Human
gguaacuugaguguguuguuca

SEQ ID NO: 93362 - RNA, 22 nt, Human
gguacaaaguuagauuuaacuu

SEQ ID NO: 93363 - RNA, 20 nt, Human
guauccccgcguggggaagg

SEQ ID NO: 93364 - RNA, 22 nt, Human
guauccuuugcggaaauuucua

SEQ ID NO: 93365 - RNA, 22 nt, Human
guaucuugacuccaugccucag

SEQ ID NO: 93366 - RNA, 22 nt, Human
guaucuuuaucccucguuggag

SEQ ID NO: 93367 - RNA, 22 nt, Human
guaucuuuugguggaaaaauaa

SEQ ID NO: 93368 - RNA, 22 nt, Human
guaugaaaauuguaaaguucuu

SEQ ID NO: 93369 - RNA, 22 nt, Human
guaugcaugcauguguauguac

SEQ ID NO: 93370 - RNA, 22 nt, Human
guaugcauuuggcauauugucc

SEQ ID NO: 93371 - RNA, 22 nt, Human
guaugcuuauuccuuguuguga

SEQ ID NO: 93372 - RNA, 22 nt, Human
guauggaucaccugaggucagc

SEQ ID NO: 93373 - RNA, 22 nt, Human
guaugguuuauagggaaauugu

SEQ ID NO: 93374 - RNA, 22 nt, Human
guauguauauauguguacacac

SEQ ID NO: 93375 - RNA, 22 nt, Human
guaugucaugagccuugugcgu

SEQ ID NO: 93376 - RNA, 22 nt, Human
guauguguaaguaugccaccuu

SEQ ID NO: 93377 - RNA, 22 nt, Human
guauuacauuuaguaauuaggc

SEQ ID NO: 93378 - RNA, 22 nt, Human
guauuagacugagaaauggagu

SEQ ID NO: 93379 - RNA, 22 nt, Human
guauuagcugccuuggagcuaa

SEQ ID NO: 93380 - RNA, 22 nt, Human
guauuagcuguuagcuacauca

SEQ ID NO: 93381 - RNA, 22 nt, Human
guauuaggaaauaugaagaaag

SEQ ID NO: 93382 - RNA, 22 nt, Human
guauuauuggguaguaugguaa

SEQ ID NO: 93383 - RNA, 22 nt, Human
guauuauugucaugaaauaaua

SEQ ID NO: 93384 - RNA, 22 nt, Human
guauucagaaggaugaucuagu

SEQ ID NO: 93385 - RNA, 22 nt, Human
guauucauuuauuuacucaucc

SEQ ID NO: 93386 - RNA, 17 nt, Human
guauucuuugccuucca

SEQ ID NO: 93387 - RNA, 21 nt, Human
guauugcagaguuaugugcuc

SEQ ID NO: 93388 - RNA, 22 nt, Human
guauugcauagaccugggauga

SEQ ID NO: 93389 - RNA, 22 nt, Human
guauugcauuuugaaugcaugg

SEQ ID NO: 93390 - RNA, 22 nt, Human
guauuuaauucugugcuucuag

SEQ ID NO: 93391 - RNA, 19 nt, Human
guauuucaggacaagacgu

SEQ ID NO: 93392 - RNA, 22 nt, Human
guauuucaguuccucuugugac

SEQ ID NO: 93393 - RNA, 22 nt, Human
guauuucccccagacucccugg

SEQ ID NO: 93394 - RNA, 22 nt, Human
guauuucccugaguucugugag

SEQ ID NO: 93395 - RNA, 22 nt, Human
guauuucuagaaugguagcacu

SEQ ID NO: 93396 - RNA, 22 nt, Human
guauuucugguaacugcugcua

SEQ ID NO: 93397 - RNA, 22 nt, Human
guauuucuuuacauaugcucau

SEQ ID NO: 93398 - RNA, 22 nt, Human
guauuugauacaugaaauggug

SEQ ID NO: 93399 - RNA, 22 nt, Human
guauuuguaguagcauagaauu

SEQ ID NO: 93400 - RNA, 22 nt, Human
gcagguguggauuugcauccag

SEQ ID NO: 93401 - RNA, 21 nt, Human
gcaggugugguaucagcuucc

SEQ ID NO: 93402 - RNA, 22 nt, Human
gcagguguucucagaggaggcu

SEQ ID NO: 93403 - RNA, 22 nt, Human
gcagguuauccaacuacaaugu

SEQ ID NO: 93404 - RNA, 22 nt, Human
gcaguaaaaaaggauaugugca

SEQ ID NO: 93405 - RNA, 16 nt, Human
gcaguaaaaugguuag

SEQ ID NO: 93406 - RNA, 22 nt, Human
gcaguaaauugagagucauguu

SEQ ID NO: 93407 - RNA, 22 nt, Human
gcaguaaguuaauagugcuggu

SEQ ID NO: 93408 - RNA, 22 nt, Human
gcaguacuuuaagggaugaagc

SEQ ID NO: 93409 - RNA, 22 nt, Human
gcaguacuuuaucacauggaau

SEQ ID NO: 93410 - RNA, 22 nt, Human
gcaguagcaguauccagaagca

SEQ ID NO: 93411 - RNA, 22 nt, Human
gcaguauaaguggauuaugucc

SEQ ID NO: 93412 - RNA, 22 nt, Human
gcaguauauggauuuuaaacau

SEQ ID NO: 93413 - RNA, 22 nt, Human
gcagucaaagauuggaccaauu

SEQ ID NO: 93414 - RNA, 22 nt, Human
gcagucaguguugacuacaugc

SEQ ID NO: 93415 - RNA, 22 nt, Human
gcagucauccagccuuuccacu

SEQ ID NO: 93416 - RNA, 22 nt, Human
gcaguccuccugccucagccuc

SEQ ID NO: 93417 - RNA, 22 nt, Human
gcaguccucucauuggccuccu

SEQ ID NO: 93418 - RNA, 22 nt, Human
gcaguccuuaggagaggaagua

SEQ ID NO: 93419 - RNA, 22 nt, Human
gcagugaaaaagugcacccugu

SEQ ID NO: 93420 - RNA, 22 nt, Human
gcagugaagauggcagguuggg

SEQ ID NO: 93421 - RNA, 22 nt, Human
gcagugacauaccuggagggca

SEQ ID NO: 93422 - RNA, 20 nt, Human
gcagugaucucaucggucug

SEQ ID NO: 93423 - RNA, 22 nt, Human
gcagugcaggacaaaucagugc

SEQ ID NO: 93424 - RNA, 22 nt, Human
gcagugcagugggacagggcgc

SEQ ID NO: 93425 - RNA, 22 nt, Human
gcagugcuaaguagcuggccca

SEQ ID NO: 93426 - RNA, 22 nt, Human
gcagugcugaucccauggcaga

SEQ ID NO: 93427 - RNA, 20 nt, Human
gcagugcuggugccucugcu

SEQ ID NO: 93428 - RNA, 22 nt, Human
gcagugcuugaagagguggcca

SEQ ID NO: 93429 - RNA, 22 nt, Human
gcagugcuugcucaggcuucau

SEQ ID NO: 93430 - RNA, 22 nt, Human
gcaguggcccagcuugcaggcu

SEQ ID NO: 93431 - RNA, 22 nt, Human
gcaguggcuaggagucuggcgu

SEQ ID NO: 93432 - RNA, 22 nt, Human
gcaguggggcaaucauagcuca

SEQ ID NO: 93433 - RNA, 22 nt, Human
gcagugucuuugaccuccaccc

SEQ ID NO: 93434 - RNA, 22 nt, Human
gcaguguggcguggggaccuaa

SEQ ID NO: 93435 - RNA, 22 nt, Human
gcagugugucucuuggcuuccu

SEQ ID NO: 93436 - RNA, 22 nt, Human
gcagugugucuggaguacaugg

SEQ ID NO: 93437 - RNA, 22 nt, Human
gcaguguguuucugagauaugg

SEQ ID NO: 93438 - RNA, 22 nt, Human
gcaguguuaaacaacugcugcu

SEQ ID NO: 93439 - RNA, 22 nt, Human
gcaguguuacuuggaguacuaa

SEQ ID NO: 93440 - RNA, 22 nt, Human
gcaguguucagugaagcaggag

SEQ ID NO: 93441 - RNA, 22 nt, Human
gcaguguugcuaggugcgguga

SEQ ID NO: 93442 - RNA, 22 nt, Human
gcaguguuuguguucucacaug

SEQ ID NO: 93443 - RNA, 22 nt, Human
gcaguuaccuauuuuguagaaa

SEQ ID NO: 93444 - RNA, 23 nt, Human
gcaguuaguccacuuugcagaga

SEQ ID NO: 93445 - RNA, 22 nt, Human
gcaguugcaggauuuguguugu

SEQ ID NO: 93446 - RNA, 22 nt, Human
gcaguuuaguagaugacauuau

SEQ ID NO: 93447 - RNA, 22 nt, Human
gcaguuuuagagcuuuaagaug

SEQ ID NO: 93448 - RNA, 22 nt, Human
gcaguuuuauuaugauggaaau

SEQ ID NO: 93449 - RNA, 22 nt, Human
gcauaacaaauaugcuuuaaau

SEQ ID NO: 93450 - RNA, 22 nt, Human
gcauaauauacaugcuugaucc

SEQ ID NO: 93451 - RNA, 22 nt, Human
gcauacaaagguuuacaacuga

SEQ ID NO: 93452 - RNA, 22 nt, Human
gcauacagagaggauguggcau

SEQ ID NO: 93453 - RNA, 22 nt, Human
gcauagcuguuaauuugguuuc

SEQ ID NO: 93454 - RNA, 22 nt, Human
gcauaggcacuuuccuccuccu

SEQ ID NO: 93455 - RNA, 22 nt, Human
gcauaguaggcugucaaaaaug

SEQ ID NO: 93456 - RNA, 22 nt, Human
gcauagucaguaggauucucaa

SEQ ID NO: 93457 - RNA, 22 nt, Human
gcauaucaugacuucuaucuua

SEQ ID NO: 93458 - RNA, 19 nt, Human
gcaucagagcagaaggggu

SEQ ID NO: 93459 - RNA, 22 nt, Human
gcaucauucuggcucuuuccau

SEQ ID NO: 93460 - RNA, 22 nt, Human
gcaucauuuucuucuuccugca

SEQ ID NO: 93461 - RNA, 23 nt, Human
gcauccagagcucaguccccuuu

SEQ ID NO: 93462 - RNA, 22 nt, Human
gcauccagagguagccacugug

SEQ ID NO: 93463 - RNA, 22 nt, Human
gcauccauucacucaacuuaga

SEQ ID NO: 93464 - RNA, 22 nt, Human
gcauccauuguuuauguguuuc

SEQ ID NO: 93465 - RNA, 22 nt, Human
gcaucccaaaucugaaagucca

SEQ ID NO: 93466 - RNA, 22 nt, Human
gcaucccucugaggggccaggc

SEQ ID NO: 93467 - RNA, 23 nt, Human
gcaucuuaaaaccuacauaugug

SEQ ID NO: 93468 - RNA, 23 nt, Human
gcaugaagugcuacgucuacagc

SEQ ID NO: 93469 - RNA, 22 nt, Human
gcaugauaccauagguuuugcc

SEQ ID NO: 93470 - RNA, 22 nt, Human
gcaugcaacucccaguucugcc

SEQ ID NO: 93471 - RNA, 22 nt, Human
gcaugcacacacuuucucacua

SEQ ID NO: 93472 - RNA, 22 nt, Human
gucauaaucacaguuuuaugca

SEQ ID NO: 93473 - RNA, 22 nt, Human
gucauauacacugcauguaauc

SEQ ID NO: 93474 - RNA, 20 nt, Human
gucaucgccggcagcaaaga

SEQ ID NO: 93475 - RNA, 22 nt, Human
gucaucuucucucagcccaggc

SEQ ID NO: 93476 - RNA, 22 nt, Human
gucaucuugcuguuuuagaucu

SEQ ID NO: 93477 - RNA, 22 nt, Human
gucauggaggauugugaguggu

SEQ ID NO: 93478 - RNA, 18 nt, Human
gucauggguaguuuagua

SEQ ID NO: 93479 - RNA, 22 nt, Human
gucaugugaaauuuggcaggcc

SEQ ID NO: 93480 - RNA, 22 nt, Human
gucauucaacugcacauuaggu

SEQ ID NO: 93481 - RNA, 22 nt, Human
gucauucagagaugcagguaga

SEQ ID NO: 93482 - RNA, 22 nt, Human
gucauuccuauccauuugauac

SEQ ID NO: 93483 - RNA, 22 nt, Human
gucauucucuggugugguuguu

SEQ ID NO: 93484 - RNA, 22 nt, Human
gucauucuuaacaacucaguag

SEQ ID NO: 93485 - RNA, 22 nt, Human
gucauugagucgucagagucuu

SEQ ID NO: 93486 - RNA, 22 nt, Human
guccaaaagagccagccgggcg

SEQ ID NO: 93487 - RNA, 22 nt, Human
guccaaauaaguugcaaaauag

SEQ ID NO: 93488 - RNA, 22 nt, Human
guccaaauuccacagauuucuc

SEQ ID NO: 93489 - RNA, 22 nt, Human
guccaagagaacugaaauagga

SEQ ID NO: 93490 - RNA, 22 nt, Human
guccaaggaugcaggaugcugu

SEQ ID NO: 93491 - RNA, 22 nt, Human
guccaaggauggggucucccag

SEQ ID NO: 93492 - RNA, 22 nt, Human
guccacagagggcugggcaggc

SEQ ID NO: 93493 - RNA, 23 nt, Human
guccagaacccaggcuggggugg

SEQ ID NO: 93494 - RNA, 22 nt, Human
guccagaauuacuacuguuuga

SEQ ID NO: 93495 - RNA, 21 nt, Human
guccagagagccggcuccuga

SEQ ID NO: 93496 - RNA, 22 nt, Human
guccagagaguaaaggggguaa

SEQ ID NO: 93497 - RNA, 22 nt, Human
guccagagggucaaguuucuug

SEQ ID NO: 93498 - RNA, 22 nt, Human
guccagagguccaggaucaagg

SEQ ID NO: 93499 - RNA, 20 nt, Human
guccagaguaaugugcugac

SEQ ID NO: 93500 - RNA, 22 nt, Human
guccagccacccuggaggcacg

SEQ ID NO: 93501 - RNA, 22 nt, Human
guccagccaggccugucucugg

SEQ ID NO: 93502 - RNA, 22 nt, Human
guccagcugaucuugacccagc

SEQ ID NO: 93503 - RNA, 22 nt, Human
guccaggaguuuccaauuaagc

SEQ ID NO: 93504 - RNA, 22 nt, Human
guccagggaaauagcgacaggg

SEQ ID NO: 93505 - RNA, 22 nt, Human
guccagggcuaaaucagguucc

SEQ ID NO: 93506 - RNA, 22 nt, Human
guccaggucuggacccugagcc

SEQ ID NO: 93507 - RNA, 22 nt, Human
guccagugacaaguagcuggcc

SEQ ID NO: 93508 - RNA, 19 nt, Human
guccaguguuuuccaguca

SEQ ID NO: 93509 - RNA, 22 nt, Human
guccaucuaaguauccagccug

SEQ ID NO: 93510 - RNA, 22 nt, Human
guccaugauucugugacacccu

SEQ ID NO: 93511 - RNA, 22 nt, Human
gucccacaccuugaggggucuu

SEQ ID NO: 93512 - RNA, 22 nt, Human
gucccagaaacauauugcuggu

SEQ ID NO: 93513 - RNA, 22 nt, Human
gucccagaggcuuuggccacag

SEQ ID NO: 93514 - RNA, 22 nt, Human
gucccagcuucccacuagcagc

SEQ ID NO: 93515 - RNA, 22 nt, Human
gucccaggcaggccacuggcag

SEQ ID NO: 93516 - RNA, 22 nt, Human
gcaggcaucucuguagccaggg

SEQ ID NO: 93517 - RNA, 22 nt, Human
gcaggcauggucgcugccaggu

SEQ ID NO: 93518 - RNA, 22 nt, Human
gcaggccacaguggagucucug

SEQ ID NO: 93519 - RNA, 22 nt, Human
gcaggcccuccucuagcaaggc

SEQ ID NO: 93520 - RNA, 18 nt, Human
gcaggcccuguuucuggg

SEQ ID NO: 93521 - RNA, 22 nt, Human
gcaggcccuuagccuugguggg

SEQ ID NO: 93522 - RNA, 22 nt, Human
gcaggccugcagguauggccgg

SEQ ID NO: 93523 - RNA, 22 nt, Human
gcaggccugggagucaucuugu

SEQ ID NO: 93524 - RNA, 22 nt, Human
gcaggccuguaaugaagggaca

SEQ ID NO: 93525 - RNA, 22 nt, Human
gcaggcggaucacuggaaguca

SEQ ID NO: 93526 - RNA, 22 nt, Human
gcaggcuaugucagggccgcuc

SEQ ID NO: 93527 - RNA, 22 nt, Human
gcaggcucagagcagauuagca

SEQ ID NO: 93528 - RNA, 22 nt, Human
gcaggcuccaacuggaggaguu

SEQ ID NO: 93529 - RNA, 22 nt, Human
gcaggcuccaggccggccccuu

SEQ ID NO: 93530 - RNA, 22 nt, Human
gcaggcugagaguccaagaagg

SEQ ID NO: 93531 - RNA, 22 nt, Human
gcaggcugauagaggauuccau

SEQ ID NO: 93532 - RNA, 22 nt, Human
gcaggcugcccucuuguguuga

SEQ ID NO: 93533 - RNA, 22 nt, Human
gcaggcuguagacaccaaacua

SEQ ID NO: 93534 - RNA, 22 nt, Human
gcaggcuuauggggagacagag

SEQ ID NO: 93535 - RNA, 22 nt, Human
gcaggcuucaagcacagcuuuu

SEQ ID NO: 93536 - RNA, 22 nt, Human
gcaggcuucccccacaccuacg

SEQ ID NO: 93537 - RNA, 22 nt, Human
gcagggaaguuguaauguaaug

SEQ ID NO: 93538 - RNA, 22 nt, Human
gcagggacaacugugcaccuga

SEQ ID NO: 93539 - RNA, 18 nt, Human
gcagggacacagggucac

SEQ ID NO: 93540 - RNA, 22 nt, Human
gcagggacaccuuugugaagcu

SEQ ID NO: 93541 - RNA, 22 nt, Human
gcagggaccuaugacgauggaa

SEQ ID NO: 93542 - RNA, 22 nt, Human
gcagggaccucacuacccccag

SEQ ID NO: 93543 - RNA, 22 nt, Human
gcagggacgccagggacagcaa

SEQ ID NO: 93544 - RNA, 22 nt, Human
gcagggagggccuuucaugaca

SEQ ID NO: 93545 - RNA, 20 nt, Human
gcagggcaagggauaugaaa

SEQ ID NO: 93546 - RNA, 22 nt, Human
gcagggcaaugaucccgagagg

SEQ ID NO: 93547 - RNA, 22 nt, Human
gcagggcacaaggacgcacagg

SEQ ID NO: 93548 - RNA, 22 nt, Human
gcagggcacagacagugccaag

SEQ ID NO: 93549 - RNA, 22 nt, Human
gcagggcagcucacugugguuc

SEQ ID NO: 93550 - RNA, 22 nt, Human
gcagggcagugugucugugggg

SEQ ID NO: 93551 - RNA, 22 nt, Human
gcagggcaucccugagcgggug

SEQ ID NO: 93552 - RNA, 22 nt, Human
gcagggccagugcagagaggaa

SEQ ID NO: 93553 - RNA, 22 nt, Human
gcagggccuuagcagcggcugc

SEQ ID NO: 93554 - RNA, 22 nt, Human
gcagggccuuggucaucuuuuu

SEQ ID NO: 93555 - RNA, 22 nt, Human
gcagggcuaauggggcaaguag

SEQ ID NO: 93556 - RNA, 22 nt, Human
gcagggcuauuggaaggagaug

SEQ ID NO: 93557 - RNA, 22 nt, Human
gcagggcucauucuaguacaau

SEQ ID NO: 93558 - RNA, 22 nt, Human
gcagggcucauugccaggcauu

SEQ ID NO: 93559 - RNA, 22 nt, Human
gcagggcugauggcuucccuca

SEQ ID NO: 93560 - RNA, 22 nt, Human
gcagggcugcagagggcacugu

SEQ ID NO: 93561 - RNA, 22 nt, Human
gcagggcugggauuugagccca

SEQ ID NO: 93562 - RNA, 22 nt, Human
gcagggcuggguccugucucau

SEQ ID NO: 93563 - RNA, 22 nt, Human
gcagggcuguggacacuuuggu

SEQ ID NO: 93564 - RNA, 22 nt, Human
gcagggcuuuuugaaacauggu

SEQ ID NO: 93565 - RNA, 22 nt, Human
gcaggggaguccacucuaugca

SEQ ID NO: 93566 - RNA, 22 nt, Human
gcaggggcaggagaucucaggc

SEQ ID NO: 93567 - RNA, 22 nt, Human
gcagggggucauucacgcuggc

SEQ ID NO: 93568 - RNA, 22 nt, Human
gcagggguagugucuuccugag

SEQ ID NO: 93569 - RNA, 16 nt, Human
gcagggguggguggag

SEQ ID NO: 93570 - RNA, 22 nt, Human
gcagggucgcucuaggagauca

SEQ ID NO: 93571 - RNA, 22 nt, Human
gcagggugauagugaggcucag

SEQ ID NO: 93572 - RNA, 22 nt, Human
gcagggugccgacuucagggau

SEQ ID NO: 93573 - RNA, 19 nt, Human
gcaggguggcagagcucuu

SEQ ID NO: 93574 - RNA, 22 nt, Human
gcaggguugguguccucugcgg

SEQ ID NO: 93575 - RNA, 22 nt, Human
gcagguaagagaggcuggcuuc

SEQ ID NO: 93576 - RNA, 20 nt, Human
gcaggucccuggcaugcaga

SEQ ID NO: 93577 - RNA, 22 nt, Human
gcaggucuagaagcugccucug

SEQ ID NO: 93578 - RNA, 22 nt, Human
gcaggucuaucaggcugcaggu

SEQ ID NO: 93579 - RNA, 22 nt, Human
gcaggucuggagggcacugggg

SEQ ID NO: 93580 - RNA, 19 nt, Human
gcaggugagccguggcucc

SEQ ID NO: 93581 - RNA, 22 nt, Human
guccuuggcuugaggcaccuca

SEQ ID NO: 93582 - RNA, 22 nt, Human
guccuuucuuaaauuccugcuu

SEQ ID NO: 93583 - RNA, 20 nt, Human
gucgaaaaagauaaacaggc

SEQ ID NO: 93584 - RNA, 22 nt, Human
gucgaucaccucguccuccgug

SEQ ID NO: 93585 - RNA, 22 nt, Human
gucggccacgcaggugcgguag

SEQ ID NO: 93586 - RNA, 22 nt, Human
gucguucucugccagggcguug

SEQ ID NO: 93587 - RNA, 22 nt, Human
gucuaaaccucaaaucaguguc

SEQ ID NO: 93588 - RNA, 22 nt, Human
gucuaaacuuagggaucgaaca

SEQ ID NO: 93589 - RNA, 22 nt, Human
gucuaacaagcauuaggaaccc

SEQ ID NO: 93590 - RNA, 22 nt, Human
gucuaauaacuuucagucauuu

SEQ ID NO: 93591 - RNA, 22 nt, Human
gucuacuuuuuaaucuuggcag

SEQ ID NO: 93592 - RNA, 22 nt, Human
gucuagagccugaugaggauga

SEQ ID NO: 93593 - RNA, 22 nt, Human
gucuagcaaugaugaugagcua

SEQ ID NO: 93594 - RNA, 22 nt, Human
gucuaugauauuuuguuauagc

SEQ ID NO: 93595 - RNA, 22 nt, Human
gucucagggcagcuggaggagg

SEQ ID NO: 93596 - RNA, 22 nt, Human
gucucagguauugaaugggaac

SEQ ID NO: 93597 - RNA, 22 nt, Human
gucucagguucgagccuccuua

SEQ ID NO: 93598 - RNA, 22 nt, Human
gucucaguaagaaaggcuccug

SEQ ID NO: 93599 - RNA, 22 nt, Human
gucuccacuaaaaacuuucacg

SEQ ID NO: 93600 - RNA, 22 nt, Human
gucuccaguguucaggugacug

SEQ ID NO: 93601 - RNA, 22 nt, Human
gucucccaaccccugugcccag

SEQ ID NO: 93602 - RNA, 22 nt, Human
gucucccaucguuugugaggaa

SEQ ID NO: 93603 - RNA, 22 nt, Human
gucucccaucucuguccuugug

SEQ ID NO: 93604 - RNA, 20 nt, Human
gucuccucuuugcauuccua

SEQ ID NO: 93605 - RNA, 22 nt, Human
gucuccuguccugcaggaugga

SEQ ID NO: 93606 - RNA, 22 nt, Human
gucucuagauugggagagagaa

SEQ ID NO: 93607 - RNA, 22 nt, Human
gucucuggcuuuaugcugguuu

SEQ ID NO: 93608 - RNA, 22 nt, Human
gucucugucauuucaccuuccc

SEQ ID NO: 93609 - RNA, 17 nt, Human
gucucugucuugcuuuu

SEQ ID NO: 93610 - RNA, 18 nt, Human
gucucugugggaauuggc

SEQ ID NO: 93611 - RNA, 22 nt, Human
gucucuuagaaucgcauauugu

SEQ ID NO: 93612 - RNA, 16 nt, Human
gucucuucccugcuga

SEQ ID NO: 93613 - RNA, 22 nt, Human
gucucuuguuaucauuucugag

SEQ ID NO: 93614 - RNA, 22 nt, Human
gucugaauacguacuugugaag

SEQ ID NO: 93615 - RNA, 22 nt, Human
gucugagaggaggcagccucgg

SEQ ID NO: 93616 - RNA, 22 nt, Human
gucugagcgcuggagcuugugu

SEQ ID NO: 93617 - RNA, 22 nt, Human
gucugagggagaaggaucuggg

SEQ ID NO: 93618 - RNA, 22 nt, Human
gucugaggguugugcuggagga

SEQ ID NO: 93619 - RNA, 22 nt, Human
gucugaggucauuagcucucuu

SEQ ID NO: 93620 - RNA, 22 nt, Human
gucugauaucagaaaaaguaaa

SEQ ID NO: 93621 - RNA, 22 nt, Human
gucugcacggggaggaugggcu

SEQ ID NO: 93622 - RNA, 22 nt, Human
gucugcacgugccagggagggg

SEQ ID NO: 93623 - RNA, 22 nt, Human
gucugcagagggaaggcuucag

SEQ ID NO: 93624 - RNA, 18 nt, Human
gucugccaacaacuauca

SEQ ID NO: 93625 - RNA, 22 nt, Human
gucugccauguggagaaagcca

SEQ ID NO: 93626 - RNA, 22 nt, Human
gucugccccacaggcucaguug

SEQ ID NO: 93627 - RNA, 22 nt, Human
gucugcccugcugaucucaccc

SEQ ID NO: 93628 - RNA, 22 nt, Human
gucugcccuuggcucagccaua

SEQ ID NO: 93629 - RNA, 22 nt, Human
gucugcuggcacgucacagaua

SEQ ID NO: 93630 - RNA, 22 nt, Human
gucugcuguucagagauguugc

SEQ ID NO: 93631 - RNA, 22 nt, Human
gucuggaagcucuaggggagaa

SEQ ID NO: 93632 - RNA, 22 nt, Human
gucuggacagcagcaccucggc

SEQ ID NO: 93633 - RNA, 21 nt, Human
gcagcagaggcuugacagaca

SEQ ID NO: 93634 - RNA, 22 nt, Human
gcagcagaguagacagagcccu

SEQ ID NO: 93635 - RNA, 22 nt, Human
gcagcagaugugggcccagagc

SEQ ID NO: 93636 - RNA, 22 nt, Human
gcagcagcagcaauuuucuguc

SEQ ID NO: 93637 - RNA, 22 nt, Human
gcagcagcccagggcucucaga

SEQ ID NO: 93638 - RNA, 22 nt, Human
gcagcagccgacauggauugca

SEQ ID NO: 93639 - RNA, 22 nt, Human
gcagcagcggggccccugcgcg

SEQ ID NO: 93640 - RNA, 22 nt, Human
gcagcagcucaguucugggagg

SEQ ID NO: 93641 - RNA, 22 nt, Human
gcagcagcugacagugggugcc

SEQ ID NO: 93642 - RNA, 22 nt, Human
gcagcaggacugccguuaaagu

SEQ ID NO: 93643 - RNA, 22 nt, Human
gcagcaggagaguaauagcggu

SEQ ID NO: 93644 - RNA, 22 nt, Human
gcagcaggauggccaauugcca

SEQ ID NO: 93645 - RNA, 22 nt, Human
gcagcaggcacggucucgacau

SEQ ID NO: 93646 - RNA, 22 nt, Human
gcagcaggcacuuaccguugcu

SEQ ID NO: 93647 - RNA, 22 nt, Human
gcagcagggugccagcuuugca

SEQ ID NO: 93648 - RNA, 22 nt, Human
gcagcagguccgcaucaucauc

SEQ ID NO: 93649 - RNA, 22 nt, Human
gcagcaguaggaaauaacacag

SEQ ID NO: 93650 - RNA, 22 nt, Human
gcagcagugcuuuggaauccug

SEQ ID NO: 93651 - RNA, 19 nt, Human
gcagcaguggaaggaaaaa

SEQ ID NO: 93652 - RNA, 22 nt, Human
gcagcaguggucuguagaagga

SEQ ID NO: 93653 - RNA, 22 nt, Human
gcagcauccccaggcagcaggg

SEQ ID NO: 93654 - RNA, 22 nt, Human
gcagcaucuagggcacuggccu

SEQ ID NO: 93655 - RNA, 22 nt, Human
gcagcauugcacuuuuguucuu

SEQ ID NO: 93656 - RNA, 22 nt, Human
gcagcauuucucaaaggguggu

SEQ ID NO: 93657 - RNA, 22 nt, Human
gcagccaagaccccaagaacug

SEQ ID NO: 93658 - RNA, 22 nt, Human
gcagccacuaguuuuccuguuu

SEQ ID NO: 93659 - RNA, 22 nt, Human
gcagccacucucauuccacgug

SEQ ID NO: 93660 - RNA, 22 nt, Human
gcagccagcaggaagcgggaga

SEQ ID NO: 93661 - RNA, 22 nt, Human
gcagccagccccucugaccucu

SEQ ID NO: 93662 - RNA, 21 nt, Human
gcagccaggacuuugggcugg

SEQ ID NO: 93663 - RNA, 22 nt, Human
gcagccagggagagaaccaggg

SEQ ID NO: 93664 - RNA, 22 nt, Human
gcagccagggcuaagcugggga

SEQ ID NO: 93665 - RNA, 22 nt, Human
gcagccaggggcugugaccugu

SEQ ID NO: 93666 - RNA, 22 nt, Human
gcagccaggguuaauuauauuu

SEQ ID NO: 93667 - RNA, 22 nt, Human
gcagccaguauccucugagauu

SEQ ID NO: 93668 - RNA, 17 nt, Human
gcagccagugcagcagg

SEQ ID NO: 93669 - RNA, 22 nt, Human
gcagcccaagccugagcauccu

SEQ ID NO: 93670 - RNA, 22 nt, Human
gcagcccacagcuggaggccua

SEQ ID NO: 93671 - RNA, 22 nt, Human
gcagcccaggagcaggcgaccc

SEQ ID NO: 93672 - RNA, 22 nt, Human
gcagcccaggcucgcucacugc

SEQ ID NO: 93673 - RNA, 22 nt, Human
gcagcccagguggaguaaucua

SEQ ID NO: 93674 - RNA, 22 nt, Human
gcagcccuaaccugucauagug

SEQ ID NO: 93675 - RNA, 22 nt, Human
gcagcccucuuggucacuaggc

SEQ ID NO: 93676 - RNA, 22 nt, Human
gcagcccuggccuggccuacuu

SEQ ID NO: 93677 - RNA, 20 nt, Human
gcagccucaacaggcacagc

SEQ ID NO: 93678 - RNA, 22 nt, Human
gcagccugaugaucuggguugu

SEQ ID NO: 93679 - RNA, 22 nt, Human
gcagccuguuguaccagccugu

SEQ ID NO: 93680 - RNA, 22 nt, Human
gcagccuuccugaccucuaccc

SEQ ID NO: 93681 - RNA, 22 nt, Human
gcagcguggggcugagucagcu

SEQ ID NO: 93682 - RNA, 22 nt, Human
gcagcuaccacccaggaaggac

SEQ ID NO: 93683 - RNA, 18 nt, Human
gcagcuagccaggggggc

SEQ ID NO: 93684 - RNA, 22 nt, Human
gcagcucccaucagggcacaga

SEQ ID NO: 93685 - RNA, 22 nt, Human
gcagcuccuccugggcuggaga

SEQ ID NO: 93686 - RNA, 22 nt, Human
gcagcugagcgugaggaagagu

SEQ ID NO: 93687 - RNA, 22 nt, Human
gcagcugauggaaguccuauug

SEQ ID NO: 93688 - RNA, 22 nt, Human
gcagcugcagacccucagugcu

SEQ ID NO: 93689 - RNA, 22 nt, Human
gcagcugcagagaccggguggg

SEQ ID NO: 93690 - RNA, 22 nt, Human
gccaggaaucacugcugaguaa

SEQ ID NO: 93691 - RNA, 22 nt, Human
gccaggagacuccauucauuug

SEQ ID NO: 93692 - RNA, 22 nt, Human
gccaggagagcuccuucagguu

SEQ ID NO: 93693 - RNA, 22 nt, Human
gccaggagcaugucauuguuga

SEQ ID NO: 93694 - RNA, 22 nt, Human
gccaggagccagcuucuuagca

SEQ ID NO: 93695 - RNA, 22 nt, Human
gccaggagggaaaggacaauuu

SEQ ID NO: 93696 - RNA, 22 nt, Human
gccaggaggggagaguguguca

SEQ ID NO: 93697 - RNA, 17 nt, Human
gccaggagguuugagcu

SEQ ID NO: 93698 - RNA, 22 nt, Human
gccaggagugucccacucauuu

SEQ ID NO: 93699 - RNA, 22 nt, Human
gccaggaguguguggcuauguu

SEQ ID NO: 93700 - RNA, 22 nt, Human
gccaggaguucagaugcauguu

SEQ ID NO: 93701 - RNA, 22 nt, Human
gccaggcauuauuccgaucccu

SEQ ID NO: 93702 - RNA, 22 nt, Human
gccaggcauucuagaaguagug

SEQ ID NO: 93703 - RNA, 22 nt, Human
gccaggccacucccggguccug

SEQ ID NO: 93704 - RNA, 19 nt, Human
gccaggccuggaccugcag

SEQ ID NO: 93705 - RNA, 22 nt, Human
gccaggcucagcagucaaccug

SEQ ID NO: 93706 - RNA, 22 nt, Human
gccaggcuccccggaucccugg

SEQ ID NO: 93707 - RNA, 22 nt, Human
gccaggcugaggcucuggaaga

SEQ ID NO: 93708 - RNA, 22 nt, Human
gccaggcugccuuaucucuagc

SEQ ID NO: 93709 - RNA, 22 nt, Human
gccaggcuggggggagaugucu

SEQ ID NO: 93710 - RNA, 22 nt, Human
gccaggcuggucuugaacuccu

SEQ ID NO: 93711 - RNA, 22 nt, Human
gccaggcuguggggaacuugaa

SEQ ID NO: 93712 - RNA, 22 nt, Human
gccagggugugcagggacagga

SEQ ID NO: 93713 - RNA, 22 nt, Human
gccaggguucaagcuauucucc

SEQ ID NO: 93714 - RNA, 22 nt, Human
gccaggguucgaauccguaugg

SEQ ID NO: 93715 - RNA, 22 nt, Human
gccaggucgucuccauguccaa

SEQ ID NO: 93716 - RNA, 22 nt, Human
gccaggucucauaaaugcagcu

SEQ ID NO: 93717 - RNA, 22 nt, Human
gccaggucuggguagcagagga

SEQ ID NO: 93718 - RNA, 19 nt, Human
gccaggucuuggguccagg

SEQ ID NO: 93719 - RNA, 22 nt, Human
gccaggugcaccugcccuggcc

SEQ ID NO: 93720 - RNA, 22 nt, Human
gccagguggcugagcagcugca

SEQ ID NO: 93721 - RNA, 22 nt, Human
gccagguguaguggccacaccu

SEQ ID NO: 93722 - RNA, 22 nt, Human
gccagguguccucacagugagg

SEQ ID NO: 93723 - RNA, 22 nt, Human
gccagguugcugacgacgaucu

SEQ ID NO: 93724 - RNA, 22 nt, Human
gccaguaaaacaaaggccaugu

SEQ ID NO: 93725 - RNA, 22 nt, Human
gccagucucccucaguccucug

SEQ ID NO: 93726 - RNA, 22 nt, Human
gccagucugcucccacaaguuc

SEQ ID NO: 93727 - RNA, 22 nt, Human
gccagugccucgccgcgcuccu

SEQ ID NO: 93728 - RNA, 22 nt, Human
gccaguggagacugaaacccau

SEQ ID NO: 93729 - RNA, 22 nt, Human
gccaguggcaugcggcagggac

SEQ ID NO: 93730 - RNA, 22 nt, Human
gccaguggcuugccaggcagga

SEQ ID NO: 93731 - RNA, 22 nt, Human
gccaguggguaguuggagcugg

SEQ ID NO: 93732 - RNA, 18 nt, Human
gccaguggguccaggugc

SEQ ID NO: 93733 - RNA, 22 nt, Human
gccagugugguguagucaugaa

SEQ ID NO: 93734 - RNA, 22 nt, Human
gccagugugucuugcaggcucc

SEQ ID NO: 93735 - RNA, 19 nt, Human
gccagugugugguacagug

SEQ ID NO: 93736 - RNA, 22 nt, Human
gccaguuuccaccuaggcaauu

SEQ ID NO: 93737 - RNA, 22 nt, Human
gccauauacccacugucuccau

SEQ ID NO: 93738 - RNA, 22 nt, Human
gccauauauauuuugcacuagg

SEQ ID NO: 93739 - RNA, 22 nt, Human
gccaucacauccaggcuaccuc

SEQ ID NO: 93740 - RNA, 23 nt, Human
gccaucacguucaaccaaagccu

SEQ ID NO: 93741 - RNA, 20 nt, Human
gccauccagccucccaggag

SEQ ID NO: 93742 - RNA, 22 nt, Human
gccaucuggcauugcagcaccu

SEQ ID NO: 93743 - RNA, 22 nt, Human
gccaugaggaacuguaagacaa

SEQ ID NO: 93744 - RNA, 23 nt, Human
gccaugaguucccuuucacuugu

SEQ ID NO: 93745 - RNA, 22 nt, Human
gccaugccugugucuccaggcc

SEQ ID NO: 93746 - RNA, 23 nt, Human
gccauggcugccccacaggccuc

SEQ ID NO: 93747 - RNA, 22 nt, Human
gccauguccugggcaucugcca

SEQ ID NO: 93748 - RNA, 22 nt, Human
gccauguucuugaaucuggguc

SEQ ID NO: 93749 - RNA, 22 nt, Human
gccaggcagagccccgugcagc

SEQ ID NO: 93750 - RNA, 22 nt, Human
gccaggcagcugggagggugcc

SEQ ID NO: 93751 - RNA, 18 nt, Human
gccaggcaggguggggaa

SEQ ID NO: 93752 - RNA, 22 nt, Human
gccaggcaguucaaguacacca

SEQ ID NO: 93753 - RNA, 22 nt, Human
gccaggcauguccucugcagaa

SEQ ID NO: 93754 - RNA, 22 nt, Human
gccaggccugcaagugcuggug

SEQ ID NO: 93755 - RNA, 22 nt, Human
gccaggcuaagaaaggugugau

SEQ ID NO: 93756 - RNA, 22 nt, Human
gccaggcugcuccagggaggcc

SEQ ID NO: 93757 - RNA, 22 nt, Human
gccaggcuggugucacaacucu

SEQ ID NO: 93758 - RNA, 22 nt, Human
gccagggaaacugcagaccagc

SEQ ID NO: 93759 - RNA, 17 nt, Human
gccagggagaggaagcc

SEQ ID NO: 93760 - RNA, 22 nt, Human
gccagggagucugggccacaga

SEQ ID NO: 93761 - RNA, 22 nt, Human
gccaggggacgcggagcgacga

SEQ ID NO: 93762 - RNA, 22 nt, Human
gccaggggugcccacccaagga

SEQ ID NO: 93763 - RNA, 22 nt, Human
gccagggugagggcugagaggu

SEQ ID NO: 93764 - RNA, 22 nt, Human
gccaggguggcagaaggcccca

SEQ ID NO: 93765 - RNA, 22 nt, Human
gccagguccaggguggagcgcu

SEQ ID NO: 93766 - RNA, 22 nt, Human
gccaggucuaagcaucagccac

SEQ ID NO: 93767 - RNA, 18 nt, Human
gccaggucucucugcuuc

SEQ ID NO: 93768 - RNA, 22 nt, Human
gccaggugagaggacugaggcu

SEQ ID NO: 93769 - RNA, 22 nt, Human
gccaggugcauauuagaagcau

SEQ ID NO: 93770 - RNA, 22 nt, Human
gccaggugcauggcugagucuc

SEQ ID NO: 93771 - RNA, 22 nt, Human
gccaggugcuaucccugcgcug

SEQ ID NO: 93772 - RNA, 22 nt, Human
gccagguggagguugcagugag

SEQ ID NO: 93773 - RNA, 22 nt, Human
gccaggugggagacagacagca

SEQ ID NO: 93774 - RNA, 22 nt, Human
gccagguggucuggcuccagag

SEQ ID NO: 93775 - RNA, 22 nt, Human
gccaguaagugguagagacuua

SEQ ID NO: 93776 - RNA, 22 nt, Human
gccaguaagugguagaguugag

SEQ ID NO: 93777 - RNA, 22 nt, Human
gccagucagcuggccaggcugg

SEQ ID NO: 93778 - RNA, 22 nt, Human
gccagucuucauauucauggug

SEQ ID NO: 93779 - RNA, 18 nt, Human
gccagugcccuggcucac

SEQ ID NO: 93780 - RNA, 22 nt, Human
gccagugcuuguggagcuggca

SEQ ID NO: 93781 - RNA, 22 nt, Human
gccagugguagaggggaggccg

SEQ ID NO: 93782 - RNA, 22 nt, Human
gccagugugcaagaggccacca

SEQ ID NO: 93783 - RNA, 22 nt, Human
gccaguguuuauagcagugagg

SEQ ID NO: 93784 - RNA, 21 nt, Human
gccaucaccaagcucuucccc

SEQ ID NO: 93785 - RNA, 22 nt, Human
gccaucucggagcuaucaaagg

SEQ ID NO: 93786 - RNA, 22 nt, Human
gccaucugcgcgguguccagcu

SEQ ID NO: 93787 - RNA, 23 nt, Human
gccaucugguauuuccugacuuc

SEQ ID NO: 93788 - RNA, 22 nt, Human
gccaucuucaacaucagaaguu

SEQ ID NO: 93789 - RNA, 22 nt, Human
gccaucuugagccaggaaguga

SEQ ID NO: 93790 - RNA, 22 nt, Human
gccaugaacucgggcauggaga

SEQ ID NO: 93791 - RNA, 20 nt, Human
gccaugaggggaggugacug

SEQ ID NO: 93792 - RNA, 22 nt, Human
gccaugaguaaacuggaaagcc

SEQ ID NO: 93793 - RNA, 22 nt, Human
gccaugcagcuuauuaaagugg

SEQ ID NO: 93794 - RNA, 19 nt, Human
gccaugggcuggcagcaga

SEQ ID NO: 93795 - RNA, 18 nt, Human
gccauguucuaugcuuac

SEQ ID NO: 93796 - RNA, 22 nt, Human
gccauguuuugguaaauaccau

SEQ ID NO: 93797 - RNA, 21 nt, Human
gccauuguuuucuaccuggag

SEQ ID NO: 93798 - RNA, 22 nt, Human
gccauuuucugucuuguuuauu

SEQ ID NO: 93799 - RNA, 22 nt, Human
gugcagagcaagggcugagggc

SEQ ID NO: 93800 - RNA, 22 nt, Human
gugcagcaaaguuugagauaua

SEQ ID NO: 93801 - RNA, 22 nt, Human
gugcagccauuugcaugcuucc

SEQ ID NO: 93802 - RNA, 22 nt, Human
gugcagcugaaggcuggccagc

SEQ ID NO: 93803 - RNA, 22 nt, Human
gugcagcugcaggagucagguc

SEQ ID NO: 93804 - RNA, 22 nt, Human
gugcagcugcuugccugguuag

SEQ ID NO: 93805 - RNA, 22 nt, Human
gugcagcugggcgcugaccuuc

SEQ ID NO: 93806 - RNA, 22 nt, Human
gugcaggacagcacaucuccug

SEQ ID NO: 93807 - RNA, 22 nt, Human
gugcaggagccagggguaggaa

SEQ ID NO: 93808 - RNA, 22 nt, Human
gugcaggaggaugacaacugca

SEQ ID NO: 93809 - RNA, 22 nt, Human
gugcaggagguaacauagcaaa

SEQ ID NO: 93810 - RNA, 22 nt, Human
gugcaggauguugggaaucagg

SEQ ID NO: 93811 - RNA, 22 nt, Human
gugcaggcauugggcuagccau

SEQ ID NO: 93812 - RNA, 17 nt, Human
gugcagggaugaaggau

SEQ ID NO: 93813 - RNA, 22 nt, Human
gugcagggcagguguccuucca

SEQ ID NO: 93814 - RNA, 22 nt, Human
gugcaggggaucagguugcagc

SEQ ID NO: 93815 - RNA, 22 nt, Human
gugcaggggccuccccuugcug

SEQ ID NO: 93816 - RNA, 22 nt, Human
gugcaggguagcgacggcagga

SEQ ID NO: 93817 - RNA, 22 nt, Human
gugcaggguccuaauuguuaag

SEQ ID NO: 93818 - RNA, 22 nt, Human
gugcagguggauuugggcucaa

SEQ ID NO: 93819 - RNA, 22 nt, Human
gugcagguuuaggaagcagcuc

SEQ ID NO: 93820 - RNA, 22 nt, Human
gugcaguguguaauccaggaac

SEQ ID NO: 93821 - RNA, 22 nt, Human
gugcaguucccaaggucacaca

SEQ ID NO: 93822 - RNA, 22 nt, Human
gugcaguucuuguaacaugcug

SEQ ID NO: 93823 - RNA, 22 nt, Human
gugcauauauaugggagggagc

SEQ ID NO: 93824 - RNA, 22 nt, Human
gugcauauaugcacauaugugu

SEQ ID NO: 93825 - RNA, 22 nt, Human
gugcauccacuagggcucuccc

SEQ ID NO: 93826 - RNA, 22 nt, Human
gugcaugaagacucagaaaguc

SEQ ID NO: 93827 - RNA, 22 nt, Human
gugcaugcaaauuacuguaaag

SEQ ID NO: 93828 - RNA, 22 nt, Human
gugcaugucuuuggaggccucc

SEQ ID NO: 93829 - RNA, 22 nt, Human
gugcaugugcguugacugucca

SEQ ID NO: 93830 - RNA, 22 nt, Human
gugcauuacauguaauaaaaua

SEQ ID NO: 93831 - RNA, 22 nt, Human
gugcauuaggcuggaauguuga

SEQ ID NO: 93832 - RNA, 22 nt, Human
gugcauuccaccgugcagguug

SEQ ID NO: 93833 - RNA, 22 nt, Human
gugcauuugacgaauacucacu

SEQ ID NO: 93834 - RNA, 22 nt, Human
gugccacauggccuaauagaga

SEQ ID NO: 93835 - RNA, 22 nt, Human
gugccagagaugacaggccugc

SEQ ID NO: 93836 - RNA, 22 nt, Human
gugccagcucuccccacaucug

SEQ ID NO: 93837 - RNA, 18 nt, Human
gugccaggaggcgcagcc

SEQ ID NO: 93838 - RNA, 22 nt, Human
gugccaggcccagggagcgggg

SEQ ID NO: 93839 - RNA, 22 nt, Human
gugcccacgaggccaggcuggu

SEQ ID NO: 93840 - RNA, 22 nt, Human
gugcccagcuccaccucacaga

SEQ ID NO: 93841 - RNA, 22 nt, Human
gugcccaggugucccugagaag

SEQ ID NO: 93842 - RNA, 22 nt, Human
gugcccuccugaagccaucaca

SEQ ID NO: 93843 - RNA, 22 nt, Human
gugcccugaucgcuaggcuccc

SEQ ID NO: 93844 - RNA, 22 nt, Human
gugcccugaugcaauugucuca

SEQ ID NO: 93845 - RNA, 22 nt, Human
gugcccugggccuucagggcca

SEQ ID NO: 93846 - RNA, 22 nt, Human
gugcccugucucuugucuccag

SEQ ID NO: 93847 - RNA, 22 nt, Human
gugcccuguugcacacuugagg

SEQ ID NO: 93848 - RNA, 22 nt, Human
gugcccuucagcuuugcugaaa

SEQ ID NO: 93849 - RNA, 22 nt, Human
gugccucccuguugacuagggu

SEQ ID NO: 93850 - RNA, 22 nt, Human
gugccuccuuaaauucugcacc

SEQ ID NO: 93851 - RNA, 22 nt, Human
gugccugccccacuccucagca

SEQ ID NO: 93852 - RNA, 22 nt, Human
gugccuggaaugcgccucggcg

SEQ ID NO: 93853 - RNA, 22 nt, Human
gugccuggacccucuuuccgga

SEQ ID NO: 93854 - RNA, 20 nt, Human
gugccuggagaagaggcugu

SEQ ID NO: 93855 - RNA, 22 nt, Human
gugccuggcacacagaaggcaa

SEQ ID NO: 93856 - RNA, 22 nt, Human
gugccugggacacagcagauac

SEQ ID NO: 93857 - RNA, 22 nt, Human
gugccuguaaguuguaugggcu

SEQ ID NO: 93858 - RNA, 22 nt, Human
gugccuguuucuuuugaauuca

SEQ ID NO: 93859 - RNA, 22 nt, Human
gugccuuaucugcacccucccc

SEQ ID NO: 93860 - RNA, 22 nt, Human
gugccuuugugucuaaaacagc

SEQ ID NO: 93861 - RNA, 22 nt, Human
gugcggaucgguguccuccaaa

SEQ ID NO: 93862 - RNA, 21 nt, Human
gugcggaugccgucauuguca

SEQ ID NO: 93863 - RNA, 22 nt, Human
gugcguccugggggcugggucg

SEQ ID NO: 93864 - RNA, 22 nt, Human
gugcgugugccuaucaauaaag

SEQ ID NO: 93865 - RNA, 22 nt, Human
gugcucacugugagacguccug

SEQ ID NO: 93866 - RNA, 22 nt, Human
gugcucagggccuggcugggga

SEQ ID NO: 93867 - RNA, 22 nt, Human
gugcucaucguggagccugagg

SEQ ID NO: 93868 - RNA, 22 nt, Human
gugcuccauugucuagaacugg

SEQ ID NO: 93869 - RNA, 22 nt, Human
gugcucuaggcuacagggaugc

SEQ ID NO: 93870 - RNA, 18 nt, Human
gugcucuaugucuguuau

SEQ ID NO: 93871 - RNA, 22 nt, Human
gugcucuauguugauuccuuga

SEQ ID NO: 93872 - RNA, 22 nt, Human
gugcucugaguuugcaugucag

SEQ ID NO: 93873 - RNA, 22 nt, Human
gugcucuguggauugaguugaa

SEQ ID NO: 93874 - RNA, 22 nt, Human
gugcucuguguauuaggauguc

SEQ ID NO: 93875 - RNA, 22 nt, Human
gugcugaauuugagaaacucug

SEQ ID NO: 93876 - RNA, 22 nt, Human
gugcugagcacaccuuggagca

SEQ ID NO: 93877 - RNA, 22 nt, Human
gugcugaggaaggaagacuuau

SEQ ID NO: 93878 - RNA, 22 nt, Human
gugcugaggagagggggugguc

SEQ ID NO: 93879 - RNA, 21 nt, Human
gugcugaggauacaguaguaa

SEQ ID NO: 93880 - RNA, 22 nt, Human
gugcugaggugggugggcagcc

SEQ ID NO: 93881 - RNA, 20 nt, Human
gugcugagugaaaugagauu

SEQ ID NO: 93882 - RNA, 22 nt, Human
gugcugagugcagagugcagag

SEQ ID NO: 93883 - RNA, 22 nt, Human
gugcugcagagucucgugccgc

SEQ ID NO: 93884 - RNA, 22 nt, Human
gugcugcaugacuugcuccuga

SEQ ID NO: 93885 - RNA, 22 nt, Human
gugcugccugccagcuucuggg

SEQ ID NO: 93886 - RNA, 21 nt, Human
gugcugcuagcgggacgggag

SEQ ID NO: 93887 - RNA, 22 nt, Human
gugcugcucacaucuggaggua

SEQ ID NO: 93888 - RNA, 20 nt, Human
gugcuggaguuaggaaaggu

SEQ ID NO: 93889 - RNA, 22 nt, Human
gugcuggcuggacauggagcac

SEQ ID NO: 93890 - RNA, 22 nt, Human
gugcuguaacaacagagugucu

SEQ ID NO: 93891 - RNA, 22 nt, Human
gugcugucguggaacugggcug

SEQ ID NO: 93892 - RNA, 22 nt, Human
gugcugugugauccaugcuggc

SEQ ID NO: 93893 - RNA, 22 nt, Human
gugcuguugccuggcugcacgg

SEQ ID NO: 93894 - RNA, 22 nt, Human
gugcuuaaccuaguuucuagua

SEQ ID NO: 93895 - RNA, 22 nt, Human
gugcuuaauacaugucaauaac

SEQ ID NO: 93896 - RNA, 22 nt, Human
gugcuucaaguucuuaauguuu

SEQ ID NO: 93897 - RNA, 20 nt, Human
gugcuucagaagccauugcu

SEQ ID NO: 93898 - RNA, 22 nt, Human
gugcuuccccaagccacagccu

SEQ ID NO: 93899 - RNA, 22 nt, Human
gugcuuccucagagguucccau

SEQ ID NO: 93900 - RNA, 22 nt, Human
gugcuuccucaguguuuaagga

SEQ ID NO: 93901 - RNA, 20 nt, Human
gugcuuccucgcaaguugca

SEQ ID NO: 93902 - RNA, 22 nt, Human
gugcuucucugcucuacccggc

SEQ ID NO: 93903 - RNA, 23 nt, Human
gugcuugaaagaugcagaauuaa

SEQ ID NO: 93904 - RNA, 22 nt, Human
gugcuuggcuuggugugaccug

SEQ ID NO: 93905 - RNA, 21 nt, Human
gugcuuuuccuuaauguucuu

SEQ ID NO: 93906 - RNA, 22 nt, Human
gugcuuuuuauaaggcagacug

SEQ ID NO: 93907 - RNA, 22 nt, Human
gugcuuuuucaaucagaaggga

SEQ ID NO: 93908 - RNA, 19 nt, Human
gcccaggggcccgaugcug

SEQ ID NO: 93909 - RNA, 22 nt, Human
gcccagggugcuuagaacccau

SEQ ID NO: 93910 - RNA, 22 nt, Human
gcccagucucuucuggcccugu

SEQ ID NO: 93911 - RNA, 22 nt, Human
gcccagugcccuagaaugcacu

SEQ ID NO: 93912 - RNA, 22 nt, Human
gcccaucaucacuguggaggcu

SEQ ID NO: 93913 - RNA, 22 nt, Human
gcccaugcucucaggcgggccu

SEQ ID NO: 93914 - RNA, 23 nt, Human
gcccaugcuguugggcccgagca

SEQ ID NO: 93915 - RNA, 22 nt, Human
gcccaugguuacuuuucuggcu

SEQ ID NO: 93916 - RNA, 22 nt, Human
gccccaccugcuaccuuccagc

SEQ ID NO: 93917 - RNA, 22 nt, Human
gccccaccuugagagcagaaac

SEQ ID NO: 93918 - RNA, 22 nt, Human
gccccagauggaggaagcuggg

SEQ ID NO: 93919 - RNA, 22 nt, Human
gccccagccugggaacuggagg

SEQ ID NO: 93920 - RNA, 22 nt, Human
gccccagcguggcuguguuagg

SEQ ID NO: 93921 - RNA, 22 nt, Human
gcccccacaggcgggcucgggu

SEQ ID NO: 93922 - RNA, 18 nt, Human
gcccccagaugcuacuga

SEQ ID NO: 93923 - RNA, 22 nt, Human
gcccccagcucucaagcucaaa

SEQ ID NO: 93924 - RNA, 22 nt, Human
gcccccaggcacuacaugugaa

SEQ ID NO: 93925 - RNA, 21 nt, Human
gcccccuggacuccucaucca

SEQ ID NO: 93926 - RNA, 22 nt, Human
gccccgucguggggccagggau

SEQ ID NO: 93927 - RNA, 22 nt, Human
gcccgcagagaucuuuaacaaa

SEQ ID NO: 93928 - RNA, 22 nt, Human
gcccggccaggaacagaguaua

SEQ ID NO: 93929 - RNA, 17 nt, Human
gcccgugggcuacggua

SEQ ID NO: 93930 - RNA, 22 nt, Human
gcccuagcgccagcucagcacc

SEQ ID NO: 93931 - RNA, 22 nt, Human
gcccuagggcuuuugggccugu

SEQ ID NO: 93932 - RNA, 22 nt, Human
gcccucagaggacagcugacuu

SEQ ID NO: 93933 - RNA, 22 nt, Human
gcccucagcaggaaagaucaac

SEQ ID NO: 93934 - RNA, 17 nt, Human
gcccucagcuuuaacca

SEQ ID NO: 93935 - RNA, 22 nt, Human
gcccucaggcagggagucuuuc

SEQ ID NO: 93936 - RNA, 15 nt, Human
gcccucaggcgacac

SEQ ID NO: 93937 - RNA, 20 nt, Human
gcccucagucuugucuuuau

SEQ ID NO: 93938 - RNA, 22 nt, Human
gcccuccugcaggggcuucugg

SEQ ID NO: 93939 - RNA, 22 nt, Human
gcccucgcuucuuccuaggggu

SEQ ID NO: 93940 - RNA, 20 nt, Human
gcccucugccucccucagcg

SEQ ID NO: 93941 - RNA, 22 nt, Human
gcccugacacuuugcagcugag

SEQ ID NO: 93942 - RNA, 22 nt, Human
gcccugagaagaagucggaggg

SEQ ID NO: 93943 - RNA, 22 nt, Human
gcccugagacugaagaacuguc

SEQ ID NO: 93944 - RNA, 19 nt, Human
gcccugagagcuuggguuc

SEQ ID NO: 93945 - RNA, 22 nt, Human
gcccugagccaccaaugccauu

SEQ ID NO: 93946 - RNA, 22 nt, Human
gcccugagccuaugagccucuc

SEQ ID NO: 93947 - RNA, 22 nt, Human
gcccugaggcaaaagaacaguc

SEQ ID NO: 93948 - RNA, 22 nt, Human
gcccugagugguaccugugggu

SEQ ID NO: 93949 - RNA, 22 nt, Human
gcccugaguugagccuuccaaa

SEQ ID NO: 93950 - RNA, 22 nt, Human
gcccugcaccccaauggcauga

SEQ ID NO: 93951 - RNA, 22 nt, Human
gcccugcccugagccguagacc

SEQ ID NO: 93952 - RNA, 22 nt, Human
gcccugccggguauuuugugcu

SEQ ID NO: 93953 - RNA, 22 nt, Human
gcccugccugccgguguggguc

SEQ ID NO: 93954 - RNA, 23 nt, Human
gcccugcuccuggcugggaggga

SEQ ID NO: 93955 - RNA, 22 nt, Human
gcccugcucuguuggucaccug

SEQ ID NO: 93956 - RNA, 22 nt, Human
gcccugcugucuucagaguaua

SEQ ID NO: 93957 - RNA, 22 nt, Human
gcccugcuguuuagagagcuac

SEQ ID NO: 93958 - RNA, 22 nt, Human
gcccuggagagggauauggcau

SEQ ID NO: 93959 - RNA, 22 nt, Human
gcccuggagcuagacuaggaca

SEQ ID NO: 93960 - RNA, 22 nt, Human
gcccugugagucaugcggcaga

SEQ ID NO: 93961 - RNA, 22 nt, Human
gcccugugauggagacuagagg

SEQ ID NO: 93962 - RNA, 22 nt, Human
gcccugugccagucacgcugug

SEQ ID NO: 93963 - RNA, 22 nt, Human
gcccuguggacagugagaagug

SEQ ID NO: 93964 - RNA, 22 nt, Human
gcccuguuauccagaugaggau

SEQ ID NO: 93965 - RNA, 22 nt, Human
gcccuguucuggacaggcacaa

SEQ ID NO: 93966 - RNA, 22 nt, Human
gcccuuaggcaagcagaagccc

SEQ ID NO: 93967 - RNA, 22 nt, Human
gcccuucacgaugguaucuuag

SEQ ID NO: 93968 - RNA, 22 nt, Human
gcccuuggcaaauucuccuuua

SEQ ID NO: 93969 - RNA, 22 nt, Human
gcccuuuguggucagaggccug

SEQ ID NO: 93970 - RNA, 22 nt, Human
gccgaacuugagggccaggcgg

SEQ ID NO: 93971 - RNA, 22 nt, Human
gccgaggcucugcccagcugcu

SEQ ID NO: 93972 - RNA, 22 nt, Human
gccggggcuggggagagacaug

SEQ ID NO: 93973 - RNA, 22 nt, Human
gccgugucaucugcggguggca

SEQ ID NO: 93974 - RNA, 22 nt, Human
gccguuagauaauaacaagcau

SEQ ID NO: 93975 - RNA, 22 nt, Human
gccuaacuuggcuuuguucacc

SEQ ID NO: 93976 - RNA, 22 nt, Human
gccuaagacugaggcuuuuguc

SEQ ID NO: 93977 - RNA, 22 nt, Human
gccuaauacaugaugauaggua

SEQ ID NO: 93978 - RNA, 22 nt, Human
gccuacaugcuuuuaguguuuc

SEQ ID NO: 93979 - RNA, 22 nt, Human
gccuagagaaaaagccucugca

SEQ ID NO: 93980 - RNA, 22 nt, Human
gccuaggaguggggauggcggu

SEQ ID NO: 93981 - RNA, 21 nt, Human
gccuagggagaugggacugcc

SEQ ID NO: 93982 - RNA, 22 nt, Human
gccuagggaugacaaauauucu

SEQ ID NO: 93983 - RNA, 22 nt, Human
gccucaaauguggagcacuauu

SEQ ID NO: 93984 - RNA, 22 nt, Human
gccucaagacauuuuuaauugc

SEQ ID NO: 93985 - RNA, 22 nt, Human
gccucagagcuacacacacgca

SEQ ID NO: 93986 - RNA, 20 nt, Human
gccucagccaacccaugggg

SEQ ID NO: 93987 - RNA, 22 nt, Human
gccucagcucccagcccaggcu

SEQ ID NO: 93988 - RNA, 22 nt, Human
gccucagggggagaggccagcu

SEQ ID NO: 93989 - RNA, 22 nt, Human
gccucaugagggaucugcccuc

SEQ ID NO: 93990 - RNA, 22 nt, Human
gccucauuacagccaggaagca

SEQ ID NO: 93991 - RNA, 22 nt, Human
gccuccaccccuggggagugga

SEQ ID NO: 93992 - RNA, 21 nt, Human
gccuccagccagauggccucc

SEQ ID NO: 93993 - RNA, 22 nt, Human
gccuccaggguagaggaggaag

SEQ ID NO: 93994 - RNA, 22 nt, Human
gccuccccaggggugucaugag

SEQ ID NO: 93995 - RNA, 22 nt, Human
gccucccugagucacccaagca

SEQ ID NO: 93996 - RNA, 22 nt, Human
gccucccuguagaggccagccu

SEQ ID NO: 93997 - RNA, 22 nt, Human
gccucccuguuuccugcuccaa

SEQ ID NO: 93998 - RNA, 23 nt, Human
gccuccuagcaguaaacauguua

SEQ ID NO: 93999 - RNA, 22 nt, Human
gccuccucacaauguacccacg

SEQ ID NO: 94000 - RNA, 22 nt, Human
gccuccuccuucccgagggucu

SEQ ID NO: 94001 - RNA, 22 nt, Human
guucuucaccaaggucagaggc

SEQ ID NO: 94002 - RNA, 22 nt, Human
guucuuccuggaaguggauuuc

SEQ ID NO: 94003 - RNA, 22 nt, Human
guucuugccagcauccucaggu

SEQ ID NO: 94004 - RNA, 22 nt, Human
guucuuuaaacugcugcucugu

SEQ ID NO: 94005 - RNA, 22 nt, Human
guucuuuaaguggagaaggaaa

SEQ ID NO: 94006 - RNA, 19 nt, Human
guucuuucauaguaagagc

SEQ ID NO: 94007 - RNA, 22 nt, Human
guugaaaaugacuuuauaccau

SEQ ID NO: 94008 - RNA, 22 nt, Human
guugaaauuugugauaauuuag

SEQ ID NO: 94009 - RNA, 22 nt, Human
guugaauacuugagaaauccau

SEQ ID NO: 94010 - RNA, 22 nt, Human
guugaauaucccguaucuuaaa

SEQ ID NO: 94011 - RNA, 22 nt, Human
guugagaguuaagcgggcuaau

SEQ ID NO: 94012 - RNA, 22 nt, Human
guugagcaaggccagagaagcc

SEQ ID NO: 94013 - RNA, 22 nt, Human
guugaggagcaagcaugugucu

SEQ ID NO: 94014 - RNA, 22 nt, Human
guugauuuagugagugagcagu

SEQ ID NO: 94015 - RNA, 22 nt, Human
guugcacacuggcuauaacaag

SEQ ID NO: 94016 - RNA, 22 nt, Human
guugcagauguggaacucgugc

SEQ ID NO: 94017 - RNA, 22 nt, Human
guuugcaaauuauguuaaaagu

SEQ ID NO: 94018 - RNA, 22 nt, Human
guuugccugccgacgcucucau

SEQ ID NO: 94019 - RNA, 22 nt, Human
guuugcugccaccaccgccaca

SEQ ID NO: 94020 - RNA, 22 nt, Human
guuugcugcccucuccuguccg

SEQ ID NO: 94021 - RNA, 22 nt, Human
guuuggaaguuaagugcagcag

SEQ ID NO: 94022 - RNA, 22 nt, Human
guuuggaccucugcuagaugga

SEQ ID NO: 94023 - RNA, 22 nt, Human
guuuggcaguguuauguagguu

SEQ ID NO: 94024 - RNA, 22 nt, Human
guuuggggucugcagagcggcg

SEQ ID NO: 94025 - RNA, 22 nt, Human
guuuggugugaguucauaccac

SEQ ID NO: 94026 - RNA, 22 nt, Human
guuuguaagcagucugcuugug

SEQ ID NO: 94027 - RNA, 22 nt, Human
guuuguaauuacugcagcaugg

SEQ ID NO: 94028 - RNA, 22 nt, Human
guuugucauuuguacuucuagc

SEQ ID NO: 94029 - RNA, 22 nt, Human
guuuguugauaugccccuuugu

SEQ ID NO: 94030 - RNA, 22 nt, Human
guuuguuuauacaaaagauccu

SEQ ID NO: 94031 - RNA, 23 nt, Human
guuuuacaggugagaaaauggag

SEQ ID NO: 94032 - RNA, 22 nt, Human
guuuuaguggguggccacugau

SEQ ID NO: 94033 - RNA, 22 nt, Human
guuuuauaauugcuucauaaga

SEQ ID NO: 94034 - RNA, 23 nt, Human
guuuucaacacaauaaauguaac

SEQ ID NO: 94035 - RNA, 21 nt, Human
guuuucaugauagagucugua

SEQ ID NO: 94036 - RNA, 22 nt, Human
guuuuccuacuguaucaucaaa

SEQ ID NO: 94037 - RNA, 22 nt, Human
guuuuccuguugaguaguauuc

SEQ ID NO: 94038 - RNA, 22 nt, Human
guuuucuaaguagguagcacca

SEQ ID NO: 94039 - RNA, 22 nt, Human
guuuucucaucuccucaauggu

SEQ ID NO: 94040 - RNA, 22 nt, Human
guuuucucuguguuuggaugau

SEQ ID NO: 94041 - RNA, 22 nt, Human
guuuugcucauuugguccaagg

SEQ ID NO: 94042 - RNA, 22 nt, Human
guuuuggcucuggcauguggaa

SEQ ID NO: 94043 - RNA, 22 nt, Human
guuuuguucuuguccagggaaa

SEQ ID NO: 94044 - RNA, 22 nt, Human
guuuuuccugcugacuuggguc

SEQ ID NO: 94045 - RNA, 22 nt, Human
guuuuuccuugcugaggacccg

SEQ ID NO: 94046 - RNA, 20 nt, Human
guuuuucuugggcgagcuau

SEQ ID NO: 94047 - RNA, 19 nt, Human
uaaaaacugaaggaagcag

SEQ ID NO: 94048 - RNA, 22 nt, Human
uaaaaagcagcugagauuuucu

SEQ ID NO: 94049 - RNA, 22 nt, Human
uaaaacacucagcaccuagcaa

SEQ ID NO: 94050 - RNA, 22 nt, Human
uaaaacagcagggcagagaagu

SEQ ID NO: 94051 - RNA, 22 nt, Human
uaaaacuagaccgugagucuaa

SEQ ID NO: 94052 - RNA, 21 nt, Human
uaaaacuguaacuuuguccug

SEQ ID NO: 94053 - RNA, 22 nt, Human
uaaaacuuugaaggugcucagu

SEQ ID NO: 94054 - RNA, 22 nt, Human
uaaaagaagcuucaaggccggc

SEQ ID NO: 94055 - RNA, 22 nt, Human
uaaaagaccacaaggugguaau

SEQ ID NO: 94056 - RNA, 22 nt, Human
uaaaagaucacuggcugcuuua

SEQ ID NO: 94057 - RNA, 22 nt, Human
uaaaagcugagauauccuguac

SEQ ID NO: 94058 - RNA, 22 nt, Human
uaaaaggcacuuggaugcugag

SEQ ID NO: 94059 - RNA, 22 nt, Human
uaaaaguuagcuaggacaaagu

SEQ ID NO: 94060 - RNA, 22 nt, Human
uaaaaucagccgaccauggugg

SEQ ID NO: 94061 - RNA, 22 nt, Human
uaaaaugcacagcaguugaaag

SEQ ID NO: 94062 - RNA, 22 nt, Human
uaaaauguguuucuguaugguu

SEQ ID NO: 94063 - RNA, 22 nt, Human
uaaaauguuugcaagagaccag

SEQ ID NO: 94064 - RNA, 22 nt, Human
uaaacacucacuucauagccau

SEQ ID NO: 94065 - RNA, 22 nt, Human
uaaacacugccuugguggguca

SEQ ID NO: 94066 - RNA, 22 nt, Human
uaaacagaaagcagauguacuu

SEQ ID NO: 94067 - RNA, 22 nt, Human
uaaacagaaugcguaagaagug

SEQ ID NO: 94068 - RNA, 16 nt, Human
uaaacagcagacaguu

SEQ ID NO: 94069 - RNA, 22 nt, Human
uaaacaucaccuucugcaguug

SEQ ID NO: 94070 - RNA, 22 nt, Human
uaaacaucuguagccuucaguc

SEQ ID NO: 94071 - RNA, 22 nt, Human
uaaacauggcuguuucaguuau

SEQ ID NO: 94072 - RNA, 22 nt, Human
uaaacauuuguuauucuuguuu

SEQ ID NO: 94073 - RNA, 18 nt, Human
uaaaccagaugacaguug

SEQ ID NO: 94074 - RNA, 22 nt, Human
uaaaccagguaaagaagcucuc

SEQ ID NO: 94075 - RNA, 22 nt, Human
uaaaccugcaacuauagccacc

SEQ ID NO: 94076 - RNA, 22 nt, Human
uaaaccuguaguugauguaauu

SEQ ID NO: 94077 - RNA, 22 nt, Human
uaaacuacccaugacaguuuca

SEQ ID NO: 94078 - RNA, 22 nt, Human
uaaacuacugggcaaggacagg

SEQ ID NO: 94079 - RNA, 22 nt, Human
uaaacugugaaaggcuuaacau

SEQ ID NO: 94080 - RNA, 22 nt, Human
uaaacuguguaauaugaugucu

SEQ ID NO: 94081 - RNA, 22 nt, Human
uaaagaauaauacccauggagc

SEQ ID NO: 94082 - RNA, 22 nt, Human
uaaagacacccagggagggacu

SEQ ID NO: 94083 - RNA, 22 nt, Human
uaaagacaugcaaagucuaauu

SEQ ID NO: 94084 - RNA, 22 nt, Human
uaaagagcacgcuuuucucucu

SEQ ID NO: 94085 - RNA, 22 nt, Human
uaaagaugcccacauugcaggu

SEQ ID NO: 94086 - RNA, 22 nt, Human
uaaagauggagaugaccuagga

SEQ ID NO: 94087 - RNA, 22 nt, Human
uaaagauguucucauuucauag

SEQ ID NO: 94088 - RNA, 22 nt, Human
uaaagauugcucaaaacuguga

SEQ ID NO: 94089 - RNA, 22 nt, Human
uaaagcaaggaauagaguaguc

SEQ ID NO: 94090 - RNA, 22 nt, Human
uaaagcaauuacucaguggcuu

SEQ ID NO: 94091 - RNA, 22 nt, Human
uaaagcaauuugagcaaguucu

SEQ ID NO: 94092 - RNA, 19 nt, Human
uaaagcacauagcaaaagu

SEQ ID NO: 94093 - RNA, 22 nt, Human
uaaagcacgucuauuuaaugau

SEQ ID NO: 94094 - RNA, 22 nt, Human
uaaagcauaaugaauaucuaga

SEQ ID NO: 94095 - RNA, 22 nt, Human
uaaagcauguacugugugcuag

SEQ ID NO: 94096 - RNA, 22 nt, Human
uaaagcauguguuagaagugca

SEQ ID NO: 94097 - RNA, 22 nt, Human
uaaagcauguuucaguaagguu

SEQ ID NO: 94098 - RNA, 22 nt, Human
uaaagccacgcuggaaaucagg

SEQ ID NO: 94099 - RNA, 21 nt, Human
uaaagcuagaaccuuagcuuu

SEQ ID NO: 94100 - RNA, 22 nt, Human
uaaagcuagaaggugcuguaca

SEQ ID NO: 94101 - RNA, 22 nt, Human
uaaaggaacagaggacucauuu

SEQ ID NO: 94102 - RNA, 22 nt, Human
uaaaggauaacuuucaagaauu

SEQ ID NO: 94103 - RNA, 22 nt, Human
uaaaggauuuuguauaauauaa

SEQ ID NO: 94104 - RNA, 22 nt, Human
uaaaggcaauucagcaagccac

SEQ ID NO: 94105 - RNA, 22 nt, Human
uaaaggcagccuaggaaguguu

SEQ ID NO: 94106 - RNA, 22 nt, Human
uaaaggcaguuggaguugagga

SEQ ID NO: 94107 - RNA, 22 nt, Human
uaaaggcucguauuguugugug

SEQ ID NO: 94108 - RNA, 21 nt, Human
uaaaggcuuuagaauggcaaa

SEQ ID NO: 94109 - RNA, 22 nt, Human
uaaaggcuuuuacaggagugca

SEQ ID NO: 94110 - RNA, 22 nt, Human
uaaaggcuuuuagugaugguaa

SEQ ID NO: 94111 - RNA, 22 nt, Human
uaaagguagcaugaaacugcaa

SEQ ID NO: 94112 - RNA, 22 nt, Human
uaaagguuauaaagguuagggg

SEQ ID NO: 94113 - RNA, 23 nt, Human
uaaagucacauauuagagugagc

SEQ ID NO: 94114 - RNA, 22 nt, Human
uaaagucagggagauugaggcu

SEQ ID NO: 94115 - RNA, 22 nt, Human
uaaaguccuugaaccggaugua

SEQ ID NO: 94116 - RNA, 22 nt, Human
uaaagugaguacaaaaugaggg

SEQ ID NO: 94117 - RNA, 22 nt, Human
uaaagugcagacucccggaaac

SEQ ID NO: 94118 - RNA, 22 nt, Human
uaaagugcccagggaaagcggg

SEQ ID NO: 94119 - RNA, 22 nt, Human
gcuacauaguaacccacaaauc

SEQ ID NO: 94120 - RNA, 20 nt, Human
gcuacugugggaaaauugug

SEQ ID NO: 94121 - RNA, 22 nt, Human
gcuagaauauuggguaggcaag

SEQ ID NO: 94122 - RNA, 22 nt, Human
gcuagagaccagaggccuugaa

SEQ ID NO: 94123 - RNA, 22 nt, Human
gcuagcaaguggcauagcaggg

SEQ ID NO: 94124 - RNA, 22 nt, Human
gcuaggagccgcugcacuaggu

SEQ ID NO: 94125 - RNA, 22 nt, Human
gcuaggaggcccugcacgcuua

SEQ ID NO: 94126 - RNA, 22 nt, Human
uaaagugucugccucagcucag

SEQ ID NO: 94127 - RNA, 22 nt, Human
uaaaguguguggguucuaaauu

SEQ ID NO: 94128 - RNA, 22 nt, Human
uaaaguguuguacaaauguaug

SEQ ID NO: 94129 - RNA, 19 nt, Human
uaaaguugaaaucaagucc

SEQ ID NO: 94130 - RNA, 22 nt, Human
uaaaguuggaccugauuuuauu

SEQ ID NO: 94131 - RNA, 22 nt, Human
uaaaguuuauuugaacaucucu

SEQ ID NO: 94132 - RNA, 21 nt, Human
uaaauaauaaguugcugagau

SEQ ID NO: 94133 - RNA, 22 nt, Human
uaaauacagucauuugagccau

SEQ ID NO: 94134 - RNA, 22 nt, Human
uaaauacugaguuggaguuggc

SEQ ID NO: 94135 - RNA, 22 nt, Human
uaaaucacauuuucuuuguguu

SEQ ID NO: 94136 - RNA, 22 nt, Human
uaaaucacccaucuccuaaucu

SEQ ID NO: 94137 - RNA, 22 nt, Human
uaaaucacuccuaauaaucagu

SEQ ID NO: 94138 - RNA, 22 nt, Human
uaaaucacucuucucucaccac

SEQ ID NO: 94139 - RNA, 22 nt, Human
uaaaucacuguacuuuauuccu

SEQ ID NO: 94140 - RNA, 22 nt, Human
uaaaucaguuucucuuauuggu

SEQ ID NO: 94141 - RNA, 22 nt, Human
uaaaucccuacaucuguguuuu

SEQ ID NO: 94142 - RNA, 18 nt, Human
uaaaucucucuuuaguca

SEQ ID NO: 94143 - RNA, 21 nt, Human
uaaaucucuguauucuucagu

SEQ ID NO: 94144 - RNA, 16 nt, Human
uaaaucugugaucaca

SEQ ID NO: 94145 - RNA, 22 nt, Human
uaaaucuuuaggaagcucaaac

SEQ ID NO: 94146 - RNA, 22 nt, Human
uaaaugaaaggguuuaauuuau

SEQ ID NO: 94147 - RNA, 22 nt, Human
uaaaugcaagggaaaggcaaga

SEQ ID NO: 94148 - RNA, 22 nt, Human
uaaaugcaaugugcuuuaccag

SEQ ID NO: 94149 - RNA, 22 nt, Human
uaaaugcucaauaaauguugcu

SEQ ID NO: 94150 - RNA, 22 nt, Human
uaaaugcucagaccuuauucca

SEQ ID NO: 94151 - RNA, 22 nt, Human
uaaaugguauccuugcugugcu

SEQ ID NO: 94152 - RNA, 22 nt, Human
uaaauguacugaggcaacagga

SEQ ID NO: 94153 - RNA, 22 nt, Human
uaaauguagucaaaggagccuc

SEQ ID NO: 94154 - RNA, 22 nt, Human
uaaaugugaccuucauuuuaua

SEQ ID NO: 94155 - RNA, 22 nt, Human
uaaaugugagugaugcggugaa

SEQ ID NO: 94156 - RNA, 22 nt, Human
uaaauguguuagucaugguuuu

SEQ ID NO: 94157 - RNA, 22 nt, Human
uaaauguuaugcccaucaucca

SEQ ID NO: 94158 - RNA, 22 nt, Human
uaaauguuggcauuggaggccg

SEQ ID NO: 94159 - RNA, 22 nt, Human
uaaauguuguaaguacaucuaa

SEQ ID NO: 94160 - RNA, 20 nt, Human
uaaauuagccuugaagauua

SEQ ID NO: 94161 - RNA, 22 nt, Human
uaaauuaugucacaugacucug

SEQ ID NO: 94162 - RNA, 22 nt, Human
uaaauucccaacucugcucuuc

SEQ ID NO: 94163 - RNA, 22 nt, Human
uaaauuuacccaaggaacaugu

SEQ ID NO: 94164 - RNA, 23 nt, Human
uaaauuucuugauucuuauguga

SEQ ID NO: 94165 - RNA, 22 nt, Human
uaacaaaguaccauagauuggg

SEQ ID NO: 94166 - RNA, 22 nt, Human
uaacaacugcugagguauuuga

SEQ ID NO: 94167 - RNA, 19 nt, Human
uaacaagcacucugcauuc

SEQ ID NO: 94168 - RNA, 22 nt, Human
uaacaagucauuuuaucagcag

SEQ ID NO: 94169 - RNA, 22 nt, Human
uaacaaguucugacagcauugu

SEQ ID NO: 94170 - RNA, 22 nt, Human
uaacaaguuucauuuauagaau

SEQ ID NO: 94171 - RNA, 22 nt, Human
uaacaauggaguuuugagaaag

SEQ ID NO: 94172 - RNA, 22 nt, Human
uaacacauaucuacaacaugug

SEQ ID NO: 94173 - RNA, 22 nt, Human
uaacacauauuucaagaguagu

SEQ ID NO: 94174 - RNA, 22 nt, Human
uaacacauuaguucuccuagau

SEQ ID NO: 94175 - RNA, 22 nt, Human
uaacacauuuuaagccauuuua

SEQ ID NO: 94176 - RNA, 21 nt, Human
uaacacauuuugguacuuugg

SEQ ID NO: 94177 - RNA, 22 nt, Human
uaacacuauccagauaugauaa

SEQ ID NO: 94178 - RNA, 22 nt, Human
uaacacugaaaaugaugcaugu

SEQ ID NO: 94179 - RNA, 22 nt, Human
uaacacugauuuguucucaggg

SEQ ID NO: 94180 - RNA, 22 nt, Human
uaacacugguuaucccugugca

SEQ ID NO: 94181 - RNA, 22 nt, Human
uaacacugugucugccauaucc

SEQ ID NO: 94182 - RNA, 20 nt, Human
uaacacuugcuuuuugacuu

SEQ ID NO: 94183 - RNA, 22 nt, Human
uaacagaaaggcucaggugcuc

SEQ ID NO: 94184 - RNA, 22 nt, Human
uaacagaaauaguaggugaggg

SEQ ID NO: 94185 - RNA, 22 nt, Human
uaacagaagaugaaacuucuuu

SEQ ID NO: 94186 - RNA, 20 nt, Human
uaacagaaguagaagugggu

SEQ ID NO: 94187 - RNA, 22 nt, Human
uaacagagguagaauucaaggu

SEQ ID NO: 94188 - RNA, 21 nt, Human
uaacagcagggaaauacgugc

SEQ ID NO: 94189 - RNA, 22 nt, Human
uaacagcucuguguggcuguaa

SEQ ID NO: 94190 - RNA, 20 nt, Human
uaacagggcccuagaaagag

SEQ ID NO: 94191 - RNA, 22 nt, Human
uaacaguaaaguaaguuagcuu

SEQ ID NO: 94192 - RNA, 22 nt, Human
uaacaguauagccuaacauuuc

SEQ ID NO: 94193 - RNA, 22 nt, Human
uaacauaacuuuuccuugaccc

SEQ ID NO: 94194 - RNA, 20 nt, Human
uaacauaguccagagaacga

SEQ ID NO: 94195 - RNA, 22 nt, Human
uaacaucaaacugcauuuucua

SEQ ID NO: 94196 - RNA, 22 nt, Human
uaacaucuuaacuggauacuuc

SEQ ID NO: 94197 - RNA, 18 nt, Human
uaacauguuuucauuaag

SEQ ID NO: 94198 - RNA, 22 nt, Human
uaacauuacggacaucugucag

SEQ ID NO: 94199 - RNA, 22 nt, Human
uaacauugaguccacuaaacag

SEQ ID NO: 94200 - RNA, 22 nt, Human
uaacauuguuaugaaucagguc

SEQ ID NO: 94201 - RNA, 22 nt, Human
uaacauuuaaauuuuucacaua

SEQ ID NO: 94202 - RNA, 22 nt, Human
uaacauuuagaaaguguccauu

SEQ ID NO: 94203 - RNA, 16 nt, Human
uaacauuuuuaaaagg

SEQ ID NO: 94204 - RNA, 22 nt, Human
uaaccauauuuuccauuaaguu

SEQ ID NO: 94205 - RNA, 22 nt, Human
uaacccaauaauugguggccuu

SEQ ID NO: 94206 - RNA, 22 nt, Human
uaaccuacaugagaacuuuaaa

SEQ ID NO: 94207 - RNA, 22 nt, Human
uaaccuacuaugauucugggaa

SEQ ID NO: 94208 - RNA, 17 nt, Human
uaaccucucugaaccug

SEQ ID NO: 94209 - RNA, 22 nt, Human
uaaccuggggcgguuucccaau

SEQ ID NO: 94210 - RNA, 22 nt, Human
uaaccuuuguucaauguaagau

SEQ ID NO: 94211 - RNA, 22 nt, Human
uaacuacuaauugaugauaaug

SEQ ID NO: 94212 - RNA, 22 nt, Human
uaacuagaauggcuauuuugag

SEQ ID NO: 94213 - RNA, 22 nt, Human
uaacuagauauagacuuucuac

SEQ ID NO: 94214 - RNA, 22 nt, Human
uaacuaggauuacaagcgugcg

SEQ ID NO: 94215 - RNA, 22 nt, Human
uaacucuagucccaggcaugaa

SEQ ID NO: 94216 - RNA, 22 nt, Human
uaacugauauugaaaaacauca

SEQ ID NO: 94217 - RNA, 22 nt, Human
uaacugcaaccuccaucuugug

SEQ ID NO: 94218 - RNA, 22 nt, Human
uaacugcaccaucaaauuagag

SEQ ID NO: 94219 - RNA, 22 nt, Human
uaacugguauaucaguguacac

SEQ ID NO: 94220 - RNA, 22 nt, Human
uaacuggugaguaggauuuaua

SEQ ID NO: 94221 - RNA, 22 nt, Human
uaacugguuaagggugaaaucc

SEQ ID NO: 94222 - RNA, 22 nt, Human
uaacugguuucauaucauuucc

SEQ ID NO: 94223 - RNA, 22 nt, Human
uaacuguuuuugaaauauaucu

SEQ ID NO: 94224 - RNA, 22 nt, Human
uaacuucagcgaguucucuuaa

SEQ ID NO: 94225 - RNA, 22 nt, Human
uaacuucucugagccucauucc

SEQ ID NO: 94226 - RNA, 22 nt, Human
uaacuucucugcuaucauagga

SEQ ID NO: 94227 - RNA, 22 nt, Human
uaacuucuggaaaugcaucugc

SEQ ID NO: 94228 - RNA, 22 nt, Human
uaacuugauaaguauucucugc

SEQ ID NO: 94229 - RNA, 22 nt, Human
uaacuuugaucacuugauaagg

SEQ ID NO: 94230 - RNA, 22 nt, Human
uaagaaacuauugucucugaac

SEQ ID NO: 94231 - RNA, 22 nt, Human
uaagaacaagcuggggguucca

SEQ ID NO: 94232 - RNA, 22 nt, Human
uaagaacagugacagccaacau

SEQ ID NO: 94233 - RNA, 22 nt, Human
uaagaacaucuguccccagauu

SEQ ID NO: 94234 - RNA, 22 nt, Human
uaagaaggguacaauaaggcau

SEQ ID NO: 94235 - RNA, 22 nt, Human
gccuuauuuuacuuggauucug

SEQ ID NO: 94236 - RNA, 21 nt, Human
gccuucacucccagaguuugu

SEQ ID NO: 94237 - RNA, 22 nt, Human
uaagaaucugcauuuuaacaag

SEQ ID NO: 94238 - RNA, 22 nt, Human
uaagaaugacaaccauaccauu

SEQ ID NO: 94239 - RNA, 22 nt, Human
uaagacaagccucgcauuugua

SEQ ID NO: 94240 - RNA, 22 nt, Human
uaagacacaugcguacaagaua

SEQ ID NO: 94241 - RNA, 22 nt, Human
uaagacauaccaaguuguguga

SEQ ID NO: 94242 - RNA, 22 nt, Human
uaagacuaguugaaugguuuuc

SEQ ID NO: 94243 - RNA, 22 nt, Human
uaagacugugagcucagagacu

SEQ ID NO: 94244 - RNA, 22 nt, Human
uaagacuuccaggaaaaggugg

SEQ ID NO: 94245 - RNA, 22 nt, Human
uaagagaaggaucuguuccagg

SEQ ID NO: 94246 - RNA, 22 nt, Human
uaagagaauguuguggcuaggu

SEQ ID NO: 94247 - RNA, 18 nt, Human
uaagagcagacuguaggc

SEQ ID NO: 94248 - RNA, 22 nt, Human
uaagagcagagguugaauaaau

SEQ ID NO: 94249 - RNA, 22 nt, Human
uaagagcuccaauauuuguggc

SEQ ID NO: 94250 - RNA, 22 nt, Human
uaagagcuuagcuaaggaugug

SEQ ID NO: 94251 - RNA, 22 nt, Human
uaagaggauauuuggccagaag

SEQ ID NO: 94252 - RNA, 22 nt, Human
uaagaguaagugauuaagaaga

SEQ ID NO: 94253 - RNA, 22 nt, Human
uaagaguuacugguuuagaacc

SEQ ID NO: 94254 - RNA, 22 nt, Human
uaagauaaggaacauucuguga

SEQ ID NO: 94255 - RNA, 22 nt, Human
uaagauaauaaguaugucuaug

SEQ ID NO: 94256 - RNA, 22 nt, Human
uaagauagaacucugaggcuac

SEQ ID NO: 94257 - RNA, 20 nt, Human
uaagaugagcuauaagaagu

SEQ ID NO: 94258 - RNA, 22 nt, Human
uaagaugagguagguaagacuu

SEQ ID NO: 94259 - RNA, 22 nt, Human
uaagaugaucaccaaaugcugg

SEQ ID NO: 94260 - RNA, 22 nt, Human
uaagaugggggaaagaaauagu

SEQ ID NO: 94261 - RNA, 22 nt, Human
uaagauguacuuuuguccucac

SEQ ID NO: 94262 - RNA, 22 nt, Human
uaagaugucuaagaggagaugc

SEQ ID NO: 94263 - RNA, 22 nt, Human
uaagauuacagugagaaauaaa

SEQ ID NO: 94264 - RNA, 22 nt, Human
uaagauuauacuuaaagagaaa

SEQ ID NO: 94265 - RNA, 22 nt, Human
uaagcaaaagucgagugugagc

SEQ ID NO: 94266 - RNA, 22 nt, Human
uaagcaaaguuuauaaggcucu

SEQ ID NO: 94267 - RNA, 22 nt, Human
uaagcaaauagcuagaucagag

SEQ ID NO: 94268 - RNA, 22 nt, Human
uaagcaagauuuauugaauuuu

SEQ ID NO: 94269 - RNA, 22 nt, Human
uaagcaaucuguaguuggaauc

SEQ ID NO: 94270 - RNA, 22 nt, Human
uaagcaaugcuguaguucaguc

SEQ ID NO: 94271 - RNA, 22 nt, Human
uaagcagagcccucuuuauuag

SEQ ID NO: 94272 - RNA, 22 nt, Human
uaagcaggugccuucugugacc

SEQ ID NO: 94273 - RNA, 22 nt, Human
uaagcauaagauacaugagaca

SEQ ID NO: 94274 - RNA, 22 nt, Human
uaagcauaguaccguagcagcu

SEQ ID NO: 94275 - RNA, 22 nt, Human
uaagccauacauuucagacucu

SEQ ID NO: 94276 - RNA, 22 nt, Human
uaagcccaggaaugcacuucag

SEQ ID NO: 94277 - RNA, 21 nt, Human
uaagcuaaacauucaguuaac

SEQ ID NO: 94278 - RNA, 22 nt, Human
uaagcuaacguccauggaaaug

SEQ ID NO: 94279 - RNA, 22 nt, Human
uaagcuggggcuaugcuaaaua

SEQ ID NO: 94280 - RNA, 22 nt, Human
uaagcugugggagauuggcaua

SEQ ID NO: 94281 - RNA, 21 nt, Human
uaaggaagagcauuuuagguc

SEQ ID NO: 94282 - RNA, 22 nt, Human
uaaggaagagcuugguaauagg

SEQ ID NO: 94283 - RNA, 22 nt, Human
uaaggacaaucagguuaguagc

SEQ ID NO: 94284 - RNA, 22 nt, Human
uaaggcaauggcauucuugaca

SEQ ID NO: 94285 - RNA, 22 nt, Human
uaaggcaccauaauauauuuaa

SEQ ID NO: 94286 - RNA, 22 nt, Human
uaaggcacgcauaagagggggc

SEQ ID NO: 94287 - RNA, 22 nt, Human
uaaggcagagguaccacuaggc

SEQ ID NO: 94288 - RNA, 22 nt, Human
uaaggcagcugagcuucuaaca

SEQ ID NO: 94289 - RNA, 22 nt, Human
uaaggcaggacuggauagcuau

SEQ ID NO: 94290 - RNA, 22 nt, Human
uaaggcagguaugguaccaggc

SEQ ID NO: 94291 - RNA, 22 nt, Human
uaaggcagugagaagaaacagg

SEQ ID NO: 94292 - RNA, 20 nt, Human
uaaggcaucaaguuugggua

SEQ ID NO: 94293 - RNA, 18 nt, Human
uaaggcauucuuauguga

SEQ ID NO: 94294 - RNA, 22 nt, Human
uaaggcuaggaauucucugaag

SEQ ID NO: 94295 - RNA, 22 nt, Human
uaaggcucauguaauuagagau

SEQ ID NO: 94296 - RNA, 22 nt, Human
uaaggcuguuaggaggauuaaa

SEQ ID NO: 94297 - RNA, 22 nt, Human
uaaggcuuuuaaagguucacca

SEQ ID NO: 94298 - RNA, 22 nt, Human
uaaggcuuuuguucagcguggg

SEQ ID NO: 94299 - RNA, 22 nt, Human
uaaggguucagaaugcaguggu

SEQ ID NO: 94300 - RNA, 22 nt, Human
uaagguuucuucagauacuagu

SEQ ID NO: 94301 - RNA, 22 nt, Human
uaagguuuggcugucucuuggu

SEQ ID NO: 94302 - RNA, 22 nt, Human
uaagguuuugagaccagaacgu

SEQ ID NO: 94303 - RNA, 22 nt, Human
uaaguaaauuuauaaugugauu

SEQ ID NO: 94304 - RNA, 22 nt, Human
uaaguaacugcauaauuaaauu

SEQ ID NO: 94305 - RNA, 22 nt, Human
uaaguaauugcagcaauuugcc

SEQ ID NO: 94306 - RNA, 22 nt, Human
uaaguacaaauguauacauaag

SEQ ID NO: 94307 - RNA, 22 nt, Human
uaaguagaugcaaaauggaguu

SEQ ID NO: 94308 - RNA, 22 nt, Human
uaaguagucagacauaccccau

SEQ ID NO: 94309 - RNA, 22 nt, Human
uaaguaguccugauuuaaccuu

SEQ ID NO: 94310 - RNA, 22 nt, Human
uaaguaguuccauccaaacagc

SEQ ID NO: 94311 - RNA, 22 nt, Human
uaagucauaagucaacaaagga

SEQ ID NO: 94312 - RNA, 22 nt, Human
uaagucaugauucuguguuacu

SEQ ID NO: 94313 - RNA, 18 nt, Human
uaagucauuugaaaugcc

SEQ ID NO: 94314 - RNA, 22 nt, Human
uaagucauuuggagccacugga

SEQ ID NO: 94315 - RNA, 22 nt, Human
uaaguccaaggguaugaguugg

SEQ ID NO: 94316 - RNA, 22 nt, Human
uaaguccacaggaguuguguuc

SEQ ID NO: 94317 - RNA, 22 nt, Human
uaaguccacaggcugacagcgg

SEQ ID NO: 94318 - RNA, 22 nt, Human
uaaguccacuauauccuucucu

SEQ ID NO: 94319 - RNA, 22 nt, Human
uaaguccuucaccuaauccuca

SEQ ID NO: 94320 - RNA, 22 nt, Human
uaagugaaauggugcaucaaau

SEQ ID NO: 94321 - RNA, 22 nt, Human
uaagugaauuguccgaggacac

SEQ ID NO: 94322 - RNA, 20 nt, Human
uaagugagaacaugugguau

SEQ ID NO: 94323 - RNA, 22 nt, Human
uaagugagcuagcagaagugac

SEQ ID NO: 94324 - RNA, 22 nt, Human
uaagugagggagcugggacuug

SEQ ID NO: 94325 - RNA, 22 nt, Human
uaagugaguucuugcuagauuu

SEQ ID NO: 94326 - RNA, 23 nt, Human
uaagugauaaagaguagagaugg

SEQ ID NO: 94327 - RNA, 22 nt, Human
uaagugcaucugaucuuucaug

SEQ ID NO: 94328 - RNA, 22 nt, Human
uaaguggguuuguaaugugccu

SEQ ID NO: 94329 - RNA, 22 nt, Human
uaagugguugcuuguuuucauu

SEQ ID NO: 94330 - RNA, 22 nt, Human
uaagugucccuauugugauuuu

SEQ ID NO: 94331 - RNA, 22 nt, Human
uaagugucuaaaaggcagaacu

SEQ ID NO: 94332 - RNA, 22 nt, Human
uaaguguugaucugagugcuaa

SEQ ID NO: 94333 - RNA, 22 nt, Human
uaaguguugguaauuacaauga

SEQ ID NO: 94334 - RNA, 22 nt, Human
uaaguguuucuccagugucuuu

SEQ ID NO: 94335 - RNA, 22 nt, Human
uaaguuacacuuaacuuacuag

SEQ ID NO: 94336 - RNA, 22 nt, Human
uaaguuagagguuaggcacuua

SEQ ID NO: 94337 - RNA, 22 nt, Human
uaaguuagcaaggccaagguaa

SEQ ID NO: 94338 - RNA, 22 nt, Human
uaaguucaaaucaucccaacuu

SEQ ID NO: 94339 - RNA, 22 nt, Human
uaaguuccuggaaggcaaggau

SEQ ID NO: 94340 - RNA, 22 nt, Human
uaaguucucagaagauuuugua

SEQ ID NO: 94341 - RNA, 22 nt, Human
uaaguucucugaaaugaaaaag

SEQ ID NO: 94342 - RNA, 22 nt, Human
uaaguucugaagauaggaaaug

SEQ ID NO: 94343 - RNA, 21 nt, Human
uaaguucugaucccuaucaac

SEQ ID NO: 94344 - RNA, 22 nt, Human
uaaguuuaagucauguuugaug

SEQ ID NO: 94345 - RNA, 22 nt, Human
uaaguuuagagagaauggggac

SEQ ID NO: 94346 - RNA, 22 nt, Human
uaaguuuauagauaaaugccua

SEQ ID NO: 94347 - RNA, 22 nt, Human
uaaguuucuacuugucgggucu

SEQ ID NO: 94348 - RNA, 22 nt, Human
gccuucaggugucccugugggc

SEQ ID NO: 94349 - RNA, 22 nt, Human
gccuucaguaacugagacggaa

SEQ ID NO: 94350 - RNA, 22 nt, Human
gccuuccaggcagggggagcag

SEQ ID NO: 94351 - RNA, 22 nt, Human
gccuucccaagacgccugaguu

SEQ ID NO: 94352 - RNA, 17 nt, Human
gccuuccuuccuccaca

SEQ ID NO: 94353 - RNA, 22 nt, Human
gccuuccuuuuaccaccagcca

SEQ ID NO: 94354 - RNA, 22 nt, Human
gccuucucccuaaccaaauccu

SEQ ID NO: 94355 - RNA, 17 nt, Human
gccuucucugcccucac

SEQ ID NO: 94356 - RNA, 22 nt, Human
gccuucugcgcucgugucuccg

SEQ ID NO: 94357 - RNA, 15 nt, Human
gccuugaaugugaau

SEQ ID NO: 94358 - RNA, 22 nt, Human
gccuugccucagccauggaaac

SEQ ID NO: 94359 - RNA, 22 nt, Human
gccuugcuuugcuucuggacag

SEQ ID NO: 94360 - RNA, 22 nt, Human
gccuuggacucggguggacuca

SEQ ID NO: 94361 - RNA, 23 nt, Human
gccuuggcgauccguggggcauc

SEQ ID NO: 94362 - RNA, 22 nt, Human
gccuuggcugaugugcgaauga

SEQ ID NO: 94363 - RNA, 22 nt, Human
gccuuggcuguuggagcuugau

SEQ ID NO: 94364 - RNA, 22 nt, Human
gccuuuaucuugggccaaguuu

SEQ ID NO: 94365 - RNA, 22 nt, Human
gccuuuaugucugaaaaucagc

SEQ ID NO: 94366 - RNA, 22 nt, Human
gccuuuauuguuuauucagugc

SEQ ID NO: 94367 - RNA, 18 nt, Human
gccuuugcacaagcagcu

SEQ ID NO: 94368 - RNA, 22 nt, Human
gccuuugcaccaucagugcaau

SEQ ID NO: 94369 - RNA, 22 nt, Human
gccuuuggagaugucauaggau

SEQ ID NO: 94370 - RNA, 21 nt, Human
gccuuugguuucuuguccugc

SEQ ID NO: 94371 - RNA, 22 nt, Human
gccuuuguaacucuuuuauugu

SEQ ID NO: 94372 - RNA, 22 nt, Human
gcgaaucucagcuggugcugcg

SEQ ID NO: 94373 - RNA, 22 nt, Human
gcgacagugcggccaccuucau

SEQ ID NO: 94374 - RNA, 22 nt, Human
gcgaggaggggugcugggcccc

SEQ ID NO: 94375 - RNA, 22 nt, Human
gcgaggcugggcccugcaggcg

SEQ ID NO: 94376 - RNA, 22 nt, Human
gcgcacauguucagauguguga

SEQ ID NO: 94377 - RNA, 22 nt, Human
gcgcacugggcgcacgcguagg

SEQ ID NO: 94378 - RNA, 22 nt, Human
gcgccuggcacacagcaagggc

SEQ ID NO: 94379 - RNA, 22 nt, Human
gcgcgggguacacgcgguggcc

SEQ ID NO: 94380 - RNA, 22 nt, Human
gcgcugccucugcucuccccac

SEQ ID NO: 94381 - RNA, 22 nt, Human
gcggaaaugcagggcuagggug

SEQ ID NO: 94382 - RNA, 22 nt, Human
gcggaagcgguagucacccucg

SEQ ID NO: 94383 - RNA, 22 nt, Human
gcggagaggcagagacuccgcg

SEQ ID NO: 94384 - RNA, 22 nt, Human
gcggccuuguggcggagcaggc

SEQ ID NO: 94385 - RNA, 22 nt, Human
gcgggcagggcacugguccccu

SEQ ID NO: 94386 - RNA, 22 nt, Human
gcgggcgcucaggcugcagcug

SEQ ID NO: 94387 - RNA, 19 nt, Human
gcgggcggcgccugcgagg

SEQ ID NO: 94388 - RNA, 22 nt, Human
gcguccagggaaggcccagcug

SEQ ID NO: 94389 - RNA, 22 nt, Human
gcgugcauggccguguguaugc

SEQ ID NO: 94390 - RNA, 22 nt, Human
gcguggagacaacucuggggug

SEQ ID NO: 94391 - RNA, 22 nt, Human
gcguggcuccuaacagaucuga

SEQ ID NO: 94392 - RNA, 22 nt, Human
gcguggugcugcccugcacaca

SEQ ID NO: 94393 - RNA, 22 nt, Human
gcgugugugauaugccucugca

SEQ ID NO: 94394 - RNA, 22 nt, Human
gcguuuguuuugcuggcgccag

SEQ ID NO: 94395 - RNA, 22 nt, Human
gcuaaaugaugggaaaucuggg

SEQ ID NO: 94396 - RNA, 22 nt, Human
gcuaacauugauucagugccug

SEQ ID NO: 94397 - RNA, 23 nt, Human
gcuaagaaccuggguacgcaacu

SEQ ID NO: 94398 - RNA, 15 nt, Human
gcuaaggcauuggua

SEQ ID NO: 94399 - RNA, 22 nt, Human
gcuaagugguuuucuucuccuc

SEQ ID NO: 94400 - RNA, 22 nt, Human
gcuaauaauuccuuugugaacu

SEQ ID NO: 94401 - RNA, 22 nt, Human
gcuacaaagugguaggagguca

SEQ ID NO: 94402 - RNA, 22 nt, Human
gcuacaggggucaguccuuugc

SEQ ID NO: 94403 - RNA, 22 nt, Human
gcuacaggugacagccucugca

SEQ ID NO: 94404 - RNA, 22 nt, Human
gcuacaguagauaaggacgguc

SEQ ID NO: 94405 - RNA, 22 nt, Human
gcuacuuugcagcuagcuagga

SEQ ID NO: 94406 - RNA, 22 nt, Human
gcuagaaacuguuuaaucucuu

SEQ ID NO: 94407 - RNA, 22 nt, Human
gcuagaaaucgacuucagaauu

SEQ ID NO: 94408 - RNA, 22 nt, Human
gcuagaggcaacaacuuuauag

SEQ ID NO: 94409 - RNA, 22 nt, Human
gcuagaucucucauaaauucca

SEQ ID NO: 94410 - RNA, 22 nt, Human
gcuagcagaaagcaggcugcuc

SEQ ID NO: 94411 - RNA, 22 nt, Human
gcuagcuuuauaaugcugggcg

SEQ ID NO: 94412 - RNA, 22 nt, Human
gcuaggaagcuggggagaaguc

SEQ ID NO: 94413 - RNA, 17 nt, Human
gcuaggagagggaggag

SEQ ID NO: 94414 - RNA, 22 nt, Human
gcuaggaggaagaaugugaauu

SEQ ID NO: 94415 - RNA, 22 nt, Human
gcuaggcucuuccaucagggca

SEQ ID NO: 94416 - RNA, 22 nt, Human
gcuagggagacuugugucauca

SEQ ID NO: 94417 - RNA, 19 nt, Human
gcuaggguugguggcgugc

SEQ ID NO: 94418 - RNA, 19 nt, Human
gcuaggugaccagcuggau

SEQ ID NO: 94419 - RNA, 22 nt, Human
gcuauacaaguguagaauagag

SEQ ID NO: 94420 - RNA, 21 nt, Human
gcuauacagaauggccagagg

SEQ ID NO: 94421 - RNA, 22 nt, Human
gcuaucuuucugcaccauaauu

SEQ ID NO: 94422 - RNA, 22 nt, Human
gcuaugaacaugagaaugcaaa

SEQ ID NO: 94423 - RNA, 22 nt, Human
gcuauguuagacauucucauuu

SEQ ID NO: 94424 - RNA, 22 nt, Human
gcuauucaucaauuguucuagc

SEQ ID NO: 94425 - RNA, 22 nt, Human
gcucaaagaauauucagaauga

SEQ ID NO: 94426 - RNA, 22 nt, Human
gcucaaagcacuuugcaaauau

SEQ ID NO: 94427 - RNA, 22 nt, Human
gcucaaaggccagguagcagca

SEQ ID NO: 94428 - RNA, 22 nt, Human
gcucaaagguugauagcugugc

SEQ ID NO: 94429 - RNA, 22 nt, Human
gcucaaauuucagacucaugaa

SEQ ID NO: 94430 - RNA, 22 nt, Human
gcucaagagagaugcaguucuu

SEQ ID NO: 94431 - RNA, 22 nt, Human
gcucaaggcaggcagacaugag

SEQ ID NO: 94432 - RNA, 22 nt, Human
gcucaaugcucaaugcugcaaa

SEQ ID NO: 94433 - RNA, 23 nt, Human
gcucacagaauguugaagggaau

SEQ ID NO: 94434 - RNA, 22 nt, Human
gcucacaggucuguggcuauug

SEQ ID NO: 94435 - RNA, 22 nt, Human
gcucacaucauaguaagcucau

SEQ ID NO: 94436 - RNA, 22 nt, Human
gcucaccuucguccagcagccg

SEQ ID NO: 94437 - RNA, 22 nt, Human
gcucacuaaauaacaggaagaa

SEQ ID NO: 94438 - RNA, 22 nt, Human
gcucacugcaaccucugcuucc

SEQ ID NO: 94439 - RNA, 22 nt, Human
gcucacugccugggcaacaaga

SEQ ID NO: 94440 - RNA, 22 nt, Human
gcucagagaaagauuagucccu

SEQ ID NO: 94441 - RNA, 22 nt, Human
gcucagagaaguuaaggaauuu

SEQ ID NO: 94442 - RNA, 22 nt, Human
gcucagagagaggcucaccauu

SEQ ID NO: 94443 - RNA, 22 nt, Human
gcucagagcacucagacucagc

SEQ ID NO: 94444 - RNA, 22 nt, Human
gcucagaggagcaucauaagga

SEQ ID NO: 94445 - RNA, 22 nt, Human
gcucagaggccacuguuggaaa

SEQ ID NO: 94446 - RNA, 23 nt, Human
gcucagaggugaaauguuuuggg

SEQ ID NO: 94447 - RNA, 22 nt, Human
gcucagagguuguucuuggguu

SEQ ID NO: 94448 - RNA, 23 nt, Human
gcucagagguuuuucucuggaug

SEQ ID NO: 94449 - RNA, 17 nt, Human
gcucagaguacacgugu

SEQ ID NO: 94450 - RNA, 22 nt, Human
gcucagaguggccuggcuaggg

SEQ ID NO: 94451 - RNA, 23 nt, Human
gcucagaugcccuaggagguggc

SEQ ID NO: 94452 - RNA, 22 nt, Human
gcucagcacuuucuccaaccac

SEQ ID NO: 94453 - RNA, 22 nt, Human
gcugagauuacgggcaugagcc

SEQ ID NO: 94454 - RNA, 22 nt, Human
gcugagccacccuugcuucccu

SEQ ID NO: 94455 - RNA, 22 nt, Human
gcugagccaugaggccucuugc

SEQ ID NO: 94456 - RNA, 22 nt, Human
gcugagcccucaucccuaguuu

SEQ ID NO: 94457 - RNA, 22 nt, Human
gcugagcuagcuaucucagucu

SEQ ID NO: 94458 - RNA, 22 nt, Human
gcugaggauugaagaguugcca

SEQ ID NO: 94459 - RNA, 22 nt, Human
gcugaggcaguccacccuugug

SEQ ID NO: 94460 - RNA, 22 nt, Human
gcugaggccaggccccaccgga

SEQ ID NO: 94461 - RNA, 22 nt, Human
gcugaggccccagggugauggg

SEQ ID NO: 94462 - RNA, 22 nt, Human
gcuggagaggaucccaaagcca

SEQ ID NO: 94463 - RNA, 22 nt, Human
gcuggagagugaggggagcaag

SEQ ID NO: 94464 - RNA, 22 nt, Human
gcuggagaugcuaugcagaggg

SEQ ID NO: 94465 - RNA, 22 nt, Human
gcuggagccuucugcucuguug

SEQ ID NO: 94466 - RNA, 22 nt, Human
gcuggaggcuggagugcagugg

SEQ ID NO: 94467 - RNA, 22 nt, Human
gcuggagggguaauaggauggg

SEQ ID NO: 94468 - RNA, 22 nt, Human
gcuggagguggugagaaaaggu

SEQ ID NO: 94469 - RNA, 22 nt, Human
gcuggagguuucaccugaguuu

SEQ ID NO: 94470 - RNA, 22 nt, Human
gcuggaguacaucuuuggcggc

SEQ ID NO: 94471 - RNA, 19 nt, Human
gcuggagucacuuuugaga

SEQ ID NO: 94472 - RNA, 22 nt, Human
gcuggagugagggaccauauuu

SEQ ID NO: 94473 - RNA, 22 nt, Human
gcuggagugaguauguguaguc

SEQ ID NO: 94474 - RNA, 22 nt, Human
gcuggaguuagaacuagccugg

SEQ ID NO: 94475 - RNA, 22 nt, Human
gcuggaguuaggugggcuugaa

SEQ ID NO: 94476 - RNA, 22 nt, Human
gcuggaguuggcaaggcaugua

SEQ ID NO: 94477 - RNA, 22 nt, Human
gcuggauccacaaauaacuuug

SEQ ID NO: 94478 - RNA, 22 nt, Human
gcuggauccugauucgucuuug

SEQ ID NO: 94479 - RNA, 22 nt, Human
gcuggcagaagagcugguucaa

SEQ ID NO: 94480 - RNA, 19 nt, Human
gcuggcagaauuuugaacc

SEQ ID NO: 94481 - RNA, 22 nt, Human
gcuggcagagagcuggugagga

SEQ ID NO: 94482 - RNA, 20 nt, Human
gcuggcagaugucuugagau

SEQ ID NO: 94483 - RNA, 22 nt, Human
gcuggcaggagaccauacccua

SEQ ID NO: 94484 - RNA, 22 nt, Human
gcuggcaggauaacuucuaagc

SEQ ID NO: 94485 - RNA, 22 nt, Human
gcuggcaggauagaagucuaau

SEQ ID NO: 94486 - RNA, 22 nt, Human
gcuggcagggugguugagagag

SEQ ID NO: 94487 - RNA, 22 nt, Human
gcuggcagucccaucagcuggg

SEQ ID NO: 94488 - RNA, 22 nt, Human
gcuggcaguguauuguuagcug

SEQ ID NO: 94489 - RNA, 22 nt, Human
gcuggcaucacuggcuucggug

SEQ ID NO: 94490 - RNA, 22 nt, Human
gcuggcauuacaggagagaacc

SEQ ID NO: 94491 - RNA, 22 nt, Human
gcuggccacacugcugauggag

SEQ ID NO: 94492 - RNA, 19 nt, Human
gcuggccacgccccaguug

SEQ ID NO: 94493 - RNA, 22 nt, Human
gcuggccaggaagagucucaga

SEQ ID NO: 94494 - RNA, 22 nt, Human
gcuggccauggccugcgccauc

SEQ ID NO: 94495 - RNA, 22 nt, Human
gcuggccucuggagaagggcuu

SEQ ID NO: 94496 - RNA, 22 nt, Human
gcuggccugcgagggcaggcug

SEQ ID NO: 94497 - RNA, 22 nt, Human
gcuggccugcugggcaccaccg

SEQ ID NO: 94498 - RNA, 22 nt, Human
gcuggccugggcagaggcuaug

SEQ ID NO: 94499 - RNA, 22 nt, Human
gcuggccugggcucaagaccag

SEQ ID NO: 94500 - RNA, 22 nt, Human
gcuggccuucugcagaguucug

SEQ ID NO: 94501 - RNA, 22 nt, Human
gcuggccuugugucugaggaag

SEQ ID NO: 94502 - RNA, 22 nt, Human
gcuggccuuugaggaagcugcg

SEQ ID NO: 94503 - RNA, 22 nt, Human
gcuggcuccucuguccucacgg

SEQ ID NO: 94504 - RNA, 22 nt, Human
gcuggcucugcacccaggccuc

SEQ ID NO: 94505 - RNA, 22 nt, Human
gcuggcucugugguaguuggca

SEQ ID NO: 94506 - RNA, 22 nt, Human
gcuggcugaaucuucugcaaua

SEQ ID NO: 94507 - RNA, 22 nt, Human
gcuggcugagcacugguuuaua

SEQ ID NO: 94508 - RNA, 22 nt, Human
gcuggcugaguucugucgucug

SEQ ID NO: 94509 - RNA, 22 nt, Human
gcuggcugcacaggggcucacu

SEQ ID NO: 94510 - RNA, 22 nt, Human
gcuggcugccaauuucagagcu

SEQ ID NO: 94511 - RNA, 22 nt, Human
gcuggcugccuuacuuugugga

SEQ ID NO: 94512 - RNA, 22 nt, Human
gcuggcugcuaggacagcuaca

SEQ ID NO: 94513 - RNA, 22 nt, Human
gcuggcuggaaugggagaagaa

SEQ ID NO: 94514 - RNA, 19 nt, Human
gcuggcuggaggagggaca

SEQ ID NO: 94515 - RNA, 22 nt, Human
gcuggcuggaggagggagguug

SEQ ID NO: 94516 - RNA, 22 nt, Human
gcuggcuggaggugaggaagaa

SEQ ID NO: 94517 - RNA, 22 nt, Human
gcuggcuggaguaaggagggag

SEQ ID NO: 94518 - RNA, 22 nt, Human
gcuggcuggcacguucgcacgu

SEQ ID NO: 94519 - RNA, 23 nt, Human
gcuggcuggcaguaaagguuguu

SEQ ID NO: 94520 - RNA, 22 nt, Human
gcuggcuggcgggugcguccuc

SEQ ID NO: 94521 - RNA, 22 nt, Human
gcuggcugggucccugagaggc

SEQ ID NO: 94522 - RNA, 22 nt, Human
gcuggcuguggcuuaagcaaac

SEQ ID NO: 94523 - RNA, 22 nt, Human
gcuggcuguguuccuucugcca

SEQ ID NO: 94524 - RNA, 22 nt, Human
gcuggcuguugaauaauggcau

SEQ ID NO: 94525 - RNA, 22 nt, Human
gcuggcuguuggagguaccugc

SEQ ID NO: 94526 - RNA, 17 nt, Human
gcuggcuucuccuugcu

SEQ ID NO: 94527 - RNA, 22 nt, Human
gcuggcuugacagaggccuggg

SEQ ID NO: 94528 - RNA, 22 nt, Human
gcuggcuugauaguuucugcuu

SEQ ID NO: 94529 - RNA, 22 nt, Human
gcuggcuuuauggggcuugugg

SEQ ID NO: 94530 - RNA, 21 nt, Human
gcuggcuuuauucugcguuug

SEQ ID NO: 94531 - RNA, 22 nt, Human
gcuggcuuugucaagggcagca

SEQ ID NO: 94532 - RNA, 22 nt, Human
gcuggcuuuguggucucuccuc

SEQ ID NO: 94533 - RNA, 22 nt, Human
gcuggcuuuugaagucuagcua

SEQ ID NO: 94534 - RNA, 22 nt, Human
gcugggaacacagccaugagag

SEQ ID NO: 94535 - RNA, 22 nt, Human
gcugggaagugcaagaucaagg

SEQ ID NO: 94536 - RNA, 22 nt, Human
gcugggacaggcuuggcccugu

SEQ ID NO: 94537 - RNA, 22 nt, Human
gcugggagcaaagccaugcaua

SEQ ID NO: 94538 - RNA, 22 nt, Human
gcugggagccguaccugucacg

SEQ ID NO: 94539 - RNA, 22 nt, Human
gcugggaggcagcaccuuuagc

SEQ ID NO: 94540 - RNA, 22 nt, Human
gcugggagugggcaagaugaga

SEQ ID NO: 94541 - RNA, 22 nt, Human
gcugggcaagugccuuggguuu

SEQ ID NO: 94542 - RNA, 22 nt, Human
gcugggcaaugccagagaggag

SEQ ID NO: 94543 - RNA, 22 nt, Human
gcugggccagccagacauguga

SEQ ID NO: 94544 - RNA, 22 nt, Human
gcugggccccaucccucgagca

SEQ ID NO: 94545 - RNA, 22 nt, Human
gcugggccccuugaaaggcguc

SEQ ID NO: 94546 - RNA, 22 nt, Human
gcugggcccugggugcccuagc

SEQ ID NO: 94547 - RNA, 22 nt, Human
gcugggccgaccugggcugcag

SEQ ID NO: 94548 - RNA, 22 nt, Human
gcugggccuuccgauucucaag

SEQ ID NO: 94549 - RNA, 22 nt, Human
gcugggcucauuugugugucug

SEQ ID NO: 94550 - RNA, 22 nt, Human
gcugggcuccacccucaacugu

SEQ ID NO: 94551 - RNA, 22 nt, Human
gcugggcucuuaucaccuguac

SEQ ID NO: 94552 - RNA, 22 nt, Human
gcugggcuggaaggccaaggca

SEQ ID NO: 94553 - RNA, 22 nt, Human
gcugggcuggccgccgagaucg

SEQ ID NO: 94554 - RNA, 23 nt, Human
gcugggcuuacucuuucagugag

SEQ ID NO: 94555 - RNA, 22 nt, Human
gcugggcuucaccuccagaguu

SEQ ID NO: 94556 - RNA, 22 nt, Human
gcugggcuucucaaugcugccu

SEQ ID NO: 94557 - RNA, 22 nt, Human
gcuggggaccagcugucucuga

SEQ ID NO: 94558 - RNA, 22 nt, Human
gcuggggacuccccaccauagc

SEQ ID NO: 94559 - RNA, 22 nt, Human
gcuggggagcaagaguagugag

SEQ ID NO: 94560 - RNA, 22 nt, Human
gcuggggaggcagcagagaaca

SEQ ID NO: 94561 - RNA, 22 nt, Human
gcuggggagggcgucaaggcca

SEQ ID NO: 94562 - RNA, 21 nt, Human
uacaagauagagguaauauau

SEQ ID NO: 94563 - RNA, 22 nt, Human
uacaagauuaaaacuuauacca

SEQ ID NO: 94564 - RNA, 22 nt, Human
uacaaggaaaaucuugaaguac

SEQ ID NO: 94565 - RNA, 22 nt, Human
uacaaggaggcuaaugaugaca

SEQ ID NO: 94566 - RNA, 22 nt, Human
uacaagguuguacuuucucucu

SEQ ID NO: 94567 - RNA, 20 nt, Human
uacaaguacauuauaguuau

SEQ ID NO: 94568 - RNA, 22 nt, Human
uacaaguauauucuagugauau

SEQ ID NO: 94569 - RNA, 22 nt, Human
uacaaguauguuuuaaaauguu

SEQ ID NO: 94570 - RNA, 22 nt, Human
uacaagucacuuccuuucuaaa

SEQ ID NO: 94571 - RNA, 21 nt, Human
uacaaguugcuuuugaagucc

SEQ ID NO: 94572 - RNA, 22 nt, Human
uacaauagggagguuuagggga

SEQ ID NO: 94573 - RNA, 22 nt, Human
uacaauagggcuuuuguuuaug

SEQ ID NO: 94574 - RNA, 22 nt, Human
uacaaucuuuauguugaguggu

SEQ ID NO: 94575 - RNA, 22 nt, Human
uacaaugaccauauuauguaag

SEQ ID NO: 94576 - RNA, 19 nt, Human
uacaaugauguuaccuuug

SEQ ID NO: 94577 - RNA, 22 nt, Human
uacaaugauuagcuaacuugcc

SEQ ID NO: 94578 - RNA, 17 nt, Human
uacaaugugauucaauc

SEQ ID NO: 94579 - RNA, 22 nt, Human
uacaauguuaaggaaagagaga

SEQ ID NO: 94580 - RNA, 22 nt, Human
uacaauguuccuagcaggaaag

SEQ ID NO: 94581 - RNA, 22 nt, Human
uacacaaaggcacucuguuguu

SEQ ID NO: 94582 - RNA, 22 nt, Human
uacacacaugcauuugccuuau

SEQ ID NO: 94583 - RNA, 22 nt, Human
uacacagaaccugguguacagu

SEQ ID NO: 94584 - RNA, 22 nt, Human
uacacagaagccagaaggccug

SEQ ID NO: 94585 - RNA, 22 nt, Human
uacacagagacucaaaagggca

SEQ ID NO: 94586 - RNA, 22 nt, Human
uacacagaggcugaugucuuag

SEQ ID NO: 94587 - RNA, 22 nt, Human
uacacagauaugugaucaauca

SEQ ID NO: 94588 - RNA, 22 nt, Human
uacacagauuuaaaagcaggga

SEQ ID NO: 94589 - RNA, 22 nt, Human
uacacaggcugccucuuugcau

SEQ ID NO: 94590 - RNA, 22 nt, Human
uacacagggaaaggucucagag

SEQ ID NO: 94591 - RNA, 22 nt, Human
uacacaguaaaugguaaauaca

SEQ ID NO: 94592 - RNA, 22 nt, Human
uacacauccauguuuugacuuu

SEQ ID NO: 94593 - RNA, 22 nt, Human
uacacaucccagacucccagga

SEQ ID NO: 94594 - RNA, 22 nt, Human
uacacaugcauguacuccagga

SEQ ID NO: 94595 - RNA, 22 nt, Human
uacacauucuagggcacaguua

SEQ ID NO: 94596 - RNA, 22 nt, Human
uacaccagauuauuuauaacau

SEQ ID NO: 94597 - RNA, 21 nt, Human
uacaccaguuuacacuuccuc

SEQ ID NO: 94598 - RNA, 22 nt, Human
uacacccacauugagcauggga

SEQ ID NO: 94599 - RNA, 22 nt, Human
uacacccagguaccgugauuuc

SEQ ID NO: 94600 - RNA, 22 nt, Human
uacacccuucuccugagugugu

SEQ ID NO: 94601 - RNA, 22 nt, Human
uacacuaaaucuucaucuuuua

SEQ ID NO: 94602 - RNA, 22 nt, Human
uacacuaauguuuuugcaaagc

SEQ ID NO: 94603 - RNA, 22 nt, Human
uacacucuuaggaauugguuau

SEQ ID NO: 94604 - RNA, 22 nt, Human
uacacugaagugucuugguaua

SEQ ID NO: 94605 - RNA, 22 nt, Human
uacacugugacaaucaugacag

SEQ ID NO: 94606 - RNA, 22 nt, Human
uacacuguguaaaaugcacuuu

SEQ ID NO: 94607 - RNA, 22 nt, Human
uacacuuauaacucugugugug

SEQ ID NO: 94608 - RNA, 22 nt, Human
uacagaaaaacuuggaggcuuu

SEQ ID NO: 94609 - RNA, 22 nt, Human
uacagaaauacagucaggccua

SEQ ID NO: 94610 - RNA, 22 nt, Human
uacagaagcugagacacugaga

SEQ ID NO: 94611 - RNA, 22 nt, Human
uacagaauaaagcgugaagcuu

SEQ ID NO: 94612 - RNA, 22 nt, Human
uacagacaaagagcaugcggua

SEQ ID NO: 94613 - RNA, 22 nt, Human
uacagacaguuuuucagauauu

SEQ ID NO: 94614 - RNA, 22 nt, Human
uacagagaacucauagaaagaa

SEQ ID NO: 94615 - RNA, 20 nt, Human
uacagagagcuagcucucug

SEQ ID NO: 94616 - RNA, 22 nt, Human
uacagaggguaauugaucaagg

SEQ ID NO: 94617 - RNA, 22 nt, Human
uacagaguauuuuuaauauggu

SEQ ID NO: 94618 - RNA, 22 nt, Human
uacagaguggugagaucuuuug

SEQ ID NO: 94619 - RNA, 22 nt, Human
uacagauaaaaaugcuguucuu

SEQ ID NO: 94620 - RNA, 22 nt, Human
uacagauaacugaaugcagacu

SEQ ID NO: 94621 - RNA, 22 nt, Human
uacagauauauagugugugccu

SEQ ID NO: 94622 - RNA, 22 nt, Human
uacagcauuaacaggcuguuua

SEQ ID NO: 94623 - RNA, 22 nt, Human
uacagcauugugucuucacuca

SEQ ID NO: 94624 - RNA, 22 nt, Human
uacagccacaggugacucucau

SEQ ID NO: 94625 - RNA, 22 nt, Human
uacagccaugguuaauuuaccu

SEQ ID NO: 94626 - RNA, 23 nt, Human
uacagccaugucgcugauuuaac

SEQ ID NO: 94627 - RNA, 22 nt, Human
uacagccugauuuggagccacu

SEQ ID NO: 94628 - RNA, 22 nt, Human
uacagccuucaucuuugccuug

SEQ ID NO: 94629 - RNA, 22 nt, Human
uacagcuguugguguuuccucu

SEQ ID NO: 94630 - RNA, 22 nt, Human
uacagcuuaaaaaagccaacuu

SEQ ID NO: 94631 - RNA, 22 nt, Human
uacagcuugaugagagcgcgag

SEQ ID NO: 94632 - RNA, 22 nt, Human
uacagcuuuagcaaauuaccua

SEQ ID NO: 94633 - RNA, 22 nt, Human
uacagcuuugggaaggccccau

SEQ ID NO: 94634 - RNA, 22 nt, Human
uacagcuuuucauauuuguguu

SEQ ID NO: 94635 - RNA, 22 nt, Human
uacaggaaggcucuggaggugc

SEQ ID NO: 94636 - RNA, 20 nt, Human
uacaggaaucaagacugcau

SEQ ID NO: 94637 - RNA, 22 nt, Human
uacaggagcacaaaagaguuga

SEQ ID NO: 94638 - RNA, 19 nt, Human
uacaggaggccugcaaucu

SEQ ID NO: 94639 - RNA, 22 nt, Human
uacaggcaugaaugaaaucugu

SEQ ID NO: 94640 - RNA, 22 nt, Human
uacaggcccauagucccugcuu

SEQ ID NO: 94641 - RNA, 22 nt, Human
uacagggaccaauaauaacuau

SEQ ID NO: 94642 - RNA, 22 nt, Human
uacaggguauucaaggguaguu

SEQ ID NO: 94643 - RNA, 22 nt, Human
uacaggucuaacuaaaugaauu

SEQ ID NO: 94644 - RNA, 22 nt, Human
uacaguaaagcugcuaugaauu

SEQ ID NO: 94645 - RNA, 22 nt, Human
uacaguaaaugugguagaaacu

SEQ ID NO: 94646 - RNA, 22 nt, Human
uacaguacacagguaccaagcu

SEQ ID NO: 94647 - RNA, 22 nt, Human
uacaguaccugccacguuguug

SEQ ID NO: 94648 - RNA, 22 nt, Human
uacaguagaauuuuuaguaacu

SEQ ID NO: 94649 - RNA, 22 nt, Human
uacaguagacaggaccacaggc

SEQ ID NO: 94650 - RNA, 22 nt, Human
uacaguagcuacucaauaacua

SEQ ID NO: 94651 - RNA, 22 nt, Human
uacaguaggauuuucagggucu

SEQ ID NO: 94652 - RNA, 22 nt, Human
uacaguauguucuugaauuugg

SEQ ID NO: 94653 - RNA, 22 nt, Human
uacaguauuaugagugauugaa

SEQ ID NO: 94654 - RNA, 22 nt, Human
uacaguauuugaagaauaugag

SEQ ID NO: 94655 - RNA, 22 nt, Human
uacagucuuuggaaagagauag

SEQ ID NO: 94656 - RNA, 22 nt, Human
uacagugacccuauuuccaaau

SEQ ID NO: 94657 - RNA, 22 nt, Human
uacagugaccuagaauaaauac

SEQ ID NO: 94658 - RNA, 22 nt, Human
uacagugcgggugcgggccucu

SEQ ID NO: 94659 - RNA, 22 nt, Human
uacagugucccuuuuucagaca

SEQ ID NO: 94660 - RNA, 22 nt, Human
uacagugucugcaacugcacac

SEQ ID NO: 94661 - RNA, 22 nt, Human
uacagugucuggauaucaaagg

SEQ ID NO: 94662 - RNA, 22 nt, Human
uacagugugaauaagcaggcau

SEQ ID NO: 94663 - RNA, 22 nt, Human
uacagugugacauuucuacaaa

SEQ ID NO: 94664 - RNA, 22 nt, Human
uacaguuacugcauuucuaaua

SEQ ID NO: 94665 - RNA, 22 nt, Human
uacaguuacuuugaaaauugau

SEQ ID NO: 94666 - RNA, 22 nt, Human
uacaguuauaugugauaaguaa

SEQ ID NO: 94667 - RNA, 22 nt, Human
uacaguuuacaugagaggaagc

SEQ ID NO: 94668 - RNA, 22 nt, Human
uacaguuucuguccuuguggag

SEQ ID NO: 94669 - RNA, 22 nt, Human
uacauacaagauguguuuaaaa

SEQ ID NO: 94670 - RNA, 22 nt, Human
uacauacacaaauauacuguuu

SEQ ID NO: 94671 - RNA, 22 nt, Human
gcuuccagaucccaugcucuua

SEQ ID NO: 94672 - RNA, 22 nt, Human
gcuuccagcaccagcagagggg

SEQ ID NO: 94673 - RNA, 22 nt, Human
gcuuccagggugggggauguuu

SEQ ID NO: 94674 - RNA, 22 nt, Human
gcuuccaggucauucucacccu

SEQ ID NO: 94675 - RNA, 22 nt, Human
gcuuccagugacuuuggucgug

SEQ ID NO: 94676 - RNA, 22 nt, Human
gcuuccauuugcuaggggauuu

SEQ ID NO: 94677 - RNA, 22 nt, Human
gcuucccaaugugcuaguuucu

SEQ ID NO: 94678 - RNA, 20 nt, Human
gcuucccaauucuugaucug

SEQ ID NO: 94679 - RNA, 22 nt, Human
gcuuccuacaugugucugcgag

SEQ ID NO: 94680 - RNA, 22 nt, Human
gcuuccuagaucugugguacuc

SEQ ID NO: 94681 - RNA, 22 nt, Human
gcuuccuccaucuggggcuugc

SEQ ID NO: 94682 - RNA, 18 nt, Human
gcuuccugaaagcugccc

SEQ ID NO: 94683 - RNA, 22 nt, Human
gcuuccugagaaacaaucugau

SEQ ID NO: 94684 - RNA, 22 nt, Human
gcuuccuggagggagagagcug

SEQ ID NO: 94685 - RNA, 22 nt, Human
gcuuccuguaggcagguccaag

SEQ ID NO: 94686 - RNA, 22 nt, Human
gcuuccuugggaaaauuagaug

SEQ ID NO: 94687 - RNA, 22 nt, Human
gcuucuagggaaggcagucaca

SEQ ID NO: 94688 - RNA, 23 nt, Human
gcuucuagucaauuucaccagga

SEQ ID NO: 94689 - RNA, 22 nt, Human
gcuucuauccuaccaugucuug

SEQ ID NO: 94690 - RNA, 22 nt, Human
gcuucucauguuuauuuuuaca

SEQ ID NO: 94691 - RNA, 22 nt, Human
gcuucucuuguccaagggcagg

SEQ ID NO: 94692 - RNA, 22 nt, Human
gcuucucuuucuccccuggcgg

SEQ ID NO: 94693 - RNA, 22 nt, Human
gcuucuggaggagcugggcuga

SEQ ID NO: 94694 - RNA, 22 nt, Human
gcuucuggcagugcagccacca

SEQ ID NO: 94695 - RNA, 22 nt, Human
gcuucugguagaauucaauaga

SEQ ID NO: 94696 - RNA, 22 nt, Human
gcuucuggugaggccucaggaa

SEQ ID NO: 94697 - RNA, 21 nt, Human
gcuucuguaucuagcaggaac

SEQ ID NO: 94698 - RNA, 22 nt, Human
gcuucugucuuagcuaccuccc

SEQ ID NO: 94699 - RNA, 22 nt, Human
gcuucuguggugcaucuuugcu

SEQ ID NO: 94700 - RNA, 19 nt, Human
gcuucuguuugggcuuaga

SEQ ID NO: 94701 - RNA, 20 nt, Human
gcuucuuuucuggcccauga

SEQ ID NO: 94702 - RNA, 22 nt, Human
gcuugaguuuugggacaaagcc

SEQ ID NO: 94703 - RNA, 22 nt, Human
gcuugcaagauagguuacuuaa

SEQ ID NO: 94704 - RNA, 22 nt, Human
gcuugccuggcauuucuggggc

SEQ ID NO: 94705 - RNA, 21 nt, Human
gcuugccuuccuaucuuuggc

SEQ ID NO: 94706 - RNA, 23 nt, Human
gcuugcucauucuaucacacagc

SEQ ID NO: 94707 - RNA, 22 nt, Human
uagagaaacagaaccaacaggg

SEQ ID NO: 94708 - RNA, 20 nt, Human
uagagagaggauauuaaagu

SEQ ID NO: 94709 - RNA, 16 nt, Human
uagagagggcagggag

SEQ ID NO: 94710 - RNA, 22 nt, Human
uagagauagcaguauugauucg

SEQ ID NO: 94711 - RNA, 22 nt, Human
uagagaugaauucugcagucuu

SEQ ID NO: 94712 - RNA, 22 nt, Human
uagagaugcccuagcugaagua

SEQ ID NO: 94713 - RNA, 22 nt, Human
uagagcagccuucagagcaguu

SEQ ID NO: 94714 - RNA, 23 nt, Human
uagagcauugcugaggccucccu

SEQ ID NO: 94715 - RNA, 22 nt, Human
uagagcuauacacugaguaaaa

SEQ ID NO: 94716 - RNA, 22 nt, Human
uagagcuggaauuugcagcaag

SEQ ID NO: 94717 - RNA, 22 nt, Human
uagagcugggcagugcucugag

SEQ ID NO: 94718 - RNA, 17 nt, Human
uagagcugguucaggag

SEQ ID NO: 94719 - RNA, 22 nt, Human
uagagcuguaucaaagagccuu

SEQ ID NO: 94720 - RNA, 22 nt, Human
uagagcuuagagaaugaguuug

SEQ ID NO: 94721 - RNA, 20 nt, Human
uagagcuuagguuuuauucu

SEQ ID NO: 94722 - RNA, 21 nt, Human
uagagcuuggcacagaguaga

SEQ ID NO: 94723 - RNA, 22 nt, Human
uagaggagaacacaaauuauag

SEQ ID NO: 94724 - RNA, 19 nt, Human
uagaggagaagggaagugg

SEQ ID NO: 94725 - RNA, 22 nt, Human
uagaggaugauccuuccuugcc

SEQ ID NO: 94726 - RNA, 22 nt, Human
uagaggauuuugcauuucauau

SEQ ID NO: 94727 - RNA, 22 nt, Human
uagaggcacagucuauguagag

SEQ ID NO: 94728 - RNA, 22 nt, Human
uagaggcauaagagggaagcag

SEQ ID NO: 94729 - RNA, 22 nt, Human
uagaggcauugcuuaauuucag

SEQ ID NO: 94730 - RNA, 22 nt, Human
uagaggcuccuguguguagguu

SEQ ID NO: 94731 - RNA, 22 nt, Human
uagagggcaggaguguccuacu

SEQ ID NO: 94732 - RNA, 22 nt, Human
uagaggggaaaaugcguauuaa

SEQ ID NO: 94733 - RNA, 18 nt, Human
uagaggggaagaccuuua

SEQ ID NO: 94734 - RNA, 22 nt, Human
uagaggggaaucugccuccucu

SEQ ID NO: 94735 - RNA, 20 nt, Human
uagaggggacaaucauugcc

SEQ ID NO: 94736 - RNA, 22 nt, Human
uagagguagaguuacauuaguc

SEQ ID NO: 94737 - RNA, 22 nt, Human
uagagguagauggucagccaau

SEQ ID NO: 94738 - RNA, 22 nt, Human
uagaggugagauuguggugcug

SEQ ID NO: 94739 - RNA, 22 nt, Human
uagagguguuguugauauagaa

SEQ ID NO: 94740 - RNA, 22 nt, Human
uagaguauauaggccuuugugu

SEQ ID NO: 94741 - RNA, 22 nt, Human
uagagucagagaaucauuacag

SEQ ID NO: 94742 - RNA, 22 nt, Human
uagaguccugugugcucugugg

SEQ ID NO: 94743 - RNA, 22 nt, Human
uagaguguccaacacauaggag

SEQ ID NO: 94744 - RNA, 21 nt, Human
uagagugucugugugggaauu

SEQ ID NO: 94745 - RNA, 18 nt, Human
uagaguuacuacaugauu

SEQ ID NO: 94746 - RNA, 22 nt, Human
uagauacacacacagucaugug

SEQ ID NO: 94747 - RNA, 19 nt, Human
uagauacugaugaacucca

SEQ ID NO: 94748 - RNA, 22 nt, Human
uagauaggugauuaggaaaagc

SEQ ID NO: 94749 - RNA, 22 nt, Human
uagaucauauacuugccaugac

SEQ ID NO: 94750 - RNA, 22 nt, Human
uagaucauuugaauugagguag

SEQ ID NO: 94751 - RNA, 22 nt, Human
uagaucugauacaauucaucug

SEQ ID NO: 94752 - RNA, 23 nt, Human
uagaucuucaucuaauucuguag

SEQ ID NO: 94753 - RNA, 22 nt, Human
uagaucuuguuacagauuuccu

SEQ ID NO: 94754 - RNA, 21 nt, Human
uagaugaaaucagaguauuuc

SEQ ID NO: 94755 - RNA, 22 nt, Human
uagaugauuuucagucaaagca

SEQ ID NO: 94756 - RNA, 22 nt, Human
uagaugcuacaauuuuguacuc

SEQ ID NO: 94757 - RNA, 22 nt, Human
uagauguaagcagaagaacagc

SEQ ID NO: 94758 - RNA, 22 nt, Human
uagauguuuugauauuugcuga

SEQ ID NO: 94759 - RNA, 17 nt, Human
uagauuaaacacggcca

SEQ ID NO: 94760 - RNA, 22 nt, Human
uagauuaagaugccaguuuuga

SEQ ID NO: 94761 - RNA, 22 nt, Human
uagauucuacugucacuuaguu

SEQ ID NO: 94762 - RNA, 22 nt, Human
uagauucucugcuggcugacau

SEQ ID NO: 94763 - RNA, 22 nt, Human
uagauucugacccucuuuuuac

SEQ ID NO: 94764 - RNA, 22 nt, Human
uagauucuggagagacagcagu

SEQ ID NO: 94765 - RNA, 22 nt, Human
uagauucuguaugucugcucuc

SEQ ID NO: 94766 - RNA, 22 nt, Human
uagauucugugagagucaaagu

SEQ ID NO: 94767 - RNA, 22 nt, Human
uagauucuuaguuucauagaau

SEQ ID NO: 94768 - RNA, 22 nt, Human
uagauucuuugcuagaucauug

SEQ ID NO: 94769 - RNA, 22 nt, Human
uagauugauugcaaagacaggc

SEQ ID NO: 94770 - RNA, 22 nt, Human
uagauuguucuuaacuuuauaa

SEQ ID NO: 94771 - RNA, 20 nt, Human
uagauuucauacuucucuuu

SEQ ID NO: 94772 - RNA, 22 nt, Human
uagauuucgcugcaucucaauc

SEQ ID NO: 94773 - RNA, 22 nt, Human
uagauuucucauucauagauug

SEQ ID NO: 94774 - RNA, 22 nt, Human
uagauuugugcaagaagggauu

SEQ ID NO: 94775 - RNA, 22 nt, Human
uagauuuugcauuucuaacaag

SEQ ID NO: 94776 - RNA, 22 nt, Human
uagauuuuuuggagacucucug

SEQ ID NO: 94777 - RNA, 22 nt, Human
uagcaaaaacugcaguuacuuu

SEQ ID NO: 94778 - RNA, 22 nt, Human
uagcaaaauguggauguaguug

SEQ ID NO: 94779 - RNA, 22 nt, Human
uagcaaaggaugacuauguacc

SEQ ID NO: 94780 - RNA, 22 nt, Human
uagcaaagguagaguuuugaga

SEQ ID NO: 94781 - RNA, 22 nt, Human
gcuggcucuacauuugagguca

SEQ ID NO: 94782 - RNA, 22 nt, Human
gcuggcugacagagauuuaaaa

SEQ ID NO: 94783 - RNA, 22 nt, Human
gcuggcugcagauuuuagaggu

SEQ ID NO: 94784 - RNA, 22 nt, Human
gcuggcugcuguugagacuugu

SEQ ID NO: 94785 - RNA, 22 nt, Human
gcuggcuggagugagcuacccu

SEQ ID NO: 94786 - RNA, 22 nt, Human
gcuggcuggcugugcaaaggca

SEQ ID NO: 94787 - RNA, 22 nt, Human
gcuggcuguaucaccuggccag

SEQ ID NO: 94788 - RNA, 21 nt, Human
gcuggcugucucuuacacggu

SEQ ID NO: 94789 - RNA, 22 nt, Human
gcuggcugugauuuugccaaca

SEQ ID NO: 94790 - RNA, 22 nt, Human
gcuggcuguguuucaucucuga

SEQ ID NO: 94791 - RNA, 22 nt, Human
gcuggcuuccaucagaggguga

SEQ ID NO: 94792 - RNA, 22 nt, Human
gcuggcuuccuucugcagcuag

SEQ ID NO: 94793 - RNA, 22 nt, Human
gcuggcuuuaucgucagacucc

SEQ ID NO: 94794 - RNA, 22 nt, Human
gcugggaaguggcagagcugga

SEQ ID NO: 94795 - RNA, 22 nt, Human
gcugggagacagacuuggaacc

SEQ ID NO: 94796 - RNA, 22 nt, Human
gcugggaggaauuuggggaaua

SEQ ID NO: 94797 - RNA, 22 nt, Human
gcugggagucgcgucuguggcc

SEQ ID NO: 94798 - RNA, 22 nt, Human
gcugggaguuugauuugacugg

SEQ ID NO: 94799 - RNA, 22 nt, Human
gcugggcagcaggcucuccggg

SEQ ID NO: 94800 - RNA, 22 nt, Human
gcugggcagcugaggccucuca

SEQ ID NO: 94801 - RNA, 22 nt, Human
gcugggcagugagugaguccuu

SEQ ID NO: 94802 - RNA, 21 nt, Human
gcugggccuguacuugcccug

SEQ ID NO: 94803 - RNA, 21 nt, Human
gcugggcuccagucugccgcu

SEQ ID NO: 94804 - RNA, 22 nt, Human
gcugggcucugucaugccuucc

SEQ ID NO: 94805 - RNA, 22 nt, Human
gcugggcugagcuagacuuggc

SEQ ID NO: 94806 - RNA, 22 nt, Human
gcugggcuguaguuugcugacc

SEQ ID NO: 94807 - RNA, 22 nt, Human
gcugggcuuguggccagcuggg

SEQ ID NO: 94808 - RNA, 19 nt, Human
gcuggggaauggauauuga

SEQ ID NO: 94809 - RNA, 18 nt, Human
gcugggguugagcucucc

SEQ ID NO: 94810 - RNA, 22 nt, Human
gcuggguauuuuaagaaaggaa

SEQ ID NO: 94811 - RNA, 22 nt, Human
gcugggucagaaucucccugug

SEQ ID NO: 94812 - RNA, 22 nt, Human
gcuggguccuaugcugguagag

SEQ ID NO: 94813 - RNA, 19 nt, Human
gcugggugaggucguugga

SEQ ID NO: 94814 - RNA, 22 nt, Human
gcuggguggaucggaggcucug

SEQ ID NO: 94815 - RNA, 19 nt, Human
gcugggugggguccacagc

SEQ ID NO: 94816 - RNA, 22 nt, Human
gcugguaggaagugcuccugcc

SEQ ID NO: 94817 - RNA, 22 nt, Human
gcugguccaauuaugaacuguu

SEQ ID NO: 94818 - RNA, 22 nt, Human
gcugguccauuggcacugcuca

SEQ ID NO: 94819 - RNA, 17 nt, Human
gcugguccuugguaacu

SEQ ID NO: 94820 - RNA, 22 nt, Human
gcuggugucuaaccuggcucuu

SEQ ID NO: 94821 - RNA, 22 nt, Human
ggacaguugguugggcucuugu

SEQ ID NO: 94822 - RNA, 22 nt, Human
ggacauagaggcccugcauggc

SEQ ID NO: 94823 - RNA, 22 nt, Human
ggacaucucuugccagggcugc

SEQ ID NO: 94824 - RNA, 22 nt, Human
ggacaucuugguugcuuccaag

SEQ ID NO: 94825 - RNA, 22 nt, Human
ggacaugaagcaaaaugggagg

SEQ ID NO: 94826 - RNA, 22 nt, Human
ggacaugauauuucaggaagac

SEQ ID NO: 94827 - RNA, 19 nt, Human
ggacauuugaguuguuuau

SEQ ID NO: 94828 - RNA, 22 nt, Human
ggacauuuuucuuccuacaaug

SEQ ID NO: 94829 - RNA, 22 nt, Human
ggaccacagugcauggccugua

SEQ ID NO: 94830 - RNA, 18 nt, Human
ggaccacaucaacuugaa

SEQ ID NO: 94831 - RNA, 22 nt, Human
ggaccacauugagagucauuaa

SEQ ID NO: 94832 - RNA, 22 nt, Human
ggaccagagcucgggcuucuca

SEQ ID NO: 94833 - RNA, 22 nt, Human
ggaccaggcaagcugaggcggg

SEQ ID NO: 94834 - RNA, 22 nt, Human
ggaccaggccagccucccugcg

SEQ ID NO: 94835 - RNA, 17 nt, Human
ggaccagggguugccau

SEQ ID NO: 94836 - RNA, 20 nt, Human
ggaccagguggggcgguggc

SEQ ID NO: 94837 - RNA, 22 nt, Human
ggacccugcagccacccgacau

SEQ ID NO: 94838 - RNA, 22 nt, Human
ggacccuggagacccacuggga

SEQ ID NO: 94839 - RNA, 22 nt, Human
ggacccugggcuugcuccuggg

SEQ ID NO: 94840 - RNA, 22 nt, Human
ggaccgguggcuuccucggguc

SEQ ID NO: 94841 - RNA, 22 nt, Human
ggaccugaacauaaaacgaggc

SEQ ID NO: 94842 - RNA, 22 nt, Human
ggaccugauguuuagucuuguu

SEQ ID NO: 94843 - RNA, 19 nt, Human
ggaccuggcaaucugcauu

SEQ ID NO: 94844 - RNA, 22 nt, Human
ggaccugugucuacagcaugug

SEQ ID NO: 94845 - RNA, 22 nt, Human
ggaccuuccuggcuccuggggu

SEQ ID NO: 94846 - RNA, 18 nt, Human
ggacuacaggcacaggga

SEQ ID NO: 94847 - RNA, 22 nt, Human
ggacucagcagccaggaguggc

SEQ ID NO: 94848 - RNA, 22 nt, Human
ggacucucaggcugucggcuuc

SEQ ID NO: 94849 - RNA, 22 nt, Human
ggacugaaaucuuuccauguca

SEQ ID NO: 94850 - RNA, 22 nt, Human
ggacugaauggaagauauaugg

SEQ ID NO: 94851 - RNA, 22 nt, Human
ggacugaggcccacuugaggga

SEQ ID NO: 94852 - RNA, 22 nt, Human
ggacuggccggcgcugaggccc

SEQ ID NO: 94853 - RNA, 22 nt, Human
ggacugggaaucagggagaugc

SEQ ID NO: 94854 - RNA, 22 nt, Human
ggacuggguaggagcccagggc

SEQ ID NO: 94855 - RNA, 22 nt, Human
ggacugggucacuaagauagua

SEQ ID NO: 94856 - RNA, 22 nt, Human
ggacuggucugagagggauuca

SEQ ID NO: 94857 - RNA, 22 nt, Human
ggacuucuggggacuguagauu

SEQ ID NO: 94858 - RNA, 22 nt, Human
ggacuugcaggggagacugcgu

SEQ ID NO: 94859 - RNA, 22 nt, Human
ggacuuuagcagcuggagagga

SEQ ID NO: 94860 - RNA, 22 nt, Human
ggagaaagaaauuuuugauugg

SEQ ID NO: 94861 - RNA, 22 nt, Human
ggagaaaguacagcaggcaaca

SEQ ID NO: 94862 - RNA, 18 nt, Human
ggagaagaacagaugugg

SEQ ID NO: 94863 - RNA, 22 nt, Human
ggagaagaggagcuggaagccu

SEQ ID NO: 94864 - RNA, 22 nt, Human
ggagaagccaggugauaagcaa

SEQ ID NO: 94865 - RNA, 22 nt, Human
ggagaagguggcucagcaaagg

SEQ ID NO: 94866 - RNA, 22 nt, Human
ggagaaugauauauagcucagu

SEQ ID NO: 94867 - RNA, 22 nt, Human
ggagaauggccaucuuuucaga

SEQ ID NO: 94868 - RNA, 22 nt, Human
ggagacacgggugcugaggacc

SEQ ID NO: 94869 - RNA, 22 nt, Human
ggagacagcaggaagaaauauc

SEQ ID NO: 94870 - RNA, 22 nt, Human
ggagacagugacuuagagacug

SEQ ID NO: 94871 - RNA, 22 nt, Human
ggagacagugguagggccuaag

SEQ ID NO: 94872 - RNA, 22 nt, Human
ggagacauauuccagagcuggg

SEQ ID NO: 94873 - RNA, 22 nt, Human
ggagacucaccccgcauucuag

SEQ ID NO: 94874 - RNA, 22 nt, Human
ggagagaaauugagguagcaag

SEQ ID NO: 94875 - RNA, 22 nt, Human
ggagagaacugaccugaaagga

SEQ ID NO: 94876 - RNA, 22 nt, Human
ggagagagaugccgccuugcuc

SEQ ID NO: 94877 - RNA, 22 nt, Human
ggagagauaggaguccuggacu

SEQ ID NO: 94878 - RNA, 22 nt, Human
ggagagcauucuuagucuguuu

SEQ ID NO: 94879 - RNA, 22 nt, Human
ggagagcugaagcauggacagg

SEQ ID NO: 94880 - RNA, 22 nt, Human
ggagagcugacaucaugauguu

SEQ ID NO: 94881 - RNA, 22 nt, Human
ggagagcugguauaugaagaca

SEQ ID NO: 94882 - RNA, 22 nt, Human
ggagaggagauuguggcauuuu

SEQ ID NO: 94883 - RNA, 22 nt, Human
ggagaggagcuauugggggcuc

SEQ ID NO: 94884 - RNA, 22 nt, Human
ggagaggauguuuuaguaacuu

SEQ ID NO: 94885 - RNA, 22 nt, Human
ggagaggcgaugagucacagcc

SEQ ID NO: 94886 - RNA, 22 nt, Human
ggagaggcuuccagagucgugc

SEQ ID NO: 94887 - RNA, 22 nt, Human
ggagagguuauccguguuaugu

SEQ ID NO: 94888 - RNA, 22 nt, Human
ggagagucugccgagccagccc

SEQ ID NO: 94889 - RNA, 22 nt, Human
ggagagucugcuggccacagug

SEQ ID NO: 94890 - RNA, 23 nt, Human
uagcuguggcguaaggcucagcu

SEQ ID NO: 94891 - RNA, 22 nt, Human
uagcuguguaugguuuacaaau

SEQ ID NO: 94892 - RNA, 22 nt, Human
uagcugugugaugggaaaccuu

SEQ ID NO: 94893 - RNA, 22 nt, Human
uagcuguucauguggcuuuaug

SEQ ID NO: 94894 - RNA, 22 nt, Human
uagcuguucccagcucugugua

SEQ ID NO: 94895 - RNA, 22 nt, Human
uagcuucaugcuucaccacgcu

SEQ ID NO: 94896 - RNA, 21 nt, Human
uagcuuccagcucaagcugag

SEQ ID NO: 94897 - RNA, 22 nt, Human
uagcuucuauacaacuucagca

SEQ ID NO: 94898 - RNA, 22 nt, Human
uagcuucucauaauuuaugcug

SEQ ID NO: 94899 - RNA, 22 nt, Human
uagcuuguacugcaguagagaa

SEQ ID NO: 94900 - RNA, 22 nt, Human
uagcuugucagugaauagcugu

SEQ ID NO: 94901 - RNA, 22 nt, Human
uagcuuuaagacauggugaaug

SEQ ID NO: 94902 - RNA, 22 nt, Human
uagcuuuacaaagugcugcacc

SEQ ID NO: 94903 - RNA, 22 nt, Human
uagcuuuaccauagaagaguau

SEQ ID NO: 94904 - RNA, 22 nt, Human
uagcuuuagaaauauucucaga

SEQ ID NO: 94905 - RNA, 22 nt, Human
uagcuuuaggcacguuugaauu

SEQ ID NO: 94906 - RNA, 22 nt, Human
uagcuuuccuuguugccugugc

SEQ ID NO: 94907 - RNA, 22 nt, Human
uagcuuugaaguuauuuaacag

SEQ ID NO: 94908 - RNA, 22 nt, Human
uagcuuuguauuaucagcauug

SEQ ID NO: 94909 - RNA, 22 nt, Human
uagcuuuguccuccacccucag

SEQ ID NO: 94910 - RNA, 22 nt, Human
uagcuuugugaaguuuacagac

SEQ ID NO: 94911 - RNA, 22 nt, Human
uagcuuuguuuaucaaggggca

SEQ ID NO: 94912 - RNA, 22 nt, Human
uaggaaaaauacagaauuauau

SEQ ID NO: 94913 - RNA, 22 nt, Human
uaggaaacaaaccugccucuuc

SEQ ID NO: 94914 - RNA, 22 nt, Human
uaggaaacaaagcuuagcagga

SEQ ID NO: 94915 - RNA, 22 nt, Human
uaggaaacaaaguaaugcaacu

SEQ ID NO: 94916 - RNA, 22 nt, Human
uaggaaacuaauacagucugga

SEQ ID NO: 94917 - RNA, 22 nt, Human
uaggaaacucucagcuggucau

SEQ ID NO: 94918 - RNA, 22 nt, Human
uaggaaagaaaugaguagugau

SEQ ID NO: 94919 - RNA, 22 nt, Human
uaggaaauaaauacuuaugguu

SEQ ID NO: 94920 - RNA, 18 nt, Human
uaggaaauagggcuguga

SEQ ID NO: 94921 - RNA, 20 nt, Human
uaggaaauauguuuuuaccc

SEQ ID NO: 94922 - RNA, 22 nt, Human
uaggaaauauugauuucaguca

SEQ ID NO: 94923 - RNA, 22 nt, Human
uaggaaauauuugaacauagga

SEQ ID NO: 94924 - RNA, 22 nt, Human
uaggaaauuaagucucuuuugu

SEQ ID NO: 94925 - RNA, 22 nt, Human
uaggaaauuagaacuuggaaac

SEQ ID NO: 94926 - RNA, 22 nt, Human
uaggaaauuucauuugaggucu

SEQ ID NO: 94927 - RNA, 22 nt, Human
uaggaaauuuuacuggucuggg

SEQ ID NO: 94928 - RNA, 22 nt, Human
uaggaacaaaagguuuuccuga

SEQ ID NO: 94929 - RNA, 22 nt, Human
uaggaacacacauguguagcug

SEQ ID NO: 94930 - RNA, 22 nt, Human
uaggaacaguccuagaaaucug

SEQ ID NO: 94931 - RNA, 22 nt, Human
uaggaacccgcagcaguccgag

SEQ ID NO: 94932 - RNA, 22 nt, Human
uaggaacuagacucaugacuca

SEQ ID NO: 94933 - RNA, 21 nt, Human
uaggaacuguucugagugguc

SEQ ID NO: 94934 - RNA, 22 nt, Human
uaggaagaaacuuucccugcag

SEQ ID NO: 94935 - RNA, 23 nt, Human
uaggaagacagcaaaagaaugga

SEQ ID NO: 94936 - RNA, 22 nt, Human
gcugguucaccuggcuccuccc

SEQ ID NO: 94937 - RNA, 22 nt, Human
gcuguacaggguuauccuuucc

SEQ ID NO: 94938 - RNA, 22 nt, Human
gcuguacaguuuacuagguggg

SEQ ID NO: 94939 - RNA, 22 nt, Human
gcuguacauucugcacaggccc

SEQ ID NO: 94940 - RNA, 22 nt, Human
gcuguacauucuguggguuugg

SEQ ID NO: 94941 - RNA, 22 nt, Human
gcuguacauuuguguacacuug

SEQ ID NO: 94942 - RNA, 22 nt, Human
gcuguaggaaugacauguaccu

SEQ ID NO: 94943 - RNA, 22 nt, Human
gcuguagggugucauaugaagc

SEQ ID NO: 94944 - RNA, 22 nt, Human
gcuguagguucagucuccaugc

SEQ ID NO: 94945 - RNA, 22 nt, Human
gcuguagguuuuuccaggaguu

SEQ ID NO: 94946 - RNA, 22 nt, Human
gcugucaagguagaaaacagag

SEQ ID NO: 94947 - RNA, 22 nt, Human
gcugucacaaauauuucucagc

SEQ ID NO: 94948 - RNA, 22 nt, Human
gcugucacaucaaggcacuaaa

SEQ ID NO: 94949 - RNA, 22 nt, Human
gcugucagaaggugaaggguaa

SEQ ID NO: 94950 - RNA, 23 nt, Human
gcugucaguuguuuuugucucua

SEQ ID NO: 94951 - RNA, 22 nt, Human
gcuguccaccuccagagccuua

SEQ ID NO: 94952 - RNA, 22 nt, Human
gcuguccagguuguggagcaac

SEQ ID NO: 94953 - RNA, 22 nt, Human
gcugucccaugguugcaagaug

SEQ ID NO: 94954 - RNA, 22 nt, Human
gcuguccucgucucucacgcaa

SEQ ID NO: 94955 - RNA, 18 nt, Human
gcugucugaggucugagg

SEQ ID NO: 94956 - RNA, 22 nt, Human
gcugucugaguaagagaauccu

SEQ ID NO: 94957 - RNA, 22 nt, Human
gcugucugccgcaggcugccac

SEQ ID NO: 94958 - RNA, 22 nt, Human
gcugucuggaggcucugaggga

SEQ ID NO: 94959 - RNA, 22 nt, Human
gcugucugucucugucccacca

SEQ ID NO: 94960 - RNA, 22 nt, Human
gcugucuguucgagcguguguu

SEQ ID NO: 94961 - RNA, 22 nt, Human
gcugucuuggaaaaggcaaaga

SEQ ID NO: 94962 - RNA, 22 nt, Human
gcugucuuggguagaaagaggu

SEQ ID NO: 94963 - RNA, 22 nt, Human
gcugugagcacugcugggugga

SEQ ID NO: 94964 - RNA, 22 nt, Human
gcugugagggcuucugaggcau

SEQ ID NO: 94965 - RNA, 22 nt, Human
gcugugagggucuagugaggug

SEQ ID NO: 94966 - RNA, 22 nt, Human
gcugugauguggagggugcuga

SEQ ID NO: 94967 - RNA, 22 nt, Human
gcugugauugucagucuucaau

SEQ ID NO: 94968 - RNA, 23 nt, Human
gcugugcacgagccacugccugu

SEQ ID NO: 94969 - RNA, 21 nt, Human
gcugugcagaggauggagugg

SEQ ID NO: 94970 - RNA, 21 nt, Human
gcugugcaggauugaaagcag

SEQ ID NO: 94971 - RNA, 22 nt, Human
gcugugcagguccccacugccu

SEQ ID NO: 94972 - RNA, 21 nt, Human
gcugugcaggugccccugcuc

SEQ ID NO: 94973 - RNA, 22 nt, Human
gcugugcaguaguagguacagu

SEQ ID NO: 94974 - RNA, 22 nt, Human
gcugugcagucuuuggugugcc

SEQ ID NO: 94975 - RNA, 22 nt, Human
gcugugcagugggaguucggug

SEQ ID NO: 94976 - RNA, 22 nt, Human
gcugugcauugagccugagagu

SEQ ID NO: 94977 - RNA, 22 nt, Human
gcugugcccagccauucuagau

SEQ ID NO: 94978 - RNA, 19 nt, Human
gcugugccucucuccugcu

SEQ ID NO: 94979 - RNA, 22 nt, Human
gcugugcugcgggaggauuccg

SEQ ID NO: 94980 - RNA, 22 nt, Human
gcugugcuggaaggggaccugc

SEQ ID NO: 94981 - RNA, 22 nt, Human
gcugugcuugcaugagugucug

SEQ ID NO: 94982 - RNA, 22 nt, Human
gcugugcuugggaagaaucucu

SEQ ID NO: 94983 - RNA, 22 nt, Human
gcugugcuuuugguagauccca

SEQ ID NO: 94984 - RNA, 22 nt, Human
gcuguggccgucagggaaaugg

SEQ ID NO: 94985 - RNA, 22 nt, Human
gcuguggcgauugguaucgauu

SEQ ID NO: 94986 - RNA, 22 nt, Human
gcuguggcucucacaagcaaau

SEQ ID NO: 94987 - RNA, 22 nt, Human
gcuguggcugaagaugcaggga

SEQ ID NO: 94988 - RNA, 22 nt, Human
gcuguggcugacauugcagaca

SEQ ID NO: 94989 - RNA, 22 nt, Human
gcuguggcugaccaccaggggg

SEQ ID NO: 94990 - RNA, 22 nt, Human
gcuguggcuugcagcuggggcu

SEQ ID NO: 94991 - RNA, 22 nt, Human
gcugugggacagguccagccag

SEQ ID NO: 94992 - RNA, 22 nt, Human
gcugugggccacacggcugagu

SEQ ID NO: 94993 - RNA, 22 nt, Human
gcuguggggagagaacacacaa

SEQ ID NO: 94994 - RNA, 22 nt, Human
gcuguggucugugagcuccaaa

SEQ ID NO: 94995 - RNA, 22 nt, Human
gcuguguccucacacagccuuu

SEQ ID NO: 94996 - RNA, 22 nt, Human
gcugugugaaaacugggccugg

SEQ ID NO: 94997 - RNA, 22 nt, Human
gcugugugacccuagccaguag

SEQ ID NO: 94998 - RNA, 19 nt, Human
gcugugugaccuugggcaa

SEQ ID NO: 94999 - RNA, 22 nt, Human
uaggcugggaagaaagauucuc

SEQ ID NO: 95000 - RNA, 22 nt, Human
uaggcugggccugccuuccagg

SEQ ID NO: 95001 - RNA, 22 nt, Human
uaggcugggcugagcuggacgg

SEQ ID NO: 95002 - RNA, 18 nt, Human
uaggcugggggcuguagu

SEQ ID NO: 95003 - RNA, 22 nt, Human
uagggaagcuccugauuccccu

SEQ ID NO: 95004 - RNA, 22 nt, Human
uagggacccucccugcucuaac

SEQ ID NO: 95005 - RNA, 22 nt, Human
uagggaccuuagaauuguaugu

SEQ ID NO: 95006 - RNA, 22 nt, Human
uagggacuaguuucaaggcuaa

SEQ ID NO: 95007 - RNA, 22 nt, Human
uagggagaaacaccaauuuauu

SEQ ID NO: 95008 - RNA, 22 nt, Human
uagggaggaggguuuucaaauc

SEQ ID NO: 95009 - RNA, 22 nt, Human
uagggagugcguagcagggugg

SEQ ID NO: 95010 - RNA, 22 nt, Human
uagggaugagcaacugguagug

SEQ ID NO: 95011 - RNA, 22 nt, Human
uagggaugauggagccuaugua

SEQ ID NO: 95012 - RNA, 22 nt, Human
uagggcagcugcaucaggcacu

SEQ ID NO: 95013 - RNA, 22 nt, Human
uagggcaguuucauguuaucuu

SEQ ID NO: 95014 - RNA, 22 nt, Human
uagggccagauaggcuucuuga

SEQ ID NO: 95015 - RNA, 22 nt, Human
uagggcuauucugaguaauaau

SEQ ID NO: 95016 - RNA, 22 nt, Human
uagggcucgggcacaggacagg

SEQ ID NO: 95017 - RNA, 18 nt, Human
uagggcucuagggaguga

SEQ ID NO: 95018 - RNA, 21 nt, Human
uagggcucucugugucaggug

SEQ ID NO: 95019 - RNA, 22 nt, Human
uagggcucugagaguucagccu

SEQ ID NO: 95020 - RNA, 22 nt, Human
uagggcugaggcaacaagggag

SEQ ID NO: 95021 - RNA, 22 nt, Human
uagggcugcagaacaauggccu

SEQ ID NO: 95022 - RNA, 22 nt, Human
uagggcuuugcgauggcuauuc

SEQ ID NO: 95023 - RNA, 22 nt, Human
uagggcuuugcucauccuaggu

SEQ ID NO: 95024 - RNA, 22 nt, Human
uaggggaaagcagaauccugga

SEQ ID NO: 95025 - RNA, 22 nt, Human
uaggggaagucucagaaugcag

SEQ ID NO: 95026 - RNA, 22 nt, Human
uaggggcuuguaauuuaauaga

SEQ ID NO: 95027 - RNA, 22 nt, Human
uagggggcuuugcugcuugaca

SEQ ID NO: 95028 - RNA, 22 nt, Human
uaggggugaggccaggcaucag

SEQ ID NO: 95029 - RNA, 22 nt, Human
uagggguggagcuaagaguccc

SEQ ID NO: 95030 - RNA, 22 nt, Human
uagggguguuucgagagagguu

SEQ ID NO: 95031 - RNA, 22 nt, Human
uagggucccagauaggagccag

SEQ ID NO: 95032 - RNA, 22 nt, Human
uagggugcaugacaagaucccu

SEQ ID NO: 95033 - RNA, 22 nt, Human
uagggugcuuaauacuagauuu

SEQ ID NO: 95034 - RNA, 22 nt, Human
uagggugguuagaaggaguaug

SEQ ID NO: 95035 - RNA, 23 nt, Human
uaggguguuaagucagugauuga

SEQ ID NO: 95036 - RNA, 22 nt, Human
uagguacaaggagggauucuug

SEQ ID NO: 95037 - RNA, 22 nt, Human
uagguacagcuaaaaauuaucu

SEQ ID NO: 95038 - RNA, 22 nt, Human
uagguagcuuuggcguuucuug

SEQ ID NO: 95039 - RNA, 22 nt, Human
uagguaguuacacagcaaugua

SEQ ID NO: 95040 - RNA, 22 nt, Human
uagguaguuuccuguuguuggg

SEQ ID NO: 95041 - RNA, 22 nt, Human
uaggucuguacccuguccuucu

SEQ ID NO: 95042 - RNA, 22 nt, Human
uaggugagguuacaagaguuca

SEQ ID NO: 95043 - RNA, 22 nt, Human
uaggugguuauaaauucaaggc

SEQ ID NO: 95044 - RNA, 17 nt, Human
uaggugguugcuggucu

SEQ ID NO: 95045 - RNA, 22 nt, Human
uaggugguugucugcuuuccua

SEQ ID NO: 95046 - RNA, 22 nt, Human
uaggugucugcucuuauuuaac

SEQ ID NO: 95047 - RNA, 22 nt, Human
uaggugucuguccugggcugug

SEQ ID NO: 95048 - RNA, 20 nt, Human
uaggugucuuugccagcuuu

SEQ ID NO: 95049 - RNA, 22 nt, Human
uagguucacuuagcugugggaa

SEQ ID NO: 95050 - RNA, 22 nt, Human
uagguucagagaacugaaaaua

SEQ ID NO: 95051 - RNA, 22 nt, Human
gcuucccaaacuuguggauaga

SEQ ID NO: 95052 - RNA, 22 nt, Human
gcuucccacagcuggacugggg

SEQ ID NO: 95053 - RNA, 22 nt, Human
gcuucccauaguggaauucggg

SEQ ID NO: 95054 - RNA, 22 nt, Human
gcuuccgcgauguccuaggugg

SEQ ID NO: 95055 - RNA, 22 nt, Human
gcuuccggagccaaaaggcccc

SEQ ID NO: 95056 - RNA, 22 nt, Human
gcuuccuagcauuagccauugc

SEQ ID NO: 95057 - RNA, 22 nt, Human
gcuuccucaccuucucuugcau

SEQ ID NO: 95058 - RNA, 22 nt, Human
gcuuccuccagggaggggccug

SEQ ID NO: 95059 - RNA, 22 nt, Human
gcuuccugucccucagccauga

SEQ ID NO: 95060 - RNA, 20 nt, Human
gcuuccuucccagcccccac

SEQ ID NO: 95061 - RNA, 22 nt, Human
gcuuccuuccuuacauuggugg

SEQ ID NO: 95062 - RNA, 22 nt, Human
gcuuccuucuaccacaucaugc

SEQ ID NO: 95063 - RNA, 22 nt, Human
gcuucgggguccaagcgcgugu

SEQ ID NO: 95064 - RNA, 22 nt, Human
gcuucuacccacgagaugcaaa

SEQ ID NO: 95065 - RNA, 22 nt, Human
gcuucuaugcuucaagagagag

SEQ ID NO: 95066 - RNA, 20 nt, Human
gcuucucagggcuucucuga

SEQ ID NO: 95067 - RNA, 15 nt, Human
gcuucuccagaugac

SEQ ID NO: 95068 - RNA, 22 nt, Human
gcuucucccuacagaugucagu

SEQ ID NO: 95069 - RNA, 22 nt, Human
gcuucucgggccugaugucguc

SEQ ID NO: 95070 - RNA, 22 nt, Human
gcuucucuggcuggucugccac

SEQ ID NO: 95071 - RNA, 22 nt, Human
gcuucugaggaaggcucagccu

SEQ ID NO: 95072 - RNA, 22 nt, Human
gcuucugaguucuugcuuaaua

SEQ ID NO: 95073 - RNA, 22 nt, Human
gcuucugcuguugaagccacca

SEQ ID NO: 95074 - RNA, 17 nt, Human
gcuucuggagcuucugu

SEQ ID NO: 95075 - RNA, 22 nt, Human
gcuucuggagucuucagaggaa

SEQ ID NO: 95076 - RNA, 22 nt, Human
gcuucuguauuuauuguccuuu

SEQ ID NO: 95077 - RNA, 22 nt, Human
gcuucugugagugcagaugcug

SEQ ID NO: 95078 - RNA, 22 nt, Human
gcuucuguggauuggcuggcuu

SEQ ID NO: 95079 - RNA, 22 nt, Human
gcuucuuuccuugggcuggaac

SEQ ID NO: 95080 - RNA, 22 nt, Human
gcuugagaacuucaacucagug

SEQ ID NO: 95081 - RNA, 22 nt, Human
gcuugcagcaggugcuuaggaa

SEQ ID NO: 95082 - RNA, 22 nt, Human
gcuugcaugauuggagugggug

SEQ ID NO: 95083 - RNA, 22 nt, Human
gcuugccuaucugguggucguu

SEQ ID NO: 95084 - RNA, 22 nt, Human
gcuugcucaacccccgucucuc

SEQ ID NO: 95085 - RNA, 22 nt, Human
gcuugcugaacaggaaccuggc

SEQ ID NO: 95086 - RNA, 19 nt, Human
gcuugcuuuaugaaggggg

SEQ ID NO: 95087 - RNA, 22 nt, Human
gcuugcuuuguaaauaucugug

SEQ ID NO: 95088 - RNA, 22 nt, Human
gcuuggaaguaggauugggaga

SEQ ID NO: 95089 - RNA, 22 nt, Human
gcuuggcagggccugcuggagc

SEQ ID NO: 95090 - RNA, 20 nt, Human
gcuuggcagguuuuguugcc

SEQ ID NO: 95091 - RNA, 22 nt, Human
gcuugggaaacguaguuccuag

SEQ ID NO: 95092 - RNA, 22 nt, Human
gcuugggacuggagaauagggu

SEQ ID NO: 95093 - RNA, 22 nt, Human
gcuugggagaggguccccagga

SEQ ID NO: 95094 - RNA, 22 nt, Human
gcuuggggucaugaggcugcug

SEQ ID NO: 95095 - RNA, 22 nt, Human
gcuugguuucuaacuuuucaua

SEQ ID NO: 95096 - RNA, 22 nt, Human
gcuugucugcugagccaccugu

SEQ ID NO: 95097 - RNA, 23 nt, Human
gcuuguguauacaggaggccacc

SEQ ID NO: 95098 - RNA, 22 nt, Human
gcuuuacaacaaauugaauaug

SEQ ID NO: 95099 - RNA, 22 nt, Human
gcuuuacugagaugacacaggg

SEQ ID NO: 95100 - RNA, 23 nt, Human
gcuuuauaguucucccaacauua

SEQ ID NO: 95101 - RNA, 22 nt, Human
gcuuuaugcaaaccugguacuu

SEQ ID NO: 95102 - RNA, 22 nt, Human
gcuuuaugggccaugcgguguc

SEQ ID NO: 95103 - RNA, 22 nt, Human
gcuuucagggucacugucaaca

SEQ ID NO: 95104 - RNA, 22 nt, Human
gcuuucuaggcagagaugacug

SEQ ID NO: 95105 - RNA, 20 nt, Human
gcuuucuaugagauggacug

SEQ ID NO: 95106 - RNA, 22 nt, Human
gcuuucugaagcaguguuucuc

SEQ ID NO: 95107 - RNA, 22 nt, Human
gcuuucugguucucaaagcacu

SEQ ID NO: 95108 - RNA, 22 nt, Human
ggaauucaguggccagacauga

SEQ ID NO: 95109 - RNA, 22 nt, Human
ggaauuuagauguuucucaacu

SEQ ID NO: 95110 - RNA, 22 nt, Human
ggacaaaccaauagacacuggc

SEQ ID NO: 95111 - RNA, 22 nt, Human
ggacaaagcucugcugccuccc

SEQ ID NO: 95112 - RNA, 22 nt, Human
ggacaaagggcuagccacaacu

SEQ ID NO: 95113 - RNA, 22 nt, Human
ggacaaagguagacagucucug

SEQ ID NO: 95114 - RNA, 22 nt, Human
ggacaagccucagacaaaacuc

SEQ ID NO: 95115 - RNA, 22 nt, Human
ggacaagccugugaguggguuu

SEQ ID NO: 95116 - RNA, 22 nt, Human
ggacacaagcuccggggcugca

SEQ ID NO: 95117 - RNA, 23 nt, Human
ggacacagagauaagugagacaa

SEQ ID NO: 95118 - RNA, 18 nt, Human
ggacacagauagguacag

SEQ ID NO: 95119 - RNA, 22 nt, Human
ggacacaggcagcugggugggu

SEQ ID NO: 95120 - RNA, 19 nt, Human
ggacacccuaucaauaccu

SEQ ID NO: 95121 - RNA, 17 nt, Human
ggacaccuggagucucc

SEQ ID NO: 95122 - RNA, 22 nt, Human
ggacacugaagaaucucagaug

SEQ ID NO: 95123 - RNA, 23 nt, Human
ggacacugugcagaugcuagugc

SEQ ID NO: 95124 - RNA, 22 nt, Human
ggacacuuugaguugaaggggu

SEQ ID NO: 95125 - RNA, 22 nt, Human
ggacagaaaccauaugagugua

SEQ ID NO: 95126 - RNA, 22 nt, Human
ggacagagggcaggagcccaga

SEQ ID NO: 95127 - RNA, 22 nt, Human
ggacaggagugaggcggguucc

SEQ ID NO: 95128 - RNA, 22 nt, Human
ggacaggccuggcacaguacug

SEQ ID NO: 95129 - RNA, 22 nt, Human
ggacaggcugcaucugagcaug

SEQ ID NO: 95130 - RNA, 22 nt, Human
ggacagggaucauuaucugagc

SEQ ID NO: 95131 - RNA, 19 nt, Human
ggacagggggagcuuuuau

SEQ ID NO: 95132 - RNA, 22 nt, Human
ggacaggugacugcccagagug

SEQ ID NO: 95133 - RNA, 22 nt, Human
ggacaguagucacuaaacuaga

SEQ ID NO: 95134 - RNA, 22 nt, Human
ggacagugaauguggggaugca

SEQ ID NO: 95135 - RNA, 20 nt, Human
ggacagugagacauaucuca

SEQ ID NO: 95136 - RNA, 19 nt, Human
ggacaucacucuaagccuu

SEQ ID NO: 95137 - RNA, 18 nt, Human
ggacaucaucaggugcuu

SEQ ID NO: 95138 - RNA, 22 nt, Human
ggacaucuguugugguagagga

SEQ ID NO: 95139 - RNA, 21 nt, Human
ggacaugaggcaggagaggcu

SEQ ID NO: 95140 - RNA, 22 nt, Human
ggacaugauuagcagggagagc

SEQ ID NO: 95141 - RNA, 22 nt, Human
ggacauugaagcuggaaaggga

SEQ ID NO: 95142 - RNA, 22 nt, Human
ggacauuucuauugagcuaaga

SEQ ID NO: 95143 - RNA, 22 nt, Human
ggaccagagaagugagcaccug

SEQ ID NO: 95144 - RNA, 22 nt, Human
ggaccagcuaucaaugccaggg

SEQ ID NO: 95145 - RNA, 20 nt, Human
ggaccagcugucugaggggc

SEQ ID NO: 95146 - RNA, 19 nt, Human
ggaccagcuuucaggaggc

SEQ ID NO: 95147 - RNA, 22 nt, Human
ggaccaggggcgcacucccugc

SEQ ID NO: 95148 - RNA, 22 nt, Human
ggaccaguuucaaacuguacca

SEQ ID NO: 95149 - RNA, 22 nt, Human
ggacccacagauucuucauucu

SEQ ID NO: 95150 - RNA, 23 nt, Human
ggacccacggucuuugaggcucu

SEQ ID NO: 95151 - RNA, 22 nt, Human
ggacccagguagggaggaagau

SEQ ID NO: 95152 - RNA, 22 nt, Human
ggacccugcguguauccacacu

SEQ ID NO: 95153 - RNA, 20 nt, Human
ggacccuggguucuucugag

SEQ ID NO: 95154 - RNA, 22 nt, Human
ggacccuuggcuucugcagauu

SEQ ID NO: 95155 - RNA, 20 nt, Human
ggacuacaauuugcagugug

SEQ ID NO: 95156 - RNA, 22 nt, Human
ggacucaggcugguguucggac

SEQ ID NO: 95157 - RNA, 21 nt, Human
ggacucuacacaggccaucuu

SEQ ID NO: 95158 - RNA, 20 nt, Human
ggacugaaaacacaaaccug

SEQ ID NO: 95159 - RNA, 22 nt, Human
ggacugaagugcugucuagugu

SEQ ID NO: 95160 - RNA, 22 nt, Human
ggacugggauucuggaucugcu

SEQ ID NO: 95161 - RNA, 22 nt, Human
ggacuguagacaucagccugua

SEQ ID NO: 95162 - RNA, 22 nt, Human
ggacuugccuuuaguuaaaaua

SEQ ID NO: 95163 - RNA, 21 nt, Human
ggacuuggaugguggcaguag

SEQ ID NO: 95164 - RNA, 22 nt, Human
ggacuuuagcuguaaugugugu

SEQ ID NO: 95165 - RNA, 22 nt, Human
ggagaaaauugaugaaguuggc

SEQ ID NO: 95166 - RNA, 22 nt, Human
ggagaaagaagacgaacauugu

SEQ ID NO: 95167 - RNA, 22 nt, Human
ggagaaagcuguaguggaaugu

SEQ ID NO: 95168 - RNA, 22 nt, Human
ggagccugugggaugagaugug

SEQ ID NO: 95169 - RNA, 20 nt, Human
ggagcuagagcugaaagacu

SEQ ID NO: 95170 - RNA, 22 nt, Human
ggagcucaccuuggagucucug

SEQ ID NO: 95171 - RNA, 22 nt, Human
ggagcucugugucucuccugcc

SEQ ID NO: 95172 - RNA, 22 nt, Human
ggagcucuuccagcuuguugcu

SEQ ID NO: 95173 - RNA, 22 nt, Human
ggagcugaaggggugggcucag

SEQ ID NO: 95174 - RNA, 22 nt, Human
ggagcugagcagcgauggcgga

SEQ ID NO: 95175 - RNA, 22 nt, Human
ggagcugaggaauagcuuugau

SEQ ID NO: 95176 - RNA, 22 nt, Human
ggagcugaggcugaggccucac

SEQ ID NO: 95177 - RNA, 22 nt, Human
ggagcugagguaacagugagug

SEQ ID NO: 95178 - RNA, 22 nt, Human
ggagcugaugacgucaccaugg

SEQ ID NO: 95179 - RNA, 22 nt, Human
ggagcugcauuuagggagccuu

SEQ ID NO: 95180 - RNA, 22 nt, Human
ggagcugcucagagccaguccc

SEQ ID NO: 95181 - RNA, 18 nt, Human
ggagcugggccugguucc

SEQ ID NO: 95182 - RNA, 21 nt, Human
ggagcuggggagcuggcccca

SEQ ID NO: 95183 - RNA, 22 nt, Human
ggagcugggguuggcaucuucc

SEQ ID NO: 95184 - RNA, 22 nt, Human
ggagcuggucagccuugagcau

SEQ ID NO: 95185 - RNA, 22 nt, Human
ggagcuguagaucagcuaaucu

SEQ ID NO: 95186 - RNA, 22 nt, Human
ggagcugugcugggugaucagg

SEQ ID NO: 95187 - RNA, 22 nt, Human
ggagcuguuauggcauaagcau

SEQ ID NO: 95188 - RNA, 22 nt, Human
ggagcuguucaggacugcuuca

SEQ ID NO: 95189 - RNA, 22 nt, Human
ggagcuguuggcagcuaucuug

SEQ ID NO: 95190 - RNA, 22 nt, Human
ggaggaaaugaaaggaggguuu

SEQ ID NO: 95191 - RNA, 22 nt, Human
ggaggaagcccucggugcccca

SEQ ID NO: 95192 - RNA, 22 nt, Human
ggaggaccauccugguuucacc

SEQ ID NO: 95193 - RNA, 22 nt, Human
ggaggacugagacacuccuggc

SEQ ID NO: 95194 - RNA, 22 nt, Human
ggaggaggggugacugaaugcu

SEQ ID NO: 95195 - RNA, 22 nt, Human
ggaggagggguuuacauuggaa

SEQ ID NO: 95196 - RNA, 23 nt, Human
ggaggaguucccagcccuccugg

SEQ ID NO: 95197 - RNA, 22 nt, Human
ggaggccaaggcaggcggauca

SEQ ID NO: 95198 - RNA, 22 nt, Human
ggaggccaaggcagguggauca

SEQ ID NO: 95199 - RNA, 22 nt, Human
ggaggccaccauggagucacuu

SEQ ID NO: 95200 - RNA, 22 nt, Human
ggaggccaccugaccugcuguu

SEQ ID NO: 95201 - RNA, 22 nt, Human
ggaggccagccugaggcugagg

SEQ ID NO: 95202 - RNA, 22 nt, Human
ggaggccaggaagagccgcccu

SEQ ID NO: 95203 - RNA, 22 nt, Human
ggaggccagggacccagucagc

SEQ ID NO: 95204 - RNA, 22 nt, Human
ggaggccaggugggagucaucu

SEQ ID NO: 95205 - RNA, 22 nt, Human
ggaggcccagagaggugaagug

SEQ ID NO: 95206 - RNA, 22 nt, Human
ggaggccuaagguacaguuugc

SEQ ID NO: 95207 - RNA, 22 nt, Human
ggaggccucaguaccuugcuuu

SEQ ID NO: 95208 - RNA, 22 nt, Human
ggaggccucaucuugccccgug

SEQ ID NO: 95209 - RNA, 22 nt, Human
ggaggccuugaggccaggagcu

SEQ ID NO: 95210 - RNA, 22 nt, Human
ggaggcggacacagguaguguu

SEQ ID NO: 95211 - RNA, 23 nt, Human
ggaggcucaaguaucacgggcag

SEQ ID NO: 95212 - RNA, 22 nt, Human
ggaggcucagugaggaaaugga

SEQ ID NO: 95213 - RNA, 22 nt, Human
ggaggcuccaugagcuccugca

SEQ ID NO: 95214 - RNA, 22 nt, Human
ggaggcucugcuccguguguuc

SEQ ID NO: 95215 - RNA, 22 nt, Human
ggaggcuugaugaucuuggaua

SEQ ID NO: 95216 - RNA, 22 nt, Human
ggagggacccacugcggugacc

SEQ ID NO: 95217 - RNA, 22 nt, Human
ggagaucuugcuugaaggcaug

SEQ ID NO: 95218 - RNA, 20 nt, Human
ggagaugcagcccaggugcc

SEQ ID NO: 95219 - RNA, 20 nt, Human
ggagaugccucucaguccau

SEQ ID NO: 95220 - RNA, 22 nt, Human
ggagauggcaagaaguuauuag

SEQ ID NO: 95221 - RNA, 22 nt, Human
ggagcacccugcucagccaagc

SEQ ID NO: 95222 - RNA, 22 nt, Human
ggagcagcacugauuagcgguu

SEQ ID NO: 95223 - RNA, 22 nt, Human
ggagcagcacugccacacagag

SEQ ID NO: 95224 - RNA, 22 nt, Human
ggagcagccgcgucucagggca

SEQ ID NO: 95225 - RNA, 22 nt, Human
ggagcagcuugcaugcucaggg

SEQ ID NO: 95226 - RNA, 22 nt, Human
ggagcaggagucucuugaauuu

SEQ ID NO: 95227 - RNA, 22 nt, Human
ggagcagggaauuacagcgcag

SEQ ID NO: 95228 - RNA, 22 nt, Human
ggagcaguggucauucagcugg

SEQ ID NO: 95229 - RNA, 22 nt, Human
ggagccagaaaugcugugguug

SEQ ID NO: 95230 - RNA, 22 nt, Human
ggagccagcagggugacacuga

SEQ ID NO: 95231 - RNA, 22 nt, Human
ggagccaggcaaucuguacuuu

SEQ ID NO: 95232 - RNA, 18 nt, Human
ggagcccagaggugaguu

SEQ ID NO: 95233 - RNA, 22 nt, Human
ggagcccugcccuaggcagcuc

SEQ ID NO: 95234 - RNA, 22 nt, Human
ggagcccuuggcaccuaguagg

SEQ ID NO: 95235 - RNA, 22 nt, Human
ggagccggagggccacuggcag

SEQ ID NO: 95236 - RNA, 22 nt, Human
ggagccuggcccggcccuuggc

SEQ ID NO: 95237 - RNA, 22 nt, Human
ggagccuguggccgucacgacu

SEQ ID NO: 95238 - RNA, 22 nt, Human
ggagcggagggagggccacugu

SEQ ID NO: 95239 - RNA, 22 nt, Human
ggagcggcagauggagugggag

SEQ ID NO: 95240 - RNA, 22 nt, Human
ggagcgugcacuccaggcccuu

SEQ ID NO: 95241 - RNA, 22 nt, Human
ggagcgugcagcaugagcucau

SEQ ID NO: 95242 - RNA, 22 nt, Human
ggagcuaguaguuucaugaguu

SEQ ID NO: 95243 - RNA, 22 nt, Human
ggagcucagaagugagugaguu

SEQ ID NO: 95244 - RNA, 22 nt, Human
ggagcucaggcccagcaaggcc

SEQ ID NO: 95245 - RNA, 22 nt, Human
ggagcucugaggaugcauuggu

SEQ ID NO: 95246 - RNA, 22 nt, Human
ggagcugagaguagucccuuuu

SEQ ID NO: 95247 - RNA, 22 nt, Human
ggagcugaggacacuacauuuu

SEQ ID NO: 95248 - RNA, 22 nt, Human
ggagcugaguucuucagccggg

SEQ ID NO: 95249 - RNA, 22 nt, Human
ggagcugcacgcucugaagccu

SEQ ID NO: 95250 - RNA, 23 nt, Human
ggagcugcuguugggggagcugc

SEQ ID NO: 95251 - RNA, 22 nt, Human
ggagcugcuucuugcugugggu

SEQ ID NO: 95252 - RNA, 22 nt, Human
ggagcugcuuugaucugaagaa

SEQ ID NO: 95253 - RNA, 22 nt, Human
ggagcuggcagcgcaacccaga

SEQ ID NO: 95254 - RNA, 22 nt, Human
ggagcuggccgccuaugugcag

SEQ ID NO: 95255 - RNA, 22 nt, Human
ggagcuguugauuguuugagga

SEQ ID NO: 95256 - RNA, 22 nt, Human
ggagcuguugcgcaugcgcucg

SEQ ID NO: 95257 - RNA, 16 nt, Human
ggaggaaggcauagug

SEQ ID NO: 95258 - RNA, 22 nt, Human
ggaggaagggcccaggcuuuau

SEQ ID NO: 95259 - RNA, 22 nt, Human
ggaggacacuggcucugccuuc

SEQ ID NO: 95260 - RNA, 22 nt, Human
ggaggacucaggucuggccaug

SEQ ID NO: 95261 - RNA, 22 nt, Human
ggaggagacaguaaaaagcacg

SEQ ID NO: 95262 - RNA, 22 nt, Human
ggaggagacccugugucaguuu

SEQ ID NO: 95263 - RNA, 22 nt, Human
ggaggagauuccccucucacuu

SEQ ID NO: 95264 - RNA, 22 nt, Human
ggaggagcccacucaaagggga

SEQ ID NO: 95265 - RNA, 22 nt, Human
ggaggaguguggggcacucugc

SEQ ID NO: 95266 - RNA, 22 nt, Human
ggaggaugagcuacgaggagcu

SEQ ID NO: 95267 - RNA, 22 nt, Human
ggaggcaaagcacuuugcuugg

SEQ ID NO: 95268 - RNA, 23 nt, Human
ggaggcacuuaggcagagcagag

SEQ ID NO: 95269 - RNA, 22 nt, Human
ggaggcagaacuucccgucagu

SEQ ID NO: 95270 - RNA, 22 nt, Human
ggaggcauuauggggaagacuu

SEQ ID NO: 95271 - RNA, 22 nt, Human
ggaggccaaagugugggcggcu

SEQ ID NO: 95272 - RNA, 22 nt, Human
ggaggccaaggaggagcuugcc

SEQ ID NO: 95273 - RNA, 22 nt, Human
ggaggccaaggagggcggauca

SEQ ID NO: 95274 - RNA, 22 nt, Human
ggaggccaaggcagguggaucg

SEQ ID NO: 95275 - RNA, 22 nt, Human
ggaggccaaggugggcggauca

SEQ ID NO: 95276 - RNA, 22 nt, Human
ggaggccaauuuucuaacugca

SEQ ID NO: 95277 - RNA, 22 nt, Human
ggaggccaggaugggaacucaa

SEQ ID NO: 95278 - RNA, 22 nt, Human
ggaggccaggguggguggaucg

SEQ ID NO: 95279 - RNA, 22 nt, Human
ggaggccaugaggcucuaggug

SEQ ID NO: 95280 - RNA, 22 nt, Human
ggaggccuagaaaagugguucu

SEQ ID NO: 95281 - RNA, 22 nt, Human
uauaauaugaggcaggagugau

SEQ ID NO: 95282 - RNA, 22 nt, Human
uauaauauuccuuguuguaggu

SEQ ID NO: 95283 - RNA, 22 nt, Human
uauaauuuggggaaaguggugu

SEQ ID NO: 95284 - RNA, 22 nt, Human
uauaauuuuagaagagauggaa

SEQ ID NO: 95285 - RNA, 22 nt, Human
uauaauuuuucuguggccaguu

SEQ ID NO: 95286 - RNA, 22 nt, Human
uauacaaguaaugcugaaugau

SEQ ID NO: 95287 - RNA, 22 nt, Human
uauacaaugaguacauucuggg

SEQ ID NO: 95288 - RNA, 22 nt, Human
uauacacacaugcuccggccuu

SEQ ID NO: 95289 - RNA, 17 nt, Human
uauacacagacagacug

SEQ ID NO: 95290 - RNA, 22 nt, Human
uauacacaggaaucugugaaaa

SEQ ID NO: 95291 - RNA, 22 nt, Human
uauacacuguuguugggagucu

SEQ ID NO: 95292 - RNA, 15 nt, Human
uauacagaaguucag

SEQ ID NO: 95293 - RNA, 21 nt, Human
uauacagaggggaacaggaga

SEQ ID NO: 95294 - RNA, 22 nt, Human
uauacagauuaacagauuuaaa

SEQ ID NO: 95295 - RNA, 22 nt, Human
uauacagcuauggcaagacaaa

SEQ ID NO: 95296 - RNA, 22 nt, Human
uauacagucuuuugcuauauuc

SEQ ID NO: 95297 - RNA, 21 nt, Human
uauacaugugugcauacgugu

SEQ ID NO: 95298 - RNA, 22 nt, Human
uauaccuuccacaaaacagcuu

SEQ ID NO: 95299 - RNA, 22 nt, Human
uauaccuugagcagggcggccc

SEQ ID NO: 95300 - RNA, 22 nt, Human
uauacuaugcuucugauccaau

SEQ ID NO: 95301 - RNA, 22 nt, Human
uauacuuaugcuaaaaaauguu

SEQ ID NO: 95302 - RNA, 22 nt, Human
uauacuucccugcagaguaaag

SEQ ID NO: 95303 - RNA, 22 nt, Human
uauagacuagcagcagaauuua

SEQ ID NO: 95304 - RNA, 22 nt, Human
uauagagcuuuggcauugauua

SEQ ID NO: 95305 - RNA, 22 nt, Human
uauagaggccaccaacaugaaa

SEQ ID NO: 95306 - RNA, 22 nt, Human
uauagcaaggacauaauaugcu

SEQ ID NO: 95307 - RNA, 22 nt, Human
uauagcacacaguuuauaaaag

SEQ ID NO: 95308 - RNA, 22 nt, Human
uauagccauuuccaguggcauc

SEQ ID NO: 95309 - RNA, 19 nt, Human
uauaggaagugugguuaag

SEQ ID NO: 95310 - RNA, 22 nt, Human
uauaggauugguucccauuuua

SEQ ID NO: 95311 - RNA, 21 nt, Human
uauaggcuuccauaugaaggg

SEQ ID NO: 95312 - RNA, 22 nt, Human
uauagguaugucgagaaaugaa

SEQ ID NO: 95313 - RNA, 22 nt, Human
uauaguaaaauuuucauuuaug

SEQ ID NO: 95314 - RNA, 22 nt, Human
uauaguacauggaaucuucaua

SEQ ID NO: 95315 - RNA, 21 nt, Human
uauaguguggauaugcugaug

SEQ ID NO: 95316 - RNA, 22 nt, Human
uauauaagauggguaggcuugu

SEQ ID NO: 95317 - RNA, 22 nt, Human
uauauaauuuucugccauaucc

SEQ ID NO: 95318 - RNA, 22 nt, Human
uauauacaagguagguuuaggu

SEQ ID NO: 95319 - RNA, 22 nt, Human
uauauacuaugcgauuccugcc

SEQ ID NO: 95320 - RNA, 22 nt, Human
uauauagaaaagcagauguugg

SEQ ID NO: 95321 - RNA, 20 nt, Human
uauauaggaaauauuguguu

SEQ ID NO: 95322 - RNA, 22 nt, Human
uauaucauggagauuaacauuc

SEQ ID NO: 95323 - RNA, 22 nt, Human
uauauccagaaaaucaguucau

SEQ ID NO: 95324 - RNA, 22 nt, Human
uauaucuggauggacugcagaa

SEQ ID NO: 95325 - RNA, 22 nt, Human
uauaugaugccaaauaaccugu

SEQ ID NO: 95326 - RNA, 22 nt, Human
ggcagagguagcuggaaccagg

SEQ ID NO: 95327 - RNA, 22 nt, Human
ggcagaggugacagugucuuuu

SEQ ID NO: 95328 - RNA, 22 nt, Human
ggcagagucagaggugguucug

SEQ ID NO: 95329 - RNA, 20 nt, Human
ggcagaugcagagcuaugca

SEQ ID NO: 95330 - RNA, 22 nt, Human
ggcagauggagaagcagcaggu

SEQ ID NO: 95331 - RNA, 23 nt, Human
ggcagauuugguuuguuuuaaua

SEQ ID NO: 95332 - RNA, 22 nt, Human
ggcagcaaaaagccugguugaa

SEQ ID NO: 95333 - RNA, 22 nt, Human
ggcagcaaacuggcuucaggcu

SEQ ID NO: 95334 - RNA, 22 nt, Human
ggcagcaaauauugucagcugu

SEQ ID NO: 95335 - RNA, 22 nt, Human
ggcagcaacgaggcuugauacc

SEQ ID NO: 95336 - RNA, 22 nt, Human
ggcagcaacucggagagaagag

SEQ ID NO: 95337 - RNA, 22 nt, Human
ggcagcaagagagguucagcuu

SEQ ID NO: 95338 - RNA, 22 nt, Human
ggcagcaaguaggauucuuauu

SEQ ID NO: 95339 - RNA, 22 nt, Human
ggcagcacgacaggaguggaag

SEQ ID NO: 95340 - RNA, 22 nt, Human
ggcagcaggagccaucugguag

SEQ ID NO: 95341 - RNA, 20 nt, Human
ggcagcaggaguuuccucuu

SEQ ID NO: 95342 - RNA, 22 nt, Human
ggcagcaucuugauauugguuu

SEQ ID NO: 95343 - RNA, 22 nt, Human
ggcagccaugcacgcugccugg

SEQ ID NO: 95344 - RNA, 22 nt, Human
ggcagccauggacacuggcuag

SEQ ID NO: 95345 - RNA, 22 nt, Human
ggcagccaugucccagggcuuc

SEQ ID NO: 95346 - RNA, 22 nt, Human
ggcagccaugugggcagcgagu

SEQ ID NO: 95347 - RNA, 22 nt, Human
ggcagccucagguuuucuuuga

SEQ ID NO: 95348 - RNA, 22 nt, Human
ggcagccuccagggcacuggug

SEQ ID NO: 95349 - RNA, 21 nt, Human
ggcagccucuguggaagggga

SEQ ID NO: 95350 - RNA, 21 nt, Human
ggcagccugacccccagagag

SEQ ID NO: 95351 - RNA, 19 nt, Human
ggcagccugcacgggcugc

SEQ ID NO: 95352 - RNA, 22 nt, Human
ggcagcucacgggcauggggug

SEQ ID NO: 95353 - RNA, 20 nt, Human
ggcagcucacuacuuucugu

SEQ ID NO: 95354 - RNA, 22 nt, Human
ggcagcuccuccuagucugccc

SEQ ID NO: 95355 - RNA, 22 nt, Human
ggcagcugaagaggaacuuugg

SEQ ID NO: 95356 - RNA, 22 nt, Human
ggcagcugcugcauuacguugu

SEQ ID NO: 95357 - RNA, 19 nt, Human
ggcagcuggacgcuguuca

SEQ ID NO: 95358 - RNA, 22 nt, Human
ggcagcugggucacaccgaucu

SEQ ID NO: 95359 - RNA, 22 nt, Human
ggcagcuggguuggccagaaac

SEQ ID NO: 95360 - RNA, 22 nt, Human
ggcagcugucucauucacaccu

SEQ ID NO: 95361 - RNA, 22 nt, Human
ggcagcugugaagugccucaca

SEQ ID NO: 95362 - RNA, 22 nt, Human
ggcagcuucuuaauauggagac

SEQ ID NO: 95363 - RNA, 22 nt, Human
ggcagcuugcccuggucucaac

SEQ ID NO: 95364 - RNA, 19 nt, Human
ggcagcuugggaagguagc

SEQ ID NO: 95365 - RNA, 22 nt, Human
ggcagcuuguccuggaggaugg

SEQ ID NO: 95366 - RNA, 22 nt, Human
ggcagcuuucaccugucuuccu

SEQ ID NO: 95367 - RNA, 22 nt, Human
ggcagcuuucucacccaugacc

SEQ ID NO: 95368 - RNA, 22 nt, Human
ggcaggaaaugggauaagggcu

SEQ ID NO: 95369 - RNA, 22 nt, Human
ggcaggaagcucauguggacug

SEQ ID NO: 95370 - RNA, 22 nt, Human
ggcaggacaggggaauguuugg

SEQ ID NO: 95371 - RNA, 22 nt, Human
ggcaggagaauggcgugaacuc

SEQ ID NO: 95372 - RNA, 22 nt, Human
ggcaggagauaaaauauuaguu

SEQ ID NO: 95373 - RNA, 22 nt, Human
ggcaggaggaagaguuagcacc

SEQ ID NO: 95374 - RNA, 22 nt, Human
ggcaggagggcggacaaugacc

SEQ ID NO: 95375 - RNA, 22 nt, Human
ggcaggaggugaguggcgggug

SEQ ID NO: 95376 - RNA, 22 nt, Human
ggcaggcaagucugcucuguga

SEQ ID NO: 95377 - RNA, 22 nt, Human
ggcaggcacugugauagauucu

SEQ ID NO: 95378 - RNA, 22 nt, Human
ggcaggcacuguguuuuguguu

SEQ ID NO: 95379 - RNA, 22 nt, Human
ggcaggcagaaaaauagaauau

SEQ ID NO: 95380 - RNA, 22 nt, Human
ggcaggcaggagcgugcuuggg

SEQ ID NO: 95381 - RNA, 22 nt, Human
ggcaggcaucaucaguugauca

SEQ ID NO: 95382 - RNA, 22 nt, Human
ggcaggcaucauguggucauua

SEQ ID NO: 95383 - RNA, 22 nt, Human
ggcaggcauuagagauucccag

SEQ ID NO: 95384 - RNA, 22 nt, Human
ggcaggcauugcaacauguaca

SEQ ID NO: 95385 - RNA, 22 nt, Human
ggcaggcuccguguuccauucc

SEQ ID NO: 95386 - RNA, 19 nt, Human
ggcaggcuggauagagagg

SEQ ID NO: 95387 - RNA, 22 nt, Human
ggcaggcuuucagcaucaaguc

SEQ ID NO: 95388 - RNA, 22 nt, Human
ggcaggcuuugagaaagagcau

SEQ ID NO: 95389 - RNA, 22 nt, Human
ggcagggcccugauuccugggg

SEQ ID NO: 95390 - RNA, 22 nt, Human
ggcagggcuugucucugugaug

SEQ ID NO: 95391 - RNA, 22 nt, Human
ggcaggggugaggccacucuga

SEQ ID NO: 95392 - RNA, 22 nt, Human
ggcaggguaugauuaccucuga

SEQ ID NO: 95393 - RNA, 22 nt, Human
ggcagggucuggacugaaagcu

SEQ ID NO: 95394 - RNA, 22 nt, Human
ggcagguacagcaagaggacaa

SEQ ID NO: 95395 - RNA, 22 nt, Human
ggcaggucaucaacuguaauuu

SEQ ID NO: 95396 - RNA, 22 nt, Human
ggcaggugaccuggccucccag

SEQ ID NO: 95397 - RNA, 22 nt, Human
ggcaggugacggggaugaguau

SEQ ID NO: 95398 - RNA, 22 nt, Human
ggcaggugcaccugagccaucu

SEQ ID NO: 95399 - RNA, 22 nt, Human
ggcaggugcgcauguugcauua

SEQ ID NO: 95400 - RNA, 17 nt, Human
ggcaggugcggggccgc

SEQ ID NO: 95401 - RNA, 22 nt, Human
ggcagguggacgugcuaaagcu

SEQ ID NO: 95402 - RNA, 22 nt, Human
ggcagguggccaagugucuaag

SEQ ID NO: 95403 - RNA, 21 nt, Human
ggcaggugggucucuguugcu

SEQ ID NO: 95404 - RNA, 22 nt, Human
ggcaguagccagggacuggcag

SEQ ID NO: 95405 - RNA, 19 nt, Human
ggcagucacggucaggagc

SEQ ID NO: 95406 - RNA, 22 nt, Human
ggcagucagugugguucauaaa

SEQ ID NO: 95407 - RNA, 22 nt, Human
ggcagucuaguguccuugggcc

SEQ ID NO: 95408 - RNA, 22 nt, Human
ggcagucuuaucagcauuggac

SEQ ID NO: 95409 - RNA, 22 nt, Human
ggcagugaaucugagagccugg

SEQ ID NO: 95410 - RNA, 19 nt, Human
ggcagugagaagacuccug

SEQ ID NO: 95411 - RNA, 22 nt, Human
ggcagugagucccggagaggcc

SEQ ID NO: 95412 - RNA, 21 nt, Human
ggcagugaugugaagugcauc

SEQ ID NO: 95413 - RNA, 22 nt, Human
ggcagugccacuaagcucugcu

SEQ ID NO: 95414 - RNA, 17 nt, Human
ggcaguggaggaagaga

SEQ ID NO: 95415 - RNA, 22 nt, Human
ggcaguggcagagcuuggucua

SEQ ID NO: 95416 - RNA, 22 nt, Human
ggcaguguccuugcagcucuac

SEQ ID NO: 95417 - RNA, 22 nt, Human
ggcauagaaugugcugugacaa

SEQ ID NO: 95418 - RNA, 22 nt, Human
ggcauccaaauaccaagaugua

SEQ ID NO: 95419 - RNA, 22 nt, Human
ggcaggugagagcucuuugaaa

SEQ ID NO: 95420 - RNA, 22 nt, Human
ggcaggugaggcaugugccugg

SEQ ID NO: 95421 - RNA, 22 nt, Human
ggcaggugaucuagagucaaua

SEQ ID NO: 95422 - RNA, 22 nt, Human
ggcaggugcuaagagagguaaa

SEQ ID NO: 95423 - RNA, 22 nt, Human
ggcaggugcucaaaaauauuug

SEQ ID NO: 95424 - RNA, 22 nt, Human
ggcaggugcucugugggccugg

SEQ ID NO: 95425 - RNA, 22 nt, Human
ggcaggugcugggagcaucuca

SEQ ID NO: 95426 - RNA, 20 nt, Human
ggcaggugcuguccccuccu

SEQ ID NO: 95427 - RNA, 22 nt, Human
ggcagguggauuuucuacucua

SEQ ID NO: 95428 - RNA, 22 nt, Human
ggcagguguggugaccagagau

SEQ ID NO: 95429 - RNA, 22 nt, Human
ggcagguuggaugcuguaguga

SEQ ID NO: 95430 - RNA, 22 nt, Human
ggcaguaugaguucaaauaauu

SEQ ID NO: 95431 - RNA, 22 nt, Human
ggcagucacaggggagacuggg

SEQ ID NO: 95432 - RNA, 22 nt, Human
ggcagucauuuaaucccugcau

SEQ ID NO: 95433 - RNA, 22 nt, Human
ggcagucccagcccagaggcgc

SEQ ID NO: 95434 - RNA, 19 nt, Human
ggcagucucaagcagcaca

SEQ ID NO: 95435 - RNA, 22 nt, Human
ucagaaguuaauauauaaauuu

SEQ ID NO: 95436 - RNA, 22 nt, Human
ucagaaguugaaggcucuuuuu

SEQ ID NO: 95437 - RNA, 22 nt, Human
ucagaauaaacaugggcauggg

SEQ ID NO: 95438 - RNA, 22 nt, Human
ucagaauaaguuaugaaaugaa

SEQ ID NO: 95439 - RNA, 22 nt, Human
ucagaaucuaaauaggcuccag

SEQ ID NO: 95440 - RNA, 22 nt, Human
ucagaaucucuggaggcuuggc

SEQ ID NO: 95441 - RNA, 21 nt, Human
ucagaaucugugagcuaucuc

SEQ ID NO: 95442 - RNA, 22 nt, Human
ucagaauuaagcucuuggucag

SEQ ID NO: 95443 - RNA, 23 nt, Human
ucagaauuccaguuucuuugaag

SEQ ID NO: 95444 - RNA, 22 nt, Human
ucagaauucugaagggcacaaa

SEQ ID NO: 95445 - RNA, 22 nt, Human
ucagaauugucuggggaauguu

SEQ ID NO: 95446 - RNA, 22 nt, Human
ucagaauuugauuccugggaua

SEQ ID NO: 95447 - RNA, 22 nt, Human
ucagaauuuucuggaauggagc

SEQ ID NO: 95448 - RNA, 22 nt, Human
ucagaauuuugguuugguuggu

SEQ ID NO: 95449 - RNA, 22 nt, Human
ucagacacagaugagacaagga

SEQ ID NO: 95450 - RNA, 22 nt, Human
ucagacagaggagcucgugcag

SEQ ID NO: 95451 - RNA, 22 nt, Human
ucagacaggccucuccagccuc

SEQ ID NO: 95452 - RNA, 22 nt, Human
ucagacagggcuucucaaacuu

SEQ ID NO: 95453 - RNA, 22 nt, Human
ucagacagugugaucagucucu

SEQ ID NO: 95454 - RNA, 22 nt, Human
ucagacaguuugcagugugccu

SEQ ID NO: 95455 - RNA, 22 nt, Human
ucagacauguuuuaagacuuau

SEQ ID NO: 95456 - RNA, 20 nt, Human
ucagacccggggaagggagc

SEQ ID NO: 95457 - RNA, 17 nt, Human
ucagacccugugucagg

SEQ ID NO: 95458 - RNA, 19 nt, Human
ucagacugaaaguuuagau

SEQ ID NO: 95459 - RNA, 22 nt, Human
ucagacuucaguuuuuaguugu

SEQ ID NO: 95460 - RNA, 22 nt, Human
ucagacuucuacuuugcagagc

SEQ ID NO: 95461 - RNA, 22 nt, Human
ucagacuuuaaaggcuaacagg

SEQ ID NO: 95462 - RNA, 22 nt, Human
ucagagaacuggcauguuuaga

SEQ ID NO: 95463 - RNA, 22 nt, Human
ucagagaagcugccaggcgagc

SEQ ID NO: 95464 - RNA, 22 nt, Human
ucagagaagcuuaagcuguaau

SEQ ID NO: 95465 - RNA, 22 nt, Human
ucagagaaggcaauuuuauggu

SEQ ID NO: 95466 - RNA, 22 nt, Human
ucagagaaguaggcuaauggug

SEQ ID NO: 95467 - RNA, 22 nt, Human
ucagagaauccguaagucacaa

SEQ ID NO: 95468 - RNA, 23 nt, Human
ucagagaaugguaugcuuuuccu

SEQ ID NO: 95469 - RNA, 22 nt, Human
ucagagacaccagagagcugug

SEQ ID NO: 95470 - RNA, 22 nt, Human
ucagagacaucagguuguagca

SEQ ID NO: 95471 - RNA, 22 nt, Human
ucagagagaaauaguuuuugac

SEQ ID NO: 95472 - RNA, 18 nt, Human
ucagagagcagcuuuauu

SEQ ID NO: 95473 - RNA, 22 nt, Human
ucagagagguuggugauaagaa

SEQ ID NO: 95474 - RNA, 22 nt, Human
ucagagagugcaaaauauagcu

SEQ ID NO: 95475 - RNA, 22 nt, Human
ucagagaguuagugucuuagcu

SEQ ID NO: 95476 - RNA, 22 nt, Human
ucagagaucuucaggaugggac

SEQ ID NO: 95477 - RNA, 22 nt, Human
ucagagauggaguuagcaguga

SEQ ID NO: 95478 - RNA, 22 nt, Human
ucagagcaaauuccugugagcc

SEQ ID NO: 95479 - RNA, 22 nt, Human
ucagagcaacuuuuccugcuuu

SEQ ID NO: 95480 - RNA, 22 nt, Human
ucagagcacuggugcuaccuug

SEQ ID NO: 95481 - RNA, 22 nt, Human
ucagagcauucgggugacaaau

SEQ ID NO: 95482 - RNA, 22 nt, Human
ucagagccaaucauggugcauu

SEQ ID NO: 95483 - RNA, 22 nt, Human
ucagagcccugcuccuccccaa

SEQ ID NO: 95484 - RNA, 22 nt, Human
ucagagcugggugcuucuuccu

SEQ ID NO: 95485 - RNA, 22 nt, Human
ucagagcuuaucucuugcugga

SEQ ID NO: 95486 - RNA, 22 nt, Human
ucagaggaaacaaucuuuagua

SEQ ID NO: 95487 - RNA, 22 nt, Human
ucagaggaacuggacuaaagcc

SEQ ID NO: 95488 - RNA, 22 nt, Human
ucagaggaagcaucaaguucuc

SEQ ID NO: 95489 - RNA, 22 nt, Human
ucagaggagcaaaagaggggau

SEQ ID NO: 95490 - RNA, 22 nt, Human
ucagaggagccaaaguucugag

SEQ ID NO: 95491 - RNA, 22 nt, Human
ucagaggaucaugucccuacuc

SEQ ID NO: 95492 - RNA, 22 nt, Human
ucagaggaugcuguucuuuaau

SEQ ID NO: 95493 - RNA, 21 nt, Human
ucagaggcacugagagcaaug

SEQ ID NO: 95494 - RNA, 22 nt, Human
ucagaggcaucauucauaguua

SEQ ID NO: 95495 - RNA, 22 nt, Human
ucagaggccaaacugagcaggg

SEQ ID NO: 95496 - RNA, 21 nt, Human
ucagagggcccuggaggcuca

SEQ ID NO: 95497 - RNA, 22 nt, Human
ucagaggucacacagcaaguuu

SEQ ID NO: 95498 - RNA, 22 nt, Human
ucagaggucagcagcuugccca

SEQ ID NO: 95499 - RNA, 22 nt, Human
ucagaggugcaagaaguucuga

SEQ ID NO: 95500 - RNA, 22 nt, Human
ucagagguggcaggggugucca

SEQ ID NO: 95501 - RNA, 22 nt, Human
ucagagguucuucucaguggcc

SEQ ID NO: 95502 - RNA, 23 nt, Human
ucagaguagcaauuuuucucucc

SEQ ID NO: 95503 - RNA, 20 nt, Human
ucagagucaucaaagauggu

SEQ ID NO: 95504 - RNA, 22 nt, Human
ucagaguccuuuggccugacag

SEQ ID NO: 95505 - RNA, 22 nt, Human
ucagagucuaugcaacagaauu

SEQ ID NO: 95506 - RNA, 22 nt, Human
ucagagucucccccaguuuggg

SEQ ID NO: 95507 - RNA, 22 nt, Human
ucagagucugugcauucugcua

SEQ ID NO: 95508 - RNA, 22 nt, Human
ucagagugaggcccagcaaucu

SEQ ID NO: 95509 - RNA, 22 nt, Human
ucagagugaggcgucaacauga

SEQ ID NO: 95510 - RNA, 22 nt, Human
ucagaguggugguuuugccuuc

SEQ ID NO: 95511 - RNA, 22 nt, Human
ucagagugugagacauauugga

SEQ ID NO: 95512 - RNA, 22 nt, Human
ucagaguucucuguccagauga

SEQ ID NO: 95513 - RNA, 22 nt, Human
ucagaguuucaggauacaaaua

SEQ ID NO: 95514 - RNA, 21 nt, Human
ucagauaccagacucaagggg

SEQ ID NO: 95515 - RNA, 22 nt, Human
ucagaucacaaaaguuucuauu

SEQ ID NO: 95516 - RNA, 22 nt, Human
ucagaucuggugaaguuauagu

SEQ ID NO: 95517 - RNA, 23 nt, Human
ucagaugaggaaugcauacuaau

SEQ ID NO: 95518 - RNA, 22 nt, Human
ucagaugagugcuuucagcugc

SEQ ID NO: 95519 - RNA, 22 nt, Human
ucagauggcauagguuggaauu

SEQ ID NO: 95520 - RNA, 22 nt, Human
ucagaugguacuaauuuaagga

SEQ ID NO: 95521 - RNA, 22 nt, Human
ucagauggucauucacuagggu

SEQ ID NO: 95522 - RNA, 22 nt, Human
ucagaugguuccaucauuuuuc

SEQ ID NO: 95523 - RNA, 22 nt, Human
ucagauguugaaaaggaaaagu

SEQ ID NO: 95524 - RNA, 22 nt, Human
ucagauuuagggugauuaccuu

SEQ ID NO: 95525 - RNA, 22 nt, Human
ucagauuucagcuaaagggaug

SEQ ID NO: 95526 - RNA, 22 nt, Human
ucagauuuuauuuuccuguuac

SEQ ID NO: 95527 - RNA, 20 nt, Human
ucagauuuugggucacugau

SEQ ID NO: 95528 - RNA, 22 nt, Human
ucagauuuuugagaugucuguu

SEQ ID NO: 95529 - RNA, 22 nt, Human
ucagcaaaggaccagcacaggc

SEQ ID NO: 95530 - RNA, 22 nt, Human
ucagcaagaagucauuuguagc

SEQ ID NO: 95531 - RNA, 22 nt, Human
ucagcaagcagggggauguuca

SEQ ID NO: 95532 - RNA, 22 nt, Human
ucagcacaggucuugcaaaaca

SEQ ID NO: 95533 - RNA, 22 nt, Human
ucagcacugauguuucagaaga

SEQ ID NO: 95534 - RNA, 22 nt, Human
ucagcacugucuauuagugaga

SEQ ID NO: 95535 - RNA, 22 nt, Human
ucagcagaccuguuauuuggau

SEQ ID NO: 95536 - RNA, 22 nt, Human
ucagcagaggggaaggcaucug

SEQ ID NO: 95537 - RNA, 22 nt, Human
ucagcagaguggaacauuguca

SEQ ID NO: 95538 - RNA, 19 nt, Human
ucagcagcacugugauuuc

SEQ ID NO: 95539 - RNA, 22 nt, Human
ggcuggaaguccaagaucaagg

SEQ ID NO: 95540 - RNA, 20 nt, Human
ggcuggaaguguggguuugg

SEQ ID NO: 95541 - RNA, 22 nt, Human
ggcuggaaugcaacuguguguu

SEQ ID NO: 95542 - RNA, 22 nt, Human
ggcuggacuuucugcugggcuc

SEQ ID NO: 95543 - RNA, 22 nt, Human
ggcuggacuuuuugcaggucau

SEQ ID NO: 95544 - RNA, 22 nt, Human
ggcucuggaaaguguccuugau

SEQ ID NO: 95545 - RNA, 22 nt, Human
ucagcagcagcucagcauguuu

SEQ ID NO: 95546 - RNA, 22 nt, Human
ucagcagccgcagcugacucag

SEQ ID NO: 95547 - RNA, 22 nt, Human
ucagcaggcacggacaggcugc

SEQ ID NO: 95548 - RNA, 22 nt, Human
ucagcaggcagugggucacaau

SEQ ID NO: 95549 - RNA, 22 nt, Human
ucagcaggcgguuccuuguggg

SEQ ID NO: 95550 - RNA, 22 nt, Human
ucagcagggccuccuugugcag

SEQ ID NO: 95551 - RNA, 22 nt, Human
ucagcaggugcuuuguuuacuc

SEQ ID NO: 95552 - RNA, 17 nt, Human
ucagcaguaaugguggg

SEQ ID NO: 95553 - RNA, 22 nt, Human
ucagcaguagagggggcacagu

SEQ ID NO: 95554 - RNA, 22 nt, Human
ucagcaguccuccaggaucaag

SEQ ID NO: 95555 - RNA, 22 nt, Human
ucagcaguguaguuuaucauuc

SEQ ID NO: 95556 - RNA, 22 nt, Human
ucagcagugucaguucccagag

SEQ ID NO: 95557 - RNA, 22 nt, Human
ucagcagugugcccagaggcug

SEQ ID NO: 95558 - RNA, 22 nt, Human
ucagcagugugcuuggaaugga

SEQ ID NO: 95559 - RNA, 22 nt, Human
ucagcaguuauuccccuacaga

SEQ ID NO: 95560 - RNA, 23 nt, Human
ucagcaucaccugggaacuuacu

SEQ ID NO: 95561 - RNA, 22 nt, Human
ucagcaucagguugucugaauu

SEQ ID NO: 95562 - RNA, 22 nt, Human
ucagcaucuucagcauggggaa

SEQ ID NO: 95563 - RNA, 22 nt, Human
ucagcauguucuuaggucacag

SEQ ID NO: 95564 - RNA, 19 nt, Human
ucagccaccagaagagaua

SEQ ID NO: 95565 - RNA, 22 nt, Human
ucagccacuacccaccuuaaca

SEQ ID NO: 95566 - RNA, 22 nt, Human
ucagccagaggcuucuugguuu

SEQ ID NO: 95567 - RNA, 22 nt, Human
ucagccagcaucagcuaagugc

SEQ ID NO: 95568 - RNA, 22 nt, Human
ucagccagcugugugcuucugc

SEQ ID NO: 95569 - RNA, 22 nt, Human
ucagccaggccaggcauucaca

SEQ ID NO: 95570 - RNA, 22 nt, Human
ucagccagggcagagcagguga

SEQ ID NO: 95571 - RNA, 22 nt, Human
ucagccagggggagagaaugga

SEQ ID NO: 95572 - RNA, 22 nt, Human
ucagccagguaauguggagaug

SEQ ID NO: 95573 - RNA, 22 nt, Human
ucagccaguuaaggcuuagaca

SEQ ID NO: 95574 - RNA, 22 nt, Human
ucagccaguugccccaguuagu

SEQ ID NO: 95575 - RNA, 22 nt, Human
ucagcccaccuucaggggaguu

SEQ ID NO: 95576 - RNA, 22 nt, Human
ucagcccagcccagcaagugca

SEQ ID NO: 95577 - RNA, 22 nt, Human
ucagcccaggagguugagacua

SEQ ID NO: 95578 - RNA, 20 nt, Human
ucagcccagggugagcaucu

SEQ ID NO: 95579 - RNA, 21 nt, Human
ucagcccaggugucuuugccc

SEQ ID NO: 95580 - RNA, 22 nt, Human
ucagcccaucacucacguauua

SEQ ID NO: 95581 - RNA, 22 nt, Human
ucagcccuagccucaguccagg

SEQ ID NO: 95582 - RNA, 20 nt, Human
ucagcccugaguccaggcug

SEQ ID NO: 95583 - RNA, 22 nt, Human
ucagcccugggacccagggaug

SEQ ID NO: 95584 - RNA, 22 nt, Human
ucagccuccuaauuuccuguga

SEQ ID NO: 95585 - RNA, 22 nt, Human
ucagccugcuccaagugcugcc

SEQ ID NO: 95586 - RNA, 22 nt, Human
ucagccuggcaggauggccugg

SEQ ID NO: 95587 - RNA, 22 nt, Human
ucagcuacagcaucucugcuuu

SEQ ID NO: 95588 - RNA, 22 nt, Human
ucagcuaggcacuucucacuga

SEQ ID NO: 95589 - RNA, 22 nt, Human
ucagcucaucugagugucagcg

SEQ ID NO: 95590 - RNA, 22 nt, Human
ucagcucggccuaggcccacgg

SEQ ID NO: 95591 - RNA, 22 nt, Human
ucagcucuaccugggagcuguc

SEQ ID NO: 95592 - RNA, 22 nt, Human
ucagcucucacagaucucaacc

SEQ ID NO: 95593 - RNA, 22 nt, Human
ucagcucugcacuccacugugg

SEQ ID NO: 95594 - RNA, 19 nt, Human
ucagcucuggggucagugg

SEQ ID NO: 95595 - RNA, 22 nt, Human
ucagcucugguucauguggucu

SEQ ID NO: 95596 - RNA, 22 nt, Human
ucagcucuuaacccucuggccu

SEQ ID NO: 95597 - RNA, 22 nt, Human
ucagcucuuccccccagccagg

SEQ ID NO: 95598 - RNA, 22 nt, Human
ucagcugaguucuagagcacuc

SEQ ID NO: 95599 - RNA, 22 nt, Human
ucagcugcacuguucugaccca

SEQ ID NO: 95600 - RNA, 22 nt, Human
ucagcuggagaugagaaccgaa

SEQ ID NO: 95601 - RNA, 18 nt, Human
ucagcuggggcugcagcc

SEQ ID NO: 95602 - RNA, 22 nt, Human
ucagcugggugaguguucugca

SEQ ID NO: 95603 - RNA, 22 nt, Human
ucagcuggugaauggacucauc

SEQ ID NO: 95604 - RNA, 22 nt, Human
ucagcugguguuucuucuccuu

SEQ ID NO: 95605 - RNA, 22 nt, Human
ucagcuguacugugccauagcu

SEQ ID NO: 95606 - RNA, 22 nt, Human
ucagcuguagguauggaugucc

SEQ ID NO: 95607 - RNA, 22 nt, Human
ucagcuguaucuugcugcacuu

SEQ ID NO: 95608 - RNA, 22 nt, Human
ucagcuguuaucacugucuguc

SEQ ID NO: 95609 - RNA, 23 nt, Human
ucagcuguucuuuucccugggac

SEQ ID NO: 95610 - RNA, 22 nt, Human
ucagcuguuuugaguuuaauug

SEQ ID NO: 95611 - RNA, 22 nt, Human
ucagcuucaaauuuggugaagu

SEQ ID NO: 95612 - RNA, 18 nt, Human
ucagcuuccagcauguuu

SEQ ID NO: 95613 - RNA, 22 nt, Human
ucagcuucuccaagugacaugg

SEQ ID NO: 95614 - RNA, 22 nt, Human
ucagcuuucucagaggccuaac

SEQ ID NO: 95615 - RNA, 22 nt, Human
ucagcuuucucuucuaucgaua

SEQ ID NO: 95616 - RNA, 22 nt, Human
ucagcuuugaucucaggcaauc

SEQ ID NO: 95617 - RNA, 22 nt, Human
ucagcuuugccaccagcuguaa

SEQ ID NO: 95618 - RNA, 22 nt, Human
ucaggaaaauacugcuuaucca

SEQ ID NO: 95619 - RNA, 22 nt, Human
ucaggaaaguguucucagagga

SEQ ID NO: 95620 - RNA, 22 nt, Human
ucaggaaauggcuucaugguuu

SEQ ID NO: 95621 - RNA, 22 nt, Human
ucaggaagacaaucuuuggcuc

SEQ ID NO: 95622 - RNA, 21 nt, Human
ucaggaagagccaguucaugc

SEQ ID NO: 95623 - RNA, 22 nt, Human
ucaggaaggcgccccaucagga

SEQ ID NO: 95624 - RNA, 22 nt, Human
ucaggaaguauaaucagauuca

SEQ ID NO: 95625 - RNA, 22 nt, Human
ucaggaagucucaauuagcuac

SEQ ID NO: 95626 - RNA, 22 nt, Human
ucaggaagugcugaggcugcuu

SEQ ID NO: 95627 - RNA, 22 nt, Human
ucaggaagugguaaaggauguu

SEQ ID NO: 95628 - RNA, 22 nt, Human
ucaggaauuuuguucuguaucc

SEQ ID NO: 95629 - RNA, 22 nt, Human
ucaggacagacuagacuagcgu

SEQ ID NO: 95630 - RNA, 22 nt, Human
ucaggacagggaucacaucauc

SEQ ID NO: 95631 - RNA, 22 nt, Human
ucaggacagguucgggugggua

SEQ ID NO: 95632 - RNA, 19 nt, Human
ucaggacugacuugaaguc

SEQ ID NO: 95633 - RNA, 22 nt, Human
ucaggagaaucagggcuguccu

SEQ ID NO: 95634 - RNA, 22 nt, Human
ucaggagacauucuuaaaguag

SEQ ID NO: 95635 - RNA, 22 nt, Human
ucaggagacuuaugucacagug

SEQ ID NO: 95636 - RNA, 22 nt, Human
ucaggagagaguuggguaggcu

SEQ ID NO: 95637 - RNA, 22 nt, Human
ucaggagauggucuuuauaggc

SEQ ID NO: 95638 - RNA, 22 nt, Human
ucaggagauguaaccuuagcug

SEQ ID NO: 95639 - RNA, 22 nt, Human
ucaggagcagggucuguuacca

SEQ ID NO: 95640 - RNA, 22 nt, Human
ucaggagcauauauugaugucu

SEQ ID NO: 95641 - RNA, 22 nt, Human
ucaggagccugaaagaggucua

SEQ ID NO: 95642 - RNA, 22 nt, Human
ucaggagcucaggcugauggaa

SEQ ID NO: 95643 - RNA, 22 nt, Human
ucaggagcugcacugggcccac

SEQ ID NO: 95644 - RNA, 22 nt, Human
ucaggaggcaaguagguauuga

SEQ ID NO: 95645 - RNA, 22 nt, Human
ucaggaggcucaagaccuggca

SEQ ID NO: 95646 - RNA, 22 nt, Human
ucaggaggucugcugcggggug

SEQ ID NO: 95647 - RNA, 22 nt, Human
ucaggagguugaccacggggca

SEQ ID NO: 95648 - RNA, 22 nt, Human
ucaggagugcagcaguuuggag

SEQ ID NO: 95649 - RNA, 22 nt, Human
ucaggagugccaguaccuuuug

SEQ ID NO: 95650 - RNA, 22 nt, Human
ucaggauaaaauguaauggcaa

SEQ ID NO: 95651 - RNA, 22 nt, Human
ucaggauaccucaguuuuagcu

SEQ ID NO: 95652 - RNA, 22 nt, Human
ucaggaucaggggccuuuccuu

SEQ ID NO: 95653 - RNA, 22 nt, Human
gggcaggaacaaaucaaaugau

SEQ ID NO: 95654 - RNA, 17 nt, Human
gggcagggacuccuggg

SEQ ID NO: 95655 - RNA, 22 nt, Human
gggcaggggucaguggccccaa

SEQ ID NO: 95656 - RNA, 22 nt, Human
gggcagguacuggguggugagc

SEQ ID NO: 95657 - RNA, 22 nt, Human
gggcagguauuuaucuucuauu

SEQ ID NO: 95658 - RNA, 22 nt, Human
ggcucuggagacauguggagag

SEQ ID NO: 95659 - RNA, 22 nt, Human
ggcucuggagcacagacgucug

SEQ ID NO: 95660 - RNA, 19 nt, Human
ggcucuggcggcuguagcc

SEQ ID NO: 95661 - RNA, 22 nt, Human
ggcucuggcguccaauggagcg

SEQ ID NO: 95662 - RNA, 22 nt, Human
ggcucuggcuccuggcuuugug

SEQ ID NO: 95663 - RNA, 22 nt, Human
ggcucugggaaauggucuuccu

SEQ ID NO: 95664 - RNA, 22 nt, Human
ggcucugggccagaguuggcuu

SEQ ID NO: 95665 - RNA, 22 nt, Human
ggcucugggugugaccuugggu

SEQ ID NO: 95666 - RNA, 22 nt, Human
ggcucugguggcaauugacugg

SEQ ID NO: 95667 - RNA, 22 nt, Human
ggcucuggugggaagguuagau

SEQ ID NO: 95668 - RNA, 22 nt, Human
ggcucuguaaguguugcaggua

SEQ ID NO: 95669 - RNA, 22 nt, Human
ggcucugugagaacaaaggcua

SEQ ID NO: 95670 - RNA, 23 nt, Human
ggcucugugcuaauugcugaaaa

SEQ ID NO: 95671 - RNA, 22 nt, Human
ggcucuguuuacuuucagaggc

SEQ ID NO: 95672 - RNA, 22 nt, Human
ggcucuucugguugucacauuu

SEQ ID NO: 95673 - RNA, 22 nt, Human
ggcucuucuguggcagccaagg

SEQ ID NO: 95674 - RNA, 22 nt, Human
ggcucuugaaauguggcuggcg

SEQ ID NO: 95675 - RNA, 22 nt, Human
ggcugagaaggagugggugagg

SEQ ID NO: 95676 - RNA, 23 nt, Human
ggcugagacuacaggcgcuugcc

SEQ ID NO: 95677 - RNA, 21 nt, Human
ggcugagauggcagaaucacc

SEQ ID NO: 95678 - RNA, 22 nt, Human
ggcugagccuggagcaucuggu

SEQ ID NO: 95679 - RNA, 22 nt, Human
ggcugagcggacuggggucccu

SEQ ID NO: 95680 - RNA, 22 nt, Human
ggcugaggguauagcuguccca

SEQ ID NO: 95681 - RNA, 22 nt, Human
ggcugaggguuaagaucagaca

SEQ ID NO: 95682 - RNA, 22 nt, Human
ggcugagucugugacccaugcg

SEQ ID NO: 95683 - RNA, 22 nt, Human
ggcugagugcugcuguucacga

SEQ ID NO: 95684 - RNA, 22 nt, Human
ggcugcaggcaggguauccacu

SEQ ID NO: 95685 - RNA, 22 nt, Human
ggcugcagggcagcuggugugg

SEQ ID NO: 95686 - RNA, 22 nt, Human
ggcugcaguugugugaaggccg

SEQ ID NO: 95687 - RNA, 22 nt, Human
ggcugccacccucggacuuccg

SEQ ID NO: 95688 - RNA, 22 nt, Human
ggcugccaggagggaggccagu

SEQ ID NO: 95689 - RNA, 20 nt, Human
ggcugcccacuccagaguac

SEQ ID NO: 95690 - RNA, 22 nt, Human
ggcugccucaaagcucaagcuc

SEQ ID NO: 95691 - RNA, 22 nt, Human
ggcugccuccacugcuuguccc

SEQ ID NO: 95692 - RNA, 22 nt, Human
ggcugccucccaggagaaucug

SEQ ID NO: 95693 - RNA, 22 nt, Human
ggcugccuccugcugggcugga

SEQ ID NO: 95694 - RNA, 22 nt, Human
ggcugccucuauuuaggaucaa

SEQ ID NO: 95695 - RNA, 22 nt, Human
ggcugccugccuccaagccggg

SEQ ID NO: 95696 - RNA, 19 nt, Human
ggcugccuggagcgagggc

SEQ ID NO: 95697 - RNA, 22 nt, Human
ggcugccuucauagaccauggg

SEQ ID NO: 95698 - RNA, 22 nt, Human
ggcugccuuuagaacggaugcu

SEQ ID NO: 95699 - RNA, 19 nt, Human
ggcugccuuuccuuaccag

SEQ ID NO: 95700 - RNA, 23 nt, Human
ggcugcgagugccugggccugug

SEQ ID NO: 95701 - RNA, 18 nt, Human
ggcugcucgcucuccccg

SEQ ID NO: 95702 - RNA, 19 nt, Human
ggcugcugaagagaauuac

SEQ ID NO: 95703 - RNA, 22 nt, Human
ggcugcugaaguguggcaaucu

SEQ ID NO: 95704 - RNA, 22 nt, Human
ggcugcugacuucauccagcuu

SEQ ID NO: 95705 - RNA, 22 nt, Human
ggcugcugcuguguaggccugu

SEQ ID NO: 95706 - RNA, 22 nt, Human
ggcugcugggaauaugccagcu

SEQ ID NO: 95707 - RNA, 22 nt, Human
ggcugcuguacugaugucaguu

SEQ ID NO: 95708 - RNA, 22 nt, Human
ggcugcuguuucagagacuguu

SEQ ID NO: 95709 - RNA, 23 nt, Human
ggcuggaagaaaacagaauuguu

SEQ ID NO: 95710 - RNA, 22 nt, Human
ggcuggaagagacugaggacac

SEQ ID NO: 95711 - RNA, 22 nt, Human
ggcuggaauagagacugacugg

SEQ ID NO: 95712 - RNA, 22 nt, Human
ggcuggacaugagcuuggcagu

SEQ ID NO: 95713 - RNA, 22 nt, Human
ggcuggaccaugcugccccuuc

SEQ ID NO: 95714 - RNA, 19 nt, Human
ggcuggagaaaggaaucag

SEQ ID NO: 95715 - RNA, 22 nt, Human
ggcuggagacaacguccugccc

SEQ ID NO: 95716 - RNA, 17 nt, Human
ggcuggagcagcucccc

SEQ ID NO: 95717 - RNA, 19 nt, Human
ggcuggcaagugacagugu

SEQ ID NO: 95718 - RNA, 22 nt, Human
ggcuggcacagagggcuggugu

SEQ ID NO: 95719 - RNA, 22 nt, Human
ggcuggcacgaagcccugcugg

SEQ ID NO: 95720 - RNA, 22 nt, Human
ggcuggcacucuguccaguguc

SEQ ID NO: 95721 - RNA, 22 nt, Human
ggcuggcacugaggagagcucu

SEQ ID NO: 95722 - RNA, 22 nt, Human
ggcuggcagaagugugcuggcu

SEQ ID NO: 95723 - RNA, 22 nt, Human
ggcuggcaggggaugucagaug

SEQ ID NO: 95724 - RNA, 22 nt, Human
ggcuggccucaggguccucgcu

SEQ ID NO: 95725 - RNA, 22 nt, Human
ggcuggcucagggcuugagaga

SEQ ID NO: 95726 - RNA, 22 nt, Human
ggcuggcucuuaccgacagcgu

SEQ ID NO: 95727 - RNA, 22 nt, Human
ggcuggcugauaaaggguugag

SEQ ID NO: 95728 - RNA, 22 nt, Human
ggcuggcugugcccuguacucu

SEQ ID NO: 95729 - RNA, 22 nt, Human
ggcuggcuuucucuccgcaccu

SEQ ID NO: 95730 - RNA, 22 nt, Human
ggcugggacgaugaggauuagu

SEQ ID NO: 95731 - RNA, 23 nt, Human
ggcugggagcuccgggugcacgu

SEQ ID NO: 95732 - RNA, 22 nt, Human
ggcugggccgcggcuacccaga

SEQ ID NO: 95733 - RNA, 22 nt, Human
ggcugggcuccgggagcaugcg

SEQ ID NO: 95734 - RNA, 22 nt, Human
ggcugggcugcugggucagagc

SEQ ID NO: 95735 - RNA, 22 nt, Human
ggcuggguacccuguuuccccu

SEQ ID NO: 95736 - RNA, 22 nt, Human
ggcugggucccagcugggagga

SEQ ID NO: 95737 - RNA, 22 nt, Human
ggcugguccuuucucuguccua

SEQ ID NO: 95738 - RNA, 22 nt, Human
ggcuggucuccaacccccgauc

SEQ ID NO: 95739 - RNA, 22 nt, Human
ggcugguggggaaagaggacca

SEQ ID NO: 95740 - RNA, 22 nt, Human
ggcugguuugacaaacugacaa

SEQ ID NO: 95741 - RNA, 22 nt, Human
ggcuguaccugccucuccucua

SEQ ID NO: 95742 - RNA, 22 nt, Human
ggcugucaauucauaggucaga

SEQ ID NO: 95743 - RNA, 19 nt, Human
ggcugucucggcccagcca

SEQ ID NO: 95744 - RNA, 22 nt, Human
ggcugucugugguggagcguug

SEQ ID NO: 95745 - RNA, 22 nt, Human
ggcugugaguuuguccuccaug

SEQ ID NO: 95746 - RNA, 22 nt, Human
ggcugugauugguggaugugaa

SEQ ID NO: 95747 - RNA, 22 nt, Human
ggcugugcgucauccggcugca

SEQ ID NO: 95748 - RNA, 22 nt, Human
ggcugugcuugguguccuugga

SEQ ID NO: 95749 - RNA, 21 nt, Human
ggcuguggagccaugacucac

SEQ ID NO: 95750 - RNA, 22 nt, Human
ggcuguggcagcuggaaguggu

SEQ ID NO: 95751 - RNA, 22 nt, Human
ggcuguggcauuaggugaggcc

SEQ ID NO: 95752 - RNA, 22 nt, Human
ggcugugggaugcauaggagcu

SEQ ID NO: 95753 - RNA, 22 nt, Human
ggcuguggggggagccugcccg

SEQ ID NO: 95754 - RNA, 19 nt, Human
ggcugugguggugccuugc

SEQ ID NO: 95755 - RNA, 21 nt, Human
ggcuguguucagggcaugcgg

SEQ ID NO: 95756 - RNA, 22 nt, Human
ggcuuaaaaggaaaaugagagu

SEQ ID NO: 95757 - RNA, 22 nt, Human
ggcuuaaagaauuaacagagau

SEQ ID NO: 95758 - RNA, 22 nt, Human
ggcuuaagauauuucugauucc

SEQ ID NO: 95759 - RNA, 20 nt, Human
ggcuuaaggaauucuuuucu

SEQ ID NO: 95760 - RNA, 22 nt, Human
ggcuuaaguccugaauuuaugc

SEQ ID NO: 95761 - RNA, 17 nt, Human
ggcuuacaggugccagc

SEQ ID NO: 95762 - RNA, 18 nt, Human
ggucaggggcggagagaa

SEQ ID NO: 95763 - RNA, 22 nt, Human
ggucaggggcugcucuacagag

SEQ ID NO: 95764 - RNA, 22 nt, Human
ggucagggggaucugugaggua

SEQ ID NO: 95765 - RNA, 22 nt, Human
ggucagguuuuuaggagugacc

SEQ ID NO: 95766 - RNA, 22 nt, Human
ggucagucucucccgaguguug

SEQ ID NO: 95767 - RNA, 22 nt, Human
ggucaucuguauguccucagcu

SEQ ID NO: 95768 - RNA, 22 nt, Human
ggucaucuguguauccucagug

SEQ ID NO: 95769 - RNA, 23 nt, Human
gguccacccgagccugcagcuuc

SEQ ID NO: 95770 - RNA, 22 nt, Human
gguccagucagauauucaugca

SEQ ID NO: 95771 - RNA, 22 nt, Human
gguccagucuuucccuucuaga

SEQ ID NO: 95772 - RNA, 22 nt, Human
gguccaugauaggaaguuccga

SEQ ID NO: 95773 - RNA, 22 nt, Human
ggucccaggaagugcggcggcg

SEQ ID NO: 95774 - RNA, 22 nt, Human
ggucccagguugacagggagac

SEQ ID NO: 95775 - RNA, 22 nt, Human
ggucccaugaaagagggaggcc

SEQ ID NO: 95776 - RNA, 22 nt, Human
ggucccugaagaggccuggggu

SEQ ID NO: 95777 - RNA, 23 nt, Human
ggucccugacagcgggcaaguug

SEQ ID NO: 95778 - RNA, 22 nt, Human
ggucccuggaaggccaagcuug

SEQ ID NO: 95779 - RNA, 22 nt, Human
gguccucugagcacgccaggca

SEQ ID NO: 95780 - RNA, 22 nt, Human
gguccuggaaauugacggaaag

SEQ ID NO: 95781 - RNA, 22 nt, Human
gguccuggcagcucugugucca

SEQ ID NO: 95782 - RNA, 22 nt, Human
gguccuugcuucgguccaguac

SEQ ID NO: 95783 - RNA, 22 nt, Human
gguccuugugucucuauggccc

SEQ ID NO: 95784 - RNA, 22 nt, Human
gguccuuugccaucucuccacc

SEQ ID NO: 95785 - RNA, 22 nt, Human
ggucggggauggccaggcuccc

SEQ ID NO: 95786 - RNA, 22 nt, Human
ggucgugaauugaaucaguggc

SEQ ID NO: 95787 - RNA, 22 nt, Human
ggucuacauugagagagcugcu

SEQ ID NO: 95788 - RNA, 22 nt, Human
ggucuagaggauguuccuuucc

SEQ ID NO: 95789 - RNA, 22 nt, Human
ggucucagacuggcaggcagug

SEQ ID NO: 95790 - RNA, 22 nt, Human
uccaaauauucggucuuucuga

SEQ ID NO: 95791 - RNA, 22 nt, Human
uccaaauucuauguucuuucca

SEQ ID NO: 95792 - RNA, 22 nt, Human
uccaacuaggcacacagcuggu

SEQ ID NO: 95793 - RNA, 22 nt, Human
uccaacuucugcaaucaguuug

SEQ ID NO: 95794 - RNA, 22 nt, Human
uccaagaacccaagcgaaugcc

SEQ ID NO: 95795 - RNA, 22 nt, Human
uccaagaaguuucguuaaaugu

SEQ ID NO: 95796 - RNA, 22 nt, Human
uccaagaaucacugacacagcu

SEQ ID NO: 95797 - RNA, 22 nt, Human
uccaagaguucaaggcuacagu

SEQ ID NO: 95798 - RNA, 22 nt, Human
uccaagaucaagguguuggcag

SEQ ID NO: 95799 - RNA, 22 nt, Human
uccaagaugguugguguggugg

SEQ ID NO: 95800 - RNA, 22 nt, Human
uccaagcacuguuaauuaaacu

SEQ ID NO: 95801 - RNA, 22 nt, Human
uccaagcauguggucaggagcc

SEQ ID NO: 95802 - RNA, 22 nt, Human
uccaagcuguauguuccuagag

SEQ ID NO: 95803 - RNA, 22 nt, Human
uccaaggacauuguucuaguug

SEQ ID NO: 95804 - RNA, 22 nt, Human
uccaaggaggcuuugacgucca

SEQ ID NO: 95805 - RNA, 22 nt, Human
uccaaggcauagacacagugcc

SEQ ID NO: 95806 - RNA, 22 nt, Human
uccaagggcaacaauggaacac

SEQ ID NO: 95807 - RNA, 22 nt, Human
uccaagggcaugcugaaauaag

SEQ ID NO: 95808 - RNA, 23 nt, Human
uccaagggcuacaaacacagacc

SEQ ID NO: 95809 - RNA, 22 nt, Human
uccaagggcucauggacacuuu

SEQ ID NO: 95810 - RNA, 22 nt, Human
uccaaggguucaugugcauuca

SEQ ID NO: 95811 - RNA, 22 nt, Human
uccaaguauaaauuagauacug

SEQ ID NO: 95812 - RNA, 22 nt, Human
uccaaguugauguuucuuaaau

SEQ ID NO: 95813 - RNA, 22 nt, Human
uccaauaacaucuaaaaacuua

SEQ ID NO: 95814 - RNA, 22 nt, Human
uccaauauggauaaaaggggcc

SEQ ID NO: 95815 - RNA, 22 nt, Human
uccaauauuucucacauaugga

SEQ ID NO: 95816 - RNA, 22 nt, Human
uccaauauuucucauauaugga

SEQ ID NO: 95817 - RNA, 22 nt, Human
uccaaucuaguaugauaaauga

SEQ ID NO: 95818 - RNA, 22 nt, Human
uccaauguuccugcuuucagcu

SEQ ID NO: 95819 - RNA, 20 nt, Human
uccaauuuaagaauuuagag

SEQ ID NO: 95820 - RNA, 19 nt, Human
uccaauuuguauguuuuca

SEQ ID NO: 95821 - RNA, 22 nt, Human
uccaauuuguuugaugauggaa

SEQ ID NO: 95822 - RNA, 22 nt, Human
uccaauuuuacgucuguauaaa

SEQ ID NO: 95823 - RNA, 21 nt, Human
uccacaaguuagaaggaaauu

SEQ ID NO: 95824 - RNA, 22 nt, Human
uccacagaauguaagauccaca

SEQ ID NO: 95825 - RNA, 22 nt, Human
uccacagacguguuauuaguug

SEQ ID NO: 95826 - RNA, 22 nt, Human
uccacagggauucacccaaaag

SEQ ID NO: 95827 - RNA, 19 nt, Human
uccacagugguugaacuag

SEQ ID NO: 95828 - RNA, 22 nt, Human
uccacauagucauuaauuucug

SEQ ID NO: 95829 - RNA, 22 nt, Human
uccacauucucuguuacagaua

SEQ ID NO: 95830 - RNA, 22 nt, Human
uccaccagccaggcccaggcug

SEQ ID NO: 95831 - RNA, 22 nt, Human
uccaccauguaacaagcucugu

SEQ ID NO: 95832 - RNA, 23 nt, Human
uccaccccagcugaggcuuagcc

SEQ ID NO: 95833 - RNA, 22 nt, Human
uccacccccagacagcugguga

SEQ ID NO: 95834 - RNA, 22 nt, Human
uccaccccugggaaugucaaua

SEQ ID NO: 95835 - RNA, 22 nt, Human
uccacccugcuuucuuaucucc

SEQ ID NO: 95836 - RNA, 22 nt, Human
uccaccugggcaacagugccuc

SEQ ID NO: 95837 - RNA, 19 nt, Human
uccaccuuucuucauuugg

SEQ ID NO: 95838 - RNA, 22 nt, Human
uccacgcugugugaccuugggc

SEQ ID NO: 95839 - RNA, 22 nt, Human
uccacuccuuaugccagacggu

SEQ ID NO: 95840 - RNA, 22 nt, Human
uccacugcuacaaccucccaga

SEQ ID NO: 95841 - RNA, 22 nt, Human
uccacugugcagcucugcugau

SEQ ID NO: 95842 - RNA, 22 nt, Human
uccacuucauccagggucacca

SEQ ID NO: 95843 - RNA, 21 nt, Human
uccagaaaagaggucauuagc

SEQ ID NO: 95844 - RNA, 19 nt, Human
uccagaacugcccuggccu

SEQ ID NO: 95845 - RNA, 22 nt, Human
uccagaccaaggaaggcugggc

SEQ ID NO: 95846 - RNA, 22 nt, Human
uccagacccaugacccugggga

SEQ ID NO: 95847 - RNA, 22 nt, Human
uccagacucacucaugugacua

SEQ ID NO: 95848 - RNA, 22 nt, Human
uccagacugcccugcacaugug

SEQ ID NO: 95849 - RNA, 22 nt, Human
uccagacugcuucuaggaugag

SEQ ID NO: 95850 - RNA, 22 nt, Human
uccagacuggggccaugucugc

SEQ ID NO: 95851 - RNA, 22 nt, Human
uccagagaggcauauuuacaag

SEQ ID NO: 95852 - RNA, 22 nt, Human
uccagagcaggugucuacacag

SEQ ID NO: 95853 - RNA, 22 nt, Human
uccagagccugggguuuguaac

SEQ ID NO: 95854 - RNA, 23 nt, Human
uccagagcucaugcucucaacca

SEQ ID NO: 95855 - RNA, 21 nt, Human
uccagaggaggacagacucag

SEQ ID NO: 95856 - RNA, 22 nt, Human
uccagaggcaaaaagguaugga

SEQ ID NO: 95857 - RNA, 22 nt, Human
uccagagguauguagagaguau

SEQ ID NO: 95858 - RNA, 22 nt, Human
uccagagugcugacgcagaccc

SEQ ID NO: 95859 - RNA, 23 nt, Human
uccagagugugagcuugccgugc

SEQ ID NO: 95860 - RNA, 22 nt, Human
uccagcacagaauuuccuagcu

SEQ ID NO: 95861 - RNA, 22 nt, Human
uccagcaccaccacagggaaga

SEQ ID NO: 95862 - RNA, 22 nt, Human
uccagcacucgcccagggcuug

SEQ ID NO: 95863 - RNA, 22 nt, Human
uccagcagaaaagagguaggga

SEQ ID NO: 95864 - RNA, 22 nt, Human
uccagcagccacaccucuggac

SEQ ID NO: 95865 - RNA, 22 nt, Human
uccagcagccugacuucccucu

SEQ ID NO: 95866 - RNA, 22 nt, Human
uccagcagguguuugccaacuu

SEQ ID NO: 95867 - RNA, 22 nt, Human
uccagcagguuggucaggugca

SEQ ID NO: 95868 - RNA, 19 nt, Human
uccagcagugcuugaaauc

SEQ ID NO: 95869 - RNA, 20 nt, Human
uccagcauauaaacuccucu

SEQ ID NO: 95870 - RNA, 22 nt, Human
uccagcauauauagagaaugag

SEQ ID NO: 95871 - RNA, 22 nt, Human
gggcauggugcugguguucaug

SEQ ID NO: 95872 - RNA, 22 nt, Human
gggccaaggggagcuggaaggg

SEQ ID NO: 95873 - RNA, 22 nt, Human
gggccacauugaagggugggua

SEQ ID NO: 95874 - RNA, 22 nt, Human
gggccacuggguccugcuggcc

SEQ ID NO: 95875 - RNA, 22 nt, Human
gggccacuucuagugccucaga

SEQ ID NO: 95876 - RNA, 22 nt, Human
gggccagacccuuggcgaucug

SEQ ID NO: 95877 - RNA, 22 nt, Human
gggccagagcuuggcagcuggg

SEQ ID NO: 95878 - RNA, 22 nt, Human
gggccagccuacugcuagaccc

SEQ ID NO: 95879 - RNA, 22 nt, Human
gggccaggaguggagauauggg

SEQ ID NO: 95880 - RNA, 22 nt, Human
gggccagguggaccccagccuc

SEQ ID NO: 95881 - RNA, 22 nt, Human
gggccaguagcaccugugugga

SEQ ID NO: 95882 - RNA, 22 nt, Human
gggccagugaacaaugagggaa

SEQ ID NO: 95883 - RNA, 22 nt, Human
gggccaugagagguucaucaac

SEQ ID NO: 95884 - RNA, 23 nt, Human
gggcccagcacaggaccuggcag

SEQ ID NO: 95885 - RNA, 22 nt, Human
gggcccagcacuggcugggauc

SEQ ID NO: 95886 - RNA, 22 nt, Human
gggccccacuggggcugccugc

SEQ ID NO: 95887 - RNA, 22 nt, Human
gggccccaguccucccacgugg

SEQ ID NO: 95888 - RNA, 22 nt, Human
gggccccugggaauucugugau

SEQ ID NO: 95889 - RNA, 22 nt, Human
gggcccugaucugugagcgcag

SEQ ID NO: 95890 - RNA, 22 nt, Human
gggcccugcguccggaagucug

SEQ ID NO: 95891 - RNA, 18 nt, Human
gggcccuggcguccgccc

SEQ ID NO: 95892 - RNA, 22 nt, Human
gggcccuggcuuuccuguucuu

SEQ ID NO: 95893 - RNA, 22 nt, Human
gggcccuggggccugauuugca

SEQ ID NO: 95894 - RNA, 22 nt, Human
gggccucagcucugcucugcaa

SEQ ID NO: 95895 - RNA, 22 nt, Human
gggccucaggccuugcucugug

SEQ ID NO: 95896 - RNA, 22 nt, Human
gggccucaugauggcucaggaa

SEQ ID NO: 95897 - RNA, 22 nt, Human
gggccugauuagcaggcuagcu

SEQ ID NO: 95898 - RNA, 22 nt, Human
gggccugccaggcuuucagcau

SEQ ID NO: 95899 - RNA, 21 nt, Human
gggccuggcugcgcaggacgg

SEQ ID NO: 95900 - RNA, 22 nt, Human
gggccuggggugacguaccccu

SEQ ID NO: 95901 - RNA, 22 nt, Human
gggccuggugcuucugacuccu

SEQ ID NO: 95902 - RNA, 22 nt, Human
gggccuguaugggucucagaua

SEQ ID NO: 95903 - RNA, 22 nt, Human
gggccugugcacaguucuguua

SEQ ID NO: 95904 - RNA, 22 nt, Human
gggccuguguguucaggagccu

SEQ ID NO: 95905 - RNA, 22 nt, Human
ggucucagcuggaguccuuggu

SEQ ID NO: 95906 - RNA, 22 nt, Human
ggucucagguagggccuaggaa

SEQ ID NO: 95907 - RNA, 22 nt, Human
ggucucaucuuucagcgucgag

SEQ ID NO: 95908 - RNA, 22 nt, Human
ggucucauguccuaugugcuua

SEQ ID NO: 95909 - RNA, 22 nt, Human
ggucuccugaccuuuagucccu

SEQ ID NO: 95910 - RNA, 22 nt, Human
ggucucugcagcucccggcccc

SEQ ID NO: 95911 - RNA, 22 nt, Human
ggucucuguugccuccaucaag

SEQ ID NO: 95912 - RNA, 22 nt, Human
ggucucuguuuggggcuggcaa

SEQ ID NO: 95913 - RNA, 22 nt, Human
ggucugagauauuuguucagcu

SEQ ID NO: 95914 - RNA, 22 nt, Human
ggucugcccuggguggaggcgc

SEQ ID NO: 95915 - RNA, 22 nt, Human
ggucuggacccuccuggagugg

SEQ ID NO: 95916 - RNA, 22 nt, Human
ggucuggaugcugagguuccca

SEQ ID NO: 95917 - RNA, 22 nt, Human
ggucuggccaauagacagcccc

SEQ ID NO: 95918 - RNA, 22 nt, Human
ggucuggccuccgggcaggugg

SEQ ID NO: 95919 - RNA, 22 nt, Human
ggucugugucauaggcugaguu

SEQ ID NO: 95920 - RNA, 17 nt, Human
ggucugugucuagggaa

SEQ ID NO: 95921 - RNA, 21 nt, Human
ggucuuccaaauaaggagaaa

SEQ ID NO: 95922 - RNA, 22 nt, Human
ggucuuccgagaggccugugcu

SEQ ID NO: 95923 - RNA, 18 nt, Human
ggucuuuaggucaguguc

SEQ ID NO: 95924 - RNA, 22 nt, Human
ggugaaauuccuuguggaaagu

SEQ ID NO: 95925 - RNA, 22 nt, Human
ggugaacauugaugugguuaca

SEQ ID NO: 95926 - RNA, 22 nt, Human
ggugaagggccuuaggagacag

SEQ ID NO: 95927 - RNA, 22 nt, Human
ggugaauaagcugaacacuugg

SEQ ID NO: 95928 - RNA, 19 nt, Human
ggugaccaccuggucagug

SEQ ID NO: 95929 - RNA, 22 nt, Human
ggugaccagggucaguagcuuu

SEQ ID NO: 95930 - RNA, 22 nt, Human
ggugagacuuuagaagagccag

SEQ ID NO: 95931 - RNA, 22 nt, Human
ggugagaggcagaggacagcuu

SEQ ID NO: 95932 - RNA, 15 nt, Human
ggugagaguaggauu

SEQ ID NO: 95933 - RNA, 22 nt, Human
ggugagcagcugucuguaugga

SEQ ID NO: 95934 - RNA, 22 nt, Human
ggugaggaaagauggugacagu

SEQ ID NO: 95935 - RNA, 22 nt, Human
ggugaggcagguggcugcugag

SEQ ID NO: 95936 - RNA, 22 nt, Human
ggugaggccuguacaaagcugc

SEQ ID NO: 95937 - RNA, 18 nt, Human
ggugagggagcuggaagc

SEQ ID NO: 95938 - RNA, 22 nt, Human
ggugaggguaaacuaaaacauc

SEQ ID NO: 95939 - RNA, 22 nt, Human
ggugaggguaaauauaggcaaa

SEQ ID NO: 95940 - RNA, 22 nt, Human
ggugagugucaaugguuagagu

SEQ ID NO: 95941 - RNA, 22 nt, Human
ggugauucugugaggggcugac

SEQ ID NO: 95942 - RNA, 22 nt, Human
ggugcaaagggccuagagagug

SEQ ID NO: 95943 - RNA, 22 nt, Human
ggugcagagcagugucagagca

SEQ ID NO: 95944 - RNA, 22 nt, Human
ggugcagaggagccagcugggg

SEQ ID NO: 95945 - RNA, 22 nt, Human
ggugcagaucuuucucuucagg

SEQ ID NO: 95946 - RNA, 22 nt, Human
ggugcagcaguuuguucagcuu

SEQ ID NO: 95947 - RNA, 21 nt, Human
ggugcagguaaugaugauaua

SEQ ID NO: 95948 - RNA, 22 nt, Human
ggugcauggaaagaguaaguaa

SEQ ID NO: 95949 - RNA, 22 nt, Human
ggugcaugugagaaagacuggg

SEQ ID NO: 95950 - RNA, 18 nt, Human
ggugccaagucugggauc

SEQ ID NO: 95951 - RNA, 22 nt, Human
ggugccacauaaauggagagag

SEQ ID NO: 95952 - RNA, 22 nt, Human
ggugcccaaggaagguugccgu

SEQ ID NO: 95953 - RNA, 22 nt, Human
ggugcccaccugucuuccugga

SEQ ID NO: 95954 - RNA, 22 nt, Human
ggugcccugccaggaugugcca

SEQ ID NO: 95955 - RNA, 22 nt, Human
ggugccguugaggaaguaacug

SEQ ID NO: 95956 - RNA, 22 nt, Human
ggugccuuccugccagccgcaa

SEQ ID NO: 95957 - RNA, 22 nt, Human
ggugcugaauaaauacuaguua

SEQ ID NO: 95958 - RNA, 20 nt, Human
ggugcugauaagaaagaagu

SEQ ID NO: 95959 - RNA, 22 nt, Human
ggugcugauauuguuuugguga

SEQ ID NO: 95960 - RNA, 22 nt, Human
ggugcugauguuauugaugcug

SEQ ID NO: 95961 - RNA, 22 nt, Human
ggugcugauucacugacuucug

SEQ ID NO: 95962 - RNA, 22 nt, Human
ggugcugccuauagucugaaac

SEQ ID NO: 95963 - RNA, 22 nt, Human
gguggaagccuucagaacagca

SEQ ID NO: 95964 - RNA, 22 nt, Human
gguggagcugugaguagaaucu

SEQ ID NO: 95965 - RNA, 22 nt, Human
gguggagcuguggacaggaagg

SEQ ID NO: 95966 - RNA, 19 nt, Human
gguggcagaacgugggucc

SEQ ID NO: 95967 - RNA, 22 nt, Human
gguggcagaauaauugaagguc

SEQ ID NO: 95968 - RNA, 22 nt, Human
gguggcagaggugcaucagccc

SEQ ID NO: 95969 - RNA, 22 nt, Human
gguggcagcauggucccagugu

SEQ ID NO: 95970 - RNA, 22 nt, Human
gguggcagugcuugcgggucua

SEQ ID NO: 95971 - RNA, 22 nt, Human
gguggccauggucagguagcgg

SEQ ID NO: 95972 - RNA, 22 nt, Human
gguggcccuaaccgcagccucc

SEQ ID NO: 95973 - RNA, 22 nt, Human
gguggccuagggcccagccugu

SEQ ID NO: 95974 - RNA, 22 nt, Human
gguggccuccagggcauaggug

SEQ ID NO: 95975 - RNA, 22 nt, Human
gguggccucugcaggccucgac

SEQ ID NO: 95976 - RNA, 18 nt, Human
gguggccuugacuucucu

SEQ ID NO: 95977 - RNA, 21 nt, Human
gguggccuuggugagagaccu

SEQ ID NO: 95978 - RNA, 22 nt, Human
gguggccuuucaguggaucagg

SEQ ID NO: 95979 - RNA, 22 nt, Human
gguggcggccacuucagcccug

SEQ ID NO: 95980 - RNA, 22 nt, Human
gggcuccuccucugacuguggc

SEQ ID NO: 95981 - RNA, 22 nt, Human
gggcuccuggcagucaugcuca

SEQ ID NO: 95982 - RNA, 19 nt, Human
gggcuccuugggccucucu

SEQ ID NO: 95983 - RNA, 22 nt, Human
gggcucucaugaguguguggua

SEQ ID NO: 95984 - RNA, 21 nt, Human
gggcucuccugaggccaugaa

SEQ ID NO: 95985 - RNA, 22 nt, Human
gggcucucuuuuuggccugccc

SEQ ID NO: 95986 - RNA, 20 nt, Human
gggcucugcauccaucagcc

SEQ ID NO: 95987 - RNA, 22 nt, Human
gggcucugccuggcugggagua

SEQ ID NO: 95988 - RNA, 22 nt, Human
gggcucuggaaaugggagcucc

SEQ ID NO: 95989 - RNA, 22 nt, Human
gggcucuggggucagacagccu

SEQ ID NO: 95990 - RNA, 22 nt, Human
gggcucuucucaggagcuaucu

SEQ ID NO: 95991 - RNA, 22 nt, Human
gggcugaaaggccgccucagau

SEQ ID NO: 95992 - RNA, 22 nt, Human
gggcugacaaccaucugacaag

SEQ ID NO: 95993 - RNA, 22 nt, Human
gggcugacaaucucuuuacuua

SEQ ID NO: 95994 - RNA, 22 nt, Human
gggcugacauauuuggugcucu

SEQ ID NO: 95995 - RNA, 22 nt, Human
gggcugaccaaugccuugcuuu

SEQ ID NO: 95996 - RNA, 22 nt, Human
gggcugacgaaggccaugugug

SEQ ID NO: 95997 - RNA, 22 nt, Human
gggcugagagcuggaaucugag

SEQ ID NO: 95998 - RNA, 22 nt, Human
gggcugagcacauacugacagc

SEQ ID NO: 95999 - RNA, 22 nt, Human
gggcugagccauuugaaccuug

SEQ ID NO: 96000 - RNA, 22 nt, Human
gggcugagucaucuggggccuc

SEQ ID NO: 96001 - RNA, 22 nt, Human
gggcugaugugacagaacucuc

SEQ ID NO: 96002 - RNA, 22 nt, Human
gggcugauucgauggggguaga

SEQ ID NO: 96003 - RNA, 22 nt, Human
gggcugcacagaucuucaaggg

SEQ ID NO: 96004 - RNA, 22 nt, Human
gggcugcacguauucugcucac

SEQ ID NO: 96005 - RNA, 22 nt, Human
gggcugcaucagcaggacccgg

SEQ ID NO: 96006 - RNA, 22 nt, Human
gggcugccugagcaucuccucc

SEQ ID NO: 96007 - RNA, 22 nt, Human
gggcugccuuuuaauucuuccc

SEQ ID NO: 96008 - RNA, 22 nt, Human
gggcugcugccaaucacagccu

SEQ ID NO: 96009 - RNA, 22 nt, Human
gggcuggaaaaacaacauacaa

SEQ ID NO: 96010 - RNA, 22 nt, Human
gggcuggaggugagcaggacag

SEQ ID NO: 96011 - RNA, 22 nt, Human
gggcuggaguugggaagacaaa

SEQ ID NO: 96012 - RNA, 22 nt, Human
gggcuggaucuccugcaggcag

SEQ ID NO: 96013 - RNA, 22 nt, Human
gggcuggauguuugaugacgaa

SEQ ID NO: 96014 - RNA, 22 nt, Human
gggcuggcaggaccugggcuga

SEQ ID NO: 96015 - RNA, 22 nt, Human
gggcuggcaucaguugccgaga

SEQ ID NO: 96016 - RNA, 22 nt, Human
gggcuggcaucgguugcugaga

SEQ ID NO: 96017 - RNA, 20 nt, Human
gggcuggcgcauggggaaag

SEQ ID NO: 96018 - RNA, 22 nt, Human
gggcuggcgggaaaggcaauuc

SEQ ID NO: 96019 - RNA, 22 nt, Human
gggcuggcugauuuuccucucu

SEQ ID NO: 96020 - RNA, 22 nt, Human
gggcuguaggagcuggaauggg

SEQ ID NO: 96021 - RNA, 22 nt, Human
gggcugucacgccccugcaccu

SEQ ID NO: 96022 - RNA, 22 nt, Human
gggccuucagccuuggacugag

SEQ ID NO: 96023 - RNA, 21 nt, Human
gggccuugagugugcgguggg

SEQ ID NO: 96024 - RNA, 21 nt, Human
gggcgaggccugauguggcuc

SEQ ID NO: 96025 - RNA, 22 nt, Human
gggcgcaucaccugaggucagg

SEQ ID NO: 96026 - RNA, 22 nt, Human
gggcggggcuuccguccuccac

SEQ ID NO: 96027 - RNA, 22 nt, Human
gggcuaaaugcagaaaugcaga

SEQ ID NO: 96028 - RNA, 22 nt, Human
gggcuaagcagagugggaacag

SEQ ID NO: 96029 - RNA, 22 nt, Human
gggcuaagcucgcccagggcca

SEQ ID NO: 96030 - RNA, 22 nt, Human
gggcuagcagauucuaccuaau

SEQ ID NO: 96031 - RNA, 22 nt, Human
gggcuaggcuuggccagcacug

SEQ ID NO: 96032 - RNA, 22 nt, Human
gggcuaggucugaucagagaag

SEQ ID NO: 96033 - RNA, 22 nt, Human
gggcucagagcauuuggguugg

SEQ ID NO: 96034 - RNA, 22 nt, Human
gggcucagaggaguggccuggg

SEQ ID NO: 96035 - RNA, 22 nt, Human
gggcucagccccauugaaccag

SEQ ID NO: 96036 - RNA, 22 nt, Human
gggcucagccuccucacuucga

SEQ ID NO: 96037 - RNA, 22 nt, Human
gggcucagucugcggcgcgcgg

SEQ ID NO: 96038 - RNA, 22 nt, Human
gggcucagucuggcguggaaug

SEQ ID NO: 96039 - RNA, 22 nt, Human
gggcucauggacagcucuccag

SEQ ID NO: 96040 - RNA, 22 nt, Human
gggcuccaaccccagugaacuc

SEQ ID NO: 96041 - RNA, 22 nt, Human
gggcuccacgcacgcgagaggu

SEQ ID NO: 96042 - RNA, 22 nt, Human
gggcuccagaguccauguucuu

SEQ ID NO: 96043 - RNA, 22 nt, Human
gggcuccagauugcagcgauca

SEQ ID NO: 96044 - RNA, 22 nt, Human
gggcuccagcagaggcagccgg

SEQ ID NO: 96045 - RNA, 22 nt, Human
gggcuccagcccgggaccaggu

SEQ ID NO: 96046 - RNA, 22 nt, Human
gggcuccaggagcccuaagaga

SEQ ID NO: 96047 - RNA, 23 nt, Human
gggcuccagucucugcucaguug

SEQ ID NO: 96048 - RNA, 22 nt, Human
gggcuccaucacaggcuccauc

SEQ ID NO: 96049 - RNA, 22 nt, Human
gggcuccaucggacuuggguuu

SEQ ID NO: 96050 - RNA, 22 nt, Human
gggcuccugccuccuggcaccu

SEQ ID NO: 96051 - RNA, 22 nt, Human
gggcucggcaucuguggacucu

SEQ ID NO: 96052 - RNA, 22 nt, Human
gggcucuaggccaagagucccg

SEQ ID NO: 96053 - RNA, 19 nt, Human
gggcucucgagcaaccaac

SEQ ID NO: 96054 - RNA, 22 nt, Human
gggcucucgauuagacccuggg

SEQ ID NO: 96055 - RNA, 21 nt, Human
gggcucugcccuccuggagcu

SEQ ID NO: 96056 - RNA, 22 nt, Human
gggcucuggacccaggcaagag

SEQ ID NO: 96057 - RNA, 22 nt, Human
gggcucuggauggagccugcag

SEQ ID NO: 96058 - RNA, 19 nt, Human
gggcucuggccucaguggg

SEQ ID NO: 96059 - RNA, 22 nt, Human
gggcucugguccugaacugaag

SEQ ID NO: 96060 - RNA, 22 nt, Human
gggcucuguccauuccuucaua

SEQ ID NO: 96061 - RNA, 22 nt, Human
gggcucuguggaugugagagcu

SEQ ID NO: 96062 - RNA, 22 nt, Human
gggcugaauuuguugcauguaa

SEQ ID NO: 96063 - RNA, 22 nt, Human
gggcugacuccuauuggaugaa

SEQ ID NO: 96064 - RNA, 22 nt, Human
gggcugagaaguugaucccaag

SEQ ID NO: 96065 - RNA, 22 nt, Human
gggcugagccacagcuuuuguu

SEQ ID NO: 96066 - RNA, 22 nt, Human
gggcugagcuaagcuggguuga

SEQ ID NO: 96067 - RNA, 22 nt, Human
gggcugaggcuaccacuggucu

SEQ ID NO: 96068 - RNA, 22 nt, Human
gggcugagggccaauuccuacu

SEQ ID NO: 96069 - RNA, 22 nt, Human
gggcugagugucccaggccgaa

SEQ ID NO: 96070 - RNA, 22 nt, Human
gggcugaucgcuugagcucagg

SEQ ID NO: 96071 - RNA, 22 nt, Human
gggcugcugcccaggaggcacc

SEQ ID NO: 96072 - RNA, 22 nt, Human
gggcugcuguagagaacauguu

SEQ ID NO: 96073 - RNA, 22 nt, Human
gggcugcuguguuccugaggca

SEQ ID NO: 96074 - RNA, 22 nt, Human
gggcugcuuauacugaugauaa

SEQ ID NO: 96075 - RNA, 22 nt, Human
gggcugcuugcuggagacagac

SEQ ID NO: 96076 - RNA, 22 nt, Human
gggcuggacaucuaagguagcu

SEQ ID NO: 96077 - RNA, 21 nt, Human
gggcuggacaugguggcucau

SEQ ID NO: 96078 - RNA, 22 nt, Human
gggcuggagaugcuuauggaga

SEQ ID NO: 96079 - RNA, 22 nt, Human
gggcuggagccuggcggugguu

SEQ ID NO: 96080 - RNA, 21 nt, Human
gggcuggaggaugggaagccc

SEQ ID NO: 96081 - RNA, 20 nt, Human
gggcuggauaauucuuugcu

SEQ ID NO: 96082 - RNA, 22 nt, Human
gggcuggaugggagccuuggcc

SEQ ID NO: 96083 - RNA, 22 nt, Human
gggcuggauuacugaacugagu

SEQ ID NO: 96084 - RNA, 22 nt, Human
gggcuggcuaagacuuuucugu

SEQ ID NO: 96085 - RNA, 22 nt, Human
gggcuggcucugucuagaaagg

SEQ ID NO: 96086 - RNA, 22 nt, Human
gggcugggaauggcuaaguaug

SEQ ID NO: 96087 - RNA, 16 nt, Human
gggcugggggauucug

SEQ ID NO: 96088 - RNA, 22 nt, Human
gggcuggugaggcugcccugca

SEQ ID NO: 96089 - RNA, 22 nt, Human
guauacuagauagacaguauca

SEQ ID NO: 96090 - RNA, 22 nt, Human
guauauaugugugaacauguau

SEQ ID NO: 96091 - RNA, 22 nt, Human
guauccuccccgcuggccuuca

SEQ ID NO: 96092 - RNA, 22 nt, Human
guaucuggugaggguuccccug

SEQ ID NO: 96093 - RNA, 22 nt, Human
guaucuguggauuuugguaucc

SEQ ID NO: 96094 - RNA, 22 nt, Human
guaugaaagcaucauuccugcu

SEQ ID NO: 96095 - RNA, 22 nt, Human
guaugaaggcgagagcccacua

SEQ ID NO: 96096 - RNA, 22 nt, Human
guaugaaguaagauauuguuca

SEQ ID NO: 96097 - RNA, 22 nt, Human
guaugaucaacuucauguccua

SEQ ID NO: 96098 - RNA, 22 nt, Human
guaugcaucgacucaagucuga

SEQ ID NO: 96099 - RNA, 22 nt, Human
guauggaaguauaaguuuugaa

SEQ ID NO: 96100 - RNA, 22 nt, Human
guauguauguauauguuuaaga

SEQ ID NO: 96101 - RNA, 22 nt, Human
guaugucuauaguuuuuaaaua

SEQ ID NO: 96102 - RNA, 22 nt, Human
guaugugagguugguuuccagg

SEQ ID NO: 96103 - RNA, 22 nt, Human
guaugugugcaaauguaaauau

SEQ ID NO: 96104 - RNA, 22 nt, Human
guauuagaagaaauuauaggua

SEQ ID NO: 96105 - RNA, 22 nt, Human
guauuagggccaaaggcaggaa

SEQ ID NO: 96106 - RNA, 22 nt, Human
guauuagucaauuacagugggg

SEQ ID NO: 96107 - RNA, 18 nt, Human
guauuaguuuucagagag

SEQ ID NO: 96108 - RNA, 22 nt, Human
guauuauuaaguguauuugacc

SEQ ID NO: 96109 - RNA, 22 nt, Human
guauucaaggauuuuguucuac

SEQ ID NO: 96110 - RNA, 22 nt, Human
guauucauauuaaacauaucaa

SEQ ID NO: 96111 - RNA, 22 nt, Human
guauuccuaagucaugacaaau

SEQ ID NO: 96112 - RNA, 22 nt, Human
guauuccugcaaauagcaguga

SEQ ID NO: 96113 - RNA, 22 nt, Human
guauuccuucagaagacguuua

SEQ ID NO: 96114 - RNA, 22 nt, Human
guauucucaggugguuccucga

SEQ ID NO: 96115 - RNA, 22 nt, Human
guauucugggccgauuacaaaa

SEQ ID NO: 96116 - RNA, 22 nt, Human
guauucuuauacucagugagcu

SEQ ID NO: 96117 - RNA, 22 nt, Human
guauugcauuguuucaagcugu

SEQ ID NO: 96118 - RNA, 22 nt, Human
guauuuaauuccauuaaguuag

SEQ ID NO: 96119 - RNA, 22 nt, Human
guauuuauaggggaaugagagu

SEQ ID NO: 96120 - RNA, 22 nt, Human
guauuucaucuugaaaaccagu

SEQ ID NO: 96121 - RNA, 22 nt, Human
guauuucuagaaccaaaagcca

SEQ ID NO: 96122 - RNA, 22 nt, Human
guauuucuaguuucuuccacag

SEQ ID NO: 96123 - RNA, 22 nt, Human
guauuugucuuguuggucucca

SEQ ID NO: 96124 - RNA, 22 nt, Human
guauuuucaagagcaguaguau

SEQ ID NO: 96125 - RNA, 22 nt, Human
guauuuuuagguaaggaaagua

SEQ ID NO: 96126 - RNA, 22 nt, Human
gucaaaaugagcuuuguuauug

SEQ ID NO: 96127 - RNA, 22 nt, Human
gucaaacagccuccuguucuaa

SEQ ID NO: 96128 - RNA, 22 nt, Human
gucaaaugcacagaaccauuaa

SEQ ID NO: 96129 - RNA, 22 nt, Human
gucaacaaagaaaauuguuaau

SEQ ID NO: 96130 - RNA, 22 nt, Human
gucaagcagaagauaauuuaaa

SEQ ID NO: 96131 - RNA, 22 nt, Human
gucaauauagaucaaugcacag

SEQ ID NO: 96132 - RNA, 22 nt, Human
gucaauaucuugguuguacuau

SEQ ID NO: 96133 - RNA, 17 nt, Human
gucaauauuguugacag

SEQ ID NO: 96134 - RNA, 22 nt, Human
gucacacagggccuccaaauca

SEQ ID NO: 96135 - RNA, 22 nt, Human
gucacagaucucuugagucaag

SEQ ID NO: 96136 - RNA, 22 nt, Human
gucacaggguccccauauggag

SEQ ID NO: 96137 - RNA, 22 nt, Human
gucacagguguggaggugcugg

SEQ ID NO: 96138 - RNA, 22 nt, Human
uccagugguacauggagacacu

SEQ ID NO: 96139 - RNA, 22 nt, Human
uccagugguaguaaagaggucu

SEQ ID NO: 96140 - RNA, 22 nt, Human
uccagugguggcucccggaccu

SEQ ID NO: 96141 - RNA, 22 nt, Human
uccagugguuugaaaggggugu

SEQ ID NO: 96142 - RNA, 22 nt, Human
uccagugucugagcccuuagcu

SEQ ID NO: 96143 - RNA, 22 nt, Human
uccaguguggucaaaggggaau

SEQ ID NO: 96144 - RNA, 21 nt, Human
uccaguugagacugaagaucu

SEQ ID NO: 96145 - RNA, 22 nt, Human
uccaguuuauuuuuggcagggu

SEQ ID NO: 96146 - RNA, 22 nt, Human
uccaguuuccaaucacugcacg

SEQ ID NO: 96147 - RNA, 16 nt, Human
uccaguuuucagcacu

SEQ ID NO: 96148 - RNA, 22 nt, Human
uccauaaaugaaauagaacgcu

SEQ ID NO: 96149 - RNA, 22 nt, Human
uccauaaauuuuaugaacauau

SEQ ID NO: 96150 - RNA, 19 nt, Human
uccauacaaacuguugaaa

SEQ ID NO: 96151 - RNA, 22 nt, Human
uccauacacauugaauuuuagu

SEQ ID NO: 96152 - RNA, 22 nt, Human
uccauacauaaaauguuuaaug

SEQ ID NO: 96153 - RNA, 22 nt, Human
uccauacauauccaaagagaag

SEQ ID NO: 96154 - RNA, 22 nt, Human
uccauacuaacagcauuuauca

SEQ ID NO: 96155 - RNA, 22 nt, Human
uccauacucagaaaguauugca

SEQ ID NO: 96156 - RNA, 22 nt, Human
uccauacuggaguccacaguuc

SEQ ID NO: 96157 - RNA, 22 nt, Human
uccauaguagaaaaugggacag

SEQ ID NO: 96158 - RNA, 22 nt, Human
uccauagugaauggguaaugca

SEQ ID NO: 96159 - RNA, 22 nt, Human
uccaucaccauuucugcgagcu

SEQ ID NO: 96160 - RNA, 22 nt, Human
uccaucauggcagcagcaguga

SEQ ID NO: 96161 - RNA, 22 nt, Human
uccauccacccugcauuauauu

SEQ ID NO: 96162 - RNA, 22 nt, Human
uccauccaggccagcaguaauc

SEQ ID NO: 96163 - RNA, 21 nt, Human
uccauccaucaguccagccag

SEQ ID NO: 96164 - RNA, 22 nt, Human
uccaucuggagacuuccugguc

SEQ ID NO: 96165 - RNA, 22 nt, Human
uccaucugguggcuuccuuuug

SEQ ID NO: 96166 - RNA, 22 nt, Human
uccaucuguuuacuauaaagau

SEQ ID NO: 96167 - RNA, 22 nt, Human
uccaugagacagauacuguaag

SEQ ID NO: 96168 - RNA, 23 nt, Human
uccaugagaugugggcuucuagu

SEQ ID NO: 96169 - RNA, 22 nt, Human
uccaugagcuagcuuuccaaag

SEQ ID NO: 96170 - RNA, 22 nt, Human
uccaugaggaccaaauucguag

SEQ ID NO: 96171 - RNA, 22 nt, Human
uccaugauuggucaucauagaa

SEQ ID NO: 96172 - RNA, 22 nt, Human
uccaugcagaggagcugguggc

SEQ ID NO: 96173 - RNA, 19 nt, Human
uccaugcccaggcaccaag

SEQ ID NO: 96174 - RNA, 19 nt, Human
uccauggcucuucauccuu

SEQ ID NO: 96175 - RNA, 22 nt, Human
uccaugguagguuucuuaaaga

SEQ ID NO: 96176 - RNA, 22 nt, Human
uccaugucuucaugugucuaac

SEQ ID NO: 96177 - RNA, 22 nt, Human
uccaugugacgguggcaguuuu

SEQ ID NO: 96178 - RNA, 22 nt, Human
uccauguguuuuccuguccaca

SEQ ID NO: 96179 - RNA, 22 nt, Human
uccauuaaaccuggauggaguu

SEQ ID NO: 96180 - RNA, 22 nt, Human
uccauuaacaccuguacguggc

SEQ ID NO: 96181 - RNA, 22 nt, Human
uccauuauacuucugauucaaa

SEQ ID NO: 96182 - RNA, 21 nt, Human
uccauuguuuucccaggguuu

SEQ ID NO: 96183 - RNA, 22 nt, Human
uccauuuagcuggcaaacaaug

SEQ ID NO: 96184 - RNA, 22 nt, Human
uccauuuucucuuccggaggug

SEQ ID NO: 96185 - RNA, 22 nt, Human
uccauuuuguagguaugcuaca

SEQ ID NO: 96186 - RNA, 22 nt, Human
ucccaaagguccgagcgggaau

SEQ ID NO: 96187 - RNA, 22 nt, Human
ucccaagacuauguucugugug

SEQ ID NO: 96188 - RNA, 22 nt, Human
ucccaagcuuagggcucucagu

SEQ ID NO: 96189 - RNA, 22 nt, Human
ucccaaggugcucggcaacagg

SEQ ID NO: 96190 - RNA, 22 nt, Human
ucccaaguacuaccaaucuaau

SEQ ID NO: 96191 - RNA, 22 nt, Human
ucccacagaugcuguccagagu

SEQ ID NO: 96192 - RNA, 22 nt, Human
ucccacaggggcucuguggguu

SEQ ID NO: 96193 - RNA, 22 nt, Human
ucccacagucucacaaugcaua

SEQ ID NO: 96194 - RNA, 22 nt, Human
ucccacauuacccugacugaca

SEQ ID NO: 96195 - RNA, 22 nt, Human
ucccacccccuccaaggaggaa

SEQ ID NO: 96196 - RNA, 22 nt, Human
ucccaccccggucaagggcuga

SEQ ID NO: 96197 - RNA, 21 nt, Human
ucccacucuaaauggacugaa

SEQ ID NO: 96198 - RNA, 22 nt, Human
gggggagcuguuauuggcaggg

SEQ ID NO: 96199 - RNA, 22 nt, Human
gggggcagaauguacucuuguc

SEQ ID NO: 96200 - RNA, 22 nt, Human
gggggccaucuucaaggaugug

SEQ ID NO: 96201 - RNA, 22 nt, Human
gggggcuaccgucucuggagcu

SEQ ID NO: 96202 - RNA, 23 nt, Human
gggggcugguugacucucugcag

SEQ ID NO: 96203 - RNA, 22 nt, Human
ggggggcuguucuggacaggaa

SEQ ID NO: 96204 - RNA, 22 nt, Human
gggggucccaagcugggcugcu

SEQ ID NO: 96205 - RNA, 22 nt, Human
gggggugagccugccaggccca

SEQ ID NO: 96206 - RNA, 22 nt, Human
gggguacuggcuggagccccac

SEQ ID NO: 96207 - RNA, 18 nt, Human
gggguagaguguccuauu

SEQ ID NO: 96208 - RNA, 22 nt, Human
gggguaggaagagaaaauagug

SEQ ID NO: 96209 - RNA, 22 nt, Human
gggguagggcgauugcugcuuu

SEQ ID NO: 96210 - RNA, 22 nt, Human
ggggucacacuguggugacugg

SEQ ID NO: 96211 - RNA, 22 nt, Human
ggggucccugcaccagcauguc

SEQ ID NO: 96212 - RNA, 22 nt, Human
ggggucggggcauagccacuua

SEQ ID NO: 96213 - RNA, 22 nt, Human
ggggucugcugcggagcagaga

SEQ ID NO: 96214 - RNA, 22 nt, Human
ggggugaagguuuucugaaagc

SEQ ID NO: 96215 - RNA, 22 nt, Human
ggggugagaucaaggaagcccu

SEQ ID NO: 96216 - RNA, 22 nt, Human
ggggugagcugggccugugccu

SEQ ID NO: 96217 - RNA, 22 nt, Human
ggggugagguuuauguucuggg

SEQ ID NO: 96218 - RNA, 22 nt, Human
gggguggauuucaggcgguguc

SEQ ID NO: 96219 - RNA, 22 nt, Human
gggguggcccuacccucuggaa

SEQ ID NO: 96220 - RNA, 19 nt, Human
gggguggcuggggcuccag

SEQ ID NO: 96221 - RNA, 21 nt, Human
gggguuggcaagagcagagac

SEQ ID NO: 96222 - RNA, 20 nt, Human
gggguuggcuggcacaggga

SEQ ID NO: 96223 - RNA, 22 nt, Human
ggguaaaggucgcccucaaggu

SEQ ID NO: 96224 - RNA, 21 nt, Human
ggguaaggaaaaugauucuuc

SEQ ID NO: 96225 - RNA, 22 nt, Human
ggguacaaagauuucauaagau

SEQ ID NO: 96226 - RNA, 22 nt, Human
ggguacagaaacugaggcuuag

SEQ ID NO: 96227 - RNA, 22 nt, Human
ggguaccaagcugcuugggggc

SEQ ID NO: 96228 - RNA, 22 nt, Human
ggguaggcaaagcaaugacguu

SEQ ID NO: 96229 - RNA, 22 nt, Human
ggguaggcagugcguccugccu

SEQ ID NO: 96230 - RNA, 22 nt, Human
ggguaggccagaagggccugga

SEQ ID NO: 96231 - RNA, 22 nt, Human
ggguaggcucugcaggcugggu

SEQ ID NO: 96232 - RNA, 21 nt, Human
ggguauaaaaugguaucucau

SEQ ID NO: 96233 - RNA, 22 nt, Human
ggguaugagauauaggugaaua

SEQ ID NO: 96234 - RNA, 22 nt, Human
gggucaaaugauaauugcuucu

SEQ ID NO: 96235 - RNA, 22 nt, Human
gggucaaggcuacauggagacc

SEQ ID NO: 96236 - RNA, 22 nt, Human
gggucagaguucaggucgaggg

SEQ ID NO: 96237 - RNA, 22 nt, Human
gggucagcucccuccccagggc

SEQ ID NO: 96238 - RNA, 22 nt, Human
gggucagggcugccugggcuca

SEQ ID NO: 96239 - RNA, 22 nt, Human
ggguccagacuaugaagaacuu

SEQ ID NO: 96240 - RNA, 23 nt, Human
ggguccagagaagccauuagggc

SEQ ID NO: 96241 - RNA, 22 nt, Human
ggguccagcuacaucagggugg

SEQ ID NO: 96242 - RNA, 22 nt, Human
ggguccaggcguggcccagaug

SEQ ID NO: 96243 - RNA, 22 nt, Human
gggucgagggucucgcccuucc

SEQ ID NO: 96244 - RNA, 22 nt, Human
gggucuccuaauggaggaugac

SEQ ID NO: 96245 - RNA, 22 nt, Human
gggucugaggaguaccauuguc

SEQ ID NO: 96246 - RNA, 22 nt, Human
gggucugagggccuuaccacuc

SEQ ID NO: 96247 - RNA, 22 nt, Human
gggucugccugcugugaaguca

SEQ ID NO: 96248 - RNA, 22 nt, Human
gggucuggacggcugcaggaag

SEQ ID NO: 96249 - RNA, 20 nt, Human
gggugaggauggagaauuug

SEQ ID NO: 96250 - RNA, 22 nt, Human
gggugcagagcuuaacuguagg

SEQ ID NO: 96251 - RNA, 22 nt, Human
gggugcagcuuugaaagcaugu

SEQ ID NO: 96252 - RNA, 18 nt, Human
gggugcaggcacugacug

SEQ ID NO: 96253 - RNA, 22 nt, Human
uccccaccuacacacugcuccu

SEQ ID NO: 96254 - RNA, 22 nt, Human
uccccacuccugggcagaugcg

SEQ ID NO: 96255 - RNA, 22 nt, Human
uccccacugggccuccucuuuc

SEQ ID NO: 96256 - RNA, 22 nt, Human
uccccagacagcgggaggccug

SEQ ID NO: 96257 - RNA, 19 nt, Human
uccccagcaccucugaguc

SEQ ID NO: 96258 - RNA, 22 nt, Human
uccccaggaaggcccuuccugg

SEQ ID NO: 96259 - RNA, 22 nt, Human
uccccaggaaucaggugguugc

SEQ ID NO: 96260 - RNA, 22 nt, Human
uccccauggguggggacacaua

SEQ ID NO: 96261 - RNA, 22 nt, Human
ucccccucauuaccucauucaa

SEQ ID NO: 96262 - RNA, 22 nt, Human
ucccccuccaauugccauguua

SEQ ID NO: 96263 - RNA, 21 nt, Human
uccccucacuugucuucugag

SEQ ID NO: 96264 - RNA, 22 nt, Human
uccccucuggaggcugcagggg

SEQ ID NO: 96265 - RNA, 22 nt, Human
uccccugcagaugagggcagug

SEQ ID NO: 96266 - RNA, 22 nt, Human
uccccugcagcgccugcuucua

SEQ ID NO: 96267 - RNA, 22 nt, Human
ucccgauucuuccuauacagga

SEQ ID NO: 96268 - RNA, 22 nt, Human
ucccgcaugccgccggugaaca

SEQ ID NO: 96269 - RNA, 22 nt, Human
ucccuacuguuagggacucagc

SEQ ID NO: 96270 - RNA, 22 nt, Human
ucccuaggaccccaccuuccgc

SEQ ID NO: 96271 - RNA, 22 nt, Human
ucccuaguagacccagaucauu

SEQ ID NO: 96272 - RNA, 22 nt, Human
ucccucacugguucugcauccc

SEQ ID NO: 96273 - RNA, 22 nt, Human
ucccucagagaccguggugcag

SEQ ID NO: 96274 - RNA, 22 nt, Human
ucccucagagggcaagcgcaga

SEQ ID NO: 96275 - RNA, 20 nt, Human
ucccucagcacuucuaccuc

SEQ ID NO: 96276 - RNA, 20 nt, Human
ucccucaggucauugggcug

SEQ ID NO: 96277 - RNA, 22 nt, Human
ucccucagucccuggacaggca

SEQ ID NO: 96278 - RNA, 22 nt, Human
ucccuccaggcagcuggguacu

SEQ ID NO: 96279 - RNA, 20 nt, Human
ucccucccuccagcucuggg

SEQ ID NO: 96280 - RNA, 22 nt, Human
ucccuccuggugaugaugcaaa

SEQ ID NO: 96281 - RNA, 22 nt, Human
ucccuccuuuaucaaaaagaga

SEQ ID NO: 96282 - RNA, 22 nt, Human
ucccucgaagagcuuauucuuu

SEQ ID NO: 96283 - RNA, 22 nt, Human
ucccucuacagggaagcgcuuu

SEQ ID NO: 96284 - RNA, 22 nt, Human
ucccucuggucuggacgccaua

SEQ ID NO: 96285 - RNA, 22 nt, Human
ucccucuguguugggcaugccu

SEQ ID NO: 96286 - RNA, 22 nt, Human
ucccugaagccagggaaggaag

SEQ ID NO: 96287 - RNA, 22 nt, Human
ucccugagcucacauggcagga

SEQ ID NO: 96288 - RNA, 21 nt, Human
ucccugaguucucugagcauc

SEQ ID NO: 96289 - RNA, 22 nt, Human
ucccugcagacguccugcgggu

SEQ ID NO: 96290 - RNA, 22 nt, Human
ucccugcagcaggugaucaaug

SEQ ID NO: 96291 - RNA, 22 nt, Human
ucccugcaggugugcaagcuga

SEQ ID NO: 96292 - RNA, 22 nt, Human
ucccugccaguccuggucugaa

SEQ ID NO: 96293 - RNA, 22 nt, Human
ucccugcccugccuucaugguu

SEQ ID NO: 96294 - RNA, 22 nt, Human
ucccugccugacagcacccacc

SEQ ID NO: 96295 - RNA, 22 nt, Human
ucccuggacaacagacuucacu

SEQ ID NO: 96296 - RNA, 22 nt, Human
ucccuggacagccuugccuggg

SEQ ID NO: 96297 - RNA, 23 nt, Human
ucccuggaggcagguccagggcc

SEQ ID NO: 96298 - RNA, 22 nt, Human
ucccuggcagcuaagggugguc

SEQ ID NO: 96299 - RNA, 22 nt, Human
ucccuggcuguguucaggugcg

SEQ ID NO: 96300 - RNA, 22 nt, Human
ucccugggacggccuuuuggag

SEQ ID NO: 96301 - RNA, 15 nt, Human
ucccugggagauggu

SEQ ID NO: 96302 - RNA, 22 nt, Human
ucccugggcacaaucugcuggc

SEQ ID NO: 96303 - RNA, 22 nt, Human
ucccugggccuccugcuaugca

SEQ ID NO: 96304 - RNA, 22 nt, Human
ucccuggggauguuggccugcc

SEQ ID NO: 96305 - RNA, 22 nt, Human
ucccugggguuccuccagccac

SEQ ID NO: 96306 - RNA, 22 nt, Human
ucccugggucauucucuggcac

SEQ ID NO: 96307 - RNA, 22 nt, Human
uccugugaagaauagcacucaa

SEQ ID NO: 96308 - RNA, 22 nt, Human
uccugugagcagcacagagaca

SEQ ID NO: 96309 - RNA, 22 nt, Human
uccugugauauuguuuguuaua

SEQ ID NO: 96310 - RNA, 22 nt, Human
uccugugccaucucuagagacu

SEQ ID NO: 96311 - RNA, 22 nt, Human
uccugugcuuuggaggauguuc

SEQ ID NO: 96312 - RNA, 22 nt, Human
uccuguggaagacaguguuggg

SEQ ID NO: 96313 - RNA, 17 nt, Human
uccugugggugcagcag

SEQ ID NO: 96314 - RNA, 22 nt, Human
uccugugguaugggagugaugu

SEQ ID NO: 96315 - RNA, 22 nt, Human
uccuguguaaauagaucugguu

SEQ ID NO: 96316 - RNA, 22 nt, Human
uccugugucaauuccucauucu

SEQ ID NO: 96317 - RNA, 22 nt, Human
uccugugugggcaggaugagaa

SEQ ID NO: 96318 - RNA, 22 nt, Human
uccuguguguggccuuucccag

SEQ ID NO: 96319 - RNA, 22 nt, Human
uccuguguuacugccuggagcg

SEQ ID NO: 96320 - RNA, 17 nt, Human
uccuguuuaucauugau

SEQ ID NO: 96321 - RNA, 22 nt, Human
uccuguuuccaauuuguugggu

SEQ ID NO: 96322 - RNA, 22 nt, Human
uccuguuuuuguaaucgacucu

SEQ ID NO: 96323 - RNA, 22 nt, Human
uccuuaaaugaacucugcauga

SEQ ID NO: 96324 - RNA, 22 nt, Human
uccuuaacaagauggcauuugu

SEQ ID NO: 96325 - RNA, 22 nt, Human
uccuuaauucugugcaauaugu

SEQ ID NO: 96326 - RNA, 22 nt, Human
uccuuacaacuuguuauuuuuc

SEQ ID NO: 96327 - RNA, 22 nt, Human
uccuuagagauacugucuugaa

SEQ ID NO: 96328 - RNA, 22 nt, Human
uccuuagagugguugugcuaug

SEQ ID NO: 96329 - RNA, 22 nt, Human
uccuuauaaaugaggcccuggg

SEQ ID NO: 96330 - RNA, 22 nt, Human
uccuuauaacaacaggagugga

SEQ ID NO: 96331 - RNA, 22 nt, Human
uccuuauauggcagacagcaga

SEQ ID NO: 96332 - RNA, 22 nt, Human
uccuucaaagcuccuagugagc

SEQ ID NO: 96333 - RNA, 22 nt, Human
uccuucaagaugccacagcuuu

SEQ ID NO: 96334 - RNA, 22 nt, Human
uccuucaaucacccagugggga

SEQ ID NO: 96335 - RNA, 19 nt, Human
uccuucacuucuuaccagg

SEQ ID NO: 96336 - RNA, 22 nt, Human
uccuucagaaccugugauggaa

SEQ ID NO: 96337 - RNA, 23 nt, Human
uccuucagagccucccuccaagc

SEQ ID NO: 96338 - RNA, 22 nt, Human
uccuucagccaugggcucucca

SEQ ID NO: 96339 - RNA, 22 nt, Human
uccuucagcugcuaggaaauga

SEQ ID NO: 96340 - RNA, 22 nt, Human
uccuucagcuuauuucuuagga

SEQ ID NO: 96341 - RNA, 20 nt, Human
uccuucaggcagggccuagu

SEQ ID NO: 96342 - RNA, 22 nt, Human
uccuucagggggccgccugcac

SEQ ID NO: 96343 - RNA, 22 nt, Human
uccuucaguucaauuaguccgu

SEQ ID NO: 96344 - RNA, 22 nt, Human
uccuuccaugguggggcugcuu

SEQ ID NO: 96345 - RNA, 22 nt, Human
uccuuccucggggacccagauc

SEQ ID NO: 96346 - RNA, 22 nt, Human
uccuuccugcucuaacauucag

SEQ ID NO: 96347 - RNA, 22 nt, Human
uccuucucugguuuuuacugua

SEQ ID NO: 96348 - RNA, 22 nt, Human
uccuucuggaggcucuaagggg

SEQ ID NO: 96349 - RNA, 22 nt, Human
uccuucuggaggcuguaaagga

SEQ ID NO: 96350 - RNA, 22 nt, Human
uccuugaaaagaaugucuccau

SEQ ID NO: 96351 - RNA, 22 nt, Human
uccuugaaaggggcugcagggc

SEQ ID NO: 96352 - RNA, 22 nt, Human
uccuugaagaaugauucuugga

SEQ ID NO: 96353 - RNA, 22 nt, Human
uccuugaagagugggcggucga

SEQ ID NO: 96354 - RNA, 22 nt, Human
uccuugaaugaagagaggugac

SEQ ID NO: 96355 - RNA, 22 nt, Human
uccuugaaugaauguucucucc

SEQ ID NO: 96356 - RNA, 22 nt, Human
uccuugaauugugccacuuacc

SEQ ID NO: 96357 - RNA, 19 nt, Human
uccuugacuguauucagag

SEQ ID NO: 96358 - RNA, 22 nt, Human
uccuugagagccacugucuugg

SEQ ID NO: 96359 - RNA, 22 nt, Human
uccuugagccguggccagggcc

SEQ ID NO: 96360 - RNA, 22 nt, Human
uccuugagccucccagacucag

SEQ ID NO: 96361 - RNA, 22 nt, Human
uccuugcaaauagcuuucugag

SEQ ID NO: 96362 - RNA, 22 nt, Human
uccuugcauaucugaaaauguu

SEQ ID NO: 96363 - RNA, 22 nt, Human
uccuuggagcccaggaguagca

SEQ ID NO: 96364 - RNA, 22 nt, Human
uccuuggaguaguuguucuuua

SEQ ID NO: 96365 - RNA, 17 nt, Human
uccuuggcaaccaguuc

SEQ ID NO: 96366 - RNA, 22 nt, Human
uccuuggcaugccgucuucucc

SEQ ID NO: 96367 - RNA, 22 nt, Human
uccuugggaaaucacuagcacu

SEQ ID NO: 96368 - RNA, 21 nt, Human
uccuugggcagugcccagcuu

SEQ ID NO: 96369 - RNA, 23 nt, Human
uccuugggccugcccagaguggu

SEQ ID NO: 96370 - RNA, 22 nt, Human
uccuuuaaacuccuuucaaguc

SEQ ID NO: 96371 - RNA, 23 nt, Human
uccuuuaaugcuggaauggcuag

SEQ ID NO: 96372 - RNA, 20 nt, Human
uccuuuccuccuucuaaaug

SEQ ID NO: 96373 - RNA, 22 nt, Human
uccuuucuucuucugcccaugg

SEQ ID NO: 96374 - RNA, 22 nt, Human
uccuuugacuucuugcagucca

SEQ ID NO: 96375 - RNA, 22 nt, Human
uccuuuggaacugacuccguua

SEQ ID NO: 96376 - RNA, 22 nt, Human
uccuuuggacacauuuuuuaua

SEQ ID NO: 96377 - RNA, 23 nt, Human
uccuuugucuuugcauagauggu

SEQ ID NO: 96378 - RNA, 22 nt, Human
uccuuuucccugaagguauuua

SEQ ID NO: 96379 - RNA, 22 nt, Human
uccuuuugcugggaucaucagg

SEQ ID NO: 96380 - RNA, 22 nt, Human
ucgaauggcaaggaaagaggcu

SEQ ID NO: 96381 - RNA, 21 nt, Human
ucgaccugcugggcucgggcu

SEQ ID NO: 96382 - RNA, 22 nt, Human
ucgagcucuggagccaaggaug

SEQ ID NO: 96383 - RNA, 22 nt, Human
ucgauaauaucuuacaugugcu

SEQ ID NO: 96384 - RNA, 22 nt, Human
gugaggucaccggccguugcca

SEQ ID NO: 96385 - RNA, 22 nt, Human
gugaggucauauagcgaacucc

SEQ ID NO: 96386 - RNA, 22 nt, Human
gugagguccuaauagacaucga

SEQ ID NO: 96387 - RNA, 19 nt, Human
gugaggucuuuccuuuugu

SEQ ID NO: 96388 - RNA, 22 nt, Human
gugaggucuuugggaggugauu

SEQ ID NO: 96389 - RNA, 22 nt, Human
gugaggugggcuggccagagac

SEQ ID NO: 96390 - RNA, 22 nt, Human
gugaggugguacaauauuaacu

SEQ ID NO: 96391 - RNA, 22 nt, Human
gugagucuuuggagacaguuca

SEQ ID NO: 96392 - RNA, 22 nt, Human
gugaguuacucugguucucauu

SEQ ID NO: 96393 - RNA, 22 nt, Human
gugauaaaauucaaauagcucu

SEQ ID NO: 96394 - RNA, 22 nt, Human
gugauccuauaaagugagcaca

SEQ ID NO: 96395 - RNA, 22 nt, Human
gugauggguaacuguuuaggga

SEQ ID NO: 96396 - RNA, 22 nt, Human
gugauguagcccuaauucugca

SEQ ID NO: 96397 - RNA, 22 nt, Human
gugauguggggaccguccuggc

SEQ ID NO: 96398 - RNA, 22 nt, Human
gugauucaaauguaacuaauua

SEQ ID NO: 96399 - RNA, 22 nt, Human
gugauucauccuggcauucauu

SEQ ID NO: 96400 - RNA, 22 nt, Human
gugauucuaaagcuuugagcag

SEQ ID NO: 96401 - RNA, 22 nt, Human
gugauucucauguuccugaagu

SEQ ID NO: 96402 - RNA, 23 nt, Human
gugauucucucugugugggcagg

SEQ ID NO: 96403 - RNA, 22 nt, Human
gugauucugaccuucagggagu

SEQ ID NO: 96404 - RNA, 22 nt, Human
gugauugcccagcaccauuguu

SEQ ID NO: 96405 - RNA, 22 nt, Human
gugauuucaaauauagagugag

SEQ ID NO: 96406 - RNA, 22 nt, Human
gugauuuucuccuccuagaagu

SEQ ID NO: 96407 - RNA, 22 nt, Human
gugcaaaaauaauugugguuuu

SEQ ID NO: 96408 - RNA, 22 nt, Human
gugcaaaaguaauugcgguuuu

SEQ ID NO: 96409 - RNA, 23 nt, Human
gugcaaagauauaccacauggcu

SEQ ID NO: 96410 - RNA, 22 nt, Human
gugcaaaugauucuaaugggua

SEQ ID NO: 96411 - RNA, 22 nt, Human
gugcaaccucgucagagcaccu

SEQ ID NO: 96412 - RNA, 22 nt, Human
gugcaagacuuccuaagcaaua

SEQ ID NO: 96413 - RNA, 22 nt, Human
gugcaagaggacaguaagggug

SEQ ID NO: 96414 - RNA, 22 nt, Human
gugcaagcaguacacucaaagc

SEQ ID NO: 96415 - RNA, 20 nt, Human
gugcaauggcucagucucag

SEQ ID NO: 96416 - RNA, 22 nt, Human
guagaggggugauucugugaga

SEQ ID NO: 96417 - RNA, 22 nt, Human
guagaguuuaaugaaaaaucug

SEQ ID NO: 96418 - RNA, 22 nt, Human
guagaucaugagaauguuuuug

SEQ ID NO: 96419 - RNA, 22 nt, Human
guagaucugccuuaaccuggga

SEQ ID NO: 96420 - RNA, 22 nt, Human
guagccagaucugcugugucug

SEQ ID NO: 96421 - RNA, 22 nt, Human
guagccauuggcaaugaagccu

SEQ ID NO: 96422 - RNA, 22 nt, Human
guagcccaccuggggagggcga

SEQ ID NO: 96423 - RNA, 22 nt, Human
guagcgguuaugucugcaggga

SEQ ID NO: 96424 - RNA, 22 nt, Human
guaggaaagggagugaagggaa

SEQ ID NO: 96425 - RNA, 22 nt, Human
guaggaagcucugaggcuaguu

SEQ ID NO: 96426 - RNA, 22 nt, Human
guaggagcucauggggccagga

SEQ ID NO: 96427 - RNA, 22 nt, Human
guaggcagaauaauuccuccuu

SEQ ID NO: 96428 - RNA, 22 nt, Human
guaggcagaccaguggaugggu

SEQ ID NO: 96429 - RNA, 22 nt, Human
guaggccagugugaaaccuggu

SEQ ID NO: 96430 - RNA, 22 nt, Human
guagggacuuguuuuacuagua

SEQ ID NO: 96431 - RNA, 22 nt, Human
guagggagcccagagcccagug

SEQ ID NO: 96432 - RNA, 22 nt, Human
guagggcauguaagucaccaua

SEQ ID NO: 96433 - RNA, 22 nt, Human
guaggggaugguucccuagaaa

SEQ ID NO: 96434 - RNA, 22 nt, Human
guaggguuggagagcacaacca

SEQ ID NO: 96435 - RNA, 22 nt, Human
guaggucuucugaaaaccaaaa

SEQ ID NO: 96436 - RNA, 22 nt, Human
guaggugagugggagaagaggc

SEQ ID NO: 96437 - RNA, 22 nt, Human
guaguaauaguacauuagaaug

SEQ ID NO: 96438 - RNA, 22 nt, Human
guagucuuggauuuuaaaaagu

SEQ ID NO: 96439 - RNA, 22 nt, Human
guaguuacccagaacacuggaa

SEQ ID NO: 96440 - RNA, 22 nt, Human
guaguuaguuaagaugaguuua

SEQ ID NO: 96441 - RNA, 22 nt, Human
guauacagauacuuagacgugc

SEQ ID NO: 96442 - RNA, 22 nt, Human
guauaguuccaagcauauuuug

SEQ ID NO: 96443 - RNA, 22 nt, Human
guauaguuugcgauuugugguu

SEQ ID NO: 96444 - RNA, 22 nt, Human
guauaucagacacucauaugua

SEQ ID NO: 96445 - RNA, 18 nt, Human
guauaucugcacauauac

SEQ ID NO: 96446 - RNA, 22 nt, Human
guauaucuucagaaauuauagg

SEQ ID NO: 96447 - RNA, 22 nt, Human
guauaugagcucuauguaaugg

SEQ ID NO: 96448 - RNA, 22 nt, Human
guauauguaugcguauacacac

SEQ ID NO: 96449 - RNA, 22 nt, Human
guauaugugugggccugcauau

SEQ ID NO: 96450 - RNA, 22 nt, Human
guauauuuugaucacccucuau

SEQ ID NO: 96451 - RNA, 21 nt, Human
guaucacauuugcaugcuuau

SEQ ID NO: 96452 - RNA, 22 nt, Human
guaucacuuuugagagugagaa

SEQ ID NO: 96453 - RNA, 22 nt, Human
guauccucaccuauacaaugga

SEQ ID NO: 96454 - RNA, 22 nt, Human
guaucuaugauccuuuauaucu

SEQ ID NO: 96455 - RNA, 22 nt, Human
guaucuuuccacaucuucagua

SEQ ID NO: 96456 - RNA, 22 nt, Human
guaucuuucccaccaaucacaa

SEQ ID NO: 96457 - RNA, 22 nt, Human
guaucuuugucuucauguugga

SEQ ID NO: 96458 - RNA, 22 nt, Human
guaugaaguuggacuguauaaa

SEQ ID NO: 96459 - RNA, 22 nt, Human
guauggaugugugaacugguua

SEQ ID NO: 96460 - RNA, 22 nt, Human
guauguauacauuguggaaugg

SEQ ID NO: 96461 - RNA, 21 nt, Human
guauguauggauaaugagagg

SEQ ID NO: 96462 - RNA, 22 nt, Human
guaugucaaaaucugcaugaua

SEQ ID NO: 96463 - RNA, 22 nt, Human
guaugucuuaggguucaguaac

SEQ ID NO: 96464 - RNA, 22 nt, Human
guaugugucuuagaacuuggga

SEQ ID NO: 96465 - RNA, 22 nt, Human
guauuacaaauaaauguuacug

SEQ ID NO: 96466 - RNA, 22 nt, Human
guauuaggaggaacacaggccu

SEQ ID NO: 96467 - RNA, 22 nt, Human
guauuaggugguggaauuguag

SEQ ID NO: 96468 - RNA, 22 nt, Human
guauuagguuggugcaaaagua

SEQ ID NO: 96469 - RNA, 22 nt, Human
guauuaguuaucuacugcugug

SEQ ID NO: 96470 - RNA, 22 nt, Human
guauuaugaaugccgaggcggc

SEQ ID NO: 96471 - RNA, 22 nt, Human
guauuauucucagcuuugggau

SEQ ID NO: 96472 - RNA, 22 nt, Human
guauucaagcgagcagaugucu

SEQ ID NO: 96473 - RNA, 22 nt, Human
guauucagggcuagucagagga

SEQ ID NO: 96474 - RNA, 22 nt, Human
guauuccauuaguguuaauauc

SEQ ID NO: 96475 - RNA, 20 nt, Human
guauucuguauucugcucag

SEQ ID NO: 96476 - RNA, 22 nt, Human
guauucuguuuacagugagcaa

SEQ ID NO: 96477 - RNA, 22 nt, Human
guauucuugguuaucaaaauac

SEQ ID NO: 96478 - RNA, 22 nt, Human
guauugcaauuacucuucuucu

SEQ ID NO: 96479 - RNA, 22 nt, Human
guauuguagcuacaauagacgu

SEQ ID NO: 96480 - RNA, 22 nt, Human
guauuuccauuagugugugcac

SEQ ID NO: 96481 - RNA, 22 nt, Human
guauuuccucgcuugugggauu

SEQ ID NO: 96482 - RNA, 22 nt, Human
guauuucuuuccauuauaguca

SEQ ID NO: 96483 - RNA, 22 nt, Human
guauuugaucauuagaaugauu

SEQ ID NO: 96484 - RNA, 22 nt, Human
guauuuggucuauuuggcaucc

SEQ ID NO: 96485 - RNA, 22 nt, Human
guauuuggugaugccuccaaac

SEQ ID NO: 96486 - RNA, 22 nt, Human
guauuuuacuuacgcaugacuu

SEQ ID NO: 96487 - RNA, 22 nt, Human
guauuuucaugauuucagacca

SEQ ID NO: 96488 - RNA, 22 nt, Human
guauuuuguuagggugugguau

SEQ ID NO: 96489 - RNA, 22 nt, Human
guauuuuuaguagagucggggu

SEQ ID NO: 96490 - RNA, 22 nt, Human
guauuuuucaguuaggagcuua

SEQ ID NO: 96491 - RNA, 22 nt, Human
gucaaaaaguagucauuucugu

SEQ ID NO: 96492 - RNA, 22 nt, Human
gucaaaacacuggggaauguug

SEQ ID NO: 96493 - RNA, 22 nt, Human
gucaaacauagggacuuugugg

SEQ ID NO: 96494 - RNA, 21 nt, Human
gucaaacuugcaccagugccc

SEQ ID NO: 96495 - RNA, 22 nt, Human
gucaaauaauuuucucaauagu

SEQ ID NO: 96496 - RNA, 17 nt, Human
gucaacaggauuucuuu

SEQ ID NO: 96497 - RNA, 22 nt, Human
gucaacaguauuaggacauuug

SEQ ID NO: 96498 - RNA, 22 nt, Human
gucaacauaggccucagugagg

SEQ ID NO: 96499 - RNA, 22 nt, Human
guagcugccuuucuggcccagg

SEQ ID NO: 96500 - RNA, 22 nt, Human
guagcuuacaucagaguugguu

SEQ ID NO: 96501 - RNA, 22 nt, Human
guagcuuaugaaaugugagggg

SEQ ID NO: 96502 - RNA, 22 nt, Human
guaggaaaguaaaugaaauaca

SEQ ID NO: 96503 - RNA, 22 nt, Human
guaggaauuuugugagcuuucc

SEQ ID NO: 96504 - RNA, 22 nt, Human
guaggagcauugaggguaugga

SEQ ID NO: 96505 - RNA, 22 nt, Human
guaggcagguggaggagugaag

SEQ ID NO: 96506 - RNA, 22 nt, Human
guaggcagucucucaggugauc

SEQ ID NO: 96507 - RNA, 22 nt, Human
guagggacaauauguuauuaga

SEQ ID NO: 96508 - RNA, 19 nt, Human
guagggacagugguucuga

SEQ ID NO: 96509 - RNA, 22 nt, Human
guagggacuguucucaccugag

SEQ ID NO: 96510 - RNA, 22 nt, Human
guagggcauagagauguuggca

SEQ ID NO: 96511 - RNA, 22 nt, Human
guagggcucaguaaauacuuug

SEQ ID NO: 96512 - RNA, 22 nt, Human
guaguaaagcggaaagggugau

SEQ ID NO: 96513 - RNA, 22 nt, Human
guaguaauuguuuuaagccacc

SEQ ID NO: 96514 - RNA, 22 nt, Human
guaguacagugagacaauguuu

SEQ ID NO: 96515 - RNA, 22 nt, Human
guaguauuuucugugauguagg

SEQ ID NO: 96516 - RNA, 22 nt, Human
guagucugaacaguaauuuugu

SEQ ID NO: 96517 - RNA, 22 nt, Human
guagucugagcaagcagugugu

SEQ ID NO: 96518 - RNA, 22 nt, Human
guagugcuuucaucuggagugu

SEQ ID NO: 96519 - RNA, 22 nt, Human
guaguggagucuccuguccugg

SEQ ID NO: 96520 - RNA, 22 nt, Human
guaguuauugcuguuuacuucu

SEQ ID NO: 96521 - RNA, 22 nt, Human
guaguucugcagugucaccuga

SEQ ID NO: 96522 - RNA, 22 nt, Human
guaguucuuucucaauguucaa

SEQ ID NO: 96523 - RNA, 22 nt, Human
guauaaaguauaagcuuguuuu

SEQ ID NO: 96524 - RNA, 20 nt, Human
guauaagauuucacacauua

SEQ ID NO: 96525 - RNA, 22 nt, Human
gugcuucacugaccuguuuuca

SEQ ID NO: 96526 - RNA, 22 nt, Human
gugcuuccaucuagagggucac

SEQ ID NO: 96527 - RNA, 22 nt, Human
gugcuucugccaacuaauuaac

SEQ ID NO: 96528 - RNA, 22 nt, Human
gugcuugcagugagaugagaug

SEQ ID NO: 96529 - RNA, 22 nt, Human
gugcuuuaaaaauaggagauga

SEQ ID NO: 96530 - RNA, 22 nt, Human
gugcuuuaaagacaguuaugcu

SEQ ID NO: 96531 - RNA, 22 nt, Human
gugcuuuaauaagauuucacuu

SEQ ID NO: 96532 - RNA, 22 nt, Human
gugcuuuaguucuugcaacugg

SEQ ID NO: 96533 - RNA, 22 nt, Human
gugcuuuauauguggguaucca

SEQ ID NO: 96534 - RNA, 23 nt, Human
gugcuuuaugaucugcugucccu

SEQ ID NO: 96535 - RNA, 22 nt, Human
gugcuuuuaaaggcaauuagua

SEQ ID NO: 96536 - RNA, 22 nt, Human
gugcuuuuaacuuuugaaagga

SEQ ID NO: 96537 - RNA, 22 nt, Human
gugcuuuuaauucuggugagua

SEQ ID NO: 96538 - RNA, 22 nt, Human
gugcuuuuccuuauuuggugcu

SEQ ID NO: 96539 - RNA, 22 nt, Human
guggaaauaguuugguuauaga

SEQ ID NO: 96540 - RNA, 22 nt, Human
guggaacauguccauauacauu

SEQ ID NO: 96541 - RNA, 22 nt, Human
guggaagggucacagccccuac

SEQ ID NO: 96542 - RNA, 22 nt, Human
guggaagguaaugcagcuuacu

SEQ ID NO: 96543 - RNA, 22 nt, Human
guggaaguagauuugagaaggu

SEQ ID NO: 96544 - RNA, 22 nt, Human
guggaauugcuggauaauauca

SEQ ID NO: 96545 - RNA, 22 nt, Human
guggacaugcauacauauguuu

SEQ ID NO: 96546 - RNA, 17 nt, Human
guggagacagaugccuc

SEQ ID NO: 96547 - RNA, 22 nt, Human
guggagacuucuacuagagacc

SEQ ID NO: 96548 - RNA, 22 nt, Human
guggagcaaucagagggucagu

SEQ ID NO: 96549 - RNA, 22 nt, Human
guggagcauaacacacuagccu

SEQ ID NO: 96550 - RNA, 22 nt, Human
guggagccaggggcuguaggua

SEQ ID NO: 96551 - RNA, 22 nt, Human
guggaggagaggcgccuugcgg

SEQ ID NO: 96552 - RNA, 22 nt, Human
guggagggugauugccggcugu

SEQ ID NO: 96553 - RNA, 22 nt, Human
guggaugauugacucuguagac

SEQ ID NO: 96554 - RNA, 22 nt, Human
guggauggagcagugacccagg

SEQ ID NO: 96555 - RNA, 22 nt, Human
guggauggauuuugaggaaugg

SEQ ID NO: 96556 - RNA, 22 nt, Human
guggauggcccugcacacaggu

SEQ ID NO: 96557 - RNA, 22 nt, Human
guggcaaggagcaugaaaaguc

SEQ ID NO: 96558 - RNA, 22 nt, Human
guggcacaaggcuuacacagca

SEQ ID NO: 96559 - RNA, 22 nt, Human
guggcacacaggagagagcuca

SEQ ID NO: 96560 - RNA, 22 nt, Human
guggcacaggguuguuggucau

SEQ ID NO: 96561 - RNA, 22 nt, Human
guggcacauugguagggucugu

SEQ ID NO: 96562 - RNA, 22 nt, Human
guggcacucaccuguaguuuca

SEQ ID NO: 96563 - RNA, 22 nt, Human
guggcagaaauauucuugcucu

SEQ ID NO: 96564 - RNA, 22 nt, Human
guggcagagaacaaggagaggu

SEQ ID NO: 96565 - RNA, 22 nt, Human
guggcagaggcugugaggaugc

SEQ ID NO: 96566 - RNA, 22 nt, Human
guggcagagugcgguucugacc

SEQ ID NO: 96567 - RNA, 22 nt, Human
guggcagcaaaugccuggacua

SEQ ID NO: 96568 - RNA, 22 nt, Human
guggcagccaugagaauauaac

SEQ ID NO: 96569 - RNA, 16 nt, Human
guggcagccccuucuc

SEQ ID NO: 96570 - RNA, 22 nt, Human
guggcagcggcccaggccgucu

SEQ ID NO: 96571 - RNA, 22 nt, Human
guggcagggagaagccauuggg

SEQ ID NO: 96572 - RNA, 22 nt, Human
guggcagggcaaugcucccucu

SEQ ID NO: 96573 - RNA, 22 nt, Human
guggcaguagacagugcaucua

SEQ ID NO: 96574 - RNA, 22 nt, Human
guggcagucgcugacagauaca

SEQ ID NO: 96575 - RNA, 22 nt, Human
guggcagucucaucuguggcuc

SEQ ID NO: 96576 - RNA, 22 nt, Human
guggcagugaggcaggagcagu

SEQ ID NO: 96577 - RNA, 22 nt, Human
guggcaucaagauuuagauuca

SEQ ID NO: 96578 - RNA, 22 nt, Human
guggcauugacauguaaacagu

SEQ ID NO: 96579 - RNA, 22 nt, Human
guggcauuugggagaugcgugg

SEQ ID NO: 96580 - RNA, 22 nt, Human
guggccaaaaggaagaagguua

SEQ ID NO: 96581 - RNA, 22 nt, Human
guggccaagaaaauagaugcau

SEQ ID NO: 96582 - RNA, 22 nt, Human
guggccaagaggggacuggaua

SEQ ID NO: 96583 - RNA, 22 nt, Human
guggccagaaccaggagaauga

SEQ ID NO: 96584 - RNA, 22 nt, Human
guggccagaagacugcaaugcu

SEQ ID NO: 96585 - RNA, 22 nt, Human
guggccagagauuaaauagagu

SEQ ID NO: 96586 - RNA, 22 nt, Human
guggccagaggauuuguucagu

SEQ ID NO: 96587 - RNA, 22 nt, Human
guggccagagugucauuuuauu

SEQ ID NO: 96588 - RNA, 22 nt, Human
guggccagcaagugcugccucu

SEQ ID NO: 96589 - RNA, 22 nt, Human
guggccagccccauggacaguu

SEQ ID NO: 96590 - RNA, 22 nt, Human
guggccaggucagggacuugug

SEQ ID NO: 96591 - RNA, 22 nt, Human
guggcccaggcuuggcgcuggc

SEQ ID NO: 96592 - RNA, 22 nt, Human
guggcccuauuugaggacccca

SEQ ID NO: 96593 - RNA, 22 nt, Human
guggcccugagcccuuugacag

SEQ ID NO: 96594 - RNA, 22 nt, Human
guggcccugucccaggccuccu

SEQ ID NO: 96595 - RNA, 22 nt, Human
guggcccugugaacagcgcagu

SEQ ID NO: 96596 - RNA, 22 nt, Human
guggcccuugaagcagcuucau

SEQ ID NO: 96597 - RNA, 22 nt, Human
guggccucuguuggcuccuagg

SEQ ID NO: 96598 - RNA, 21 nt, Human
guggccugauuaugaaugggu

SEQ ID NO: 96599 - RNA, 22 nt, Human
guggccugccagcagauggcgc

SEQ ID NO: 96600 - RNA, 22 nt, Human
guggccuggaaaggcuggucug

SEQ ID NO: 96601 - RNA, 22 nt, Human
guggccuggauagacuccaucu

SEQ ID NO: 96602 - RNA, 22 nt, Human
guggccuggcgagcuggcgcgg

SEQ ID NO: 96603 - RNA, 22 nt, Human
guggccuugcucacauguccag

SEQ ID NO: 96604 - RNA, 22 nt, Human
guggccuuuccugaagaaauga

SEQ ID NO: 96605 - RNA, 22 nt, Human
guggcuagaaaaauaugggugc

SEQ ID NO: 96606 - RNA, 22 nt, Human
guggcucacgucugucaucuca

SEQ ID NO: 96607 - RNA, 19 nt, Human
guggcucauguagugggcc

SEQ ID NO: 96608 - RNA, 22 nt, Human
guggcuccgcaggcuccauucu

SEQ ID NO: 96609 - RNA, 22 nt, Human
guggcucucgccagccugcggg

SEQ ID NO: 96610 - RNA, 22 nt, Human
guggcucuugcauggggucucu

SEQ ID NO: 96611 - RNA, 22 nt, Human
guggcugacaaccacuggagga

SEQ ID NO: 96612 - RNA, 22 nt, Human
guggcugcaguaguguaggguc

SEQ ID NO: 96613 - RNA, 19 nt, Human
guggcugccgaucgcggcu

SEQ ID NO: 96614 - RNA, 22 nt, Human
gucaacauuuacugcccuggcc

SEQ ID NO: 96615 - RNA, 22 nt, Human
gucaacuuaucucuuuaucugu

SEQ ID NO: 96616 - RNA, 22 nt, Human
gucaagucaugacucaaaggaa

SEQ ID NO: 96617 - RNA, 22 nt, Human
gucaaguuuauccgcucauuca

SEQ ID NO: 96618 - RNA, 19 nt, Human
gucaauaaaaguuaggggu

SEQ ID NO: 96619 - RNA, 22 nt, Human
gucaauaaguuuguaacuggau

SEQ ID NO: 96620 - RNA, 22 nt, Human
gucaauaauugauagauauugg

SEQ ID NO: 96621 - RNA, 22 nt, Human
gucaauaauuuuauggagagaa

SEQ ID NO: 96622 - RNA, 22 nt, Human
gucaauauauucugucucuuug

SEQ ID NO: 96623 - RNA, 22 nt, Human
gucaauaucgccaagugucucu

SEQ ID NO: 96624 - RNA, 22 nt, Human
gucaaucagaaaucauguuaca

SEQ ID NO: 96625 - RNA, 22 nt, Human
gucaaugcuuuaguuucuggua

SEQ ID NO: 96626 - RNA, 22 nt, Human
gucaauuagcuaaaauuuggua

SEQ ID NO: 96627 - RNA, 22 nt, Human
gucacaaagcgcgguggucggu

SEQ ID NO: 96628 - RNA, 21 nt, Human
gucacacaggccuggagcuga

SEQ ID NO: 96629 - RNA, 22 nt, Human
gucacacagguugaaaugcagu

SEQ ID NO: 96630 - RNA, 22 nt, Human
gucacacucaaaagcuaggaug

SEQ ID NO: 96631 - RNA, 22 nt, Human
gucacacucuucccuccacaug

SEQ ID NO: 96632 - RNA, 18 nt, Human
gucacagcagagaacugc

SEQ ID NO: 96633 - RNA, 22 nt, Human
gucacaguaucauguuugaaug

SEQ ID NO: 96634 - RNA, 22 nt, Human
gucacaguguaucucuucagcu

SEQ ID NO: 96635 - RNA, 19 nt, Human
gucacauuugucucccagg

SEQ ID NO: 96636 - RNA, 22 nt, Human
gucaccagugcuaagaggugga

SEQ ID NO: 96637 - RNA, 19 nt, Human
gucaccauuuccaaaugcc

SEQ ID NO: 96638 - RNA, 22 nt, Human
gucaccugaggggaggugacag

SEQ ID NO: 96639 - RNA, 22 nt, Human
gucacucaggcuggaguucagu

SEQ ID NO: 96640 - RNA, 22 nt, Human
gucacuuucacacuuuauugcu

SEQ ID NO: 96641 - RNA, 22 nt, Human
gucagaaaccagucaaacaaga

SEQ ID NO: 96642 - RNA, 22 nt, Human
gucagagagggcacgugcacac

SEQ ID NO: 96643 - RNA, 22 nt, Human
gucagagcacugaguugugggc

SEQ ID NO: 96644 - RNA, 22 nt, Human
gucagagcccccagcggcgcgg

SEQ ID NO: 96645 - RNA, 22 nt, Human
gucagaggaauggaugagugau

SEQ ID NO: 96646 - RNA, 22 nt, Human
gucagaggaggcugaguaggaa

SEQ ID NO: 96647 - RNA, 22 nt, Human
gucagcaaggugcaagcggcug

SEQ ID NO: 96648 - RNA, 22 nt, Human
gucagcaccucuuuggggagcu

SEQ ID NO: 96649 - RNA, 22 nt, Human
gucagcacuuuuccgaggcaga

SEQ ID NO: 96650 - RNA, 22 nt, Human
gucagcauugcagauauauggc

SEQ ID NO: 96651 - RNA, 22 nt, Human
gucagccugcacucagggagcg

SEQ ID NO: 96652 - RNA, 22 nt, Human
gucagcgugcucagccuauuau

SEQ ID NO: 96653 - RNA, 22 nt, Human
gucagcuaggcagcugcgaugg

SEQ ID NO: 96654 - RNA, 22 nt, Human
gucagcuaggcagcugugaugg

SEQ ID NO: 96655 - RNA, 22 nt, Human
gucaggacaggcucuggacuga

SEQ ID NO: 96656 - RNA, 22 nt, Human
gucaggaugggcagccaaacua

SEQ ID NO: 96657 - RNA, 22 nt, Human
gucaggcauuuaggaugaguuc

SEQ ID NO: 96658 - RNA, 22 nt, Human
gucaggcccuggcagccgugac

SEQ ID NO: 96659 - RNA, 21 nt, Human
gucagggauucaagugcucac

SEQ ID NO: 96660 - RNA, 22 nt, Human
gucagggcuccacucacccucc

SEQ ID NO: 96661 - RNA, 22 nt, Human
gucagucauauuguacagauau

SEQ ID NO: 96662 - RNA, 22 nt, Human
gucagucuccugccuuuuggac

SEQ ID NO: 96663 - RNA, 22 nt, Human
gucagugccaccagccacugcc

SEQ ID NO: 96664 - RNA, 22 nt, Human
gucagugcuugaagggcagaga

SEQ ID NO: 96665 - RNA, 22 nt, Human
gucaguguagcaggugcaagcc

SEQ ID NO: 96666 - RNA, 22 nt, Human
gucagugucuuaacagagauua

SEQ ID NO: 96667 - RNA, 22 nt, Human
gucauaaaauuuguggauuaga

SEQ ID NO: 96668 - RNA, 22 nt, Human
gucauagaggccuauauaauuu

SEQ ID NO: 96669 - RNA, 22 nt, Human
gucauauuauaaauguucuguu

SEQ ID NO: 96670 - RNA, 22 nt, Human
gucauauugaagaagacuggca

SEQ ID NO: 96671 - RNA, 22 nt, Human
gucauccagacuuugccucugc

SEQ ID NO: 96672 - RNA, 22 nt, Human
gucaucugugcuuuugguagga

SEQ ID NO: 96673 - RNA, 22 nt, Human
gucaucuuaaggacugcuauag

SEQ ID NO: 96674 - RNA, 19 nt, Human
gucaucuuuuaauaaugug

SEQ ID NO: 96675 - RNA, 22 nt, Human
gucaugaaauucuagagcuuga

SEQ ID NO: 96676 - RNA, 22 nt, Human
gucaugagaaaucuuugaaggu

SEQ ID NO: 96677 - RNA, 22 nt, Human
gucaugugacccaaccugagcc

SEQ ID NO: 96678 - RNA, 18 nt, Human
gucauugcaacauacugu

SEQ ID NO: 96679 - RNA, 22 nt, Human
gucauuuaucaucagaagucau

SEQ ID NO: 96680 - RNA, 22 nt, Human
gucauuucuguuucuucagugc

SEQ ID NO: 96681 - RNA, 22 nt, Human
gucauuuuugacuuugaaguga

SEQ ID NO: 96682 - RNA, 22 nt, Human
guccaaacaggucaaaauauua

SEQ ID NO: 96683 - RNA, 22 nt, Human
guccaaauuuuucacauguaga

SEQ ID NO: 96684 - RNA, 22 nt, Human
guccaagagucaagaagggggc

SEQ ID NO: 96685 - RNA, 18 nt, Human
guccacagauucuucacu

SEQ ID NO: 96686 - RNA, 22 nt, Human
guccacucccagugccugaggc

SEQ ID NO: 96687 - RNA, 22 nt, Human
guccagaagcagugcacaucac

SEQ ID NO: 96688 - RNA, 22 nt, Human
guccagagaagggaggggacuc

SEQ ID NO: 96689 - RNA, 22 nt, Human
guccagagaggcaggaggcuac

SEQ ID NO: 96690 - RNA, 22 nt, Human
guccagaguagucgaguauucu

SEQ ID NO: 96691 - RNA, 22 nt, Human
guccagaguauucaaguaacuu

SEQ ID NO: 96692 - RNA, 22 nt, Human
guccagcauuuaggcuugcuga

SEQ ID NO: 96693 - RNA, 22 nt, Human
guccagccacucaccuuccagc

SEQ ID NO: 96694 - RNA, 22 nt, Human
guccagccaggcugcagcaccc

SEQ ID NO: 96695 - RNA, 22 nt, Human
guccagccccugacucccaggc

SEQ ID NO: 96696 - RNA, 22 nt, Human
guccagcccgggcuccgccagc

SEQ ID NO: 96697 - RNA, 22 nt, Human
guccagcccuugcagcuucuuu

SEQ ID NO: 96698 - RNA, 22 nt, Human
guccagccugaagagugggggc

SEQ ID NO: 96699 - RNA, 19 nt, Human
guccagccuuugggucuua

SEQ ID NO: 96700 - RNA, 22 nt, Human
guccaggaagcaauaaauagaa

SEQ ID NO: 96701 - RNA, 22 nt, Human
guccaggagcucagggcuuauu

SEQ ID NO: 96702 - RNA, 22 nt, Human
guccaggcugcccaggguccug

SEQ ID NO: 96703 - RNA, 22 nt, Human
guccagggccccgagcaccagg

SEQ ID NO: 96704 - RNA, 22 nt, Human
guccagucucuuuccaagccca

SEQ ID NO: 96705 - RNA, 21 nt, Human
guccaguggaggaggacagga

SEQ ID NO: 96706 - RNA, 20 nt, Human
guccagugggccuucauuuc

SEQ ID NO: 96707 - RNA, 22 nt, Human
guccagugucuucuacauaaca

SEQ ID NO: 96708 - RNA, 22 nt, Human
guccauccagggucaccaugac

SEQ ID NO: 96709 - RNA, 22 nt, Human
guccaugacugugacucacaug

SEQ ID NO: 96710 - RNA, 22 nt, Human
guccauggcagagcccuucugc

SEQ ID NO: 96711 - RNA, 22 nt, Human
guccauuuuauucagagacuuu

SEQ ID NO: 96712 - RNA, 22 nt, Human
gucccagagagcacuaguccau

SEQ ID NO: 96713 - RNA, 22 nt, Human
gucccagaggacagggucacau

SEQ ID NO: 96714 - RNA, 22 nt, Human
gucccaggcagagucaggaggg

SEQ ID NO: 96715 - RNA, 22 nt, Human
gucccagggagguucagggcuu

SEQ ID NO: 96716 - RNA, 22 nt, Human
gucccaggggagcucucugauu

SEQ ID NO: 96717 - RNA, 22 nt, Human
gucccaggucccagcacaucug

SEQ ID NO: 96718 - RNA, 22 nt, Human
gucccaggugcccagugggcag

SEQ ID NO: 96719 - RNA, 22 nt, Human
gucccauuucaagaaauucaug

SEQ ID NO: 96720 - RNA, 22 nt, Human
guccccagaaaggugaggcagg

SEQ ID NO: 96721 - RNA, 22 nt, Human
guccccagcugugacgagagcc

SEQ ID NO: 96722 - RNA, 22 nt, Human
guccccucagccacccaugggg

SEQ ID NO: 96723 - RNA, 22 nt, Human
gucccucucaaauuuauaugcu

SEQ ID NO: 96724 - RNA, 22 nt, Human
gucccucugccugugguucucu

SEQ ID NO: 96725 - RNA, 22 nt, Human
gucaggauuugaacucaggucu

SEQ ID NO: 96726 - RNA, 22 nt, Human
gucaggauuuuaaaaucccagu

SEQ ID NO: 96727 - RNA, 22 nt, Human
gucaggcagccuggagauucag

SEQ ID NO: 96728 - RNA, 22 nt, Human
gucaggcuggggcugcugccag

SEQ ID NO: 96729 - RNA, 23 nt, Human
gucagggcuggggucagagugac

SEQ ID NO: 96730 - RNA, 23 nt, Human
gucagugcuuuaguucaggaugg

SEQ ID NO: 96731 - RNA, 22 nt, Human
gucagugugguugcuggcuugg

SEQ ID NO: 96732 - RNA, 22 nt, Human
gucaguguuauaaguuuagcca

SEQ ID NO: 96733 - RNA, 22 nt, Human
gucaguuacagccacggcgggu

SEQ ID NO: 96734 - RNA, 22 nt, Human
gucaguuauuuugagcaauugg

SEQ ID NO: 96735 - RNA, 22 nt, Human
gucauagguucaaaaggcagau

SEQ ID NO: 96736 - RNA, 22 nt, Human
gucauauuggcuccacuuccuc

SEQ ID NO: 96737 - RNA, 22 nt, Human
gucaucaucaggcagaugcugc

SEQ ID NO: 96738 - RNA, 22 nt, Human
gucauccaacaagaggcucuug

SEQ ID NO: 96739 - RNA, 21 nt, Human
gucauccaccucucgggcucu

SEQ ID NO: 96740 - RNA, 22 nt, Human
gucaucuuaucauuguugcugu

SEQ ID NO: 96741 - RNA, 22 nt, Human
gucaucuuccuaguguuaacua

SEQ ID NO: 96742 - RNA, 22 nt, Human
gucaucuuugcccugugcagga

SEQ ID NO: 96743 - RNA, 22 nt, Human
aaaugcagguucuugagccaag

SEQ ID NO: 96744 - RNA, 22 nt, Human
aaaugcauaucaaagacuugaa

SEQ ID NO: 96745 - RNA, 22 nt, Human
aaaugcauggcuguuuuaaagc

SEQ ID NO: 96746 - RNA, 22 nt, Human
aaaugcauucuguuuucacuag

SEQ ID NO: 96747 - RNA, 22 nt, Human
aaaugccagcacacgucugugg

SEQ ID NO: 96748 - RNA, 22 nt, Human
aaaugcuacauacacaucaggg

SEQ ID NO: 96749 - RNA, 22 nt, Human
aaaugcucuggggauaagacug

SEQ ID NO: 96750 - RNA, 18 nt, Human
aaaugcugcucaaauucc

SEQ ID NO: 96751 - RNA, 22 nt, Human
aaaugcuguaacugauauucug

SEQ ID NO: 96752 - RNA, 22 nt, Human
aaaugcuguagaucagugaguu

SEQ ID NO: 96753 - RNA, 22 nt, Human
aaaugcuguguuuuaacauaga

SEQ ID NO: 96754 - RNA, 22 nt, Human
aaaugcuuauuagugucacaaa

SEQ ID NO: 96755 - RNA, 22 nt, Human
aaaugcuucaccucauuaaacu

SEQ ID NO: 96756 - RNA, 22 nt, Human
aaaugcuugcucuugauuauuu

SEQ ID NO: 96757 - RNA, 22 nt, Human
aaauggaacugggcuacuaggu

SEQ ID NO: 96758 - RNA, 22 nt, Human
aaauggaagcuauuuaugauuc

SEQ ID NO: 96759 - RNA, 22 nt, Human
aaauggaguucuaaguauagua

SEQ ID NO: 96760 - RNA, 21 nt, Human
aaauggauagggcaauggaag

SEQ ID NO: 96761 - RNA, 22 nt, Human
aaauggaucuguggaauacauu

SEQ ID NO: 96762 - RNA, 22 nt, Human
aaauggcaauuuaguuuauuua

SEQ ID NO: 96763 - RNA, 18 nt, Human
aaauggcagaauggauag

SEQ ID NO: 96764 - RNA, 22 nt, Human
aaauggcauucagcaaccuuuc

SEQ ID NO: 96765 - RNA, 22 nt, Human
aaauggcuacaagaugugcucu

SEQ ID NO: 96766 - RNA, 22 nt, Human
aaauggcugacuaaauuaaauu

SEQ ID NO: 96767 - RNA, 16 nt, Human
aaauggcuuaggcuua

SEQ ID NO: 96768 - RNA, 22 nt, Human
aaaugggccuggaaagaggaug

SEQ ID NO: 96769 - RNA, 22 nt, Human
aaauggguuugauucucagcca

SEQ ID NO: 96770 - RNA, 22 nt, Human
aaaugguaugaaaagagauuuc

SEQ ID NO: 96771 - RNA, 22 nt, Human
aaaugguauuuacucuguauua

SEQ ID NO: 96772 - RNA, 22 nt, Human
aaaugguccauccuaaagaagu

SEQ ID NO: 96773 - RNA, 22 nt, Human
aaauggugagggaauugaacag

SEQ ID NO: 96774 - RNA, 22 nt, Human
aaauguaagucuuuguuucuua

SEQ ID NO: 96775 - RNA, 22 nt, Human
aaauguagaccuauagggaccu

SEQ ID NO: 96776 - RNA, 22 nt, Human
aaauguauugcauaggauauuu

SEQ ID NO: 96777 - RNA, 22 nt, Human
aaaugucaaagacguguuuuug

SEQ ID NO: 96778 - RNA, 22 nt, Human
aaaugucaggugguggauggcu

SEQ ID NO: 96779 - RNA, 22 nt, Human
aaaugucuguaugagaaagaga

SEQ ID NO: 96780 - RNA, 22 nt, Human
aaaugucuguuagucauaucau

SEQ ID NO: 96781 - RNA, 22 nt, Human
aaaugucuuugaguauuucugc

SEQ ID NO: 96782 - RNA, 22 nt, Human
aaaugucuuugaguuuuuauaa

SEQ ID NO: 96783 - RNA, 22 nt, Human
aaaugugagacugaguuuuccu

SEQ ID NO: 96784 - RNA, 22 nt, Human
aaaugugauacuguucuuuuua

SEQ ID NO: 96785 - RNA, 19 nt, Human
aaaugugaugguacaauuc

SEQ ID NO: 96786 - RNA, 19 nt, Human
aaaugugcacuguuuucca

SEQ ID NO: 96787 - RNA, 22 nt, Human
aaaugugucauauucaaaguca

SEQ ID NO: 96788 - RNA, 22 nt, Human
aaauguguguauguacauauau

SEQ ID NO: 96789 - RNA, 22 nt, Human
aaauguguuuagaugguuuauu

SEQ ID NO: 96790 - RNA, 22 nt, Human
aaauguucauuaagggccuguu

SEQ ID NO: 96791 - RNA, 22 nt, Human
aaauguucauuucucacucaca

SEQ ID NO: 96792 - RNA, 22 nt, Human
aaauguuccauuauuguguaau

SEQ ID NO: 96793 - RNA, 22 nt, Human
aaauguucugaaagacccgcuc

SEQ ID NO: 96794 - RNA, 22 nt, Human
aaauuaacuaucacuuuuguga

SEQ ID NO: 96795 - RNA, 22 nt, Human
aaauuaccauuguaaaguauuu

SEQ ID NO: 96796 - RNA, 22 nt, Human
aaauuacuuuacacuuucaucu

SEQ ID NO: 96797 - RNA, 18 nt, Human
aaauuagauggaccugug

SEQ ID NO: 96798 - RNA, 21 nt, Human
aaauuagcuucaaguucugca

SEQ ID NO: 96799 - RNA, 22 nt, Human
aaauuaguacauugcaaagucc

SEQ ID NO: 96800 - RNA, 22 nt, Human
aaauuaucaugggggagaaaca

SEQ ID NO: 96801 - RNA, 22 nt, Human
aaauuauuauaggcagagcuga

SEQ ID NO: 96802 - RNA, 22 nt, Human
aaauuauuaugccccucuauaa

SEQ ID NO: 96803 - RNA, 22 nt, Human
aaauuauucaaaaagcuguguu

SEQ ID NO: 96804 - RNA, 18 nt, Human
aaauuauucuuccuuuuc

SEQ ID NO: 96805 - RNA, 22 nt, Human
aaauuauugggucccaccccag

SEQ ID NO: 96806 - RNA, 21 nt, Human
aaauucaccuaguaaaacuuc

SEQ ID NO: 96807 - RNA, 22 nt, Human
aaaggcuacgggggccgugugc

SEQ ID NO: 96808 - RNA, 22 nt, Human
aaaggcuauuucagggucagua

SEQ ID NO: 96809 - RNA, 22 nt, Human
aaaggcucacgcaguuagugau

SEQ ID NO: 96810 - RNA, 22 nt, Human
aaaggcucauacagaaaauaca

SEQ ID NO: 96811 - RNA, 22 nt, Human
aaaggcucaugaaccaggcucg

SEQ ID NO: 96812 - RNA, 22 nt, Human
aaaggcucuauuguuuucauau

SEQ ID NO: 96813 - RNA, 22 nt, Human
aaaggcuuagacacagaacugu

SEQ ID NO: 96814 - RNA, 22 nt, Human
aaaggcuucuuugcuccauguc

SEQ ID NO: 96815 - RNA, 22 nt, Human
aaaggcuugagcauuuguugaa

SEQ ID NO: 96816 - RNA, 22 nt, Human
aaagggaaguugcacauguucc

SEQ ID NO: 96817 - RNA, 22 nt, Human
aaagggccuccgccugggcagg

SEQ ID NO: 96818 - RNA, 22 nt, Human
aaagguaaaguaucugcccaag

SEQ ID NO: 96819 - RNA, 22 nt, Human
aaaggucaaaaucgugacauug

SEQ ID NO: 96820 - RNA, 22 nt, Human
aaaggucaagcuggacucaggu

SEQ ID NO: 96821 - RNA, 23 nt, Human
aaaggucucugagccuugguuuc

SEQ ID NO: 96822 - RNA, 22 nt, Human
aaaggucuuuuuucuaacacca

SEQ ID NO: 96823 - RNA, 22 nt, Human
aaaggugacugcagcagcuauu

SEQ ID NO: 96824 - RNA, 22 nt, Human
aaagguuauuauuacuauuguc

SEQ ID NO: 96825 - RNA, 22 nt, Human
aaagguucuacuuuuaaagaau

SEQ ID NO: 96826 - RNA, 22 nt, Human
aaagguugaauucaggauccac

SEQ ID NO: 96827 - RNA, 22 nt, Human
aaagguuuauuuaaucagggag

SEQ ID NO: 96828 - RNA, 22 nt, Human
aaagguuuuauguuuuccacuu

SEQ ID NO: 96829 - RNA, 22 nt, Human
aaagguuuucugacccuuagua

SEQ ID NO: 96830 - RNA, 22 nt, Human
aaagguuuugcccuggguauuc

SEQ ID NO: 96831 - RNA, 22 nt, Human
aaagguuuugguaaggcuuuaa

SEQ ID NO: 96832 - RNA, 22 nt, Human
aaaguaauugcaguuucugcca

SEQ ID NO: 96833 - RNA, 22 nt, Human
aaaguacaaauguucuagccau

SEQ ID NO: 96834 - RNA, 22 nt, Human
aaaguacaauauugagauugau

SEQ ID NO: 96835 - RNA, 22 nt, Human
aaaguacagauggugagguugg

SEQ ID NO: 96836 - RNA, 22 nt, Human
aaaguacaugcaauucuucuga

SEQ ID NO: 96837 - RNA, 22 nt, Human
aaaguacauguuuggccauuug

SEQ ID NO: 96838 - RNA, 22 nt, Human
aaaguacccaagaacagaguga

SEQ ID NO: 96839 - RNA, 22 nt, Human
aaaguacuuacaguaugcuugg

SEQ ID NO: 96840 - RNA, 22 nt, Human
aaaguacuuggauuacaggcau

SEQ ID NO: 96841 - RNA, 22 nt, Human
aaaguagaacauuuucuuaucu

SEQ ID NO: 96842 - RNA, 22 nt, Human
aaaguagcccuucuggaauuua

SEQ ID NO: 96843 - RNA, 22 nt, Human
aaaguaguccuuggagcgaaau

SEQ ID NO: 96844 - RNA, 22 nt, Human
aaaguauauuuacuuacuguga

SEQ ID NO: 96845 - RNA, 22 nt, Human
aaaguaugauuggggauuauuu

SEQ ID NO: 96846 - RNA, 22 nt, Human
aaagucaagguuuagacuagag

SEQ ID NO: 96847 - RNA, 22 nt, Human
aaagucauccaaauuuuuaugu

SEQ ID NO: 96848 - RNA, 22 nt, Human
aaagucauggaaaaucuuggaa

SEQ ID NO: 96849 - RNA, 20 nt, Human
aaagucucaacagcugagaa

SEQ ID NO: 96850 - RNA, 22 nt, Human
aaagucugagcagaauuucuca

SEQ ID NO: 96851 - RNA, 22 nt, Human
aaagucuuaauguaaguuuagu

SEQ ID NO: 96852 - RNA, 22 nt, Human
aacaucucuguauuuuauagac

SEQ ID NO: 96853 - RNA, 22 nt, Human
aacaucugggcccugauuuugg

SEQ ID NO: 96854 - RNA, 22 nt, Human
aacaucuuguccuuagauuaaa

SEQ ID NO: 96855 - RNA, 22 nt, Human
aacaucuuuguaguguucuccu

SEQ ID NO: 96856 - RNA, 22 nt, Human
aacaugaaaaccuccacagcaa

SEQ ID NO: 96857 - RNA, 22 nt, Human
aacaugaaaacuaccugugauu

SEQ ID NO: 96858 - RNA, 22 nt, Human
aacaugaaacccaaacagaaua

SEQ ID NO: 96859 - RNA, 22 nt, Human
aacaugaaguuuucuauaguga

SEQ ID NO: 96860 - RNA, 22 nt, Human
aacaugagugauaaaauuaccu

SEQ ID NO: 96861 - RNA, 22 nt, Human
aacaugauaguauuuugaggug

SEQ ID NO: 96862 - RNA, 22 nt, Human
aacaugcaaagcuaugauguau

SEQ ID NO: 96863 - RNA, 22 nt, Human
aacaugcaaugucugaaaaucc

SEQ ID NO: 96864 - RNA, 18 nt, Human
aacaugcauuagaacugc

SEQ ID NO: 96865 - RNA, 22 nt, Human
aacaugcccgcuguaugccauu

SEQ ID NO: 96866 - RNA, 22 nt, Human
aacaugcuggguguuuuugaug

SEQ ID NO: 96867 - RNA, 19 nt, Human
aacauggaacuggagaggg

SEQ ID NO: 96868 - RNA, 22 nt, Human
aacauggcucaugagagauuug

SEQ ID NO: 96869 - RNA, 22 nt, Human
aacauguaaauaucauuguacu

SEQ ID NO: 96870 - RNA, 22 nt, Human
aacauguaaccagcauucaucu

SEQ ID NO: 96871 - RNA, 22 nt, Human
aacauguagcagaaacgacuaa

SEQ ID NO: 96872 - RNA, 22 nt, Human
aacauguauuuuccuuggcaac

SEQ ID NO: 96873 - RNA, 22 nt, Human
aacaugucuuuagagaaacauu

SEQ ID NO: 96874 - RNA, 22 nt, Human
aacaugugucuugcauuucuug

SEQ ID NO: 96875 - RNA, 22 nt, Human
aacauguugaguugaaaguagc

SEQ ID NO: 96876 - RNA, 22 nt, Human
aacauucaaguucugguuuaug

SEQ ID NO: 96877 - RNA, 22 nt, Human
aacauucuacuguacugcauug

SEQ ID NO: 96878 - RNA, 22 nt, Human
aacauuucauaacuugacuuuu

SEQ ID NO: 96879 - RNA, 22 nt, Human
aacauuucauuggaagcuaugu

SEQ ID NO: 96880 - RNA, 22 nt, Human
aacauuucuucugaaacugagu

SEQ ID NO: 96881 - RNA, 22 nt, Human
aacauuugcaugcuuuauuaga

SEQ ID NO: 96882 - RNA, 21 nt, Human
aacauuuggcuggcuuuugug

SEQ ID NO: 96883 - RNA, 22 nt, Human
aacauuugugaaguacuuagau

SEQ ID NO: 96884 - RNA, 20 nt, Human
aaccaacagaaucaugucuc

SEQ ID NO: 96885 - RNA, 22 nt, Human
aaccaacaggaguggggauugg

SEQ ID NO: 96886 - RNA, 22 nt, Human
aaccaacauaggaaugcagaga

SEQ ID NO: 96887 - RNA, 22 nt, Human
aaccaagcccauuacuuuacuu

SEQ ID NO: 96888 - RNA, 22 nt, Human
aaccaaguuuauuccaaguuac

SEQ ID NO: 96889 - RNA, 22 nt, Human
aaccagcuccagccuccauuca

SEQ ID NO: 96890 - RNA, 22 nt, Human
aaccagcucugcaaaaugucau

SEQ ID NO: 96891 - RNA, 22 nt, Human
aaccagcuuugauacgcauuau

SEQ ID NO: 96892 - RNA, 22 nt, Human
aaccaggaacuuuugugagagc

SEQ ID NO: 96893 - RNA, 22 nt, Human
aaccaggaagggcgcaaauuau

SEQ ID NO: 96894 - RNA, 20 nt, Human
aaccaggauagaccagggaa

SEQ ID NO: 96895 - RNA, 22 nt, Human
aaccaguacuuuacacagcucu

SEQ ID NO: 96896 - RNA, 22 nt, Human
aaccaguuuagucaugcuguaa

SEQ ID NO: 96897 - RNA, 22 nt, Human
aaccaugcuagcaucaaaaugu

SEQ ID NO: 96898 - RNA, 22 nt, Human
aaccauguacuuuauucuguuu

SEQ ID NO: 96899 - RNA, 22 nt, Human
aacccacaagcagcuguagccc

SEQ ID NO: 96900 - RNA, 22 nt, Human
aacccagccguguagcugccgc

SEQ ID NO: 96901 - RNA, 22 nt, Human
aacccaggagacggaguuugug

SEQ ID NO: 96902 - RNA, 22 nt, Human
aacccaggagccggagguugug

SEQ ID NO: 96903 - RNA, 22 nt, Human
aacccagggugaggggagucua

SEQ ID NO: 96904 - RNA, 22 nt, Human
aacccauuaauccuugcaagca

SEQ ID NO: 96905 - RNA, 22 nt, Human
aaccccaggcuggaggagucuc

SEQ ID NO: 96906 - RNA, 22 nt, Human
aacccgggagguggagguuaug

SEQ ID NO: 96907 - RNA, 22 nt, Human
aacccuggggcagcugcuaggg

SEQ ID NO: 96908 - RNA, 22 nt, Human
aaccucucugugcccugacuuu

SEQ ID NO: 96909 - RNA, 22 nt, Human
aaccugaagaaaauauuugcug

SEQ ID NO: 96910 - RNA, 22 nt, Human
aaccugagauacuggucuuuau

SEQ ID NO: 96911 - RNA, 22 nt, Human
aaccugcaguuuuuauucugag

SEQ ID NO: 96912 - RNA, 22 nt, Human
aaccuggagcacccucauaucu

SEQ ID NO: 96913 - RNA, 22 nt, Human
aaccuggaggcuguguagucuu

SEQ ID NO: 96914 - RNA, 22 nt, Human
aaccuguucccugguccuugac

SEQ ID NO: 96915 - RNA, 22 nt, Human
aaccuguuuucuucucaucuag

SEQ ID NO: 96916 - RNA, 22 nt, Human
aaccuguuuugguugcauuuca

SEQ ID NO: 96917 - RNA, 22 nt, Human
aaccuuccugaggaaagucuaa

SEQ ID NO: 96918 - RNA, 22 nt, Human
aaccuuuauuugguacuauucu

SEQ ID NO: 96919 - RNA, 22 nt, Human
aaccuuucaauuauccucaucu

SEQ ID NO: 96920 - RNA, 22 nt, Human
aaccuuugaggggagcucuuuc

SEQ ID NO: 96921 - RNA, 22 nt, Human
aacgcccgugguugccaaggua

SEQ ID NO: 96922 - RNA, 22 nt, Human
aacuaauacauuaauacaugug

SEQ ID NO: 96923 - RNA, 22 nt, Human
aacuacaggggguggcaggcgg

SEQ ID NO: 96924 - RNA, 22 nt, Human
aacuacaguaguuugcccuucu

SEQ ID NO: 96925 - RNA, 22 nt, Human
aacuacauuuuacagaagauga

SEQ ID NO: 96926 - RNA, 22 nt, Human
aaauagacaggcuuaaauagga

SEQ ID NO: 96927 - RNA, 22 nt, Human
aaauagauugcugaggcauuac

SEQ ID NO: 96928 - RNA, 22 nt, Human
aaauagcagccuuuaguuaaca

SEQ ID NO: 96929 - RNA, 22 nt, Human
aaauagcugaaaguuccuagau

SEQ ID NO: 96930 - RNA, 22 nt, Human
aaauagcuucuaagccuuuuga

SEQ ID NO: 96931 - RNA, 22 nt, Human
aaauaggggaccaggaaaggag

SEQ ID NO: 96932 - RNA, 22 nt, Human
aaauaguaaagugguagccauc

SEQ ID NO: 96933 - RNA, 22 nt, Human
aaauaguuguuuggaucaauaa

SEQ ID NO: 96934 - RNA, 22 nt, Human
aaauauaguaaaugcauaguuc

SEQ ID NO: 96935 - RNA, 22 nt, Human
aaauauagugacacuuauaguc

SEQ ID NO: 96936 - RNA, 22 nt, Human
aaauauccucagggcagaggug

SEQ ID NO: 96937 - RNA, 22 nt, Human
aaauaucuuaggaguauaugag

SEQ ID NO: 96938 - RNA, 22 nt, Human
aaauaugagaguaggaguuugg

SEQ ID NO: 96939 - RNA, 22 nt, Human
aaauaugauacucccuuuuagu

SEQ ID NO: 96940 - RNA, 22 nt, Human
aaauauguaagauuagcacuag

SEQ ID NO: 96941 - RNA, 22 nt, Human
aaauauguauggaguucaugaa

SEQ ID NO: 96942 - RNA, 22 nt, Human
aaauaugugaucagugaauaaa

SEQ ID NO: 96943 - RNA, 22 nt, Human
aaauauuguuuugguaagcuuc

SEQ ID NO: 96944 - RNA, 22 nt, Human
aaaucaacuugugacguuaggu

SEQ ID NO: 96945 - RNA, 22 nt, Human
aaaucaaggagggauuauauuu

SEQ ID NO: 96946 - RNA, 22 nt, Human
aaaucagaaaauauggagagga

SEQ ID NO: 96947 - RNA, 22 nt, Human
aaaucagaggucagcuguacca

SEQ ID NO: 96948 - RNA, 22 nt, Human
aaaucagagucugauuuuaagg

SEQ ID NO: 96949 - RNA, 22 nt, Human
aaaucaguaaauguucauuaac

SEQ ID NO: 96950 - RNA, 22 nt, Human
aaaucaguuaagaugaggccau

SEQ ID NO: 96951 - RNA, 22 nt, Human
aaaucaguuagugguaggauug

SEQ ID NO: 96952 - RNA, 22 nt, Human
aaaucaguucucccuuucuuca

SEQ ID NO: 96953 - RNA, 22 nt, Human
aaaucauagcccccauccgauu

SEQ ID NO: 96954 - RNA, 22 nt, Human
aaaucaugugcagagaucagga

SEQ ID NO: 96955 - RNA, 22 nt, Human
aaauccaguuugucauuuccca

SEQ ID NO: 96956 - RNA, 22 nt, Human
aaaucccacucagaaacugcca

SEQ ID NO: 96957 - RNA, 22 nt, Human
aaaucccagauaguaauguauu

SEQ ID NO: 96958 - RNA, 23 nt, Human
aaauccugccucuuguauuuauc

SEQ ID NO: 96959 - RNA, 22 nt, Human
aaauccuguccauuuaccagau

SEQ ID NO: 96960 - RNA, 22 nt, Human
aaauccuugauaguuugcccua

SEQ ID NO: 96961 - RNA, 22 nt, Human
aacugauuucaaguucaguuuc

SEQ ID NO: 96962 - RNA, 22 nt, Human
aacugcaacuucguaaagugag

SEQ ID NO: 96963 - RNA, 23 nt, Human
aacugcaagguugcugggaagua

SEQ ID NO: 96964 - RNA, 22 nt, Human
aacugcaauuacuuuugcacua

SEQ ID NO: 96965 - RNA, 22 nt, Human
aacugcaauuacuuuugcgcca

SEQ ID NO: 96966 - RNA, 22 nt, Human
aacugcauaauauaucaugcag

SEQ ID NO: 96967 - RNA, 22 nt, Human
aacugcauguguguggcaugau

SEQ ID NO: 96968 - RNA, 22 nt, Human
aacugcauuugcauaaguccau

SEQ ID NO: 96969 - RNA, 22 nt, Human
aacugcuggggaggccaaacuc

SEQ ID NO: 96970 - RNA, 21 nt, Human
aacugcuggucuuuucugucu

SEQ ID NO: 96971 - RNA, 22 nt, Human
aacugcuuccuuggcaggcaug

SEQ ID NO: 96972 - RNA, 22 nt, Human
aacugcuugaugaagcucccac

SEQ ID NO: 96973 - RNA, 22 nt, Human
aacuggaagagugaauauaacu

SEQ ID NO: 96974 - RNA, 22 nt, Human
aacuggaaggauugcagauguc

SEQ ID NO: 96975 - RNA, 22 nt, Human
aacuggaaugaaauuuacgaug

SEQ ID NO: 96976 - RNA, 19 nt, Human
aacuggauaauggccacau

SEQ ID NO: 96977 - RNA, 22 nt, Human
aacuguaagacaaaugacuucu

SEQ ID NO: 96978 - RNA, 22 nt, Human
aacuguaagugguuggaagaag

SEQ ID NO: 96979 - RNA, 19 nt, Human
aacuguaauuaauacccua

SEQ ID NO: 96980 - RNA, 22 nt, Human
aacuguacgauaauaaauuugu

SEQ ID NO: 96981 - RNA, 22 nt, Human
aacugugaggaugugcaaauuc

SEQ ID NO: 96982 - RNA, 22 nt, Human
aacuguggacuugagacugaug

SEQ ID NO: 96983 - RNA, 22 nt, Human
aacuguggccagggacuggagu

SEQ ID NO: 96984 - RNA, 22 nt, Human
aacuguucuuguguuugcuaug

SEQ ID NO: 96985 - RNA, 22 nt, Human
aacuguugucauauggucuuaa

SEQ ID NO: 96986 - RNA, 22 nt, Human
aacuguuuaccauacacaguga

SEQ ID NO: 96987 - RNA, 22 nt, Human
aacuguuuauguaaguaugcag

SEQ ID NO: 96988 - RNA, 23 nt, Human
aacuuaauacugggauaagaugc

SEQ ID NO: 96989 - RNA, 22 nt, Human
aacuuacaaggaugauagcugc

SEQ ID NO: 96990 - RNA, 22 nt, Human
aacuuagacuuguuucuuggua

SEQ ID NO: 96991 - RNA, 22 nt, Human
aacuuauacccagggcagaaau

SEQ ID NO: 96992 - RNA, 22 nt, Human
aacuuauuccauaggcucacug

SEQ ID NO: 96993 - RNA, 22 nt, Human
aacuucaaaugugacuuugcau

SEQ ID NO: 96994 - RNA, 18 nt, Human
aacuucaacuacaaugga

SEQ ID NO: 96995 - RNA, 22 nt, Human
aacuucaccuuuuugccacacu

SEQ ID NO: 96996 - RNA, 22 nt, Human
aacuucagggggcacauucaag

SEQ ID NO: 96997 - RNA, 22 nt, Human
aacuuccugacuucuaaugagu

SEQ ID NO: 96998 - RNA, 22 nt, Human
aacuucucagccugcaccuggc

SEQ ID NO: 96999 - RNA, 22 nt, Human
aacuucugaccucaagaacugu

SEQ ID NO: 97000 - RNA, 22 nt, Human
aacuucugcagaaaagugcaug

SEQ ID NO: 97001 - RNA, 22 nt, Human
aacuucuuugagcuccaguuuu

SEQ ID NO: 97002 - RNA, 22 nt, Human
aacuugaaaaccucaugaauug

SEQ ID NO: 97003 - RNA, 22 nt, Human
aacuugaacugaugaguguuag

SEQ ID NO: 97004 - RNA, 22 nt, Human
aacuuguaggacugcacuguag

SEQ ID NO: 97005 - RNA, 22 nt, Human
aacuuguuuagaagagguuacu

SEQ ID NO: 97006 - RNA, 20 nt, Human
aacuuguuuuguuuucuaau

SEQ ID NO: 97007 - RNA, 22 nt, Human
aacuuuacacugcuuuacauga

SEQ ID NO: 97008 - RNA, 22 nt, Human
aacuuuacuugaaagaacaugu

SEQ ID NO: 97009 - RNA, 22 nt, Human
aacuuuauuguuaggggcuaaa

SEQ ID NO: 97010 - RNA, 22 nt, Human
aacuuucuauagguugggauuu

SEQ ID NO: 97011 - RNA, 22 nt, Human
aacuuucucuggauggcuuccu

SEQ ID NO: 97012 - RNA, 22 nt, Human
aacuuucuuggaugucucaaca

SEQ ID NO: 97013 - RNA, 22 nt, Human
aacuuucuugugacauuugggg

SEQ ID NO: 97014 - RNA, 22 nt, Human
aacuuugagucauugccucuuu

SEQ ID NO: 97015 - RNA, 20 nt, Human
aacuuugcauuuuauucucc

SEQ ID NO: 97016 - RNA, 22 nt, Human
aacuuuguuuuauucacugcug

SEQ ID NO: 97017 - RNA, 22 nt, Human
aacuuuucauuccaaaggugcu

SEQ ID NO: 97018 - RNA, 22 nt, Human
aagaaaacaugaucuaauuuaa

SEQ ID NO: 97019 - RNA, 22 nt, Human
aagaaaagauguuugguuuuca

SEQ ID NO: 97020 - RNA, 22 nt, Human
aagaaaagguaaccgcuuaucu

SEQ ID NO: 97021 - RNA, 22 nt, Human
aagaaaccaacccugccagcac

SEQ ID NO: 97022 - RNA, 22 nt, Human
aagaaacuguugcgugacagcg

SEQ ID NO: 97023 - RNA, 22 nt, Human
aagaaagccaaaguucauaccu

SEQ ID NO: 97024 - RNA, 22 nt, Human
aagaaagggagaaggauggugu

SEQ ID NO: 97025 - RNA, 22 nt, Human
aagaaaguguggagagccuagc

SEQ ID NO: 97026 - RNA, 22 nt, Human
aagaaauacaugguuuuugagu

SEQ ID NO: 97027 - RNA, 22 nt, Human
aagaaaucauaucauuucuugg

SEQ ID NO: 97028 - RNA, 22 nt, Human
aagaaaugcugauguuggaugg

SEQ ID NO: 97029 - RNA, 22 nt, Human
aagaaauggcuucaucugagua

SEQ ID NO: 97030 - RNA, 22 nt, Human
aagaacaacugcuuuaaaagca

SEQ ID NO: 97031 - RNA, 22 nt, Human
aagaacagauucagccugaacu

SEQ ID NO: 97032 - RNA, 22 nt, Human
aagaacaguguccugggacucg

SEQ ID NO: 97033 - RNA, 22 nt, Human
aagaacaugaagucacaaaugc

SEQ ID NO: 97034 - RNA, 22 nt, Human
aagaacauggacugugggguua

SEQ ID NO: 97035 - RNA, 22 nt, Human
aagaacuagucuuacagccuca

SEQ ID NO: 97036 - RNA, 21 nt, Human
aagaacuauugagguacacag

SEQ ID NO: 97037 - RNA, 18 nt, Human
aagaacugagguccuaga

SEQ ID NO: 97038 - RNA, 23 nt, Human
aagaacugcgaauggagaaagua

SEQ ID NO: 97039 - RNA, 22 nt, Human
aagaacuuccuaauauauuuuc

SEQ ID NO: 97040 - RNA, 22 nt, Human
aagaacuugggcugagugaaag

SEQ ID NO: 97041 - RNA, 22 nt, Human
aagaacuuuaaagcacuuauga

SEQ ID NO: 97042 - RNA, 23 nt, Human
aagaacuuugguccugcagaguc

SEQ ID NO: 97043 - RNA, 22 nt, Human
aagaagagaaaugugcugcugg

SEQ ID NO: 97044 - RNA, 22 nt, Human
aagaagcuaagacuaucugggu

SEQ ID NO: 97045 - RNA, 22 nt, Human
aagaagcuauacauaauuuggg

SEQ ID NO: 97046 - RNA, 22 nt, Human
aaaugccugaaugguauuuggu

SEQ ID NO: 97047 - RNA, 22 nt, Human
aaaugccuguguaaauucuagc

SEQ ID NO: 97048 - RNA, 22 nt, Human
aaaugcuaaaugcagcaaguag

SEQ ID NO: 97049 - RNA, 22 nt, Human
aaaugcuacacaggaauucuca

SEQ ID NO: 97050 - RNA, 22 nt, Human
aaaugcuagaacauuuuaaagg

SEQ ID NO: 97051 - RNA, 22 nt, Human
aaaugcucugcaucugauagac

SEQ ID NO: 97052 - RNA, 22 nt, Human
aaaugcugggaaccauuggauc

SEQ ID NO: 97053 - RNA, 19 nt, Human
aaaugcuguggagggcucc

SEQ ID NO: 97054 - RNA, 22 nt, Human
aaaugcuugcaacaucccaggu

SEQ ID NO: 97055 - RNA, 22 nt, Human
aaaugcuuguauauuucuuggu

SEQ ID NO: 97056 - RNA, 22 nt, Human
aaauggaaaaugcuguuuuggu

SEQ ID NO: 97057 - RNA, 22 nt, Human
aaauggaauguguuuauaauuc

SEQ ID NO: 97058 - RNA, 22 nt, Human
aaauggcaaucagcagaagcua

SEQ ID NO: 97059 - RNA, 18 nt, Human
aaauggcacacagaccug

SEQ ID NO: 97060 - RNA, 20 nt, Human
aaauggcacaugggaagucc

SEQ ID NO: 97061 - RNA, 22 nt, Human
aaauggcagcccagagguaagg

SEQ ID NO: 97062 - RNA, 22 nt, Human
aaauggcaguagaaaagaaucc

SEQ ID NO: 97063 - RNA, 22 nt, Human
aaauggcagugucauaaggcuc

SEQ ID NO: 97064 - RNA, 20 nt, Human
aaauggccucagauaagcag

SEQ ID NO: 97065 - RNA, 23 nt, Human
aaauggcuugcccucucguuugg

SEQ ID NO: 97066 - RNA, 22 nt, Human
aaaugguaaugucuuucuguuu

SEQ ID NO: 97067 - RNA, 22 nt, Human
aaaugguaguagcauuccauau

SEQ ID NO: 97068 - RNA, 22 nt, Human
aaauggucacuggugaguguca

SEQ ID NO: 97069 - RNA, 22 nt, Human
aaaugguguuucuaaugcuaga

SEQ ID NO: 97070 - RNA, 22 nt, Human
aagauacuucacuugccgaaau

SEQ ID NO: 97071 - RNA, 22 nt, Human
aagauagaugucaucagcauau

SEQ ID NO: 97072 - RNA, 22 nt, Human
aagauauagauaaaacuaugca

SEQ ID NO: 97073 - RNA, 22 nt, Human
aagauauucaaagauuuauuag

SEQ ID NO: 97074 - RNA, 22 nt, Human
aagaucaaguguacuuuaugua

SEQ ID NO: 97075 - RNA, 22 nt, Human
aagaucaauguucauuaagaug

SEQ ID NO: 97076 - RNA, 14 nt, Human
aagaucaccuuccu

SEQ ID NO: 97077 - RNA, 22 nt, Human
aagaucaccuugacaugaaaag

SEQ ID NO: 97078 - RNA, 22 nt, Human
aagaucagcucccgagucugag

SEQ ID NO: 97079 - RNA, 23 nt, Human
aagauccauucaaauuauguauc

SEQ ID NO: 97080 - RNA, 22 nt, Human
aagauccugcuuuugcuucugu

SEQ ID NO: 97081 - RNA, 22 nt, Human
aagauccuucucacugcagugu

SEQ ID NO: 97082 - RNA, 22 nt, Human
aagauccuugguucugcuuucc

SEQ ID NO: 97083 - RNA, 22 nt, Human
aagaugacagaugcuuagaguc

SEQ ID NO: 97084 - RNA, 22 nt, Human
aagaugauaggacuugcuuaag

SEQ ID NO: 97085 - RNA, 22 nt, Human
aagaugaugcagacuuugaugu

SEQ ID NO: 97086 - RNA, 22 nt, Human
aagaugcacaauguggcaauua

SEQ ID NO: 97087 - RNA, 22 nt, Human
aagaugcuggcaggaauagcua

SEQ ID NO: 97088 - RNA, 22 nt, Human
aagaugcuuccacugcaguggc

SEQ ID NO: 97089 - RNA, 22 nt, Human
aagaugcuugcaaauuucugaa

SEQ ID NO: 97090 - RNA, 22 nt, Human
aagauggcaucuccuauagaug

SEQ ID NO: 97091 - RNA, 22 nt, Human
aagaugguguggucaaggacca

SEQ ID NO: 97092 - RNA, 22 nt, Human
aagaugguuauuucaucaccua

SEQ ID NO: 97093 - RNA, 22 nt, Human
aagauguaaaggcaauauaaag

SEQ ID NO: 97094 - RNA, 22 nt, Human
aagauguaucaguuaagucuuc

SEQ ID NO: 97095 - RNA, 23 nt, Human
aagauguauuuuuaccaaauguc

SEQ ID NO: 97096 - RNA, 22 nt, Human
aagaugugcaguucauggcagg

SEQ ID NO: 97097 - RNA, 22 nt, Human
aagaugugcauggguaugcaau

SEQ ID NO: 97098 - RNA, 22 nt, Human
aagauguuaggguggaagggau

SEQ ID NO: 97099 - RNA, 22 nt, Human
aagauguucuauuuucacuuuu

SEQ ID NO: 97100 - RNA, 22 nt, Human
aagauuaaaggggagacaagcu

SEQ ID NO: 97101 - RNA, 22 nt, Human
aagauuauggcagauaacaauu

SEQ ID NO: 97102 - RNA, 22 nt, Human
aagauucccagagaaguuccac

SEQ ID NO: 97103 - RNA, 22 nt, Human
aagauucuacaguagguacauu

SEQ ID NO: 97104 - RNA, 22 nt, Human
aagauucugaaagggguggggc

SEQ ID NO: 97105 - RNA, 22 nt, Human
aagauucuuauuagguaauuuu

SEQ ID NO: 97106 - RNA, 19 nt, Human
aagauugccuuguuccauu

SEQ ID NO: 97107 - RNA, 22 nt, Human
aagauuuaccacuuuauucaag

SEQ ID NO: 97108 - RNA, 22 nt, Human
aagauuuacuagcauaauagcu

SEQ ID NO: 97109 - RNA, 22 nt, Human
aagauuuauuagaugcuuaccu

SEQ ID NO: 97110 - RNA, 22 nt, Human
aagauuuguggauuuaaggaua

SEQ ID NO: 97111 - RNA, 22 nt, Human
aagauuuucagcuaauggugca

SEQ ID NO: 97112 - RNA, 22 nt, Human
aagcaaagacaguuugagugga

SEQ ID NO: 97113 - RNA, 22 nt, Human
aagcaaaggaaagcugacuuuu

SEQ ID NO: 97114 - RNA, 22 nt, Human
aagcaaagugcuuugccuccag

SEQ ID NO: 97115 - RNA, 22 nt, Human
aagcaaauucuggaggugaggu

SEQ ID NO: 97116 - RNA, 22 nt, Human
aagcaacugccuucaauauuua

SEQ ID NO: 97117 - RNA, 22 nt, Human
aagcaagcaagguguuacauau

SEQ ID NO: 97118 - RNA, 22 nt, Human
aagcaagccaaucuguuuuguu

SEQ ID NO: 97119 - RNA, 22 nt, Human
aagcaaguacaauagcaaguac

SEQ ID NO: 97120 - RNA, 22 nt, Human
aagcaaguagguauuugacaaa

SEQ ID NO: 97121 - RNA, 22 nt, Human
aagcaaguucucaucauuuaua

SEQ ID NO: 97122 - RNA, 22 nt, Human
aagcaauaaauaauuuuuagua

SEQ ID NO: 97123 - RNA, 22 nt, Human
aagcaauaaucccaaagugcug

SEQ ID NO: 97124 - RNA, 23 nt, Human
aagcaauaccaggugugggcccu

SEQ ID NO: 97125 - RNA, 22 nt, Human
aagcaauauacugauaugauua

SEQ ID NO: 97126 - RNA, 22 nt, Human
aagcaauguguuaaugaaugag

SEQ ID NO: 97127 - RNA, 22 nt, Human
aagcaauucacaguucacuuaa

SEQ ID NO: 97128 - RNA, 22 nt, Human
aagcaauugagugaaaccucuu

SEQ ID NO: 97129 - RNA, 22 nt, Human
aagcaauuguccugucucuaca

SEQ ID NO: 97130 - RNA, 22 nt, Human
aagcaauuugacaguacauauc

SEQ ID NO: 97131 - RNA, 22 nt, Human
aagcacagaccagaucuccagg

SEQ ID NO: 97132 - RNA, 22 nt, Human
aagcacagacucccucugagug

SEQ ID NO: 97133 - RNA, 22 nt, Human
aagcacagagagguaaaguaac

SEQ ID NO: 97134 - RNA, 22 nt, Human
aagcacagagaugggcacgccu

SEQ ID NO: 97135 - RNA, 22 nt, Human
aagcacaggaucuugaggagcg

SEQ ID NO: 97136 - RNA, 22 nt, Human
aagcacagggugucugcauuca

SEQ ID NO: 97137 - RNA, 22 nt, Human
aagcacagguugaggauuauuc

SEQ ID NO: 97138 - RNA, 22 nt, Human
aagcacaguaaaagcagauuuu

SEQ ID NO: 97139 - RNA, 22 nt, Human
aagcacagugccaaguucuauu

SEQ ID NO: 97140 - RNA, 22 nt, Human
aagcacaguucuuagaguuaca

SEQ ID NO: 97141 - RNA, 22 nt, Human
aagcacaugaaaaugugaagcu

SEQ ID NO: 97142 - RNA, 22 nt, Human
aagcacauuuggaaaacaugga

SEQ ID NO: 97143 - RNA, 22 nt, Human
aagcaccaaguucaacauuccc

SEQ ID NO: 97144 - RNA, 22 nt, Human
aagcaccugcaguugacaaaaa

SEQ ID NO: 97145 - RNA, 22 nt, Human
aagcacugggaggaggcugaga

SEQ ID NO: 97146 - RNA, 20 nt, Human
aagcacugugguggcaugga

SEQ ID NO: 97147 - RNA, 22 nt, Human
aagcacuuuagugagaauaagg

SEQ ID NO: 97148 - RNA, 22 nt, Human
aagcagaauagaggcccuuccc

SEQ ID NO: 97149 - RNA, 22 nt, Human
aagcagaauuucccacuaguug

SEQ ID NO: 97150 - RNA, 22 nt, Human
aagcagacagagaauggguuug

SEQ ID NO: 97151 - RNA, 22 nt, Human
aagcagagagcagaauuaaguu

SEQ ID NO: 97152 - RNA, 22 nt, Human
aagcagagccugagacagggau

SEQ ID NO: 97153 - RNA, 22 nt, Human
aagcagaggccacagagugggc

SEQ ID NO: 97154 - RNA, 22 nt, Human
aagcagaggguauggccagguu

SEQ ID NO: 97155 - RNA, 22 nt, Human
aagcagaguccccuucccaugg

SEQ ID NO: 97156 - RNA, 22 nt, Human
aagcagagugauauaaacaugg

SEQ ID NO: 97157 - RNA, 22 nt, Human
aagcagcaaguuuauuucuauc

SEQ ID NO: 97158 - RNA, 22 nt, Human
aagcagcacagcaaugacucua

SEQ ID NO: 97159 - RNA, 22 nt, Human
aagcagcagaccugauuuugaa

SEQ ID NO: 97160 - RNA, 22 nt, Human
aagcagcauugugguaggggag

SEQ ID NO: 97161 - RNA, 22 nt, Human
aagcagccucauuugugguaag

SEQ ID NO: 97162 - RNA, 22 nt, Human
aagcagccuggcaugaugcuuu

SEQ ID NO: 97163 - RNA, 21 nt, Human
aagcagcuuaauaaaguaugu

SEQ ID NO: 97164 - RNA, 22 nt, Human
aagcagcuucccuggcuccugg

SEQ ID NO: 97165 - RNA, 21 nt, Human
aagcaggaacuucaaagggac

SEQ ID NO: 97166 - RNA, 22 nt, Human
aagcaggaagcucagguccuug

SEQ ID NO: 97167 - RNA, 22 nt, Human
aagcaggauggagguugaguua

SEQ ID NO: 97168 - RNA, 22 nt, Human
aagcaggcaucuuggaggucaa

SEQ ID NO: 97169 - RNA, 22 nt, Human
aagcaggcaugggaggccaucc

SEQ ID NO: 97170 - RNA, 22 nt, Human
aagcaggcucacgccaggcagu

SEQ ID NO: 97171 - RNA, 22 nt, Human
aagcagguaaauauguuucccu

SEQ ID NO: 97172 - RNA, 22 nt, Human
aagcagguuacauacauuaucu

SEQ ID NO: 97173 - RNA, 22 nt, Human
aagcaguaugguauuuaaguca

SEQ ID NO: 97174 - RNA, 22 nt, Human
aagcagucuuggcuggguucag

SEQ ID NO: 97175 - RNA, 22 nt, Human
aagcaguguucccagcuggccc

SEQ ID NO: 97176 - RNA, 22 nt, Human
aagcaguuuagauaggcaaagg

SEQ ID NO: 97177 - RNA, 22 nt, Human
aacuuuaaggcuauaaauuaug

SEQ ID NO: 97178 - RNA, 22 nt, Human
aacuuuagaaaggaaggaagug

SEQ ID NO: 97179 - RNA, 22 nt, Human
aagauuucugcuuuuggaggca

SEQ ID NO: 97180 - RNA, 22 nt, Human
aagauuucuuacuuauugaugc

SEQ ID NO: 97181 - RNA, 22 nt, Human
aagcaaaacgugcucuaggagg

SEQ ID NO: 97182 - RNA, 22 nt, Human
aagcaaaagguuacacuucugg

SEQ ID NO: 97183 - RNA, 22 nt, Human
aagcaucucaccugcccccacg

SEQ ID NO: 97184 - RNA, 19 nt, Human
aagcaucuuugaaacuggg

SEQ ID NO: 97185 - RNA, 22 nt, Human
aagcauggcugagugcaauggu

SEQ ID NO: 97186 - RNA, 22 nt, Human
aagcaugggaaucccacagggu

SEQ ID NO: 97187 - RNA, 22 nt, Human
aagcaugugcuggggcuuuuug

SEQ ID NO: 97188 - RNA, 22 nt, Human
aagcauuuggcaugaaacucuu

SEQ ID NO: 97189 - RNA, 22 nt, Human
aagcauuuuguuuuaagaauga

SEQ ID NO: 97190 - RNA, 22 nt, Human
aagccaacaugauuacuauaau

SEQ ID NO: 97191 - RNA, 22 nt, Human
aagccaagaguuaacuauuugu

SEQ ID NO: 97192 - RNA, 22 nt, Human
aagccaaggagaauggccucag

SEQ ID NO: 97193 - RNA, 22 nt, Human
aagccaagugcuggccaugggc

SEQ ID NO: 97194 - RNA, 22 nt, Human
aagccaaguuggaagacugaau

SEQ ID NO: 97195 - RNA, 22 nt, Human
aagccaaugagagaggccucag

SEQ ID NO: 97196 - RNA, 22 nt, Human
aagccacaaucugcaucagcau

SEQ ID NO: 97197 - RNA, 22 nt, Human
aagccacuauggugauucucaa

SEQ ID NO: 97198 - RNA, 22 nt, Human
aagccacucacaauaacugucc

SEQ ID NO: 97199 - RNA, 22 nt, Human
aagccagauuccuuaagcacag

SEQ ID NO: 97200 - RNA, 22 nt, Human
aagccagauuucacucuuaauu

SEQ ID NO: 97201 - RNA, 19 nt, Human
aagccagcugccagcucgg

SEQ ID NO: 97202 - RNA, 22 nt, Human
aagccaggccauucucugguuc

SEQ ID NO: 97203 - RNA, 22 nt, Human
aagccaguggcuucucccugcu

SEQ ID NO: 97204 - RNA, 22 nt, Human
aagccagugggcauagcaguug

SEQ ID NO: 97205 - RNA, 22 nt, Human
aagccaguggugagaagauagc

SEQ ID NO: 97206 - RNA, 16 nt, Human
aagccaguucagcauu

SEQ ID NO: 97207 - RNA, 22 nt, Human
aagccauggcugcaucagccug

SEQ ID NO: 97208 - RNA, 22 nt, Human
aagcccagaugggagcauuuca

SEQ ID NO: 97209 - RNA, 22 nt, Human
aagcccagggaauggucgggag

SEQ ID NO: 97210 - RNA, 22 nt, Human
aagcccagguaaguggcucaug

SEQ ID NO: 97211 - RNA, 22 nt, Human
aagcccgguugggaacguggug

SEQ ID NO: 97212 - RNA, 22 nt, Human
aagcccucauccccaugggcgu

SEQ ID NO: 97213 - RNA, 22 nt, Human
aagcccugacuaugaagacaua

SEQ ID NO: 97214 - RNA, 22 nt, Human
aagcccugccacccauucacug

SEQ ID NO: 97215 - RNA, 22 nt, Human
aagcccuggauuaaagaugcca

SEQ ID NO: 97216 - RNA, 22 nt, Human
aagcccuggcggguggagggcc

SEQ ID NO: 97217 - RNA, 22 nt, Human
aagcccuguuaggcacugggga

SEQ ID NO: 97218 - RNA, 22 nt, Human
aagcccuuggcagaguucccca

SEQ ID NO: 97219 - RNA, 22 nt, Human
aagccgaggccacacagcagga

SEQ ID NO: 97220 - RNA, 16 nt, Human
aagccuaaauuacaga

SEQ ID NO: 97221 - RNA, 22 nt, Human
aagccuaggccuacucugguuu

SEQ ID NO: 97222 - RNA, 22 nt, Human
aagccucaccuuuuagaagcua

SEQ ID NO: 97223 - RNA, 22 nt, Human
aagccuucaguccguugcagag

SEQ ID NO: 97224 - RNA, 22 nt, Human
aagccuugauucacucugugga

SEQ ID NO: 97225 - RNA, 22 nt, Human
aagccuugcagcauuaggcucu

SEQ ID NO: 97226 - RNA, 22 nt, Human
aagccuuggcccuucauuauaa

SEQ ID NO: 97227 - RNA, 22 nt, Human
aagcgcagacacagagagugga

SEQ ID NO: 97228 - RNA, 22 nt, Human
aagcgccacgagaagcuggacc

SEQ ID NO: 97229 - RNA, 19 nt, Human
aagcuaagaccugaagguu

SEQ ID NO: 97230 - RNA, 22 nt, Human
aagcuaaggguguuuaagcagg

SEQ ID NO: 97231 - RNA, 22 nt, Human
aagcuaauuguacuucucacag

SEQ ID NO: 97232 - RNA, 21 nt, Human
aagcuacagaaaauaauuuga

SEQ ID NO: 97233 - RNA, 22 nt, Human
aagcuacauuaagcagauuuac

SEQ ID NO: 97234 - RNA, 22 nt, Human
aagcuaggccucaguuuccuga

SEQ ID NO: 97235 - RNA, 22 nt, Human
aagcuauauuauauuuguguuu

SEQ ID NO: 97236 - RNA, 22 nt, Human
aagcuaugggggaguuucaacc

SEQ ID NO: 97237 - RNA, 22 nt, Human
aagcucagagucucggagggaa

SEQ ID NO: 97238 - RNA, 22 nt, Human
aagcucaggaaagagucugguu

SEQ ID NO: 97239 - RNA, 22 nt, Human
aagcucauuaauuagaagcuaa

SEQ ID NO: 97240 - RNA, 19 nt, Human
aagcuccagcagauccuuu

SEQ ID NO: 97241 - RNA, 22 nt, Human
aagcucugauacuuccuaccug

SEQ ID NO: 97242 - RNA, 22 nt, Human
aagcucugcucagcagacuagg

SEQ ID NO: 97243 - RNA, 20 nt, Human
aagcucugcuucaugugguc

SEQ ID NO: 97244 - RNA, 22 nt, Human
aagcucugggguacacaucugc

SEQ ID NO: 97245 - RNA, 22 nt, Human
aagcucuuaugauauuuauuua

SEQ ID NO: 97246 - RNA, 21 nt, Human
aagcucuucucagggucaccu

SEQ ID NO: 97247 - RNA, 22 nt, Human
aagcugaaacauuagccuaaac

SEQ ID NO: 97248 - RNA, 23 nt, Human
aagcugaacuuguuugcugggag

SEQ ID NO: 97249 - RNA, 22 nt, Human
aagcugaugucccaguuugaag

SEQ ID NO: 97250 - RNA, 22 nt, Human
aagcugcaaaaaauuucugucu

SEQ ID NO: 97251 - RNA, 22 nt, Human
aagcugcagacccccugucuca

SEQ ID NO: 97252 - RNA, 22 nt, Human
aagcugcagguugaauccaggu

SEQ ID NO: 97253 - RNA, 22 nt, Human
aagcugccagcugagcugaggc

SEQ ID NO: 97254 - RNA, 22 nt, Human
aagcugcccucauucccagugc

SEQ ID NO: 97255 - RNA, 22 nt, Human
aagcugcccuguguuagaguuc

SEQ ID NO: 97256 - RNA, 22 nt, Human
aagcugccuagaguugaauguc

SEQ ID NO: 97257 - RNA, 22 nt, Human
aagcugccuugcugaggagaaa

SEQ ID NO: 97258 - RNA, 22 nt, Human
aagcuggacacugacccacugu

SEQ ID NO: 97259 - RNA, 22 nt, Human
aagcuggagugcagugcaaugg

SEQ ID NO: 97260 - RNA, 22 nt, Human
aagcuggauguaggaucccccu

SEQ ID NO: 97261 - RNA, 22 nt, Human
aagcuggcaaacaagcaucauu

SEQ ID NO: 97262 - RNA, 22 nt, Human
aagcuggcaauuaucaaaacug

SEQ ID NO: 97263 - RNA, 20 nt, Human
aagcuggcaggucauagcuu

SEQ ID NO: 97264 - RNA, 22 nt, Human
aagcuggcaugucaccugagaa

SEQ ID NO: 97265 - RNA, 22 nt, Human
aagcuggccucaaacuccuagc

SEQ ID NO: 97266 - RNA, 22 nt, Human
aagcuguagaggcaguacauuu

SEQ ID NO: 97267 - RNA, 22 nt, Human
aagcuguauguuaccacuguca

SEQ ID NO: 97268 - RNA, 19 nt, Human
aagcuguccuguuggcccu

SEQ ID NO: 97269 - RNA, 22 nt, Human
aagcugugaaaucucuagugca

SEQ ID NO: 97270 - RNA, 22 nt, Human
aagcugugcaggaacugcuugc

SEQ ID NO: 97271 - RNA, 22 nt, Human
aagcuguggcuuggaggaaaca

SEQ ID NO: 97272 - RNA, 22 nt, Human
aagcuguguauuacagaauauu

SEQ ID NO: 97273 - RNA, 22 nt, Human
aagcuguuaauggcuugcagcu

SEQ ID NO: 97274 - RNA, 22 nt, Human
aagcuguuagggagugguaggu

SEQ ID NO: 97275 - RNA, 22 nt, Human
aagcuguuaucuucuggcggac

SEQ ID NO: 97276 - RNA, 22 nt, Human
aagcuguucucuaaguuucaug

SEQ ID NO: 97277 - RNA, 22 nt, Human
aagcuguuugcaguggauggag

SEQ ID NO: 97278 - RNA, 22 nt, Human
aagcuucaggcccacccauguc

SEQ ID NO: 97279 - RNA, 22 nt, Human
aagcuucaguggacuguagugu

SEQ ID NO: 97280 - RNA, 22 nt, Human
aagcuucagugugagcauguaa

SEQ ID NO: 97281 - RNA, 22 nt, Human
aagcuucauauaugugugaguc

SEQ ID NO: 97282 - RNA, 21 nt, Human
aagcuuccaaacugcuggacu

SEQ ID NO: 97283 - RNA, 21 nt, Human
aagcuucccugcucuccaggg

SEQ ID NO: 97284 - RNA, 23 nt, Human
aagcuuccuucacgucuccuggg

SEQ ID NO: 97285 - RNA, 22 nt, Human
aagcuuuaagugucagucagcc

SEQ ID NO: 97286 - RNA, 22 nt, Human
aagcuuuaugacuuggagacag

SEQ ID NO: 97287 - RNA, 19 nt, Human
aagcuuucccauuaacccc

SEQ ID NO: 97288 - RNA, 22 nt, Human
aggaaugucaaguagaugugcg

SEQ ID NO: 97289 - RNA, 22 nt, Human
aggaaugugaaacagguggcug

SEQ ID NO: 97290 - RNA, 22 nt, Human
aggaauguggcaaucuucaagu

SEQ ID NO: 97291 - RNA, 16 nt, Human
aggaauguggcggaac

SEQ ID NO: 97292 - RNA, 22 nt, Human
aggaauuaacaauauauuuagg

SEQ ID NO: 97293 - RNA, 22 nt, Human
aggaauuacucaucugugguau

SEQ ID NO: 97294 - RNA, 22 nt, Human
aggaauuauuugucuuagucuu

SEQ ID NO: 97295 - RNA, 22 nt, Human
aggaauucaagaccagcugggc

SEQ ID NO: 97296 - RNA, 22 nt, Human
aggaauuuagacagggcauaaa

SEQ ID NO: 97297 - RNA, 22 nt, Human
aggaauuuggaauuuuuccugu

SEQ ID NO: 97298 - RNA, 22 nt, Human
aggaauuugggguuacaugaug

SEQ ID NO: 97299 - RNA, 22 nt, Human
aggaauuuucacaguuggguau

SEQ ID NO: 97300 - RNA, 22 nt, Human
aggaauuuuguauggauacugu

SEQ ID NO: 97301 - RNA, 22 nt, Human
aggacaagcuaaaggacuuccu

SEQ ID NO: 97302 - RNA, 22 nt, Human
aggacacacaaagagugagaac

SEQ ID NO: 97303 - RNA, 22 nt, Human
aggacacacccagcucacgggg

SEQ ID NO: 97304 - RNA, 22 nt, Human
aggacacacugcaagagccugg

SEQ ID NO: 97305 - RNA, 22 nt, Human
aggacacagacugauugcagca

SEQ ID NO: 97306 - RNA, 22 nt, Human
aggacacagacuuagauuuaaa

SEQ ID NO: 97307 - RNA, 22 nt, Human
aggacacagugguggggaaaag

SEQ ID NO: 97308 - RNA, 22 nt, Human
aggacacuugagaguccaguca

SEQ ID NO: 97309 - RNA, 22 nt, Human
aggacagaccuaggacuggagc

SEQ ID NO: 97310 - RNA, 21 nt, Human
aggacagauguaggaauaaag

SEQ ID NO: 97311 - RNA, 22 nt, Human
aggacagcauuuucagcaucuc

SEQ ID NO: 97312 - RNA, 22 nt, Human
aggacaguauaggcuuuaggag

SEQ ID NO: 97313 - RNA, 23 nt, Human
aggacaguggaauuuagggauug

SEQ ID NO: 97314 - RNA, 22 nt, Human
aggacagugguguucuggagug

SEQ ID NO: 97315 - RNA, 22 nt, Human
aggacaguguggaagagggugc

SEQ ID NO: 97316 - RNA, 22 nt, Human
aggacaugaagaaagggcaagg

SEQ ID NO: 97317 - RNA, 22 nt, Human
aggacauguaaauggagaggga

SEQ ID NO: 97318 - RNA, 22 nt, Human
aggacaugugccuccagggcag

SEQ ID NO: 97319 - RNA, 22 nt, Human
aggaccaacauagcagcagugg

SEQ ID NO: 97320 - RNA, 22 nt, Human
aggaccaccgguccauccaccc

SEQ ID NO: 97321 - RNA, 22 nt, Human
aggaccagccuccaggucucuu

SEQ ID NO: 97322 - RNA, 23 nt, Human
aggaccagguucccaaaagucaa

SEQ ID NO: 97323 - RNA, 22 nt, Human
aggaccaguaugagagcaucug

SEQ ID NO: 97324 - RNA, 22 nt, Human
aggacccagaaggugcagcaga

SEQ ID NO: 97325 - RNA, 22 nt, Human
aggacccugagcgggcaugccg

SEQ ID NO: 97326 - RNA, 22 nt, Human
aggacccugcucaagcaucucc

SEQ ID NO: 97327 - RNA, 22 nt, Human
aggaccuacugauaucuuagca

SEQ ID NO: 97328 - RNA, 21 nt, Human
aggaccuagaaaagugccuag

SEQ ID NO: 97329 - RNA, 22 nt, Human
aggaccugaaauucuugcuuuu

SEQ ID NO: 97330 - RNA, 22 nt, Human
aggaccugacuggcuccugcuu

SEQ ID NO: 97331 - RNA, 22 nt, Human
aggaccugcuaaugugccaagu

SEQ ID NO: 97332 - RNA, 22 nt, Human
aggaccuguagggccugcaucc

SEQ ID NO: 97333 - RNA, 22 nt, Human
aggacggggacgcaagucagca

SEQ ID NO: 97334 - RNA, 22 nt, Human
aggacucacauagcuucagaug

SEQ ID NO: 97335 - RNA, 19 nt, Human
aggacucuggaggcaugag

SEQ ID NO: 97336 - RNA, 22 nt, Human
aggacuggugccagacaaggua

SEQ ID NO: 97337 - RNA, 22 nt, Human
aggacuucuaagcuaagaaguu

SEQ ID NO: 97338 - RNA, 19 nt, Human
aggacuucugaacccgucc

SEQ ID NO: 97339 - RNA, 20 nt, Human
aggacuuguuugggcagagu

SEQ ID NO: 97340 - RNA, 22 nt, Human
aggacuuuaacauauuaacugu

SEQ ID NO: 97341 - RNA, 22 nt, Human
aggagaaaacaguguuuugccu

SEQ ID NO: 97342 - RNA, 20 nt, Human
aggagaaauucgggacaccu

SEQ ID NO: 97343 - RNA, 23 nt, Human
aggagaagagauuuccacaugca

SEQ ID NO: 97344 - RNA, 22 nt, Human
aggagaaguaaggcuagaugau

SEQ ID NO: 97345 - RNA, 22 nt, Human
aggagacacugagacuucacca

SEQ ID NO: 97346 - RNA, 18 nt, Human
aggagacagccucaccug

SEQ ID NO: 97347 - RNA, 22 nt, Human
aggagacauaacuaugaugaga

SEQ ID NO: 97348 - RNA, 22 nt, Human
aggagacauggaauagugaggc

SEQ ID NO: 97349 - RNA, 22 nt, Human
aggagagagcugagcuuugcug

SEQ ID NO: 97350 - RNA, 22 nt, Human
aggagaggcucuaacucugugu

SEQ ID NO: 97351 - RNA, 22 nt, Human
aggagaucagccucccugcaac

SEQ ID NO: 97352 - RNA, 22 nt, Human
aggagauuguacugucaucacu

SEQ ID NO: 97353 - RNA, 22 nt, Human
aggagccaaaagcugaacaaga

SEQ ID NO: 97354 - RNA, 22 nt, Human
aggagccaaauuuuagacucug

SEQ ID NO: 97355 - RNA, 22 nt, Human
aggagccagaauccagacucgg

SEQ ID NO: 97356 - RNA, 22 nt, Human
aggagccaggccccauggggcu

SEQ ID NO: 97357 - RNA, 22 nt, Human
aggagccaguuccaccccagga

SEQ ID NO: 97358 - RNA, 23 nt, Human
aggagcccaaggagagguaacuu

SEQ ID NO: 97359 - RNA, 22 nt, Human
aggagccuccauggucacauuc

SEQ ID NO: 97360 - RNA, 22 nt, Human
aggagccuccuucucaugugca

SEQ ID NO: 97361 - RNA, 22 nt, Human
aggagccugaaucagaggguga

SEQ ID NO: 97362 - RNA, 22 nt, Human
aggagcucauguggcugccugu

SEQ ID NO: 97363 - RNA, 22 nt, Human
aggagcucugggcagggccucc

SEQ ID NO: 97364 - RNA, 22 nt, Human
aggagcugaugauucuuugauc

SEQ ID NO: 97365 - RNA, 22 nt, Human
aggagcugcagauucugccuug

SEQ ID NO: 97366 - RNA, 22 nt, Human
aggagcugcauggauaccuggu

SEQ ID NO: 97367 - RNA, 22 nt, Human
aggagcugggagaaggacuaaa

SEQ ID NO: 97368 - RNA, 17 nt, Human
aggagcuggggguggug

SEQ ID NO: 97369 - RNA, 22 nt, Human
aggagcugguagucucauuggg

SEQ ID NO: 97370 - RNA, 22 nt, Human
aggagcugucauuugauucaca

SEQ ID NO: 97371 - RNA, 22 nt, Human
aggagcugugaaugggaggggu

SEQ ID NO: 97372 - RNA, 21 nt, Human
aggagcugugugcuuccuuuc

SEQ ID NO: 97373 - RNA, 22 nt, Human
aggaggaaagaaggcccccagc

SEQ ID NO: 97374 - RNA, 21 nt, Human
aggaggaacccguggcugggc

SEQ ID NO: 97375 - RNA, 22 nt, Human
aggaggaacucagaaagaaggu

SEQ ID NO: 97376 - RNA, 22 nt, Human
aggaggaggugggacacaguga

SEQ ID NO: 97377 - RNA, 22 nt, Human
aggaggcagucugucccuuagc

SEQ ID NO: 97378 - RNA, 19 nt, Human
aggaggccaugccacuaga

SEQ ID NO: 97379 - RNA, 22 nt, Human
aggaggccuggcuggggagauc

SEQ ID NO: 97380 - RNA, 22 nt, Human
aggaggcugggcacaguggccu

SEQ ID NO: 97381 - RNA, 22 nt, Human
aggagggagcacuauaugggga

SEQ ID NO: 97382 - RNA, 16 nt, Human
aggaggggaauuagga

SEQ ID NO: 97383 - RNA, 20 nt, Human
aggaggggauagaaucaaag

SEQ ID NO: 97384 - RNA, 21 nt, Human
aggaggggucuuucccacuga

SEQ ID NO: 97385 - RNA, 22 nt, Human
aggagggucauguugaagugua

SEQ ID NO: 97386 - RNA, 22 nt, Human
aggagguggcaacugucgacag

SEQ ID NO: 97387 - RNA, 22 nt, Human
aggagguggccugagcgugccc

SEQ ID NO: 97388 - RNA, 22 nt, Human
aggagguguagauuuccuguca

SEQ ID NO: 97389 - RNA, 22 nt, Human
aggagucagauaugggaaaguu

SEQ ID NO: 97390 - RNA, 22 nt, Human
aggagucauugagagggguccu

SEQ ID NO: 97391 - RNA, 22 nt, Human
aggauaaguuugauucuugcca

SEQ ID NO: 97392 - RNA, 22 nt, Human
aggauacaagucucagaaugcu

SEQ ID NO: 97393 - RNA, 22 nt, Human
aggauacacggggauuuaugua

SEQ ID NO: 97394 - RNA, 21 nt, Human
aggauauuaggugauuugggu

SEQ ID NO: 97395 - RNA, 22 nt, Human
aggauauuugcuuaagauagcu

SEQ ID NO: 97396 - RNA, 22 nt, Human
aggaucaaaugaaauauuuuga

SEQ ID NO: 97397 - RNA, 20 nt, Human
aggcucugccugcaggccca

SEQ ID NO: 97398 - RNA, 22 nt, Human
aggcucugcuuuucuggauaua

SEQ ID NO: 97399 - RNA, 22 nt, Human
aggcucuggaguguggugcugg

SEQ ID NO: 97400 - RNA, 22 nt, Human
aggcucugguuggcaaguaaag

SEQ ID NO: 97401 - RNA, 22 nt, Human
aggcucugugacaaucaagcug

SEQ ID NO: 97402 - RNA, 22 nt, Human
aggcucuguuauucuagagggc

SEQ ID NO: 97403 - RNA, 22 nt, Human
auagacaugcaacacuuuuuac

SEQ ID NO: 97404 - RNA, 22 nt, Human
auagagauggguuuaguuauaa

SEQ ID NO: 97405 - RNA, 19 nt, Human
auagaguagaguaucuguu

SEQ ID NO: 97406 - RNA, 22 nt, Human
auagauauuugaguuguuucca

SEQ ID NO: 97407 - RNA, 22 nt, Human
auagaucauguuaaaagcucca

SEQ ID NO: 97408 - RNA, 22 nt, Human
auagaucauuugcauuggucgu

SEQ ID NO: 97409 - RNA, 20 nt, Human
auagauccugguucuuugca

SEQ ID NO: 97410 - RNA, 22 nt, Human
auagaugguauuuagacuagcg

SEQ ID NO: 97411 - RNA, 22 nt, Human
auagauguucaaucagauauuu

SEQ ID NO: 97412 - RNA, 22 nt, Human
auagauuauuugcucauuacuu

SEQ ID NO: 97413 - RNA, 22 nt, Human
auagauucauucuauuucuccg

SEQ ID NO: 97414 - RNA, 22 nt, Human
auagcaaaacccacugcauuac

SEQ ID NO: 97415 - RNA, 22 nt, Human
auagcaaaagcaugugcaauac

SEQ ID NO: 97416 - RNA, 22 nt, Human
auagcaaagaucacuuccuuga

SEQ ID NO: 97417 - RNA, 22 nt, Human
auagcaaaggacaauagucagu

SEQ ID NO: 97418 - RNA, 22 nt, Human
auagcaacaccccaauuuucua

SEQ ID NO: 97419 - RNA, 22 nt, Human
auagcaaucaguguauuugaaa

SEQ ID NO: 97420 - RNA, 22 nt, Human
auagcaaugaucaagacagaca

SEQ ID NO: 97421 - RNA, 22 nt, Human
auagcacaauauuaccuuuaug

SEQ ID NO: 97422 - RNA, 22 nt, Human
auagcagaaaccaagcuucuuc

SEQ ID NO: 97423 - RNA, 22 nt, Human
auagcaguggauguggagaaag

SEQ ID NO: 97424 - RNA, 22 nt, Human
auagcauuuacuuuucagaaau

SEQ ID NO: 97425 - RNA, 22 nt, Human
auagccaggucacagagcuagc

SEQ ID NO: 97426 - RNA, 22 nt, Human
auagcuguagaauguauacaca

SEQ ID NO: 97427 - RNA, 22 nt, Human
auagcuuuuugucauagagucu

SEQ ID NO: 97428 - RNA, 22 nt, Human
auaggaaagaaaauuauguagg

SEQ ID NO: 97429 - RNA, 22 nt, Human
auaggacugagauugucaguuu

SEQ ID NO: 97430 - RNA, 22 nt, Human
auaggacuuuguaucaggauga

SEQ ID NO: 97431 - RNA, 22 nt, Human
auaggagacuguucuuggcuuc

SEQ ID NO: 97432 - RNA, 22 nt, Human
auaggcauaacacugauguccu

SEQ ID NO: 97433 - RNA, 22 nt, Human
auaggcguguuuaggaggacgu

SEQ ID NO: 97434 - RNA, 19 nt, Human
auagggcacccuaaggagu

SEQ ID NO: 97435 - RNA, 22 nt, Human
auagggcaguggcaucucuuaa

SEQ ID NO: 97436 - RNA, 22 nt, Human
auagggcccccgugggugcuca

SEQ ID NO: 97437 - RNA, 22 nt, Human
auaguacaaucaguuaauuagu

SEQ ID NO: 97438 - RNA, 22 nt, Human
auaguacagagggcuacugguu

SEQ ID NO: 97439 - RNA, 22 nt, Human
auaguacagauccauuaauuau

SEQ ID NO: 97440 - RNA, 22 nt, Human
auaguaugaauuaaaucaugag

SEQ ID NO: 97441 - RNA, 22 nt, Human
auagucuuagucuauaguuuug

SEQ ID NO: 97442 - RNA, 19 nt, Human
auagucuuuccaauuauac

SEQ ID NO: 97443 - RNA, 22 nt, Human
auagugcaguggacugaguuaa

SEQ ID NO: 97444 - RNA, 22 nt, Human
auaguguuacccuucuuaaagu

SEQ ID NO: 97445 - RNA, 22 nt, Human
auaguguugauagcaguggagu

SEQ ID NO: 97446 - RNA, 22 nt, Human
auaguucuagaccuauaguucu

SEQ ID NO: 97447 - RNA, 22 nt, Human
auaguugagaucagauucaacu

SEQ ID NO: 97448 - RNA, 22 nt, Human
auaguuuaccuuccagauggcu

SEQ ID NO: 97449 - RNA, 23 nt, Human
auauaaacaccagauagauugua

SEQ ID NO: 97450 - RNA, 22 nt, Human
auauacaaagggcaaccucgcu

SEQ ID NO: 97451 - RNA, 22 nt, Human
auauacaguuuuacaggguuuc

SEQ ID NO: 97452 - RNA, 22 nt, Human
auauaccucauucuuugagugc

SEQ ID NO: 97453 - RNA, 22 nt, Human
auauacugauagcugcacuucu

SEQ ID NO: 97454 - RNA, 22 nt, Human
auauacuugauuuaacugagca

SEQ ID NO: 97455 - RNA, 22 nt, Human
auauacuuuucacuaauggcua

SEQ ID NO: 97456 - RNA, 20 nt, Human
auauagagucaaaauggcuu

SEQ ID NO: 97457 - RNA, 22 nt, Human
auauagcacuuguuuugcaugu

SEQ ID NO: 97458 - RNA, 22 nt, Human
auauaggcuaacaacuauugag

SEQ ID NO: 97459 - RNA, 19 nt, Human
auauaggcugaaccaugcu

SEQ ID NO: 97460 - RNA, 22 nt, Human
auauaguauguccuccagaauu

SEQ ID NO: 97461 - RNA, 22 nt, Human
auauagugaaagugaugugugg

SEQ ID NO: 97462 - RNA, 22 nt, Human
auauauaauacuugcugugggc

SEQ ID NO: 97463 - RNA, 22 nt, Human
auauauacaacuagauuaaaag

SEQ ID NO: 97464 - RNA, 22 nt, Human
auauauauugcccaggcugguu

SEQ ID NO: 97465 - RNA, 22 nt, Human
auauaucaugaguaaaacuuga

SEQ ID NO: 97466 - RNA, 18 nt, Human
auauauugacaagaggga

SEQ ID NO: 97467 - RNA, 22 nt, Human
auauauuuacucuccuguugca

SEQ ID NO: 97468 - RNA, 22 nt, Human
auauauuugagaauauucauga

SEQ ID NO: 97469 - RNA, 22 nt, Human
auaucaaaauaaacagcaugca

SEQ ID NO: 97470 - RNA, 22 nt, Human
auaucacaaacaagucuguacu

SEQ ID NO: 97471 - RNA, 22 nt, Human
auaucacagcucuuucauugcu

SEQ ID NO: 97472 - RNA, 22 nt, Human
auaucauaaaucggugcaugaa

SEQ ID NO: 97473 - RNA, 18 nt, Human
auauccaauaaugaacac

SEQ ID NO: 97474 - RNA, 22 nt, Human
auauccauaguaaaagucauua

SEQ ID NO: 97475 - RNA, 19 nt, Human
auauccuugagaaagggaa

SEQ ID NO: 97476 - RNA, 22 nt, Human
auauccuugagacguggcuacu

SEQ ID NO: 97477 - RNA, 22 nt, Human
auauccuuuguguaggcaauuu

SEQ ID NO: 97478 - RNA, 22 nt, Human
auaucuaccuagcuuaggcuga

SEQ ID NO: 97479 - RNA, 22 nt, Human
auaucucauuaccuugcuguuc

SEQ ID NO: 97480 - RNA, 22 nt, Human
auaucuggggacugaauuuaga

SEQ ID NO: 97481 - RNA, 22 nt, Human
auaucugguugguaauauaaca

SEQ ID NO: 97482 - RNA, 22 nt, Human
auaucuuucaaagccaaaagua

SEQ ID NO: 97483 - RNA, 22 nt, Human
auaucuuuguuuuugccaagau

SEQ ID NO: 97484 - RNA, 22 nt, Human
auaugaagaauuccaauuugga

SEQ ID NO: 97485 - RNA, 22 nt, Human
auaugaagucagacaaacuggg

SEQ ID NO: 97486 - RNA, 21 nt, Human
auaugaguuucagauguugcu

SEQ ID NO: 97487 - RNA, 22 nt, Human
auaugcagagagcaugaauagg

SEQ ID NO: 97488 - RNA, 22 nt, Human
auaugcauauaaagcuuuuagu

SEQ ID NO: 97489 - RNA, 22 nt, Human
auaugcauaugucaaaacuuau

SEQ ID NO: 97490 - RNA, 22 nt, Human
auaugcauguacgugugcacaa

SEQ ID NO: 97491 - RNA, 20 nt, Human
auaugcugagugaaggcaga

SEQ ID NO: 97492 - RNA, 22 nt, Human
auaugcuuacacuacaagauga

SEQ ID NO: 97493 - RNA, 22 nt, Human
auaugcuuacagcuuaaaaucc

SEQ ID NO: 97494 - RNA, 22 nt, Human
auaugcuugggacugauacagu

SEQ ID NO: 97495 - RNA, 22 nt, Human
auauggagaacucaaaaaguga

SEQ ID NO: 97496 - RNA, 22 nt, Human
auauggcagaccaauuagaagc

SEQ ID NO: 97497 - RNA, 22 nt, Human
auauggcauuacauuguuaaau

SEQ ID NO: 97498 - RNA, 22 nt, Human
auauggcuguugguagccaaca

SEQ ID NO: 97499 - RNA, 22 nt, Human
auaugggucaugugauguucaa

SEQ ID NO: 97500 - RNA, 22 nt, Human
auauguauguguuuucuuugga

SEQ ID NO: 97501 - RNA, 22 nt, Human
auauguauuuuaacguguaagg

SEQ ID NO: 97502 - RNA, 23 nt, Human
auaugucaugcaccagcacuuua

SEQ ID NO: 97503 - RNA, 22 nt, Human
auauguguauggauuucuaucu

SEQ ID NO: 97504 - RNA, 22 nt, Human
auaugugugccauuucagcagu

SEQ ID NO: 97505 - RNA, 22 nt, Human
auaugugugugugagaaaagcu

SEQ ID NO: 97506 - RNA, 22 nt, Human
aguaggcauuuaauaaacauga

SEQ ID NO: 97507 - RNA, 22 nt, Human
aguagggagaccggaggccgcc

SEQ ID NO: 97508 - RNA, 22 nt, Human
aguagugaacagccacaggauu

SEQ ID NO: 97509 - RNA, 22 nt, Human
aguaguuuuuaagagguauaaa

SEQ ID NO: 97510 - RNA, 22 nt, Human
aguauacauagagauggcuguu

SEQ ID NO: 97511 - RNA, 22 nt, Human
aguauacauagugcuuccucuu

SEQ ID NO: 97512 - RNA, 22 nt, Human
aguauacauauauuagccuucg

SEQ ID NO: 97513 - RNA, 19 nt, Human
aguauagaguauugaggag

SEQ ID NO: 97514 - RNA, 22 nt, Human
aguauaucugcuucuggguccc

SEQ ID NO: 97515 - RNA, 22 nt, Human
aguauaugugcacauaugcaug

SEQ ID NO: 97516 - RNA, 22 nt, Human
aguaucaaggaucuccagcacc

SEQ ID NO: 97517 - RNA, 22 nt, Human
aguaucugcaugauuuugagaa

SEQ ID NO: 97518 - RNA, 22 nt, Human
aguaucuuuacuuaaauaguca

SEQ ID NO: 97519 - RNA, 22 nt, Human
aguaugaagaugaugaaaaaua

SEQ ID NO: 97520 - RNA, 22 nt, Human
aguaugaaucucuuuauucugc

SEQ ID NO: 97521 - RNA, 22 nt, Human
aguaugaauggaaacuaccuau

SEQ ID NO: 97522 - RNA, 22 nt, Human
aguaugcaaaugucauaagcau

SEQ ID NO: 97523 - RNA, 22 nt, Human
aguauggggcugugugugcaca

SEQ ID NO: 97524 - RNA, 22 nt, Human
aguauguagugcaaucagucag

SEQ ID NO: 97525 - RNA, 19 nt, Human
aguaugucuaugagucuuu

SEQ ID NO: 97526 - RNA, 22 nt, Human
aguauguugaguuuugcuuuag

SEQ ID NO: 97527 - RNA, 22 nt, Human
aguauucagcaaacgugaacag

SEQ ID NO: 97528 - RNA, 22 nt, Human
aguauucugguuuuucaggugg

SEQ ID NO: 97529 - RNA, 22 nt, Human
aguauuuccuggcuuaucugcu

SEQ ID NO: 97530 - RNA, 22 nt, Human
aguauuucuaguugguucuacu

SEQ ID NO: 97531 - RNA, 22 nt, Human
aguauuucugaauauuaucaua

SEQ ID NO: 97532 - RNA, 22 nt, Human
aguauuucugcucaugaaagag

SEQ ID NO: 97533 - RNA, 21 nt, Human
aguauuucuucauguccuugc

SEQ ID NO: 97534 - RNA, 22 nt, Human
aguauuugauacagucuucuag

SEQ ID NO: 97535 - RNA, 22 nt, Human
aguauuugcauguuagggaccu

SEQ ID NO: 97536 - RNA, 22 nt, Human
aguauuuggccucuacagucuc

SEQ ID NO: 97537 - RNA, 22 nt, Human
aguauuuguugauugauaugaa

SEQ ID NO: 97538 - RNA, 22 nt, Human
aguauuuucaaccauagccugg

SEQ ID NO: 97539 - RNA, 22 nt, Human
aguauuuucgccaucacaagaa

SEQ ID NO: 97540 - RNA, 22 nt, Human
agucaaaacauguacuuuccuu

SEQ ID NO: 97541 - RNA, 22 nt, Human
agucaaagaagaugguuccaaa

SEQ ID NO: 97542 - RNA, 22 nt, Human
agucaaagcuacaggcauuuga

SEQ ID NO: 97543 - RNA, 22 nt, Human
agucaaaggguauuuggauuga

SEQ ID NO: 97544 - RNA, 22 nt, Human
agucaaauaagacugucauaag

SEQ ID NO: 97545 - RNA, 22 nt, Human
agucaacaccugguucuauuac

SEQ ID NO: 97546 - RNA, 22 nt, Human
agucaacagaguggccgcagcg

SEQ ID NO: 97547 - RNA, 22 nt, Human
agucaacagcauuauggaugaa

SEQ ID NO: 97548 - RNA, 22 nt, Human
agucaacugcauuaggaaauga

SEQ ID NO: 97549 - RNA, 22 nt, Human
agucaagguggaccagaaaaau

SEQ ID NO: 97550 - RNA, 22 nt, Human
agucaauaaaagcuuuagauuc

SEQ ID NO: 97551 - RNA, 22 nt, Human
agucaauauucaaguguaaaua

SEQ ID NO: 97552 - RNA, 22 nt, Human
agucacacacugucaguucugc

SEQ ID NO: 97553 - RNA, 22 nt, Human
agucacacuucguaucucuagc

SEQ ID NO: 97554 - RNA, 19 nt, Human
agucacagaccuugucucc

SEQ ID NO: 97555 - RNA, 22 nt, Human
auggggaagcaauuggauuucc

SEQ ID NO: 97556 - RNA, 22 nt, Human
auggggagcucaccaccuguuu

SEQ ID NO: 97557 - RNA, 22 nt, Human
auggggcugggauucuccucgg

SEQ ID NO: 97558 - RNA, 22 nt, Human
auggggugaccaugagcauuua

SEQ ID NO: 97559 - RNA, 22 nt, Human
auggggugagacuaggauuaaa

SEQ ID NO: 97560 - RNA, 22 nt, Human
augggguggaguccgggcagcg

SEQ ID NO: 97561 - RNA, 22 nt, Human
augggucccuggccgcccucgg

SEQ ID NO: 97562 - RNA, 22 nt, Human
auggguggaggagaaaggcauc

SEQ ID NO: 97563 - RNA, 22 nt, Human
auggguggccccgugugcaguc

SEQ ID NO: 97564 - RNA, 22 nt, Human
augguaacaguugaguagaaac

SEQ ID NO: 97565 - RNA, 22 nt, Human
augguaaccagaagacuaugac

SEQ ID NO: 97566 - RNA, 22 nt, Human
augguaaugauuuauguaaauu

SEQ ID NO: 97567 - RNA, 22 nt, Human
augguacagauaauacaugcug

SEQ ID NO: 97568 - RNA, 22 nt, Human
augguagguacaacagcaggca

SEQ ID NO: 97569 - RNA, 22 nt, Human
augguauacaauuauggacugu

SEQ ID NO: 97570 - RNA, 22 nt, Human
augguauagagccacauguauu

SEQ ID NO: 97571 - RNA, 22 nt, Human
augguauucucagcaccuagca

SEQ ID NO: 97572 - RNA, 22 nt, Human
auggucaaagauaaagugaucu

SEQ ID NO: 97573 - RNA, 23 nt, Human
auggucagaauuuuccagcugag

SEQ ID NO: 97574 - RNA, 22 nt, Human
augguccuuauggccgugauau

SEQ ID NO: 97575 - RNA, 17 nt, Human
auggucucacugagcaa

SEQ ID NO: 97576 - RNA, 22 nt, Human
auggucuugauuuuccauaggu

SEQ ID NO: 97577 - RNA, 22 nt, Human
auggucuuuuuguuaugagaga

SEQ ID NO: 97578 - RNA, 22 nt, Human
augguggaagagcaucagaaag

SEQ ID NO: 97579 - RNA, 22 nt, Human
augguggacucuugauucaggc

SEQ ID NO: 97580 - RNA, 22 nt, Human
auggugguuugggagaaaaagc

SEQ ID NO: 97581 - RNA, 22 nt, Human
augguguagcugucagucauaa

SEQ ID NO: 97582 - RNA, 22 nt, Human
augguguccccagccuuugaag

SEQ ID NO: 97583 - RNA, 22 nt, Human
augguugaaucaagguagacaa

SEQ ID NO: 97584 - RNA, 22 nt, Human
augguugagaagguaagguacc

SEQ ID NO: 97585 - RNA, 22 nt, Human
augguuuacagaacuccuagca

SEQ ID NO: 97586 - RNA, 22 nt, Human
augguuuacugaucuuuuuggu

SEQ ID NO: 97587 - RNA, 22 nt, Human
augguuuacuucauccaaucua

SEQ ID NO: 97588 - RNA, 22 nt, Human
augguuuauaaucuagguguga

SEQ ID NO: 97589 - RNA, 22 nt, Human
augguuuauccuuuaccagucg

SEQ ID NO: 97590 - RNA, 23 nt, Human
augguuuauguuguugugaagca

SEQ ID NO: 97591 - RNA, 22 nt, Human
auguaaaagauuauuuuccugu

SEQ ID NO: 97592 - RNA, 22 nt, Human
auguaaacuuagauaagcagua

SEQ ID NO: 97593 - RNA, 22 nt, Human
auguaaacuuuaccagcucuga

SEQ ID NO: 97594 - RNA, 22 nt, Human
auguaaaggcagacuuuaauuu

SEQ ID NO: 97595 - RNA, 22 nt, Human
auguaacauugaauuauauagu

SEQ ID NO: 97596 - RNA, 22 nt, Human
auguaaggcugccuaugacacu

SEQ ID NO: 97597 - RNA, 22 nt, Human
auguaaguuuaagcacaacaag

SEQ ID NO: 97598 - RNA, 22 nt, Human
auguaauuguagcaaaaugaug

SEQ ID NO: 97599 - RNA, 22 nt, Human
auguacaaccugcaugacaguc

SEQ ID NO: 97600 - RNA, 22 nt, Human
auguacacaugcaugcaugugc

SEQ ID NO: 97601 - RNA, 22 nt, Human
auguacaggauggugcucaucu

SEQ ID NO: 97602 - RNA, 22 nt, Human
auguacagugauaagagggcag

SEQ ID NO: 97603 - RNA, 18 nt, Human
auguacauguacucacac

SEQ ID NO: 97604 - RNA, 22 nt, Human
auguacauucuucucaccgaag

SEQ ID NO: 97605 - RNA, 22 nt, Human
auguacugacuguacuuuuaaa

SEQ ID NO: 97606 - RNA, 22 nt, Human
auguagaaauaauuucaguucc

SEQ ID NO: 97607 - RNA, 22 nt, Human
auguagaaauuaggaugauagu

SEQ ID NO: 97608 - RNA, 22 nt, Human
auguagaccuuucuuugugauu

SEQ ID NO: 97609 - RNA, 20 nt, Human
auguagaugaaagcaaaggc

SEQ ID NO: 97610 - RNA, 22 nt, Human
auguagauuugcuucuccugcc

SEQ ID NO: 97611 - RNA, 22 nt, Human
auguagcaugaggcacugugcc

SEQ ID NO: 97612 - RNA, 22 nt, Human
auguagcuugucccacaucaua

SEQ ID NO: 97613 - RNA, 22 nt, Human
auguagugcccuuugucaucua

SEQ ID NO: 97614 - RNA, 22 nt, Human
auguaguugaagugcuauaaag

SEQ ID NO: 97615 - RNA, 21 nt, Human
aguccaggagucacccaagcc

SEQ ID NO: 97616 - RNA, 22 nt, Human
aguccaggccuccucuuuuccu

SEQ ID NO: 97617 - RNA, 22 nt, Human
aguccagggagcccaggcuuug

SEQ ID NO: 97618 - RNA, 22 nt, Human
aguccagggcuuagucagcggg

SEQ ID NO: 97619 - RNA, 22 nt, Human
aguccagguggaccuuggccag

SEQ ID NO: 97620 - RNA, 22 nt, Human
aguccaguguguucuggcagca

SEQ ID NO: 97621 - RNA, 22 nt, Human
aguccauacauugagaauaaca

SEQ ID NO: 97622 - RNA, 19 nt, Human
aguccaugaauggaggaug

SEQ ID NO: 97623 - RNA, 18 nt, Human
aguccaugcauggcuaua

SEQ ID NO: 97624 - RNA, 22 nt, Human
aguccauuaacuguguuaacag

SEQ ID NO: 97625 - RNA, 22 nt, Human
agucccaacagcuuacaaggaa

SEQ ID NO: 97626 - RNA, 22 nt, Human
agucccagagaggucggggcca

SEQ ID NO: 97627 - RNA, 22 nt, Human
agucccagcuacucaagaggcu

SEQ ID NO: 97628 - RNA, 22 nt, Human
agucccagcucugccacuuacu

SEQ ID NO: 97629 - RNA, 22 nt, Human
agucccagugacuuggccagaa

SEQ ID NO: 97630 - RNA, 22 nt, Human
agucccagugagaugagccacg

SEQ ID NO: 97631 - RNA, 23 nt, Human
aguccccuacauaguuccugggg

SEQ ID NO: 97632 - RNA, 22 nt, Human
aguccccucucgcuuggcugag

SEQ ID NO: 97633 - RNA, 22 nt, Human
agucccuguacuuuccacugcc

SEQ ID NO: 97634 - RNA, 22 nt, Human
agucccuucucaaagugugcgg

SEQ ID NO: 97635 - RNA, 22 nt, Human
aguccggggucuggacaccugg

SEQ ID NO: 97636 - RNA, 22 nt, Human
aguccuggguucugguguuuug

SEQ ID NO: 97637 - RNA, 22 nt, Human
aguccugucucucccagggcca

SEQ ID NO: 97638 - RNA, 22 nt, Human
aguccugugaggggugcagcuu

SEQ ID NO: 97639 - RNA, 22 nt, Human
aguccuuacaccuggaaccuau

SEQ ID NO: 97640 - RNA, 18 nt, Human
aguccuuacgaggcuaua

SEQ ID NO: 97641 - RNA, 22 nt, Human
aguccuuacucgggggcccaga

SEQ ID NO: 97642 - RNA, 22 nt, Human
aguccuuagaacagugccuggg

SEQ ID NO: 97643 - RNA, 22 nt, Human
aguccuucccaucugacacccu

SEQ ID NO: 97644 - RNA, 18 nt, Human
aguccuucuugguuuuac

SEQ ID NO: 97645 - RNA, 21 nt, Human
aguccuugaaacucuuucuug

SEQ ID NO: 97646 - RNA, 22 nt, Human
aguccuuugcugaacugucaca

SEQ ID NO: 97647 - RNA, 22 nt, Human
aguccuuuuguuuugagaugag

SEQ ID NO: 97648 - RNA, 22 nt, Human
agucuacaaagggaagcccuuu

SEQ ID NO: 97649 - RNA, 21 nt, Human
agucuacaacuagggaagcug

SEQ ID NO: 97650 - RNA, 22 nt, Human
agucuacaguucccucaggucc

SEQ ID NO: 97651 - RNA, 22 nt, Human
agucuacauuuuuguuaauggu

SEQ ID NO: 97652 - RNA, 22 nt, Human
agucuagaaugugcaccaagcu

SEQ ID NO: 97653 - RNA, 22 nt, Human
agucuagcuuaggagccuagcu

SEQ ID NO: 97654 - RNA, 22 nt, Human
agucuauacuggacuguuguga

SEQ ID NO: 97655 - RNA, 22 nt, Human
agucuauauugugaaaguaaaa

SEQ ID NO: 97656 - RNA, 22 nt, Human
agucuauuuucagaagcaguuu

SEQ ID NO: 97657 - RNA, 22 nt, Human
agucucaaguguuaguauuauu

SEQ ID NO: 97658 - RNA, 22 nt, Human
agucucagaaaauaugcuuuuu

SEQ ID NO: 97659 - RNA, 22 nt, Human
agucucagccacacagaccuau

SEQ ID NO: 97660 - RNA, 22 nt, Human
agucucagcuacuugggaggcu

SEQ ID NO: 97661 - RNA, 22 nt, Human
agucucaggcagaggaaggcua

SEQ ID NO: 97662 - RNA, 19 nt, Human
agucucaguguacagaggc

SEQ ID NO: 97663 - RNA, 22 nt, Human
agucuccacuugacaucagcag

SEQ ID NO: 97664 - RNA, 22 nt, Human
agucuccgcucucggagucggc

SEQ ID NO: 97665 - RNA, 22 nt, Human
agucucuauguuccugcaauau

SEQ ID NO: 97666 - RNA, 22 nt, Human
agucucucacagaggauucucc

SEQ ID NO: 97667 - RNA, 22 nt, Human
agucucucuccucgugguaacc

SEQ ID NO: 97668 - RNA, 22 nt, Human
agucucucuugggugugguuug

SEQ ID NO: 97669 - RNA, 22 nt, Human
agucucugagguucagaugccu

SEQ ID NO: 97670 - RNA, 22 nt, Human
agucucugcacaguaagaagca

SEQ ID NO: 97671 - RNA, 22 nt, Human
agucucugcaugccugcugugc

SEQ ID NO: 97672 - RNA, 22 nt, Human
augucuuuaaacuugaguuguu

SEQ ID NO: 97673 - RNA, 22 nt, Human
augucuuuauaaauguauaaug

SEQ ID NO: 97674 - RNA, 22 nt, Human
augucuuuauuaauaucaugcc

SEQ ID NO: 97675 - RNA, 22 nt, Human
augucuuucgcaucaguagcua

SEQ ID NO: 97676 - RNA, 22 nt, Human
augucuuucuaguuaagagcua

SEQ ID NO: 97677 - RNA, 22 nt, Human
augucuuuggcuuugacauggc

SEQ ID NO: 97678 - RNA, 22 nt, Human
augucuuuuauggagaugucau

SEQ ID NO: 97679 - RNA, 22 nt, Human
augugaaaauccaauggcagca

SEQ ID NO: 97680 - RNA, 21 nt, Human
augugaaauaucaucagagca

SEQ ID NO: 97681 - RNA, 22 nt, Human
augugacaauauuuggucuuau

SEQ ID NO: 97682 - RNA, 22 nt, Human
augugacuucagucuucuuaca

SEQ ID NO: 97683 - RNA, 22 nt, Human
augugacuuugugucuuccauc

SEQ ID NO: 97684 - RNA, 22 nt, Human
augugagcuccggcagguggaa

SEQ ID NO: 97685 - RNA, 22 nt, Human
augugagcuggggcccggccag

SEQ ID NO: 97686 - RNA, 22 nt, Human
augugagguagauaggaugcag

SEQ ID NO: 97687 - RNA, 22 nt, Human
augugagguaucuaggucuucg

SEQ ID NO: 97688 - RNA, 22 nt, Human
augugauacuccuucuagugga

SEQ ID NO: 97689 - RNA, 22 nt, Human
augugcaaaguaaaguaauuuu

SEQ ID NO: 97690 - RNA, 23 nt, Human
augugcaaagugcuacaguauag

SEQ ID NO: 97691 - RNA, 22 nt, Human
augugcaaauccaaugugaaug

SEQ ID NO: 97692 - RNA, 22 nt, Human
augugcaaauuauuuugccaga

SEQ ID NO: 97693 - RNA, 22 nt, Human
augugcaacuuuucugucuuuu

SEQ ID NO: 97694 - RNA, 22 nt, Human
augugcacacagugucaugcaa

SEQ ID NO: 97695 - RNA, 22 nt, Human
augugcaggauccaggcuccua

SEQ ID NO: 97696 - RNA, 22 nt, Human
augugcugaguguguauauaca

SEQ ID NO: 97697 - RNA, 22 nt, Human
augugcuggcuaacuggauggg

SEQ ID NO: 97698 - RNA, 21 nt, Human
augugcuuagcugcugguagu

SEQ ID NO: 97699 - RNA, 22 nt, Human
augugcuugacuacucucuauu

SEQ ID NO: 97700 - RNA, 22 nt, Human
augugcuugcagaugagccuca

SEQ ID NO: 97701 - RNA, 19 nt, Human
augugcuugggccaugcua

SEQ ID NO: 97702 - RNA, 22 nt, Human
augugcuuuagguuuguuuaca

SEQ ID NO: 97703 - RNA, 22 nt, Human
auguggagaggaagugcaaacu

SEQ ID NO: 97704 - RNA, 22 nt, Human
auguggauagcacaggaauggu

SEQ ID NO: 97705 - RNA, 22 nt, Human
auguggaucuguuauucuagau

SEQ ID NO: 97706 - RNA, 22 nt, Human
auguggauguuuauaugaagaa

SEQ ID NO: 97707 - RNA, 22 nt, Human
auguggauuguaggaaacugau

SEQ ID NO: 97708 - RNA, 22 nt, Human
auguggcagugggaggugaauu

SEQ ID NO: 97709 - RNA, 17 nt, Human
auguggcuaagcugcug

SEQ ID NO: 97710 - RNA, 23 nt, Human
auguggcuagugagaccaagaaa

SEQ ID NO: 97711 - RNA, 22 nt, Human
auguggcuaguggacacaguau

SEQ ID NO: 97712 - RNA, 22 nt, Human
auguggcuauuuuaauguuaau

SEQ ID NO: 97713 - RNA, 22 nt, Human
auguggcugguaguugacaacu

SEQ ID NO: 97714 - RNA, 20 nt, Human
auguggcuuuuugaccugcu

SEQ ID NO: 97715 - RNA, 22 nt, Human
augugggaaauacaagcuaaaa

SEQ ID NO: 97716 - RNA, 22 nt, Human
auguggggacaaaaugauggcc

SEQ ID NO: 97717 - RNA, 22 nt, Human
auguggggacucugagagaauu

SEQ ID NO: 97718 - RNA, 22 nt, Human
augugguugaagaauuacaucu

SEQ ID NO: 97719 - RNA, 22 nt, Human
auguguaaugugguauuuuaau

SEQ ID NO: 97720 - RNA, 22 nt, Human
auguguacacacauauauguau

SEQ ID NO: 97721 - RNA, 22 nt, Human
auguguauguguauacacacag

SEQ ID NO: 97722 - RNA, 22 nt, Human
auguguauuaccucgauuguga

SEQ ID NO: 97723 - RNA, 22 nt, Human
augugucauuauccagaauaac

SEQ ID NO: 97724 - RNA, 20 nt, Human
auuuggcaugaaguauugau

SEQ ID NO: 97725 - RNA, 22 nt, Human
auuugggcaguccaugaaauaa

SEQ ID NO: 97726 - RNA, 22 nt, Human
auuuggucauguucaguguaga

SEQ ID NO: 97727 - RNA, 22 nt, Human
auuuggucuccauacugguuag

SEQ ID NO: 97728 - RNA, 22 nt, Human
auuuggugagguagccauuguu

SEQ ID NO: 97729 - RNA, 22 nt, Human
auuugguuacucaguugucuga

SEQ ID NO: 97730 - RNA, 22 nt, Human
auuugguuucaggauucucagg

SEQ ID NO: 97731 - RNA, 17 nt, Human
auuuguaacuagcucuu

SEQ ID NO: 97732 - RNA, 22 nt, Human
auuugucacacauaguuuaucc

SEQ ID NO: 97733 - RNA, 22 nt, Human
auuugucuagugguauucacgu

SEQ ID NO: 97734 - RNA, 22 nt, Human
auuugucucucuggguuuacuu

SEQ ID NO: 97735 - RNA, 22 nt, Human
auuugucuuuggaccugugaga

SEQ ID NO: 97736 - RNA, 22 nt, Human
auuugugaauuaagcaugucaa

SEQ ID NO: 97737 - RNA, 22 nt, Human
auuugugaucgugcgugaugaa

SEQ ID NO: 97738 - RNA, 17 nt, Human
auuugugauguaacguc

SEQ ID NO: 97739 - RNA, 22 nt, Human
auuugugcauaucccauccacc

SEQ ID NO: 97740 - RNA, 22 nt, Human
auuuguguuguauuaagcugcu

SEQ ID NO: 97741 - RNA, 22 nt, Human
auuuguucacaaucagggcagg

SEQ ID NO: 97742 - RNA, 22 nt, Human
auuuguucauggguuguuaugc

SEQ ID NO: 97743 - RNA, 22 nt, Human
auuuguucucauaaagaaugaa

SEQ ID NO: 97744 - RNA, 22 nt, Human
auuuguugaauaaauuaguauu

SEQ ID NO: 97745 - RNA, 22 nt, Human
auuuguugcuagcagcacugau

SEQ ID NO: 97746 - RNA, 22 nt, Human
auuuguuuaucgucgauuguag

SEQ ID NO: 97747 - RNA, 22 nt, Human
auuuguuucagggccuugguau

SEQ ID NO: 97748 - RNA, 22 nt, Human
auuuuaauaagauucccaagua

SEQ ID NO: 97749 - RNA, 22 nt, Human
auuuuagagaaacaaacguagg

SEQ ID NO: 97750 - RNA, 22 nt, Human
auuuuauccccacuggauuaca

SEQ ID NO: 97751 - RNA, 22 nt, Human
auuuuaucugcuuacuuucagg

SEQ ID NO: 97752 - RNA, 22 nt, Human
auuuucaaaacaucugcugugu

SEQ ID NO: 97753 - RNA, 22 nt, Human
auuuucacccugaauauauuga

SEQ ID NO: 97754 - RNA, 22 nt, Human
auuuucagagacaucuggacuu

SEQ ID NO: 97755 - RNA, 22 nt, Human
auuuucagucuggcuggaccca

SEQ ID NO: 97756 - RNA, 22 nt, Human
auuuucagugaucauagcacac

SEQ ID NO: 97757 - RNA, 22 nt, Human
auuuucaguguaaauguuuuau

SEQ ID NO: 97758 - RNA, 21 nt, Human
auuuucauuaauucagugugg

SEQ ID NO: 97759 - RNA, 22 nt, Human
auuuucauuuugcagggugaga

SEQ ID NO: 97760 - RNA, 22 nt, Human
auuuuccaaaauaauuguuacu

SEQ ID NO: 97761 - RNA, 22 nt, Human
auuuucuagauagaugaugcau

SEQ ID NO: 97762 - RNA, 22 nt, Human
auuuucuauucugcugguuuag

SEQ ID NO: 97763 - RNA, 22 nt, Human
auuuucucacaaugcagaagga

SEQ ID NO: 97764 - RNA, 22 nt, Human
auuuucucuuuguauaugcuag

SEQ ID NO: 97765 - RNA, 22 nt, Human
auuuucugaguccagaauuuac

SEQ ID NO: 97766 - RNA, 22 nt, Human
auuuugacagaagaggcccuaa

SEQ ID NO: 97767 - RNA, 22 nt, Human
auuuugaugcuaucuaaugaau

SEQ ID NO: 97768 - RNA, 22 nt, Human
auuuugcacacuaugcagcuuu

SEQ ID NO: 97769 - RNA, 22 nt, Human
auuuuggcaacagccaugagcc

SEQ ID NO: 97770 - RNA, 20 nt, Human
auuuuggugaacacagcuuc

SEQ ID NO: 97771 - RNA, 22 nt, Human
auuuuguaucuuacggggacua

SEQ ID NO: 97772 - RNA, 22 nt, Human
auuuuguuauaggagcugaaau

SEQ ID NO: 97773 - RNA, 22 nt, Human
auuuuuaggcucuacccucaga

SEQ ID NO: 97774 - RNA, 22 nt, Human
auuuuucaacuuuggaaauggc

SEQ ID NO: 97775 - RNA, 22 nt, Human
auuuuucagcuucauugaggca

SEQ ID NO: 97776 - RNA, 18 nt, Human
auuuuucccagauggaua

SEQ ID NO: 97777 - RNA, 23 nt, Human
auuuuuccuggaacagucaccca

SEQ ID NO: 97778 - RNA, 22 nt, Human
auuuuuccugggugcuuuaguu

SEQ ID NO: 97779 - RNA, 22 nt, Human
auuuuucucuccacuccauuaa

SEQ ID NO: 97780 - RNA, 22 nt, Human
auuuuuucagauugaguguuaa

SEQ ID NO: 97781 - RNA, 22 nt, Human
auuuuuucccaguuagccagga

SEQ ID NO: 97782 - RNA, 22 nt, Human
caaaaacugcaauuacuuuuac

SEQ ID NO: 97783 - RNA, 22 nt, Human
caaaaggcaggggaaagagugc

SEQ ID NO: 97784 - RNA, 22 nt, Human
caaaaggccaguacuuuguuug

SEQ ID NO: 97785 - RNA, 22 nt, Human
caaaaguaaucguggcuuuugc

SEQ ID NO: 97786 - RNA, 22 nt, Human
caaaaguaauguaugcucaucg

SEQ ID NO: 97787 - RNA, 22 nt, Human
caaaaguaauugcaguuuuugc

SEQ ID NO: 97788 - RNA, 22 nt, Human
caaaaguaccuugugugcuuug

SEQ ID NO: 97789 - RNA, 22 nt, Human
caaaagucuguccuuuaacuuc

SEQ ID NO: 97790 - RNA, 23 nt, Human
caaaaguuagcccuucccaucuc

SEQ ID NO: 97791 - RNA, 22 nt, Human
caaaaguuauugcgguuuuugc

SEQ ID NO: 97792 - RNA, 23 nt, Human
caaaaugguuuaaaaguggcaua

SEQ ID NO: 97793 - RNA, 22 nt, Human
caaaaugugagucccaccucaa

SEQ ID NO: 97794 - RNA, 22 nt, Human
caaaauguucuggcaccuuuaa

SEQ ID NO: 97795 - RNA, 22 nt, Human
caaaauuagggagugagcugga

SEQ ID NO: 97796 - RNA, 22 nt, Human
caaaauucugcauuucuaauaa

SEQ ID NO: 97797 - RNA, 22 nt, Human
caaaauugaugaauguaugauu

SEQ ID NO: 97798 - RNA, 22 nt, Human
caaaauuguugaugcugcuuug

SEQ ID NO: 97799 - RNA, 22 nt, Human
caaacauucagaugcaauggua

SEQ ID NO: 97800 - RNA, 22 nt, Human
caaacauuccgcuucucccagg

SEQ ID NO: 97801 - RNA, 22 nt, Human
caaacauugcacuuucugcuau

SEQ ID NO: 97802 - RNA, 22 nt, Human
caaacauuuaggaggagggagg

SEQ ID NO: 97803 - RNA, 22 nt, Human
caaaccugagaacaugugcugu

SEQ ID NO: 97804 - RNA, 22 nt, Human
caaaccugcugcuauuuuaucc

SEQ ID NO: 97805 - RNA, 22 nt, Human
caaaccuguccuuuugucuccu

SEQ ID NO: 97806 - RNA, 23 nt, Human
caaaccuguucuccccacaugca

SEQ ID NO: 97807 - RNA, 22 nt, Human
caaaccuugcagaacugggcag

SEQ ID NO: 97808 - RNA, 22 nt, Human
caaacuauuguucacaagacaa

SEQ ID NO: 97809 - RNA, 22 nt, Human
caaacucucccacucacucuga

SEQ ID NO: 97810 - RNA, 22 nt, Human
caaacuguaugacccuaggccg

SEQ ID NO: 97811 - RNA, 22 nt, Human
caaacuguucucugugggauuc

SEQ ID NO: 97812 - RNA, 22 nt, Human
caaacuugguggauuaguacag

SEQ ID NO: 97813 - RNA, 22 nt, Human
caaagaauagcauggcauuugu

SEQ ID NO: 97814 - RNA, 22 nt, Human
caaagauaaucacagaauaccc

SEQ ID NO: 97815 - RNA, 22 nt, Human
caaagaugccaaaaggaagaca

SEQ ID NO: 97816 - RNA, 22 nt, Human
caaagcaggaagaauauugaaa

SEQ ID NO: 97817 - RNA, 22 nt, Human
caaagcaguauuggauucuuua

SEQ ID NO: 97818 - RNA, 22 nt, Human
caaagcagugauccuuaaagga

SEQ ID NO: 97819 - RNA, 22 nt, Human
caaagcaguuuuaaucaaguag

SEQ ID NO: 97820 - RNA, 18 nt, Human
caaagcucacguuccauc

SEQ ID NO: 97821 - RNA, 22 nt, Human
caaagcugugaauuccuacaaa

SEQ ID NO: 97822 - RNA, 22 nt, Human
caaagcuuggagaagcagcugg

SEQ ID NO: 97823 - RNA, 22 nt, Human
caaaggaaauacuaaucuggaa

SEQ ID NO: 97824 - RNA, 22 nt, Human
caaaggaggugauaggcccucu

SEQ ID NO: 97825 - RNA, 22 nt, Human
aguguuugggggccuuguaaca

SEQ ID NO: 97826 - RNA, 22 nt, Human
aguguuuguaaacuacagaucu

SEQ ID NO: 97827 - RNA, 22 nt, Human
aguguuuuucaggagcagaaca

SEQ ID NO: 97828 - RNA, 22 nt, Human
aguguuuuuggguagggugagu

SEQ ID NO: 97829 - RNA, 22 nt, Human
aguuaaaucauggccauuggaa

SEQ ID NO: 97830 - RNA, 22 nt, Human
aguuaacaaguuggcaaucaac

SEQ ID NO: 97831 - RNA, 22 nt, Human
aguuaacacagucaggaguaac

SEQ ID NO: 97832 - RNA, 17 nt, Human
aguuaaggcucuuugcu

SEQ ID NO: 97833 - RNA, 22 nt, Human
auaauguagguauguguauuua

SEQ ID NO: 97834 - RNA, 22 nt, Human
auaauguguucaucuuacaauu

SEQ ID NO: 97835 - RNA, 22 nt, Human
auaauguugaugauugucuuug

SEQ ID NO: 97836 - RNA, 22 nt, Human
auaauguuucaguacugucugu

SEQ ID NO: 97837 - RNA, 22 nt, Human
auaauguuuuuguauaagcaug

SEQ ID NO: 97838 - RNA, 22 nt, Human
auaauuaauuucaguaaucucc

SEQ ID NO: 97839 - RNA, 20 nt, Human
auaauuauuuacuuuugugc

SEQ ID NO: 97840 - RNA, 22 nt, Human
auaauuuacaacugcuuuuaau

SEQ ID NO: 97841 - RNA, 22 nt, Human
auaauuuuuguuugauguccaa

SEQ ID NO: 97842 - RNA, 22 nt, Human
auacaacugcucucagauaagu

SEQ ID NO: 97843 - RNA, 22 nt, Human
auacaaguggccacuugaauuc

SEQ ID NO: 97844 - RNA, 22 nt, Human
auacaaguugcccaaaugauua

SEQ ID NO: 97845 - RNA, 20 nt, Human
auacaaucaugaggaaaaag

SEQ ID NO: 97846 - RNA, 22 nt, Human
auacaaugauugguucucaccc

SEQ ID NO: 97847 - RNA, 22 nt, Human
auacaauuauucugcagauauu

SEQ ID NO: 97848 - RNA, 22 nt, Human
auacacagcuacauugaacaau

SEQ ID NO: 97849 - RNA, 19 nt, Human
auacacauacguaaacuga

SEQ ID NO: 97850 - RNA, 22 nt, Human
auacacauguguaugugcaugc

SEQ ID NO: 97851 - RNA, 20 nt, Human
auacacauucauagaaaaau

SEQ ID NO: 97852 - RNA, 19 nt, Human
auacacuaauauaaaccac

SEQ ID NO: 97853 - RNA, 22 nt, Human
auacacuaaucaugugcucagu

SEQ ID NO: 97854 - RNA, 22 nt, Human
auacacugguuuaugauauugu

SEQ ID NO: 97855 - RNA, 22 nt, Human
auacacuucauguuuucaucug

SEQ ID NO: 97856 - RNA, 22 nt, Human
auacacuuccaaauauugauua

SEQ ID NO: 97857 - RNA, 22 nt, Human
auacacuugaccuggagugaag

SEQ ID NO: 97858 - RNA, 21 nt, Human
auacagaaggcagacucucuc

SEQ ID NO: 97859 - RNA, 21 nt, Human
auacagaagguggcaaaguac

SEQ ID NO: 97860 - RNA, 22 nt, Human
auacagaauuugcccuuuucau

SEQ ID NO: 97861 - RNA, 22 nt, Human
auacagagaagggguagaggau

SEQ ID NO: 97862 - RNA, 22 nt, Human
auacagagcaguaauagaggag

SEQ ID NO: 97863 - RNA, 22 nt, Human
auacagaggguuucaugggcag

SEQ ID NO: 97864 - RNA, 22 nt, Human
auacagaugcuugcucgugacu

SEQ ID NO: 97865 - RNA, 19 nt, Human
auacagauguauccaugau

SEQ ID NO: 97866 - RNA, 22 nt, Human
auacagccuauucuuaccauug

SEQ ID NO: 97867 - RNA, 22 nt, Human
auacagcuuaugcauauaucuc

SEQ ID NO: 97868 - RNA, 22 nt, Human
auacagggacauccaguuuuuc

SEQ ID NO: 97869 - RNA, 22 nt, Human
auacagguaggggacauacauc

SEQ ID NO: 97870 - RNA, 22 nt, Human
auacagguguacacacaugcaa

SEQ ID NO: 97871 - RNA, 22 nt, Human
auacaguaagugucccugaaac

SEQ ID NO: 97872 - RNA, 22 nt, Human
auacaguagacaaucucaugaa

SEQ ID NO: 97873 - RNA, 22 nt, Human
auacaguauuaccuguucagga

SEQ ID NO: 97874 - RNA, 22 nt, Human
auacagugccccuuuucacaug

SEQ ID NO: 97875 - RNA, 22 nt, Human
auacaguguacuauuuagcagu

SEQ ID NO: 97876 - RNA, 22 nt, Human
auacauacauguaugcacauac

SEQ ID NO: 97877 - RNA, 22 nt, Human
auacauagauagauaaucuggc

SEQ ID NO: 97878 - RNA, 22 nt, Human
auacauagcaggguaguagauc

SEQ ID NO: 97879 - RNA, 22 nt, Human
auacauaguaccacauuugaca

SEQ ID NO: 97880 - RNA, 22 nt, Human
auacauaguucugugaaaagua

SEQ ID NO: 97881 - RNA, 22 nt, Human
auacauauccacaggagauaaa

SEQ ID NO: 97882 - RNA, 22 nt, Human
auacaucaaggaugauggugua

SEQ ID NO: 97883 - RNA, 22 nt, Human
auacaucguuuauuuuaguuca

SEQ ID NO: 97884 - RNA, 22 nt, Human
auacaucuagagucauaaaaac

SEQ ID NO: 97885 - RNA, 22 nt, Human
auacaucuaugccuuucugaca

SEQ ID NO: 97886 - RNA, 22 nt, Human
auacaucucauguaagagauaa

SEQ ID NO: 97887 - RNA, 22 nt, Human
auacaucucuuugaagugcuuu

SEQ ID NO: 97888 - RNA, 22 nt, Human
auacaugaucacuguauuauaa

SEQ ID NO: 97889 - RNA, 23 nt, Human
auacauggccggauaugauguuc

SEQ ID NO: 97890 - RNA, 22 nt, Human
auacauguaacugcauuguaau

SEQ ID NO: 97891 - RNA, 22 nt, Human
auacauguacauaaauguagca

SEQ ID NO: 97892 - RNA, 22 nt, Human
auacaugugccauguuggugua

SEQ ID NO: 97893 - RNA, 22 nt, Human
auacaugugugugcauacaugu

SEQ ID NO: 97894 - RNA, 22 nt, Human
auacauuagaaucugguacuca

SEQ ID NO: 97895 - RNA, 22 nt, Human
auacauuauuguuaaagaacau

SEQ ID NO: 97896 - RNA, 22 nt, Human
auacauucaaaggaaggauaga

SEQ ID NO: 97897 - RNA, 22 nt, Human
auaccauuguuucuaccagcug

SEQ ID NO: 97898 - RNA, 22 nt, Human
auacccaguccaaucucuuagc

SEQ ID NO: 97899 - RNA, 22 nt, Human
auacguaaguugaacaucagaa

SEQ ID NO: 97900 - RNA, 22 nt, Human
auacuaaaguauagaacuuagu

SEQ ID NO: 97901 - RNA, 22 nt, Human
auacuacauacuauguaaacau

SEQ ID NO: 97902 - RNA, 22 nt, Human
auacuagacuguucuguuauca

SEQ ID NO: 97903 - RNA, 19 nt, Human
auacuaggucaugauaauc

SEQ ID NO: 97904 - RNA, 22 nt, Human
auacugauugauauucccauga

SEQ ID NO: 97905 - RNA, 22 nt, Human
auacuguaucacuugugaguga

SEQ ID NO: 97906 - RNA, 22 nt, Human
auacugugugcagaguccuaau

SEQ ID NO: 97907 - RNA, 22 nt, Human
auacuuaacuguggagucauug

SEQ ID NO: 97908 - RNA, 22 nt, Human
auacuuaaugucaguuugaugu

SEQ ID NO: 97909 - RNA, 22 nt, Human
auacuuauacuaagaauguacu

SEQ ID NO: 97910 - RNA, 22 nt, Human
auacuuaugauaaauaauugcu

SEQ ID NO: 97911 - RNA, 22 nt, Human
auacuucuagaaauacuaugca

SEQ ID NO: 97912 - RNA, 22 nt, Human
auacuucuggugacaaagucuu

SEQ ID NO: 97913 - RNA, 22 nt, Human
auacuucuuuagcauauugaac

SEQ ID NO: 97914 - RNA, 22 nt, Human
auacuucuuugauguucacagg

SEQ ID NO: 97915 - RNA, 22 nt, Human
auacuugagguuguauaaauau

SEQ ID NO: 97916 - RNA, 20 nt, Human
auacuuguuuucaggcuuuu

SEQ ID NO: 97917 - RNA, 22 nt, Human
auacuuuaacguggcgaaccuu

SEQ ID NO: 97918 - RNA, 22 nt, Human
auacuuuggucacuauuauugg

SEQ ID NO: 97919 - RNA, 22 nt, Human
auagaaacagggaagcaaagca

SEQ ID NO: 97920 - RNA, 22 nt, Human
auagaacaagguagacagcuuu

SEQ ID NO: 97921 - RNA, 22 nt, Human
auagaacacagaugggcguggc

SEQ ID NO: 97922 - RNA, 23 nt, Human
auagaagauuauugcaacagucc

SEQ ID NO: 97923 - RNA, 22 nt, Human
auagaagcaagaacagaaugga

SEQ ID NO: 97924 - RNA, 22 nt, Human
auagaauaugacuuuuagaucc

SEQ ID NO: 97925 - RNA, 22 nt, Human
auagaaucaucugugcacuagu

SEQ ID NO: 97926 - RNA, 22 nt, Human
auagaauucuuugaaauuuaug

SEQ ID NO: 97927 - RNA, 22 nt, Human
auagaauuugcacuaaaucugc

SEQ ID NO: 97928 - RNA, 22 nt, Human
auagacaaacacgaagaugaca

SEQ ID NO: 97929 - RNA, 22 nt, Human
auagacauggucuuuugucauu

SEQ ID NO: 97930 - RNA, 23 nt, Human
auagaccauugucucacacuuca

SEQ ID NO: 97931 - RNA, 22 nt, Human
auagaguacagucuuugauuau

SEQ ID NO: 97932 - RNA, 22 nt, Human
auagauacauuagguaacuugu

SEQ ID NO: 97933 - RNA, 22 nt, Human
auagauacuggguauggagaug

SEQ ID NO: 97934 - RNA, 20 nt, Human
auagauaucaucuuuagaag

SEQ ID NO: 97935 - RNA, 22 nt, Human
auagaucaauauuuagaaacuu

SEQ ID NO: 97936 - RNA, 22 nt, Human
auagaucacaaugguucacuuu

SEQ ID NO: 97937 - RNA, 20 nt, Human
auagaucagugagacuaaag

SEQ ID NO: 97938 - RNA, 22 nt, Human
auagcaaaaggcaccagaguga

SEQ ID NO: 97939 - RNA, 22 nt, Human
auagcaaagaugucaauucccc

SEQ ID NO: 97940 - RNA, 22 nt, Human
auagcaccugugaugggaugag

SEQ ID NO: 97941 - RNA, 22 nt, Human
auagcacugguuuuucuugguu

SEQ ID NO: 97942 - RNA, 22 nt, Human
aucagcaaggcaaucacugcag

SEQ ID NO: 97943 - RNA, 22 nt, Human
aucagcauucccaaaugaugug

SEQ ID NO: 97944 - RNA, 22 nt, Human
aucagcuaauuagaauuaggau

SEQ ID NO: 97945 - RNA, 22 nt, Human
aucaggaaaaauugugaaaggg

SEQ ID NO: 97946 - RNA, 22 nt, Human
aucaggaaagaaaagcuuggcg

SEQ ID NO: 97947 - RNA, 22 nt, Human
aucaggaaagaguggaacucug

SEQ ID NO: 97948 - RNA, 22 nt, Human
aucaggaagaucuagcgaaugu

SEQ ID NO: 97949 - RNA, 22 nt, Human
aucaggauagucuguaaauugu

SEQ ID NO: 97950 - RNA, 22 nt, Human
aucaggaucacugggagucuug

SEQ ID NO: 97951 - RNA, 22 nt, Human
aucaggaucagggcuagcagag

SEQ ID NO: 97952 - RNA, 22 nt, Human
aucaggaugaagcuguagcgaa

SEQ ID NO: 97953 - RNA, 22 nt, Human
aucaggauguuuggcugucaua

SEQ ID NO: 97954 - RNA, 22 nt, Human
aucaggauuacacggggaugcu

SEQ ID NO: 97955 - RNA, 21 nt, Human
aucaggcucaaaucaucccaa

SEQ ID NO: 97956 - RNA, 22 nt, Human
aucaggugaagucacugagugg

SEQ ID NO: 97957 - RNA, 20 nt, Human
aucagguguucagccacugc

SEQ ID NO: 97958 - RNA, 22 nt, Human
aucaguaaauauucauugugca

SEQ ID NO: 97959 - RNA, 22 nt, Human
aucaguaggccaagcagcuggc

SEQ ID NO: 97960 - RNA, 22 nt, Human
aucagugcugggagaugucaga

SEQ ID NO: 97961 - RNA, 22 nt, Human
aucaguguauucauagggaaua

SEQ ID NO: 97962 - RNA, 22 nt, Human
aucaguuucacuugcuugcaaa

SEQ ID NO: 97963 - RNA, 22 nt, Human
aucaguuugagugcugugucaa

SEQ ID NO: 97964 - RNA, 22 nt, Human
aucaguuuuguucacuacuaua

SEQ ID NO: 97965 - RNA, 22 nt, Human
aucauaaaauugcaccauuucu

SEQ ID NO: 97966 - RNA, 22 nt, Human
aucauacagaaccugagcacuu

SEQ ID NO: 97967 - RNA, 22 nt, Human
aucauacauacaugguccucag

SEQ ID NO: 97968 - RNA, 22 nt, Human
aucaucaucaacaagaaacauu

SEQ ID NO: 97969 - RNA, 22 nt, Human
aucaucaugcccacuugagacu

SEQ ID NO: 97970 - RNA, 22 nt, Human
aucauccaagcguaguucuucu

SEQ ID NO: 97971 - RNA, 22 nt, Human
aucauccaucuagcgcgggggg

SEQ ID NO: 97972 - RNA, 22 nt, Human
aucauccuauugugccccaggu

SEQ ID NO: 97973 - RNA, 22 nt, Human
aucaucuuaagguaucucaagc

SEQ ID NO: 97974 - RNA, 22 nt, Human
aucaucuucauauuccucagcu

SEQ ID NO: 97975 - RNA, 22 nt, Human
aucaugacauacuuuugagaag

SEQ ID NO: 97976 - RNA, 18 nt, Human
aucaugcugaauuaaaga

SEQ ID NO: 97977 - RNA, 22 nt, Human
aucauguacuugacaaauaugu

SEQ ID NO: 97978 - RNA, 22 nt, Human
aucauguuccagaaacagugau

SEQ ID NO: 97979 - RNA, 22 nt, Human
aucauguuggcucugacaaaaa

SEQ ID NO: 97980 - RNA, 22 nt, Human
augagggaggcaaggagaugcu

SEQ ID NO: 97981 - RNA, 22 nt, Human
augagggagggguggugccgca

SEQ ID NO: 97982 - RNA, 23 nt, Human
augagguaaagaucagcuuuaaa

SEQ ID NO: 97983 - RNA, 22 nt, Human
augagguaacagcuuaucaaca

SEQ ID NO: 97984 - RNA, 22 nt, Human
augagguaagcacugggcccaa

SEQ ID NO: 97985 - RNA, 22 nt, Human
augagguaauagggcagugggg

SEQ ID NO: 97986 - RNA, 21 nt, Human
augagguaauucacuaagcag

SEQ ID NO: 97987 - RNA, 22 nt, Human
augagguacuuacauugagcuu

SEQ ID NO: 97988 - RNA, 19 nt, Human
augagguagcagcuggugc

SEQ ID NO: 97989 - RNA, 22 nt, Human
augagguaucucauuuccugaa

SEQ ID NO: 97990 - RNA, 22 nt, Human
augagguaugaagugugggaua

SEQ ID NO: 97991 - RNA, 22 nt, Human
augagguauucguaauauuucc

SEQ ID NO: 97992 - RNA, 22 nt, Human
augaggucauccuggaguaagg

SEQ ID NO: 97993 - RNA, 17 nt, Human
augaggucauuaagaua

SEQ ID NO: 97994 - RNA, 22 nt, Human
augaggucauucuuggauuaca

SEQ ID NO: 97995 - RNA, 22 nt, Human
augaggucuuauugcaguaguu

SEQ ID NO: 97996 - RNA, 22 nt, Human
augaguaagaccauaauuuuug

SEQ ID NO: 97997 - RNA, 22 nt, Human
augaguaagugaaucuccaaag

SEQ ID NO: 97998 - RNA, 22 nt, Human
augaguacauugggaucaaaga

SEQ ID NO: 97999 - RNA, 22 nt, Human
augagugauggguacauuggcu

SEQ ID NO: 98000 - RNA, 22 nt, Human
augagugugaaguuagcucagu

SEQ ID NO: 98001 - RNA, 22 nt, Human
augaguucauacuuucaguacc

SEQ ID NO: 98002 - RNA, 23 nt, Human
augauaaugccauuaacuuugau

SEQ ID NO: 98003 - RNA, 22 nt, Human
augauacaagcaaaacuaauca

SEQ ID NO: 98004 - RNA, 22 nt, Human
augauacauugcaaaauuuuaa

SEQ ID NO: 98005 - RNA, 22 nt, Human
augaucagggcagaagcagaag

SEQ ID NO: 98006 - RNA, 22 nt, Human
augaucauacagagcccuggua

SEQ ID NO: 98007 - RNA, 22 nt, Human
augauccaaagccacaggggca

SEQ ID NO: 98008 - RNA, 22 nt, Human
augaucucauucuuucaaaggg

SEQ ID NO: 98009 - RNA, 19 nt, Human
augaucugcccuuguaaua

SEQ ID NO: 98010 - RNA, 22 nt, Human
augaugaaacuaggaacuagag

SEQ ID NO: 98011 - RNA, 22 nt, Human
augaugaagcaugguuacacug

SEQ ID NO: 98012 - RNA, 22 nt, Human
augaugcuguuauuaucuauac

SEQ ID NO: 98013 - RNA, 22 nt, Human
augauggagguguccuggauuu

SEQ ID NO: 98014 - RNA, 22 nt, Human
augauggaugucacagucugua

SEQ ID NO: 98015 - RNA, 22 nt, Human
augauggugggagaugacccag

SEQ ID NO: 98016 - RNA, 22 nt, Human
augauguaaaauaaguugugag

SEQ ID NO: 98017 - RNA, 22 nt, Human
augauguaacauaaagaugucu

SEQ ID NO: 98018 - RNA, 22 nt, Human
augauguaauggaaagaacaga

SEQ ID NO: 98019 - RNA, 22 nt, Human
augaugucccuaggcagguagu

SEQ ID NO: 98020 - RNA, 22 nt, Human
augauguugauaaauuacuuua

SEQ ID NO: 98021 - RNA, 23 nt, Human
augauguuuuugguagucaaaug

SEQ ID NO: 98022 - RNA, 22 nt, Human
augauuacauguguuaauauac

SEQ ID NO: 98023 - RNA, 20 nt, Human
augauucugggcuacacugg

SEQ ID NO: 98024 - RNA, 22 nt, Human
augauugcagcccuacagcugu

SEQ ID NO: 98025 - RNA, 22 nt, Human
augauugccugugugugagaaa

SEQ ID NO: 98026 - RNA, 22 nt, Human
augauuucuauauaaacuuaaa

SEQ ID NO: 98027 - RNA, 22 nt, Human
augcaaaauaaggcagaaacau

SEQ ID NO: 98028 - RNA, 22 nt, Human
augcaaaauuaccauucuguuc

SEQ ID NO: 98029 - RNA, 20 nt, Human
augcaaacucacaaaauacc

SEQ ID NO: 98030 - RNA, 22 nt, Human
augcaaagcaccacacuaagau

SEQ ID NO: 98031 - RNA, 22 nt, Human
augcaaauaaagcaacuauaca

SEQ ID NO: 98032 - RNA, 20 nt, Human
augcaaaucccaaaaucagg

SEQ ID NO: 98033 - RNA, 22 nt, Human
augcaaaugucaccacuucuaa

SEQ ID NO: 98034 - RNA, 22 nt, Human
augcaaauugccauaaaguggg

SEQ ID NO: 98035 - RNA, 22 nt, Human
augcaacaaauugugugcaaua

SEQ ID NO: 98036 - RNA, 22 nt, Human
augcaacagaaaauugccuggg

SEQ ID NO: 98037 - RNA, 22 nt, Human
augcaacauccaauuccuuuug

SEQ ID NO: 98038 - RNA, 22 nt, Human
augcaagagauggacuuguguu

SEQ ID NO: 98039 - RNA, 22 nt, Human
augcaagagggaaaaggaaaua

SEQ ID NO: 98040 - RNA, 23 nt, Human
augcaagaguuucucaaacugga

SEQ ID NO: 98041 - RNA, 22 nt, Human
augcaauaaauacuuuccagcu

SEQ ID NO: 98042 - RNA, 22 nt, Human
augcaauaguaauucuagucug

SEQ ID NO: 98043 - RNA, 22 nt, Human
augcaauauguguuucuguuua

SEQ ID NO: 98044 - RNA, 22 nt, Human
augcacaagcaagagauaaugg

SEQ ID NO: 98045 - RNA, 23 nt, Human
augcacaagccagcaggggacag

SEQ ID NO: 98046 - RNA, 22 nt, Human
augcacaagguagauuauuauu

SEQ ID NO: 98047 - RNA, 22 nt, Human
augcacaaguuauauguaugga

SEQ ID NO: 98048 - RNA, 22 nt, Human
augcacacaagcuuauguauua

SEQ ID NO: 98049 - RNA, 22 nt, Human
augcacacguacccuacaaggc

SEQ ID NO: 98050 - RNA, 22 nt, Human
augcacagaaaaauugcuuacu

SEQ ID NO: 98051 - RNA, 22 nt, Human
cagagccuuccuagcagacucu

SEQ ID NO: 98052 - RNA, 22 nt, Human
cagagcggccacuagagggcgc

SEQ ID NO: 98053 - RNA, 22 nt, Human
cagagcucucuuugcuacuaca

SEQ ID NO: 98054 - RNA, 22 nt, Human
cagagcugacccaaggauugaa

SEQ ID NO: 98055 - RNA, 22 nt, Human
cagagcugagucuucaagguug

SEQ ID NO: 98056 - RNA, 23 nt, Human
cagagcugauuaaacuuaaucuc

SEQ ID NO: 98057 - RNA, 22 nt, Human
cagagcugcaaaugccccuccg

SEQ ID NO: 98058 - RNA, 22 nt, Human
cagagcuggagggaacccuggc

SEQ ID NO: 98059 - RNA, 22 nt, Human
cagagcuggcggugagaagaca

SEQ ID NO: 98060 - RNA, 22 nt, Human
cagagcugggaucccaugggcg

SEQ ID NO: 98061 - RNA, 22 nt, Human
cagagcuguccaaacccugaca

SEQ ID NO: 98062 - RNA, 22 nt, Human
cagagcuguuacuauucaugaa

SEQ ID NO: 98063 - RNA, 22 nt, Human
cagagcuuccugcugggcuucu

SEQ ID NO: 98064 - RNA, 22 nt, Human
cagagcuuuuuacauuaaugau

SEQ ID NO: 98065 - RNA, 22 nt, Human
cagaggaaaguauuucuggaag

SEQ ID NO: 98066 - RNA, 22 nt, Human
cagaggaacguuuggauugauu

SEQ ID NO: 98067 - RNA, 22 nt, Human
cagaggaagagauacaagcccu

SEQ ID NO: 98068 - RNA, 22 nt, Human
cagaggaagcuggguguggagu

SEQ ID NO: 98069 - RNA, 22 nt, Human
cagaggacuucccacucaucug

SEQ ID NO: 98070 - RNA, 22 nt, Human
cagaggaugaucuggccucucu

SEQ ID NO: 98071 - RNA, 22 nt, Human
cagaggauuauggagauggucu

SEQ ID NO: 98072 - RNA, 20 nt, Human
cagaggcaaggagacuugga

SEQ ID NO: 98073 - RNA, 16 nt, Human
cagaggcaccuggcuc

SEQ ID NO: 98074 - RNA, 22 nt, Human
cagaggcagacccuccagggcg

SEQ ID NO: 98075 - RNA, 21 nt, Human
cagaggcagguccugggacgg

SEQ ID NO: 98076 - RNA, 22 nt, Human
cagaggccaccuguggccacug

SEQ ID NO: 98077 - RNA, 21 nt, Human
cagaggccuaucacagacucc

SEQ ID NO: 98078 - RNA, 22 nt, Human
cagaggccucacuuccagccag

SEQ ID NO: 98079 - RNA, 22 nt, Human
cagaggccuggcuuggacaccu

SEQ ID NO: 98080 - RNA, 22 nt, Human
cagaggccuuucuacagugaua

SEQ ID NO: 98081 - RNA, 22 nt, Human
cagaggcgaggcagcugaaccu

SEQ ID NO: 98082 - RNA, 22 nt, Human
cagaggcugacaaaauauugcu

SEQ ID NO: 98083 - RNA, 21 nt, Human
cagaggcugagagggcaaucu

SEQ ID NO: 98084 - RNA, 22 nt, Human
cagaggcugagcagucaguuug

SEQ ID NO: 98085 - RNA, 22 nt, Human
cagaggcugccagccaugugca

SEQ ID NO: 98086 - RNA, 22 nt, Human
cagaggcugggaccucaggcau

SEQ ID NO: 98087 - RNA, 22 nt, Human
cagagggagcccuccaggagca

SEQ ID NO: 98088 - RNA, 21 nt, Human
cagagggccggcauguggucu

SEQ ID NO: 98089 - RNA, 22 nt, Human
cagagggcguccggguuaacuu

SEQ ID NO: 98090 - RNA, 22 nt, Human
cagagggcucuuggcugccugc

SEQ ID NO: 98091 - RNA, 22 nt, Human
cagagggcuucagguucaggau

SEQ ID NO: 98092 - RNA, 21 nt, Human
cagagggcuuuucucuguucu

SEQ ID NO: 98093 - RNA, 22 nt, Human
cagagggguguagagaucacug

SEQ ID NO: 98094 - RNA, 22 nt, Human
cagaggguugucaggcgccuug

SEQ ID NO: 98095 - RNA, 22 nt, Human
cagagguagaacuggcccucac

SEQ ID NO: 98096 - RNA, 22 nt, Human
cagaggucagguuggacauuau

SEQ ID NO: 98097 - RNA, 22 nt, Human
aucuauacuacaaauggcuggu

SEQ ID NO: 98098 - RNA, 22 nt, Human
aucuaucaccuuuagguuuguu

SEQ ID NO: 98099 - RNA, 22 nt, Human
aucuaugugccuuuguauagaa

SEQ ID NO: 98100 - RNA, 22 nt, Human
aucucacacuggguuugagggu

SEQ ID NO: 98101 - RNA, 22 nt, Human
aucucagaaaguuuaauuuuuc

SEQ ID NO: 98102 - RNA, 16 nt, Human
aucucaggagagucuu

SEQ ID NO: 98103 - RNA, 22 nt, Human
aucucaggagguuccucugucc

SEQ ID NO: 98104 - RNA, 22 nt, Human
aucucaggcccuagugaccuca

SEQ ID NO: 98105 - RNA, 22 nt, Human
aucucagggcuggagcccugga

SEQ ID NO: 98106 - RNA, 22 nt, Human
aucuccagaacauuuauaaacg

SEQ ID NO: 98107 - RNA, 22 nt, Human
aucuccagauugugaucaucag

SEQ ID NO: 98108 - RNA, 22 nt, Human
aucuccagcaauggggagcucu

SEQ ID NO: 98109 - RNA, 22 nt, Human
aucuccagcagugcuuuugagc

SEQ ID NO: 98110 - RNA, 22 nt, Human
aucuccagguugugccugcguc

SEQ ID NO: 98111 - RNA, 22 nt, Human
aucucccaaacucauuucuuca

SEQ ID NO: 98112 - RNA, 18 nt, Human
aucucccauuggccaagg

SEQ ID NO: 98113 - RNA, 22 nt, Human
aucuccucgcaggccagaacac

SEQ ID NO: 98114 - RNA, 23 nt, Human
aucuccugagaacccacaguggu

SEQ ID NO: 98115 - RNA, 22 nt, Human
aucucuccuuaugaagcauuau

SEQ ID NO: 98116 - RNA, 22 nt, Human
aucucuccuucagcugaggccc

SEQ ID NO: 98117 - RNA, 22 nt, Human
aucucucugcccaggggcugug

SEQ ID NO: 98118 - RNA, 23 nt, Human
aucucucuuuauucuuggggaua

SEQ ID NO: 98119 - RNA, 22 nt, Human
aucucugcguccccagcaucga

SEQ ID NO: 98120 - RNA, 22 nt, Human
aucucugguccaaauguuaccu

SEQ ID NO: 98121 - RNA, 22 nt, Human
aucucuuagcagucuagugacc

SEQ ID NO: 98122 - RNA, 22 nt, Human
aucucuuaugucacauaaacca

SEQ ID NO: 98123 - RNA, 22 nt, Human
aucucuucucccaacaccuggc

SEQ ID NO: 98124 - RNA, 22 nt, Human
aucucuucugagcaauuccugu

SEQ ID NO: 98125 - RNA, 22 nt, Human
aucugaaaagccucuuacuccu

SEQ ID NO: 98126 - RNA, 22 nt, Human
aucugaaacucugacauugucu

SEQ ID NO: 98127 - RNA, 22 nt, Human
aucugaaagcuaggaguucuca

SEQ ID NO: 98128 - RNA, 21 nt, Human
aucugaaagguuaguguugag

SEQ ID NO: 98129 - RNA, 22 nt, Human
aucugaaaguuuagaauucuug

SEQ ID NO: 98130 - RNA, 21 nt, Human
aucugaaaugucaaagcagau

SEQ ID NO: 98131 - RNA, 22 nt, Human
aucugaaguggagaaaaauaua

SEQ ID NO: 98132 - RNA, 21 nt, Human
aucugaaguuugagaggaaag

SEQ ID NO: 98133 - RNA, 22 nt, Human
aucugacaaggccacauauucu

SEQ ID NO: 98134 - RNA, 22 nt, Human
aucugacaucuacuagaacaga

SEQ ID NO: 98135 - RNA, 22 nt, Human
aucugacuucacgcccaugcca

SEQ ID NO: 98136 - RNA, 22 nt, Human
aucugagucaaauauuucauuu

SEQ ID NO: 98137 - RNA, 22 nt, Human
aucugauuuguaauuuuagaaa

SEQ ID NO: 98138 - RNA, 22 nt, Human
aucugcaggaaugugugcagag

SEQ ID NO: 98139 - RNA, 22 nt, Human
aucugccuggcuccaggugagc

SEQ ID NO: 98140 - RNA, 22 nt, Human
aucugccuggucuuugaugcag

SEQ ID NO: 98141 - RNA, 20 nt, Human
aucugcugagaaugaaaggc

SEQ ID NO: 98142 - RNA, 22 nt, Human
aucugcugcccagccacuugcu

SEQ ID NO: 98143 - RNA, 18 nt, Human
aucugcuggcaggucugg

SEQ ID NO: 98144 - RNA, 22 nt, Human
aucugcuggcaucucuagccca

SEQ ID NO: 98145 - RNA, 22 nt, Human
aucugcuguucuucacagcuug

SEQ ID NO: 98146 - RNA, 21 nt, Human
aucugcuuagguuuguucaga

SEQ ID NO: 98147 - RNA, 17 nt, Human
aucugcuucacccagca

SEQ ID NO: 98148 - RNA, 22 nt, Human
aucugcuucgcgccaauuucau

SEQ ID NO: 98149 - RNA, 22 nt, Human
aucugcuugaguuugaagucag

SEQ ID NO: 98150 - RNA, 22 nt, Human
aucugcuugcccucuuaggacc

SEQ ID NO: 98151 - RNA, 22 nt, Human
aucuggaacaaagcuuaggaau

SEQ ID NO: 98152 - RNA, 22 nt, Human
aucuggaagccagauacucagu

SEQ ID NO: 98153 - RNA, 22 nt, Human
aucuggaagucagagguuugca

SEQ ID NO: 98154 - RNA, 22 nt, Human
aucuggaauuaagagaaaguga

SEQ ID NO: 98155 - RNA, 22 nt, Human
aucuggacuagagcagaauggg

SEQ ID NO: 98156 - RNA, 22 nt, Human
aucuggagcucugcacaccugg

SEQ ID NO: 98157 - RNA, 22 nt, Human
aucuggagcuuguuagauguuu

SEQ ID NO: 98158 - RNA, 22 nt, Human
aucuggaguagaaaaaucgcuu

SEQ ID NO: 98159 - RNA, 22 nt, Human
aucuggagugggacacagaaau

SEQ ID NO: 98160 - RNA, 22 nt, Human
aagcugugccuuugccuagaau

SEQ ID NO: 98161 - RNA, 22 nt, Human
aagcuguguaaguugcuugguu

SEQ ID NO: 98162 - RNA, 22 nt, Human
aagcugugugacuauuucugag

SEQ ID NO: 98163 - RNA, 22 nt, Human
aagcugugugcagaugaucuca

SEQ ID NO: 98164 - RNA, 21 nt, Human
aagcuguguuccacugauagc

SEQ ID NO: 98165 - RNA, 22 nt, Human
aagcuguuguucauccugaauu

SEQ ID NO: 98166 - RNA, 22 nt, Human
aagcuucacauugaacuugggu

SEQ ID NO: 98167 - RNA, 22 nt, Human
aagcuuccugcaugggacugcu

SEQ ID NO: 98168 - RNA, 22 nt, Human
aagcuugaaucaauggauaucc

SEQ ID NO: 98169 - RNA, 22 nt, Human
aagcuuggaagucuuccuuuca

SEQ ID NO: 98170 - RNA, 21 nt, Human
aagcuuggcugauguuauugg

SEQ ID NO: 98171 - RNA, 22 nt, Human
aagcuuguagaguuugacuucc

SEQ ID NO: 98172 - RNA, 22 nt, Human
aagcuuugcaaugcuucauuau

SEQ ID NO: 98173 - RNA, 22 nt, Human
aagcuuuguucuucacagagug

SEQ ID NO: 98174 - RNA, 22 nt, Human
aaggaaacacugaacuuuguag

SEQ ID NO: 98175 - RNA, 22 nt, Human
aaggaaagaguaugcaccuugu

SEQ ID NO: 98176 - RNA, 22 nt, Human
aaggaaauacaacauguauuca

SEQ ID NO: 98177 - RNA, 22 nt, Human
aaggaaauacuucugcagagca

SEQ ID NO: 98178 - RNA, 22 nt, Human
aaggaaaugaagcugauguugg

SEQ ID NO: 98179 - RNA, 22 nt, Human
aaggaaaugugccugacacugc

SEQ ID NO: 98180 - RNA, 22 nt, Human
aaggaaauuagguuauuuugcu

SEQ ID NO: 98181 - RNA, 22 nt, Human
aaggaaccuggaguagagggag

SEQ ID NO: 98182 - RNA, 22 nt, Human
aaggaacuaacuauguagagau

SEQ ID NO: 98183 - RNA, 22 nt, Human
aaggaacuagcaugauguguag

SEQ ID NO: 98184 - RNA, 20 nt, Human
aaggaacucacccaugggcu

SEQ ID NO: 98185 - RNA, 22 nt, Human
aaggaacucuagagccuugaac

SEQ ID NO: 98186 - RNA, 22 nt, Human
aaggaacugcugauguggugac

SEQ ID NO: 98187 - RNA, 22 nt, Human
aaggaacuugccacagaaaaga

SEQ ID NO: 98188 - RNA, 22 nt, Human
aaggaagaagacucuuuacucc

SEQ ID NO: 98189 - RNA, 22 nt, Human
aaggaagaaucaucacguuggg

SEQ ID NO: 98190 - RNA, 22 nt, Human
aaggaagacucgcaggucuaug

SEQ ID NO: 98191 - RNA, 22 nt, Human
aaggaagacuugagaagguucc

SEQ ID NO: 98192 - RNA, 22 nt, Human
aaggaagaggcagguuuugcug

SEQ ID NO: 98193 - RNA, 22 nt, Human
aaggaagauauaucaagcuuaa

SEQ ID NO: 98194 - RNA, 22 nt, Human
aaggaagaugcuggccugggga

SEQ ID NO: 98195 - RNA, 22 nt, Human
aaggaagccuugccugaauaca

SEQ ID NO: 98196 - RNA, 18 nt, Human
aaggacacagucccugcu

SEQ ID NO: 98197 - RNA, 22 nt, Human
aaggacaggagaaaacgggauc

SEQ ID NO: 98198 - RNA, 22 nt, Human
aaggacagggaugguugauugu

SEQ ID NO: 98199 - RNA, 22 nt, Human
aaggacuaaugaauagaugaau

SEQ ID NO: 98200 - RNA, 22 nt, Human
aaggagagguuguccguguugu

SEQ ID NO: 98201 - RNA, 22 nt, Human
aaggagauuguuaaagcuauau

SEQ ID NO: 98202 - RNA, 22 nt, Human
aaggagcacacaaucuagaacc

SEQ ID NO: 98203 - RNA, 22 nt, Human
aaggagcucuuaaaaucagaga

SEQ ID NO: 98204 - RNA, 22 nt, Human
aaggaggaauucugaguucaug

SEQ ID NO: 98205 - RNA, 22 nt, Human
aaggaggacacccaggacuggg

SEQ ID NO: 98206 - RNA, 22 nt, Human
aaggaggcacccugagccugcc

SEQ ID NO: 98207 - RNA, 22 nt, Human
aaggaggcacucgcucucaggg

SEQ ID NO: 98208 - RNA, 22 nt, Human
aaggagggaaagcagugcuucu

SEQ ID NO: 98209 - RNA, 22 nt, Human
aaggagguuaucccaguggacu

SEQ ID NO: 98210 - RNA, 22 nt, Human
aaggauaaaaaccacuucuaau

SEQ ID NO: 98211 - RNA, 22 nt, Human
aaggaucauguauauguuuaag

SEQ ID NO: 98212 - RNA, 22 nt, Human
aaggaugugacucagucagcua

SEQ ID NO: 98213 - RNA, 22 nt, Human
aaggauguucuaguuugcugag

SEQ ID NO: 98214 - RNA, 22 nt, Human
aaggauuaguagguacaguuca

SEQ ID NO: 98215 - RNA, 22 nt, Human
aaggcaacuguaaaacaugcac

SEQ ID NO: 98216 - RNA, 22 nt, Human
aaggcaaugacugauuuagaau

SEQ ID NO: 98217 - RNA, 22 nt, Human
aaggcaaugagggagauagagu

SEQ ID NO: 98218 - RNA, 22 nt, Human
aaggcaaugucauggcucuugc

SEQ ID NO: 98219 - RNA, 22 nt, Human
aaggcaauuuggaagaggcaga

SEQ ID NO: 98220 - RNA, 22 nt, Human
aaggcaauuuguugugaggauu

SEQ ID NO: 98221 - RNA, 22 nt, Human
aaggcacagccacuugaucauc

SEQ ID NO: 98222 - RNA, 22 nt, Human
aaggcacauauuuuagagucac

SEQ ID NO: 98223 - RNA, 20 nt, Human
aaggcacuaugucugcuagc

SEQ ID NO: 98224 - RNA, 22 nt, Human
aaggcacugaacuuaaauucug

SEQ ID NO: 98225 - RNA, 22 nt, Human
aaggcacugcuuugcugcgccc

SEQ ID NO: 98226 - RNA, 22 nt, Human
aaggcacuguacuaguuaguua

SEQ ID NO: 98227 - RNA, 22 nt, Human
aaggcagaggaaggucuaguuu

SEQ ID NO: 98228 - RNA, 22 nt, Human
aaggcagcaacuaauggaucuc

SEQ ID NO: 98229 - RNA, 22 nt, Human
aaggcagcaccgccuccugaaa

SEQ ID NO: 98230 - RNA, 22 nt, Human
aaggcagccagauccuuugggu

SEQ ID NO: 98231 - RNA, 22 nt, Human
aaggcagcccuggcucagccug

SEQ ID NO: 98232 - RNA, 22 nt, Human
aaggcagccucugccagccggg

SEQ ID NO: 98233 - RNA, 22 nt, Human
aaggcagccuuuugaguugauu

SEQ ID NO: 98234 - RNA, 22 nt, Human
aaggcagcuucaccacagcauu

SEQ ID NO: 98235 - RNA, 22 nt, Human
aaggcaguaucuguagagugcu

SEQ ID NO: 98236 - RNA, 18 nt, Human
aaggcaguaugauugcac

SEQ ID NO: 98237 - RNA, 22 nt, Human
aaggcagucaguuguuuugaaa

SEQ ID NO: 98238 - RNA, 22 nt, Human
aaggcaguuaauuuggcuagaa

SEQ ID NO: 98239 - RNA, 22 nt, Human
aaggcaguucacucacgcagcc

SEQ ID NO: 98240 - RNA, 22 nt, Human
aaggcaguuugggccaccaucu

SEQ ID NO: 98241 - RNA, 22 nt, Human
aaggcauaggacaaaucaguga

SEQ ID NO: 98242 - RNA, 22 nt, Human
aaggcauuggacuaguaucaga

SEQ ID NO: 98243 - RNA, 22 nt, Human
aaggccaacuaggaugagcuag

SEQ ID NO: 98244 - RNA, 22 nt, Human
aaggccaaggcugcagugagcc

SEQ ID NO: 98245 - RNA, 22 nt, Human
aaggccacagagccucagagag

SEQ ID NO: 98246 - RNA, 22 nt, Human
aaggccacugaagaaaucacaa

SEQ ID NO: 98247 - RNA, 22 nt, Human
aaggccagccugagagcuaaca

SEQ ID NO: 98248 - RNA, 22 nt, Human
aaggccaggccuagcacggagg

SEQ ID NO: 98249 - RNA, 22 nt, Human
aaggccauacaaugaaaggggc

SEQ ID NO: 98250 - RNA, 22 nt, Human
aaggccaugaccacuugcugug

SEQ ID NO: 98251 - RNA, 22 nt, Human
aaggccaugcuugaguugaagg

SEQ ID NO: 98252 - RNA, 22 nt, Human
aaggccauguaggaggcaugcg

SEQ ID NO: 98253 - RNA, 22 nt, Human
aaggcccagccuggagcuuguu

SEQ ID NO: 98254 - RNA, 22 nt, Human
aaggcccuggccccagcuucuu

SEQ ID NO: 98255 - RNA, 22 nt, Human
aaggccucccucuuucauggga

SEQ ID NO: 98256 - RNA, 22 nt, Human
aaggccucuucucucuggagau

SEQ ID NO: 98257 - RNA, 22 nt, Human
aaggccugaacaugaggagaug

SEQ ID NO: 98258 - RNA, 22 nt, Human
aaggcgcugggcuaaggcacca

SEQ ID NO: 98259 - RNA, 22 nt, Human
aaggcuaaguaaggcucuuucu

SEQ ID NO: 98260 - RNA, 22 nt, Human
aaggcuaugaucuuuuucauga

SEQ ID NO: 98261 - RNA, 22 nt, Human
aaggcuauugggaagaaaaaug

SEQ ID NO: 98262 - RNA, 22 nt, Human
aaggcuccagugaaugcuggca

SEQ ID NO: 98263 - RNA, 22 nt, Human
aaggcuccgugacuggggcuga

SEQ ID NO: 98264 - RNA, 22 nt, Human
aaggcucuccaaaugauauaau

SEQ ID NO: 98265 - RNA, 22 nt, Human
aaggcugagacagcacaggucc

SEQ ID NO: 98266 - RNA, 22 nt, Human
aaggcugagagucacaguccua

SEQ ID NO: 98267 - RNA, 22 nt, Human
aaggcugaggcuggagaauuac

SEQ ID NO: 98268 - RNA, 22 nt, Human
aaggcugagguagggccuaaaa

SEQ ID NO: 98269 - RNA, 22 nt, Human
aagguuucuccgaggcuauuuu

SEQ ID NO: 98270 - RNA, 22 nt, Human
aaguaaaagcaggugugcuggg

SEQ ID NO: 98271 - RNA, 21 nt, Human
aaguaaaucagagaaauaacc

SEQ ID NO: 98272 - RNA, 22 nt, Human
aaguaaauguuggagcucaaau

SEQ ID NO: 98273 - RNA, 18 nt, Human
aaguaacagaagagcaca

SEQ ID NO: 98274 - RNA, 22 nt, Human
aaguaacaggcaugugaaugac

SEQ ID NO: 98275 - RNA, 22 nt, Human
aaguaacaggugcuuaguuuau

SEQ ID NO: 98276 - RNA, 22 nt, Human
aaguaaggcagugaaugagauu

SEQ ID NO: 98277 - RNA, 22 nt, Human
aaguaagugccuuuuauucuua

SEQ ID NO: 98278 - RNA, 22 nt, Human
aaguaaguuucucucuccaaga

SEQ ID NO: 98279 - RNA, 20 nt, Human
aaguaauauuuguguaacug

SEQ ID NO: 98280 - RNA, 22 nt, Human
aaguaaucuggaauuugguuuu

SEQ ID NO: 98281 - RNA, 22 nt, Human
aaguaaugguuaaauaauucua

SEQ ID NO: 98282 - RNA, 21 nt, Human
aaguaaugugucucuucuacc

SEQ ID NO: 98283 - RNA, 22 nt, Human
aaguacaaucuuucuguaaagg

SEQ ID NO: 98284 - RNA, 22 nt, Human
aaguacacaucguuggccccga

SEQ ID NO: 98285 - RNA, 22 nt, Human
aaguacagaaggagcgaacaau

SEQ ID NO: 98286 - RNA, 22 nt, Human
aaguacauuuuuaacuuacagc

SEQ ID NO: 98287 - RNA, 22 nt, Human
aaguaccaaguuuguuugacgc

SEQ ID NO: 98288 - RNA, 22 nt, Human
aaguaccucauaggguuauuuu

SEQ ID NO: 98289 - RNA, 22 nt, Human
aaguacuagaaauagcagugcc

SEQ ID NO: 98290 - RNA, 22 nt, Human
aaguacugacagagaagaauga

SEQ ID NO: 98291 - RNA, 22 nt, Human
aaguacuguaucacuuacuccu

SEQ ID NO: 98292 - RNA, 22 nt, Human
aagggcucacccaacucacuuc

SEQ ID NO: 98293 - RNA, 22 nt, Human
aagggcucgguagcaguccuga

SEQ ID NO: 98294 - RNA, 22 nt, Human
aagggcucugggcuacgcacug

SEQ ID NO: 98295 - RNA, 22 nt, Human
aagggcucuucuauuuauggcc

SEQ ID NO: 98296 - RNA, 22 nt, Human
aagggcugaaugaaggguugaa

SEQ ID NO: 98297 - RNA, 22 nt, Human
aagggcugagaaguggggcugg

SEQ ID NO: 98298 - RNA, 22 nt, Human
aagggcugcaauccaaaacacu

SEQ ID NO: 98299 - RNA, 22 nt, Human
aagggcugcauuugauguguca

SEQ ID NO: 98300 - RNA, 22 nt, Human
aagggcugccagggggugccag

SEQ ID NO: 98301 - RNA, 22 nt, Human
aagggcuggagacugggucuuc

SEQ ID NO: 98302 - RNA, 22 nt, Human
aagggcuguagacaagauugcu

SEQ ID NO: 98303 - RNA, 22 nt, Human
aaggggaaaaaguguuaggagu

SEQ ID NO: 98304 - RNA, 22 nt, Human
aagggggagagguguuuggaug

SEQ ID NO: 98305 - RNA, 22 nt, Human
aagggggcggcagccaguggaa

SEQ ID NO: 98306 - RNA, 19 nt, Human
aaggggugagggaagcaga

SEQ ID NO: 98307 - RNA, 23 nt, Human
aaggguccauagcuaucauuaca

SEQ ID NO: 98308 - RNA, 22 nt, Human
aagggugaagggugguggccua

SEQ ID NO: 98309 - RNA, 22 nt, Human
aagggugcaaagcacucuagcu

SEQ ID NO: 98310 - RNA, 22 nt, Human
aagggugcugcuaucaggaagc

SEQ ID NO: 98311 - RNA, 22 nt, Human
aagguaaucagccuuuccacaa

SEQ ID NO: 98312 - RNA, 22 nt, Human
aagguagauguugucaugccca

SEQ ID NO: 98313 - RNA, 22 nt, Human
aagguagauucuggaucgaagg

SEQ ID NO: 98314 - RNA, 21 nt, Human
aagguagcauggguugcagcc

SEQ ID NO: 98315 - RNA, 22 nt, Human
aagguagcuugcuuccugagua

SEQ ID NO: 98316 - RNA, 22 nt, Human
aagguauauguacaauagacau

SEQ ID NO: 98317 - RNA, 22 nt, Human
aagguauuuagugugaaagcua

SEQ ID NO: 98318 - RNA, 22 nt, Human
aaggucacugaucaguugagua

SEQ ID NO: 98319 - RNA, 22 nt, Human
aaggucauugguucugaauucu

SEQ ID NO: 98320 - RNA, 22 nt, Human
aaggucauuuaacaauuuauga

SEQ ID NO: 98321 - RNA, 20 nt, Human
aagguccaaacucuguguuc

SEQ ID NO: 98322 - RNA, 22 nt, Human
aagguccagaggucccgucacc

SEQ ID NO: 98323 - RNA, 22 nt, Human
aagguccaguggaaacuagagu

SEQ ID NO: 98324 - RNA, 22 nt, Human
aagguccaugacucggcauagu

SEQ ID NO: 98325 - RNA, 22 nt, Human
aaggucuaugaggccagaacau

SEQ ID NO: 98326 - RNA, 22 nt, Human
aaggucuguauuagaguuucau

SEQ ID NO: 98327 - RNA, 22 nt, Human
aaggugaagcucccgaugagaa

SEQ ID NO: 98328 - RNA, 17 nt, Human
aaggugagagcuguucu

SEQ ID NO: 98329 - RNA, 22 nt, Human
aagguggauguaagcggcaaug

SEQ ID NO: 98330 - RNA, 22 nt, Human
aaggugguaggcuauaucagua

SEQ ID NO: 98331 - RNA, 22 nt, Human
aaggugguugcaauuaccauaa

SEQ ID NO: 98332 - RNA, 22 nt, Human
aaggugucaccagauuggcagg

SEQ ID NO: 98333 - RNA, 22 nt, Human
aaggugucggguuagcucagcc

SEQ ID NO: 98334 - RNA, 22 nt, Human
aaggugucucucugcuucuugg

SEQ ID NO: 98335 - RNA, 22 nt, Human
aagguguggaguggugcgacug

SEQ ID NO: 98336 - RNA, 22 nt, Human
aagguguuauagcugaggaaua

SEQ ID NO: 98337 - RNA, 22 nt, Human
aagguguucagguuuucccauu

SEQ ID NO: 98338 - RNA, 22 nt, Human
aagguuaaauagguauuuucca

SEQ ID NO: 98339 - RNA, 22 nt, Human
aagguuagugcaucuuuuguuu

SEQ ID NO: 98340 - RNA, 22 nt, Human
aagguuaguuuucaauaauuac

SEQ ID NO: 98341 - RNA, 22 nt, Human
aagguucccucucuggaagccu

SEQ ID NO: 98342 - RNA, 22 nt, Human
aagguuuaaggucuauaaaugu

SEQ ID NO: 98343 - RNA, 22 nt, Human
aaguaaaauucaaucuucacug

SEQ ID NO: 98344 - RNA, 22 nt, Human
aaguaaacucaguggucauuca

SEQ ID NO: 98345 - RNA, 22 nt, Human
aaguaaacuuacacauaguaaa

SEQ ID NO: 98346 - RNA, 22 nt, Human
aaguaacagaggggguguugcu

SEQ ID NO: 98347 - RNA, 22 nt, Human
aaguaacaucugaacaugaugu

SEQ ID NO: 98348 - RNA, 22 nt, Human
aaguaacaugggaacaucugaa

SEQ ID NO: 98349 - RNA, 22 nt, Human
aaguaacuuauuugcaaacagg

SEQ ID NO: 98350 - RNA, 22 nt, Human
aaguaagucuuacauucacauu

SEQ ID NO: 98351 - RNA, 22 nt, Human
aaguacaacgcauacagagaaa

SEQ ID NO: 98352 - RNA, 22 nt, Human
aaguacagccagcacccagacu

SEQ ID NO: 98353 - RNA, 22 nt, Human
aaguacauaaaggaauuagcca

SEQ ID NO: 98354 - RNA, 22 nt, Human
aaguacuugauagauuaacugu

SEQ ID NO: 98355 - RNA, 22 nt, Human
aaguagacagucaucuacuuug

SEQ ID NO: 98356 - RNA, 18 nt, Human
aaguagaucaugagccac

SEQ ID NO: 98357 - RNA, 22 nt, Human
aaguagaugaucuuucugcaua

SEQ ID NO: 98358 - RNA, 22 nt, Human
aaguagcaaucucauuaguugg

SEQ ID NO: 98359 - RNA, 22 nt, Human
aaguagcauuuucaaaauguau

SEQ ID NO: 98360 - RNA, 22 nt, Human
aaguaguuaggaacauucucuc

SEQ ID NO: 98361 - RNA, 22 nt, Human
aaguaguuggaaauaagacaga

SEQ ID NO: 98362 - RNA, 20 nt, Human
aaguauauguccguguacuu

SEQ ID NO: 98363 - RNA, 22 nt, Human
aaguaucaaaugguagcauaug

SEQ ID NO: 98364 - RNA, 22 nt, Human
aaguaucucaaaaacaguaauc

SEQ ID NO: 98365 - RNA, 22 nt, Human
aaguauucauaaggacauaugu

SEQ ID NO: 98366 - RNA, 22 nt, Human
aaguauuucagcgguucuuugu

SEQ ID NO: 98367 - RNA, 22 nt, Human
aaguauuucuggccugugaaag

SEQ ID NO: 98368 - RNA, 22 nt, Human
aagucaaagcuuucagaggaaa

SEQ ID NO: 98369 - RNA, 22 nt, Human
aagucaaucaaggguguaggca

SEQ ID NO: 98370 - RNA, 22 nt, Human
aagucaauuuauguucucagac

SEQ ID NO: 98371 - RNA, 22 nt, Human
aagucacccuagggccuggacu

SEQ ID NO: 98372 - RNA, 20 nt, Human
aagucacuuaagaugggcag

SEQ ID NO: 98373 - RNA, 22 nt, Human
aagucacuucuuaggaaaggag

SEQ ID NO: 98374 - RNA, 23 nt, Human
aagucagagccaagucaaugaga

SEQ ID NO: 98375 - RNA, 22 nt, Human
aagucaggacuuaugcuaccug

SEQ ID NO: 98376 - RNA, 22 nt, Human
aagucaggcuggggucuggcag

SEQ ID NO: 98377 - RNA, 22 nt, Human
aagucagugcuagcuaauggcu

SEQ ID NO: 98378 - RNA, 22 nt, Human
aaucagaaaauucaguggaauu

SEQ ID NO: 98379 - RNA, 20 nt, Human
aaucagaaagugugagcucu

SEQ ID NO: 98380 - RNA, 19 nt, Human
aaucagaaauaucgaggcc

SEQ ID NO: 98381 - RNA, 22 nt, Human
aaucagaaccuugggucauaac

SEQ ID NO: 98382 - RNA, 22 nt, Human
aaucagaacuucucaggguggg

SEQ ID NO: 98383 - RNA, 22 nt, Human
aaucagaccguucuggcugucc

SEQ ID NO: 98384 - RNA, 22 nt, Human
aaucagacuauuaaagucucuu

SEQ ID NO: 98385 - RNA, 22 nt, Human
aaucagagucccaagaucugua

SEQ ID NO: 98386 - RNA, 22 nt, Human
aaucagcaggcuucuaaauuuu

SEQ ID NO: 98387 - RNA, 22 nt, Human
aaucagcaguuggaauuagaua

SEQ ID NO: 98388 - RNA, 22 nt, Human
aaucaggagcugagguuuagcc

SEQ ID NO: 98389 - RNA, 22 nt, Human
aaucaggaggaagccuugggca

SEQ ID NO: 98390 - RNA, 22 nt, Human
aaucaggauaugaacccaggua

SEQ ID NO: 98391 - RNA, 22 nt, Human
aaucaggcacagcgacugcagc

SEQ ID NO: 98392 - RNA, 22 nt, Human
aaucagucauuagcucugaccu

SEQ ID NO: 98393 - RNA, 23 nt, Human
aaucagugcaguuuuaugccaag

SEQ ID NO: 98394 - RNA, 22 nt, Human
aaucagugguucccagcccagg

SEQ ID NO: 98395 - RNA, 22 nt, Human
aaucaguguggugacuugucug

SEQ ID NO: 98396 - RNA, 22 nt, Human
aaucaguuucuuggcaaguuua

SEQ ID NO: 98397 - RNA, 22 nt, Human
aaucaugaaauaucaguucuuu

SEQ ID NO: 98398 - RNA, 22 nt, Human
aaucauguuucagaugaguuuu

SEQ ID NO: 98399 - RNA, 22 nt, Human
aauccacacaucuggcauguga

SEQ ID NO: 98400 - RNA, 22 nt, Human
aauccacgagcaguagguaauu

SEQ ID NO: 98401 - RNA, 19 nt, Human
aauccaggauaagccccuu

SEQ ID NO: 98402 - RNA, 22 nt, Human
aauccauuuaccuuugcuugaa

SEQ ID NO: 98403 - RNA, 22 nt, Human
aaucccuacuagagcauaccgu

SEQ ID NO: 98404 - RNA, 22 nt, Human
aaucccuucccuucucugggac

SEQ ID NO: 98405 - RNA, 22 nt, Human
aauccuagaaauuuauuugaag

SEQ ID NO: 98406 - RNA, 22 nt, Human
aauccuggaaugaguuugcuga

SEQ ID NO: 98407 - RNA, 22 nt, Human
aauccuggcaugugccuuggga

SEQ ID NO: 98408 - RNA, 22 nt, Human
aauccuggccuagcugggcuca

SEQ ID NO: 98409 - RNA, 22 nt, Human
aauccugugugacucuggggag

SEQ ID NO: 98410 - RNA, 22 nt, Human
aaucgaaagcugagggagcauu

SEQ ID NO: 98411 - RNA, 22 nt, Human
aaucgguugaacccaggaagug

SEQ ID NO: 98412 - RNA, 22 nt, Human
aaucuacauagagaucaaauga

SEQ ID NO: 98413 - RNA, 23 nt, Human
aaucuagaaugaccuacucaucu

SEQ ID NO: 98414 - RNA, 22 nt, Human
aaucuagaauuuuagggguaua

SEQ ID NO: 98415 - RNA, 22 nt, Human
aaucuagagacaauuugaauau

SEQ ID NO: 98416 - RNA, 22 nt, Human
aaucuagucuccuuaagucuuu

SEQ ID NO: 98417 - RNA, 22 nt, Human
aaucuaguuuaauauguuuaaa

SEQ ID NO: 98418 - RNA, 22 nt, Human
aaucuauaugcuuuucacauac

SEQ ID NO: 98419 - RNA, 22 nt, Human
aaucuauucccuuucuguaaaa

SEQ ID NO: 98420 - RNA, 22 nt, Human
aaucucaaagauggccagaaga

SEQ ID NO: 98421 - RNA, 22 nt, Human
aaucucaagcuguaaauaccuc

SEQ ID NO: 98422 - RNA, 22 nt, Human
aaucucagaaacugguggauuu

SEQ ID NO: 98423 - RNA, 22 nt, Human
aaucucagagauaucugugucc

SEQ ID NO: 98424 - RNA, 20 nt, Human
aaucucaguauccuaugcaa

SEQ ID NO: 98425 - RNA, 22 nt, Human
aaucucaugagcuucuuguccc

SEQ ID NO: 98426 - RNA, 22 nt, Human
aaucucuuguauuuccuuugac

SEQ ID NO: 98427 - RNA, 22 nt, Human
aaucaggaacucaagugcauug

SEQ ID NO: 98428 - RNA, 22 nt, Human
aaucaggacccacucuacaguu

SEQ ID NO: 98429 - RNA, 22 nt, Human
aaucaggagagcugcgaacguu

SEQ ID NO: 98430 - RNA, 22 nt, Human
aaucaggauagaaccucacgug

SEQ ID NO: 98431 - RNA, 22 nt, Human
aaucaguguguaaaguggcugc

SEQ ID NO: 98432 - RNA, 22 nt, Human
aaucaguuaaauauugaguaca

SEQ ID NO: 98433 - RNA, 22 nt, Human
aaucaguuaggguguuaaugag

SEQ ID NO: 98434 - RNA, 22 nt, Human
aaucaguucuacaucuuaucca

SEQ ID NO: 98435 - RNA, 22 nt, Human
aaucaguuguccaaaguucaca

SEQ ID NO: 98436 - RNA, 22 nt, Human
aaucauaauuguauacauucau

SEQ ID NO: 98437 - RNA, 22 nt, Human
aaucauaauuuugugaauguag

SEQ ID NO: 98438 - RNA, 22 nt, Human
aaucaucccaacugagaauccc

SEQ ID NO: 98439 - RNA, 22 nt, Human
aaucaucuccgaaaaaagagua

SEQ ID NO: 98440 - RNA, 22 nt, Human
aaucaucuucaucuuacacaga

SEQ ID NO: 98441 - RNA, 22 nt, Human
aaucauguacugcuguggcuuu

SEQ ID NO: 98442 - RNA, 22 nt, Human
aaucauguccaucuuaacuuuc

SEQ ID NO: 98443 - RNA, 22 nt, Human
aaucauguuuacgugacauguc

SEQ ID NO: 98444 - RNA, 22 nt, Human
aaucauucucaugccaguuucc

SEQ ID NO: 98445 - RNA, 22 nt, Human
aaucauugagacaaauuagcuu

SEQ ID NO: 98446 - RNA, 22 nt, Human
aaucauugcuccuuucucuggu

SEQ ID NO: 98447 - RNA, 22 nt, Human
aauccacgggauuauucuaacu

SEQ ID NO: 98448 - RNA, 22 nt, Human
aauccagaugagcaaucauacu

SEQ ID NO: 98449 - RNA, 22 nt, Human
aauccagcacauggacacaguc

SEQ ID NO: 98450 - RNA, 22 nt, Human
aauccaggguguggccuuucca

SEQ ID NO: 98451 - RNA, 22 nt, Human
aauccaucucuccgagaaguuu

SEQ ID NO: 98452 - RNA, 22 nt, Human
aauccaugaagugaacaaucug

SEQ ID NO: 98453 - RNA, 22 nt, Human
aauccauuaaaaacaagcgcau

SEQ ID NO: 98454 - RNA, 22 nt, Human
aauccauugcugugcugccagg

SEQ ID NO: 98455 - RNA, 22 nt, Human
aauccauuuacucuuuacaaga

SEQ ID NO: 98456 - RNA, 22 nt, Human
aaucccagcuacucaggaaguu

SEQ ID NO: 98457 - RNA, 22 nt, Human
aauccuggaauacaagagugaa

SEQ ID NO: 98458 - RNA, 22 nt, Human
aauccuggcugcguuggccagc

SEQ ID NO: 98459 - RNA, 22 nt, Human
aaucgcaauuacuuuugcacca

SEQ ID NO: 98460 - RNA, 22 nt, Human
aaucuaagccaccaguaguuuc

SEQ ID NO: 98461 - RNA, 22 nt, Human
aaucuaagggaaauuggagaug

SEQ ID NO: 98462 - RNA, 19 nt, Human
aaucuagaaauauguguuc

SEQ ID NO: 98463 - RNA, 22 nt, Human
aaucuagagugcuaggucugug

SEQ ID NO: 98464 - RNA, 22 nt, Human
aaucuagauucggaucaaaggg

SEQ ID NO: 98465 - RNA, 23 nt, Human
aaucuauacuuaggcugguaaua

SEQ ID NO: 98466 - RNA, 22 nt, Human
aaucucacauagcuaggaguag

SEQ ID NO: 98467 - RNA, 22 nt, Human
aaucucagcucaugcaauucca

SEQ ID NO: 98468 - RNA, 22 nt, Human
aaucucuucccaguaaaaaugg

SEQ ID NO: 98469 - RNA, 22 nt, Human
aaucucuugggaggaaugaauu

SEQ ID NO: 98470 - RNA, 20 nt, Human
aaucugaaucccaguccuag

SEQ ID NO: 98471 - RNA, 22 nt, Human
aaucugcacccacugaaaaugc

SEQ ID NO: 98472 - RNA, 22 nt, Human
aaucugcuuuugucauuuauga

SEQ ID NO: 98473 - RNA, 22 nt, Human
aaucuggaguuaauguuuucgc

SEQ ID NO: 98474 - RNA, 22 nt, Human
aaucuggcucagaagaagauga

SEQ ID NO: 98475 - RNA, 22 nt, Human
aaucugguuugacaacuuuugu

SEQ ID NO: 98476 - RNA, 22 nt, Human
aaucuguagggaacaacuguac

SEQ ID NO: 98477 - RNA, 22 nt, Human
aaucuguauuguuaacaaguaa

SEQ ID NO: 98478 - RNA, 22 nt, Human
aaucugucccuuaacuagucau

SEQ ID NO: 98479 - RNA, 22 nt, Human
aaucugugcucccugcauuugu

SEQ ID NO: 98480 - RNA, 22 nt, Human
aaucuguugaugcaaaccuccc

SEQ ID NO: 98481 - RNA, 22 nt, Human
aaucuguugucaggaauccaca

SEQ ID NO: 98482 - RNA, 22 nt, Human
aaucuguuuuaaaguuugugcc

SEQ ID NO: 98483 - RNA, 22 nt, Human
aaucuucaaaauguucugcuug

SEQ ID NO: 98484 - RNA, 22 nt, Human
aaucuucagcacuccagagacu

SEQ ID NO: 98485 - RNA, 22 nt, Human
aaucuucagugucuaaaaagca

SEQ ID NO: 98486 - RNA, 22 nt, Human
aaucuucauuuugacaagauuc

SEQ ID NO: 98487 - RNA, 22 nt, Human
aaugaugaguucuaauagaccc

SEQ ID NO: 98488 - RNA, 22 nt, Human
aaugauggauuuagacaagcug

SEQ ID NO: 98489 - RNA, 22 nt, Human
aaugaugguauugaugagcuaa

SEQ ID NO: 98490 - RNA, 22 nt, Human
aaugauugcaaacauugagaac

SEQ ID NO: 98491 - RNA, 22 nt, Human
aaugcaaauuaucaggcuucuc

SEQ ID NO: 98492 - RNA, 22 nt, Human
aaugcaaugcagcaccuccuug

SEQ ID NO: 98493 - RNA, 22 nt, Human
aaugcacaaaaauuguauguaa

SEQ ID NO: 98494 - RNA, 22 nt, Human
aaugcacacauuugguacugaa

SEQ ID NO: 98495 - RNA, 22 nt, Human
aaugcacagcuaaagugguucc

SEQ ID NO: 98496 - RNA, 22 nt, Human
aaugcaccuuggcagggauuca

SEQ ID NO: 98497 - RNA, 22 nt, Human
aaugcagaccaguaugaaaaac

SEQ ID NO: 98498 - RNA, 22 nt, Human
aaugcagaguaaauauuuaauu

SEQ ID NO: 98499 - RNA, 22 nt, Human
aaugcaggcacgugcaagcaag

SEQ ID NO: 98500 - RNA, 22 nt, Human
aaugcagugagccauuaaaugg

SEQ ID NO: 98501 - RNA, 21 nt, Human
aaugcauuaacauaaagcuga

SEQ ID NO: 98502 - RNA, 22 nt, Human
aaugcauuagcuacauaugucu

SEQ ID NO: 98503 - RNA, 22 nt, Human
aaugcauuguugauuuggagug

SEQ ID NO: 98504 - RNA, 22 nt, Human
aaugccaacuuggauauacauu

SEQ ID NO: 98505 - RNA, 22 nt, Human
aaugccaaugggcagaacuaga

SEQ ID NO: 98506 - RNA, 22 nt, Human
aaugccacuaaaucugugaaua

SEQ ID NO: 98507 - RNA, 22 nt, Human
aaugccaguguguugauuccag

SEQ ID NO: 98508 - RNA, 22 nt, Human
aaugccaucagagaaaacucuu

SEQ ID NO: 98509 - RNA, 22 nt, Human
aaugcuauucauuaagccuacu

SEQ ID NO: 98510 - RNA, 18 nt, Human
aaugcuauuguuauaggg

SEQ ID NO: 98511 - RNA, 22 nt, Human
aaugcucuuuaaccuauucuga

SEQ ID NO: 98512 - RNA, 22 nt, Human
aaugcucuuugaauuugucaga

SEQ ID NO: 98513 - RNA, 22 nt, Human
aaugcugcaagaggugaaaaga

SEQ ID NO: 98514 - RNA, 19 nt, Human
aaugcugcuucuuuuugca

SEQ ID NO: 98515 - RNA, 22 nt, Human
aaugcuguaaagaugcuaucug

SEQ ID NO: 98516 - RNA, 22 nt, Human
aaugcugucuuagcaugaaagc

SEQ ID NO: 98517 - RNA, 19 nt, Human
aaugcuuaggacagugccu

SEQ ID NO: 98518 - RNA, 22 nt, Human
aaugcuuauaccuaaugaucuu

SEQ ID NO: 98519 - RNA, 22 nt, Human
aaugcuuccuccucaccucagg

SEQ ID NO: 98520 - RNA, 22 nt, Human
aauggaaccuaguuauccacau

SEQ ID NO: 98521 - RNA, 22 nt, Human
aauggacaggagagcauaguca

SEQ ID NO: 98522 - RNA, 19 nt, Human
aauggacaggcaauagucu

SEQ ID NO: 98523 - RNA, 22 nt, Human
aauggagacugacacaaagaua

SEQ ID NO: 98524 - RNA, 22 nt, Human
aauggaggugucuggccuggua

SEQ ID NO: 98525 - RNA, 22 nt, Human
aauggcaaaguguuuucauacc

SEQ ID NO: 98526 - RNA, 22 nt, Human
aauggcaauucagugaaauuau

SEQ ID NO: 98527 - RNA, 22 nt, Human
aauggcacuuuauaaauguuaa

SEQ ID NO: 98528 - RNA, 22 nt, Human
aauggcaugggaaaugcagugg

SEQ ID NO: 98529 - RNA, 22 nt, Human
aauggcuguucucugugauugg

SEQ ID NO: 98530 - RNA, 21 nt, Human
aauggcuuauacagaaguaag

SEQ ID NO: 98531 - RNA, 20 nt, Human
aauggcuuauagcaugcuac

SEQ ID NO: 98532 - RNA, 22 nt, Human
aauggcuuuaaguagucucaca

SEQ ID NO: 98533 - RNA, 22 nt, Human
aaugggaaaagaguaugauuua

SEQ ID NO: 98534 - RNA, 22 nt, Human
aaugggaagccagaagacaagg

SEQ ID NO: 98535 - RNA, 22 nt, Human
aaugggauaauagaaguagaau

SEQ ID NO: 98536 - RNA, 22 nt, Human
aaugggauuaagaaagaucuug

SEQ ID NO: 98537 - RNA, 22 nt, Human
aaugggcuuucuuggacaggag

SEQ ID NO: 98538 - RNA, 22 nt, Human
aaugggcuuuggccaguaggag

SEQ ID NO: 98539 - RNA, 23 nt, Human
aaugggugcaacuauccaugaca

SEQ ID NO: 98540 - RNA, 22 nt, Human
aauggguugaacaucaaggucu

SEQ ID NO: 98541 - RNA, 22 nt, Human
aauggguuucugucccagcucu

SEQ ID NO: 98542 - RNA, 22 nt, Human
aaugcauguuuccucucagcag

SEQ ID NO: 98543 - RNA, 22 nt, Human
aaugcauuaaaguuagagacuu

SEQ ID NO: 98544 - RNA, 22 nt, Human
aaugcauucucgguuugugugu

SEQ ID NO: 98545 - RNA, 22 nt, Human
aaugcauugauugcuggaaaua

SEQ ID NO: 98546 - RNA, 22 nt, Human
aaugcauuuuauuauaugugac

SEQ ID NO: 98547 - RNA, 22 nt, Human
aaugccaucccucugucaccaa

SEQ ID NO: 98548 - RNA, 22 nt, Human
aaugccaucuggugauguauua

SEQ ID NO: 98549 - RNA, 22 nt, Human
aaugccauuccaucacacaccu

SEQ ID NO: 98550 - RNA, 19 nt, Human
aaugccucaaauugggaga

SEQ ID NO: 98551 - RNA, 22 nt, Human
aaugccuugccugcuacaacuu

SEQ ID NO: 98552 - RNA, 22 nt, Human
aaugccuuggagagccuagagg

SEQ ID NO: 98553 - RNA, 22 nt, Human
aaugcuaaaacacagauuuuug

SEQ ID NO: 98554 - RNA, 22 nt, Human
aaugcuacagaagugaucuugg

SEQ ID NO: 98555 - RNA, 22 nt, Human
aaugcugaauuuaguauuuaug

SEQ ID NO: 98556 - RNA, 22 nt, Human
aaugcugagggaugagagaggc

SEQ ID NO: 98557 - RNA, 22 nt, Human
aaugcugcucucauaauuauag

SEQ ID NO: 98558 - RNA, 20 nt, Human
aaugcugcuucuuuuugcau

SEQ ID NO: 98559 - RNA, 23 nt, Human
aaugcuggaaauucaggcaugau

SEQ ID NO: 98560 - RNA, 22 nt, Human
aaugcuguauaucuuagcuaau

SEQ ID NO: 98561 - RNA, 22 nt, Human
aaugcuguccaauaggaacaua

SEQ ID NO: 98562 - RNA, 22 nt, Human
aaugcugucuuuucuacuucau

SEQ ID NO: 98563 - RNA, 22 nt, Human
aaugcugugauuuauuaaguau

SEQ ID NO: 98564 - RNA, 22 nt, Human
aaugcuguugaguuguuccugu

SEQ ID NO: 98565 - RNA, 22 nt, Human
aaugcuuauaacguuagaaugu

SEQ ID NO: 98566 - RNA, 22 nt, Human
aaugcuuauggguuccauaaua

SEQ ID NO: 98567 - RNA, 22 nt, Human
aaugcuuauuauuaauagaaug

SEQ ID NO: 98568 - RNA, 22 nt, Human
aaugcuuuaauugcauguagug

SEQ ID NO: 98569 - RNA, 22 nt, Human
aaugcuuuagcagugauuagug

SEQ ID NO: 98570 - RNA, 22 nt, Human
aaugcuuucaaaaaugugcagu

SEQ ID NO: 98571 - RNA, 22 nt, Human
aaugcuuugagggaagaugaaa

SEQ ID NO: 98572 - RNA, 22 nt, Human
aaugcuuugauugauuaaaaca

SEQ ID NO: 98573 - RNA, 22 nt, Human
aaugcuuugccaacagcuauug

SEQ ID NO: 98574 - RNA, 22 nt, Human
aaugcuuuugcugucauugcuu

SEQ ID NO: 98575 - RNA, 22 nt, Human
aaugcuuuuugcgaaaugugca

SEQ ID NO: 98576 - RNA, 22 nt, Human
aauggacaaacuugggaaguau

SEQ ID NO: 98577 - RNA, 22 nt, Human
aauggagacccuaaggaagagg

SEQ ID NO: 98578 - RNA, 22 nt, Human
aauggcaaaaggaguuaguuga

SEQ ID NO: 98579 - RNA, 22 nt, Human
aauggcacaagaguaaacuguu

SEQ ID NO: 98580 - RNA, 22 nt, Human
aauggcaccugcuauauacuga

SEQ ID NO: 98581 - RNA, 22 nt, Human
aauggcaccuucaagaagaaaa

SEQ ID NO: 98582 - RNA, 22 nt, Human
aauggcagagacuguugaaaua

SEQ ID NO: 98583 - RNA, 22 nt, Human
aauggcaguaguugcaugagag

SEQ ID NO: 98584 - RNA, 22 nt, Human
aauggccagcaacaggagugaa

SEQ ID NO: 98585 - RNA, 22 nt, Human
aauggccauaucauugcagagc

SEQ ID NO: 98586 - RNA, 22 nt, Human
aauggcugccagggcaggaggu

SEQ ID NO: 98587 - RNA, 22 nt, Human
aauggcuuaaguauaagugaga

SEQ ID NO: 98588 - RNA, 22 nt, Human
aauggcuuagcucagcgcucag

SEQ ID NO: 98589 - RNA, 22 nt, Human
aauggcuuagugcuucacuucu

SEQ ID NO: 98590 - RNA, 22 nt, Human
aauggcuucaugucuguggaaa

SEQ ID NO: 98591 - RNA, 22 nt, Human
aauggcuucugaagcacacuuu

SEQ ID NO: 98592 - RNA, 22 nt, Human
aauggcuuuaggaauccagugc

SEQ ID NO: 98593 - RNA, 22 nt, Human
aauggcuuugaguauuuucugg

SEQ ID NO: 98594 - RNA, 22 nt, Human
aauggcuuuuaaaaauagcauu

SEQ ID NO: 98595 - RNA, 22 nt, Human
aaugggaaagagacuagaugcu

SEQ ID NO: 98596 - RNA, 22 nt, Human
aauuccaagagcuuccuaagug

SEQ ID NO: 98597 - RNA, 22 nt, Human
aauuccacagcugcacagaggu

SEQ ID NO: 98598 - RNA, 22 nt, Human
aauuccagccucaguucuauua

SEQ ID NO: 98599 - RNA, 22 nt, Human
aauuccagcugauugacuuucc

SEQ ID NO: 98600 - RNA, 22 nt, Human
aauuccaggcagaaaugugagu

SEQ ID NO: 98601 - RNA, 22 nt, Human
aauuccaggggguaccauucau

SEQ ID NO: 98602 - RNA, 22 nt, Human
aauuccagucucugcucuauuu

SEQ ID NO: 98603 - RNA, 22 nt, Human
aauucccaccuucucucuuuug

SEQ ID NO: 98604 - RNA, 21 nt, Human
aauucguuugcaacacugaua

SEQ ID NO: 98605 - RNA, 22 nt, Human
aauucuagcauugugaaaauau

SEQ ID NO: 98606 - RNA, 22 nt, Human
aauucuauguucuugaguaaga

SEQ ID NO: 98607 - RNA, 22 nt, Human
aauucucuccaggguaacauca

SEQ ID NO: 98608 - RNA, 22 nt, Human
aauucugcauaagguggcucug

SEQ ID NO: 98609 - RNA, 22 nt, Human
aauucugcucuuaacauaaugu

SEQ ID NO: 98610 - RNA, 22 nt, Human
aauucugcuucaucagcucuuu

SEQ ID NO: 98611 - RNA, 22 nt, Human
aauucuguaaagcuugucaugc

SEQ ID NO: 98612 - RNA, 22 nt, Human
aauucuguaacuuuacugaauu

SEQ ID NO: 98613 - RNA, 22 nt, Human
aauugaaaauauuguagaccau

SEQ ID NO: 98614 - RNA, 22 nt, Human
aauugagugcuagacaucauga

SEQ ID NO: 98615 - RNA, 22 nt, Human
aauugaugauucuuaugugaaa

SEQ ID NO: 98616 - RNA, 22 nt, Human
aauugauggacagagaugaaga

SEQ ID NO: 98617 - RNA, 22 nt, Human
aauugcacuuuagcaaugguga

SEQ ID NO: 98618 - RNA, 22 nt, Human
aauugcauaaaauucaacucug

SEQ ID NO: 98619 - RNA, 22 nt, Human
aauugcccgcacauugagaggu

SEQ ID NO: 98620 - RNA, 19 nt, Human
aauugccugucucugccag

SEQ ID NO: 98621 - RNA, 22 nt, Human
aauugcuucauuaacauuuagg

SEQ ID NO: 98622 - RNA, 22 nt, Human
aauugcuugucuucuucccuac

SEQ ID NO: 98623 - RNA, 22 nt, Human
aauugcuuguuucuuuaacuga

SEQ ID NO: 98624 - RNA, 22 nt, Human
aauugcuuguuuucggucauaa

SEQ ID NO: 98625 - RNA, 22 nt, Human
aauugcuuuaguuaccauagug

SEQ ID NO: 98626 - RNA, 22 nt, Human
aauugcuuuuauuuagggccag

SEQ ID NO: 98627 - RNA, 22 nt, Human
aauugcuuuucaaggguacagc

SEQ ID NO: 98628 - RNA, 22 nt, Human
aauuggaaaaagacuuaauugc

SEQ ID NO: 98629 - RNA, 22 nt, Human
aauuggaagaauugauuugcuu

SEQ ID NO: 98630 - RNA, 22 nt, Human
aauuggcaagcagauuuccacu

SEQ ID NO: 98631 - RNA, 22 nt, Human
aauuggcuuugagaaguuugag

SEQ ID NO: 98632 - RNA, 22 nt, Human
aauuggcuuugugguuucugca

SEQ ID NO: 98633 - RNA, 22 nt, Human
aauugucaaacacaaauaagag

SEQ ID NO: 98634 - RNA, 22 nt, Human
aauugugcauuuuuaaaucacg

SEQ ID NO: 98635 - RNA, 22 nt, Human
aauuuaacugagaguacuuuua

SEQ ID NO: 98636 - RNA, 22 nt, Human
aauuuaagaacauuucaggacu

SEQ ID NO: 98637 - RNA, 22 nt, Human
aauuuaaggaggccuucacucu

SEQ ID NO: 98638 - RNA, 20 nt, Human
aauuuacucacagaaugaau

SEQ ID NO: 98639 - RNA, 22 nt, Human
aauuuagaauucgcuagcuaau

SEQ ID NO: 98640 - RNA, 22 nt, Human
aauuuaguguaaagcuacugga

SEQ ID NO: 98641 - RNA, 23 nt, Human
aauuuaguuugagacauuagccu

SEQ ID NO: 98642 - RNA, 22 nt, Human
aauuuauaauaaauagggcuuu

SEQ ID NO: 98643 - RNA, 22 nt, Human
aauuuauucccgucucugggcu

SEQ ID NO: 98644 - RNA, 22 nt, Human
aauuuauuuccugccaguacac

SEQ ID NO: 98645 - RNA, 22 nt, Human
aauuucaaacucuugcccucag

SEQ ID NO: 98646 - RNA, 22 nt, Human
aauuucaaguggcaucuuugau

SEQ ID NO: 98647 - RNA, 22 nt, Human
aauuucaaugcacucaugguug

SEQ ID NO: 98648 - RNA, 22 nt, Human
aauuucacauaaggcucauugg

SEQ ID NO: 98649 - RNA, 22 nt, Human
aauuucaccuaucacuuaagcc

SEQ ID NO: 98650 - RNA, 22 nt, Human
aauuucagaugucauaaauaua

SEQ ID NO: 98651 - RNA, 18 nt, Human
aauuuccauaugaauugc

SEQ ID NO: 98652 - RNA, 22 nt, Human
aauuucucacucucuugaucac

SEQ ID NO: 98653 - RNA, 22 nt, Human
aauuucucauggauucaguuau

SEQ ID NO: 98654 - RNA, 22 nt, Human
aauuugacccaucuuggaauuu

SEQ ID NO: 98655 - RNA, 22 nt, Human
aauuuggaagauguuguuuauc

SEQ ID NO: 98656 - RNA, 22 nt, Human
aauuuggagagaaacaaguagg

SEQ ID NO: 98657 - RNA, 22 nt, Human
aauuuggagagagauuaauguu

SEQ ID NO: 98658 - RNA, 22 nt, Human
aauuuguuagcauacucuaguu

SEQ ID NO: 98659 - RNA, 22 nt, Human
aaugguaaauguaacagcauuc

SEQ ID NO: 98660 - RNA, 22 nt, Human
aauggucauuggugguuauugg

SEQ ID NO: 98661 - RNA, 22 nt, Human
aaugguuacagaaaugaaagua

SEQ ID NO: 98662 - RNA, 22 nt, Human
aaugguuugauggacaaaauga

SEQ ID NO: 98663 - RNA, 22 nt, Human
aaugguuuugucucaucaaugu

SEQ ID NO: 98664 - RNA, 22 nt, Human
aauguaaaauaucuuguacuug

SEQ ID NO: 98665 - RNA, 22 nt, Human
aauguaaagcucaggucaggag

SEQ ID NO: 98666 - RNA, 22 nt, Human
aauguacaaaccuucuuuguag

SEQ ID NO: 98667 - RNA, 22 nt, Human
aauguacaaggguuccaguuuu

SEQ ID NO: 98668 - RNA, 19 nt, Human
aauguaguguuaugucaac

SEQ ID NO: 98669 - RNA, 22 nt, Human
aauguauaaaguguuaauaacu

SEQ ID NO: 98670 - RNA, 22 nt, Human
aauguauaauauuuaaugcuuu

SEQ ID NO: 98671 - RNA, 23 nt, Human
aauguauguuaguaucuuagaga

SEQ ID NO: 98672 - RNA, 21 nt, Human
aauguauguuuaucucacagu

SEQ ID NO: 98673 - RNA, 22 nt, Human
aauguauucucuuuauaagaua

SEQ ID NO: 98674 - RNA, 22 nt, Human
aauguauucuucaaccuugcua

SEQ ID NO: 98675 - RNA, 22 nt, Human
aaugucaaacagagcagagcua

SEQ ID NO: 98676 - RNA, 22 nt, Human
aaugucaacacuugguauguca

SEQ ID NO: 98677 - RNA, 22 nt, Human
aaugucaaguagccaaugcuuc

SEQ ID NO: 98678 - RNA, 22 nt, Human
aaugucaauaacuuuaucccuc

SEQ ID NO: 98679 - RNA, 22 nt, Human
aaugucaauuaccagaacagaa

SEQ ID NO: 98680 - RNA, 22 nt, Human
aaugucacucuguuuccucugc

SEQ ID NO: 98681 - RNA, 22 nt, Human
aaugucaguguuacugcuauug

SEQ ID NO: 98682 - RNA, 22 nt, Human
aaugucauagcauuucuucaau

SEQ ID NO: 98683 - RNA, 22 nt, Human
aaugucauauuaguuugugccu

SEQ ID NO: 98684 - RNA, 21 nt, Human
aaugucauugaauggugagac

SEQ ID NO: 98685 - RNA, 22 nt, Human
aaugucauuuaggauuauguuu

SEQ ID NO: 98686 - RNA, 22 nt, Human
aauguccaccgugaugauggaa

SEQ ID NO: 98687 - RNA, 22 nt, Human
aaugucuacagcaaaccccaca

SEQ ID NO: 98688 - RNA, 22 nt, Human
aaugucuacauucugaauucgu

SEQ ID NO: 98689 - RNA, 22 nt, Human
aaugucuagaguuuuaagcuua

SEQ ID NO: 98690 - RNA, 22 nt, Human
aaugucuauuugcuacaaagcc

SEQ ID NO: 98691 - RNA, 22 nt, Human
aaugucucaccguaaauguaac

SEQ ID NO: 98692 - RNA, 19 nt, Human
aaugucucuaucuguucuc

SEQ ID NO: 98693 - RNA, 22 nt, Human
aaugucucucuaaauaaacuuu

SEQ ID NO: 98694 - RNA, 22 nt, Human
aaugucugccugaacuuuauau

SEQ ID NO: 98695 - RNA, 22 nt, Human
aaugucugugccuuaaaacuuc

SEQ ID NO: 98696 - RNA, 22 nt, Human
aaugucuucaguguauacaugg

SEQ ID NO: 98697 - RNA, 22 nt, Human
aaugucuucucuuguugaauuu

SEQ ID NO: 98698 - RNA, 22 nt, Human
aaugucuugagaagagaaaucu

SEQ ID NO: 98699 - RNA, 20 nt, Human
aaugucuugagacauuucag

SEQ ID NO: 98700 - RNA, 22 nt, Human
aaugucuuucucauaacagaua

SEQ ID NO: 98701 - RNA, 22 nt, Human
aaugucuuucuguucuaugaga

SEQ ID NO: 98702 - RNA, 22 nt, Human
aauguggauccuuacagauacc

SEQ ID NO: 98703 - RNA, 22 nt, Human
aauguguagggugccuguuuuu

SEQ ID NO: 98704 - RNA, 22 nt, Human
aauguguauacuggcaauuaag

SEQ ID NO: 98705 - RNA, 22 nt, Human
aauuucucgguuuugauauugu

SEQ ID NO: 98706 - RNA, 22 nt, Human
aauuucucucucaugcuucaug

SEQ ID NO: 98707 - RNA, 22 nt, Human
aauuucuguaugaauagagaaa

SEQ ID NO: 98708 - RNA, 22 nt, Human
aauuugauucagcaaauguuca

SEQ ID NO: 98709 - RNA, 22 nt, Human
aauuugccuuaccuucuuccaa

SEQ ID NO: 98710 - RNA, 21 nt, Human
aauuugcuaagcaaaggagca

SEQ ID NO: 98711 - RNA, 22 nt, Human
aauuugggcgaggagggaggca

SEQ ID NO: 98712 - RNA, 22 nt, Human
aauuuguauacauguuacauuu

SEQ ID NO: 98713 - RNA, 22 nt, Human
aauuugugaaucugucucuuga

SEQ ID NO: 98714 - RNA, 22 nt, Human
aauuuguggccacauuguggaa

SEQ ID NO: 98715 - RNA, 22 nt, Human
aauuuguuaaaagugagugaca

SEQ ID NO: 98716 - RNA, 22 nt, Human
aauuuuaaucaguggugcugag

SEQ ID NO: 98717 - RNA, 22 nt, Human
aauuuuacauaggggauauggg

SEQ ID NO: 98718 - RNA, 22 nt, Human
aauuuuacuaaucugaguguga

SEQ ID NO: 98719 - RNA, 20 nt, Human
aauuuuacuguccuauagag

SEQ ID NO: 98720 - RNA, 22 nt, Human
aauuuuauuagaaggcaagggg

SEQ ID NO: 98721 - RNA, 21 nt, Human
aauuuugaaggaagauuaagg

SEQ ID NO: 98722 - RNA, 22 nt, Human
aauuuugugugggaucaaagga

SEQ ID NO: 98723 - RNA, 22 nt, Human
aauuuuguuuaagugaucugcu

SEQ ID NO: 98724 - RNA, 22 nt, Human
acaaaaaccguggauucagcau

SEQ ID NO: 98725 - RNA, 22 nt, Human
acaaaaccagaaaaucucuacc

SEQ ID NO: 98726 - RNA, 22 nt, Human
acaaaagcuuuuggaggguugu

SEQ ID NO: 98727 - RNA, 22 nt, Human
acaaaaguguaggaauuccuua

SEQ ID NO: 98728 - RNA, 22 nt, Human
acaaaauuguguuaaacuuuau

SEQ ID NO: 98729 - RNA, 22 nt, Human
acaaacacgagacgccacugug

SEQ ID NO: 98730 - RNA, 22 nt, Human
acaaaccagcuuaagcaagaug

SEQ ID NO: 98731 - RNA, 22 nt, Human
acaaacuaccuacagauguuca

SEQ ID NO: 98732 - RNA, 21 nt, Human
acaaacugaaaugaguuuccu

SEQ ID NO: 98733 - RNA, 22 nt, Human
acaaacugaauggguuuucugu

SEQ ID NO: 98734 - RNA, 22 nt, Human
acaaacuuccaucaugaauuuu

SEQ ID NO: 98735 - RNA, 20 nt, Human
acaaagacuggaaaagcaag

SEQ ID NO: 98736 - RNA, 22 nt, Human
acaaagagggaccagugacuug

SEQ ID NO: 98737 - RNA, 22 nt, Human
acaaagaucuugcuuuccuacu

SEQ ID NO: 98738 - RNA, 22 nt, Human
acaaagauguuuaaagcauuua

SEQ ID NO: 98739 - RNA, 21 nt, Human
acaaaggaagucucuuuuaag

SEQ ID NO: 98740 - RNA, 18 nt, Human
acaaaggaucaugaggga

SEQ ID NO: 98741 - RNA, 18 nt, Human
acaaaggucugcaagacc

SEQ ID NO: 98742 - RNA, 22 nt, Human
acaaaggugagcagaagacaca

SEQ ID NO: 98743 - RNA, 22 nt, Human
acaaaguaggaagauuagcuga

SEQ ID NO: 98744 - RNA, 22 nt, Human
acaaagucaaauugcagccgcc

SEQ ID NO: 98745 - RNA, 22 nt, Human
acaaagugcugacauuacaggc

SEQ ID NO: 98746 - RNA, 22 nt, Human
acaaaguuauucuuucagagga

SEQ ID NO: 98747 - RNA, 19 nt, Human
acaaauaguuacauauccu

SEQ ID NO: 98748 - RNA, 22 nt, Human
acaaaugaaccugaaaucucag

SEQ ID NO: 98749 - RNA, 22 nt, Human
acaaaugaaucauacauaaugu

SEQ ID NO: 98750 - RNA, 18 nt, Human
acaaauguagugucuuaa

SEQ ID NO: 98751 - RNA, 22 nt, Human
acaaaugucuacauugagaaua

SEQ ID NO: 98752 - RNA, 23 nt, Human
acaaaugucuagagaggguguga

SEQ ID NO: 98753 - RNA, 22 nt, Human
acaaaugucuccucuuuuguua

SEQ ID NO: 98754 - RNA, 22 nt, Human
acaaaugugucuaauugugccu

SEQ ID NO: 98755 - RNA, 22 nt, Human
acaaauucucuaggcaaggaag

SEQ ID NO: 98756 - RNA, 22 nt, Human
acaaauuggguaugagcuaaga

SEQ ID NO: 98757 - RNA, 22 nt, Human
acaacaaggcuuuucauucaua

SEQ ID NO: 98758 - RNA, 22 nt, Human
acaacacagcaaaaccccaucu

SEQ ID NO: 98759 - RNA, 17 nt, Human
acaacagaaauguauuc

SEQ ID NO: 98760 - RNA, 22 nt, Human
acaacaguaggaaaacaugucu

SEQ ID NO: 98761 - RNA, 22 nt, Human
acaacaucagcugagaccuuca

SEQ ID NO: 98762 - RNA, 22 nt, Human
acaacauuauacauagaaagcu

SEQ ID NO: 98763 - RNA, 22 nt, Human
acaacauuuccauuuccuuggu

SEQ ID NO: 98764 - RNA, 22 nt, Human
acaaccaugucaguucaaacca

SEQ ID NO: 98765 - RNA, 22 nt, Human
acaaccuucuggagauaucugu

SEQ ID NO: 98766 - RNA, 22 nt, Human
acaacucucaguuaaauaaaga

SEQ ID NO: 98767 - RNA, 22 nt, Human
acaacugucaguaaagaauauu

SEQ ID NO: 98768 - RNA, 20 nt, Human
acaacuuaguugagagacua

SEQ ID NO: 98769 - RNA, 22 nt, Human
acaagaauaaggauaagagauu

SEQ ID NO: 98770 - RNA, 22 nt, Human
acaagaauuuacauguagugga

SEQ ID NO: 98771 - RNA, 22 nt, Human
acaagacugugcucuaagagug

SEQ ID NO: 98772 - RNA, 22 nt, Human
acaagagauuaucuacagauga

SEQ ID NO: 98773 - RNA, 22 nt, Human
acaagaguaucuuugacuuuag

SEQ ID NO: 98774 - RNA, 22 nt, Human
acaagauaaggugucagugugu

SEQ ID NO: 98775 - RNA, 22 nt, Human
acaagauagcuuagaagauuca

SEQ ID NO: 98776 - RNA, 23 nt, Human
acaagauagggauaaaaagauaa

SEQ ID NO: 98777 - RNA, 22 nt, Human
acaagauagguugagucuagcc

SEQ ID NO: 98778 - RNA, 22 nt, Human
acaagauuuggcugaaacucca

SEQ ID NO: 98779 - RNA, 22 nt, Human
aaucauggcguguuuagcuuaa

SEQ ID NO: 98780 - RNA, 22 nt, Human
aaucauuguucuucagauuuga

SEQ ID NO: 98781 - RNA, 22 nt, Human
aauccaauccuacucagaaagu

SEQ ID NO: 98782 - RNA, 22 nt, Human
aauccacuaaugaagaaugggc

SEQ ID NO: 98783 - RNA, 22 nt, Human
aauccauaauguugugggguuu

SEQ ID NO: 98784 - RNA, 22 nt, Human
aauccauagaauaaaauugcag

SEQ ID NO: 98785 - RNA, 22 nt, Human
aauccauagguuuuuccaagag

SEQ ID NO: 98786 - RNA, 22 nt, Human
aauccauguugauguauauuuu

SEQ ID NO: 98787 - RNA, 22 nt, Human
aauccauucagaaauugggaau

SEQ ID NO: 98788 - RNA, 20 nt, Human
aauccauuggucuauauguc

SEQ ID NO: 98789 - RNA, 22 nt, Human
aaucccuuuuucauuuaauaga

SEQ ID NO: 98790 - RNA, 22 nt, Human
aauccugaggcaaagagaugag

SEQ ID NO: 98791 - RNA, 20 nt, Human
aauccugggacagaggcagg

SEQ ID NO: 98792 - RNA, 22 nt, Human
aauccuguagauucuaauuccu

SEQ ID NO: 98793 - RNA, 21 nt, Human
aauccuuaaugaggaguuggu

SEQ ID NO: 98794 - RNA, 22 nt, Human
aaucgcuugguaauuuuaaaag

SEQ ID NO: 98795 - RNA, 22 nt, Human
aaucuaacuucauagcugauuu

SEQ ID NO: 98796 - RNA, 22 nt, Human
aaucuacauuucaguuuugccc

SEQ ID NO: 98797 - RNA, 22 nt, Human
aaucuagagaacuguggggcag

SEQ ID NO: 98798 - RNA, 22 nt, Human
aaucuagaguucccagcauaaa

SEQ ID NO: 98799 - RNA, 22 nt, Human
aaucuaguuucagacuuugagu

SEQ ID NO: 98800 - RNA, 22 nt, Human
aaucucucugggguucaguccu

SEQ ID NO: 98801 - RNA, 22 nt, Human
aaucucuugguucagaagccuc

SEQ ID NO: 98802 - RNA, 22 nt, Human
aaucugaauauuuauguguauu

SEQ ID NO: 98803 - RNA, 22 nt, Human
aaucugauguuaaauguaaggu

SEQ ID NO: 98804 - RNA, 22 nt, Human
aaucuggaauauuugcauugua

SEQ ID NO: 98805 - RNA, 22 nt, Human
aaucuggacuugucugugaaga

SEQ ID NO: 98806 - RNA, 22 nt, Human
aaucuggcauguaagcuuagag

SEQ ID NO: 98807 - RNA, 22 nt, Human
aaucuguuuaacagauuucugu

SEQ ID NO: 98808 - RNA, 22 nt, Human
aaucuguuuuaucauuuguuac

SEQ ID NO: 98809 - RNA, 22 nt, Human
aaucuguuuucugccucuauga

SEQ ID NO: 98810 - RNA, 22 nt, Human
aaucuuaagcugaauucucucc

SEQ ID NO: 98811 - RNA, 22 nt, Human
aaucuucacagagaaaauuagg

SEQ ID NO: 98812 - RNA, 22 nt, Human
aaucuucauaaaaaucuaguag

SEQ ID NO: 98813 - RNA, 22 nt, Human
aaucuucauguccucucuaauu

SEQ ID NO: 98814 - RNA, 22 nt, Human
acaggcaccuccagggguaugu

SEQ ID NO: 98815 - RNA, 22 nt, Human
acaggcaccugccaccacaucu

SEQ ID NO: 98816 - RNA, 22 nt, Human
acaggcacugucaagucaugaa

SEQ ID NO: 98817 - RNA, 19 nt, Human
acaggcagaauugggugug

SEQ ID NO: 98818 - RNA, 22 nt, Human
acaggcagagaacucagccaga

SEQ ID NO: 98819 - RNA, 17 nt, Human
acaggcagaucaccuga

SEQ ID NO: 98820 - RNA, 14 nt, Human
acaggcagauuucu

SEQ ID NO: 98821 - RNA, 22 nt, Human
acaggcagcccucucccugguu

SEQ ID NO: 98822 - RNA, 22 nt, Human
acaggcaggagcuccccauucc

SEQ ID NO: 98823 - RNA, 22 nt, Human
acaggcagguaauuuacauauu

SEQ ID NO: 98824 - RNA, 22 nt, Human
acaggcagugauuuccucuggu

SEQ ID NO: 98825 - RNA, 22 nt, Human
acaggcagugggccagauuugu

SEQ ID NO: 98826 - RNA, 22 nt, Human
acaggcauugggauggagguug

SEQ ID NO: 98827 - RNA, 22 nt, Human
acaggccucccauccggagccc

SEQ ID NO: 98828 - RNA, 22 nt, Human
acaggccugagauuuugcauuu

SEQ ID NO: 98829 - RNA, 17 nt, Human
acaggccugcuugcacu

SEQ ID NO: 98830 - RNA, 22 nt, Human
acaggcucacagucauuucauu

SEQ ID NO: 98831 - RNA, 21 nt, Human
acaggcucacgauccauuucu

SEQ ID NO: 98832 - RNA, 22 nt, Human
acaggcucgugcgcgcacgugu

SEQ ID NO: 98833 - RNA, 22 nt, Human
acaggcucucuauugagugcag

SEQ ID NO: 98834 - RNA, 22 nt, Human
acaggcucuggggcaggauggc

SEQ ID NO: 98835 - RNA, 23 nt, Human
acaggcucuuaaucagugcuccu

SEQ ID NO: 98836 - RNA, 22 nt, Human
acaggcugaaaguuaaguucug

SEQ ID NO: 98837 - RNA, 22 nt, Human
acaggcuggugguccuggccau

SEQ ID NO: 98838 - RNA, 22 nt, Human
acaggcuuacuguuucauaggg

SEQ ID NO: 98839 - RNA, 22 nt, Human
acaggcuuagggcuugggcccg

SEQ ID NO: 98840 - RNA, 22 nt, Human
acaggcuucagauguauuaacu

SEQ ID NO: 98841 - RNA, 22 nt, Human
acaggcuuggggcucagacaga

SEQ ID NO: 98842 - RNA, 22 nt, Human
acaggcuuuauguagugacuua

SEQ ID NO: 98843 - RNA, 22 nt, Human
acaggcuuuuacggauaucuuu

SEQ ID NO: 98844 - RNA, 22 nt, Human
acagggaacaggaauauacaaa

SEQ ID NO: 98845 - RNA, 22 nt, Human
acagggaagcucaggggcucug

SEQ ID NO: 98846 - RNA, 22 nt, Human
acagggaaggacaugacuuggc

SEQ ID NO: 98847 - RNA, 22 nt, Human
acagggaaguucugcaacagga

SEQ ID NO: 98848 - RNA, 22 nt, Human
acagggagaugggugaaagcgg

SEQ ID NO: 98849 - RNA, 22 nt, Human
acagggcagagggcaguuggua

SEQ ID NO: 98850 - RNA, 19 nt, Human
acagggcagcaauaggaua

SEQ ID NO: 98851 - RNA, 22 nt, Human
acagggccaaguaaacccuacc

SEQ ID NO: 98852 - RNA, 22 nt, Human
acagggccauuaucuguucuag

SEQ ID NO: 98853 - RNA, 22 nt, Human
acagggccauuggaggauuaua

SEQ ID NO: 98854 - RNA, 22 nt, Human
acagggcuauauuccucagagc

SEQ ID NO: 98855 - RNA, 23 nt, Human
acagggcuggcagcugcaagacc

SEQ ID NO: 98856 - RNA, 23 nt, Human
acagggcuguccagggcuagguc

SEQ ID NO: 98857 - RNA, 22 nt, Human
acagggcuuagaacuuggccuc

SEQ ID NO: 98858 - RNA, 22 nt, Human
acagggcuuguugaaagcggag

SEQ ID NO: 98859 - RNA, 22 nt, Human
acaggggauugauuggaagucu

SEQ ID NO: 98860 - RNA, 22 nt, Human
acaggggcaagggcucacggcc

SEQ ID NO: 98861 - RNA, 20 nt, Human
acaggggcagcacaauaaug

SEQ ID NO: 98862 - RNA, 22 nt, Human
acaggggugcauggugcauggu

SEQ ID NO: 98863 - RNA, 22 nt, Human
acagguccuuauaagagcacuc

SEQ ID NO: 98864 - RNA, 22 nt, Human
acaggucuccagagugagagga

SEQ ID NO: 98865 - RNA, 22 nt, Human
acaggucugcaguaacugggaa

SEQ ID NO: 98866 - RNA, 22 nt, Human
acaggugagggguucuaggcug

SEQ ID NO: 98867 - RNA, 22 nt, Human
acaggugauucaggcucuggga

SEQ ID NO: 98868 - RNA, 22 nt, Human
acagguggcacugcuguuacuc

SEQ ID NO: 98869 - RNA, 22 nt, Human
acagguggcuuccauuuucuaa

SEQ ID NO: 98870 - RNA, 22 nt, Human
acagguggggaggcugagguuc

SEQ ID NO: 98871 - RNA, 22 nt, Human
acagguggggcacuuggagccu

SEQ ID NO: 98872 - RNA, 22 nt, Human
acagguggucuuugcuccuuuu

SEQ ID NO: 98873 - RNA, 22 nt, Human
acagguguaaaacccaggaugg

SEQ ID NO: 98874 - RNA, 22 nt, Human
acagguguaauuugcccgaggu

SEQ ID NO: 98875 - RNA, 22 nt, Human
acagguguacaaugcaugacag

SEQ ID NO: 98876 - RNA, 22 nt, Human
acagguguagaaaacagauuau

SEQ ID NO: 98877 - RNA, 22 nt, Human
acagguguagguacauuugcau

SEQ ID NO: 98878 - RNA, 22 nt, Human
acagguguccucacagggggug

SEQ ID NO: 98879 - RNA, 22 nt, Human
acaggugucuaaggcagacagc

SEQ ID NO: 98880 - RNA, 22 nt, Human
acaggugucugcaaguuacugg

SEQ ID NO: 98881 - RNA, 22 nt, Human
acaggugugcggaaagcuguga

SEQ ID NO: 98882 - RNA, 22 nt, Human
acaggugugggcugggcucuga

SEQ ID NO: 98883 - RNA, 22 nt, Human
acagguguuuuggaggaugauu

SEQ ID NO: 98884 - RNA, 22 nt, Human
acagguuugcagcuuguuaccu

SEQ ID NO: 98885 - RNA, 22 nt, Human
acagguuuuggacuccagauuu

SEQ ID NO: 98886 - RNA, 22 nt, Human
acaguaaaucaacagaauaucu

SEQ ID NO: 98887 - RNA, 22 nt, Human
acaguaaccucuccucugaagg

SEQ ID NO: 98888 - RNA, 22 nt, Human
acaguaauaaguguuggugagg

SEQ ID NO: 98889 - RNA, 22 nt, Human
acaguaaugcauacaaguuagu

SEQ ID NO: 98890 - RNA, 22 nt, Human
acaguaauuaaacauucugauu

SEQ ID NO: 98891 - RNA, 22 nt, Human
acaguaauugugaacuuaacgu

SEQ ID NO: 98892 - RNA, 22 nt, Human
acaguaauuuauugaacaccuu

SEQ ID NO: 98893 - RNA, 22 nt, Human
acaguacaagcaaugcauuuuu

SEQ ID NO: 98894 - RNA, 22 nt, Human
acaguacaccacuguguacagu

SEQ ID NO: 98895 - RNA, 22 nt, Human
acaguacucuaaugaaaagugc

SEQ ID NO: 98896 - RNA, 21 nt, Human
acaguacuugagaucuuuuga

SEQ ID NO: 98897 - RNA, 20 nt, Human
acaguagaagggauuucaaa

SEQ ID NO: 98898 - RNA, 21 nt, Human
acaguagcugacacacaguuu

SEQ ID NO: 98899 - RNA, 22 nt, Human
acaguagucuuaauuucaugua

SEQ ID NO: 98900 - RNA, 22 nt, Human
acaguauagggcuuauauugua

SEQ ID NO: 98901 - RNA, 22 nt, Human
acaguauauauagucuaaaagc

SEQ ID NO: 98902 - RNA, 22 nt, Human
acaguauauuuucuugauuguu

SEQ ID NO: 98903 - RNA, 22 nt, Human
acaguaugaaugcagaauguag

SEQ ID NO: 98904 - RNA, 22 nt, Human
acagucaggccgagaugggccu

SEQ ID NO: 98905 - RNA, 22 nt, Human
acagucauagcagccuuuguua

SEQ ID NO: 98906 - RNA, 22 nt, Human
acaguccuuguuucggucagau

SEQ ID NO: 98907 - RNA, 23 nt, Human
acagucguagguauccuuuuccu

SEQ ID NO: 98908 - RNA, 22 nt, Human
acagucuaaucuuguguucugu

SEQ ID NO: 98909 - RNA, 22 nt, Human
acagucuacuaaacaucaucag

SEQ ID NO: 98910 - RNA, 22 nt, Human
acagucuggaagcagggggcaa

SEQ ID NO: 98911 - RNA, 22 nt, Human
acagucugucccccaggugcua

SEQ ID NO: 98912 - RNA, 22 nt, Human
acacugauuguagucuguggug

SEQ ID NO: 98913 - RNA, 22 nt, Human
acacugcauuucaacaaggccc

SEQ ID NO: 98914 - RNA, 22 nt, Human
acacugcuaaacaguaaagaug

SEQ ID NO: 98915 - RNA, 22 nt, Human
acacugcuucucuggcagagcc

SEQ ID NO: 98916 - RNA, 22 nt, Human
acacuggaggguccagggaugu

SEQ ID NO: 98917 - RNA, 22 nt, Human
acacugguaggaagagauggcu

SEQ ID NO: 98918 - RNA, 22 nt, Human
acacuguaaauugagugcguga

SEQ ID NO: 98919 - RNA, 19 nt, Human
acacuguagauauagcuau

SEQ ID NO: 98920 - RNA, 22 nt, Human
acacuguagcugagggcaugcg

SEQ ID NO: 98921 - RNA, 22 nt, Human
acacugucugggacucaggagu

SEQ ID NO: 98922 - RNA, 22 nt, Human
acacugugcuuagaugcugaac

SEQ ID NO: 98923 - RNA, 22 nt, Human
acagucuuucaguaauaauacu

SEQ ID NO: 98924 - RNA, 22 nt, Human
acagucuuugcaaaguccuggu

SEQ ID NO: 98925 - RNA, 22 nt, Human
acagugaaaauaauaucuucaa

SEQ ID NO: 98926 - RNA, 22 nt, Human
acagugaauaagacaugugcuu

SEQ ID NO: 98927 - RNA, 22 nt, Human
acagugaaugcccaagaaaagu

SEQ ID NO: 98928 - RNA, 22 nt, Human
acagugacaacccaggauaaau

SEQ ID NO: 98929 - RNA, 22 nt, Human
acagugauauuuuuacucaaau

SEQ ID NO: 98930 - RNA, 22 nt, Human
acagugaucaguuacugucugu

SEQ ID NO: 98931 - RNA, 22 nt, Human
acagugcaaauaggacugucuu

SEQ ID NO: 98932 - RNA, 20 nt, Human
acagugcauggggggacagc

SEQ ID NO: 98933 - RNA, 22 nt, Human
acagugcuaaacacuucuugaa

SEQ ID NO: 98934 - RNA, 22 nt, Human
acagugcuaucaauagcuagaa

SEQ ID NO: 98935 - RNA, 22 nt, Human
acagugcuggcuacaacccugg

SEQ ID NO: 98936 - RNA, 22 nt, Human
acagugcugucaaauauguuuu

SEQ ID NO: 98937 - RNA, 22 nt, Human
acagugcugucuaucucacuaa

SEQ ID NO: 98938 - RNA, 22 nt, Human
acagugcugugcagucugcccu

SEQ ID NO: 98939 - RNA, 22 nt, Human
acaguggaaagaacauggauuu

SEQ ID NO: 98940 - RNA, 22 nt, Human
acaguggagcucagaugaaaau

SEQ ID NO: 98941 - RNA, 22 nt, Human
acaguggauauauuaaaugaga

SEQ ID NO: 98942 - RNA, 22 nt, Human
acaguggcaucuacuuaaucug

SEQ ID NO: 98943 - RNA, 22 nt, Human
acaguggccucaaagaaagaga

SEQ ID NO: 98944 - RNA, 22 nt, Human
acaguggcucaugccugucauc

SEQ ID NO: 98945 - RNA, 20 nt, Human
acaguggguggggagcacug

SEQ ID NO: 98946 - RNA, 22 nt, Human
acaguguacuccuuuaccggag

SEQ ID NO: 98947 - RNA, 22 nt, Human
acaguguagcaugguagcaaug

SEQ ID NO: 98948 - RNA, 22 nt, Human
acaguguauauuguuuaucugg

SEQ ID NO: 98949 - RNA, 22 nt, Human
acaguguccuuguggucccugu

SEQ ID NO: 98950 - RNA, 22 nt, Human
acagugucugacacauuguagc

SEQ ID NO: 98951 - RNA, 19 nt, Human
acagugucuguauauaaau

SEQ ID NO: 98952 - RNA, 22 nt, Human
acagugugacaauugugucaga

SEQ ID NO: 98953 - RNA, 22 nt, Human
acagugugaugggccugccuga

SEQ ID NO: 98954 - RNA, 22 nt, Human
acagugugcaagaaauggggga

SEQ ID NO: 98955 - RNA, 22 nt, Human
acaguguggugauggcacuugc

SEQ ID NO: 98956 - RNA, 22 nt, Human
acaguguuacuugauaguguau

SEQ ID NO: 98957 - RNA, 20 nt, Human
acaguguuaguuaucaucuc

SEQ ID NO: 98958 - RNA, 22 nt, Human
acaguguuauuucugaguaaug

SEQ ID NO: 98959 - RNA, 22 nt, Human
acaguguucacuaagguuagcu

SEQ ID NO: 98960 - RNA, 22 nt, Human
acaguguucugcuuuuuaaucc

SEQ ID NO: 98961 - RNA, 20 nt, Human
acaguguuuuugaguagagc

SEQ ID NO: 98962 - RNA, 22 nt, Human
acaguuaaggaaauggagguuc

SEQ ID NO: 98963 - RNA, 22 nt, Human
acaguuaauaugugacagaacu

SEQ ID NO: 98964 - RNA, 22 nt, Human
acaguuaaucaaauggcauaug

SEQ ID NO: 98965 - RNA, 22 nt, Human
acaguuaauuaacauuaagggg

SEQ ID NO: 98966 - RNA, 22 nt, Human
acaguuaccacuuagcaguuac

SEQ ID NO: 98967 - RNA, 22 nt, Human
acaguuagggacuauaaucauu

SEQ ID NO: 98968 - RNA, 22 nt, Human
acaguuaguugaggaguguuug

SEQ ID NO: 98969 - RNA, 22 nt, Human
acaguuaucuuugaaauagaga

SEQ ID NO: 98970 - RNA, 22 nt, Human
acaguucuaaaucuuggauaau

SEQ ID NO: 98971 - RNA, 22 nt, Human
acaguucuccagugccuuugag

SEQ ID NO: 98972 - RNA, 22 nt, Human
acaguucucuugucacuuccuc

SEQ ID NO: 98973 - RNA, 22 nt, Human
acaguucugccuguuugagaag

SEQ ID NO: 98974 - RNA, 22 nt, Human
acaguucuuuguuuauagcuug

SEQ ID NO: 98975 - RNA, 22 nt, Human
acaguugggcuguagcaugcuu

SEQ ID NO: 98976 - RNA, 22 nt, Human
acaguugguuaacacaaauauu

SEQ ID NO: 98977 - RNA, 22 nt, Human
acaguuuacuggccuugccguu

SEQ ID NO: 98978 - RNA, 22 nt, Human
acaguuuaggaugagagaacac

SEQ ID NO: 98979 - RNA, 20 nt, Human
acaguuuauccaguuagcag

SEQ ID NO: 98980 - RNA, 22 nt, Human
acaguuuaugccucugagccug

SEQ ID NO: 98981 - RNA, 22 nt, Human
acaguuucccccuagggcagca

SEQ ID NO: 98982 - RNA, 22 nt, Human
acaguuugagaaccacuagccu

SEQ ID NO: 98983 - RNA, 22 nt, Human
acaguuuggcgugauugauagu

SEQ ID NO: 98984 - RNA, 21 nt, Human
acaguuuuaaggagcacaugg

SEQ ID NO: 98985 - RNA, 23 nt, Human
acauaaacagaaggugugcuucc

SEQ ID NO: 98986 - RNA, 22 nt, Human
acauaaaggugacuaacaucuu

SEQ ID NO: 98987 - RNA, 22 nt, Human
acauaaauagauuauugggagg

SEQ ID NO: 98988 - RNA, 22 nt, Human
acauaaugagcucuuuauaaau

SEQ ID NO: 98989 - RNA, 22 nt, Human
acauaauggacaauaaugcauc

SEQ ID NO: 98990 - RNA, 22 nt, Human
acauacacaagcguacaugaac

SEQ ID NO: 98991 - RNA, 17 nt, Human
acauacacuggugaaca

SEQ ID NO: 98992 - RNA, 22 nt, Human
acauacauauguuuaaaugcau

SEQ ID NO: 98993 - RNA, 22 nt, Human
acauacuaugaauacauguguc

SEQ ID NO: 98994 - RNA, 22 nt, Human
acauacuuuuuaaaagauugcu

SEQ ID NO: 98995 - RNA, 22 nt, Human
acauagcacgucucaauuugga

SEQ ID NO: 98996 - RNA, 22 nt, Human
acauagcauaaagaaugacucu

SEQ ID NO: 98997 - RNA, 22 nt, Human
acauaguuagcuuagagauacu

SEQ ID NO: 98998 - RNA, 22 nt, Human
acauauaagggaucagugacag

SEQ ID NO: 98999 - RNA, 22 nt, Human
acauauauguaaaguacuuugu

SEQ ID NO: 99000 - RNA, 22 nt, Human
acauaucugugagguuuuguug

SEQ ID NO: 99001 - RNA, 22 nt, Human
acauaucuguuagacacagcag

SEQ ID NO: 99002 - RNA, 22 nt, Human
acauaugcucaucugcauuccc

SEQ ID NO: 99003 - RNA, 19 nt, Human
acauauguggauauacaug

SEQ ID NO: 99004 - RNA, 22 nt, Human
acauauuccauuguugggaucc

SEQ ID NO: 99005 - RNA, 22 nt, Human
acauauugagcucuaaaaguac

SEQ ID NO: 99006 - RNA, 22 nt, Human
acauauuuugaaagcuuucuaa

SEQ ID NO: 99007 - RNA, 22 nt, Human
acaucagugcucuugguucuug

SEQ ID NO: 99008 - RNA, 18 nt, Human
acaucaguuaccaggcca

SEQ ID NO: 99009 - RNA, 22 nt, Human
acaucauucagggccucguugg

SEQ ID NO: 99010 - RNA, 22 nt, Human
acauccaucuucugccugugaa

SEQ ID NO: 99011 - RNA, 22 nt, Human
acauccauuugcuuuauuugcu

SEQ ID NO: 99012 - RNA, 22 nt, Human
acauccauuugucagcucuuga

SEQ ID NO: 99013 - RNA, 22 nt, Human
acauccauuuuguucaaaagca

SEQ ID NO: 99014 - RNA, 22 nt, Human
acauccucggggaaaggcacug

SEQ ID NO: 99015 - RNA, 22 nt, Human
acaucgauggauagagcuugcu

SEQ ID NO: 99016 - RNA, 22 nt, Human
acaucuaagccaauuuugauuu

SEQ ID NO: 99017 - RNA, 22 nt, Human
acaucucagaacugaguaaccg

SEQ ID NO: 99018 - RNA, 22 nt, Human
acaucucuccaaaggaaggugc

SEQ ID NO: 99019 - RNA, 22 nt, Human
acaucucuuauaaacucucuga

SEQ ID NO: 99020 - RNA, 20 nt, Human
acaucugagaaacacuuaaa

SEQ ID NO: 99021 - RNA, 22 nt, Human
acaucuguuugagaaaaagaag

SEQ ID NO: 99022 - RNA, 22 nt, Human
acaucuuuuuggaaacggcuga

SEQ ID NO: 99023 - RNA, 22 nt, Human
acaucuuuuuucucuaauugug

SEQ ID NO: 99024 - RNA, 20 nt, Human
acaugaaaggaaacaggaaa

SEQ ID NO: 99025 - RNA, 22 nt, Human
acaugaaaugcagccuguaacc

SEQ ID NO: 99026 - RNA, 22 nt, Human
acaugaacauuauaucagcaag

SEQ ID NO: 99027 - RNA, 22 nt, Human
acaugaagcaagaaagaugcua

SEQ ID NO: 99028 - RNA, 22 nt, Human
acaugacaaaaugcacaggauu

SEQ ID NO: 99029 - RNA, 19 nt, Human
acaugacaacaggggaggc

SEQ ID NO: 99030 - RNA, 22 nt, Human
acaugggcaucuaugaggcucu

SEQ ID NO: 99031 - RNA, 22 nt, Human
acaugguauguauuuuaagaga

SEQ ID NO: 99032 - RNA, 22 nt, Human
auguauguaguguacauauaca

SEQ ID NO: 99033 - RNA, 22 nt, Human
auguaugucugcauacacauac

SEQ ID NO: 99034 - RNA, 22 nt, Human
auguauuugcgagguuaggaaa

SEQ ID NO: 99035 - RNA, 22 nt, Human
auguauuuugccagacugucuc

SEQ ID NO: 99036 - RNA, 22 nt, Human
augucaaacacaacaccagugg

SEQ ID NO: 99037 - RNA, 22 nt, Human
augucaaaugcugcaaacucau

SEQ ID NO: 99038 - RNA, 22 nt, Human
augucaauuuguucucucgaag

SEQ ID NO: 99039 - RNA, 22 nt, Human
augucacagcucccauuccucc

SEQ ID NO: 99040 - RNA, 22 nt, Human
augucacaguugcaacaugaau

SEQ ID NO: 99041 - RNA, 22 nt, Human
augucacaugagagcgcagcac

SEQ ID NO: 99042 - RNA, 22 nt, Human
augucacauuggagcugcugga

SEQ ID NO: 99043 - RNA, 22 nt, Human
augucagauccucagaaagucu

SEQ ID NO: 99044 - RNA, 22 nt, Human
augucaguaguuucuuugaguu

SEQ ID NO: 99045 - RNA, 22 nt, Human
augucagucuuucugucucaga

SEQ ID NO: 99046 - RNA, 22 nt, Human
augucauauuacuaaugcuggc

SEQ ID NO: 99047 - RNA, 22 nt, Human
augucaugaaaugcuacuaacu

SEQ ID NO: 99048 - RNA, 22 nt, Human
augucauuaaaauugugcugca

SEQ ID NO: 99049 - RNA, 23 nt, Human
auguccaaagggauucgucugau

SEQ ID NO: 99050 - RNA, 22 nt, Human
auguccaagucacagauuuuca

SEQ ID NO: 99051 - RNA, 22 nt, Human
auguccagaaggguccccuguu

SEQ ID NO: 99052 - RNA, 22 nt, Human
auguccagagaacauuugcuuu

SEQ ID NO: 99053 - RNA, 22 nt, Human
auguccagccaaccacuggauu

SEQ ID NO: 99054 - RNA, 22 nt, Human
auguccagcucaugauacuauc

SEQ ID NO: 99055 - RNA, 23 nt, Human
auguccaguuuacuucaggauga

SEQ ID NO: 99056 - RNA, 22 nt, Human
auguccaguuucuacacacaua

SEQ ID NO: 99057 - RNA, 22 nt, Human
augucccaagauacagcuagag

SEQ ID NO: 99058 - RNA, 23 nt, Human
auguccccuucuugaugccuggc

SEQ ID NO: 99059 - RNA, 22 nt, Human
augucccuugucugugaugucu

SEQ ID NO: 99060 - RNA, 21 nt, Human
auguccuggcuaccagcgcag

SEQ ID NO: 99061 - RNA, 22 nt, Human
auguccugggcuggguuauguu

SEQ ID NO: 99062 - RNA, 22 nt, Human
auguccugguccuccaccaugg

SEQ ID NO: 99063 - RNA, 22 nt, Human
auguccuuccauuuugaucugu

SEQ ID NO: 99064 - RNA, 22 nt, Human
auguccuuccugagaucccugu

SEQ ID NO: 99065 - RNA, 22 nt, Human
auguccuuugcuucucuggucc

SEQ ID NO: 99066 - RNA, 22 nt, Human
auguccuuuguaucccuaggca

SEQ ID NO: 99067 - RNA, 22 nt, Human
auguccuuuuauuuaaagcagg

SEQ ID NO: 99068 - RNA, 22 nt, Human
augucgauaggagugccaucgg

SEQ ID NO: 99069 - RNA, 22 nt, Human
augucuauauagucaauaauca

SEQ ID NO: 99070 - RNA, 22 nt, Human
augucuauggaauuuccacaca

SEQ ID NO: 99071 - RNA, 22 nt, Human
augucuauguucuuuacugugu

SEQ ID NO: 99072 - RNA, 22 nt, Human
augucucucagguuuaacuuua

SEQ ID NO: 99073 - RNA, 22 nt, Human
augucucugccccagagagcuu

SEQ ID NO: 99074 - RNA, 19 nt, Human
augucucuguagcacauac

SEQ ID NO: 99075 - RNA, 22 nt, Human
augucugauaaauaaugcauaa

SEQ ID NO: 99076 - RNA, 22 nt, Human
augucugucuuuguacuccaca

SEQ ID NO: 99077 - RNA, 22 nt, Human
augucuguuaaucgacccuaau

SEQ ID NO: 99078 - RNA, 22 nt, Human
augucuguuugcugagcccggc

SEQ ID NO: 99079 - RNA, 22 nt, Human
augucuucucuguagguaaauu

SEQ ID NO: 99080 - RNA, 22 nt, Human
augucuuucaaauucugccuag

SEQ ID NO: 99081 - RNA, 22 nt, Human
augucuuucucacagccaguuc

SEQ ID NO: 99082 - RNA, 22 nt, Human
augucuuucucauacaagccca

SEQ ID NO: 99083 - RNA, 22 nt, Human
augucuuucuuauggucuguug

SEQ ID NO: 99084 - RNA, 22 nt, Human
augucuuucuugugucccaaga

SEQ ID NO: 99085 - RNA, 22 nt, Human
augucuuugccauaguucauau

SEQ ID NO: 99086 - RNA, 22 nt, Human
augugaaacugaagcauccaua

SEQ ID NO: 99087 - RNA, 22 nt, Human
augugaaagagguguucagugg

SEQ ID NO: 99088 - RNA, 22 nt, Human
augugaaauagcuggauaugaa

SEQ ID NO: 99089 - RNA, 22 nt, Human
augugaagcuugugcuaacaua

SEQ ID NO: 99090 - RNA, 22 nt, Human
augugaaugcaguuaucuauaa

SEQ ID NO: 99091 - RNA, 22 nt, Human
augugacaguguuugacagaug

SEQ ID NO: 99092 - RNA, 22 nt, Human
augugagaauaacucaaaacaa

SEQ ID NO: 99093 - RNA, 22 nt, Human
augugaggaagaaagagguaag

SEQ ID NO: 99094 - RNA, 22 nt, Human
augugagggcucaggcugacug

SEQ ID NO: 99095 - RNA, 21 nt, Human
augugauuauaugacuuuuac

SEQ ID NO: 99096 - RNA, 22 nt, Human
augugauucccacugaaucacu

SEQ ID NO: 99097 - RNA, 22 nt, Human
augugcaacuucagcagaaagg

SEQ ID NO: 99098 - RNA, 18 nt, Human
augugcaauuuuguauuu

SEQ ID NO: 99099 - RNA, 22 nt, Human
augugcagccuuucuucaucau

SEQ ID NO: 99100 - RNA, 22 nt, Human
augugcagcuuuucuagagaag

SEQ ID NO: 99101 - RNA, 22 nt, Human
augugcaugcacuuacaugugu

SEQ ID NO: 99102 - RNA, 22 nt, Human
augugcccucuuagagucucug

SEQ ID NO: 99103 - RNA, 22 nt, Human
augugcguguguacauauauau

SEQ ID NO: 99104 - RNA, 20 nt, Human
augugcugggcaauauguua

SEQ ID NO: 99105 - RNA, 22 nt, Human
augugcuguaauccauugaagg

SEQ ID NO: 99106 - RNA, 22 nt, Human
augugcuucauaaucuucucau

SEQ ID NO: 99107 - RNA, 22 nt, Human
augugcuucauucuacaugaca

SEQ ID NO: 99108 - RNA, 22 nt, Human
augugcuugaagccucagagaa

SEQ ID NO: 99109 - RNA, 22 nt, Human
augugcuuggaaaagcaguggu

SEQ ID NO: 99110 - RNA, 22 nt, Human
augugcuuuauuaaguaaaaau

SEQ ID NO: 99111 - RNA, 22 nt, Human
augugcuuucuuuccaaggggc

SEQ ID NO: 99112 - RNA, 22 nt, Human
augugcuuugcuggaaauguca

SEQ ID NO: 99113 - RNA, 22 nt, Human
augugcuuuuacuccccagagu

SEQ ID NO: 99114 - RNA, 22 nt, Human
auguggauggaagucagauagc

SEQ ID NO: 99115 - RNA, 22 nt, Human
auguggcacagcacaguaagag

SEQ ID NO: 99116 - RNA, 22 nt, Human
auguggcaccgaucuuuagcca

SEQ ID NO: 99117 - RNA, 22 nt, Human
auguggcccagcggucaggcug

SEQ ID NO: 99118 - RNA, 22 nt, Human
auguggccuaguauagaaauga

SEQ ID NO: 99119 - RNA, 22 nt, Human
auguggccuuaaugacagcagc

SEQ ID NO: 99120 - RNA, 22 nt, Human
auguggcugaucgcagagcucu

SEQ ID NO: 99121 - RNA, 22 nt, Human
caggcaggcugcuuuuuguuca

SEQ ID NO: 99122 - RNA, 22 nt, Human
caggcagggagccacuguauaa

SEQ ID NO: 99123 - RNA, 22 nt, Human
caggcagugugacgcuaggguu

SEQ ID NO: 99124 - RNA, 22 nt, Human
caggcauagguaggauguuucu

SEQ ID NO: 99125 - RNA, 22 nt, Human
caggcaugagccaggccccucc

SEQ ID NO: 99126 - RNA, 22 nt, Human
caggcaugaugggaagugccug

SEQ ID NO: 99127 - RNA, 22 nt, Human
caggcaugcuucugucugggca

SEQ ID NO: 99128 - RNA, 22 nt, Human
caggcauggaaaagcccagagg

SEQ ID NO: 99129 - RNA, 22 nt, Human
caggcauggagaggcagagacu

SEQ ID NO: 99130 - RNA, 22 nt, Human
caggcauggaucuggaaucauu

SEQ ID NO: 99131 - RNA, 22 nt, Human
caggcauggugagaacucagcc

SEQ ID NO: 99132 - RNA, 22 nt, Human
caggcauugccauuccuccaga

SEQ ID NO: 99133 - RNA, 21 nt, Human
caggccaaaagguucaacauu

SEQ ID NO: 99134 - RNA, 22 nt, Human
caggccaaagaucccauugaca

SEQ ID NO: 99135 - RNA, 22 nt, Human
caggccaccagauacaugcccc

SEQ ID NO: 99136 - RNA, 22 nt, Human
caggccagcggcccgcgcguuc

SEQ ID NO: 99137 - RNA, 22 nt, Human
caggccagcguccagaacaagc

SEQ ID NO: 99138 - RNA, 22 nt, Human
caggccaggguugagaagagaa

SEQ ID NO: 99139 - RNA, 22 nt, Human
caggccaggugcucuagaauca

SEQ ID NO: 99140 - RNA, 22 nt, Human
caggccagguggcaggcaaaac

SEQ ID NO: 99141 - RNA, 20 nt, Human
augugucugccucuguguuc

SEQ ID NO: 99142 - RNA, 22 nt, Human
augugucuggcauggcucuauu

SEQ ID NO: 99143 - RNA, 22 nt, Human
augugucugugggcacacacac

SEQ ID NO: 99144 - RNA, 22 nt, Human
augugucuugcggcaguuggua

SEQ ID NO: 99145 - RNA, 18 nt, Human
augugucuuucuuguuug

SEQ ID NO: 99146 - RNA, 22 nt, Human
augugugcaaugcuauuuuggc

SEQ ID NO: 99147 - RNA, 22 nt, Human
augugugcuacaggugugggaa

SEQ ID NO: 99148 - RNA, 23 nt, Human
augugugggaggucagagagcca

SEQ ID NO: 99149 - RNA, 22 nt, Human
augugugugcauuucucucccu

SEQ ID NO: 99150 - RNA, 22 nt, Human
auguguguguauauacacacau

SEQ ID NO: 99151 - RNA, 22 nt, Human
auguguguguuuaauccucaaa

SEQ ID NO: 99152 - RNA, 22 nt, Human
auguguuaaugagcaaugaccu

SEQ ID NO: 99153 - RNA, 22 nt, Human
auguguuaguuugugauuauac

SEQ ID NO: 99154 - RNA, 22 nt, Human
auguguucaguugacaggagca

SEQ ID NO: 99155 - RNA, 22 nt, Human
auguguucgcuagauugcuguu

SEQ ID NO: 99156 - RNA, 22 nt, Human
auguguucugaggcagaugacu

SEQ ID NO: 99157 - RNA, 22 nt, Human
auguuaaaagucugagugggag

SEQ ID NO: 99158 - RNA, 22 nt, Human
auguuaacugaagccauucucg

SEQ ID NO: 99159 - RNA, 22 nt, Human
auguuaagaaugcagacaaaug

SEQ ID NO: 99160 - RNA, 22 nt, Human
auguuaaguguaccauauauca

SEQ ID NO: 99161 - RNA, 22 nt, Human
auguuacaacccugaggagccg

SEQ ID NO: 99162 - RNA, 22 nt, Human
auguuacagaaagcaaagauga

SEQ ID NO: 99163 - RNA, 23 nt, Human
auguuaccaauggaggaaauugg

SEQ ID NO: 99164 - RNA, 22 nt, Human
auguuaccucuauuagaauauu

SEQ ID NO: 99165 - RNA, 23 nt, Human
auguuacuuaaccucucugugcc

SEQ ID NO: 99166 - RNA, 22 nt, Human
auguuauaaauagagacacugg

SEQ ID NO: 99167 - RNA, 22 nt, Human
auguuauaguuauaaaaugagg

SEQ ID NO: 99168 - RNA, 22 nt, Human
auguuauggcucaaacauuugg

SEQ ID NO: 99169 - RNA, 22 nt, Human
auguuauuaaaguacagauucu

SEQ ID NO: 99170 - RNA, 23 nt, Human
auguuauuauuagcagucuugcc

SEQ ID NO: 99171 - RNA, 22 nt, Human
auguuauuucugaaagaucauu

SEQ ID NO: 99172 - RNA, 22 nt, Human
auguucaacaguuugcacacau

SEQ ID NO: 99173 - RNA, 22 nt, Human
auguucauagcaucgguauuca

SEQ ID NO: 99174 - RNA, 18 nt, Human
auguucauauuuuuaggg

SEQ ID NO: 99175 - RNA, 22 nt, Human
auguucaucaacacauuacaag

SEQ ID NO: 99176 - RNA, 22 nt, Human
auguucaucuacaaggcauugu

SEQ ID NO: 99177 - RNA, 22 nt, Human
auguucauguggcugcuggcag

SEQ ID NO: 99178 - RNA, 18 nt, Human
auguuccugaggagaggu

SEQ ID NO: 99179 - RNA, 22 nt, Human
auguucuacagauggaaagggg

SEQ ID NO: 99180 - RNA, 22 nt, Human
auguucugaaucaagcaacucu

SEQ ID NO: 99181 - RNA, 22 nt, Human
auguucuguuucuuaaucuuga

SEQ ID NO: 99182 - RNA, 22 nt, Human
auguucuuagcaaaguacuugc

SEQ ID NO: 99183 - RNA, 20 nt, Human
auguucuucauuuaauguuc

SEQ ID NO: 99184 - RNA, 22 nt, Human
auguucuucuaucuuuauuaaa

SEQ ID NO: 99185 - RNA, 22 nt, Human
auguucuuguucaaaugucagu

SEQ ID NO: 99186 - RNA, 22 nt, Human
auguugaguggaugaacaaaca

SEQ ID NO: 99187 - RNA, 22 nt, Human
auguuguguuugacuguuaccc

SEQ ID NO: 99188 - RNA, 20 nt, Human
auguuguuuacucauagcau

SEQ ID NO: 99189 - RNA, 22 nt, Human
auguuuaagaaagucuuccaua

SEQ ID NO: 99190 - RNA, 22 nt, Human
auguuuaaggaacugguuugcu

SEQ ID NO: 99191 - RNA, 19 nt, Human
auguuuacacucaggggcu

SEQ ID NO: 99192 - RNA, 22 nt, Human
auguuuacagaggaagugccuc

SEQ ID NO: 99193 - RNA, 22 nt, Human
auguuuaugaccuccauaagga

SEQ ID NO: 99194 - RNA, 22 nt, Human
auguuucaaauauauagaguug

SEQ ID NO: 99195 - RNA, 22 nt, Human
auguuucaccagcaaauuaccu

SEQ ID NO: 99196 - RNA, 22 nt, Human
auguuucagauacagaucaaau

SEQ ID NO: 99197 - RNA, 22 nt, Human
auguuucagggugauagaaggu

SEQ ID NO: 99198 - RNA, 22 nt, Human
auguuucauccacuggccuuuc

SEQ ID NO: 99199 - RNA, 22 nt, Human
auguuucauuuagauaucaggc

SEQ ID NO: 99200 - RNA, 22 nt, Human
auguuucuacagcguccacuga

SEQ ID NO: 99201 - RNA, 22 nt, Human
auguuucuagagcuuuguccca

SEQ ID NO: 99202 - RNA, 22 nt, Human
auguuucuaguuguaugucacu

SEQ ID NO: 99203 - RNA, 22 nt, Human
auguuucuauaaagaaguuugg

SEQ ID NO: 99204 - RNA, 22 nt, Human
auguuucucacuguuucucuau

SEQ ID NO: 99205 - RNA, 22 nt, Human
auguuucugaaguuuacagaua

SEQ ID NO: 99206 - RNA, 22 nt, Human
auguuucuguccuacgagauaa

SEQ ID NO: 99207 - RNA, 19 nt, Human
auguuugcuugaguaauaa

SEQ ID NO: 99208 - RNA, 22 nt, Human
auguuugucccugacauccucu

SEQ ID NO: 99209 - RNA, 22 nt, Human
auguuuguugaacaucuacugc

SEQ ID NO: 99210 - RNA, 22 nt, Human
auguuuguugaaugaagaaagg

SEQ ID NO: 99211 - RNA, 22 nt, Human
auguuuuaaauauguguguaaa

SEQ ID NO: 99212 - RNA, 22 nt, Human
auguuuuauguuccacucaagg

SEQ ID NO: 99213 - RNA, 22 nt, Human
auguuuuccccaaaugaucuuc

SEQ ID NO: 99214 - RNA, 22 nt, Human
auguuuucuccauguuaugcuu

SEQ ID NO: 99215 - RNA, 22 nt, Human
auuaaauguuggacguauacau

SEQ ID NO: 99216 - RNA, 22 nt, Human
auuaaauuaaguggcuaauuua

SEQ ID NO: 99217 - RNA, 22 nt, Human
auuaaauuggaucugcauaguu

SEQ ID NO: 99218 - RNA, 22 nt, Human
auuaacacuuuggagucugcuc

SEQ ID NO: 99219 - RNA, 22 nt, Human
auuaacuguacuuucuaauuuu

SEQ ID NO: 99220 - RNA, 22 nt, Human
auuaacuuuugaucaguguggu

SEQ ID NO: 99221 - RNA, 22 nt, Human
auuaagagccuacuaugugccg

SEQ ID NO: 99222 - RNA, 22 nt, Human
auuaaggauuauacucuccuuu

SEQ ID NO: 99223 - RNA, 22 nt, Human
auuaaggcucccauuuccaauu

SEQ ID NO: 99224 - RNA, 22 nt, Human
auuaaggcugcacuggccuuaa

SEQ ID NO: 99225 - RNA, 22 nt, Human
auuaagugugacaugcugcucu

SEQ ID NO: 99226 - RNA, 22 nt, Human
auuaauauccugcuggcuaaau

SEQ ID NO: 99227 - RNA, 22 nt, Human
auuaaucauuucugcauuaucu

SEQ ID NO: 99228 - RNA, 22 nt, Human
auuaaugacgcagauaauaauu

SEQ ID NO: 99229 - RNA, 22 nt, Human
auuacaacuacauaaucucaga

SEQ ID NO: 99230 - RNA, 22 nt, Human
auuacaacuggaauggugcugg

SEQ ID NO: 99231 - RNA, 22 nt, Human
auuacaauaagguuuauuugua

SEQ ID NO: 99232 - RNA, 22 nt, Human
auuacacagcgguuacuacuag

SEQ ID NO: 99233 - RNA, 22 nt, Human
auuacagaaauauggucaaaga

SEQ ID NO: 99234 - RNA, 22 nt, Human
auuacagauagacuuugaagcu

SEQ ID NO: 99235 - RNA, 22 nt, Human
auuacagauuauaaauuugagc

SEQ ID NO: 99236 - RNA, 22 nt, Human
auuacauauguuggcaacauuu

SEQ ID NO: 99237 - RNA, 23 nt, Human
auuaccagccugacaccaacaaa

SEQ ID NO: 99238 - RNA, 22 nt, Human
auuacagaagauaugcucaaca

SEQ ID NO: 99239 - RNA, 22 nt, Human
auuacaguggguaaacagaauu

SEQ ID NO: 99240 - RNA, 23 nt, Human
auuacaguuaauuacaacaucuu

SEQ ID NO: 99241 - RNA, 22 nt, Human
auuacaguucuacacauccuuu

SEQ ID NO: 99242 - RNA, 22 nt, Human
auuacaugagagaauguaaaua

SEQ ID NO: 99243 - RNA, 23 nt, Human
auuacaugagcaaauauagcuau

SEQ ID NO: 99244 - RNA, 22 nt, Human
auuacuagauugucaagauuua

SEQ ID NO: 99245 - RNA, 22 nt, Human
auuacuaugauuugaucauuac

SEQ ID NO: 99246 - RNA, 22 nt, Human
auuacugagcaacggucauuuc

SEQ ID NO: 99247 - RNA, 22 nt, Human
auuacugagcuuguagcugcau

SEQ ID NO: 99248 - RNA, 22 nt, Human
auuacuguuggcaaagucuuau

SEQ ID NO: 99249 - RNA, 23 nt, Human
auuagaaaggcuuucuggugaaa

SEQ ID NO: 99250 - RNA, 22 nt, Human
caaaggcuucaucucagagcag

SEQ ID NO: 99251 - RNA, 22 nt, Human
caaaggcuuugcuaugaugcau

SEQ ID NO: 99252 - RNA, 22 nt, Human
caaagguuaugaaccacuugua

SEQ ID NO: 99253 - RNA, 22 nt, Human
caaaguaauuacgguuuuggcc

SEQ ID NO: 99254 - RNA, 22 nt, Human
caaaguaauuuggagauauaua

SEQ ID NO: 99255 - RNA, 19 nt, Human
caaaguaccuggcacagug

SEQ ID NO: 99256 - RNA, 22 nt, Human
caaagucagcugccagucccaa

SEQ ID NO: 99257 - RNA, 22 nt, Human
caaagucagggaagaguggcug

SEQ ID NO: 99258 - RNA, 22 nt, Human
caaaguccauaguuuacaauag

SEQ ID NO: 99259 - RNA, 22 nt, Human
caaaguccuagaacagugcuug

SEQ ID NO: 99260 - RNA, 22 nt, Human
caaagucuuggugaucaacuuu

SEQ ID NO: 99261 - RNA, 22 nt, Human
caaagugagagaauggcagaaa

SEQ ID NO: 99262 - RNA, 22 nt, Human
caaagugaguuauaaacaucuu

SEQ ID NO: 99263 - RNA, 22 nt, Human
caaagugcugagauuacaggua

SEQ ID NO: 99264 - RNA, 22 nt, Human
caaagugcuggaauuacaggug

SEQ ID NO: 99265 - RNA, 22 nt, Human
caaaguggaggcucuggggcca

SEQ ID NO: 99266 - RNA, 22 nt, Human
caaaguugcaguuaugugauua

SEQ ID NO: 99267 - RNA, 22 nt, Human
caaaguuuggcucucaugacau

SEQ ID NO: 99268 - RNA, 22 nt, Human
caaauaagaaccacaggggagu

SEQ ID NO: 99269 - RNA, 22 nt, Human
caaauacaaauacgggcagcuu

SEQ ID NO: 99270 - RNA, 22 nt, Human
caaauacuaaacauaagauuuu

SEQ ID NO: 99271 - RNA, 22 nt, Human
caaauacugagcacgcaaucaa

SEQ ID NO: 99272 - RNA, 18 nt, Human
caaauacuguugucuuau

SEQ ID NO: 99273 - RNA, 22 nt, Human
caaauagacucuagaauuuauu

SEQ ID NO: 99274 - RNA, 22 nt, Human
caaauagugaaacagauggggg

SEQ ID NO: 99275 - RNA, 22 nt, Human
caaauauuccagguacaucccu

SEQ ID NO: 99276 - RNA, 22 nt, Human
cauuguugugagaucaagcagu

SEQ ID NO: 99277 - RNA, 18 nt, Human
cauuguuuccagaagacc

SEQ ID NO: 99278 - RNA, 22 nt, Human
cauuuaauagaugcuguuucag

SEQ ID NO: 99279 - RNA, 22 nt, Human
cauuuaauccauagaggaaugu

SEQ ID NO: 99280 - RNA, 22 nt, Human
cauuuaauccucacaagccuau

SEQ ID NO: 99281 - RNA, 22 nt, Human
cauuuaaucuggcucaugagca

SEQ ID NO: 99282 - RNA, 22 nt, Human
cauuuaaugccuuugccaucca

SEQ ID NO: 99283 - RNA, 22 nt, Human
cauuuacacuucuaaccacaag

SEQ ID NO: 99284 - RNA, 22 nt, Human
cauuuacagcagacugaugaaa

SEQ ID NO: 99285 - RNA, 22 nt, Human
cauuuacagugagaguuuuuac

SEQ ID NO: 99286 - RNA, 22 nt, Human
cauuuacuguugaaucccuagc

SEQ ID NO: 99287 - RNA, 22 nt, Human
cauuuagagaguaaaaauuagc

SEQ ID NO: 99288 - RNA, 22 nt, Human
cauuuaguuauacuaaaacauu

SEQ ID NO: 99289 - RNA, 22 nt, Human
cauuuauauaaaauguccagaa

SEQ ID NO: 99290 - RNA, 22 nt, Human
cauuuauuaguuaguucgaugu

SEQ ID NO: 99291 - RNA, 22 nt, Human
cauuuauucucagauccuuguc

SEQ ID NO: 99292 - RNA, 22 nt, Human
cauuuauugaguggccacagug

SEQ ID NO: 99293 - RNA, 22 nt, Human
cauuucaaacaguuacagcugc

SEQ ID NO: 99294 - RNA, 22 nt, Human
cauuucaagcauugacuucuau

SEQ ID NO: 99295 - RNA, 22 nt, Human
cauuucaauuauuugcucuucu

SEQ ID NO: 99296 - RNA, 22 nt, Human
cauuucaccuuagagaauuauu

SEQ ID NO: 99297 - RNA, 21 nt, Human
cauuucaguaaggaagccugu

SEQ ID NO: 99298 - RNA, 22 nt, Human
cauuucccccucauguugcagc

SEQ ID NO: 99299 - RNA, 22 nt, Human
cauuuccugucuggaggucaaa

SEQ ID NO: 99300 - RNA, 21 nt, Human
cauuucuaagccuggcuauag

SEQ ID NO: 99301 - RNA, 22 nt, Human
cauuucuccugggugauaaauu

SEQ ID NO: 99302 - RNA, 22 nt, Human
cauuugaacuaauaacugugcu

SEQ ID NO: 99303 - RNA, 22 nt, Human
cauuugaaugagauugcuguaa

SEQ ID NO: 99304 - RNA, 21 nt, Human
cauuugaucccucaucaggau

SEQ ID NO: 99305 - RNA, 22 nt, Human
cauuugauccucacaacaaucu

SEQ ID NO: 99306 - RNA, 23 nt, Human
cauuugauccucacaauaaaugg

SEQ ID NO: 99307 - RNA, 22 nt, Human
cauuugcucugguuccuucugg

SEQ ID NO: 99308 - RNA, 22 nt, Human
cauuugguguuaggcauguuaa

SEQ ID NO: 99309 - RNA, 22 nt, Human
cauuuguacauguugucuucuu

SEQ ID NO: 99310 - RNA, 22 nt, Human
cauuuguacuguucaaugucau

SEQ ID NO: 99311 - RNA, 22 nt, Human
cauuuguaguuaaaaaugucuc

SEQ ID NO: 99312 - RNA, 22 nt, Human
cauuuguauguuccuccuuagg

SEQ ID NO: 99313 - RNA, 22 nt, Human
cauuugucucuaggaagugagg

SEQ ID NO: 99314 - RNA, 22 nt, Human
cauuuguguccgucccaguucu

SEQ ID NO: 99315 - RNA, 22 nt, Human
cauuuguuaaccaguguggauu

SEQ ID NO: 99316 - RNA, 22 nt, Human
cauuuguuuagaagucuuuaua

SEQ ID NO: 99317 - RNA, 22 nt, Human
cauuuuacugacucuugaauua

SEQ ID NO: 99318 - RNA, 22 nt, Human
cauuuuauccucugggaagcua

SEQ ID NO: 99319 - RNA, 19 nt, Human
cauuuucucauugugcccc

SEQ ID NO: 99320 - RNA, 22 nt, Human
cauuuugugcacacguggaguu

SEQ ID NO: 99321 - RNA, 22 nt, Human
ccaaaaagcucagagauauguu

SEQ ID NO: 99322 - RNA, 22 nt, Human
ccaaaaaguacauuuaggugug

SEQ ID NO: 99323 - RNA, 19 nt, Human
ccaaaagcaauuccaagua

SEQ ID NO: 99324 - RNA, 22 nt, Human
ccaaaauaacagcccaauucac

SEQ ID NO: 99325 - RNA, 22 nt, Human
ccaaaauauuagugcuuaagua

SEQ ID NO: 99326 - RNA, 22 nt, Human
ccaaacugggccagucagcugu

SEQ ID NO: 99327 - RNA, 22 nt, Human
ccaaagcaagucacaugaucaa

SEQ ID NO: 99328 - RNA, 21 nt, Human
ccaaaggcuauguaucuucug

SEQ ID NO: 99329 - RNA, 22 nt, Human
ccaaaguccacaguuuacauua

SEQ ID NO: 99330 - RNA, 22 nt, Human
ccaaaguccauaguuuacauua

SEQ ID NO: 99331 - RNA, 22 nt, Human
ccaaagugcugagauuacaggu

SEQ ID NO: 99332 - RNA, 22 nt, Human
ccaaaguuuuuauaguuagcau

SEQ ID NO: 99333 - RNA, 22 nt, Human
ccaaaugugccuguuucaacaa

SEQ ID NO: 99334 - RNA, 22 nt, Human
ccaacaccaucugagcuccagc

SEQ ID NO: 99335 - RNA, 21 nt, Human
ccaagacucccaucuaguggu

SEQ ID NO: 99336 - RNA, 21 nt, Human
ccaagagcaaugcuaaggaga

SEQ ID NO: 99337 - RNA, 22 nt, Human
ccaagaggggaagggccgcagc

SEQ ID NO: 99338 - RNA, 22 nt, Human
ccaagagguaauacgagauauc

SEQ ID NO: 99339 - RNA, 22 nt, Human
ccaagaguaaauucaugaugcc

SEQ ID NO: 99340 - RNA, 22 nt, Human
ccaagaguucaagagugaacca

SEQ ID NO: 99341 - RNA, 22 nt, Human
ccaagauaaucugugaaaaauc

SEQ ID NO: 99342 - RNA, 22 nt, Human
ccaagcaaauaaucacccacua

SEQ ID NO: 99343 - RNA, 22 nt, Human
ccaagcaaggcuaauucacuug

SEQ ID NO: 99344 - RNA, 22 nt, Human
ccaagcaggauauucuguguca

SEQ ID NO: 99345 - RNA, 22 nt, Human
ccaagcaugggguucaguagga

SEQ ID NO: 99346 - RNA, 22 nt, Human
ccaagccuagucgugcacacag

SEQ ID NO: 99347 - RNA, 22 nt, Human
ccaagcugccugaggcaaauuu

SEQ ID NO: 99348 - RNA, 23 nt, Human
ccaagcuucuaaugcugcugagc

SEQ ID NO: 99349 - RNA, 22 nt, Human
ccaagcuuucgaucaaccagaa

SEQ ID NO: 99350 - RNA, 22 nt, Human
ccaaggacguacaggagauaau

SEQ ID NO: 99351 - RNA, 22 nt, Human
ccaaggagcaaggcucaacaag

SEQ ID NO: 99352 - RNA, 22 nt, Human
ccaaggaguagagcaggaagcu

SEQ ID NO: 99353 - RNA, 20 nt, Human
ccaaggauuggcaagcagca

SEQ ID NO: 99354 - RNA, 22 nt, Human
ccaaggccaucagguagguccu

SEQ ID NO: 99355 - RNA, 22 nt, Human
ccaaggccccuguggucuagcc

SEQ ID NO: 99356 - RNA, 22 nt, Human
ccaaggcuggagggcuuaugua

SEQ ID NO: 99357 - RNA, 22 nt, Human
ccaaggcugucauucaguagcu

SEQ ID NO: 99358 - RNA, 22 nt, Human
ccaaggcuuccugaccuacaug

SEQ ID NO: 99359 - RNA, 22 nt, Human
caagauuuguauugggccucug

SEQ ID NO: 99360 - RNA, 22 nt, Human
caagcagaagccucaggggcau

SEQ ID NO: 99361 - RNA, 22 nt, Human
caagcagagacuagauagcugu

SEQ ID NO: 99362 - RNA, 22 nt, Human
caagcaggccuggcuggaccgu

SEQ ID NO: 99363 - RNA, 22 nt, Human
caagcagucagccugaagacug

SEQ ID NO: 99364 - RNA, 22 nt, Human
caagcaugucuucuuaagcaau

SEQ ID NO: 99365 - RNA, 21 nt, Human
caagccagaccaauagcagcc

SEQ ID NO: 99366 - RNA, 22 nt, Human
caagccaguuuguaguucucuc

SEQ ID NO: 99367 - RNA, 23 nt, Human
caagcugcaguuugguugguggg

SEQ ID NO: 99368 - RNA, 22 nt, Human
caagcuggaguuccucagagug

SEQ ID NO: 99369 - RNA, 22 nt, Human
caagcugggugcgggcaguaua

SEQ ID NO: 99370 - RNA, 22 nt, Human
caaggaaaacagaugaucaaca

SEQ ID NO: 99371 - RNA, 22 nt, Human
caaggagaaaacggcuucugaa

SEQ ID NO: 99372 - RNA, 22 nt, Human
caaggagaguaauugaaugaga

SEQ ID NO: 99373 - RNA, 22 nt, Human
caaggaggaagaugcaggggac

SEQ ID NO: 99374 - RNA, 22 nt, Human
caaggaggcagugggacuugaa

SEQ ID NO: 99375 - RNA, 22 nt, Human
caaggcagcguuccuuucugga

SEQ ID NO: 99376 - RNA, 22 nt, Human
caaggcaggaagccugucuuau

SEQ ID NO: 99377 - RNA, 22 nt, Human
caaggcagucccuacucccugc

SEQ ID NO: 99378 - RNA, 22 nt, Human
caaggcaugcacaagaaggggg

SEQ ID NO: 99379 - RNA, 22 nt, Human
caaggcauucuugcagguaggg

SEQ ID NO: 99380 - RNA, 22 nt, Human
caaggccagggaauuuuucugg

SEQ ID NO: 99381 - RNA, 22 nt, Human
caaggccaguucaccaagggca

SEQ ID NO: 99382 - RNA, 22 nt, Human
caaggcuacccuuucaccaaaa

SEQ ID NO: 99383 - RNA, 22 nt, Human
caaggcuagaaguccaacauca

SEQ ID NO: 99384 - RNA, 22 nt, Human
caaggcuagcaagcaguaguca

SEQ ID NO: 99385 - RNA, 22 nt, Human
caaggcugagaaauucugcccu

SEQ ID NO: 99386 - RNA, 22 nt, Human
caaggcugcaaaacuacauggg

SEQ ID NO: 99387 - RNA, 22 nt, Human
caaggcugcugcgggucgcacc

SEQ ID NO: 99388 - RNA, 22 nt, Human
caaggcugucuccagcuuccaa

SEQ ID NO: 99389 - RNA, 22 nt, Human
caaggcuuaucagccaggagcc

SEQ ID NO: 99390 - RNA, 22 nt, Human
caagggaaggcuaagggcaaca

SEQ ID NO: 99391 - RNA, 22 nt, Human
caagggaccugagauggucucu

SEQ ID NO: 99392 - RNA, 22 nt, Human
caagggaguugcugcaugcagg

SEQ ID NO: 99393 - RNA, 22 nt, Human
auuuuguuaucagggcuuugca

SEQ ID NO: 99394 - RNA, 22 nt, Human
auuuuguugaugguggaguagc

SEQ ID NO: 99395 - RNA, 20 nt, Human
auuuuguuuauguuccucuc

SEQ ID NO: 99396 - RNA, 22 nt, Human
auuuuuccaauuaggauaaaga

SEQ ID NO: 99397 - RNA, 22 nt, Human
auuuuuccaugauacuuaucug

SEQ ID NO: 99398 - RNA, 22 nt, Human
auuuuuccauucucuguuagua

SEQ ID NO: 99399 - RNA, 19 nt, Human
auuuuucuuccucugugca

SEQ ID NO: 99400 - RNA, 22 nt, Human
auuuuugagcugugaacauagc

SEQ ID NO: 99401 - RNA, 22 nt, Human
caaaaagcuuagguaacaagcc

SEQ ID NO: 99402 - RNA, 22 nt, Human
caaaacauucagagagcucacu

SEQ ID NO: 99403 - RNA, 22 nt, Human
caaaaccaagaacauucauuuc

SEQ ID NO: 99404 - RNA, 22 nt, Human
caaaacuaucaggcucaaagcu

SEQ ID NO: 99405 - RNA, 21 nt, Human
caaaacuuaggugacuuagga

SEQ ID NO: 99406 - RNA, 22 nt, Human
caaaagaagcucuuggggcuag

SEQ ID NO: 99407 - RNA, 22 nt, Human
caaaagauacuugcaucuaacu

SEQ ID NO: 99408 - RNA, 22 nt, Human
caaaagcaaagucccugaaugu

SEQ ID NO: 99409 - RNA, 22 nt, Human
caaaagcaguucuaucugaguu

SEQ ID NO: 99410 - RNA, 22 nt, Human
caaaaguaauugugguuuucac

SEQ ID NO: 99411 - RNA, 22 nt, Human
caaaaguagugaaguuguacau

SEQ ID NO: 99412 - RNA, 22 nt, Human
caaaagucuuccuauucucuua

SEQ ID NO: 99413 - RNA, 22 nt, Human
caaaauaccacgacuuguuuua

SEQ ID NO: 99414 - RNA, 22 nt, Human
caaaaugaugugauuuuauugu

SEQ ID NO: 99415 - RNA, 23 nt, Human
caaaaugcuaugugcccaaugca

SEQ ID NO: 99416 - RNA, 22 nt, Human
caaaauuagaaaugcagcuguu

SEQ ID NO: 99417 - RNA, 22 nt, Human
caaacauugcuaccagagguuu

SEQ ID NO: 99418 - RNA, 17 nt, Human
caaaccaguaagacugc

SEQ ID NO: 99419 - RNA, 22 nt, Human
caaaccuguuagaggucaucgu

SEQ ID NO: 99420 - RNA, 22 nt, Human
caaacuugucuaucuaggaauc

SEQ ID NO: 99421 - RNA, 22 nt, Human
caaacuuucaguuauaacauga

SEQ ID NO: 99422 - RNA, 22 nt, Human
caaagaaggaacuauaauccca

SEQ ID NO: 99423 - RNA, 20 nt, Human
caaagacaugcuaggggugg

SEQ ID NO: 99424 - RNA, 22 nt, Human
caaagaccauguggccugaaaa

SEQ ID NO: 99425 - RNA, 22 nt, Human
caaagacugcauaacacaugaa

SEQ ID NO: 99426 - RNA, 22 nt, Human
caaagagcuguucagugucgcu

SEQ ID NO: 99427 - RNA, 22 nt, Human
caaagagguuuugagggcagcu

SEQ ID NO: 99428 - RNA, 22 nt, Human
caaagaguccagcacccucucc

SEQ ID NO: 99429 - RNA, 22 nt, Human
caaagaugucauugguaagaca

SEQ ID NO: 99430 - RNA, 22 nt, Human
caaagcaaggcucaguuugaac

SEQ ID NO: 99431 - RNA, 22 nt, Human
caaagcaccacaaaccagguga

SEQ ID NO: 99432 - RNA, 22 nt, Human
caaagcagccugcaguguggac

SEQ ID NO: 99433 - RNA, 22 nt, Human
caaagcagcggauugggauagu

SEQ ID NO: 99434 - RNA, 22 nt, Human
caaagcaggaagcuccugacag

SEQ ID NO: 99435 - RNA, 18 nt, Human
caaagcaggugacagugu

SEQ ID NO: 99436 - RNA, 22 nt, Human
caaagccauagaguagauaaga

SEQ ID NO: 99437 - RNA, 22 nt, Human
caaagcccagaggccucacuuu

SEQ ID NO: 99438 - RNA, 22 nt, Human
caaagcccuggaaagaugaaga

SEQ ID NO: 99439 - RNA, 22 nt, Human
caaagccucugauuucacuugu

SEQ ID NO: 99440 - RNA, 22 nt, Human
caaagcugacgaggucagcauc

SEQ ID NO: 99441 - RNA, 22 nt, Human
caaagcugauacucagcaagua

SEQ ID NO: 99442 - RNA, 22 nt, Human
caaagcuggaaaaggaggcugg

SEQ ID NO: 99443 - RNA, 22 nt, Human
caaagcuguaccccaaccuaug

SEQ ID NO: 99444 - RNA, 21 nt, Human
caaaggacuguagcucacuga

SEQ ID NO: 99445 - RNA, 22 nt, Human
caaaggcaggcccccugugcag

SEQ ID NO: 99446 - RNA, 22 nt, Human
caaaggcugccacuguggcugu

SEQ ID NO: 99447 - RNA, 22 nt, Human
caaagggaaacgcagugucaag

SEQ ID NO: 99448 - RNA, 17 nt, Human
caaagggagcccaccaa

SEQ ID NO: 99449 - RNA, 22 nt, Human
caaagggcucuagacucagcag

SEQ ID NO: 99450 - RNA, 22 nt, Human
caaagguauaaguuaauauaca

SEQ ID NO: 99451 - RNA, 22 nt, Human
caaagguauucucauuuuggaa

SEQ ID NO: 99452 - RNA, 22 nt, Human
caaagguuucacaguagcccau

SEQ ID NO: 99453 - RNA, 22 nt, Human
caaaguacagugcuuccuggga

SEQ ID NO: 99454 - RNA, 22 nt, Human
caaaguaucaacucccacacug

SEQ ID NO: 99455 - RNA, 22 nt, Human
caaagucauaaaacuuguaagu

SEQ ID NO: 99456 - RNA, 22 nt, Human
caaagucuucaguugauucuga

SEQ ID NO: 99457 - RNA, 22 nt, Human
caaagugcagaaggaacugggu

SEQ ID NO: 99458 - RNA, 22 nt, Human
caaagugcugggauuauaggca

SEQ ID NO: 99459 - RNA, 22 nt, Human
caaauaauuacuauccucacuu

SEQ ID NO: 99460 - RNA, 22 nt, Human
caaauacuuacugaaccugugc

SEQ ID NO: 99461 - RNA, 22 nt, Human
caaauacuuuuagccuauugag

SEQ ID NO: 99462 - RNA, 22 nt, Human
caaauagguaaauguaugcugu

SEQ ID NO: 99463 - RNA, 22 nt, Human
caaauaguaugagcaaugauuc

SEQ ID NO: 99464 - RNA, 22 nt, Human
caaauaguuuuucauguauuau

SEQ ID NO: 99465 - RNA, 20 nt, Human
caaaucacagguaauugcaa

SEQ ID NO: 99466 - RNA, 22 nt, Human
caaauccagaucccagucguag

SEQ ID NO: 99467 - RNA, 22 nt, Human
caaaucuccuuaaagguaaaau

SEQ ID NO: 99468 - RNA, 22 nt, Human
cagaaauauuuauugagugaca

SEQ ID NO: 99469 - RNA, 18 nt, Human
cagaaaucacaccagcac

SEQ ID NO: 99470 - RNA, 23 nt, Human
cagaaaugacaguaagcacccug

SEQ ID NO: 99471 - RNA, 22 nt, Human
cagaaauguuuauauguggugu

SEQ ID NO: 99472 - RNA, 22 nt, Human
cagaacagaaucguguggugag

SEQ ID NO: 99473 - RNA, 22 nt, Human
cagaacagagccugaaucucuc

SEQ ID NO: 99474 - RNA, 22 nt, Human
cagaacagggcccaaggggucg

SEQ ID NO: 99475 - RNA, 22 nt, Human
cagaacauuccaugugcccugc

SEQ ID NO: 99476 - RNA, 22 nt, Human
cagaaccugagagcacaauccu

SEQ ID NO: 99477 - RNA, 22 nt, Human
cagaacuggccuuucaucaguc

SEQ ID NO: 99478 - RNA, 22 nt, Human
cagaacuucauauugacguuag

SEQ ID NO: 99479 - RNA, 22 nt, Human
cagaacuuggcaaagccgacug

SEQ ID NO: 99480 - RNA, 22 nt, Human
cagaagaaaucauuaucuggac

SEQ ID NO: 99481 - RNA, 22 nt, Human
cagaagacagcuguuucacucg

SEQ ID NO: 99482 - RNA, 22 nt, Human
cagaagacgccugggugcugua

SEQ ID NO: 99483 - RNA, 22 nt, Human
cagaagaggacuggguagcuca

SEQ ID NO: 99484 - RNA, 22 nt, Human
cagaagaugcuuuguaaaauga

SEQ ID NO: 99485 - RNA, 22 nt, Human
cagaagcacauguuuacaugua

SEQ ID NO: 99486 - RNA, 22 nt, Human
cagaagcagaacacuagauuua

SEQ ID NO: 99487 - RNA, 22 nt, Human
cagaagcauugacuccuugcuc

SEQ ID NO: 99488 - RNA, 22 nt, Human
cagaagcugcagugaucuggga

SEQ ID NO: 99489 - RNA, 22 nt, Human
cagaaggagggggcaagcccug

SEQ ID NO: 99490 - RNA, 22 nt, Human
cagaaggcauagaugaaggccu

SEQ ID NO: 99491 - RNA, 18 nt, Human
cagaaguccuucaaggcc

SEQ ID NO: 99492 - RNA, 22 nt, Human
cagaagugcaauuuaaauuagg

SEQ ID NO: 99493 - RNA, 22 nt, Human
cagaagugguauuaauuagauu

SEQ ID NO: 99494 - RNA, 22 nt, Human
cagaaguuagacuucaacuaau

SEQ ID NO: 99495 - RNA, 22 nt, Human
cagaaguugccacaugacccuu

SEQ ID NO: 99496 - RNA, 22 nt, Human
cagaaguuugacauguuuagcu

SEQ ID NO: 99497 - RNA, 22 nt, Human
cagaaguuuugcucucuugggu

SEQ ID NO: 99498 - RNA, 22 nt, Human
cagaauaaaagucccaaggcau

SEQ ID NO: 99499 - RNA, 22 nt, Human
cagaauaauauuggucucauag

SEQ ID NO: 99500 - RNA, 22 nt, Human
cagaaucucugggaguggauca

SEQ ID NO: 99501 - RNA, 22 nt, Human
cagaaucuucuuaauuggcaca

SEQ ID NO: 99502 - RNA, 21 nt, Human
cagaaugcauucuuugaagga

SEQ ID NO: 99503 - RNA, 22 nt, Human
cagaauguauaugaucuaaggu

SEQ ID NO: 99504 - RNA, 22 nt, Human
cagaauucgaaugagcagaauc

SEQ ID NO: 99505 - RNA, 22 nt, Human
cagaauuuaaguggauuauucu

SEQ ID NO: 99506 - RNA, 22 nt, Human
cagaauuuuucacucaaucuuc

SEQ ID NO: 99507 - RNA, 22 nt, Human
cagacaaggccaucuuucauuu

SEQ ID NO: 99508 - RNA, 22 nt, Human
cagacaauuaaguaauugaggu

SEQ ID NO: 99509 - RNA, 22 nt, Human
cagacacaccaggcccauucug

SEQ ID NO: 99510 - RNA, 22 nt, Human
cagacacagauaugcauauggc

SEQ ID NO: 99511 - RNA, 18 nt, Human
cagacacucugcucugca

SEQ ID NO: 99512 - RNA, 22 nt, Human
cagacacugcagcagucuccca

SEQ ID NO: 99513 - RNA, 22 nt, Human
cagacacuuauugagcaaguac

SEQ ID NO: 99514 - RNA, 22 nt, Human
cagacagaaggcuccuugaggu

SEQ ID NO: 99515 - RNA, 22 nt, Human
cagacagacagccguggccacc

SEQ ID NO: 99516 - RNA, 22 nt, Human
cagacagaccugcaagggcaca

SEQ ID NO: 99517 - RNA, 22 nt, Human
cagacagaggcuguaugagggc

SEQ ID NO: 99518 - RNA, 22 nt, Human
cagacagcaggccuggaugugu

SEQ ID NO: 99519 - RNA, 22 nt, Human
cagacagcugcuuucuugcugu

SEQ ID NO: 99520 - RNA, 22 nt, Human
cagacaggcuagccagacucac

SEQ ID NO: 99521 - RNA, 22 nt, Human
cagacaucacacucagauugca

SEQ ID NO: 99522 - RNA, 20 nt, Human
cagacaucuccaaaucugug

SEQ ID NO: 99523 - RNA, 22 nt, Human
cagacauggcgccaagugcuag

SEQ ID NO: 99524 - RNA, 22 nt, Human
cagaccagaaggaagccgacaa

SEQ ID NO: 99525 - RNA, 22 nt, Human
cagaccagccauuugccucuuc

SEQ ID NO: 99526 - RNA, 23 nt, Human
cagacccucaauccacuuguuuu

SEQ ID NO: 99527 - RNA, 17 nt, Human
cagaccucugugaagcc

SEQ ID NO: 99528 - RNA, 22 nt, Human
cagaccugagguugaguaccag

SEQ ID NO: 99529 - RNA, 22 nt, Human
cagaccuggggccugggagccc

SEQ ID NO: 99530 - RNA, 22 nt, Human
cagacucucuuccaugcaucac

SEQ ID NO: 99531 - RNA, 22 nt, Human
cagacugaaaaucccugguagu

SEQ ID NO: 99532 - RNA, 22 nt, Human
cagacuggccacaucugcacug

SEQ ID NO: 99533 - RNA, 22 nt, Human
cagacuguggcuucuuggaggg

SEQ ID NO: 99534 - RNA, 22 nt, Human
cagacuuucaaggagugaaggc

SEQ ID NO: 99535 - RNA, 22 nt, Human
cagagaaagaagcccauucauu

SEQ ID NO: 99536 - RNA, 22 nt, Human
cagagaacaaagcugaggguuu

SEQ ID NO: 99537 - RNA, 22 nt, Human
cagagaacuccaguggcuggcg

SEQ ID NO: 99538 - RNA, 22 nt, Human
cagagaauaaaagggcauuccu

SEQ ID NO: 99539 - RNA, 22 nt, Human
cagagacaaccugguagagaaa

SEQ ID NO: 99540 - RNA, 22 nt, Human
cccaagggugcccagcagagga

SEQ ID NO: 99541 - RNA, 22 nt, Human
cccaaguuaaaauucagugcuc

SEQ ID NO: 99542 - RNA, 22 nt, Human
cccaaguuaauuuguagcugaa

SEQ ID NO: 99543 - RNA, 22 nt, Human
cccaauaaaauucauuuucauu

SEQ ID NO: 99544 - RNA, 22 nt, Human
cccacacacauuuaugauagga

SEQ ID NO: 99545 - RNA, 22 nt, Human
cccacacacuggcugcugccaa

SEQ ID NO: 99546 - RNA, 22 nt, Human
cccacacauuuuucacuuaccg

SEQ ID NO: 99547 - RNA, 22 nt, Human
cccacacucugagaaaugcuga

SEQ ID NO: 99548 - RNA, 22 nt, Human
cccacaggacgggcuaaagagu

SEQ ID NO: 99549 - RNA, 22 nt, Human
cccacaggcaggggcagagaca

SEQ ID NO: 99550 - RNA, 22 nt, Human
cccacagguggaagccucggaa

SEQ ID NO: 99551 - RNA, 22 nt, Human
cccacaucucacaucuuggaac

SEQ ID NO: 99552 - RNA, 22 nt, Human
cccacauuuuugagucuucauc

SEQ ID NO: 99553 - RNA, 22 nt, Human
cccaccacgugcuuugcuggag

SEQ ID NO: 99554 - RNA, 22 nt, Human
cccaccaguacagaugguagau

SEQ ID NO: 99555 - RNA, 22 nt, Human
cccacccagccuggcugagggg

SEQ ID NO: 99556 - RNA, 22 nt, Human
cccacccagcugagccgcucac

SEQ ID NO: 99557 - RNA, 22 nt, Human
cccacccucaagggugucuaua

SEQ ID NO: 99558 - RNA, 22 nt, Human
cccaccucucagagagccuugc

SEQ ID NO: 99559 - RNA, 22 nt, Human
cccacguugaaccgcuuacaga

SEQ ID NO: 99560 - RNA, 22 nt, Human
cccacuccuggagcuagggcuc

SEQ ID NO: 99561 - RNA, 22 nt, Human
cccacuguugccucaaauauca

SEQ ID NO: 99562 - RNA, 22 nt, Human
cccagacagucaagaggccugc

SEQ ID NO: 99563 - RNA, 22 nt, Human
cccagagaaccuucugugccac

SEQ ID NO: 99564 - RNA, 19 nt, Human
cccagagagaucucuugcc

SEQ ID NO: 99565 - RNA, 22 nt, Human
cccagagaucuuguccuuucca

SEQ ID NO: 99566 - RNA, 22 nt, Human
cccagagaugggaggugaucgg

SEQ ID NO: 99567 - RNA, 23 nt, Human
cccagagcacagccuccagaugc

SEQ ID NO: 99568 - RNA, 19 nt, Human
cccagagcauccugaacuu

SEQ ID NO: 99569 - RNA, 22 nt, Human
cccagagcucagugugcaaggu

SEQ ID NO: 99570 - RNA, 22 nt, Human
cccagagcugagggggcacguu

SEQ ID NO: 99571 - RNA, 22 nt, Human
cccagagcugagucugauauau

SEQ ID NO: 99572 - RNA, 22 nt, Human
cccagagcugauuguuggagcc

SEQ ID NO: 99573 - RNA, 19 nt, Human
cccagaggaaugccuggaa

SEQ ID NO: 99574 - RNA, 22 nt, Human
cccagaggggucgucugagggg

SEQ ID NO: 99575 - RNA, 20 nt, Human
cccagagguugcggcaggag

SEQ ID NO: 99576 - RNA, 23 nt, Human
cccagagucaucuguagcugugg

SEQ ID NO: 99577 - RNA, 22 nt, Human
cagagccccucagcucucuccc

SEQ ID NO: 99578 - RNA, 22 nt, Human
cagagcccuaguccugauggcc

SEQ ID NO: 99579 - RNA, 22 nt, Human
cagagcccugggcacaugguag

SEQ ID NO: 99580 - RNA, 22 nt, Human
cagagcccuuggcuggagccca

SEQ ID NO: 99581 - RNA, 22 nt, Human
cagagccucagaauccugugga

SEQ ID NO: 99582 - RNA, 22 nt, Human
cagagccucccuccucugccau

SEQ ID NO: 99583 - RNA, 22 nt, Human
cagagccugcucacgucucugu

SEQ ID NO: 99584 - RNA, 21 nt, Human
cagagccuguguugacaguug

SEQ ID NO: 99585 - RNA, 21 nt, Human
cagagcucuuucugcuugcug

SEQ ID NO: 99586 - RNA, 22 nt, Human
cagagcugcagauugaaggcau

SEQ ID NO: 99587 - RNA, 22 nt, Human
cagagcugcuucccaguuugug

SEQ ID NO: 99588 - RNA, 22 nt, Human
cagagcuggccugugauuuuug

SEQ ID NO: 99589 - RNA, 23 nt, Human
cagagcuggcucagagcugccug

SEQ ID NO: 99590 - RNA, 22 nt, Human
cagagcugggcauggugaaagg

SEQ ID NO: 99591 - RNA, 22 nt, Human
cagagcugugauaaauagauau

SEQ ID NO: 99592 - RNA, 20 nt, Human
cagagcuguuauggaugaug

SEQ ID NO: 99593 - RNA, 22 nt, Human
cagagcuuucugucacauuagu

SEQ ID NO: 99594 - RNA, 22 nt, Human
cagagcuuugugucagggcugu

SEQ ID NO: 99595 - RNA, 22 nt, Human
cagaggaagggugcugcgaaag

SEQ ID NO: 99596 - RNA, 22 nt, Human
cagaggacaauagaauggaaag

SEQ ID NO: 99597 - RNA, 22 nt, Human
cagaggagaauugcgggaucau

SEQ ID NO: 99598 - RNA, 18 nt, Human
cagaggagagacauucag

SEQ ID NO: 99599 - RNA, 22 nt, Human
cagaggaguucaguacacagcc

SEQ ID NO: 99600 - RNA, 22 nt, Human
cagaggauauaugguuuguaug

SEQ ID NO: 99601 - RNA, 22 nt, Human
cagaggcacagcuucuuuuaau

SEQ ID NO: 99602 - RNA, 22 nt, Human
cagaggcaggaagaugggcagu

SEQ ID NO: 99603 - RNA, 20 nt, Human
cagaggcauuuucagacucu

SEQ ID NO: 99604 - RNA, 19 nt, Human
cagaggccagaagcacagg

SEQ ID NO: 99605 - RNA, 22 nt, Human
cagaggccagggggcucacaaa

SEQ ID NO: 99606 - RNA, 22 nt, Human
cagaggcccagugagagggcug

SEQ ID NO: 99607 - RNA, 22 nt, Human
cagaggccccagaacuagcucu

SEQ ID NO: 99608 - RNA, 21 nt, Human
cagaggccucaugcucugugc

SEQ ID NO: 99609 - RNA, 22 nt, Human
cagaggccuugucuucuuugcu

SEQ ID NO: 99610 - RNA, 22 nt, Human
cagaggcuaagaguguccaaag

SEQ ID NO: 99611 - RNA, 22 nt, Human
cagaggcuaagaugagugggug

SEQ ID NO: 99612 - RNA, 22 nt, Human
cagaggcuaaggguagcuuggg

SEQ ID NO: 99613 - RNA, 22 nt, Human
cagaggcugcucuggguggcau

SEQ ID NO: 99614 - RNA, 22 nt, Human
cagaggcuucaagucauucucc

SEQ ID NO: 99615 - RNA, 22 nt, Human
cagaggcuuugcccuggaaacc

SEQ ID NO: 99616 - RNA, 22 nt, Human
cagagggaccagaacauacugu

SEQ ID NO: 99617 - RNA, 22 nt, Human
cagagggccaucucuaucuuca

SEQ ID NO: 99618 - RNA, 22 nt, Human
cagagggcccccuggccacagu

SEQ ID NO: 99619 - RNA, 22 nt, Human
cagagggcuguguaaggauguu

SEQ ID NO: 99620 - RNA, 22 nt, Human
cagaggggauaacagguguaga

SEQ ID NO: 99621 - RNA, 21 nt, Human
cagaggggcuagccuggcugc

SEQ ID NO: 99622 - RNA, 22 nt, Human
cagagggucaccaggaagugca

SEQ ID NO: 99623 - RNA, 23 nt, Human
cagaggguuccauggagcauggu

SEQ ID NO: 99624 - RNA, 21 nt, Human
cagaggguuucucagguguuu

SEQ ID NO: 99625 - RNA, 22 nt, Human
cagagguaccagcagccucugg

SEQ ID NO: 99626 - RNA, 22 nt, Human
cagagguagcaugcuguggcuu

SEQ ID NO: 99627 - RNA, 22 nt, Human
cagagguagggagcuauguuau

SEQ ID NO: 99628 - RNA, 22 nt, Human
cagagguauugcaaaagccuag

SEQ ID NO: 99629 - RNA, 21 nt, Human
cagaggucauccugaggacaa

SEQ ID NO: 99630 - RNA, 22 nt, Human
cagaggucccuauuucuuuguu

SEQ ID NO: 99631 - RNA, 22 nt, Human
cagaggucugacacugaauggu

SEQ ID NO: 99632 - RNA, 22 nt, Human
cagaggugacccauaguaccuc

SEQ ID NO: 99633 - RNA, 22 nt, Human
cagagguguacagagggaggcc

SEQ ID NO: 99634 - RNA, 22 nt, Human
cagagguuugaucgaguagguc

SEQ ID NO: 99635 - RNA, 22 nt, Human
cagaguaaggagcugucaaacg

SEQ ID NO: 99636 - RNA, 19 nt, Human
cagaguacaccagauagga

SEQ ID NO: 99637 - RNA, 22 nt, Human
cagagucagagcuccauggagu

SEQ ID NO: 99638 - RNA, 22 nt, Human
cagaguccaauugcucagagcg

SEQ ID NO: 99639 - RNA, 22 nt, Human
cagaguccccagcggcgcgggc

SEQ ID NO: 99640 - RNA, 22 nt, Human
cagagucuuguguguucagccc

SEQ ID NO: 99641 - RNA, 22 nt, Human
cagagugauuugaugaguugca

SEQ ID NO: 99642 - RNA, 22 nt, Human
cagaguggagaaacgcuucguc

SEQ ID NO: 99643 - RNA, 22 nt, Human
cagaguggcaugaaugaagccu

SEQ ID NO: 99644 - RNA, 22 nt, Human
cagaguguggcaucuuccaacu

SEQ ID NO: 99645 - RNA, 22 nt, Human
cagaguguuagcgcugguuggg

SEQ ID NO: 99646 - RNA, 22 nt, Human
cagaguucaaagccugcuggga

SEQ ID NO: 99647 - RNA, 19 nt, Human
cagaguuugcaggcagagg

SEQ ID NO: 99648 - RNA, 20 nt, Human
cagauaaacgggaaagaagc

SEQ ID NO: 99649 - RNA, 22 nt, Human
cagauaaauagacuuggucaga

SEQ ID NO: 99650 - RNA, 22 nt, Human
cagauaauaauaugacuucacu

SEQ ID NO: 99651 - RNA, 22 nt, Human
cagauacauuaaaaugaugauu

SEQ ID NO: 99652 - RNA, 22 nt, Human
cagauauaguggcuugccuggg

SEQ ID NO: 99653 - RNA, 22 nt, Human
cagaucaagcuguauggucaga

SEQ ID NO: 99654 - RNA, 22 nt, Human
cagaucaugaaugacugacaga

SEQ ID NO: 99655 - RNA, 22 nt, Human
cagaucugugguaucucuauuu

SEQ ID NO: 99656 - RNA, 22 nt, Human
cagaugaacucuauccuguggc

SEQ ID NO: 99657 - RNA, 22 nt, Human
cagaugaaguaggugacgagca

SEQ ID NO: 99658 - RNA, 22 nt, Human
cagaugaauaaaugaugaggua

SEQ ID NO: 99659 - RNA, 22 nt, Human
cagaugagcaugggcacaagca

SEQ ID NO: 99660 - RNA, 22 nt, Human
cagaugcacauucucaucagca

SEQ ID NO: 99661 - RNA, 22 nt, Human
cccugaggcaaaggcuagaguu

SEQ ID NO: 99662 - RNA, 22 nt, Human
cccugaggcugaggauaggugg

SEQ ID NO: 99663 - RNA, 22 nt, Human
cccugaggggaguggugaggug

SEQ ID NO: 99664 - RNA, 23 nt, Human
cccugcacuaagaggagaaggug

SEQ ID NO: 99665 - RNA, 22 nt, Human
cccugcagaaccacagacaaac

SEQ ID NO: 99666 - RNA, 22 nt, Human
cccugcagagggaugggggcag

SEQ ID NO: 99667 - RNA, 20 nt, Human
cccugcagccaugggagugg

SEQ ID NO: 99668 - RNA, 22 nt, Human
cccugcaguccuuucuuggcuc

SEQ ID NO: 99669 - RNA, 22 nt, Human
cccugccaaucccgucucucug

SEQ ID NO: 99670 - RNA, 22 nt, Human
cccugccaggguccugacagac

SEQ ID NO: 99671 - RNA, 22 nt, Human
cccugccuacaggguuuucuuu

SEQ ID NO: 99672 - RNA, 22 nt, Human
cccugccucugaagcugcucag

SEQ ID NO: 99673 - RNA, 22 nt, Human
cccugccugugggcaucaacau

SEQ ID NO: 99674 - RNA, 23 nt, Human
cccugcucaggggucugauucuc

SEQ ID NO: 99675 - RNA, 22 nt, Human
cccugcucuucugacucaagcu

SEQ ID NO: 99676 - RNA, 22 nt, Human
cccugcugcaggcuucaggagg

SEQ ID NO: 99677 - RNA, 22 nt, Human
cccugcugcauggccuccacga

SEQ ID NO: 99678 - RNA, 22 nt, Human
cccugcugucaggugcugggag

SEQ ID NO: 99679 - RNA, 22 nt, Human
cccugcuguguagcggaggaac

SEQ ID NO: 99680 - RNA, 22 nt, Human
cccuggaagguucucuggcuca

SEQ ID NO: 99681 - RNA, 20 nt, Human
cccuggacuccugagcaaac

SEQ ID NO: 99682 - RNA, 22 nt, Human
cccuggacuguucagggccuga

SEQ ID NO: 99683 - RNA, 22 nt, Human
cccuggagaggacucaccccug

SEQ ID NO: 99684 - RNA, 22 nt, Human
cccuggaggcggauguugcagu

SEQ ID NO: 99685 - RNA, 22 nt, Human
cccuggagugccggaaucaaga

SEQ ID NO: 99686 - RNA, 22 nt, Human
cuacagugacagaauuaaacag

SEQ ID NO: 99687 - RNA, 17 nt, Human
cuacaguguguuuccug

SEQ ID NO: 99688 - RNA, 22 nt, Human
cuacauaaauauuuaugugucu

SEQ ID NO: 99689 - RNA, 22 nt, Human
cuacaucaaguaaucuucaaaa

SEQ ID NO: 99690 - RNA, 22 nt, Human
cuacaucacuuaauucuuagaa

SEQ ID NO: 99691 - RNA, 22 nt, Human
cuacaucagaacauuuacccua

SEQ ID NO: 99692 - RNA, 22 nt, Human
cuacaugaauggguguauuacu

SEQ ID NO: 99693 - RNA, 22 nt, Human
cuacauggagaagaaaauucuu

SEQ ID NO: 99694 - RNA, 22 nt, Human
cuacauuaaauuggcuuacuua

SEQ ID NO: 99695 - RNA, 22 nt, Human
cuacauuauguuuauugggacu

SEQ ID NO: 99696 - RNA, 22 nt, Human
cuacauuguuaucuguaagugu

SEQ ID NO: 99697 - RNA, 22 nt, Human
cuacauuucccagcugccuucc

SEQ ID NO: 99698 - RNA, 22 nt, Human
cuacauuuggagaguauaggaa

SEQ ID NO: 99699 - RNA, 22 nt, Human
caggaggagggcagccgccucc

SEQ ID NO: 99700 - RNA, 22 nt, Human
caggaggaggugagguagaacu

SEQ ID NO: 99701 - RNA, 22 nt, Human
caggaggcagcgcucucaggac

SEQ ID NO: 99702 - RNA, 22 nt, Human
caggaggcaguggguguugucu

SEQ ID NO: 99703 - RNA, 22 nt, Human
caggaggcaucauggagcggac

SEQ ID NO: 99704 - RNA, 22 nt, Human
caggaggcccaaagggcgcaga

SEQ ID NO: 99705 - RNA, 22 nt, Human
caggaggcccggccacagccca

SEQ ID NO: 99706 - RNA, 20 nt, Human
caggagggacauuucagcau

SEQ ID NO: 99707 - RNA, 22 nt, Human
caggaggugcccucuaguggca

SEQ ID NO: 99708 - RNA, 22 nt, Human
caggagguggagcucaaguggu

SEQ ID NO: 99709 - RNA, 22 nt, Human
caggaguggugugagggacucc

SEQ ID NO: 99710 - RNA, 22 nt, Human
caggaguguugauugcucagga

SEQ ID NO: 99711 - RNA, 22 nt, Human
caggaguucaagguugcaguga

SEQ ID NO: 99712 - RNA, 22 nt, Human
caggauauuaguuuucuuguua

SEQ ID NO: 99713 - RNA, 22 nt, Human
caggauauuuacguucugcuac

SEQ ID NO: 99714 - RNA, 22 nt, Human
caggaucccuggccuccgccca

SEQ ID NO: 99715 - RNA, 22 nt, Human
caggaucuguuaaguuguucca

SEQ ID NO: 99716 - RNA, 22 nt, Human
caggaugaagggcaaaggcaag

SEQ ID NO: 99717 - RNA, 22 nt, Human
caggaugagguagaggcagaua

SEQ ID NO: 99718 - RNA, 21 nt, Human
caggaugaugggaagguggug

SEQ ID NO: 99719 - RNA, 22 nt, Human
caggaugauguuaauugaaguu

SEQ ID NO: 99720 - RNA, 20 nt, Human
caggaugauuggacacgaug

SEQ ID NO: 99721 - RNA, 22 nt, Human
caggaugccuuugaacucugga

SEQ ID NO: 99722 - RNA, 22 nt, Human
caggauggucuucauuuggcuc

SEQ ID NO: 99723 - RNA, 22 nt, Human
caggaugguggcaugaucagaa

SEQ ID NO: 99724 - RNA, 22 nt, Human
caggauugcagauuugauuaga

SEQ ID NO: 99725 - RNA, 22 nt, Human
caggcaacguccuuagagaugc

SEQ ID NO: 99726 - RNA, 22 nt, Human
caggcaaguucauuuccaggca

SEQ ID NO: 99727 - RNA, 22 nt, Human
caggcacagcuaagacuggcca

SEQ ID NO: 99728 - RNA, 22 nt, Human
caggcacaggggaaugucuuuu

SEQ ID NO: 99729 - RNA, 22 nt, Human
caggcacaguguugcuguucaa

SEQ ID NO: 99730 - RNA, 22 nt, Human
caggcacaguuccaagcauuuu

SEQ ID NO: 99731 - RNA, 22 nt, Human
caggcaccaauagggaucgugg

SEQ ID NO: 99732 - RNA, 22 nt, Human
caggcaccacacuaggggcuga

SEQ ID NO: 99733 - RNA, 22 nt, Human
caggcacccucugaggggaagc

SEQ ID NO: 99734 - RNA, 22 nt, Human
caggcacgggggcauggccucu

SEQ ID NO: 99735 - RNA, 22 nt, Human
caggcacuggccagucagcaca

SEQ ID NO: 99736 - RNA, 22 nt, Human
caggcacuggggaugcugggau

SEQ ID NO: 99737 - RNA, 22 nt, Human
caggcacugugccucgcucccu

SEQ ID NO: 99738 - RNA, 22 nt, Human
caggcacuucggcagcguggua

SEQ ID NO: 99739 - RNA, 22 nt, Human
caggcagaaugaccgaccucgc

SEQ ID NO: 99740 - RNA, 22 nt, Human
caggcagaaugagauuacuuca

SEQ ID NO: 99741 - RNA, 22 nt, Human
caggcagacauuuuugacauag

SEQ ID NO: 99742 - RNA, 22 nt, Human
caggcagaggaggccuucuccu

SEQ ID NO: 99743 - RNA, 20 nt, Human
caggcagaggaugcugacca

SEQ ID NO: 99744 - RNA, 22 nt, Human
caggcagagugagaagcccuug

SEQ ID NO: 99745 - RNA, 22 nt, Human
caggcagaguuagugauuuagg

SEQ ID NO: 99746 - RNA, 22 nt, Human
caggcagauauguucgcuuuaa

SEQ ID NO: 99747 - RNA, 22 nt, Human
caggcagcagaggaguguggga

SEQ ID NO: 99748 - RNA, 22 nt, Human
caggcagcauuuacucugauga

SEQ ID NO: 99749 - RNA, 22 nt, Human
caggcagccugcggucugcaca

SEQ ID NO: 99750 - RNA, 22 nt, Human
caggcagccuucucgucucaca

SEQ ID NO: 99751 - RNA, 22 nt, Human
caggcagcgcucguggccuggc

SEQ ID NO: 99752 - RNA, 22 nt, Human
caggcagcuagauuuauaacaa

SEQ ID NO: 99753 - RNA, 22 nt, Human
caggcagcucaaccuugggagc

SEQ ID NO: 99754 - RNA, 22 nt, Human
caggcagcugaggacuuugcua

SEQ ID NO: 99755 - RNA, 22 nt, Human
caggcaggagccagggauucca

SEQ ID NO: 99756 - RNA, 23 nt, Human
caggcaggaugaggacuacacuc

SEQ ID NO: 99757 - RNA, 22 nt, Human
caggcagggagcuggaaaggau

SEQ ID NO: 99758 - RNA, 22 nt, Human
caggcaggucagugaagaagga

SEQ ID NO: 99759 - RNA, 22 nt, Human
caggcaggugcagauuccucuu

SEQ ID NO: 99760 - RNA, 20 nt, Human
caggcaguuugugguuaggg

SEQ ID NO: 99761 - RNA, 22 nt, Human
caggcauaaguaauguuuuaug

SEQ ID NO: 99762 - RNA, 22 nt, Human
caggcauaaucucaucuuguuu

SEQ ID NO: 99763 - RNA, 22 nt, Human
caggcauaucuacauuauccaa

SEQ ID NO: 99764 - RNA, 22 nt, Human
caggcaugaucauaggaguuua

SEQ ID NO: 99765 - RNA, 22 nt, Human
caggcaugggccaugggaagug

SEQ ID NO: 99766 - RNA, 22 nt, Human
caggcauuguucuagguucuca

SEQ ID NO: 99767 - RNA, 22 nt, Human
caggccaagucccaagugcggg

SEQ ID NO: 99768 - RNA, 22 nt, Human
caggccacgccccggcguguga

SEQ ID NO: 99769 - RNA, 22 nt, Human
caggccagagcgcgugguuggg

SEQ ID NO: 99770 - RNA, 20 nt, Human
caggccagagguuugauggc

SEQ ID NO: 99771 - RNA, 22 nt, Human
caggccagaguccaacuccaga

SEQ ID NO: 99772 - RNA, 22 nt, Human
caggccaggcugcauuugcccc

SEQ ID NO: 99773 - RNA, 19 nt, Human
caggccagugucagggggc

SEQ ID NO: 99774 - RNA, 22 nt, Human
caggcccagcccuuagccaggu

SEQ ID NO: 99775 - RNA, 22 nt, Human
caggcccaggccagugguuccc

SEQ ID NO: 99776 - RNA, 22 nt, Human
caggcccauucuaggcuugcua

SEQ ID NO: 99777 - RNA, 22 nt, Human
caggcccauuuguagccacuuu

SEQ ID NO: 99778 - RNA, 22 nt, Human
caggcccucaggcaagggcucu

SEQ ID NO: 99779 - RNA, 22 nt, Human
caggcccucguggugagcuggg

SEQ ID NO: 99780 - RNA, 22 nt, Human
caggcccugccuuggcaugugu

SEQ ID NO: 99781 - RNA, 22 nt, Human
caggcccugggcaggcacagag

SEQ ID NO: 99782 - RNA, 22 nt, Human
caggccggggcggcgccaucuu

SEQ ID NO: 99783 - RNA, 22 nt, Human
caggccggugauucuggaugua

SEQ ID NO: 99784 - RNA, 22 nt, Human
caggccucaggggcucaggcug

SEQ ID NO: 99785 - RNA, 22 nt, Human
caggccucaugguguguccuuc

SEQ ID NO: 99786 - RNA, 22 nt, Human
caggccugacccugagcuucac

SEQ ID NO: 99787 - RNA, 22 nt, Human
caggccugagacaucugagaua

SEQ ID NO: 99788 - RNA, 22 nt, Human
caggccuggcccccggcacacc

SEQ ID NO: 99789 - RNA, 22 nt, Human
caggccugugaguugaggcccc

SEQ ID NO: 99790 - RNA, 17 nt, Human
caggccuugagccuuua

SEQ ID NO: 99791 - RNA, 18 nt, Human
caggccuuugagacagaa

SEQ ID NO: 99792 - RNA, 22 nt, Human
caggcgaccccuaggagcaaca

SEQ ID NO: 99793 - RNA, 22 nt, Human
caggcuacauuugcucugagaa

SEQ ID NO: 99794 - RNA, 22 nt, Human
caggcucaaggcugacuuccau

SEQ ID NO: 99795 - RNA, 22 nt, Human
cagggcuggcuuccaaguuguu

SEQ ID NO: 99796 - RNA, 23 nt, Human
cagggcugggcuugguguuaggc

SEQ ID NO: 99797 - RNA, 22 nt, Human
cagggcuugaaucaaggaaguc

SEQ ID NO: 99798 - RNA, 22 nt, Human
cagggcuugaucugcauccugc

SEQ ID NO: 99799 - RNA, 22 nt, Human
cagggcuugguuggaaccaccc

SEQ ID NO: 99800 - RNA, 22 nt, Human
cagggcuuuccugagaagugau

SEQ ID NO: 99801 - RNA, 22 nt, Human
caggggagugagucccucucug

SEQ ID NO: 99802 - RNA, 22 nt, Human
caggggccaaggguccagaccu

SEQ ID NO: 99803 - RNA, 22 nt, Human
caggggcucccugggugccagu

SEQ ID NO: 99804 - RNA, 22 nt, Human
caggggcucuaaugcaugauca

SEQ ID NO: 99805 - RNA, 22 nt, Human
caggggcugaaauguugggguu

SEQ ID NO: 99806 - RNA, 22 nt, Human
caggggcuguggcacauggugu

SEQ ID NO: 99807 - RNA, 22 nt, Human
caggggcugugggcggagccuc

SEQ ID NO: 99808 - RNA, 22 nt, Human
caggggcuguuugccucaggcc

SEQ ID NO: 99809 - RNA, 22 nt, Human
caggggcuuuuccucuauaagg

SEQ ID NO: 99810 - RNA, 22 nt, Human
cagggggcucaaaggagagugc

SEQ ID NO: 99811 - RNA, 22 nt, Human
cagggggugguccaggcugcgc

SEQ ID NO: 99812 - RNA, 22 nt, Human
cagggguguuuuuggccaggag

SEQ ID NO: 99813 - RNA, 22 nt, Human
caggguagacaguaggugucug

SEQ ID NO: 99814 - RNA, 22 nt, Human
caggguagggcaagggaaccug

SEQ ID NO: 99815 - RNA, 22 nt, Human
caggguccggcugccuggcugu

SEQ ID NO: 99816 - RNA, 22 nt, Human
cuauuuugccugccuagaaauc

SEQ ID NO: 99817 - RNA, 22 nt, Human
cucaaagaagggagguauuugg

SEQ ID NO: 99818 - RNA, 21 nt, Human
cucaaagaccaaaaguguaga

SEQ ID NO: 99819 - RNA, 22 nt, Human
cucaaagagccagguaaucacc

SEQ ID NO: 99820 - RNA, 22 nt, Human
cucaaauccccguuccucauuc

SEQ ID NO: 99821 - RNA, 21 nt, Human
cucaaaugccaguuuuauuua

SEQ ID NO: 99822 - RNA, 22 nt, Human
cucaaauguuuccacuucugcu

SEQ ID NO: 99823 - RNA, 22 nt, Human
cucaacagacucugccaucccu

SEQ ID NO: 99824 - RNA, 22 nt, Human
cucaacauaugacuuugguggg

SEQ ID NO: 99825 - RNA, 22 nt, Human
cucaacaugccuacucagucug

SEQ ID NO: 99826 - RNA, 22 nt, Human
cucaagauauuccagcucucaa

SEQ ID NO: 99827 - RNA, 22 nt, Human
cucaaggacuuauucaugccug

SEQ ID NO: 99828 - RNA, 22 nt, Human
cucaagucccgcaguguuccuc

SEQ ID NO: 99829 - RNA, 22 nt, Human
cucaagucuauugauaagugca

SEQ ID NO: 99830 - RNA, 22 nt, Human
cucaagugugaguuuuaaaguc

SEQ ID NO: 99831 - RNA, 22 nt, Human
cucaauacccagggacucuaga

SEQ ID NO: 99832 - RNA, 22 nt, Human
cucacagagccucugugucuuc

SEQ ID NO: 99833 - RNA, 22 nt, Human
cucacagagcucauacugggag

SEQ ID NO: 99834 - RNA, 22 nt, Human
cucacagcaaggagguaaggua

SEQ ID NO: 99835 - RNA, 22 nt, Human
cucacagcacuugugucauugg

SEQ ID NO: 99836 - RNA, 22 nt, Human
cucacagcagccagucugccuu

SEQ ID NO: 99837 - RNA, 21 nt, Human
cucacaggaugcaguguuacu

SEQ ID NO: 99838 - RNA, 22 nt, Human
cucacaggguucuaucgaagag

SEQ ID NO: 99839 - RNA, 22 nt, Human
cucacaguuuucuguaguccaa

SEQ ID NO: 99840 - RNA, 22 nt, Human
cucacauaccuguuuucccuuu

SEQ ID NO: 99841 - RNA, 22 nt, Human
cucacauaguaagcagucagua

SEQ ID NO: 99842 - RNA, 22 nt, Human
cucacaugauggccuuuuucau

SEQ ID NO: 99843 - RNA, 22 nt, Human
cucacauucacaggacagaagg

SEQ ID NO: 99844 - RNA, 22 nt, Human
cucacauuccacuugugccaac

SEQ ID NO: 99845 - RNA, 22 nt, Human
cucaccauaugacuuuacuaac

SEQ ID NO: 99846 - RNA, 18 nt, Human
cucaccauucugcccaau

SEQ ID NO: 99847 - RNA, 22 nt, Human
cucaccccacuaccccuuggug

SEQ ID NO: 99848 - RNA, 19 nt, Human
cucaccuggaggugcugau

SEQ ID NO: 99849 - RNA, 22 nt, Human
cucaccugggucagacaguugu

SEQ ID NO: 99850 - RNA, 22 nt, Human
cucacucaguuuuuaguucauc

SEQ ID NO: 99851 - RNA, 22 nt, Human
cucacugacugcaagucaaguu

SEQ ID NO: 99852 - RNA, 22 nt, Human
cucacugcaaguuccaccuacc

SEQ ID NO: 99853 - RNA, 22 nt, Human
cucacugcccugaaguuggguu

SEQ ID NO: 99854 - RNA, 22 nt, Human
cucagaaaaccucuuucuugau

SEQ ID NO: 99855 - RNA, 22 nt, Human
cucagaaagcaaucuggugagg

SEQ ID NO: 99856 - RNA, 22 nt, Human
cucagaaaucccacucugugua

SEQ ID NO: 99857 - RNA, 22 nt, Human
cucagaagaacccaggguccca

SEQ ID NO: 99858 - RNA, 22 nt, Human
cucagaaguucagccuagagua

SEQ ID NO: 99859 - RNA, 22 nt, Human
cucagaauaauguuucuaaagg

SEQ ID NO: 99860 - RNA, 22 nt, Human
cucagaaucugccaaguucagg

SEQ ID NO: 99861 - RNA, 22 nt, Human
cucagacacagccccacgaagu

SEQ ID NO: 99862 - RNA, 22 nt, Human
cucagacauuuguagaaagugc

SEQ ID NO: 99863 - RNA, 21 nt, Human
cucagaccacagcucacaccc

SEQ ID NO: 99864 - RNA, 22 nt, Human
cucagagaaaugucacaacaau

SEQ ID NO: 99865 - RNA, 21 nt, Human
cucagagacaaaugccauccc

SEQ ID NO: 99866 - RNA, 22 nt, Human
cucagagagggcaccagggcca

SEQ ID NO: 99867 - RNA, 22 nt, Human
cucagagcacuuuugaaagcuc

SEQ ID NO: 99868 - RNA, 21 nt, Human
cucagagcaguucagagggau

SEQ ID NO: 99869 - RNA, 22 nt, Human
cucagagccccaggagggugug

SEQ ID NO: 99870 - RNA, 22 nt, Human
cucagagggaggacugggcugg

SEQ ID NO: 99871 - RNA, 22 nt, Human
cucagaguccccaguggguuug

SEQ ID NO: 99872 - RNA, 22 nt, Human
cucagaguggggcucccugagg

SEQ ID NO: 99873 - RNA, 22 nt, Human
cucagaguucuccugggaggug

SEQ ID NO: 99874 - RNA, 22 nt, Human
cucagauucugaauaauaaaca

SEQ ID NO: 99875 - RNA, 22 nt, Human
cucagcaacccacacacggucu

SEQ ID NO: 99876 - RNA, 19 nt, Human
cucagcaagauagaaaugg

SEQ ID NO: 99877 - RNA, 22 nt, Human
cucagcaauuaccugugucucu

SEQ ID NO: 99878 - RNA, 22 nt, Human
cucagcacacucccaucuaauu

SEQ ID NO: 99879 - RNA, 22 nt, Human
cucagcagaggcaguauucagu

SEQ ID NO: 99880 - RNA, 22 nt, Human
cucagcagcagggaagagguca

SEQ ID NO: 99881 - RNA, 22 nt, Human
cucagcaguauacucugaagau

SEQ ID NO: 99882 - RNA, 22 nt, Human
cucagcaucaugguaucugggg

SEQ ID NO: 99883 - RNA, 22 nt, Human
cucagcauggagggagaacaag

SEQ ID NO: 99884 - RNA, 22 nt, Human
cucagccaugggguggaucagc

SEQ ID NO: 99885 - RNA, 22 nt, Human
cucagccaugucaugccuaccu

SEQ ID NO: 99886 - RNA, 22 nt, Human
cucagccccaauuugcccucuu

SEQ ID NO: 99887 - RNA, 22 nt, Human
cucagcccuccccggggaauaa

SEQ ID NO: 99888 - RNA, 20 nt, Human
cucagcuaaacaacacugac

SEQ ID NO: 99889 - RNA, 22 nt, Human
cucagcucauuguggauccggu

SEQ ID NO: 99890 - RNA, 22 nt, Human
cucagcuccagcccucagcagc

SEQ ID NO: 99891 - RNA, 22 nt, Human
cucagcucccuccacccagacc

SEQ ID NO: 99892 - RNA, 22 nt, Human
cucagcuucuaccuccugagug

SEQ ID NO: 99893 - RNA, 22 nt, Human
cucaggaaggaagcagggagcc

SEQ ID NO: 99894 - RNA, 22 nt, Human
cucaggacuugguuaguguuuu

SEQ ID NO: 99895 - RNA, 22 nt, Human
cucaggagguuuccugucuagg

SEQ ID NO: 99896 - RNA, 22 nt, Human
cucaggauccaucuccugcccu

SEQ ID NO: 99897 - RNA, 22 nt, Human
cucaggaugcaggucacaggac

SEQ ID NO: 99898 - RNA, 22 nt, Human
cucaggauuaaggaaucuaaau

SEQ ID NO: 99899 - RNA, 20 nt, Human
cucaggauugucuagccccu

SEQ ID NO: 99900 - RNA, 22 nt, Human
cucaggauugugccuagggaga

SEQ ID NO: 99901 - RNA, 22 nt, Human
cucaggcacuuuugucacagac

SEQ ID NO: 99902 - RNA, 22 nt, Human
cucaggcagugcccucuggccg

SEQ ID NO: 99903 - RNA, 22 nt, Human
cucaggcaguucuguagccucc

SEQ ID NO: 99904 - RNA, 22 nt, Human
acaggcccagcucuucaccaga

SEQ ID NO: 99905 - RNA, 22 nt, Human
acaggccuagggucaauuuccu

SEQ ID NO: 99906 - RNA, 18 nt, Human
acaggccucaguccugca

SEQ ID NO: 99907 - RNA, 22 nt, Human
acaugacacaggccuggccaau

SEQ ID NO: 99908 - RNA, 22 nt, Human
acaugacaccucuggcugggug

SEQ ID NO: 99909 - RNA, 22 nt, Human
acaugacauaguagaaaagccc

SEQ ID NO: 99910 - RNA, 22 nt, Human
acaugagaagcugcaacaugac

SEQ ID NO: 99911 - RNA, 23 nt, Human
acaugauacacaauuagcaaacc

SEQ ID NO: 99912 - RNA, 22 nt, Human
acaugauuuuuaaagagauaau

SEQ ID NO: 99913 - RNA, 22 nt, Human
acaugcaaagccacaggacccg

SEQ ID NO: 99914 - RNA, 22 nt, Human
acaugcaaagggaugcaauuau

SEQ ID NO: 99915 - RNA, 22 nt, Human
acaugcaaaugugcaugcaugu

SEQ ID NO: 99916 - RNA, 22 nt, Human
acaugcaacaaaguaccugcaa

SEQ ID NO: 99917 - RNA, 19 nt, Human
acaugcaaggcaccugcag

SEQ ID NO: 99918 - RNA, 22 nt, Human
acaugcacagcaagggugagag

SEQ ID NO: 99919 - RNA, 22 nt, Human
acaugcauacacguacauaccu

SEQ ID NO: 99920 - RNA, 22 nt, Human
acaugcauauacuuaaauaugu

SEQ ID NO: 99921 - RNA, 22 nt, Human
acaugcauggagggaaaauguc

SEQ ID NO: 99922 - RNA, 22 nt, Human
acaugcaugggguaaugguauu

SEQ ID NO: 99923 - RNA, 22 nt, Human
acaugcaugucaucagcccuuu

SEQ ID NO: 99924 - RNA, 22 nt, Human
acaugcaugucuaugggcaggu

SEQ ID NO: 99925 - RNA, 22 nt, Human
acaugcauuaaaaauacuugug

SEQ ID NO: 99926 - RNA, 22 nt, Human
acaugcauucucuaaaagcaaa

SEQ ID NO: 99927 - RNA, 22 nt, Human
acaugccagcccauuuaaaugg

SEQ ID NO: 99928 - RNA, 22 nt, Human
acaugccaucacuuucauuccu

SEQ ID NO: 99929 - RNA, 22 nt, Human
acaugccaugaagguauuuuug

SEQ ID NO: 99930 - RNA, 22 nt, Human
acaugcuacagugaaggaggaa

SEQ ID NO: 99931 - RNA, 22 nt, Human
acaugcuuucuagguccuucug

SEQ ID NO: 99932 - RNA, 20 nt, Human
acauggaaggucaaacuauc

SEQ ID NO: 99933 - RNA, 22 nt, Human
acauggagcucaaacaugagug

SEQ ID NO: 99934 - RNA, 21 nt, Human
acauggauauaggacugaauu

SEQ ID NO: 99935 - RNA, 22 nt, Human
acauggauuguuuuaaaagaug

SEQ ID NO: 99936 - RNA, 17 nt, Human
acauggcaguucacgcu

SEQ ID NO: 99937 - RNA, 22 nt, Human
acauggcauucacucccacagg

SEQ ID NO: 99938 - RNA, 22 nt, Human
acauggcuaaauuagcuuuacu

SEQ ID NO: 99939 - RNA, 21 nt, Human
acaugggaccugcgaaaggaa

SEQ ID NO: 99940 - RNA, 22 nt, Human
acaugggagagaaauaaaugua

SEQ ID NO: 99941 - RNA, 17 nt, Human
acaugggcugagacucc

SEQ ID NO: 99942 - RNA, 22 nt, Human
acauggggcccaaagagagguc

SEQ ID NO: 99943 - RNA, 22 nt, Human
acaugggggcugcugccagcga

SEQ ID NO: 99944 - RNA, 22 nt, Human
acauggguuauugugagguuaa

SEQ ID NO: 99945 - RNA, 22 nt, Human
acaugguaaauugguaaaggac

SEQ ID NO: 99946 - RNA, 22 nt, Human
acauguaaacauuuacaguauu

SEQ ID NO: 99947 - RNA, 22 nt, Human
acauguacuguuggugaagagg

SEQ ID NO: 99948 - RNA, 22 nt, Human
acauguaugcuuuaugaaguag

SEQ ID NO: 99949 - RNA, 22 nt, Human
acauguauugacauuauauucu

SEQ ID NO: 99950 - RNA, 22 nt, Human
acauguggaggaggcgagggua

SEQ ID NO: 99951 - RNA, 22 nt, Human
acauguggguuuuauuuugcau

SEQ ID NO: 99952 - RNA, 22 nt, Human
acauguggucaaucuguguagg

SEQ ID NO: 99953 - RNA, 22 nt, Human
acauguguaaggucucucaguc

SEQ ID NO: 99954 - RNA, 22 nt, Human
acauguuagcuacuauuguuau

SEQ ID NO: 99955 - RNA, 22 nt, Human
acauuaaaauugggugggguaa

SEQ ID NO: 99956 - RNA, 22 nt, Human
acauuaaacuugcuuggcugua

SEQ ID NO: 99957 - RNA, 21 nt, Human
acauuacagggugaugugucu

SEQ ID NO: 99958 - RNA, 22 nt, Human
acauuacauaagauuguaaccu

SEQ ID NO: 99959 - RNA, 23 nt, Human
acauuacuuagccagagucucag

SEQ ID NO: 99960 - RNA, 22 nt, Human
acauucaaaauauuucugaugu

SEQ ID NO: 99961 - RNA, 22 nt, Human
acauucaacauggcuggucuag

SEQ ID NO: 99962 - RNA, 22 nt, Human
acauucacaagccuacaagguu

SEQ ID NO: 99963 - RNA, 22 nt, Human
acauucacgcucucaaagcuga

SEQ ID NO: 99964 - RNA, 22 nt, Human
acauucacuauguccaaacucu

SEQ ID NO: 99965 - RNA, 22 nt, Human
acauucaugucccacuucuagc

SEQ ID NO: 99966 - RNA, 22 nt, Human
acauucauugccaggguggaag

SEQ ID NO: 99967 - RNA, 22 nt, Human
acauuccugaggaaauacauuc

SEQ ID NO: 99968 - RNA, 22 nt, Human
acauucuaaagcaugcucagga

SEQ ID NO: 99969 - RNA, 22 nt, Human
acauucuaacauuguacagaua

SEQ ID NO: 99970 - RNA, 22 nt, Human
acauucuauuucaucaugucua

SEQ ID NO: 99971 - RNA, 22 nt, Human
acauucucuccaugucuucuuu

SEQ ID NO: 99972 - RNA, 22 nt, Human
acauucugaaauccaugugggu

SEQ ID NO: 99973 - RNA, 22 nt, Human
acauucugucaacagugagcag

SEQ ID NO: 99974 - RNA, 22 nt, Human
acauucugugagucauguuuua

SEQ ID NO: 99975 - RNA, 22 nt, Human
acauucuguuuccccaaagaga

SEQ ID NO: 99976 - RNA, 22 nt, Human
acauucuucagcuuugucaggc

SEQ ID NO: 99977 - RNA, 22 nt, Human
acauucuucuugugaauuuacu

SEQ ID NO: 99978 - RNA, 22 nt, Human
acauugaaccaguagacacaaa

SEQ ID NO: 99979 - RNA, 19 nt, Human
acauugaauuuucuucuuu

SEQ ID NO: 99980 - RNA, 22 nt, Human
acauugagaguuuugaagagua

SEQ ID NO: 99981 - RNA, 22 nt, Human
acauugagugcuccauaaauca

SEQ ID NO: 99982 - RNA, 22 nt, Human
acauugcaauuagguaccuaug

SEQ ID NO: 99983 - RNA, 22 nt, Human
acauugcugcauucuccuuccc

SEQ ID NO: 99984 - RNA, 22 nt, Human
acauuguaaauaccuuuaucac

SEQ ID NO: 99985 - RNA, 22 nt, Human
acauuguagacuuuucauaugu

SEQ ID NO: 99986 - RNA, 22 nt, Human
acauugugauccgacugauuaa

SEQ ID NO: 99987 - RNA, 22 nt, Human
acauuguucuacuucuaguuag

SEQ ID NO: 99988 - RNA, 22 nt, Human
acauuguugagccucuuguuca

SEQ ID NO: 99989 - RNA, 22 nt, Human
acauuuaaauaccuauguuucu

SEQ ID NO: 99990 - RNA, 22 nt, Human
acauuuaacccucagguuucug

SEQ ID NO: 99991 - RNA, 22 nt, Human
acauuuacauuuucucuggccu

SEQ ID NO: 99992 - RNA, 22 nt, Human
acauuuaggauguuuugagaga

SEQ ID NO: 99993 - RNA, 22 nt, Human
acauuuaguaugagucucugua

SEQ ID NO: 99994 - RNA, 23 nt, Human
acauuucaauacugagggucuga

SEQ ID NO: 99995 - RNA, 22 nt, Human
acauuucagaaucacacagcuu

SEQ ID NO: 99996 - RNA, 22 nt, Human
acauuucagauucaugaaguga

SEQ ID NO: 99997 - RNA, 22 nt, Human
acauuucuaucauccuguaaug

SEQ ID NO: 99998 - RNA, 22 nt, Human
acauuucucccugcaugccugc

SEQ ID NO: 99999 - RNA, 22 nt, Human
acauuucuccuacuuguuauuu

SEQ ID NO: 100000 - RNA, 22 nt, Human
acauuugaaauaaacucaagug

SEQ ID NO: 100001 - RNA, 22 nt, Human
acauuugagaugccuuuuaggu

SEQ ID NO: 100002 - RNA, 22 nt, Human
acauuugaggauguuaagaaug

SEQ ID NO: 100003 - RNA, 20 nt, Human
acauuugaguaucaucuacu

SEQ ID NO: 100004 - RNA, 22 nt, Human
acauuugagucauauuugcuua

SEQ ID NO: 100005 - RNA, 22 nt, Human
acauuugauggaguuaguaggu

SEQ ID NO: 100006 - RNA, 17 nt, Human
acauuugcaaaggucug

SEQ ID NO: 100007 - RNA, 22 nt, Human
acauuugguaacacuugagcau

SEQ ID NO: 100008 - RNA, 22 nt, Human
acauuuguaggacagaggaaga

SEQ ID NO: 100009 - RNA, 22 nt, Human
acauuuguauauaugcagcaua

SEQ ID NO: 100010 - RNA, 20 nt, Human
acauuuguaucucccagugg

SEQ ID NO: 100011 - RNA, 20 nt, Human
acauuuguggaucugagaga

SEQ ID NO: 100012 - RNA, 21 nt, Human
acauuuucuguuuuaggaagu

SEQ ID NO: 100013 - RNA, 22 nt, Human
acagggcagagaggcaggcuug

SEQ ID NO: 100014 - RNA, 21 nt, Human
acagggcaugcagcuggcugu

SEQ ID NO: 100015 - RNA, 22 nt, Human
acagggccacauguaaacagau

SEQ ID NO: 100016 - RNA, 22 nt, Human
acagggccagccugggaccugg

SEQ ID NO: 100017 - RNA, 22 nt, Human
acagggcccuuagauccuuuua

SEQ ID NO: 100018 - RNA, 22 nt, Human
acagggccucagccagggcaga

SEQ ID NO: 100019 - RNA, 22 nt, Human
acagggccuuauauccagaagg

SEQ ID NO: 100020 - RNA, 22 nt, Human
acagggcuauauuccucagagu

SEQ ID NO: 100021 - RNA, 22 nt, Human
acagggcucccagcaggucugu

SEQ ID NO: 100022 - RNA, 22 nt, Human
acagggcuccuugggcugacac

SEQ ID NO: 100023 - RNA, 22 nt, Human
acagggcucgucgggcccucgg

SEQ ID NO: 100024 - RNA, 22 nt, Human
acagggcucugacaccaaggua

SEQ ID NO: 100025 - RNA, 19 nt, Human
acagggcucuggacgccau

SEQ ID NO: 100026 - RNA, 19 nt, Human
accaaacaguggacggagc

SEQ ID NO: 100027 - RNA, 22 nt, Human
accaaauaggcuuccuggguug

SEQ ID NO: 100028 - RNA, 23 nt, Human
accaacaagccucuggagagugg

SEQ ID NO: 100029 - RNA, 22 nt, Human
accaacauguccucacacagcc

SEQ ID NO: 100030 - RNA, 22 nt, Human
accaacuugcagccaaauuuga

SEQ ID NO: 100031 - RNA, 22 nt, Human
accaagcucucuucccggcucu

SEQ ID NO: 100032 - RNA, 22 nt, Human
accaagcuguauauuauugguu

SEQ ID NO: 100033 - RNA, 22 nt, Human
accaaggagacaaagguguauu

SEQ ID NO: 100034 - RNA, 22 nt, Human
accaauuuuagagcaccaagaa

SEQ ID NO: 100035 - RNA, 22 nt, Human
accaauuuuuacagcugugguu

SEQ ID NO: 100036 - RNA, 22 nt, Human
accacacuggcuagugaagaag

SEQ ID NO: 100037 - RNA, 22 nt, Human
accacaggacccaugagucagu

SEQ ID NO: 100038 - RNA, 22 nt, Human
accacaggaggauggcugcugg

SEQ ID NO: 100039 - RNA, 22 nt, Human
accacauuucugaauagcauaa

SEQ ID NO: 100040 - RNA, 22 nt, Human
accagaaguucuccaaaaagau

SEQ ID NO: 100041 - RNA, 22 nt, Human
accagagaaugugcaucucuaa

SEQ ID NO: 100042 - RNA, 22 nt, Human
accagagagagacaggguugug

SEQ ID NO: 100043 - RNA, 20 nt, Human
accagagauagcaauagugc

SEQ ID NO: 100044 - RNA, 22 nt, Human
accagagcagacuacuggaggu

SEQ ID NO: 100045 - RNA, 20 nt, Human
accagagcucucaguaugug

SEQ ID NO: 100046 - RNA, 22 nt, Human
accagaguuuuauuaguucuaa

SEQ ID NO: 100047 - RNA, 17 nt, Human
accagaguuuuccaugc

SEQ ID NO: 100048 - RNA, 23 nt, Human
accagcaaaaaugacagcccagg

SEQ ID NO: 100049 - RNA, 22 nt, Human
accagcaagauuuugcuuugca

SEQ ID NO: 100050 - RNA, 22 nt, Human
accagcaccugauaggcaguaa

SEQ ID NO: 100051 - RNA, 22 nt, Human
accagcagaguugaggaggaca

SEQ ID NO: 100052 - RNA, 22 nt, Human
accagcaguuaugaggccagga

SEQ ID NO: 100053 - RNA, 21 nt, Human
accagcauuccacacuguccc

SEQ ID NO: 100054 - RNA, 22 nt, Human
accagccaagacugccuggaau

SEQ ID NO: 100055 - RNA, 22 nt, Human
accagccagccacaguggcucc

SEQ ID NO: 100056 - RNA, 22 nt, Human
accagccuccuagcugcuccug

SEQ ID NO: 100057 - RNA, 22 nt, Human
accagcuccaggccccugcuga

SEQ ID NO: 100058 - RNA, 22 nt, Human
accagcucucuagcccuggucc

SEQ ID NO: 100059 - RNA, 22 nt, Human
accagcugaguaggggagggcc

SEQ ID NO: 100060 - RNA, 22 nt, Human
accagcugccaagggcuacacu

SEQ ID NO: 100061 - RNA, 22 nt, Human
accagcugugugaccugaggca

SEQ ID NO: 100062 - RNA, 22 nt, Human
accagcuguuaggcuuggugcu

SEQ ID NO: 100063 - RNA, 22 nt, Human
accaggaaaaacacuguguugg

SEQ ID NO: 100064 - RNA, 22 nt, Human
accaggaaauuuggcaacaaag

SEQ ID NO: 100065 - RNA, 22 nt, Human
accaggaacucacccgcagagg

SEQ ID NO: 100066 - RNA, 22 nt, Human
accaggaagaacaggcaaggca

SEQ ID NO: 100067 - RNA, 22 nt, Human
accaggaagagauuccaauuua

SEQ ID NO: 100068 - RNA, 22 nt, Human
accaggacuuuguauucagcuu

SEQ ID NO: 100069 - RNA, 22 nt, Human
accaggagaggcacuugcaaug

SEQ ID NO: 100070 - RNA, 22 nt, Human
accaggagcauuuuuuauuagu

SEQ ID NO: 100071 - RNA, 22 nt, Human
accaggaggaaguguuaaugau

SEQ ID NO: 100072 - RNA, 22 nt, Human
accaggaggccuggagcacaaa

SEQ ID NO: 100073 - RNA, 22 nt, Human
accaggaggcuacacuguccca

SEQ ID NO: 100074 - RNA, 22 nt, Human
accaggagguguuugcucaagu

SEQ ID NO: 100075 - RNA, 22 nt, Human
accaggcagagcugggccuuaa

SEQ ID NO: 100076 - RNA, 22 nt, Human
accaggcaugauguggagcaca

SEQ ID NO: 100077 - RNA, 22 nt, Human
accaggcccaccgcaugcuccu

SEQ ID NO: 100078 - RNA, 22 nt, Human
accaggcccauguggauuacua

SEQ ID NO: 100079 - RNA, 22 nt, Human
accaggcccuccagcugcgugg

SEQ ID NO: 100080 - RNA, 22 nt, Human
accaggccuagcaaguacauua

SEQ ID NO: 100081 - RNA, 22 nt, Human
accaggcucugccaguguuuac

SEQ ID NO: 100082 - RNA, 21 nt, Human
accaggcuugugggagggagc

SEQ ID NO: 100083 - RNA, 22 nt, Human
accagggcaaauguuuguacuc

SEQ ID NO: 100084 - RNA, 22 nt, Human
accagggcacaggagucugaag

SEQ ID NO: 100085 - RNA, 22 nt, Human
accagggcacauuccggccaga

SEQ ID NO: 100086 - RNA, 22 nt, Human
accagggcuuacagcaguagcu

SEQ ID NO: 100087 - RNA, 22 nt, Human
accaggggaugguuggcacugu

SEQ ID NO: 100088 - RNA, 22 nt, Human
accaggggugucaacagcauuu

SEQ ID NO: 100089 - RNA, 20 nt, Human
accagguggcugaugacacc

SEQ ID NO: 100090 - RNA, 22 nt, Human
accaguccgcggagcuccgggg

SEQ ID NO: 100091 - RNA, 22 nt, Human
accagugggaaguggaaaauga

SEQ ID NO: 100092 - RNA, 22 nt, Human
accagugucuuauugaccaucu

SEQ ID NO: 100093 - RNA, 22 nt, Human
accaguuaaagggaaauugaaa

SEQ ID NO: 100094 - RNA, 22 nt, Human
accaguuauuagcccuacaacu

SEQ ID NO: 100095 - RNA, 22 nt, Human
accaguuuauagcgaucuguca

SEQ ID NO: 100096 - RNA, 22 nt, Human
accaguuuguaaccuguuuuca

SEQ ID NO: 100097 - RNA, 22 nt, Human
accaguuuuuuauacaucuucu

SEQ ID NO: 100098 - RNA, 22 nt, Human
accauacacaauuugcaacggu

SEQ ID NO: 100099 - RNA, 22 nt, Human
accauagacuggaggaucuccu

SEQ ID NO: 100100 - RNA, 22 nt, Human
accaucuuaaggggacuucuua

SEQ ID NO: 100101 - RNA, 22 nt, Human
accaugccaguggcagccagac

SEQ ID NO: 100102 - RNA, 22 nt, Human
accaugggcagaaucuuugcag

SEQ ID NO: 100103 - RNA, 22 nt, Human
accauguuggccaagcuggucu

SEQ ID NO: 100104 - RNA, 21 nt, Human
accauucugcacaugcuguca

SEQ ID NO: 100105 - RNA, 22 nt, Human
accauugauauaacucagucuc

SEQ ID NO: 100106 - RNA, 22 nt, Human
accauuuaaggaaaauguauca

SEQ ID NO: 100107 - RNA, 22 nt, Human
accauuuaauaaguauuuccau

SEQ ID NO: 100108 - RNA, 22 nt, Human
acccaaaagucacucaggagca

SEQ ID NO: 100109 - RNA, 22 nt, Human
acccacagccgcugugcguccc

SEQ ID NO: 100110 - RNA, 22 nt, Human
acccacuguagccacucugggu

SEQ ID NO: 100111 - RNA, 22 nt, Human
acccagaggcggagguugcagu

SEQ ID NO: 100112 - RNA, 22 nt, Human
acccagcaaagauaaacuuaug

SEQ ID NO: 100113 - RNA, 22 nt, Human
acccagccauguucaguucucu

SEQ ID NO: 100114 - RNA, 22 nt, Human
acccaggacaugggcacccgug

SEQ ID NO: 100115 - RNA, 22 nt, Human
acccaggagacagguugcagug

SEQ ID NO: 100116 - RNA, 22 nt, Human
acccaggagcucugggguccuc

SEQ ID NO: 100117 - RNA, 22 nt, Human
acccaggaggugacacagggcu

SEQ ID NO: 100118 - RNA, 22 nt, Human
acccaggagguggaggcugcag

SEQ ID NO: 100119 - RNA, 22 nt, Human
acccaggauaaucuguguaucu

SEQ ID NO: 100120 - RNA, 22 nt, Human
acccaggauagagugcugcagu

SEQ ID NO: 100121 - RNA, 17 nt, Human
acccaggcucuaucuug

SEQ ID NO: 100122 - RNA, 22 nt, Human
acugagggccaaaggcacugag

SEQ ID NO: 100123 - RNA, 23 nt, Human
acugagggccacuuccaucguga

SEQ ID NO: 100124 - RNA, 22 nt, Human
acugagggguuggagagugagg

SEQ ID NO: 100125 - RNA, 22 nt, Human
acugagggugcacaggcaggca

SEQ ID NO: 100126 - RNA, 22 nt, Human
acugagguaauugugaggauua

SEQ ID NO: 100127 - RNA, 23 nt, Human
acugagguacugagguugugaca

SEQ ID NO: 100128 - RNA, 22 nt, Human
acugagguauaauugacauaac

SEQ ID NO: 100129 - RNA, 22 nt, Human
acugaggucagggguaugugau

SEQ ID NO: 100130 - RNA, 22 nt, Human
acugagguuauugcaauaaaau

SEQ ID NO: 100131 - RNA, 22 nt, Human
acugagugggagguuuguguga

SEQ ID NO: 100132 - RNA, 22 nt, Human
acugauauuaaacacaauuuaa

SEQ ID NO: 100133 - RNA, 22 nt, Human
acugaucuguuuucagauucug

SEQ ID NO: 100134 - RNA, 22 nt, Human
acugaugugacagcugagcaga

SEQ ID NO: 100135 - RNA, 22 nt, Human
acugaugugauuucaaauucca

SEQ ID NO: 100136 - RNA, 22 nt, Human
acugauuucagggaugagaaga

SEQ ID NO: 100137 - RNA, 20 nt, Human
acugcaaaguacucuuucag

SEQ ID NO: 100138 - RNA, 22 nt, Human
acugcacaaggccuggacacac

SEQ ID NO: 100139 - RNA, 21 nt, Human
acugcacaaguugcuuugcuu

SEQ ID NO: 100140 - RNA, 22 nt, Human
acugcacagaagaaacuaucaa

SEQ ID NO: 100141 - RNA, 22 nt, Human
acugcacagaauuaugguuggu

SEQ ID NO: 100142 - RNA, 22 nt, Human
acugcaccucagccugggcgac

SEQ ID NO: 100143 - RNA, 22 nt, Human
acugcacuuacauagaggaggc

SEQ ID NO: 100144 - RNA, 22 nt, Human
acugcacuuuaggccaacuagg

SEQ ID NO: 100145 - RNA, 22 nt, Human
acugcagcagguaagagcauuu

SEQ ID NO: 100146 - RNA, 23 nt, Human
acugcagccuccgccugccgggu

SEQ ID NO: 100147 - RNA, 22 nt, Human
acugcaggccuuggugccagca

SEQ ID NO: 100148 - RNA, 22 nt, Human
acugcagguggauggcacuuua

SEQ ID NO: 100149 - RNA, 22 nt, Human
acugcaucgcucgcuuaggucc

SEQ ID NO: 100150 - RNA, 22 nt, Human
acugcaucugaacugugaaugg

SEQ ID NO: 100151 - RNA, 22 nt, Human
acugcaugcuuuacaugacaug

SEQ ID NO: 100152 - RNA, 22 nt, Human
acugcauugagguuucauacuu

SEQ ID NO: 100153 - RNA, 22 nt, Human
acugcauuugguaaagucaaga

SEQ ID NO: 100154 - RNA, 22 nt, Human
acugccagaggagguaucugaa

SEQ ID NO: 100155 - RNA, 22 nt, Human
acugccaggauggcacuagagg

SEQ ID NO: 100156 - RNA, 22 nt, Human
acugccagguaagugcuccugc

SEQ ID NO: 100157 - RNA, 23 nt, Human
acugccaguuuuaccacagacgg

SEQ ID NO: 100158 - RNA, 22 nt, Human
acugcccaugugcaucaaguag

SEQ ID NO: 100159 - RNA, 22 nt, Human
acaugcucuccuaaggcccugu

SEQ ID NO: 100160 - RNA, 22 nt, Human
acaugcuucauauuauaaccaa

SEQ ID NO: 100161 - RNA, 22 nt, Human
acaugcuuccaaauuauguugg

SEQ ID NO: 100162 - RNA, 22 nt, Human
acaugcuucuguuucaagaacu

SEQ ID NO: 100163 - RNA, 22 nt, Human
acaugcuuguuuuucacaaccu

SEQ ID NO: 100164 - RNA, 22 nt, Human
acauggaaaacuaacugcuuuu

SEQ ID NO: 100165 - RNA, 22 nt, Human
acauggaaaguacuccacaauu

SEQ ID NO: 100166 - RNA, 22 nt, Human
acauggaagauaaaaauacuca

SEQ ID NO: 100167 - RNA, 22 nt, Human
acauggaauguguacuaaguua

SEQ ID NO: 100168 - RNA, 22 nt, Human
acauggaucaaccuauuuucuu

SEQ ID NO: 100169 - RNA, 22 nt, Human
acauggcacccagaucucaaaa

SEQ ID NO: 100170 - RNA, 22 nt, Human
acauggcagcugaugauuggaa

SEQ ID NO: 100171 - RNA, 22 nt, Human
acauggcaggaaucauguguuu

SEQ ID NO: 100172 - RNA, 22 nt, Human
acauggcuaaagcaagucuaga

SEQ ID NO: 100173 - RNA, 22 nt, Human
acauggcucagucucaugacag

SEQ ID NO: 100174 - RNA, 19 nt, Human
acauggcucuccagucugg

SEQ ID NO: 100175 - RNA, 22 nt, Human
acauggcuggcaccuuaaauuu

SEQ ID NO: 100176 - RNA, 22 nt, Human
acaugggaucaaugaggcaggc

SEQ ID NO: 100177 - RNA, 22 nt, Human
acauggugagcggcaggccuau

SEQ ID NO: 100178 - RNA, 22 nt, Human
acauguaaaagauaaauuaaca

SEQ ID NO: 100179 - RNA, 22 nt, Human
acauguaaaaggaacaugcaug

SEQ ID NO: 100180 - RNA, 22 nt, Human
acauguaacauauauguagcau

SEQ ID NO: 100181 - RNA, 21 nt, Human
acauguacacauguaugcaca

SEQ ID NO: 100182 - RNA, 20 nt, Human
acauguacagacagguuucu

SEQ ID NO: 100183 - RNA, 22 nt, Human
acauguacauacacauauguaa

SEQ ID NO: 100184 - RNA, 20 nt, Human
acauguacuaaugaauacag

SEQ ID NO: 100185 - RNA, 22 nt, Human
acauguaugugugcaaacacau

SEQ ID NO: 100186 - RNA, 22 nt, Human
acaugucuaaguacucaacaaa

SEQ ID NO: 100187 - RNA, 22 nt, Human
acaugucuuuuaaagucuaaua

SEQ ID NO: 100188 - RNA, 22 nt, Human
acaugugcucuugcuguacagc

SEQ ID NO: 100189 - RNA, 22 nt, Human
acauguguacauauauaugugc

SEQ ID NO: 100190 - RNA, 22 nt, Human
acaugugucuaagaaugaaaga

SEQ ID NO: 100191 - RNA, 22 nt, Human
acauguguggacaugaaucuac

SEQ ID NO: 100192 - RNA, 22 nt, Human
acauguguggccgcuguagaca

SEQ ID NO: 100193 - RNA, 22 nt, Human
acauguuagggacagaguaugu

SEQ ID NO: 100194 - RNA, 22 nt, Human
acauguuugccugcaggcuuag

SEQ ID NO: 100195 - RNA, 22 nt, Human
acauguuuggcucuaugcuaua

SEQ ID NO: 100196 - RNA, 22 nt, Human
acauuaaaauggagaauuuuga

SEQ ID NO: 100197 - RNA, 22 nt, Human
acauuaaagaguaagguuaguu

SEQ ID NO: 100198 - RNA, 22 nt, Human
acauuaacaccgugaguuuggu

SEQ ID NO: 100199 - RNA, 22 nt, Human
acauuaacacuggugcuggugu

SEQ ID NO: 100200 - RNA, 22 nt, Human
acauuaaugaggugaugacaca

SEQ ID NO: 100201 - RNA, 22 nt, Human
acauuacagcaaguuuacguua

SEQ ID NO: 100202 - RNA, 22 nt, Human
acauuacuuaccuuggguucua

SEQ ID NO: 100203 - RNA, 22 nt, Human
acauuagaacauuaauauuggg

SEQ ID NO: 100204 - RNA, 22 nt, Human
acauuagcccaucugguauuug

SEQ ID NO: 100205 - RNA, 22 nt, Human
acauuauaguugcuacagagua

SEQ ID NO: 100206 - RNA, 22 nt, Human
acauuaucccuggcacaacugc

SEQ ID NO: 100207 - RNA, 22 nt, Human
acauucaaaaagcaucugucac

SEQ ID NO: 100208 - RNA, 22 nt, Human
acauucaagaugcauucacuua

SEQ ID NO: 100209 - RNA, 22 nt, Human
acauucaaguuucugcucaugg

SEQ ID NO: 100210 - RNA, 22 nt, Human
acauucaccacacuuauagggc

SEQ ID NO: 100211 - RNA, 22 nt, Human
acauucagaaucuuguagcagu

SEQ ID NO: 100212 - RNA, 22 nt, Human
acauucaggccacaguggaguc

SEQ ID NO: 100213 - RNA, 22 nt, Human
acauucaugcaccuuccuaucc

SEQ ID NO: 100214 - RNA, 22 nt, Human
acauucauggguuuuacauuau

SEQ ID NO: 100215 - RNA, 22 nt, Human
acauuccagguuggugcagggu

SEQ ID NO: 100216 - RNA, 19 nt, Human
acauucccaucagcaaugu

SEQ ID NO: 100217 - RNA, 22 nt, Human
acauucccuuggcuugaagcag

SEQ ID NO: 100218 - RNA, 22 nt, Human
acauucuauagcaagcugaucu

SEQ ID NO: 100219 - RNA, 22 nt, Human
acauucuaugaagauaauuuua

SEQ ID NO: 100220 - RNA, 22 nt, Human
acauucucuuccuaaauauacu

SEQ ID NO: 100221 - RNA, 22 nt, Human
acauucugaauaggcauuuuau

SEQ ID NO: 100222 - RNA, 22 nt, Human
acauucuguugaggcuggguca

SEQ ID NO: 100223 - RNA, 22 nt, Human
acauucuuauaagagugaggca

SEQ ID NO: 100224 - RNA, 22 nt, Human
acauucuugaagugaaguuuau

SEQ ID NO: 100225 - RNA, 23 nt, Human
acauucuugauucaggccuuagc

SEQ ID NO: 100226 - RNA, 22 nt, Human
acauugaaagcauauuaucucc

SEQ ID NO: 100227 - RNA, 22 nt, Human
acauugaacaguacaaaugauc

SEQ ID NO: 100228 - RNA, 22 nt, Human
acauugaagcugugaaaucaaa

SEQ ID NO: 100229 - RNA, 22 nt, Human
acauugaauuucacuuuuguac

SEQ ID NO: 100230 - RNA, 22 nt, Human
acauugaugugaugcagaagug

SEQ ID NO: 100231 - RNA, 22 nt, Human
agaaaguuugagaacuguagau

SEQ ID NO: 100232 - RNA, 22 nt, Human
agaaaguuuugugcuauauaug

SEQ ID NO: 100233 - RNA, 22 nt, Human
agaaauaagagcuuuccuuggg

SEQ ID NO: 100234 - RNA, 21 nt, Human
agaaauacagcagggaugauc

SEQ ID NO: 100235 - RNA, 18 nt, Human
agaaauaccaguauugga

SEQ ID NO: 100236 - RNA, 20 nt, Human
agaaauacuuugguauaaug

SEQ ID NO: 100237 - RNA, 22 nt, Human
agaaauacuuuguaaaucucac

SEQ ID NO: 100238 - RNA, 22 nt, Human
agaaauagcagagucaggcggg

SEQ ID NO: 100239 - RNA, 20 nt, Human
agaaaucagcauguccucug

SEQ ID NO: 100240 - RNA, 22 nt, Human
agaaaucaugucuuauuucuau

SEQ ID NO: 100241 - RNA, 22 nt, Human
agaaaucauuuuaggcuugaug

SEQ ID NO: 100242 - RNA, 22 nt, Human
agaaaucuuaucaagaaaugcc

SEQ ID NO: 100243 - RNA, 22 nt, Human
agaaaucuuggagucuguggua

SEQ ID NO: 100244 - RNA, 22 nt, Human
agaaaugaaaccaaagccuaga

SEQ ID NO: 100245 - RNA, 22 nt, Human
agaaaugaagcaggaguuauua

SEQ ID NO: 100246 - RNA, 22 nt, Human
agaaaugaauauguagugguua

SEQ ID NO: 100247 - RNA, 22 nt, Human
agaaaugacacacaugagacau

SEQ ID NO: 100248 - RNA, 22 nt, Human
agaaaugcaguuucaagacaaa

SEQ ID NO: 100249 - RNA, 22 nt, Human
agaaaugcucuuccugaccaga

SEQ ID NO: 100250 - RNA, 22 nt, Human
agaaaugggccuugggacacaa

SEQ ID NO: 100251 - RNA, 22 nt, Human
agaaauguaauugcaacugucu

SEQ ID NO: 100252 - RNA, 21 nt, Human
agaaauguaucauucuuuucc

SEQ ID NO: 100253 - RNA, 22 nt, Human
agaaaugucaaguguucuuguu

SEQ ID NO: 100254 - RNA, 22 nt, Human
agaaauguugaauacacaaaau

SEQ ID NO: 100255 - RNA, 22 nt, Human
agaaauguuuauggcugccuau

SEQ ID NO: 100256 - RNA, 22 nt, Human
agaacaaaucgauggaagccug

SEQ ID NO: 100257 - RNA, 22 nt, Human
agaacacacugggggaaacaag

SEQ ID NO: 100258 - RNA, 22 nt, Human
agaacagaagggaggaaggccu

SEQ ID NO: 100259 - RNA, 22 nt, Human
agaacagguucaggguauaaaa

SEQ ID NO: 100260 - RNA, 22 nt, Human
agaacagucguggugagagaaa

SEQ ID NO: 100261 - RNA, 22 nt, Human
agaacauagauaccuaagacag

SEQ ID NO: 100262 - RNA, 22 nt, Human
agaacaucugaagauacaaagu

SEQ ID NO: 100263 - RNA, 22 nt, Human
agaacauuugucgaucaauuug

SEQ ID NO: 100264 - RNA, 22 nt, Human
agaaccaugaguuugaguaucu

SEQ ID NO: 100265 - RNA, 22 nt, Human
agaaccucacgagauuccuuca

SEQ ID NO: 100266 - RNA, 22 nt, Human
agaaccugccuuuacucuccuu

SEQ ID NO: 100267 - RNA, 22 nt, Human
agaacgaaugcuucagcucuag

SEQ ID NO: 100268 - RNA, 22 nt, Human
agaacuauacauuacucauuga

SEQ ID NO: 100269 - RNA, 22 nt, Human
agaacucuaggauuggcuggau

SEQ ID NO: 100270 - RNA, 22 nt, Human
agaacucucgcuggaucagacu

SEQ ID NO: 100271 - RNA, 22 nt, Human
agaacugucacgagugacaaag

SEQ ID NO: 100272 - RNA, 22 nt, Human
agaacuguccccagagagcacu

SEQ ID NO: 100273 - RNA, 20 nt, Human
agaacuguuguuuggguccu

SEQ ID NO: 100274 - RNA, 22 nt, Human
agaacuuacauuauagagcugu

SEQ ID NO: 100275 - RNA, 22 nt, Human
agaacuuaggaacaacagcuua

SEQ ID NO: 100276 - RNA, 22 nt, Human
agaagaacuuagcuuucuaucu

SEQ ID NO: 100277 - RNA, 22 nt, Human
agaagacagagucuacauucua

SEQ ID NO: 100278 - RNA, 17 nt, Human
accaaugucagacaaag

SEQ ID NO: 100279 - RNA, 22 nt, Human
accaaugugaugauauuaggag

SEQ ID NO: 100280 - RNA, 22 nt, Human
accaauuucuuggcuuccaaau

SEQ ID NO: 100281 - RNA, 22 nt, Human
accacagaggaauuugaagagg

SEQ ID NO: 100282 - RNA, 22 nt, Human
accacaggggaggaaugaugcc

SEQ ID NO: 100283 - RNA, 22 nt, Human
accacaggguaaaguuagauau

SEQ ID NO: 100284 - RNA, 22 nt, Human
accacaguaugaaaucugaaau

SEQ ID NO: 100285 - RNA, 22 nt, Human
accacagucucgaagcacugca

SEQ ID NO: 100286 - RNA, 22 nt, Human
accacaucuagauugcagcccu

SEQ ID NO: 100287 - RNA, 22 nt, Human
accacccaccucacagcauagu

SEQ ID NO: 100288 - RNA, 22 nt, Human
accaccccagaauuuuucaagg

SEQ ID NO: 100289 - RNA, 22 nt, Human
accacccccuuggguguggaag

SEQ ID NO: 100290 - RNA, 22 nt, Human
accacccucagcagagcugaaa

SEQ ID NO: 100291 - RNA, 17 nt, Human
accaccucucaccagca

SEQ ID NO: 100292 - RNA, 22 nt, Human
accacuguacuauuugaguggc

SEQ ID NO: 100293 - RNA, 22 nt, Human
accacuguaucuccagcacauu

SEQ ID NO: 100294 - RNA, 17 nt, Human
accacuuugccaaguug

SEQ ID NO: 100295 - RNA, 22 nt, Human
accacuuugguauuucaauuuu

SEQ ID NO: 100296 - RNA, 22 nt, Human
accagaaaggaauaauagaauu

SEQ ID NO: 100297 - RNA, 22 nt, Human
accagaaaggaugccuccuucc

SEQ ID NO: 100298 - RNA, 22 nt, Human
accagaaggaccagaggcaagg

SEQ ID NO: 100299 - RNA, 22 nt, Human
accagagaauuuagccaagaaa

SEQ ID NO: 100300 - RNA, 20 nt, Human
accagagaccugaaucaguu

SEQ ID NO: 100301 - RNA, 22 nt, Human
accagagacugcauuucucuga

SEQ ID NO: 100302 - RNA, 22 nt, Human
accagagcccaucugcuccuag

SEQ ID NO: 100303 - RNA, 22 nt, Human
accagagcgcucaagccuuccc

SEQ ID NO: 100304 - RNA, 22 nt, Human
accagaggaagggaaucucaag

SEQ ID NO: 100305 - RNA, 22 nt, Human
accagaggaggaauuaccuucc

SEQ ID NO: 100306 - RNA, 22 nt, Human
accagaggcaguuucggcuggu

SEQ ID NO: 100307 - RNA, 22 nt, Human
accagaggcucugccaccucca

SEQ ID NO: 100308 - RNA, 22 nt, Human
accagagggcaaaccccagugu

SEQ ID NO: 100309 - RNA, 22 nt, Human
accagcacuuccagaggucagg

SEQ ID NO: 100310 - RNA, 22 nt, Human
accagcauuugcagaaauggag

SEQ ID NO: 100311 - RNA, 22 nt, Human
accagccccaccgggacugcag

SEQ ID NO: 100312 - RNA, 22 nt, Human
accagcucauaauuuucaaaac

SEQ ID NO: 100313 - RNA, 22 nt, Human
accagcucuggacaggcauuuc

SEQ ID NO: 100314 - RNA, 22 nt, Human
accagcucuucugcucuaguug

SEQ ID NO: 100315 - RNA, 22 nt, Human
accagcugaacugcagcccagg

SEQ ID NO: 100316 - RNA, 22 nt, Human
accagcugauuuaagaauaaag

SEQ ID NO: 100317 - RNA, 22 nt, Human
accagcugccuggucuaucugc

SEQ ID NO: 100318 - RNA, 22 nt, Human
accagcugccuuuucuuaguag

SEQ ID NO: 100319 - RNA, 22 nt, Human
accagcuggcccaugagcacgu

SEQ ID NO: 100320 - RNA, 22 nt, Human
accagcuggucaccugggcacu

SEQ ID NO: 100321 - RNA, 22 nt, Human
accagcuggucagggcuuuucu

SEQ ID NO: 100322 - RNA, 22 nt, Human
accagcuguguccuggcugcag

SEQ ID NO: 100323 - RNA, 22 nt, Human
accagcugugugacuuuuaaug

SEQ ID NO: 100324 - RNA, 22 nt, Human
accaggaaacucucgucuaguu

SEQ ID NO: 100325 - RNA, 22 nt, Human
accaggaagcugugagaccuuu

SEQ ID NO: 100326 - RNA, 22 nt, Human
accaggacauuuuagucaucuu

SEQ ID NO: 100327 - RNA, 23 nt, Human
accaggagccaagaucucccugg

SEQ ID NO: 100328 - RNA, 22 nt, Human
accaggagccacaggaggagcc

SEQ ID NO: 100329 - RNA, 22 nt, Human
accaggagggacccugguggcc

SEQ ID NO: 100330 - RNA, 22 nt, Human
accaggaguagaauaucuguga

SEQ ID NO: 100331 - RNA, 23 nt, Human
accaggaguugucucaggaaaca

SEQ ID NO: 100332 - RNA, 22 nt, Human
accaggcaacugugaaugggcu

SEQ ID NO: 100333 - RNA, 22 nt, Human
accaggcagcacuuuccuugca

SEQ ID NO: 100334 - RNA, 22 nt, Human
accaggcagcugggggugaugu

SEQ ID NO: 100335 - RNA, 22 nt, Human
accaggcaguauggugcugcaa

SEQ ID NO: 100336 - RNA, 22 nt, Human
accaggccaaaaucauauuuac

SEQ ID NO: 100337 - RNA, 22 nt, Human
accaggccaacagcuaaguuaa

SEQ ID NO: 100338 - RNA, 20 nt, Human
accaggccccgggcccugca

SEQ ID NO: 100339 - RNA, 20 nt, Human
accaggcccggugucuccuc

SEQ ID NO: 100340 - RNA, 22 nt, Human
agaauacaguucaguaauggau

SEQ ID NO: 100341 - RNA, 22 nt, Human
agaauacaucaaucuauuuucu

SEQ ID NO: 100342 - RNA, 22 nt, Human
agaauacaucuagugcugcaug

SEQ ID NO: 100343 - RNA, 22 nt, Human
agaauauucaucuguauucuua

SEQ ID NO: 100344 - RNA, 22 nt, Human
agaaucaaagagaaauacuuug

SEQ ID NO: 100345 - RNA, 22 nt, Human
agaaucaacugaaaauugguga

SEQ ID NO: 100346 - RNA, 22 nt, Human
agaaucaauucacugcugcagc

SEQ ID NO: 100347 - RNA, 22 nt, Human
agaaucacuggaauuguuuuuu

SEQ ID NO: 100348 - RNA, 20 nt, Human
agaaucagaguggaaaggaa

SEQ ID NO: 100349 - RNA, 19 nt, Human
agaaucaggucaggugaca

SEQ ID NO: 100350 - RNA, 22 nt, Human
agaaucagugagcaguugugau

SEQ ID NO: 100351 - RNA, 19 nt, Human
agaaucaucuugaagugau

SEQ ID NO: 100352 - RNA, 22 nt, Human
agaauccugaugaaaaggagag

SEQ ID NO: 100353 - RNA, 22 nt, Human
agaauccuggagaagcuguacc

SEQ ID NO: 100354 - RNA, 22 nt, Human
agaaucuaaauaugcaauuuga

SEQ ID NO: 100355 - RNA, 22 nt, Human
agaaucugaaggcaccucuggu

SEQ ID NO: 100356 - RNA, 22 nt, Human
agaaucugcauuuuaacaagau

SEQ ID NO: 100357 - RNA, 22 nt, Human
agaaucugcauuuuaacaagcu

SEQ ID NO: 100358 - RNA, 22 nt, Human
agaaucuucgguaacuggaaga

SEQ ID NO: 100359 - RNA, 22 nt, Human
agaaucuugggcaaauucaucu

SEQ ID NO: 100360 - RNA, 22 nt, Human
agaaugaauuaaucaacuggaa

SEQ ID NO: 100361 - RNA, 22 nt, Human
agaaugauaaugccaugaugga

SEQ ID NO: 100362 - RNA, 22 nt, Human
agaaugcuuccuuugaaacuga

SEQ ID NO: 100363 - RNA, 22 nt, Human
agaaugcuuguaccuuuguuuu

SEQ ID NO: 100364 - RNA, 22 nt, Human
agaauguagucuuggagauuua

SEQ ID NO: 100365 - RNA, 22 nt, Human
agaaugucaacagccucucaag

SEQ ID NO: 100366 - RNA, 22 nt, Human
agaauguuuucaugagaaugaa

SEQ ID NO: 100367 - RNA, 22 nt, Human
agaauuagcugggcagauuccu

SEQ ID NO: 100368 - RNA, 22 nt, Human
agaauucuccuucagggcagga

SEQ ID NO: 100369 - RNA, 22 nt, Human
agaauucuuggugguuagaaua

SEQ ID NO: 100370 - RNA, 22 nt, Human
agaauugcuggaauuugcuuua

SEQ ID NO: 100371 - RNA, 22 nt, Human
agaauuuaggcuugucugcugu

SEQ ID NO: 100372 - RNA, 23 nt, Human
agaauuucaaaguccagcacauu

SEQ ID NO: 100373 - RNA, 22 nt, Human
agaauuugagugcuuucugugu

SEQ ID NO: 100374 - RNA, 22 nt, Human
agaauuugguaguuauuuuugg

SEQ ID NO: 100375 - RNA, 22 nt, Human
agaauuuuaucuaaagggagua

SEQ ID NO: 100376 - RNA, 22 nt, Human
agaauuuuugauuaucuacucg

SEQ ID NO: 100377 - RNA, 22 nt, Human
agaauuuuugcaguuuagccau

SEQ ID NO: 100378 - RNA, 22 nt, Human
agacaaacccaguggcuguuuu

SEQ ID NO: 100379 - RNA, 22 nt, Human
agacaaaccuuguuuuaugaug

SEQ ID NO: 100380 - RNA, 22 nt, Human
agacaaagaaaccguagaagca

SEQ ID NO: 100381 - RNA, 22 nt, Human
agacaaauuuccugcaaugaag

SEQ ID NO: 100382 - RNA, 22 nt, Human
agacaaauuuguuuuccugucu

SEQ ID NO: 100383 - RNA, 22 nt, Human
agacaacaucacuaaagcugag

SEQ ID NO: 100384 - RNA, 22 nt, Human
agacaacaugaucagcaguccu

SEQ ID NO: 100385 - RNA, 22 nt, Human
agacaaggcccccuugggcucu

SEQ ID NO: 100386 - RNA, 22 nt, Human
agacaaguaggaaugguugaag

SEQ ID NO: 100387 - RNA, 22 nt, Human
agacaauggaccaagcaccuuc

SEQ ID NO: 100388 - RNA, 22 nt, Human
agacaauuaaaaaauuaugcuu

SEQ ID NO: 100389 - RNA, 22 nt, Human
agacacagaaguugcuguuggg

SEQ ID NO: 100390 - RNA, 22 nt, Human
agacacagcagugccugccuca

SEQ ID NO: 100391 - RNA, 22 nt, Human
agacacaguacuugcccucaug

SEQ ID NO: 100392 - RNA, 22 nt, Human
agacacagugaguuucuuuccc

SEQ ID NO: 100393 - RNA, 22 nt, Human
agacacaguguugaaggcuagu

SEQ ID NO: 100394 - RNA, 22 nt, Human
agacacauaggaccacacugug

SEQ ID NO: 100395 - RNA, 22 nt, Human
agacacccagugauugagacuu

SEQ ID NO: 100396 - RNA, 22 nt, Human
acauuuuaauaugcuuagugug

SEQ ID NO: 100397 - RNA, 22 nt, Human
acauuuugagaaaugacaagcu

SEQ ID NO: 100398 - RNA, 22 nt, Human
acauuuuuacugggcaucugca

SEQ ID NO: 100399 - RNA, 22 nt, Human
acauuuuuauucaucaaagcag

SEQ ID NO: 100400 - RNA, 22 nt, Human
acauuuuuuagagucccacauu

SEQ ID NO: 100401 - RNA, 22 nt, Human
accaaaaauuguggggcugaau

SEQ ID NO: 100402 - RNA, 22 nt, Human
accaaagcgagugauaugucau

SEQ ID NO: 100403 - RNA, 22 nt, Human
accaaaugcuuggcugcuguga

SEQ ID NO: 100404 - RNA, 22 nt, Human
accaaggagaaggugcaagcuu

SEQ ID NO: 100405 - RNA, 22 nt, Human
accaaggagccacauacaaccu

SEQ ID NO: 100406 - RNA, 22 nt, Human
accaaggcuaaaauaacauguu

SEQ ID NO: 100407 - RNA, 22 nt, Human
accaaucuccuauuuuguuuca

SEQ ID NO: 100408 - RNA, 20 nt, Human
accaauuucagaggugcaga

SEQ ID NO: 100409 - RNA, 22 nt, Human
accacagcuuugcaccaggugu

SEQ ID NO: 100410 - RNA, 22 nt, Human
accacaggaauugcucuguggu

SEQ ID NO: 100411 - RNA, 22 nt, Human
accacagugggccacaagaagu

SEQ ID NO: 100412 - RNA, 22 nt, Human
accacaguuuaguccaaugaca

SEQ ID NO: 100413 - RNA, 22 nt, Human
accacccauucagaaacacuga

SEQ ID NO: 100414 - RNA, 22 nt, Human
accaccccaaaugaaccucugu

SEQ ID NO: 100415 - RNA, 22 nt, Human
accaccucaucaagcuggauug

SEQ ID NO: 100416 - RNA, 22 nt, Human
accacuggauaucagagaugua

SEQ ID NO: 100417 - RNA, 22 nt, Human
accacuggcucaggagcuggga

SEQ ID NO: 100418 - RNA, 22 nt, Human
accacugggcgggcagccugcu

SEQ ID NO: 100419 - RNA, 22 nt, Human
accacuguacagcagauauagu

SEQ ID NO: 100420 - RNA, 22 nt, Human
accagaagcuggagcacaagga

SEQ ID NO: 100421 - RNA, 20 nt, Human
accagagacuggggacaagu

SEQ ID NO: 100422 - RNA, 22 nt, Human
accagagaggcugcagugugug

SEQ ID NO: 100423 - RNA, 22 nt, Human
accagagaugucuaauaggggc

SEQ ID NO: 100424 - RNA, 22 nt, Human
accagagcucuucagcacagga

SEQ ID NO: 100425 - RNA, 22 nt, Human
accagagcuggcagaguaucaa

SEQ ID NO: 100426 - RNA, 22 nt, Human
accagagggagacuuccucuuc

SEQ ID NO: 100427 - RNA, 22 nt, Human
accagagucaauuauuuugcca

SEQ ID NO: 100428 - RNA, 22 nt, Human
accagaguuggaauaauuuuga

SEQ ID NO: 100429 - RNA, 22 nt, Human
accagcacggauuagaaugcuu

SEQ ID NO: 100430 - RNA, 22 nt, Human
accagcagcugccagaguggag

SEQ ID NO: 100431 - RNA, 21 nt, Human
accagcaggagaucagaagga

SEQ ID NO: 100432 - RNA, 22 nt, Human
accagcagggcugggccaaugg

SEQ ID NO: 100433 - RNA, 22 nt, Human
accagcauccuuccuauuaaca

SEQ ID NO: 100434 - RNA, 22 nt, Human
accagcauugcuuuggguuaua

SEQ ID NO: 100435 - RNA, 22 nt, Human
accagccaccaccaggagaucg

SEQ ID NO: 100436 - RNA, 19 nt, Human
accagcccacucccaguuu

SEQ ID NO: 100437 - RNA, 22 nt, Human
accagcccucaggucagauacu

SEQ ID NO: 100438 - RNA, 17 nt, Human
accagccucuccugggg

SEQ ID NO: 100439 - RNA, 22 nt, Human
accagccugucugagucguggg

SEQ ID NO: 100440 - RNA, 22 nt, Human
accagcucagaagccagaaaga

SEQ ID NO: 100441 - RNA, 22 nt, Human
accagcuccaggccccugcugg

SEQ ID NO: 100442 - RNA, 22 nt, Human
accagcucuuucuuuucacuau

SEQ ID NO: 100443 - RNA, 23 nt, Human
accagcugcccugaacuuugugc

SEQ ID NO: 100444 - RNA, 22 nt, Human
accagcuggucaguugaagauu

SEQ ID NO: 100445 - RNA, 22 nt, Human
accaggaaacugugcccacgac

SEQ ID NO: 100446 - RNA, 19 nt, Human
accaggaacuucccuaggc

SEQ ID NO: 100447 - RNA, 22 nt, Human
accaggaagcaucccuuuguaa

SEQ ID NO: 100448 - RNA, 20 nt, Human
accaggaaucuuuucugagc

SEQ ID NO: 100449 - RNA, 22 nt, Human
acucucucugauggaacuuuag

SEQ ID NO: 100450 - RNA, 22 nt, Human
acucucugguguagaaagaccu

SEQ ID NO: 100451 - RNA, 22 nt, Human
acucucugucuaaaugcaguuu

SEQ ID NO: 100452 - RNA, 22 nt, Human
acucucugugauggaggccagc

SEQ ID NO: 100453 - RNA, 22 nt, Human
acucucuugggggagagcagag

SEQ ID NO: 100454 - RNA, 22 nt, Human
acucugaacuccaggaggcuca

SEQ ID NO: 100455 - RNA, 22 nt, Human
acucugacauuuaaaaagcaau

SEQ ID NO: 100456 - RNA, 22 nt, Human
acucugacuggagugagagagg

SEQ ID NO: 100457 - RNA, 22 nt, Human
acucugccuuaguccuggggcu

SEQ ID NO: 100458 - RNA, 22 nt, Human
acucugcucaaaguccugaggc

SEQ ID NO: 100459 - RNA, 17 nt, Human
acucugcugaaguagaa

SEQ ID NO: 100460 - RNA, 22 nt, Human
acucugcugauagguccucaga

SEQ ID NO: 100461 - RNA, 21 nt, Human
acucugcugcgggcuuggccu

SEQ ID NO: 100462 - RNA, 22 nt, Human
acucuggcugccuugugagcau

SEQ ID NO: 100463 - RNA, 22 nt, Human
acucugggaauccucaccuucc

SEQ ID NO: 100464 - RNA, 22 nt, Human
acucugggaugagaaaaggguu

SEQ ID NO: 100465 - RNA, 22 nt, Human
acucugggccccagguggagcu

SEQ ID NO: 100466 - RNA, 20 nt, Human
acucuggggcucauuagggg

SEQ ID NO: 100467 - RNA, 22 nt, Human
acucuggguucuuucacuugac

SEQ ID NO: 100468 - RNA, 22 nt, Human
acucuguaauucugaagcaccu

SEQ ID NO: 100469 - RNA, 22 nt, Human
acucuguagggacgguucuccc

SEQ ID NO: 100470 - RNA, 21 nt, Human
acucugucuugagccaucugu

SEQ ID NO: 100471 - RNA, 22 nt, Human
acucugugaagucuuauuaugc

SEQ ID NO: 100472 - RNA, 22 nt, Human
acucugugcuggggaccucauc

SEQ ID NO: 100473 - RNA, 22 nt, Human
acucuguuugcagguagcucag

SEQ ID NO: 100474 - RNA, 22 nt, Human
acucuuauggaaauuuuaacua

SEQ ID NO: 100475 - RNA, 22 nt, Human
acucuucagggcagugagcggg

SEQ ID NO: 100476 - RNA, 22 nt, Human
acucuucauucaaguaugcaaa

SEQ ID NO: 100477 - RNA, 22 nt, Human
acucuugaacugauuaagaaug

SEQ ID NO: 100478 - RNA, 22 nt, Human
acucuugauugauuuagucuuu

SEQ ID NO: 100479 - RNA, 22 nt, Human
acucuuuacuuaaacucuaagu

SEQ ID NO: 100480 - RNA, 22 nt, Human
acucuuuauuguuuguggcuag

SEQ ID NO: 100481 - RNA, 22 nt, Human
acucuuugucuguugccgcuua

SEQ ID NO: 100482 - RNA, 22 nt, Human
acucuuuuauaaagcaucuuga

SEQ ID NO: 100483 - RNA, 22 nt, Human
acucuuuuaugcauuccuucag

SEQ ID NO: 100484 - RNA, 22 nt, Human
acugaaacauauauuugaguuu

SEQ ID NO: 100485 - RNA, 22 nt, Human
acugaacacuuuugaaagauua

SEQ ID NO: 100486 - RNA, 22 nt, Human
acugaacagaccauuuuguccu

SEQ ID NO: 100487 - RNA, 22 nt, Human
acugaagagaagcauuuucugc

SEQ ID NO: 100488 - RNA, 19 nt, Human
acugaagcagggacugaaa

SEQ ID NO: 100489 - RNA, 22 nt, Human
acugaaggaaacuuuuguguuu

SEQ ID NO: 100490 - RNA, 22 nt, Human
acugaauaaggugaaugcucug

SEQ ID NO: 100491 - RNA, 22 nt, Human
acugaauagugcugcauuguac

SEQ ID NO: 100492 - RNA, 21 nt, Human
acugaccacuucugccugucu

SEQ ID NO: 100493 - RNA, 22 nt, Human
acugacuguggauggcagcagc

SEQ ID NO: 100494 - RNA, 22 nt, Human
acugagaacuuggggacagagg

SEQ ID NO: 100495 - RNA, 22 nt, Human
acugagaagauucucacucuua

SEQ ID NO: 100496 - RNA, 22 nt, Human
acugagacaacuguguuucuaa

SEQ ID NO: 100497 - RNA, 22 nt, Human
acugagacugaaucugaaugau

SEQ ID NO: 100498 - RNA, 22 nt, Human
acugagaggaaauugagacuau

SEQ ID NO: 100499 - RNA, 22 nt, Human
acugagaugaauagauggcaag

SEQ ID NO: 100500 - RNA, 22 nt, Human
acugagauuuacauguucuagu

SEQ ID NO: 100501 - RNA, 22 nt, Human
acugagcacuugguauauuucc

SEQ ID NO: 100502 - RNA, 22 nt, Human
acugagcaggguuccgcaugga

SEQ ID NO: 100503 - RNA, 22 nt, Human
acugagcugcaagucagggagg

SEQ ID NO: 100504 - RNA, 20 nt, Human
acugagcugcauggagagga

SEQ ID NO: 100505 - RNA, 22 nt, Human
acugaggagaaauuugagugaa

SEQ ID NO: 100506 - RNA, 22 nt, Human
acugaggauuagcccaggcuag

SEQ ID NO: 100507 - RNA, 22 nt, Human
acugaggcuuacaaagguaaag

SEQ ID NO: 100508 - RNA, 22 nt, Human
acugagggcauaaaaguacugu

SEQ ID NO: 100509 - RNA, 21 nt, Human
acugagggccagagaggaccu

SEQ ID NO: 100510 - RNA, 22 nt, Human
acugagguagggcacaccuagg

SEQ ID NO: 100511 - RNA, 22 nt, Human
acugaggucaugcauaguuucu

SEQ ID NO: 100512 - RNA, 20 nt, Human
acugagguuagauaacaggu

SEQ ID NO: 100513 - RNA, 22 nt, Human
acuugaaaagcucagcaguagu

SEQ ID NO: 100514 - RNA, 19 nt, Human
acuugaaagcagagaguuu

SEQ ID NO: 100515 - RNA, 22 nt, Human
acuugaauaggaaagccacaaa

SEQ ID NO: 100516 - RNA, 22 nt, Human
acuugaauuaggccuugagaga

SEQ ID NO: 100517 - RNA, 22 nt, Human
acuugaauuauauuucuagaga

SEQ ID NO: 100518 - RNA, 22 nt, Human
acuugacaccuaauuagucauc

SEQ ID NO: 100519 - RNA, 23 nt, Human
acuugauuauuguugauagauuc

SEQ ID NO: 100520 - RNA, 22 nt, Human
acuugcaagguugcaguuagaa

SEQ ID NO: 100521 - RNA, 22 nt, Human
acuugcaugucaggaaauuaac

SEQ ID NO: 100522 - RNA, 22 nt, Human
acuugcauguguaaaucuuccu

SEQ ID NO: 100523 - RNA, 22 nt, Human
acuugcauuuaaauauugaaua

SEQ ID NO: 100524 - RNA, 22 nt, Human
acuugccuccauauuuuauugc

SEQ ID NO: 100525 - RNA, 22 nt, Human
acuugccuguuacauuucuagu

SEQ ID NO: 100526 - RNA, 22 nt, Human
acuugcugguggcauuuacagu

SEQ ID NO: 100527 - RNA, 20 nt, Human
acuuggaacucauuuuucuu

SEQ ID NO: 100528 - RNA, 23 nt, Human
acuuggaagcagugaacaacuuu

SEQ ID NO: 100529 - RNA, 22 nt, Human
acuuggagggagcuggguggaa

SEQ ID NO: 100530 - RNA, 22 nt, Human
acuuggcaaacaacguggauau

SEQ ID NO: 100531 - RNA, 21 nt, Human
acuuggcagaacgcagaaggc

SEQ ID NO: 100532 - RNA, 22 nt, Human
acuuggcaggucaggggauauu

SEQ ID NO: 100533 - RNA, 22 nt, Human
acuuggccuuauuuccacagaa

SEQ ID NO: 100534 - RNA, 22 nt, Human
acuuggcucagauaccaugccc

SEQ ID NO: 100535 - RNA, 22 nt, Human
acuugggaggcugaaggacauu

SEQ ID NO: 100536 - RNA, 22 nt, Human
acuugguguauuagcucucacu

SEQ ID NO: 100537 - RNA, 22 nt, Human
acuugguuggucucacccuguu

SEQ ID NO: 100538 - RNA, 22 nt, Human
acuuguaaguaacaagugagaa

SEQ ID NO: 100539 - RNA, 22 nt, Human
acuuguauggagacuuggaacc

SEQ ID NO: 100540 - RNA, 17 nt, Human
acuuguauugugcuuua

SEQ ID NO: 100541 - RNA, 22 nt, Human
acuuguuagauauaaaguuugu

SEQ ID NO: 100542 - RNA, 22 nt, Human
acuuguugcccuccugaaaauu

SEQ ID NO: 100543 - RNA, 22 nt, Human
acuuguuuacaagcaguucuga

SEQ ID NO: 100544 - RNA, 22 nt, Human
acuuguuucaacuguacucuca

SEQ ID NO: 100545 - RNA, 22 nt, Human
acuuguuucaacuguacucucc

SEQ ID NO: 100546 - RNA, 22 nt, Human
acuuuaaagcagaauggcuaug

SEQ ID NO: 100547 - RNA, 22 nt, Human
acuuuaaggaggcacucaucuc

SEQ ID NO: 100548 - RNA, 22 nt, Human
acuuuacaaacuccucacuguu

SEQ ID NO: 100549 - RNA, 22 nt, Human
acuuuacaauauccugugacuu

SEQ ID NO: 100550 - RNA, 20 nt, Human
acuuuacagagaagacugac

SEQ ID NO: 100551 - RNA, 22 nt, Human
acuuuacagaugguuuccugac

SEQ ID NO: 100552 - RNA, 22 nt, Human
acuuuacccgcacucagacaca

SEQ ID NO: 100553 - RNA, 22 nt, Human
acuuuacuacauccacagaugg

SEQ ID NO: 100554 - RNA, 22 nt, Human
acuuuacucaacaaauauuuau

SEQ ID NO: 100555 - RNA, 22 nt, Human
acuuuagaaaaggaacagagga

SEQ ID NO: 100556 - RNA, 22 nt, Human
acuuuagaccaucuuccacagu

SEQ ID NO: 100557 - RNA, 23 nt, Human
acuuuagauaaauuaugugcaca

SEQ ID NO: 100558 - RNA, 20 nt, Human
acuggcagccugccugcugu

SEQ ID NO: 100559 - RNA, 22 nt, Human
acuggcagcuguaggaugcaug

SEQ ID NO: 100560 - RNA, 19 nt, Human
acuggcagcuguagucugu

SEQ ID NO: 100561 - RNA, 22 nt, Human
acuggcaguagagggagcgcau

SEQ ID NO: 100562 - RNA, 22 nt, Human
acuggcagugucguuuacauga

SEQ ID NO: 100563 - RNA, 22 nt, Human
acuggccaggagcuggaaauac

SEQ ID NO: 100564 - RNA, 22 nt, Human
acuggccaggcacagcuguggg

SEQ ID NO: 100565 - RNA, 22 nt, Human
acuggccaugggauuuauauuu

SEQ ID NO: 100566 - RNA, 22 nt, Human
acuggcucagaguuccuagaga

SEQ ID NO: 100567 - RNA, 22 nt, Human
acuggcugaguuuauguucaca

SEQ ID NO: 100568 - RNA, 22 nt, Human
acuggcugcgggguggaagaag

SEQ ID NO: 100569 - RNA, 21 nt, Human
acuggcuggcugaguuuccug

SEQ ID NO: 100570 - RNA, 22 nt, Human
acuggcugugcccauagagcuc

SEQ ID NO: 100571 - RNA, 22 nt, Human
acuggcuguggccacggcugcu

SEQ ID NO: 100572 - RNA, 23 nt, Human
acuggcuuugauccagauagauu

SEQ ID NO: 100573 - RNA, 22 nt, Human
acuggcuuugccucugccucuc

SEQ ID NO: 100574 - RNA, 22 nt, Human
acugggaaaaacugcuuugagg

SEQ ID NO: 100575 - RNA, 22 nt, Human
acugggaaaagcuauggcaaau

SEQ ID NO: 100576 - RNA, 22 nt, Human
acugggaaagugcugccugcag

SEQ ID NO: 100577 - RNA, 22 nt, Human
acugggaacaaggugcucagcg

SEQ ID NO: 100578 - RNA, 22 nt, Human
acugggaagacaagaaagauag

SEQ ID NO: 100579 - RNA, 22 nt, Human
acugggaagucagagagaggcu

SEQ ID NO: 100580 - RNA, 20 nt, Human
acugggagcuaacggagauu

SEQ ID NO: 100581 - RNA, 22 nt, Human
acugggaggcaucuggagcuga

SEQ ID NO: 100582 - RNA, 22 nt, Human
acugggagggucuugaagaggg

SEQ ID NO: 100583 - RNA, 22 nt, Human
acugggcaccaucaugagauag

SEQ ID NO: 100584 - RNA, 22 nt, Human
acugggcaccaucaugagaugg

SEQ ID NO: 100585 - RNA, 22 nt, Human
acugggcagcagcucgagccgc

SEQ ID NO: 100586 - RNA, 22 nt, Human
acugggcauuuugaacguucuu

SEQ ID NO: 100587 - RNA, 22 nt, Human
acugggccagacacugauuccc

SEQ ID NO: 100588 - RNA, 22 nt, Human
acugggccaggggcuuuggagc

SEQ ID NO: 100589 - RNA, 22 nt, Human
acugggccaggugugggugagu

SEQ ID NO: 100590 - RNA, 22 nt, Human
acugggccgaaauggacagaau

SEQ ID NO: 100591 - RNA, 22 nt, Human
acugggcucauaaugucauaga

SEQ ID NO: 100592 - RNA, 22 nt, Human
acugggcugccugguucuucua

SEQ ID NO: 100593 - RNA, 22 nt, Human
acugggcuguaaagagaggcaa

SEQ ID NO: 100594 - RNA, 22 nt, Human
acugggcuguuuuuugagugga

SEQ ID NO: 100595 - RNA, 22 nt, Human
acuggggaauggaacugggaau

SEQ ID NO: 100596 - RNA, 22 nt, Human
acuggggauuagggacucagug

SEQ ID NO: 100597 - RNA, 22 nt, Human
acuggguggcugccuccuucuc

SEQ ID NO: 100598 - RNA, 22 nt, Human
acuggguguauuagugguguuu

SEQ ID NO: 100599 - RNA, 22 nt, Human
acugguaacaauggaagcuucu

SEQ ID NO: 100600 - RNA, 22 nt, Human
acugguaccugucuugaauuuu

SEQ ID NO: 100601 - RNA, 22 nt, Human
acugguacuguucugcggauca

SEQ ID NO: 100602 - RNA, 22 nt, Human
acugguuuuccagguuacuucu

SEQ ID NO: 100603 - RNA, 22 nt, Human
acuguaaaaugagauauguaua

SEQ ID NO: 100604 - RNA, 22 nt, Human
acuguaaagaaguaaguauggg

SEQ ID NO: 100605 - RNA, 22 nt, Human
acuguaaaguuacgaucaaguu

SEQ ID NO: 100606 - RNA, 22 nt, Human
acuguaacacaaugguaucugu

SEQ ID NO: 100607 - RNA, 22 nt, Human
acuguaacacucauacugaagu

SEQ ID NO: 100608 - RNA, 19 nt, Human
acuguaaggcauuuuuuuc

SEQ ID NO: 100609 - RNA, 22 nt, Human
acuguaaugguggauccauguc

SEQ ID NO: 100610 - RNA, 22 nt, Human
acuguaauguuuuaaagcagag

SEQ ID NO: 100611 - RNA, 22 nt, Human
acuguaauuaucugaacgugca

SEQ ID NO: 100612 - RNA, 22 nt, Human
acuguacauguaaacauuguca

SEQ ID NO: 100613 - RNA, 22 nt, Human
acuguacuuuagaaaguguagu

SEQ ID NO: 100614 - RNA, 22 nt, Human
acuguagucuaaauauagucuu

SEQ ID NO: 100615 - RNA, 22 nt, Human
acuguauaaggcauagguaagc

SEQ ID NO: 100616 - RNA, 22 nt, Human
acuguauuuuguacuuucgugu

SEQ ID NO: 100617 - RNA, 22 nt, Human
acugucaaauuuauggaaagag

SEQ ID NO: 100618 - RNA, 22 nt, Human
acugucaaggaaacaaaauuac

SEQ ID NO: 100619 - RNA, 22 nt, Human
acugucaauagugcugagcuug

SEQ ID NO: 100620 - RNA, 22 nt, Human
acugucauuaaugaauguaaua

SEQ ID NO: 100621 - RNA, 22 nt, Human
acuguccagaagauagaaauau

SEQ ID NO: 100622 - RNA, 22 nt, Human
acuguccauaauauuggugaac

SEQ ID NO: 100623 - RNA, 22 nt, Human
acuguccauucacucauauuca

SEQ ID NO: 100624 - RNA, 22 nt, Human
acuguccuggagcucacacucu

SEQ ID NO: 100625 - RNA, 22 nt, Human
acugucuccucaucaugccugg

SEQ ID NO: 100626 - RNA, 18 nt, Human
acugucucugagaguggu

SEQ ID NO: 100627 - RNA, 22 nt, Human
acugucuguacuucuugcaagg

SEQ ID NO: 100628 - RNA, 22 nt, Human
acugucuugcuaugagcuccca

SEQ ID NO: 100629 - RNA, 22 nt, Human
acugucuuguguuaaagaacca

SEQ ID NO: 100630 - RNA, 22 nt, Human
acugucuuuauuagaaucuuau

SEQ ID NO: 100631 - RNA, 21 nt, Human
acugugaagaugcuauaaacu

SEQ ID NO: 100632 - RNA, 22 nt, Human
acugugaaucacuacuaguaga

SEQ ID NO: 100633 - RNA, 22 nt, Human
acugugagagagguucuuggua

SEQ ID NO: 100634 - RNA, 22 nt, Human
acugugagaguuuuucuaggag

SEQ ID NO: 100635 - RNA, 22 nt, Human
acugugauguuugugaucaucu

SEQ ID NO: 100636 - RNA, 22 nt, Human
acugugcacaauucuaaguccu

SEQ ID NO: 100637 - RNA, 22 nt, Human
acugugcacacaaaaauagauu

SEQ ID NO: 100638 - RNA, 22 nt, Human
acugugcaucuauugccauuua

SEQ ID NO: 100639 - RNA, 21 nt, Human
acugugccaggcacaaaaaca

SEQ ID NO: 100640 - RNA, 22 nt, Human
acugugcugcucuccgcagccc

SEQ ID NO: 100641 - RNA, 22 nt, Human
acuguggaugccaaaggggagg

SEQ ID NO: 100642 - RNA, 22 nt, Human
acuguggcgucaggaagaaauu

SEQ ID NO: 100643 - RNA, 22 nt, Human
acugugggggagccagucccau

SEQ ID NO: 100644 - RNA, 22 nt, Human
acugugggucccagcugugucu

SEQ ID NO: 100645 - RNA, 22 nt, Human
acuugaaacccugagaugauaa

SEQ ID NO: 100646 - RNA, 21 nt, Human
acuugaaguuggaguuucugu

SEQ ID NO: 100647 - RNA, 22 nt, Human
acuugaauaggugucaaggcca

SEQ ID NO: 100648 - RNA, 22 nt, Human
acuugcaaagugagggaguguu

SEQ ID NO: 100649 - RNA, 22 nt, Human
acuugcauguuauuuuuauagg

SEQ ID NO: 100650 - RNA, 22 nt, Human
acuugccccagaauugcugcug

SEQ ID NO: 100651 - RNA, 22 nt, Human
acuuggaaaauucaaaauggca

SEQ ID NO: 100652 - RNA, 22 nt, Human
acuuggaaagaugcaacacagu

SEQ ID NO: 100653 - RNA, 22 nt, Human
acuuggauauguucacuagacc

SEQ ID NO: 100654 - RNA, 21 nt, Human
acuuggccaggcccccaccug

SEQ ID NO: 100655 - RNA, 22 nt, Human
acuuggcuucaagguuaagguc

SEQ ID NO: 100656 - RNA, 22 nt, Human
acuuggcuuuuccaucucugca

SEQ ID NO: 100657 - RNA, 22 nt, Human
acuugggagggugugggcagcu

SEQ ID NO: 100658 - RNA, 22 nt, Human
acuuggucguggugcagcaugg

SEQ ID NO: 100659 - RNA, 22 nt, Human
acuuggugaagucaggugauua

SEQ ID NO: 100660 - RNA, 22 nt, Human
acuugguugaugucauaagguu

SEQ ID NO: 100661 - RNA, 22 nt, Human
acuugucuggcagaucaugcaa

SEQ ID NO: 100662 - RNA, 22 nt, Human
acuugucuuuguaaaauagaaa

SEQ ID NO: 100663 - RNA, 22 nt, Human
acuuguguaacacagaaagaac

SEQ ID NO: 100664 - RNA, 22 nt, Human
acuuguuugaaucucucuagag

SEQ ID NO: 100665 - RNA, 22 nt, Human
acuuguuugccuaaaauuuuga

SEQ ID NO: 100666 - RNA, 22 nt, Human
acuuguuuggagccagcuguaa

SEQ ID NO: 100667 - RNA, 22 nt, Human
acuguuuaaaggcuuccuuucu

SEQ ID NO: 100668 - RNA, 22 nt, Human
acuguuucugccacaauagccc

SEQ ID NO: 100669 - RNA, 22 nt, Human
acuguuuuccuaaugagcaaga

SEQ ID NO: 100670 - RNA, 22 nt, Human
acuguuuugugccuuaguuucc

SEQ ID NO: 100671 - RNA, 22 nt, Human
acuuacaaguucccuuucucag

SEQ ID NO: 100672 - RNA, 22 nt, Human
acuuagaagaugcaguaaagca

SEQ ID NO: 100673 - RNA, 22 nt, Human
acuuagcagguacuuucauauu

SEQ ID NO: 100674 - RNA, 22 nt, Human
acuuaggccuugcuaagcauuu

SEQ ID NO: 100675 - RNA, 22 nt, Human
acuuaggcuugguucagcuaga

SEQ ID NO: 100676 - RNA, 20 nt, Human
acuuaguguaggguuccuag

SEQ ID NO: 100677 - RNA, 22 nt, Human
acuuaguuaaguauuuuggaaa

SEQ ID NO: 100678 - RNA, 22 nt, Human
acuuauagccagaauuaauuau

SEQ ID NO: 100679 - RNA, 22 nt, Human
acuuauauuugcuuuaugcuuc

SEQ ID NO: 100680 - RNA, 22 nt, Human
acuucaaaucucuugaaagcaa

SEQ ID NO: 100681 - RNA, 22 nt, Human
acuucaaaugugacaaugugaa

SEQ ID NO: 100682 - RNA, 22 nt, Human
acuucaaauucugggggaagag

SEQ ID NO: 100683 - RNA, 22 nt, Human
acuucacagauauuuauuuggu

SEQ ID NO: 100684 - RNA, 22 nt, Human
acuucacagguuuucauaaaac

SEQ ID NO: 100685 - RNA, 22 nt, Human
acuucagagaaagagggaauuc

SEQ ID NO: 100686 - RNA, 22 nt, Human
acuucagaguuaguuauagacc

SEQ ID NO: 100687 - RNA, 22 nt, Human
acuucagugugguauaaaacgu

SEQ ID NO: 100688 - RNA, 22 nt, Human
acuucaugcagaagagagcugu

SEQ ID NO: 100689 - RNA, 22 nt, Human
acuucauguuucuauuagcuca

SEQ ID NO: 100690 - RNA, 22 nt, Human
acuuccaaagaagugauuacag

SEQ ID NO: 100691 - RNA, 22 nt, Human
acuuccaaauaccaucacauug

SEQ ID NO: 100692 - RNA, 22 nt, Human
acuuccaaguuuauucauguga

SEQ ID NO: 100693 - RNA, 22 nt, Human
acuuccagcaacuuggugcuau

SEQ ID NO: 100694 - RNA, 22 nt, Human
acuuccagcaccucaagcggaa

SEQ ID NO: 100695 - RNA, 22 nt, Human
acuuccagcuagguucugcuaa

SEQ ID NO: 100696 - RNA, 22 nt, Human
acuuccagcuuuauaauucagu

SEQ ID NO: 100697 - RNA, 22 nt, Human
acuuccagguuccacccaagac

SEQ ID NO: 100698 - RNA, 22 nt, Human
acuuccagugucugcugcuagc

SEQ ID NO: 100699 - RNA, 23 nt, Human
acuuccaguuauaggaacucuuc

SEQ ID NO: 100700 - RNA, 23 nt, Human
acuuccaguugcuucagcauaug

SEQ ID NO: 100701 - RNA, 22 nt, Human
acuuccaguuuuaauuaaauug

SEQ ID NO: 100702 - RNA, 22 nt, Human
acuucccaacgugggccuccca

SEQ ID NO: 100703 - RNA, 18 nt, Human
acuucccagaugagggga

SEQ ID NO: 100704 - RNA, 22 nt, Human
acuucccauuucucugcuuuag

SEQ ID NO: 100705 - RNA, 22 nt, Human
acuuccuggcugggugaccugg

SEQ ID NO: 100706 - RNA, 22 nt, Human
acuuccugggcaugcagagucc

SEQ ID NO: 100707 - RNA, 22 nt, Human
acuuccuguauuuauccauagc

SEQ ID NO: 100708 - RNA, 22 nt, Human
acuuccuuccaaacauucauuu

SEQ ID NO: 100709 - RNA, 22 nt, Human
acuuccuugucaggugcaucau

SEQ ID NO: 100710 - RNA, 22 nt, Human
acuucuauuggucaugauaaaa

SEQ ID NO: 100711 - RNA, 22 nt, Human
acuucucugguugagguccaau

SEQ ID NO: 100712 - RNA, 22 nt, Human
acuucucuuccccggaacucua

SEQ ID NO: 100713 - RNA, 22 nt, Human
acuucuguauguccugcauuca

SEQ ID NO: 100714 - RNA, 22 nt, Human
acuucuguccuccaagccacgu

SEQ ID NO: 100715 - RNA, 22 nt, Human
acuucuugaugaaaaugguacu

SEQ ID NO: 100716 - RNA, 22 nt, Human
acuugaaacaucuuuaaaugua

SEQ ID NO: 100717 - RNA, 22 nt, Human
acuugaaaccuuggcaaacaau

SEQ ID NO: 100718 - RNA, 22 nt, Human
acuugaaagaaguuuccuuaaa

SEQ ID NO: 100719 - RNA, 22 nt, Human
acuugaaaggaagcucuaaaac

SEQ ID NO: 100720 - RNA, 22 nt, Human
acuugaauucaaagcgaaagca

SEQ ID NO: 100721 - RNA, 22 nt, Human
acuugacuuugucauuugugcu

SEQ ID NO: 100722 - RNA, 22 nt, Human
acuugauuguaugaaguuauuu

SEQ ID NO: 100723 - RNA, 22 nt, Human
acuugauuuugaaccuuucuac

SEQ ID NO: 100724 - RNA, 22 nt, Human
acuugauuuuuauaauaaaugg

SEQ ID NO: 100725 - RNA, 22 nt, Human
acuugcauuauauuuaucacaa

SEQ ID NO: 100726 - RNA, 22 nt, Human
acuugccauaaaugaaaauacu

SEQ ID NO: 100727 - RNA, 22 nt, Human
acuugccuaaggucaugcaacu

SEQ ID NO: 100728 - RNA, 20 nt, Human
acuugcugggcuuuguuacc

SEQ ID NO: 100729 - RNA, 22 nt, Human
acuugcuuaguuugcaacagag

SEQ ID NO: 100730 - RNA, 22 nt, Human
acuugcuugggccaucucgcuu

SEQ ID NO: 100731 - RNA, 22 nt, Human
acuuggagagauaaucccauau

SEQ ID NO: 100732 - RNA, 22 nt, Human
acuugggaaagaaguuucaccg

SEQ ID NO: 100733 - RNA, 22 nt, Human
acuugggaguucuggaagccug

SEQ ID NO: 100734 - RNA, 22 nt, Human
acuugggaugguggccagagcg

SEQ ID NO: 100735 - RNA, 22 nt, Human
acuugggucaaguagcucacag

SEQ ID NO: 100736 - RNA, 22 nt, Human
acuugggucacaugaccuaccu

SEQ ID NO: 100737 - RNA, 22 nt, Human
acuugguggaacguguauuuua

SEQ ID NO: 100738 - RNA, 22 nt, Human
acuugguucuaacuaguguaua

SEQ ID NO: 100739 - RNA, 22 nt, Human
acuugguugcaaaugaauuauu

SEQ ID NO: 100740 - RNA, 22 nt, Human
acuugguugcuucugaaaugac

SEQ ID NO: 100741 - RNA, 22 nt, Human
acuuguaaacaaaucuaaugua

SEQ ID NO: 100742 - RNA, 22 nt, Human
acuugucuaccaugaauauuua

SEQ ID NO: 100743 - RNA, 22 nt, Human
acuuguguuaccaagguuuggu

SEQ ID NO: 100744 - RNA, 22 nt, Human
acuuguuaguuuuaucugcaug

SEQ ID NO: 100745 - RNA, 22 nt, Human
acuuguucauugaguacauaug

SEQ ID NO: 100746 - RNA, 22 nt, Human
acuuuaaaaagagccuucuaac

SEQ ID NO: 100747 - RNA, 22 nt, Human
acuuuaaaacugaucaucagag

SEQ ID NO: 100748 - RNA, 22 nt, Human
acuuuaacuguuauuacucacc

SEQ ID NO: 100749 - RNA, 23 nt, Human
acuuuaagaguauaugacuuccc

SEQ ID NO: 100750 - RNA, 21 nt, Human
acuuuaauauacaugaggagg

SEQ ID NO: 100751 - RNA, 21 nt, Human
acuuuacaauuuacauaguga

SEQ ID NO: 100752 - RNA, 20 nt, Human
acuuuacugagcuguaauuc

SEQ ID NO: 100753 - RNA, 22 nt, Human
acuuuagaaaagcauccauaga

SEQ ID NO: 100754 - RNA, 22 nt, Human
acuuuaugcuaaacuuuacucu

SEQ ID NO: 100755 - RNA, 22 nt, Human
acuuuauuuccuauugcaucca

SEQ ID NO: 100756 - RNA, 22 nt, Human
acuuucaagaacuucuuuaaug

SEQ ID NO: 100757 - RNA, 22 nt, Human
acuuucaauucccuuagcaacu

SEQ ID NO: 100758 - RNA, 22 nt, Human
acuuucauguuggugaaggguu

SEQ ID NO: 100759 - RNA, 22 nt, Human
acuuucccacuuaauguauuua

SEQ ID NO: 100760 - RNA, 22 nt, Human
acuuucccucucagaacucuua

SEQ ID NO: 100761 - RNA, 22 nt, Human
acuuuccuuauggauggggaaa

SEQ ID NO: 100762 - RNA, 23 nt, Human
agcacuuguaucuuacuaaaaug

SEQ ID NO: 100763 - RNA, 22 nt, Human
agcacuuuaagcaacagaucaa

SEQ ID NO: 100764 - RNA, 22 nt, Human
agcacuuugggagauaaagcug

SEQ ID NO: 100765 - RNA, 22 nt, Human
agcagaaagcuuauuuugacug

SEQ ID NO: 100766 - RNA, 22 nt, Human
agcagaaccugcagaccugucu

SEQ ID NO: 100767 - RNA, 22 nt, Human
agcagaaucuguccuuggaaga

SEQ ID NO: 100768 - RNA, 22 nt, Human
agcagacaccaggaguaaagaa

SEQ ID NO: 100769 - RNA, 22 nt, Human
agcagacaggcugccacagugc

SEQ ID NO: 100770 - RNA, 22 nt, Human
agcagacauggcuuggaugugg

SEQ ID NO: 100771 - RNA, 22 nt, Human
agcagacuccauugagugaguc

SEQ ID NO: 100772 - RNA, 19 nt, Human
agcagagcaaaguggcuga

SEQ ID NO: 100773 - RNA, 22 nt, Human
agcagagcagaaugugaaggug

SEQ ID NO: 100774 - RNA, 18 nt, Human
agcagagcccaugcauuc

SEQ ID NO: 100775 - RNA, 19 nt, Human
agcagagcccugaagaucc

SEQ ID NO: 100776 - RNA, 22 nt, Human
cauguguggagggcaugcaugg

SEQ ID NO: 100777 - RNA, 22 nt, Human
cauguguggucuguggcuaucu

SEQ ID NO: 100778 - RNA, 22 nt, Human
cauguguuaaucuuucugcaaa

SEQ ID NO: 100779 - RNA, 22 nt, Human
cauguguuucgagacuguugag

SEQ ID NO: 100780 - RNA, 22 nt, Human
cauguguuuugucauuucaaua

SEQ ID NO: 100781 - RNA, 22 nt, Human
cauguuaacuaagauuaacuau

SEQ ID NO: 100782 - RNA, 19 nt, Human
cauguuaugcuguaguauc

SEQ ID NO: 100783 - RNA, 22 nt, Human
cauguuauuuauccauuaaaca

SEQ ID NO: 100784 - RNA, 22 nt, Human
cauguucaaauaaguaguuucu

SEQ ID NO: 100785 - RNA, 22 nt, Human
cauguucaccuguggcacuagu

SEQ ID NO: 100786 - RNA, 22 nt, Human
cauguucagugacaguuauuga

SEQ ID NO: 100787 - RNA, 22 nt, Human
cauguugauuagagagcuuaga

SEQ ID NO: 100788 - RNA, 22 nt, Human
cauguuucugagaaaaguagga

SEQ ID NO: 100789 - RNA, 22 nt, Human
cauguuuucuaggcuuucacaa

SEQ ID NO: 100790 - RNA, 22 nt, Human
cauuaaauaucaaccuagacua

SEQ ID NO: 100791 - RNA, 22 nt, Human
cauuaaaucuuccagaccucac

SEQ ID NO: 100792 - RNA, 22 nt, Human
cauuaaauuccuuguucucaaa

SEQ ID NO: 100793 - RNA, 22 nt, Human
cauuaacaaugacugcuugacu

SEQ ID NO: 100794 - RNA, 22 nt, Human
cauuaacaauuguuuaugcugu

SEQ ID NO: 100795 - RNA, 21 nt, Human
cauuaaguaccagggcacugu

SEQ ID NO: 100796 - RNA, 22 nt, Human
cauuacaaacauguuaagauuu

SEQ ID NO: 100797 - RNA, 22 nt, Human
cauuacaacaaucugccauggc

SEQ ID NO: 100798 - RNA, 22 nt, Human
cauuacaaccccaaauuacaaa

SEQ ID NO: 100799 - RNA, 22 nt, Human
cauuagcaagucacuauuuuau

SEQ ID NO: 100800 - RNA, 18 nt, Human
cauuagcaccacguagag

SEQ ID NO: 100801 - RNA, 22 nt, Human
cauuagcaugguagccagguca

SEQ ID NO: 100802 - RNA, 22 nt, Human
cauuagcauuacuucaaagagu

SEQ ID NO: 100803 - RNA, 21 nt, Human
cauuagggcagaagcaggaag

SEQ ID NO: 100804 - RNA, 22 nt, Human
cauuauauuacagcacuguuaa

SEQ ID NO: 100805 - RNA, 22 nt, Human
cauuauccaacagcacuuucca

SEQ ID NO: 100806 - RNA, 22 nt, Human
cauuaucugccauugacaccau

SEQ ID NO: 100807 - RNA, 22 nt, Human
cauuaugaagcaucaucuuauu

SEQ ID NO: 100808 - RNA, 18 nt, Human
cauuaugugguuauagaa

SEQ ID NO: 100809 - RNA, 22 nt, Human
cauuauugccagccauacugaa

SEQ ID NO: 100810 - RNA, 20 nt, Human
cauuauuguaaucagcugua

SEQ ID NO: 100811 - RNA, 22 nt, Human
cauucaaaaugggcugaccugu

SEQ ID NO: 100812 - RNA, 22 nt, Human
cauucaaaugugccacuguccu

SEQ ID NO: 100813 - RNA, 22 nt, Human
cauucaagaguggacauaaugc

SEQ ID NO: 100814 - RNA, 22 nt, Human
cauucacagagggggaagcauc

SEQ ID NO: 100815 - RNA, 22 nt, Human
cauucacagcaggucagcugaa

SEQ ID NO: 100816 - RNA, 22 nt, Human
cauucauccacuguuggaaauu

SEQ ID NO: 100817 - RNA, 22 nt, Human
cauucauucuguaaguaacuau

SEQ ID NO: 100818 - RNA, 18 nt, Human
cauuccaaguucuaccuc

SEQ ID NO: 100819 - RNA, 22 nt, Human
cauuccagagcugccucugcua

SEQ ID NO: 100820 - RNA, 22 nt, Human
cauuccagaugaggccaggccc

SEQ ID NO: 100821 - RNA, 22 nt, Human
cauuccagcucucauacucugg

SEQ ID NO: 100822 - RNA, 22 nt, Human
cauucccacguguucuuugcuu

SEQ ID NO: 100823 - RNA, 22 nt, Human
cauucccaugacuccugcucag

SEQ ID NO: 100824 - RNA, 18 nt, Human
cauuccccaucucugagc

SEQ ID NO: 100825 - RNA, 21 nt, Human
cauuccucggcucauagagga

SEQ ID NO: 100826 - RNA, 20 nt, Human
cauuccugaggaauucaugu

SEQ ID NO: 100827 - RNA, 23 nt, Human
cauuccugauauggccacaagag

SEQ ID NO: 100828 - RNA, 22 nt, Human
cauucuaaaguguuuuauaccu

SEQ ID NO: 100829 - RNA, 22 nt, Human
cauucuaugaaaacuaggcaau

SEQ ID NO: 100830 - RNA, 22 nt, Human
cauucucuacacuccugcccug

SEQ ID NO: 100831 - RNA, 22 nt, Human
cauucucuugacaggacagccc

SEQ ID NO: 100832 - RNA, 22 nt, Human
cauucugagcuaauaugcuuau

SEQ ID NO: 100833 - RNA, 18 nt, Human
cauugacaguauaucuuu

SEQ ID NO: 100834 - RNA, 22 nt, Human
cauugacaguucuuuaaguugc

SEQ ID NO: 100835 - RNA, 22 nt, Human
cauugacaucaggcuuggccaa

SEQ ID NO: 100836 - RNA, 22 nt, Human
cauugagagaaucacauagaag

SEQ ID NO: 100837 - RNA, 22 nt, Human
cauugauuauggaaagcagugg

SEQ ID NO: 100838 - RNA, 22 nt, Human
cauugcaacuucaaacuccugg

SEQ ID NO: 100839 - RNA, 22 nt, Human
cauugcugugggcauuugcugc

SEQ ID NO: 100840 - RNA, 22 nt, Human
cauugcuuauuucagcuaaagu

SEQ ID NO: 100841 - RNA, 22 nt, Human
cauuggcacaaguagcuucauc

SEQ ID NO: 100842 - RNA, 22 nt, Human
cauagaaugcagcaggaaaguu

SEQ ID NO: 100843 - RNA, 22 nt, Human
cauagaauguaauaaagaguag

SEQ ID NO: 100844 - RNA, 22 nt, Human
cauagaggcaaaauggcuguac

SEQ ID NO: 100845 - RNA, 22 nt, Human
cauagaggcuaaaauuauuugg

SEQ ID NO: 100846 - RNA, 22 nt, Human
cauagagugauguaagguaugu

SEQ ID NO: 100847 - RNA, 22 nt, Human
cauagauuuuagguuagaucga

SEQ ID NO: 100848 - RNA, 22 nt, Human
cauagcaagaucacauucugua

SEQ ID NO: 100849 - RNA, 22 nt, Human
cauagcuuagggguuaaacuca

SEQ ID NO: 100850 - RNA, 22 nt, Human
cauaguaaauaaugcagaugau

SEQ ID NO: 100851 - RNA, 22 nt, Human
cauaguuccuaccuaagcauaa

SEQ ID NO: 100852 - RNA, 22 nt, Human
cauauaaauacaacauguguua

SEQ ID NO: 100853 - RNA, 22 nt, Human
cauauacugcauacauaugugu

SEQ ID NO: 100854 - RNA, 22 nt, Human
cauauacuuuucuauagcuuuc

SEQ ID NO: 100855 - RNA, 22 nt, Human
cauauauucugguuuucacugg

SEQ ID NO: 100856 - RNA, 15 nt, Human
cauaucacugggaau

SEQ ID NO: 100857 - RNA, 22 nt, Human
cauaucccauuggccaggacau

SEQ ID NO: 100858 - RNA, 22 nt, Human
cauaucuggagacuccuggucu

SEQ ID NO: 100859 - RNA, 23 nt, Human
cauaugaaaguagacacuuucca

SEQ ID NO: 100860 - RNA, 22 nt, Human
cauaugaagaugucuuuuugua

SEQ ID NO: 100861 - RNA, 22 nt, Human
cauaugaaguucaacagagaug

SEQ ID NO: 100862 - RNA, 23 nt, Human
cauaugaauuuuagaggcaguuu

SEQ ID NO: 100863 - RNA, 20 nt, Human
cauauggaaagauauuguuc

SEQ ID NO: 100864 - RNA, 23 nt, Human
cauauucaaaacuggaccacucu

SEQ ID NO: 100865 - RNA, 16 nt, Human
cauauugcugaaagag

SEQ ID NO: 100866 - RNA, 19 nt, Human
cauauugugcuugcauuuu

SEQ ID NO: 100867 - RNA, 22 nt, Human
cauauuuauagaucuggcauuu

SEQ ID NO: 100868 - RNA, 22 nt, Human
cauauuuuaguugcugaacagc

SEQ ID NO: 100869 - RNA, 17 nt, Human
caucaaagaaauuucca

SEQ ID NO: 100870 - RNA, 22 nt, Human
caucaaaugccauauaugguug

SEQ ID NO: 100871 - RNA, 22 nt, Human
caucaaauggcaagugaaagcu

SEQ ID NO: 100872 - RNA, 22 nt, Human
caucaaugugcagagaugaacg

SEQ ID NO: 100873 - RNA, 22 nt, Human
caucacagaaauaaacauaccu

SEQ ID NO: 100874 - RNA, 22 nt, Human
caucacagauguuguguggagu

SEQ ID NO: 100875 - RNA, 21 nt, Human
caucacaggaugauuuuuuca

SEQ ID NO: 100876 - RNA, 22 nt, Human
caucacaguggcuguuuauuua

SEQ ID NO: 100877 - RNA, 22 nt, Human
caucacaucaaaccuacucuca

SEQ ID NO: 100878 - RNA, 22 nt, Human
caucacugacgcugagauucca

SEQ ID NO: 100879 - RNA, 22 nt, Human
caucacuguccaaaguucaguu

SEQ ID NO: 100880 - RNA, 22 nt, Human
caucacuguccucagcauucca

SEQ ID NO: 100881 - RNA, 22 nt, Human
caucagaaagaguccuggacuu

SEQ ID NO: 100882 - RNA, 22 nt, Human
caucagaaccagcugggugagg

SEQ ID NO: 100883 - RNA, 22 nt, Human
caucagaacgugagcuccuugu

SEQ ID NO: 100884 - RNA, 22 nt, Human
caucagaagaaagacaaaugau

SEQ ID NO: 100885 - RNA, 22 nt, Human
caucagaaggccagaggguagc

SEQ ID NO: 100886 - RNA, 22 nt, Human
cauuugaaccuggauguucuua

SEQ ID NO: 100887 - RNA, 20 nt, Human
cauuugaaucuccauucugc

SEQ ID NO: 100888 - RNA, 22 nt, Human
cauuugauuacuaaagauaauu

SEQ ID NO: 100889 - RNA, 22 nt, Human
cauuugauuccuuuacucuuau

SEQ ID NO: 100890 - RNA, 22 nt, Human
cauuugcaaaccaacaagauga

SEQ ID NO: 100891 - RNA, 22 nt, Human
cauuugcugaggccuucagagg

SEQ ID NO: 100892 - RNA, 22 nt, Human
cauuugcuggggucuugggagu

SEQ ID NO: 100893 - RNA, 20 nt, Human
cauuugggaucaugagguuu

SEQ ID NO: 100894 - RNA, 22 nt, Human
cauuuguuaagaaggaaaaagg

SEQ ID NO: 100895 - RNA, 22 nt, Human
cauuuguuaaugcugcuuuuaa

SEQ ID NO: 100896 - RNA, 22 nt, Human
cauuuguuaauuacuauuaucu

SEQ ID NO: 100897 - RNA, 18 nt, Human
cauuuguuauugugugug

SEQ ID NO: 100898 - RNA, 22 nt, Human
cauuuguugggacaaugaaaag

SEQ ID NO: 100899 - RNA, 22 nt, Human
cauuuguugguugcugucuuau

SEQ ID NO: 100900 - RNA, 19 nt, Human
cauuuuaagcauccccagu

SEQ ID NO: 100901 - RNA, 22 nt, Human
cauuuuaccuagaagcugaaag

SEQ ID NO: 100902 - RNA, 22 nt, Human
cauuuucagcacccaucugaaa

SEQ ID NO: 100903 - RNA, 22 nt, Human
cauuuuguaagucucucuuguu

SEQ ID NO: 100904 - RNA, 22 nt, Human
cauuuuguagcaaugacuguug

SEQ ID NO: 100905 - RNA, 22 nt, Human
ccaaaagcagcugucugugaau

SEQ ID NO: 100906 - RNA, 22 nt, Human
ccaaacaaauccccauucuuag

SEQ ID NO: 100907 - RNA, 22 nt, Human
ccaaacauuucaaauuuagaga

SEQ ID NO: 100908 - RNA, 22 nt, Human
ccaaagagagaccuuucuucuc

SEQ ID NO: 100909 - RNA, 22 nt, Human
ccaaagcuggcuuucaugguuu

SEQ ID NO: 100910 - RNA, 22 nt, Human
ccaaaggccaggcacugagguu

SEQ ID NO: 100911 - RNA, 22 nt, Human
ccaaagguguuggccuucagug

SEQ ID NO: 100912 - RNA, 22 nt, Human
ccaaagucagugcucagucguc

SEQ ID NO: 100913 - RNA, 22 nt, Human
ccaaaguccauaguuuacauaa

SEQ ID NO: 100914 - RNA, 23 nt, Human
ccaaagucgaagucuaguccaga

SEQ ID NO: 100915 - RNA, 22 nt, Human
ccaaagucugcauuuuaacaug

SEQ ID NO: 100916 - RNA, 22 nt, Human
ccaaagucuggagcagcagagc

SEQ ID NO: 100917 - RNA, 22 nt, Human
ccaaagugcugggauucaggca

SEQ ID NO: 100918 - RNA, 22 nt, Human
ccaaagugcugggguuacaggc

SEQ ID NO: 100919 - RNA, 22 nt, Human
ccaaauaauauuucagaaccau

SEQ ID NO: 100920 - RNA, 20 nt, Human
ccaaauguggagaaaaagua

SEQ ID NO: 100921 - RNA, 22 nt, Human
ccaaauuaaaucauacagacag

SEQ ID NO: 100922 - RNA, 22 nt, Human
ccaacacagauguguuaguguu

SEQ ID NO: 100923 - RNA, 22 nt, Human
ccaacagguugagagucugaau

SEQ ID NO: 100924 - RNA, 15 nt, Human
ccaagaacuaauuag

SEQ ID NO: 100925 - RNA, 23 nt, Human
ccaagacuguuaggaguggggag

SEQ ID NO: 100926 - RNA, 22 nt, Human
ccaagaggaccuugccagggca

SEQ ID NO: 100927 - RNA, 22 nt, Human
ccaagaggggcagagggcugca

SEQ ID NO: 100928 - RNA, 22 nt, Human
ccaagaggguugcccugagcgu

SEQ ID NO: 100929 - RNA, 22 nt, Human
ccaagagguaucuugccauaaa

SEQ ID NO: 100930 - RNA, 22 nt, Human
ccaagagguugugaggcaggca

SEQ ID NO: 100931 - RNA, 22 nt, Human
ccaagcagaaccauucaggcac

SEQ ID NO: 100932 - RNA, 22 nt, Human
ccaagcauuucuagccagucac

SEQ ID NO: 100933 - RNA, 22 nt, Human
ccaagcuggacagcagcaagga

SEQ ID NO: 100934 - RNA, 23 nt, Human
ccaagcuugucccugccugcuuu

SEQ ID NO: 100935 - RNA, 20 nt, Human
ccaaggacacuggcuccugg

SEQ ID NO: 100936 - RNA, 22 nt, Human
ccaaggagcucauauucuuguu

SEQ ID NO: 100937 - RNA, 22 nt, Human
ccaaggagcugcaggcacuugu

SEQ ID NO: 100938 - RNA, 22 nt, Human
ccaaggaggccccaggucagcu

SEQ ID NO: 100939 - RNA, 22 nt, Human
ccaaggcaaugugcagcuggug

SEQ ID NO: 100940 - RNA, 22 nt, Human
ccaaggcauauggcugaaacca

SEQ ID NO: 100941 - RNA, 18 nt, Human
ccaaggccccugcugggg

SEQ ID NO: 100942 - RNA, 22 nt, Human
ccaaggcuguggggcugugcag

SEQ ID NO: 100943 - RNA, 22 nt, Human
ccaagggaaaccgagaggcugg

SEQ ID NO: 100944 - RNA, 22 nt, Human
ccaagggcucuggacagagugg

SEQ ID NO: 100945 - RNA, 22 nt, Human
ccaagggcugagauacaucuag

SEQ ID NO: 100946 - RNA, 22 nt, Human
ccaagggcugcugaggugucca

SEQ ID NO: 100947 - RNA, 22 nt, Human
ccaaggugggcagaucacgagg

SEQ ID NO: 100948 - RNA, 22 nt, Human
ccaaguguuuuauaagggacag

SEQ ID NO: 100949 - RNA, 22 nt, Human
ccaauacacuuuauagaagaaa

SEQ ID NO: 100950 - RNA, 22 nt, Human
ccaaucuuaucuuuauuuucua

SEQ ID NO: 100951 - RNA, 22 nt, Human
ccaaucuugcuguccacuuggu

SEQ ID NO: 100952 - RNA, 22 nt, Human
ccaaucuuguuuucuacaucca

SEQ ID NO: 100953 - RNA, 22 nt, Human
ccaaugaaaggucaauucuaua

SEQ ID NO: 100954 - RNA, 22 nt, Human
ccaaugaauauauuucauauga

SEQ ID NO: 100955 - RNA, 22 nt, Human
ccaaugauggugcccacgauga

SEQ ID NO: 100956 - RNA, 22 nt, Human
ccaaugcauaaugauccccuaa

SEQ ID NO: 100957 - RNA, 23 nt, Human
ccaauucauggcagauuugaaga

SEQ ID NO: 100958 - RNA, 22 nt, Human
ccaauuguccuaauuaauuaga

SEQ ID NO: 100959 - RNA, 22 nt, Human
ccacaaaacugugugucaaaga

SEQ ID NO: 100960 - RNA, 22 nt, Human
caugaaaaugucaaguucugcu

SEQ ID NO: 100961 - RNA, 22 nt, Human
caugaaacaucagagauuucuc

SEQ ID NO: 100962 - RNA, 22 nt, Human
caugaaaugauauuuggguggg

SEQ ID NO: 100963 - RNA, 22 nt, Human
caugaaauggccaaccuucggc

SEQ ID NO: 100964 - RNA, 22 nt, Human
caugaacaaauucuguuugagg

SEQ ID NO: 100965 - RNA, 22 nt, Human
caugaacaccaggcaugaacaa

SEQ ID NO: 100966 - RNA, 22 nt, Human
caugaacuccaagcuuccuucc

SEQ ID NO: 100967 - RNA, 22 nt, Human
caugaagcauguuuugucauga

SEQ ID NO: 100968 - RNA, 22 nt, Human
caugaaggcugccagcaggcau

SEQ ID NO: 100969 - RNA, 22 nt, Human
caugaauuagcaauggugugca

SEQ ID NO: 100970 - RNA, 22 nt, Human
caugaauuuuaagacuguuuuu

SEQ ID NO: 100971 - RNA, 22 nt, Human
caugacaccuaccauauuaagu

SEQ ID NO: 100972 - RNA, 22 nt, Human
caugacagaugcaaaggauugg

SEQ ID NO: 100973 - RNA, 22 nt, Human
caugacauccugaagcugcaca

SEQ ID NO: 100974 - RNA, 22 nt, Human
caugacccauuuuucuugcugu

SEQ ID NO: 100975 - RNA, 22 nt, Human
caugagaagggguggaguuaga

SEQ ID NO: 100976 - RNA, 22 nt, Human
caugagaaguggccuucaaaaa

SEQ ID NO: 100977 - RNA, 22 nt, Human
caugagaaugaagaagacuuaa

SEQ ID NO: 100978 - RNA, 22 nt, Human
caugagagacauucugugugaa

SEQ ID NO: 100979 - RNA, 22 nt, Human
caugagauuugggaggggccag

SEQ ID NO: 100980 - RNA, 19 nt, Human
caugagcugcucacuuccc

SEQ ID NO: 100981 - RNA, 22 nt, Human
caugaggguugggguggagcuu

SEQ ID NO: 100982 - RNA, 22 nt, Human
caugaggugauaaagcugggau

SEQ ID NO: 100983 - RNA, 22 nt, Human
caugagugcuauaugugaagag

SEQ ID NO: 100984 - RNA, 22 nt, Human
caugaguucaucugcuucucuu

SEQ ID NO: 100985 - RNA, 22 nt, Human
caugauaacacuucuguuuaau

SEQ ID NO: 100986 - RNA, 22 nt, Human
caugauaauuguuaacaaagua

SEQ ID NO: 100987 - RNA, 22 nt, Human
caugaucaccacuugacagccc

SEQ ID NO: 100988 - RNA, 22 nt, Human
caugaucagaaagagaagcuag

SEQ ID NO: 100989 - RNA, 22 nt, Human
caugauggaugugcacuucgcu

SEQ ID NO: 100990 - RNA, 23 nt, Human
caugauguuaacuuuguuaugcu

SEQ ID NO: 100991 - RNA, 22 nt, Human
caugauuauguguuagaguuug

SEQ ID NO: 100992 - RNA, 22 nt, Human
caugcaaaauguauuuuauuag

SEQ ID NO: 100993 - RNA, 22 nt, Human
caugcaaagcguuuugaccagc

SEQ ID NO: 100994 - RNA, 22 nt, Human
caugcaaaggucaagaucagga

SEQ ID NO: 100995 - RNA, 22 nt, Human
cuuccucccccacacacucacu

SEQ ID NO: 100996 - RNA, 22 nt, Human
cuuccucucaauaagaugagaa

SEQ ID NO: 100997 - RNA, 22 nt, Human
cuuccucugcggcgccgggcgc

SEQ ID NO: 100998 - RNA, 17 nt, Human
ccagguggaaucgugga

SEQ ID NO: 100999 - RNA, 16 nt, Human
ccagguggggcuguga

SEQ ID NO: 101000 - RNA, 18 nt, Human
ccagguggugacagagau

SEQ ID NO: 101001 - RNA, 22 nt, Human
ccagguggugccucuguucgca

SEQ ID NO: 101002 - RNA, 22 nt, Human
ccagguguagcacugcucacag

SEQ ID NO: 101003 - RNA, 22 nt, Human
ccagguguccccgucacugcag

SEQ ID NO: 101004 - RNA, 22 nt, Human
ccaggugugcucugcaguggau

SEQ ID NO: 101005 - RNA, 22 nt, Human
ccagguguguacagaacagcac

SEQ ID NO: 101006 - RNA, 22 nt, Human
ccagguguuuggccugcaugau

SEQ ID NO: 101007 - RNA, 22 nt, Human
ccagucacucugugagagcuac

SEQ ID NO: 101008 - RNA, 22 nt, Human
ccagucccaucucugucgcuua

SEQ ID NO: 101009 - RNA, 22 nt, Human
ccaguccugggagcuugcacug

SEQ ID NO: 101010 - RNA, 22 nt, Human
ccaguccugugugacccugcac

SEQ ID NO: 101011 - RNA, 23 nt, Human
ccagucucacguauacaggauuu

SEQ ID NO: 101012 - RNA, 22 nt, Human
ccagucucaguucacguuggua

SEQ ID NO: 101013 - RNA, 19 nt, Human
ccagucuccuugcagcauc

SEQ ID NO: 101014 - RNA, 22 nt, Human
ccagucuggcaggagggggaac

SEQ ID NO: 101015 - RNA, 22 nt, Human
ccagugacuggcuuucuggugu

SEQ ID NO: 101016 - RNA, 22 nt, Human
ccagugagaaugaagauaaggc

SEQ ID NO: 101017 - RNA, 23 nt, Human
ccagugauugccuggaaggaggu

SEQ ID NO: 101018 - RNA, 22 nt, Human
ccagugcacaauggaacaacuc

SEQ ID NO: 101019 - RNA, 22 nt, Human
ccagugcaccauuucccucugu

SEQ ID NO: 101020 - RNA, 22 nt, Human
ccagugcaggugagcaccaggu

SEQ ID NO: 101021 - RNA, 17 nt, Human
ccagugccuguggcaac

SEQ ID NO: 101022 - RNA, 22 nt, Human
ccagugcgcaggcgccaccugu

SEQ ID NO: 101023 - RNA, 21 nt, Human
ccagugcuacagcugccugac

SEQ ID NO: 101024 - RNA, 22 nt, Human
ccaguggacaauuucugaggaa

SEQ ID NO: 101025 - RNA, 22 nt, Human
ccaguguauuauuugagaaauu

SEQ ID NO: 101026 - RNA, 22 nt, Human
ccagugucugugguauagaaag

SEQ ID NO: 101027 - RNA, 22 nt, Human
ccagugugcauuaucauguguc

SEQ ID NO: 101028 - RNA, 22 nt, Human
ccagugugggcccggccuccuc

SEQ ID NO: 101029 - RNA, 22 nt, Human
ccaguguguuuaaugcauucca

SEQ ID NO: 101030 - RNA, 22 nt, Human
ccaguguuauuuuagaguguga

SEQ ID NO: 101031 - RNA, 22 nt, Human
ccaguguucaguaugcauuaag

SEQ ID NO: 101032 - RNA, 22 nt, Human
ccaguguucaucaagaaaaugu

SEQ ID NO: 101033 - RNA, 22 nt, Human
ccaguguuuacaguugaacaaa

SEQ ID NO: 101034 - RNA, 22 nt, Human
ccaguguuuccgucaguacacg

SEQ ID NO: 101035 - RNA, 22 nt, Human
ccaguguuuucauccucccuug

SEQ ID NO: 101036 - RNA, 22 nt, Human
ccaguguuuuccaguuugccca

SEQ ID NO: 101037 - RNA, 22 nt, Human
ccaguuauccagcaugcugucu

SEQ ID NO: 101038 - RNA, 22 nt, Human
ccaguuuagguacuaggcucua

SEQ ID NO: 101039 - RNA, 23 nt, Human
ccaguuuaucuuuaguguagauc

SEQ ID NO: 101040 - RNA, 22 nt, Human
ccaguuuugccaugguaacacu

SEQ ID NO: 101041 - RNA, 22 nt, Human
ccauaaggagccagacauucca

SEQ ID NO: 101042 - RNA, 22 nt, Human
ccauaagguugaaaacuguaca

SEQ ID NO: 101043 - RNA, 21 nt, Human
ccauaaucuuaggaucaaaau

SEQ ID NO: 101044 - RNA, 21 nt, Human
ccauaauuuuguuucagaagu

SEQ ID NO: 101045 - RNA, 17 nt, Human
ccauacugacauauuga

SEQ ID NO: 101046 - RNA, 22 nt, Human
ccauacugaggacacauuguga

SEQ ID NO: 101047 - RNA, 22 nt, Human
ccauaguacauaauacauuuua

SEQ ID NO: 101048 - RNA, 22 nt, Human
ccauagugccaagucuucagca

SEQ ID NO: 101049 - RNA, 19 nt, Human
ccauauaaccagcaagugu

SEQ ID NO: 101050 - RNA, 22 nt, Human
ccaucagauuagcaaaauccag

SEQ ID NO: 101051 - RNA, 21 nt, Human
ccauccacugagugguucccu

SEQ ID NO: 101052 - RNA, 22 nt, Human
ccauccagaaggguuugaaaga

SEQ ID NO: 101053 - RNA, 22 nt, Human
ccauccaggcugugggugagcu

SEQ ID NO: 101054 - RNA, 19 nt, Human
ccauccauggggccagagg

SEQ ID NO: 101055 - RNA, 22 nt, Human
ccauccaugguguugguuguau

SEQ ID NO: 101056 - RNA, 22 nt, Human
ccaucccuccuccaccagcuag

SEQ ID NO: 101057 - RNA, 22 nt, Human
ccaucccugccauuauagccca

SEQ ID NO: 101058 - RNA, 22 nt, Human
ccauccugaauggucucagcca

SEQ ID NO: 101059 - RNA, 22 nt, Human
ccaucuccaaauaccaucacau

SEQ ID NO: 101060 - RNA, 22 nt, Human
ccaucuccaguuuauucuuccu

SEQ ID NO: 101061 - RNA, 22 nt, Human
ccaucuguaucugacaaauucu

SEQ ID NO: 101062 - RNA, 22 nt, Human
ccaucuugggucacugcccccc

SEQ ID NO: 101063 - RNA, 22 nt, Human
ccaugacauuuuaauuuucacu

SEQ ID NO: 101064 - RNA, 22 nt, Human
ccaugaccccuggcauccaggg

SEQ ID NO: 101065 - RNA, 22 nt, Human
ccaugagccaggcugaggaagc

SEQ ID NO: 101066 - RNA, 22 nt, Human
ccaugaguagcgauuucauuuu

SEQ ID NO: 101067 - RNA, 22 nt, Human
ccaugcaaagaaugugggcaua

SEQ ID NO: 101068 - RNA, 22 nt, Human
ccaugcaagaaguccaaccauc

SEQ ID NO: 101069 - RNA, 22 nt, Human
ccaugcacaccagcaggcagac

SEQ ID NO: 101070 - RNA, 22 nt, Human
ccaugccagcugcuaggucaca

SEQ ID NO: 101071 - RNA, 22 nt, Human
ccaugccccaccaggacgcugc

SEQ ID NO: 101072 - RNA, 22 nt, Human
ccauggaacucaguaaauuaua

SEQ ID NO: 101073 - RNA, 22 nt, Human
ccauggcaaaggagauguuuuc

SEQ ID NO: 101074 - RNA, 22 nt, Human
ccauggcaauggucagucuauu

SEQ ID NO: 101075 - RNA, 22 nt, Human
ccauggccugaaggagugcauc

SEQ ID NO: 101076 - RNA, 18 nt, Human
ccauggcucccuccugcc

SEQ ID NO: 101077 - RNA, 22 nt, Human
ccauggcuuucuuucauuguaa

SEQ ID NO: 101078 - RNA, 22 nt, Human
ccaugggagaugauggggagug

SEQ ID NO: 101079 - RNA, 22 nt, Human
ccaugggcacuggguggaggua

SEQ ID NO: 101080 - RNA, 22 nt, Human
ccaugggcuggcugccuuauca

SEQ ID NO: 101081 - RNA, 21 nt, Human
ccaugucagaugugggcugug

SEQ ID NO: 101082 - RNA, 22 nt, Human
ccauguggugggaaggagaaug

SEQ ID NO: 101083 - RNA, 22 nt, Human
ccauguuggaacuucacauucu

SEQ ID NO: 101084 - RNA, 22 nt, Human
ccauuaaaauugugacauagga

SEQ ID NO: 101085 - RNA, 22 nt, Human
ccauuauccacgggcuuccuga

SEQ ID NO: 101086 - RNA, 22 nt, Human
ccauuauccauuuugagucuua

SEQ ID NO: 101087 - RNA, 22 nt, Human
ccauucaauaccuuagagaaaa

SEQ ID NO: 101088 - RNA, 22 nt, Human
ccauucauacaauuuuguucua

SEQ ID NO: 101089 - RNA, 19 nt, Human
ccauucauauagacagcag

SEQ ID NO: 101090 - RNA, 22 nt, Human
ccauucauguuuuugaacuaug

SEQ ID NO: 101091 - RNA, 22 nt, Human
ccauucauuuguugucagccuu

SEQ ID NO: 101092 - RNA, 22 nt, Human
ccauucugacuucauugccuca

SEQ ID NO: 101093 - RNA, 22 nt, Human
ccauucuguauaaaugcuagaa

SEQ ID NO: 101094 - RNA, 22 nt, Human
ccauucugugucucuccacagc

SEQ ID NO: 101095 - RNA, 21 nt, Human
ccauucuuagucaagugucuc

SEQ ID NO: 101096 - RNA, 22 nt, Human
ccauugaauuagaaggggaagg

SEQ ID NO: 101097 - RNA, 22 nt, Human
ccauuggagccaagaguuuuac

SEQ ID NO: 101098 - RNA, 22 nt, Human
ccauuguaaauucuguggaagu

SEQ ID NO: 101099 - RNA, 22 nt, Human
ccauuuaacacagaguuuucca

SEQ ID NO: 101100 - RNA, 22 nt, Human
ccauuuacauuguacucuguga

SEQ ID NO: 101101 - RNA, 22 nt, Human
ccauuuaguaaggaagaacagc

SEQ ID NO: 101102 - RNA, 22 nt, Human
ccauuucauugccuguaaagug

SEQ ID NO: 101103 - RNA, 22 nt, Human
ccauuugaaaugaauguuuuua

SEQ ID NO: 101104 - RNA, 22 nt, Human
cuugcagaugugacuaaauuaa

SEQ ID NO: 101105 - RNA, 22 nt, Human
cuugcagcauccgguccucucu

SEQ ID NO: 101106 - RNA, 23 nt, Human
cuugcaggaagcagauggcacac

SEQ ID NO: 101107 - RNA, 20 nt, Human
cuugcaggaguggguagagu

SEQ ID NO: 101108 - RNA, 22 nt, Human
cuugcaggcagggacacugucu

SEQ ID NO: 101109 - RNA, 18 nt, Human
cuugcaguguguggagaa

SEQ ID NO: 101110 - RNA, 22 nt, Human
cuugccagcacuuggccagcug

SEQ ID NO: 101111 - RNA, 22 nt, Human
cuugccagggacucagucaggg

SEQ ID NO: 101112 - RNA, 22 nt, Human
cuugccuacuugucaaccagca

SEQ ID NO: 101113 - RNA, 22 nt, Human
cuugccucccucagcucacagc

SEQ ID NO: 101114 - RNA, 22 nt, Human
cuugccugccacuacagcugaa

SEQ ID NO: 101115 - RNA, 22 nt, Human
cuugccugcuggagcagggcuc

SEQ ID NO: 101116 - RNA, 22 nt, Human
cccuaagacccucaagaucucc

SEQ ID NO: 101117 - RNA, 22 nt, Human
cccuaaugcagcugagaagggc

SEQ ID NO: 101118 - RNA, 20 nt, Human
cccuaggaacgcagcaggag

SEQ ID NO: 101119 - RNA, 22 nt, Human
cccuaggcccaaagggugacau

SEQ ID NO: 101120 - RNA, 22 nt, Human
cccuaggcugaggccagggugc

SEQ ID NO: 101121 - RNA, 19 nt, Human
cccuaggggcuccugaggg

SEQ ID NO: 101122 - RNA, 22 nt, Human
cccuaggguuuggccagagccc

SEQ ID NO: 101123 - RNA, 22 nt, Human
cccucacagucuaggagcagcu

SEQ ID NO: 101124 - RNA, 22 nt, Human
cccucagggaccacugacuuca

SEQ ID NO: 101125 - RNA, 22 nt, Human
cccucaggugaaaggaaaaauu

SEQ ID NO: 101126 - RNA, 22 nt, Human
cccucaguuuuccagugugggc

SEQ ID NO: 101127 - RNA, 22 nt, Human
cccucaugucagucccugccca

SEQ ID NO: 101128 - RNA, 22 nt, Human
cccuccagagcuugaccugcug

SEQ ID NO: 101129 - RNA, 22 nt, Human
cccuccagcucaaagcaaccgg

SEQ ID NO: 101130 - RNA, 22 nt, Human
cccuccaggcacugcccucuuc

SEQ ID NO: 101131 - RNA, 22 nt, Human
cccuccaggccugucauguucc

SEQ ID NO: 101132 - RNA, 22 nt, Human
cccuccaugagugugcugcugg

SEQ ID NO: 101133 - RNA, 20 nt, Human
cccucccagaugcuucccaa

SEQ ID NO: 101134 - RNA, 22 nt, Human
cccucccucugcuggguguaga

SEQ ID NO: 101135 - RNA, 22 nt, Human
cccucccugaagaaguuacucu

SEQ ID NO: 101136 - RNA, 22 nt, Human
cccuccuuaccaccacagcucc

SEQ ID NO: 101137 - RNA, 22 nt, Human
cccucgccgcagcugcuucccg

SEQ ID NO: 101138 - RNA, 22 nt, Human
cccucucgcggggcagcggagg

SEQ ID NO: 101139 - RNA, 22 nt, Human
cccucucugacuucugaacuug

SEQ ID NO: 101140 - RNA, 20 nt, Human
cccucugcacauggcugugg

SEQ ID NO: 101141 - RNA, 22 nt, Human
cccucugcugccuggcuggguc

SEQ ID NO: 101142 - RNA, 17 nt, Human
cccucuggggagggagg

SEQ ID NO: 101143 - RNA, 22 nt, Human
cccucugguuugcccuugggug

SEQ ID NO: 101144 - RNA, 22 nt, Human
cccugaccaccagcuccauuug

SEQ ID NO: 101145 - RNA, 22 nt, Human
cccugacccaaaacugucagaa

SEQ ID NO: 101146 - RNA, 20 nt, Human
cccugagacgacugagcucc

SEQ ID NO: 101147 - RNA, 22 nt, Human
cccugagagcagggucuuucuc

SEQ ID NO: 101148 - RNA, 22 nt, Human
cccugagaugccucacccuagu

SEQ ID NO: 101149 - RNA, 22 nt, Human
cccugagaugugaauuucagag

SEQ ID NO: 101150 - RNA, 22 nt, Human
cccugagcccauaguugacauu

SEQ ID NO: 101151 - RNA, 22 nt, Human
cccugagccgccugccgugucc

SEQ ID NO: 101152 - RNA, 22 nt, Human
cccugagcgugaggaggaagua

SEQ ID NO: 101153 - RNA, 22 nt, Human
cccugaggcaguaggagcuuuu

SEQ ID NO: 101154 - RNA, 22 nt, Human
cccugaggcccuccuggggucu

SEQ ID NO: 101155 - RNA, 22 nt, Human
cccugaggccucagguucauug

SEQ ID NO: 101156 - RNA, 18 nt, Human
cccugaggcuagcaugcu

SEQ ID NO: 101157 - RNA, 22 nt, Human
cccugcagaccaaugccauaga

SEQ ID NO: 101158 - RNA, 22 nt, Human
cccugcagacgucuugaugccu

SEQ ID NO: 101159 - RNA, 22 nt, Human
cccugcagagagugcuuuugug

SEQ ID NO: 101160 - RNA, 22 nt, Human
cccugcagcauucucuaacugg

SEQ ID NO: 101161 - RNA, 22 nt, Human
cccugcagcuuuugcauaguca

SEQ ID NO: 101162 - RNA, 22 nt, Human
cccugcaggcucagacuggagu

SEQ ID NO: 101163 - RNA, 22 nt, Human
cccugcccaccacaugcuggga

SEQ ID NO: 101164 - RNA, 23 nt, Human
cccugcccauugagcaggacguc

SEQ ID NO: 101165 - RNA, 22 nt, Human
cccugcccugggcagaaguggg

SEQ ID NO: 101166 - RNA, 22 nt, Human
cccugcuaguugucucagugau

SEQ ID NO: 101167 - RNA, 22 nt, Human
cccugcugcagagagcuuucca

SEQ ID NO: 101168 - RNA, 22 nt, Human
cccugcugucccucaguccugc

SEQ ID NO: 101169 - RNA, 22 nt, Human
cccugcugugccugacugccau

SEQ ID NO: 101170 - RNA, 22 nt, Human
cccugcuuccgcuguuuucuca

SEQ ID NO: 101171 - RNA, 22 nt, Human
cccugcuugucaccccuggguc

SEQ ID NO: 101172 - RNA, 22 nt, Human
cccugcuuucaaccuucuagcu

SEQ ID NO: 101173 - RNA, 22 nt, Human
cccuggaacccauggccagugu

SEQ ID NO: 101174 - RNA, 22 nt, Human
cccuggagaaggggacgcggag

SEQ ID NO: 101175 - RNA, 22 nt, Human
cccuggagcuagucugagcaga

SEQ ID NO: 101176 - RNA, 23 nt, Human
cccuggagcuagucugagcagag

SEQ ID NO: 101177 - RNA, 23 nt, Human
cccuggagcuagucugagcgggg

SEQ ID NO: 101178 - RNA, 22 nt, Human
cccuggaggcggagcuugcagu

SEQ ID NO: 101179 - RNA, 22 nt, Human
cccuggagggcagacagaugcc

SEQ ID NO: 101180 - RNA, 22 nt, Human
cccuggaggucagaggccuggg

SEQ ID NO: 101181 - RNA, 22 nt, Human
cccuggagguggagguugcagg

SEQ ID NO: 101182 - RNA, 22 nt, Human
cccuggaguccuggcaguugau

SEQ ID NO: 101183 - RNA, 22 nt, Human
cccuggcagaaugucucugggc

SEQ ID NO: 101184 - RNA, 22 nt, Human
cccuggccccucacuccgaggc

SEQ ID NO: 101185 - RNA, 22 nt, Human
cccugggaguccacugauguca

SEQ ID NO: 101186 - RNA, 22 nt, Human
cccugggauaccagacaccaga

SEQ ID NO: 101187 - RNA, 22 nt, Human
cccugggauucaauuucacucu

SEQ ID NO: 101188 - RNA, 22 nt, Human
cccugggcaccaggccugguaa

SEQ ID NO: 101189 - RNA, 22 nt, Human
cccuggugcccugggucagccu

SEQ ID NO: 101190 - RNA, 22 nt, Human
cccugguggggccagacuugcu

SEQ ID NO: 101191 - RNA, 22 nt, Human
cccugugagcggcuggaugccu

SEQ ID NO: 101192 - RNA, 21 nt, Human
cccuguguuccacagcagaca

SEQ ID NO: 101193 - RNA, 22 nt, Human
cccuuagaggcuggaggcagca

SEQ ID NO: 101194 - RNA, 22 nt, Human
cccuuagauaauuuccuuuucu

SEQ ID NO: 101195 - RNA, 22 nt, Human
cccuuagaugucuuccuccgga

SEQ ID NO: 101196 - RNA, 18 nt, Human
cccuuagccuuuccucuc

SEQ ID NO: 101197 - RNA, 22 nt, Human
cccuucaggguuaaguagaggg

SEQ ID NO: 101198 - RNA, 22 nt, Human
cccuucagugcuaggcugccug

SEQ ID NO: 101199 - RNA, 22 nt, Human
cccuuccuugauuuuaacugga

SEQ ID NO: 101200 - RNA, 22 nt, Human
cccuucuaguccauucuucaca

SEQ ID NO: 101201 - RNA, 22 nt, Human
cccuugaauuuucagagagggg

SEQ ID NO: 101202 - RNA, 22 nt, Human
cccuugagccuggaggagcucu

SEQ ID NO: 101203 - RNA, 22 nt, Human
cccuuggcuucuauggguuuuc

SEQ ID NO: 101204 - RNA, 22 nt, Human
cccuugggguggagguugcagu

SEQ ID NO: 101205 - RNA, 19 nt, Human
cccuugguagacagcugca

SEQ ID NO: 101206 - RNA, 22 nt, Human
cccuuuaaggucugauuuucag

SEQ ID NO: 101207 - RNA, 22 nt, Human
cccuuucauuggcagagcucuc

SEQ ID NO: 101208 - RNA, 22 nt, Human
cccuuucugccuucuaaaauaa

SEQ ID NO: 101209 - RNA, 22 nt, Human
cccuuucugggaccccugucuc

SEQ ID NO: 101210 - RNA, 22 nt, Human
cccuuugcccaguauauucuag

SEQ ID NO: 101211 - RNA, 22 nt, Human
ccgcagggaaagccccaggaag

SEQ ID NO: 101212 - RNA, 22 nt, Human
ccgccaggauauuguggcuuuu

SEQ ID NO: 101213 - RNA, 22 nt, Human
ccuagggucaguguggcaggag

SEQ ID NO: 101214 - RNA, 22 nt, Human
ccuaguccccaggaggucagug

SEQ ID NO: 101215 - RNA, 21 nt, Human
ccuaguguuaaaacaguuuaa

SEQ ID NO: 101216 - RNA, 22 nt, Human
ccuaugaaagacaggagaugcg

SEQ ID NO: 101217 - RNA, 21 nt, Human
ccucaaagaugaugggguuuc

SEQ ID NO: 101218 - RNA, 22 nt, Human
ccucaaagcgguaugcagacgg

SEQ ID NO: 101219 - RNA, 22 nt, Human
ccucaagaacaauccaccauua

SEQ ID NO: 101220 - RNA, 22 nt, Human
ccucaagucaauucugucucgc

SEQ ID NO: 101221 - RNA, 18 nt, Human
ccucacagacuuccaugu

SEQ ID NO: 101222 - RNA, 22 nt, Human
ccucacagcccuccucuagcac

SEQ ID NO: 101223 - RNA, 22 nt, Human
ccucacagcuugggcaaacggc

SEQ ID NO: 101224 - RNA, 22 nt, Human
ccucacaugaauguaagcucca

SEQ ID NO: 101225 - RNA, 22 nt, Human
ccucacucugcacccugcagca

SEQ ID NO: 101226 - RNA, 22 nt, Human
ccucacucuuguccuggcaggu

SEQ ID NO: 101227 - RNA, 22 nt, Human
ccucagaccccacagggccugu

SEQ ID NO: 101228 - RNA, 21 nt, Human
ccucagagacagauacgggug

SEQ ID NO: 101229 - RNA, 23 nt, Human
ccucagagaggcagagccacaug

SEQ ID NO: 101230 - RNA, 22 nt, Human
ccucagagcagcacccagauga

SEQ ID NO: 101231 - RNA, 22 nt, Human
ccucagagccaugccugaguuc

SEQ ID NO: 101232 - RNA, 22 nt, Human
ccucagagccuccagaaggaau

SEQ ID NO: 101233 - RNA, 20 nt, Human
ccucagagcgcaggcccccu

SEQ ID NO: 101234 - RNA, 19 nt, Human
ccucagagcuagugaacau

SEQ ID NO: 101235 - RNA, 18 nt, Human
ccucagaggcaaauuguu

SEQ ID NO: 101236 - RNA, 23 nt, Human
ccucagaggccucauagucuggc

SEQ ID NO: 101237 - RNA, 22 nt, Human
ccucagaguaggucucagcugu

SEQ ID NO: 101238 - RNA, 22 nt, Human
ccucagaguuggccacgagagc

SEQ ID NO: 101239 - RNA, 22 nt, Human
ccucagcauccuccugcucagu

SEQ ID NO: 101240 - RNA, 22 nt, Human
ccucagcauccuggugaaguag

SEQ ID NO: 101241 - RNA, 22 nt, Human
ccucagcugcugcacagcuuuu

SEQ ID NO: 101242 - RNA, 22 nt, Human
ccucagcugcuucccuggagcc

SEQ ID NO: 101243 - RNA, 22 nt, Human
ccucagcugucuuuuccgaggu

SEQ ID NO: 101244 - RNA, 22 nt, Human
ccucaggaaccacauugcugcu

SEQ ID NO: 101245 - RNA, 22 nt, Human
ccucaggauccgcaggugcagu

SEQ ID NO: 101246 - RNA, 22 nt, Human
ccucaggcaagucacuuaacau

SEQ ID NO: 101247 - RNA, 22 nt, Human
ccucaggcccugucccugcgcc

SEQ ID NO: 101248 - RNA, 22 nt, Human
ccucaggcugggcugccccugg

SEQ ID NO: 101249 - RNA, 22 nt, Human
ccucaggcuuacgggcaaugga

SEQ ID NO: 101250 - RNA, 22 nt, Human
ccucaggcuugugagccuucag

SEQ ID NO: 101251 - RNA, 18 nt, Human
ccucagggagagagacgc

SEQ ID NO: 101252 - RNA, 18 nt, Human
ccucagggagauccagug

SEQ ID NO: 101253 - RNA, 22 nt, Human
ccucaggggcuuuucguuguug

SEQ ID NO: 101254 - RNA, 22 nt, Human
ccucaggggucacugugaggag

SEQ ID NO: 101255 - RNA, 23 nt, Human
ccucagggucuagcagagagaag

SEQ ID NO: 101256 - RNA, 22 nt, Human
ccucaggguucggaugagaaca

SEQ ID NO: 101257 - RNA, 22 nt, Human
ccucaggugugggccagcuguc

SEQ ID NO: 101258 - RNA, 22 nt, Human
ccucagucuauuuccagcaggu

SEQ ID NO: 101259 - RNA, 21 nt, Human
ccucagucucccugcuccacu

SEQ ID NO: 101260 - RNA, 22 nt, Human
ccucagugaccuauugcauuca

SEQ ID NO: 101261 - RNA, 22 nt, Human
ccucaguguguuuggggugagg

SEQ ID NO: 101262 - RNA, 22 nt, Human
ccucaguuuucucaucuguaaa

SEQ ID NO: 101263 - RNA, 21 nt, Human
ccuagccucuuacccagcuuu

SEQ ID NO: 101264 - RNA, 22 nt, Human
ccuagccuucggccuacccauc

SEQ ID NO: 101265 - RNA, 18 nt, Human
ccuaggaaagggaggcaa

SEQ ID NO: 101266 - RNA, 22 nt, Human
ccuaggaaggaguauaguaaau

SEQ ID NO: 101267 - RNA, 22 nt, Human
ccuaggcuggcugucuucaggu

SEQ ID NO: 101268 - RNA, 22 nt, Human
ccuagucuuccgcguccccacc

SEQ ID NO: 101269 - RNA, 20 nt, Human
ccuaguuuucugagcgugac

SEQ ID NO: 101270 - RNA, 22 nt, Human
ccuauacagccucagcugagau

SEQ ID NO: 101271 - RNA, 19 nt, Human
ccuauggcaggauggaggc

SEQ ID NO: 101272 - RNA, 22 nt, Human
ccuauuuguaggcugggccagu

SEQ ID NO: 101273 - RNA, 22 nt, Human
ccucaaaguagagggagaugag

SEQ ID NO: 101274 - RNA, 20 nt, Human
ccucaaauaagugccagcau

SEQ ID NO: 101275 - RNA, 22 nt, Human
ccucaaauagcccccagucuag

SEQ ID NO: 101276 - RNA, 22 nt, Human
ccucaaauugcucagcgucuag

SEQ ID NO: 101277 - RNA, 22 nt, Human
ccucaaauuggcauuaauuaag

SEQ ID NO: 101278 - RNA, 22 nt, Human
ccucaaauugucaaauaagaau

SEQ ID NO: 101279 - RNA, 22 nt, Human
ccucaagucauuccggagaccu

SEQ ID NO: 101280 - RNA, 22 nt, Human
ccucacagaggggcagccaucu

SEQ ID NO: 101281 - RNA, 22 nt, Human
ccucacagcaaggauuucagug

SEQ ID NO: 101282 - RNA, 22 nt, Human
ccucacagcccuuggcccagga

SEQ ID NO: 101283 - RNA, 22 nt, Human
ccucacagccucaugcccagcc

SEQ ID NO: 101284 - RNA, 17 nt, Human
ccucacagggaccagac

SEQ ID NO: 101285 - RNA, 20 nt, Human
ccucacagggcagagagggg

SEQ ID NO: 101286 - RNA, 22 nt, Human
ccucacagggccaggccccuca

SEQ ID NO: 101287 - RNA, 22 nt, Human
ccucacaguuuggcuaacugug

SEQ ID NO: 101288 - RNA, 19 nt, Human
ccucacccugcagaggagg

SEQ ID NO: 101289 - RNA, 22 nt, Human
ccucacuggccagccaggggug

SEQ ID NO: 101290 - RNA, 22 nt, Human
ccucagaagaaguggaauugau

SEQ ID NO: 101291 - RNA, 22 nt, Human
ccucagaagcucaaggacauug

SEQ ID NO: 101292 - RNA, 22 nt, Human
ccucagaaggacaagagacaaa

SEQ ID NO: 101293 - RNA, 22 nt, Human
ccucagacuugauaauuggguu

SEQ ID NO: 101294 - RNA, 22 nt, Human
ccucagagacaguaacuggaau

SEQ ID NO: 101295 - RNA, 22 nt, Human
ccucagagcgcguggcauuauu

SEQ ID NO: 101296 - RNA, 22 nt, Human
ccucagaguuauuugaagugaa

SEQ ID NO: 101297 - RNA, 22 nt, Human
ccucagaguuuaagaugucaga

SEQ ID NO: 101298 - RNA, 22 nt, Human
ccucagaugucuuaaggcacug

SEQ ID NO: 101299 - RNA, 22 nt, Human
ccucagcauccucaugcucagu

SEQ ID NO: 101300 - RNA, 17 nt, Human
ccucagcuucuuuccuc

SEQ ID NO: 101301 - RNA, 22 nt, Human
ccucagcuugauuucugcagag

SEQ ID NO: 101302 - RNA, 22 nt, Human
ccucaggcaggaaacugucccg

SEQ ID NO: 101303 - RNA, 22 nt, Human
ccucaggcugucuuccuucugg

SEQ ID NO: 101304 - RNA, 22 nt, Human
ccucaggcuuaacuugucuuga

SEQ ID NO: 101305 - RNA, 22 nt, Human
ccucaggcuucuaguucaguga

SEQ ID NO: 101306 - RNA, 22 nt, Human
ccucagggaaugggaggcuggg

SEQ ID NO: 101307 - RNA, 22 nt, Human
ccucagggaggccucuguggcu

SEQ ID NO: 101308 - RNA, 18 nt, Human
ccucaggggaccuggcag

SEQ ID NO: 101309 - RNA, 23 nt, Human
ccucaggggaccugugagccuga

SEQ ID NO: 101310 - RNA, 22 nt, Human
ccucaggggugcccacagcugc

SEQ ID NO: 101311 - RNA, 22 nt, Human
ccucaggguggcaucagaucuu

SEQ ID NO: 101312 - RNA, 22 nt, Human
ccucagucauuggccuacacuu

SEQ ID NO: 101313 - RNA, 22 nt, Human
ccucagugcguacugaacagug

SEQ ID NO: 101314 - RNA, 22 nt, Human
ccucagugugcagcagcaucug

SEQ ID NO: 101315 - RNA, 22 nt, Human
ccucaguguguggauguuagag

SEQ ID NO: 101316 - RNA, 22 nt, Human
ccucaugcugcaucucugaggu

SEQ ID NO: 101317 - RNA, 22 nt, Human
ccucauggccuugagcugaggg

SEQ ID NO: 101318 - RNA, 22 nt, Human
ccucauucuuuccugggccccu

SEQ ID NO: 101319 - RNA, 18 nt, Human
ccuccaaguccccagccu

SEQ ID NO: 101320 - RNA, 22 nt, Human
ccuccaaguuugacucaggaca

SEQ ID NO: 101321 - RNA, 22 nt, Human
ccuccacucuggccucucaggu

SEQ ID NO: 101322 - RNA, 22 nt, Human
ccuccagcauuacuggcccaug

SEQ ID NO: 101323 - RNA, 22 nt, Human
gagauguuauucuucagugugu

SEQ ID NO: 101324 - RNA, 20 nt, Human
gagauuaacugagaaucuag

SEQ ID NO: 101325 - RNA, 23 nt, Human
gagauucuccuguugucaagucu

SEQ ID NO: 101326 - RNA, 22 nt, Human
gagauucugagaaguuaagucc

SEQ ID NO: 101327 - RNA, 22 nt, Human
gagauucuguagucaggcaucu

SEQ ID NO: 101328 - RNA, 22 nt, Human
gagauuggauuuaauggccaaa

SEQ ID NO: 101329 - RNA, 22 nt, Human
gagauugggucuugcucuguca

SEQ ID NO: 101330 - RNA, 22 nt, Human
gagauuuaauuggauuaacuua

SEQ ID NO: 101331 - RNA, 23 nt, Human
gagauuuagcagacaaagcucuu

SEQ ID NO: 101332 - RNA, 22 nt, Human
gagauuuauugacuuaacagua

SEQ ID NO: 101333 - RNA, 22 nt, Human
gagauuuccauauuuuguaaca

SEQ ID NO: 101334 - RNA, 17 nt, Human
gagauuuucguccugaa

SEQ ID NO: 101335 - RNA, 22 nt, Human
gagcaaagcuuuuagggccuuu

SEQ ID NO: 101336 - RNA, 22 nt, Human
gagcaagauccuguuuuucuau

SEQ ID NO: 101337 - RNA, 22 nt, Human
gagcaagauuuuauaaguugug

SEQ ID NO: 101338 - RNA, 22 nt, Human
gagcaaggauggccggggccgu

SEQ ID NO: 101339 - RNA, 22 nt, Human
gagcaaggaugggucuauagua

SEQ ID NO: 101340 - RNA, 22 nt, Human
gagcaaggcggcaucucucuga

SEQ ID NO: 101341 - RNA, 22 nt, Human
gagcaauagcaccaauuaacuc

SEQ ID NO: 101342 - RNA, 22 nt, Human
gagcacagaaucuucccaugca

SEQ ID NO: 101343 - RNA, 22 nt, Human
gagcacagccaaaguaagaagg

SEQ ID NO: 101344 - RNA, 19 nt, Human
gagcacagcggcauuuggu

SEQ ID NO: 101345 - RNA, 22 nt, Human
gagcacagggaauagacagaua

SEQ ID NO: 101346 - RNA, 22 nt, Human
gagcacagugcaguuucugcua

SEQ ID NO: 101347 - RNA, 22 nt, Human
gagcacauguggagagucuggg

SEQ ID NO: 101348 - RNA, 22 nt, Human
gagcaccaaggcucugccaugg

SEQ ID NO: 101349 - RNA, 23 nt, Human
gagcaccagggcuuuugagacau

SEQ ID NO: 101350 - RNA, 22 nt, Human
gagcacccuaccugccacugag

SEQ ID NO: 101351 - RNA, 22 nt, Human
gagcaccgccuccacgaugccc

SEQ ID NO: 101352 - RNA, 22 nt, Human
gagcacucuggcauguaaccuu

SEQ ID NO: 101353 - RNA, 22 nt, Human
gagcacugauuuauuuuugucu

SEQ ID NO: 101354 - RNA, 22 nt, Human
gagcacuuagaugcuaugaaug

SEQ ID NO: 101355 - RNA, 22 nt, Human
gagcagcaagcacucaaaggcu

SEQ ID NO: 101356 - RNA, 22 nt, Human
gagcagcacugaguuagcagcu

SEQ ID NO: 101357 - RNA, 22 nt, Human
gagcagcaggccagguugcagg

SEQ ID NO: 101358 - RNA, 22 nt, Human
gagcagcaguuguuacaaugau

SEQ ID NO: 101359 - RNA, 22 nt, Human
gagcagcucugggugacccagu

SEQ ID NO: 101360 - RNA, 22 nt, Human
gagcagcuggaggccuuguugg

SEQ ID NO: 101361 - RNA, 19 nt, Human
gagcagcuuccuaucuggu

SEQ ID NO: 101362 - RNA, 22 nt, Human
gagcaggaaggccagaaggguc

SEQ ID NO: 101363 - RNA, 22 nt, Human
gagcaggacagcagcuuccugg

SEQ ID NO: 101364 - RNA, 22 nt, Human
gagcagggccacuucuguaccu

SEQ ID NO: 101365 - RNA, 22 nt, Human
gagcagugaugggaggacguca

SEQ ID NO: 101366 - RNA, 22 nt, Human
gagcagugggaaggaacagggu

SEQ ID NO: 101367 - RNA, 22 nt, Human
gagcaguuauuuuuagacauga

SEQ ID NO: 101368 - RNA, 22 nt, Human
gagcauaggacacagaggugug

SEQ ID NO: 101369 - RNA, 22 nt, Human
gagcaucgcugagaucccagac

SEQ ID NO: 101370 - RNA, 22 nt, Human
gagcaucuaugugcuggguacu

SEQ ID NO: 101371 - RNA, 22 nt, Human
gagcaucugaugagauuggauu

SEQ ID NO: 101372 - RNA, 22 nt, Human
gagcaucuuguucccaacuucu

SEQ ID NO: 101373 - RNA, 21 nt, Human
gagcauggcuuacaucagcag

SEQ ID NO: 101374 - RNA, 22 nt, Human
gagccaaggguugccauggaga

SEQ ID NO: 101375 - RNA, 22 nt, Human
gagccaaucuuugggcucuugg

SEQ ID NO: 101376 - RNA, 22 nt, Human
gagccacagaaggaaauugggg

SEQ ID NO: 101377 - RNA, 22 nt, Human
gagccacaguggauugauucca

SEQ ID NO: 101378 - RNA, 17 nt, Human
gagccacccugugcgag

SEQ ID NO: 101379 - RNA, 22 nt, Human
gagccacuguugggcacuuucc

SEQ ID NO: 101380 - RNA, 22 nt, Human
gagccagcagccggcaccacca

SEQ ID NO: 101381 - RNA, 22 nt, Human
gagccagccuccgccucucucc

SEQ ID NO: 101382 - RNA, 19 nt, Human
ccucaucuuggugugugca

SEQ ID NO: 101383 - RNA, 22 nt, Human
ccucauucucgcguguguuucu

SEQ ID NO: 101384 - RNA, 22 nt, Human
ccuccaagcugguccucugugu

SEQ ID NO: 101385 - RNA, 22 nt, Human
ccuccaaggugagagaggaugg

SEQ ID NO: 101386 - RNA, 22 nt, Human
ccuccagccuuccugaagagcc

SEQ ID NO: 101387 - RNA, 22 nt, Human
ccuccaggaacuugagagacac

SEQ ID NO: 101388 - RNA, 22 nt, Human
ccuccaggccuugcagguuaac

SEQ ID NO: 101389 - RNA, 22 nt, Human
ccuccagggccccucucacugg

SEQ ID NO: 101390 - RNA, 22 nt, Human
ccuccaucaccaucugcccuca

SEQ ID NO: 101391 - RNA, 22 nt, Human
ccucccauggagcucuguccau

SEQ ID NO: 101392 - RNA, 22 nt, Human
ccuccccacaggccaaauaggc

SEQ ID NO: 101393 - RNA, 22 nt, Human
ccuccccacgggcagccggcgc

SEQ ID NO: 101394 - RNA, 22 nt, Human
ccucccucccucuuaugguuua

SEQ ID NO: 101395 - RNA, 22 nt, Human
ccucccucuguuagagcugucu

SEQ ID NO: 101396 - RNA, 22 nt, Human
ccucccuggccagagcagcagc

SEQ ID NO: 101397 - RNA, 22 nt, Human
ccucccugguggcucuggucua

SEQ ID NO: 101398 - RNA, 22 nt, Human
ccucccugucuaccuguugugg

SEQ ID NO: 101399 - RNA, 22 nt, Human
ccucccuuccccaguagucaag

SEQ ID NO: 101400 - RNA, 23 nt, Human
ccuccucauaucuuugacuagug

SEQ ID NO: 101401 - RNA, 22 nt, Human
ccuccucugggaagauucagag

SEQ ID NO: 101402 - RNA, 21 nt, Human
ccuccugcccgcaagcuaggg

SEQ ID NO: 101403 - RNA, 19 nt, Human
ccuccugcuagauaugcaa

SEQ ID NO: 101404 - RNA, 22 nt, Human
ccuccuggaggcucuagggaaa

SEQ ID NO: 101405 - RNA, 22 nt, Human
ccuccuggauggauuuggugga

SEQ ID NO: 101406 - RNA, 22 nt, Human
ccuccuggggugaaggauggga

SEQ ID NO: 101407 - RNA, 22 nt, Human
ccuccuggguucaagcgauucu

SEQ ID NO: 101408 - RNA, 22 nt, Human
ccuccugguaauuagcgaaagg

SEQ ID NO: 101409 - RNA, 20 nt, Human
ccuccuggucaggugugcag

SEQ ID NO: 101410 - RNA, 22 nt, Human
ccuccugguccagcaucucuuu

SEQ ID NO: 101411 - RNA, 22 nt, Human
ccuccuucuggggccuucugcu

SEQ ID NO: 101412 - RNA, 22 nt, Human
ccucggagaaaggcagcuccac

SEQ ID NO: 101413 - RNA, 18 nt, Human
ccucggagccuccguguc

SEQ ID NO: 101414 - RNA, 22 nt, Human
ccucgugugcuaggauccaggu

SEQ ID NO: 101415 - RNA, 22 nt, Human
ccucuaaauuguuugaaguugg

SEQ ID NO: 101416 - RNA, 23 nt, Human
ccucuaauaaacuugaccuugug

SEQ ID NO: 101417 - RNA, 22 nt, Human
ccucucaaaagcacaacauuga

SEQ ID NO: 101418 - RNA, 23 nt, Human
ccucuccagacacugggccuugu

SEQ ID NO: 101419 - RNA, 19 nt, Human
ccucuccgcccaccagccc

SEQ ID NO: 101420 - RNA, 22 nt, Human
ccucucggcagcccaucuuguc

SEQ ID NO: 101421 - RNA, 23 nt, Human
ccucucucccuguuuggcaaaua

SEQ ID NO: 101422 - RNA, 22 nt, Human
ccucucuguaagggucccuccc

SEQ ID NO: 101423 - RNA, 16 nt, Human
ccucucuuauuccucc

SEQ ID NO: 101424 - RNA, 22 nt, Human
ccucucuuuccuacaccuugga

SEQ ID NO: 101425 - RNA, 22 nt, Human
ccucugacuccacacuugaacu

SEQ ID NO: 101426 - RNA, 22 nt, Human
ccucugagaacaccuggcgucc

SEQ ID NO: 101427 - RNA, 22 nt, Human
ccucugagccugugugcggcac

SEQ ID NO: 101428 - RNA, 22 nt, Human
ccucugaguagacuggacauga

SEQ ID NO: 101429 - RNA, 22 nt, Human
ccucugagucucacuguaaccu

SEQ ID NO: 101430 - RNA, 22 nt, Human
ccucugagugcuuugagggaga

SEQ ID NO: 101431 - RNA, 22 nt, Human
ccucugaguuagagaucuagau

SEQ ID NO: 101432 - RNA, 22 nt, Human
gauguucagugguugaccauaa

SEQ ID NO: 101433 - RNA, 22 nt, Human
gauguuuggcucaaacgagugu

SEQ ID NO: 101434 - RNA, 22 nt, Human
gauguuuucuggaaaaugaaug

SEQ ID NO: 101435 - RNA, 22 nt, Human
gauuaacaaauuucauauccaa

SEQ ID NO: 101436 - RNA, 22 nt, Human
gauuaaguaacugaacacuuug

SEQ ID NO: 101437 - RNA, 22 nt, Human
gauuaaguggaaugaguauuug

SEQ ID NO: 101438 - RNA, 22 nt, Human
gauuacaauucagguugauaag

SEQ ID NO: 101439 - RNA, 22 nt, Human
gauuacacguuuuuaaucacau

SEQ ID NO: 101440 - RNA, 22 nt, Human
gauuacauucuccuuguauuag

SEQ ID NO: 101441 - RNA, 17 nt, Human
gauuagaaaacacauga

SEQ ID NO: 101442 - RNA, 22 nt, Human
gauuagaaauguuaccauacag

SEQ ID NO: 101443 - RNA, 22 nt, Human
gauuagaaugggaagauacaag

SEQ ID NO: 101444 - RNA, 22 nt, Human
gauuauggagaagaacaaugaa

SEQ ID NO: 101445 - RNA, 22 nt, Human
gauuauguucgacuuuagaaau

SEQ ID NO: 101446 - RNA, 22 nt, Human
gauucaaaguuaaugaagaugc

SEQ ID NO: 101447 - RNA, 22 nt, Human
gauucacagaacuuagucaagc

SEQ ID NO: 101448 - RNA, 22 nt, Human
gauucagugagggugagaagaa

SEQ ID NO: 101449 - RNA, 22 nt, Human
gauucauucucaguuucuagag

SEQ ID NO: 101450 - RNA, 22 nt, Human
gauucccaugucugaggaggug

SEQ ID NO: 101451 - RNA, 22 nt, Human
gauucucugcuaucuaucaccu

SEQ ID NO: 101452 - RNA, 22 nt, Human
gauucugaucuauaguguuaua

SEQ ID NO: 101453 - RNA, 22 nt, Human
gauucuggauugucugcuugaa

SEQ ID NO: 101454 - RNA, 22 nt, Human
gauucuggguccugugucuugc

SEQ ID NO: 101455 - RNA, 22 nt, Human
gauugaaauauaaauauguguu

SEQ ID NO: 101456 - RNA, 22 nt, Human
gauugcuguucccagggggcug

SEQ ID NO: 101457 - RNA, 22 nt, Human
gauuggagaguggaacaugcug

SEQ ID NO: 101458 - RNA, 22 nt, Human
gauuggucuacucaacagcaga

SEQ ID NO: 101459 - RNA, 22 nt, Human
gauuguaaaacagaucauuauc

SEQ ID NO: 101460 - RNA, 22 nt, Human
gauuguaauuuucaagagguaa

SEQ ID NO: 101461 - RNA, 22 nt, Human
gauuuacagguuagguccugua

SEQ ID NO: 101462 - RNA, 22 nt, Human
gauuuaguggcccuugguacac

SEQ ID NO: 101463 - RNA, 21 nt, Human
gauuuaguggcuguucuaccu

SEQ ID NO: 101464 - RNA, 22 nt, Human
gauuuauuuuuaaucagcaggg

SEQ ID NO: 101465 - RNA, 22 nt, Human
gauuucaaaaguagauccauca

SEQ ID NO: 101466 - RNA, 22 nt, Human
gauuucaaagguucugcaugcc

SEQ ID NO: 101467 - RNA, 22 nt, Human
gauuucaaguaucuugggcgag

SEQ ID NO: 101468 - RNA, 22 nt, Human
gauuucagaagcaagaggaggu

SEQ ID NO: 101469 - RNA, 22 nt, Human
gauuucagaguuuauuagguua

SEQ ID NO: 101470 - RNA, 22 nt, Human
gauuucagggugucuuccagcu

SEQ ID NO: 101471 - RNA, 22 nt, Human
gauuuccaggucauuaauaaag

SEQ ID NO: 101472 - RNA, 22 nt, Human
gauuuccaugauugggccagaa

SEQ ID NO: 101473 - RNA, 22 nt, Human
gauuucccagcaaaagcugguu

SEQ ID NO: 101474 - RNA, 22 nt, Human
gauuuccuagacauggggcaga

SEQ ID NO: 101475 - RNA, 22 nt, Human
gauuucuaaggaggcugaacuu

SEQ ID NO: 101476 - RNA, 19 nt, Human
gauuucuacaaaugucaga

SEQ ID NO: 101477 - RNA, 22 nt, Human
gauuucuacuugaacuugcuaa

SEQ ID NO: 101478 - RNA, 22 nt, Human
gauuucucugcacccacucagg

SEQ ID NO: 101479 - RNA, 22 nt, Human
gauuucugggcuuuauuucaga

SEQ ID NO: 101480 - RNA, 22 nt, Human
gauuucuguaacacuucagaua

SEQ ID NO: 101481 - RNA, 22 nt, Human
gauuucuucauuuguggugaau

SEQ ID NO: 101482 - RNA, 22 nt, Human
gauuucuugauaauucaaaucc

SEQ ID NO: 101483 - RNA, 22 nt, Human
gauuucuuuaugaaguacagaa

SEQ ID NO: 101484 - RNA, 22 nt, Human
gauuucuuuguacccacaaucc

SEQ ID NO: 101485 - RNA, 22 nt, Human
gauuuggccuuucgcaugguau

SEQ ID NO: 101486 - RNA, 22 nt, Human
gauuuggcuuggaugauuaaac

SEQ ID NO: 101487 - RNA, 22 nt, Human
gauuugucacgguugagagcca

SEQ ID NO: 101488 - RNA, 22 nt, Human
gauuuguccacagagugaugaa

SEQ ID NO: 101489 - RNA, 22 nt, Human
gauuugucuaggucaugacuuu

SEQ ID NO: 101490 - RNA, 22 nt, Human
gauuugucuauauucaaauaug

SEQ ID NO: 101491 - RNA, 21 nt, Human
gauuuuaaagagacugccaca

SEQ ID NO: 101492 - RNA, 22 nt, Human
gauuuuaauuauaggagguccu

SEQ ID NO: 101493 - RNA, 22 nt, Human
gauuuuaucuuugugugcagua

SEQ ID NO: 101494 - RNA, 22 nt, Human
gcaaaauuuacacuccuucuuc

SEQ ID NO: 101495 - RNA, 22 nt, Human
gcaaacagccaggcgcagaagu

SEQ ID NO: 101496 - RNA, 22 nt, Human
gcaaacauucaggaguacagga

SEQ ID NO: 101497 - RNA, 22 nt, Human
gcaaagaaaguuuuaaugaggu

SEQ ID NO: 101498 - RNA, 22 nt, Human
gcaaagacccaggugucuaucc

SEQ ID NO: 101499 - RNA, 22 nt, Human
gcaaagacggacucaggagugc

SEQ ID NO: 101500 - RNA, 22 nt, Human
gcaaagacugcaauuacuuuug

SEQ ID NO: 101501 - RNA, 22 nt, Human
gcaaagcaagcugucagccuca

SEQ ID NO: 101502 - RNA, 22 nt, Human
gcaaagcaaucaggaguagcau

SEQ ID NO: 101503 - RNA, 22 nt, Human
gcaaagcacacccucagaguuu

SEQ ID NO: 101504 - RNA, 22 nt, Human
gcaaagcaucaguagaaauguu

SEQ ID NO: 101505 - RNA, 22 nt, Human
gcaaagcauucuguggagucua

SEQ ID NO: 101506 - RNA, 22 nt, Human
gcaaagguagccaaggagcuca

SEQ ID NO: 101507 - RNA, 17 nt, Human
gcaaaggugaggagaga

SEQ ID NO: 101508 - RNA, 22 nt, Human
gcaaagugcuucagugggagcu

SEQ ID NO: 101509 - RNA, 21 nt, Human
gcaaagugugggcauaaacag

SEQ ID NO: 101510 - RNA, 22 nt, Human
gcaaauaauauacuuugaucuc

SEQ ID NO: 101511 - RNA, 22 nt, Human
gcaaauauucaagacuuuucca

SEQ ID NO: 101512 - RNA, 22 nt, Human
gcaaauauuucuaauuccugaa

SEQ ID NO: 101513 - RNA, 22 nt, Human
gcaaaugaagguggugcuacag

SEQ ID NO: 101514 - RNA, 22 nt, Human
gcaaauguggcuuccuuucuag

SEQ ID NO: 101515 - RNA, 22 nt, Human
gcaaauguucacggggagcaua

SEQ ID NO: 101516 - RNA, 21 nt, Human
gcaaauguucaggaaaaaaga

SEQ ID NO: 101517 - RNA, 22 nt, Human
gcaaauucuaggccccucucca

SEQ ID NO: 101518 - RNA, 22 nt, Human
gcaaauugggaaauuucucuag

SEQ ID NO: 101519 - RNA, 22 nt, Human
gcaacaggcaguuugcucaugu

SEQ ID NO: 101520 - RNA, 22 nt, Human
gcaacauuaaaccaauaauugu

SEQ ID NO: 101521 - RNA, 22 nt, Human
gcaacauugcuucugaacauag

SEQ ID NO: 101522 - RNA, 21 nt, Human
gcaaccagaccacagggcagu

SEQ ID NO: 101523 - RNA, 20 nt, Human
gcaacuagggagacacagcu

SEQ ID NO: 101524 - RNA, 22 nt, Human
gcaacuuaggaguuagagcaug

SEQ ID NO: 101525 - RNA, 16 nt, Human
gcaacuuugggguuga

SEQ ID NO: 101526 - RNA, 22 nt, Human
gcaagacaauggagcauaaacg

SEQ ID NO: 101527 - RNA, 22 nt, Human
gcaagaccuaucuaguugcugu

SEQ ID NO: 101528 - RNA, 22 nt, Human
gcaagagacuuuuaugucugcc

SEQ ID NO: 101529 - RNA, 22 nt, Human
gcaagagcgcucucuuucauua

SEQ ID NO: 101530 - RNA, 22 nt, Human
gcaagauguuaacauagggaga

SEQ ID NO: 101531 - RNA, 22 nt, Human
gcaagauuagaaucaacuguga

SEQ ID NO: 101532 - RNA, 22 nt, Human
gcaagcaauggacggugacuuu

SEQ ID NO: 101533 - RNA, 22 nt, Human
gcaagcagaucuccggagggaa

SEQ ID NO: 101534 - RNA, 23 nt, Human
cguuuuuuccucagauguucugg

SEQ ID NO: 101535 - RNA, 22 nt, Human
cuaaacauguuggugcuuuaaa

SEQ ID NO: 101536 - RNA, 22 nt, Human
cuaaacuucauauguugcuuua

SEQ ID NO: 101537 - RNA, 22 nt, Human
cuaaagaagcuagcaaucuaua

SEQ ID NO: 101538 - RNA, 22 nt, Human
cuaaagacacaauaaguagcuu

SEQ ID NO: 101539 - RNA, 22 nt, Human
cuaaagcaacugagacacauag

SEQ ID NO: 101540 - RNA, 22 nt, Human
cuaaagcauucucagauuuugc

SEQ ID NO: 101541 - RNA, 22 nt, Human
cucacacacgaagcccuuggcc

SEQ ID NO: 101542 - RNA, 22 nt, Human
cucacaccagcuuacaagacuu

SEQ ID NO: 101543 - RNA, 22 nt, Human
cucacagaugaugucuaugugg

SEQ ID NO: 101544 - RNA, 22 nt, Human
cucacagaugcugugggucagg

SEQ ID NO: 101545 - RNA, 22 nt, Human
cucacaggcaucucaucaggcu

SEQ ID NO: 101546 - RNA, 22 nt, Human
cucacaggcgguaauucaggga

SEQ ID NO: 101547 - RNA, 22 nt, Human
cucacagguagaauaacaacau

SEQ ID NO: 101548 - RNA, 22 nt, Human
cucacaguuucacaguguagau

SEQ ID NO: 101549 - RNA, 23 nt, Human
cucaccaagcgccgccgcugugu

SEQ ID NO: 101550 - RNA, 22 nt, Human
cucaccccuguaauuccagcac

SEQ ID NO: 101551 - RNA, 22 nt, Human
cucacucagacauccagugcag

SEQ ID NO: 101552 - RNA, 22 nt, Human
cucacuggcaagacuacaggug

SEQ ID NO: 101553 - RNA, 22 nt, Human
cucacugucuguacuagcugau

SEQ ID NO: 101554 - RNA, 22 nt, Human
cucacuguuuaauagcuggauc

SEQ ID NO: 101555 - RNA, 20 nt, Human
cucacuuaccuuuuucuaua

SEQ ID NO: 101556 - RNA, 22 nt, Human
cucagaagaacaaaggcucuac

SEQ ID NO: 101557 - RNA, 22 nt, Human
cucagaagccuucagucuuggc

SEQ ID NO: 101558 - RNA, 22 nt, Human
cucagaauuaauaaccacaagg

SEQ ID NO: 101559 - RNA, 22 nt, Human
cucagacaaaugauuaagguua

SEQ ID NO: 101560 - RNA, 22 nt, Human
cucagacaucugaaauggguua

SEQ ID NO: 101561 - RNA, 22 nt, Human
cucagacuggggcucccugagu

SEQ ID NO: 101562 - RNA, 22 nt, Human
cucagacuuucaggguaggcca

SEQ ID NO: 101563 - RNA, 22 nt, Human
cucagagaaaaggagcaagggu

SEQ ID NO: 101564 - RNA, 22 nt, Human
cucagagaagauggaugaggua

SEQ ID NO: 101565 - RNA, 22 nt, Human
cucagagaggcaguggaaguca

SEQ ID NO: 101566 - RNA, 22 nt, Human
cucagagcaaugaacaugcaaa

SEQ ID NO: 101567 - RNA, 22 nt, Human
cucagagcacaguuuaugacag

SEQ ID NO: 101568 - RNA, 17 nt, Human
cucagagcaggacagaa

SEQ ID NO: 101569 - RNA, 22 nt, Human
cucagaggguacaggugaaccc

SEQ ID NO: 101570 - RNA, 22 nt, Human
cucagagguggaugccuugugg

SEQ ID NO: 101571 - RNA, 23 nt, Human
cucagagguguuuuucacuuacu

SEQ ID NO: 101572 - RNA, 22 nt, Human
cucagagucugcauuucuguca

SEQ ID NO: 101573 - RNA, 22 nt, Human
cucagauguagaaagauuguga

SEQ ID NO: 101574 - RNA, 22 nt, Human
cucagcaacccuagaacauuug

SEQ ID NO: 101575 - RNA, 22 nt, Human
cucagcacaucuuuacauuucc

SEQ ID NO: 101576 - RNA, 22 nt, Human
cucagcacauuccuaagggaug

SEQ ID NO: 101577 - RNA, 20 nt, Human
cucagcagauucuucuagaa

SEQ ID NO: 101578 - RNA, 22 nt, Human
cucagcagcuacaggauucggg

SEQ ID NO: 101579 - RNA, 22 nt, Human
cucagcagcugcugcugguggg

SEQ ID NO: 101580 - RNA, 22 nt, Human
cucagcagguaccacaugaucu

SEQ ID NO: 101581 - RNA, 22 nt, Human
cucagccagacaugacccaguc

SEQ ID NO: 101582 - RNA, 22 nt, Human
cucagccaggugggggucggga

SEQ ID NO: 101583 - RNA, 22 nt, Human
cucagccagugaucuuuccuuu

SEQ ID NO: 101584 - RNA, 22 nt, Human
cucagccccagcccagauagca

SEQ ID NO: 101585 - RNA, 22 nt, Human
cucagcccggugcucgugccac

SEQ ID NO: 101586 - RNA, 22 nt, Human
cucagcuagggaagguuagcuu

SEQ ID NO: 101587 - RNA, 22 nt, Human
cucagcuaguaacguacauguc

SEQ ID NO: 101588 - RNA, 22 nt, Human
cucagcucaaaauucaccuuug

SEQ ID NO: 101589 - RNA, 22 nt, Human
cucagcuccaggugugcaucuu

SEQ ID NO: 101590 - RNA, 20 nt, Human
cucagcucuucagggcaagu

SEQ ID NO: 101591 - RNA, 22 nt, Human
cucagcugcagccuggcuggca

SEQ ID NO: 101592 - RNA, 22 nt, Human
cucagcuggcaauucuggcucc

SEQ ID NO: 101593 - RNA, 22 nt, Human
cucaggagacaguguccacaug

SEQ ID NO: 101594 - RNA, 22 nt, Human
cucaggagagucuuauaucucc

SEQ ID NO: 101595 - RNA, 22 nt, Human
cucaggaguuggaggcuacagu

SEQ ID NO: 101596 - RNA, 22 nt, Human
cucaggauauugggcuggagca

SEQ ID NO: 101597 - RNA, 22 nt, Human
cucaggaugaaagucaugguga

SEQ ID NO: 101598 - RNA, 22 nt, Human
cucaggauucucgacacucaca

SEQ ID NO: 101599 - RNA, 22 nt, Human
cucaggauuuaaaggggcacuc

SEQ ID NO: 101600 - RNA, 18 nt, Human
cucaggcagagaagcuuu

SEQ ID NO: 101601 - RNA, 22 nt, Human
cucaggccagguuucucccaca

SEQ ID NO: 101602 - RNA, 22 nt, Human
cucaggcccacagcagacccac

SEQ ID NO: 101603 - RNA, 22 nt, Human
cucaggccuugaagucuuuucu

SEQ ID NO: 101604 - RNA, 22 nt, Human
cucaggcucuggccauccaagg

SEQ ID NO: 101605 - RNA, 22 nt, Human
cucaggcugucuaauggauuag

SEQ ID NO: 101606 - RNA, 22 nt, Human
cucaggcuugggaggaggccca

SEQ ID NO: 101607 - RNA, 22 nt, Human
cucagggaagcuauggugaggg

SEQ ID NO: 101608 - RNA, 22 nt, Human
cucagggacaaggggagacccc

SEQ ID NO: 101609 - RNA, 22 nt, Human
cucagggacggcaucucauuuc

SEQ ID NO: 101610 - RNA, 22 nt, Human
cucagggacguuagaggacagg

SEQ ID NO: 101611 - RNA, 22 nt, Human
cucagggagagccaagaguucc

SEQ ID NO: 101612 - RNA, 22 nt, Human
cucagggaggccucugcugguu

SEQ ID NO: 101613 - RNA, 22 nt, Human
cucagggauggugaagcaccca

SEQ ID NO: 101614 - RNA, 18 nt, Human
cucagggcaucagucugg

SEQ ID NO: 101615 - RNA, 22 nt, Human
cucagggccaaggaugcuguug

SEQ ID NO: 101616 - RNA, 22 nt, Human
cucagggugcagcacaguuccu

SEQ ID NO: 101617 - RNA, 22 nt, Human
cucagguagagucugcaugggg

SEQ ID NO: 101618 - RNA, 20 nt, Human
cucaguaaaagcacaggguc

SEQ ID NO: 101619 - RNA, 22 nt, Human
cucaguaaggaugcuucagcgg

SEQ ID NO: 101620 - RNA, 22 nt, Human
cucaguagaaaauacauggacu

SEQ ID NO: 101621 - RNA, 22 nt, Human
cucagucaugacgcucaggacc

SEQ ID NO: 101622 - RNA, 22 nt, Human
cucaguccagggaccggccucc

SEQ ID NO: 101623 - RNA, 22 nt, Human
cucaguccgucccgcuaggugc

SEQ ID NO: 101624 - RNA, 22 nt, Human
cucaguccuuauuugccucuac

SEQ ID NO: 101625 - RNA, 22 nt, Human
cucagugcugaggaaaguugaa

SEQ ID NO: 101626 - RNA, 22 nt, Human
cucagugcuuaguguguuuugg

SEQ ID NO: 101627 - RNA, 22 nt, Human
cucagugguugagagccugggc

SEQ ID NO: 101628 - RNA, 22 nt, Human
cucagugucuggggccccaggg

SEQ ID NO: 101629 - RNA, 22 nt, Human
cucagugucuuauuugaguucu

SEQ ID NO: 101630 - RNA, 23 nt, Human
cucagugugugacccauggccuc

SEQ ID NO: 101631 - RNA, 18 nt, Human
cucaguguuugcugaaaa

SEQ ID NO: 101632 - RNA, 22 nt, Human
cucaguuugagggguagguguu

SEQ ID NO: 101633 - RNA, 22 nt, Human
cucauaaaggcacacuuguugu

SEQ ID NO: 101634 - RNA, 22 nt, Human
cucauaaugugacuguauuuga

SEQ ID NO: 101635 - RNA, 22 nt, Human
cucauagauuuagauagaucga

SEQ ID NO: 101636 - RNA, 22 nt, Human
cucauauucagucacugaugca

SEQ ID NO: 101637 - RNA, 22 nt, Human
cucaucuggcuucaguaacagu

SEQ ID NO: 101638 - RNA, 22 nt, Human
cucauggauauaagaacuguuu

SEQ ID NO: 101639 - RNA, 22 nt, Human
cucaugugcaaaaguccaaauu

SEQ ID NO: 101640 - RNA, 22 nt, Human
cucauucauucccgcagccacc

SEQ ID NO: 101641 - RNA, 22 nt, Human
cucauucuuucacagucugugg

SEQ ID NO: 101642 - RNA, 22 nt, Human
cucauugcagcugcauuacugu

SEQ ID NO: 101643 - RNA, 22 nt, Human
cucauuuaacagauuaaaaagu

SEQ ID NO: 101644 - RNA, 22 nt, Human
cucauuuacucaucugcaaaac

SEQ ID NO: 101645 - RNA, 22 nt, Human
cucauuuauccaaaagccaguu

SEQ ID NO: 101646 - RNA, 22 nt, Human
cuccaaauauaaucacauugga

SEQ ID NO: 101647 - RNA, 22 nt, Human
cguuuauuuugaagauuccacu

SEQ ID NO: 101648 - RNA, 18 nt, Human
cguuuuuccgggauugca

SEQ ID NO: 101649 - RNA, 22 nt, Human
cuaaaaauccacacuaggugaa

SEQ ID NO: 101650 - RNA, 17 nt, Human
cucagcugaaccccaga

SEQ ID NO: 101651 - RNA, 19 nt, Human
cucagcuguagcucaugug

SEQ ID NO: 101652 - RNA, 22 nt, Human
cucaggaaccgcggcagcagcc

SEQ ID NO: 101653 - RNA, 22 nt, Human
cucaggacccgguccagguggg

SEQ ID NO: 101654 - RNA, 22 nt, Human
cucaggacggccgggggagccu

SEQ ID NO: 101655 - RNA, 22 nt, Human
cuccaacgaggcugggguacaa

SEQ ID NO: 101656 - RNA, 22 nt, Human
cuccaaggcucuggugcugagg

SEQ ID NO: 101657 - RNA, 22 nt, Human
cuccaaucugggcaacagagca

SEQ ID NO: 101658 - RNA, 20 nt, Human
cuccacaccuguucgcaggc

SEQ ID NO: 101659 - RNA, 22 nt, Human
cuccacagcucaggcucagagu

SEQ ID NO: 101660 - RNA, 19 nt, Human
cuccacagggauugugauu

SEQ ID NO: 101661 - RNA, 22 nt, Human
cuccacaguugcugcuuuuaau

SEQ ID NO: 101662 - RNA, 22 nt, Human
cuccaccccgugccggugcugg

SEQ ID NO: 101663 - RNA, 22 nt, Human
cuccacggcccauugggcagga

SEQ ID NO: 101664 - RNA, 22 nt, Human
cuccacucaccagaugccagga

SEQ ID NO: 101665 - RNA, 22 nt, Human
cuccagaaauuuggaugcagca

SEQ ID NO: 101666 - RNA, 19 nt, Human
cuccagaauacauguuccu

SEQ ID NO: 101667 - RNA, 22 nt, Human
cuccagaggaugcaggugaggg

SEQ ID NO: 101668 - RNA, 22 nt, Human
cuccagagggucagacucugag

SEQ ID NO: 101669 - RNA, 22 nt, Human
cuccagagucaucgagcauucc

SEQ ID NO: 101670 - RNA, 22 nt, Human
cuccagauguauacuuuccaag

SEQ ID NO: 101671 - RNA, 22 nt, Human
cuccagauuccugcuggcagaa

SEQ ID NO: 101672 - RNA, 22 nt, Human
cuccagcaggugcgucucagag

SEQ ID NO: 101673 - RNA, 22 nt, Human
cuccagccagagugccucuguu

SEQ ID NO: 101674 - RNA, 22 nt, Human
cuccagcuucugcccagagacu

SEQ ID NO: 101675 - RNA, 22 nt, Human
cuccagcuuuagcucuccaggg

SEQ ID NO: 101676 - RNA, 22 nt, Human
cuccaggaaagucaggcuuaga

SEQ ID NO: 101677 - RNA, 22 nt, Human
cuccaggacagauucagggcca

SEQ ID NO: 101678 - RNA, 22 nt, Human
cuccaggacccaguggcuccag

SEQ ID NO: 101679 - RNA, 22 nt, Human
cuccaggauaccuguuccuaua

SEQ ID NO: 101680 - RNA, 22 nt, Human
cuccaggccaagauuaaguaau

SEQ ID NO: 101681 - RNA, 22 nt, Human
cuccaggccccuggccuucugc

SEQ ID NO: 101682 - RNA, 22 nt, Human
cuccaggcuggauccaagucaa

SEQ ID NO: 101683 - RNA, 22 nt, Human
cuccaggcuucaagggccggcc

SEQ ID NO: 101684 - RNA, 18 nt, Human
cuccagggaacucaguca

SEQ ID NO: 101685 - RNA, 22 nt, Human
cuccagggaggagcacggguuc

SEQ ID NO: 101686 - RNA, 22 nt, Human
cuccagggaggucugcaggacu

SEQ ID NO: 101687 - RNA, 22 nt, Human
cuccaggguuccccgauccacu

SEQ ID NO: 101688 - RNA, 22 nt, Human
cuccagguagcuaaguccuggg

SEQ ID NO: 101689 - RNA, 22 nt, Human
cuccagguuacuuagccuagcu

SEQ ID NO: 101690 - RNA, 22 nt, Human
cuccagucuaguagagccugcu

SEQ ID NO: 101691 - RNA, 22 nt, Human
cuccagugagcgcggggcaugg

SEQ ID NO: 101692 - RNA, 22 nt, Human
cuccagugcgucuuaguaaacc

SEQ ID NO: 101693 - RNA, 22 nt, Human
cuccagugcugucaucccuucc

SEQ ID NO: 101694 - RNA, 22 nt, Human
cuccauacuuccaacaaacuuu

SEQ ID NO: 101695 - RNA, 20 nt, Human
cuccaugacuugaauuagua

SEQ ID NO: 101696 - RNA, 22 nt, Human
cuccauggaaaaggcuguuguu

SEQ ID NO: 101697 - RNA, 22 nt, Human
cuccauggaaccggggcugcuu

SEQ ID NO: 101698 - RNA, 22 nt, Human
cuccauggcuuucgcaucugca

SEQ ID NO: 101699 - RNA, 22 nt, Human
cuccauggggaaaugaaggugg

SEQ ID NO: 101700 - RNA, 22 nt, Human
cuccaugggggcuggccugugu

SEQ ID NO: 101701 - RNA, 22 nt, Human
cucccacuccuggcucaccaca

SEQ ID NO: 101702 - RNA, 22 nt, Human
cucccagacaugugccuccuug

SEQ ID NO: 101703 - RNA, 22 nt, Human
cucccagauuccugcuguggga

SEQ ID NO: 101704 - RNA, 22 nt, Human
cucccaggacucagaggagaag

SEQ ID NO: 101705 - RNA, 22 nt, Human
cucccaggacuggcucuaacug

SEQ ID NO: 101706 - RNA, 22 nt, Human
cucccaggggaacuaucaagua

SEQ ID NO: 101707 - RNA, 22 nt, Human
cucccaggggagucaucugcuu

SEQ ID NO: 101708 - RNA, 22 nt, Human
cucccagguugauucuuucccu

SEQ ID NO: 101709 - RNA, 22 nt, Human
cucccaguguuguuuucugaug

SEQ ID NO: 101710 - RNA, 22 nt, Human
cucccauugcuucaaagauccu

SEQ ID NO: 101711 - RNA, 22 nt, Human
cuccccaaagauaacggcuucu

SEQ ID NO: 101712 - RNA, 22 nt, Human
cuccccacauuucucccugucu

SEQ ID NO: 101713 - RNA, 22 nt, Human
cuccccacgccuggacuaagag

SEQ ID NO: 101714 - RNA, 22 nt, Human
cuccccagcauucugacuuccu

SEQ ID NO: 101715 - RNA, 22 nt, Human
cuccccagcucgcgggugacgg

SEQ ID NO: 101716 - RNA, 18 nt, Human
cuccccagcugcccccag

SEQ ID NO: 101717 - RNA, 22 nt, Human
cucccggcacuuggcaugucau

SEQ ID NO: 101718 - RNA, 22 nt, Human
cucccgugauccuggaggagag

SEQ ID NO: 101719 - RNA, 22 nt, Human
cucccucagaggagcaccuguu

SEQ ID NO: 101720 - RNA, 22 nt, Human
cucccucaggccuuagcccugc

SEQ ID NO: 101721 - RNA, 22 nt, Human
cucccuccaaauaagacucggg

SEQ ID NO: 101722 - RNA, 22 nt, Human
cucccuccucaaauaucuuugu

SEQ ID NO: 101723 - RNA, 22 nt, Human
cucccucugaggcuuugagccu

SEQ ID NO: 101724 - RNA, 22 nt, Human
cucccugaaauucagaugccuc

SEQ ID NO: 101725 - RNA, 22 nt, Human
cucccugaguuuguggcuaagu

SEQ ID NO: 101726 - RNA, 22 nt, Human
cucccuggcagccgcacuccug

SEQ ID NO: 101727 - RNA, 22 nt, Human
cucccuggggcuccuccuauuu

SEQ ID NO: 101728 - RNA, 22 nt, Human
cucccuggugacucccaaagcu

SEQ ID NO: 101729 - RNA, 22 nt, Human
cucccugugucuucacuuggcc

SEQ ID NO: 101730 - RNA, 22 nt, Human
cucccuucaggagaggcucaca

SEQ ID NO: 101731 - RNA, 19 nt, Human
cuccggccagcaacugcau

SEQ ID NO: 101732 - RNA, 22 nt, Human
cuccuacauuccaccuuggacu

SEQ ID NO: 101733 - RNA, 22 nt, Human
cuccuaggugcucacugggguc

SEQ ID NO: 101734 - RNA, 22 nt, Human
cuccucaaggucucaggaauaa

SEQ ID NO: 101735 - RNA, 22 nt, Human
cuccucacacccacugcaacca

SEQ ID NO: 101736 - RNA, 22 nt, Human
cuccucacuuuccagacugggc

SEQ ID NO: 101737 - RNA, 22 nt, Human
cuccucagaacagccuuggcug

SEQ ID NO: 101738 - RNA, 22 nt, Human
cuccucagucaggucuaggguc

SEQ ID NO: 101739 - RNA, 22 nt, Human
cuccuccacagaguccuugcca

SEQ ID NO: 101740 - RNA, 22 nt, Human
cuccuccagcucucccuggggg

SEQ ID NO: 101741 - RNA, 22 nt, Human
cuccuccagugggucccucagg

SEQ ID NO: 101742 - RNA, 22 nt, Human
cuccucccacggucucaggaag

SEQ ID NO: 101743 - RNA, 22 nt, Human
cuccuccuggacacaggcugug

SEQ ID NO: 101744 - RNA, 23 nt, Human
cuccucguaacucuguggugggu

SEQ ID NO: 101745 - RNA, 22 nt, Human
cuccucucaaaaguagguugac

SEQ ID NO: 101746 - RNA, 22 nt, Human
cuccucucaggcuggauggcgc

SEQ ID NO: 101747 - RNA, 22 nt, Human
cuccucuggaaauuccucugcc

SEQ ID NO: 101748 - RNA, 22 nt, Human
cuccucugucuggcccugagcc

SEQ ID NO: 101749 - RNA, 22 nt, Human
cuccugacuugugagccccucc

SEQ ID NO: 101750 - RNA, 22 nt, Human
cuccugagaaauaagcaaguaa

SEQ ID NO: 101751 - RNA, 22 nt, Human
cuccugaggacuucuauugggu

SEQ ID NO: 101752 - RNA, 22 nt, Human
cuccugcccacgugcuacuucu

SEQ ID NO: 101753 - RNA, 22 nt, Human
cuccuggagggccaaagaaaua

SEQ ID NO: 101754 - RNA, 22 nt, Human
cuccuggaucuuagccagauuc

SEQ ID NO: 101755 - RNA, 22 nt, Human
cuccuggcaguuccccuuguca

SEQ ID NO: 101756 - RNA, 22 nt, Human
cuccuggccacguucuugcugg

SEQ ID NO: 101757 - RNA, 22 nt, Human
cuccugggaauuuaguugugag

SEQ ID NO: 101758 - RNA, 20 nt, Human
cuccugggacugcugguuau

SEQ ID NO: 101759 - RNA, 22 nt, Human
acuuugcaauacuuaauacaaa

SEQ ID NO: 101760 - RNA, 22 nt, Human
acuuugcaaugggcagaaccca

SEQ ID NO: 101761 - RNA, 22 nt, Human
acuuugcagagccagaagagaa

SEQ ID NO: 101762 - RNA, 23 nt, Human
acuuugcagagccccuugaaaca

SEQ ID NO: 101763 - RNA, 22 nt, Human
acuuugcauggaaaauggucau

SEQ ID NO: 101764 - RNA, 20 nt, Human
acuuugcauuuccugauuuu

SEQ ID NO: 101765 - RNA, 22 nt, Human
acuuugccccaaagaaguuggu

SEQ ID NO: 101766 - RNA, 22 nt, Human
acuuugccccaggucucaugac

SEQ ID NO: 101767 - RNA, 22 nt, Human
acuuuggaaauugucuauaaga

SEQ ID NO: 101768 - RNA, 22 nt, Human
acuuuggacaauuuauuacugu

SEQ ID NO: 101769 - RNA, 22 nt, Human
acuuuggaggguguuguagaug

SEQ ID NO: 101770 - RNA, 22 nt, Human
acuuuggcacagaacuuccauu

SEQ ID NO: 101771 - RNA, 22 nt, Human
acuuugggaagcugcaauugcc

SEQ ID NO: 101772 - RNA, 22 nt, Human
acuuugggcacagugaggccag

SEQ ID NO: 101773 - RNA, 21 nt, Human
acuuugggcacuuuccugccc

SEQ ID NO: 101774 - RNA, 20 nt, Human
acuuuggggucuuucucaga

SEQ ID NO: 101775 - RNA, 22 nt, Human
acuuuguucuaauaguaucucu

SEQ ID NO: 101776 - RNA, 22 nt, Human
acuuuguuguuccuugucuaaa

SEQ ID NO: 101777 - RNA, 22 nt, Human
acuuuuaugauaaucaauguuc

SEQ ID NO: 101778 - RNA, 22 nt, Human
acuuuucucccuccugccuuca

SEQ ID NO: 101779 - RNA, 22 nt, Human
acuuuucuuaucagaaaggcca

SEQ ID NO: 101780 - RNA, 22 nt, Human
acuuuugaacaaacuccucugu

SEQ ID NO: 101781 - RNA, 22 nt, Human
acuuuuugcauaguaagugucu

SEQ ID NO: 101782 - RNA, 22 nt, Human
agaaaaacacaaucgggccucc

SEQ ID NO: 101783 - RNA, 22 nt, Human
agaaaaaucuuggcgcuugucu

SEQ ID NO: 101784 - RNA, 22 nt, Human
agaaaacacugcccccucucuc

SEQ ID NO: 101785 - RNA, 22 nt, Human
agaaaacugggaggagagcuuc

SEQ ID NO: 101786 - RNA, 17 nt, Human
agaaaagagaccagcag

SEQ ID NO: 101787 - RNA, 22 nt, Human
agaaaagaggcuuucuaagcau

SEQ ID NO: 101788 - RNA, 22 nt, Human
agaaaaggcuugaagagguuuu

SEQ ID NO: 101789 - RNA, 22 nt, Human
agaaaauuacuccagagacaag

SEQ ID NO: 101790 - RNA, 22 nt, Human
agaaacaacuuguuucucuugc

SEQ ID NO: 101791 - RNA, 22 nt, Human
agaaacaucauuguuugguauu

SEQ ID NO: 101792 - RNA, 21 nt, Human
agaaacaugaucaaaggaacc

SEQ ID NO: 101793 - RNA, 22 nt, Human
agaaaccagacuuggcccauuu

SEQ ID NO: 101794 - RNA, 22 nt, Human
agaaaccaucuuuauauaucug

SEQ ID NO: 101795 - RNA, 22 nt, Human
agaaaccucacagcaauucuga

SEQ ID NO: 101796 - RNA, 22 nt, Human
agaaaccuggggguuguacaua

SEQ ID NO: 101797 - RNA, 22 nt, Human
agaaacuaaccugguaggguuc

SEQ ID NO: 101798 - RNA, 22 nt, Human
agaaacuacuuggaggaaagau

SEQ ID NO: 101799 - RNA, 22 nt, Human
agaaacucaccuuuccagccau

SEQ ID NO: 101800 - RNA, 22 nt, Human
agaaacucuggaagaacuuuua

SEQ ID NO: 101801 - RNA, 22 nt, Human
agaaacugaacacaagagucgg

SEQ ID NO: 101802 - RNA, 22 nt, Human
agaaacugacaggaaaugaauu

SEQ ID NO: 101803 - RNA, 22 nt, Human
agaaagacgugaugaagaagua

SEQ ID NO: 101804 - RNA, 22 nt, Human
agaaagauuuucaacaggaggu

SEQ ID NO: 101805 - RNA, 22 nt, Human
agaaagcacagcggguccauuu

SEQ ID NO: 101806 - RNA, 22 nt, Human
agaaagcacccugcacuuucug

SEQ ID NO: 101807 - RNA, 22 nt, Human
agaaagcacucugucuuuuacc

SEQ ID NO: 101808 - RNA, 22 nt, Human
agaaagcagucccuuccgaccg

SEQ ID NO: 101809 - RNA, 22 nt, Human
agaaaggacaucucccuuuaag

SEQ ID NO: 101810 - RNA, 22 nt, Human
agaaaggcaauauuaacuacac

SEQ ID NO: 101811 - RNA, 22 nt, Human
agaaagggagagccagcacacg

SEQ ID NO: 101812 - RNA, 22 nt, Human
agaaaggguucucugaggugcu

SEQ ID NO: 101813 - RNA, 23 nt, Human
agaaagucauggccagguuugau

SEQ ID NO: 101814 - RNA, 20 nt, Human
agaaauacaugcaugcauga

SEQ ID NO: 101815 - RNA, 22 nt, Human
agaaauacugugagagcagccu

SEQ ID NO: 101816 - RNA, 22 nt, Human
agaaauagaggaaagguuugac

SEQ ID NO: 101817 - RNA, 22 nt, Human
agaaaucaauaucuauauguug

SEQ ID NO: 101818 - RNA, 22 nt, Human
agaaaucaggaacaguaaggag

SEQ ID NO: 101819 - RNA, 22 nt, Human
agaaaucauugaauuauuugcu

SEQ ID NO: 101820 - RNA, 22 nt, Human
agaaaucucaguaucucaggga

SEQ ID NO: 101821 - RNA, 22 nt, Human
agaaaucucuagcacaucgaau

SEQ ID NO: 101822 - RNA, 22 nt, Human
agaaaucugacugcugugcaca

SEQ ID NO: 101823 - RNA, 22 nt, Human
agaaaucuuugaaguguaaugu

SEQ ID NO: 101824 - RNA, 22 nt, Human
agaaaugacaagacugaucagg

SEQ ID NO: 101825 - RNA, 22 nt, Human
agaaaugccuacgagauaggga

SEQ ID NO: 101826 - RNA, 22 nt, Human
agaaaugcucaggucaacuuaa

SEQ ID NO: 101827 - RNA, 22 nt, Human
agaaauguacacgacacccaga

SEQ ID NO: 101828 - RNA, 22 nt, Human
agaaauguacgauguuaugcag

SEQ ID NO: 101829 - RNA, 22 nt, Human
agaaauguauagugaauuuuuc

SEQ ID NO: 101830 - RNA, 22 nt, Human
agaaauguauucuguauguuuu

SEQ ID NO: 101831 - RNA, 22 nt, Human
agaaaugugaauuucauuuccu

SEQ ID NO: 101832 - RNA, 22 nt, Human
agaaaugugagccccuuaucaa

SEQ ID NO: 101833 - RNA, 22 nt, Human
agaaauguucuucauuugccau

SEQ ID NO: 101834 - RNA, 22 nt, Human
agaaauguugaauacaucagga

SEQ ID NO: 101835 - RNA, 22 nt, Human
agaaauguuguggguuuuguua

SEQ ID NO: 101836 - RNA, 22 nt, Human
agaaauguuuacucacccccuu

SEQ ID NO: 101837 - RNA, 22 nt, Human
agaaauuaugcaguaguuuuau

SEQ ID NO: 101838 - RNA, 22 nt, Human
agaaauucuaagcaucaauagc

SEQ ID NO: 101839 - RNA, 22 nt, Human
agaaauugccagaaugucaggc

SEQ ID NO: 101840 - RNA, 22 nt, Human
agaacaaaauuagaggagugca

SEQ ID NO: 101841 - RNA, 20 nt, Human
agaacaaguacuaaaggaga

SEQ ID NO: 101842 - RNA, 22 nt, Human
agaacaaugcguauuuuacucc

SEQ ID NO: 101843 - RNA, 22 nt, Human
agaacacacgucagaguuuccu

SEQ ID NO: 101844 - RNA, 18 nt, Human
agaacacuugguuagauc

SEQ ID NO: 101845 - RNA, 22 nt, Human
agaacacuuuuaaauggcuugu

SEQ ID NO: 101846 - RNA, 22 nt, Human
agaacagccaauaaaagagggg

SEQ ID NO: 101847 - RNA, 22 nt, Human
agaacagccuauaguggccuuu

SEQ ID NO: 101848 - RNA, 22 nt, Human
agaacaggcaguugguuggauu

SEQ ID NO: 101849 - RNA, 22 nt, Human
agaacauggauugucaaaggua

SEQ ID NO: 101850 - RNA, 22 nt, Human
agaacauuaaugcgagguauua

SEQ ID NO: 101851 - RNA, 22 nt, Human
agaaccaguuuaagauuugggu

SEQ ID NO: 101852 - RNA, 22 nt, Human
agaaccauuuugacagauauac

SEQ ID NO: 101853 - RNA, 22 nt, Human
agaaccucaauuauuuuugcac

SEQ ID NO: 101854 - RNA, 22 nt, Human
agaaccuucagauuaggaggug

SEQ ID NO: 101855 - RNA, 22 nt, Human
agaaccuucagcuugcaacaag

SEQ ID NO: 101856 - RNA, 22 nt, Human
agaacucuauauucaugaacaa

SEQ ID NO: 101857 - RNA, 22 nt, Human
agaacugauuugaagguugggg

SEQ ID NO: 101858 - RNA, 17 nt, Human
agaacuguaguagcucc

SEQ ID NO: 101859 - RNA, 22 nt, Human
agaacuuaauucagugacuuaa

SEQ ID NO: 101860 - RNA, 22 nt, Human
agaacuucagcaaaaccaguua

SEQ ID NO: 101861 - RNA, 22 nt, Human
agaagaaacugucggggauauu

SEQ ID NO: 101862 - RNA, 22 nt, Human
agaagaauuucucucaugauuu

SEQ ID NO: 101863 - RNA, 22 nt, Human
agagauuucuacugcacucuuu

SEQ ID NO: 101864 - RNA, 22 nt, Human
agagcaacgaggugauacuaga

SEQ ID NO: 101865 - RNA, 23 nt, Human
agagcaaggaaaugaggugugau

SEQ ID NO: 101866 - RNA, 22 nt, Human
agagcaagugacagaaacaggg

SEQ ID NO: 101867 - RNA, 22 nt, Human
agagcaauuagcuuagguaaaa

SEQ ID NO: 101868 - RNA, 22 nt, Human
agccuguggaaacugggugcag

SEQ ID NO: 101869 - RNA, 22 nt, Human
agccuguguugcucuggcgaua

SEQ ID NO: 101870 - RNA, 22 nt, Human
agagggaaggacagauguuuca

SEQ ID NO: 101871 - RNA, 22 nt, Human
agagggagaaaagaaucaguug

SEQ ID NO: 101872 - RNA, 22 nt, Human
agagggagaagcuaaaauaacu

SEQ ID NO: 101873 - RNA, 22 nt, Human
agagggagcccagucauagcug

SEQ ID NO: 101874 - RNA, 22 nt, Human
agagggagugaaauggaauaga

SEQ ID NO: 101875 - RNA, 22 nt, Human
agagggauaauauguauuguaa

SEQ ID NO: 101876 - RNA, 22 nt, Human
agagggcaaguguaguccagua

SEQ ID NO: 101877 - RNA, 22 nt, Human
agagggcaugcuugguggccug

SEQ ID NO: 101878 - RNA, 22 nt, Human
agagggccauaggugcauaguu

SEQ ID NO: 101879 - RNA, 22 nt, Human
agagggcugcugcacagugcuc

SEQ ID NO: 101880 - RNA, 22 nt, Human
agagggcuggacgcagguugga

SEQ ID NO: 101881 - RNA, 22 nt, Human
agagggcuucccuaggagugag

SEQ ID NO: 101882 - RNA, 22 nt, Human
agaggggaaggaugugauguga

SEQ ID NO: 101883 - RNA, 22 nt, Human
agaggggaaguaaugaaugaua

SEQ ID NO: 101884 - RNA, 22 nt, Human
agaggggagagcuaagcaauuc

SEQ ID NO: 101885 - RNA, 22 nt, Human
agaggggaguccuaaucugauu

SEQ ID NO: 101886 - RNA, 22 nt, Human
agaggggcagggucuccggauu

SEQ ID NO: 101887 - RNA, 22 nt, Human
agagggggugucagcacugcag

SEQ ID NO: 101888 - RNA, 23 nt, Human
agagggugcaacauggggaucua

SEQ ID NO: 101889 - RNA, 22 nt, Human
agagggugcuggagagacauug

SEQ ID NO: 101890 - RNA, 22 nt, Human
agaggguggugaggccugguuc

SEQ ID NO: 101891 - RNA, 22 nt, Human
agaggguugaaccuauaaacua

SEQ ID NO: 101892 - RNA, 22 nt, Human
agagguaaagagaggggaaauu

SEQ ID NO: 101893 - RNA, 22 nt, Human
agagguaagcaguggcaagugc

SEQ ID NO: 101894 - RNA, 22 nt, Human
agagguauauauucuccauauu

SEQ ID NO: 101895 - RNA, 22 nt, Human
agagguaugguauauuggaaga

SEQ ID NO: 101896 - RNA, 22 nt, Human
agagguaugugaagugauacca

SEQ ID NO: 101897 - RNA, 22 nt, Human
agagguaugugucagugcuuau

SEQ ID NO: 101898 - RNA, 22 nt, Human
agaggucuaugcuaggggaacu

SEQ ID NO: 101899 - RNA, 22 nt, Human
agaggugaaagaauuuggcucu

SEQ ID NO: 101900 - RNA, 22 nt, Human
agagguguggccaggacucaag

SEQ ID NO: 101901 - RNA, 22 nt, Human
agagguucagagaaggcgaucu

SEQ ID NO: 101902 - RNA, 20 nt, Human
agagguucagucuggagaag

SEQ ID NO: 101903 - RNA, 16 nt, Human
agagguuuacagccug

SEQ ID NO: 101904 - RNA, 23 nt, Human
agaguaauguuuuuacuguauuc

SEQ ID NO: 101905 - RNA, 22 nt, Human
agaguagccucauagacacuca

SEQ ID NO: 101906 - RNA, 22 nt, Human
agaguaugcaucuauuguaccu

SEQ ID NO: 101907 - RNA, 22 nt, Human
agagucaagggugcagaggaag

SEQ ID NO: 101908 - RNA, 22 nt, Human
agagucaagguggcauuuagcu

SEQ ID NO: 101909 - RNA, 22 nt, Human
agagucagaaccaagaugaggc

SEQ ID NO: 101910 - RNA, 22 nt, Human
agagucagucacuggcacuuug

SEQ ID NO: 101911 - RNA, 22 nt, Human
agagucaguuagcgaauacuua

SEQ ID NO: 101912 - RNA, 22 nt, Human
agagucaguuaugucaagugcu

SEQ ID NO: 101913 - RNA, 22 nt, Human
agagucauaguuuaacuuuugu

SEQ ID NO: 101914 - RNA, 23 nt, Human
agaguccacaagauuuuccagug

SEQ ID NO: 101915 - RNA, 22 nt, Human
agaguccagaaaacagugugcu

SEQ ID NO: 101916 - RNA, 22 nt, Human
agaguccauauauugauuuguu

SEQ ID NO: 101917 - RNA, 22 nt, Human
agaguccugaguggaaaaaugg

SEQ ID NO: 101918 - RNA, 22 nt, Human
agagucugaggaggaccaacag

SEQ ID NO: 101919 - RNA, 21 nt, Human
agagucugagugugcaagggc

SEQ ID NO: 101920 - RNA, 22 nt, Human
agagucugauauuuguaccaga

SEQ ID NO: 101921 - RNA, 21 nt, Human
agagucugcauuucugacaag

SEQ ID NO: 101922 - RNA, 22 nt, Human
agagucugccuuuuucuccugc

SEQ ID NO: 101923 - RNA, 22 nt, Human
agagucugggcacugggaaugc

SEQ ID NO: 101924 - RNA, 22 nt, Human
agagucuuccaggcagccugag

SEQ ID NO: 101925 - RNA, 22 nt, Human
agagugaaggccagguuacagu

SEQ ID NO: 101926 - RNA, 22 nt, Human
agagugaaguucaucgugcagc

SEQ ID NO: 101927 - RNA, 22 nt, Human
agagugcaaccgaaacaagcag

SEQ ID NO: 101928 - RNA, 22 nt, Human
agagugcccaagccuggcaggg

SEQ ID NO: 101929 - RNA, 20 nt, Human
agagugcuggacugaggagc

SEQ ID NO: 101930 - RNA, 22 nt, Human
agagugcuuaguagugacaugg

SEQ ID NO: 101931 - RNA, 22 nt, Human
agagugcuuuauuagauguagc

SEQ ID NO: 101932 - RNA, 22 nt, Human
agaguggagagaaacaacucug

SEQ ID NO: 101933 - RNA, 23 nt, Human
agaguggccuacucacacucauu

SEQ ID NO: 101934 - RNA, 22 nt, Human
agaguggccuggccuggggcau

SEQ ID NO: 101935 - RNA, 22 nt, Human
agaguggcuugcucagcuagca

SEQ ID NO: 101936 - RNA, 22 nt, Human
agagugggacacgggcgcuguc

SEQ ID NO: 101937 - RNA, 22 nt, Human
agagugggccucugagucccag

SEQ ID NO: 101938 - RNA, 22 nt, Human
agagugggugaucucuguuguc

SEQ ID NO: 101939 - RNA, 20 nt, Human
agagugggugucacaggcug

SEQ ID NO: 101940 - RNA, 22 nt, Human
agagugguacuucuuuuucuuc

SEQ ID NO: 101941 - RNA, 22 nt, Human
agagugugaagaaagugcaaug

SEQ ID NO: 101942 - RNA, 22 nt, Human
agaguguggaaauguucagagu

SEQ ID NO: 101943 - RNA, 22 nt, Human
agaguguuauuugcucuguauu

SEQ ID NO: 101944 - RNA, 22 nt, Human
agaguuaaauaagcauuaacuu

SEQ ID NO: 101945 - RNA, 22 nt, Human
agaguuaaggccacugucagua

SEQ ID NO: 101946 - RNA, 22 nt, Human
agaguuagguccagaauguugc

SEQ ID NO: 101947 - RNA, 22 nt, Human
agaguuauccuguccuagggga

SEQ ID NO: 101948 - RNA, 22 nt, Human
agaguucacacucagugcaccc

SEQ ID NO: 101949 - RNA, 22 nt, Human
agaguucagcuacugcaaaugu

SEQ ID NO: 101950 - RNA, 22 nt, Human
agaguuccacguacagcuuuug

SEQ ID NO: 101951 - RNA, 22 nt, Human
agaguucugaauuuuauucucu

SEQ ID NO: 101952 - RNA, 21 nt, Human
agaguucuugcugagcaagcc

SEQ ID NO: 101953 - RNA, 22 nt, Human
agaguuggcccacguguaggcg

SEQ ID NO: 101954 - RNA, 19 nt, Human
agaguugggcacuguuuca

SEQ ID NO: 101955 - RNA, 22 nt, Human
agaguuuacagaaauaagcugu

SEQ ID NO: 101956 - RNA, 22 nt, Human
agaguuuagggcugagagcuug

SEQ ID NO: 101957 - RNA, 22 nt, Human
agaguuugaaguuaucuuugac

SEQ ID NO: 101958 - RNA, 22 nt, Human
agaguuugggguaugauuguuu

SEQ ID NO: 101959 - RNA, 22 nt, Human
agaguuugggugggacagcuug

SEQ ID NO: 101960 - RNA, 22 nt, Human
agaguuuggugaagcaauuuga

SEQ ID NO: 101961 - RNA, 22 nt, Human
agaguuuguaguggugaaugua

SEQ ID NO: 101962 - RNA, 22 nt, Human
agaguuugugggcuuuuccucc

SEQ ID NO: 101963 - RNA, 22 nt, Human
agaguuuguugaauuuacuugg

SEQ ID NO: 101964 - RNA, 23 nt, Human
agaguuuguuucuaaugagugag

SEQ ID NO: 101965 - RNA, 22 nt, Human
agauaaaaugauuuucuggauc

SEQ ID NO: 101966 - RNA, 22 nt, Human
agauaaauuccuaagauuucag

SEQ ID NO: 101967 - RNA, 22 nt, Human
agauaacugguuuacauuauug

SEQ ID NO: 101968 - RNA, 22 nt, Human
agauaaugaaugccaugacauu

SEQ ID NO: 101969 - RNA, 22 nt, Human
agauaaugaauuuauugaaugu

SEQ ID NO: 101970 - RNA, 22 nt, Human
agauaaugauucugcauuucua

SEQ ID NO: 101971 - RNA, 22 nt, Human
agauacaaaagauaagauuuag

SEQ ID NO: 101972 - RNA, 22 nt, Human
agauacaaggcagagaugugca

SEQ ID NO: 101973 - RNA, 22 nt, Human
agauacauagcugugagcacac

SEQ ID NO: 101974 - RNA, 22 nt, Human
agauacaucauuuauaccuuca

SEQ ID NO: 101975 - RNA, 22 nt, Human
agauacuaaaaggggaagcucc

SEQ ID NO: 101976 - RNA, 22 nt, Human
agauacuacaugaaugggaauu

SEQ ID NO: 101977 - RNA, 22 nt, Human
aggaacaacugauucagucaac

SEQ ID NO: 101978 - RNA, 22 nt, Human
aggaacacaucuuuguagcagg

SEQ ID NO: 101979 - RNA, 22 nt, Human
aggaacacuuaauucgauacua

SEQ ID NO: 101980 - RNA, 22 nt, Human
aggaacacuuguggaaacauuc

SEQ ID NO: 101981 - RNA, 22 nt, Human
aggaacaucuaucacauaaacg

SEQ ID NO: 101982 - RNA, 22 nt, Human
aggaacccugcgccauacuuug

SEQ ID NO: 101983 - RNA, 22 nt, Human
aggaaccuaagagccugcaguc

SEQ ID NO: 101984 - RNA, 22 nt, Human
aggaacugaugagcagccaggg

SEQ ID NO: 101985 - RNA, 20 nt, Human
aggaacuggaagggaggaaa

SEQ ID NO: 101986 - RNA, 22 nt, Human
aggaacugggcucagcaaacau

SEQ ID NO: 101987 - RNA, 22 nt, Human
aggaacuggggcuauucacccu

SEQ ID NO: 101988 - RNA, 22 nt, Human
aggaacuggugggaggugauug

SEQ ID NO: 101989 - RNA, 22 nt, Human
aggaagaaccuaagaaagucuc

SEQ ID NO: 101990 - RNA, 22 nt, Human
aggaagaauguuuacauaucaa

SEQ ID NO: 101991 - RNA, 23 nt, Human
aggaagagagagugccucuuucu

SEQ ID NO: 101992 - RNA, 23 nt, Human
aggaagaggcaauuucucuuaga

SEQ ID NO: 101993 - RNA, 22 nt, Human
aggaagaggguggcagauaauc

SEQ ID NO: 101994 - RNA, 22 nt, Human
aggaagaggugugcaauggugu

SEQ ID NO: 101995 - RNA, 22 nt, Human
aggaagcaguuuauaaugcauu

SEQ ID NO: 101996 - RNA, 22 nt, Human
aggaagccacugaaugaaaguu

SEQ ID NO: 101997 - RNA, 22 nt, Human
aggaagccaggcccuugggugg

SEQ ID NO: 101998 - RNA, 17 nt, Human
aggaagcgagcuggccu

SEQ ID NO: 101999 - RNA, 23 nt, Human
aggaagcuaccaauuuuguaggc

SEQ ID NO: 102000 - RNA, 22 nt, Human
aggaagcuagagccaccggacu

SEQ ID NO: 102001 - RNA, 22 nt, Human
aggaagcucaaagccaugaugu

SEQ ID NO: 102002 - RNA, 22 nt, Human
agaguccacccuggggucaggc

SEQ ID NO: 102003 - RNA, 22 nt, Human
agaguccaggugggcuggaggc

SEQ ID NO: 102004 - RNA, 22 nt, Human
agagucuggcgcugagaugaca

SEQ ID NO: 102005 - RNA, 22 nt, Human
agagucuggugcaugauaagca

SEQ ID NO: 102006 - RNA, 22 nt, Human
agagucugugcuuucaucagga

SEQ ID NO: 102007 - RNA, 22 nt, Human
agagucuuaucuuuuacaagua

SEQ ID NO: 102008 - RNA, 22 nt, Human
agagucuucuuuaggccauuua

SEQ ID NO: 102009 - RNA, 22 nt, Human
agagugaaaagcuagagcagua

SEQ ID NO: 102010 - RNA, 22 nt, Human
agagugauccuaauugauuugg

SEQ ID NO: 102011 - RNA, 22 nt, Human
agaguggcagcaagucagguag

SEQ ID NO: 102012 - RNA, 22 nt, Human
agaguggcaguaaaauagagca

SEQ ID NO: 102013 - RNA, 22 nt, Human
agaguggccucagagaaauaca

SEQ ID NO: 102014 - RNA, 22 nt, Human
agaguggggaagguguugagaa

SEQ ID NO: 102015 - RNA, 22 nt, Human
agaguggggacagggccugucc

SEQ ID NO: 102016 - RNA, 22 nt, Human
agaguggguuauaggcagacuu

SEQ ID NO: 102017 - RNA, 22 nt, Human
agagugugucuauggaaggggu

SEQ ID NO: 102018 - RNA, 22 nt, Human
agaguguguuccccaagaaaga

SEQ ID NO: 102019 - RNA, 22 nt, Human
agaguguuuuucugucaaggac

SEQ ID NO: 102020 - RNA, 22 nt, Human
agaguuaagacguacaugagug

SEQ ID NO: 102021 - RNA, 22 nt, Human
agaguuaagcuuugccuaaaga

SEQ ID NO: 102022 - RNA, 22 nt, Human
agaguuaaugcaggccaagccu

SEQ ID NO: 102023 - RNA, 21 nt, Human
agaguuacugucauccuaggu

SEQ ID NO: 102024 - RNA, 22 nt, Human
agaguucagaaagugcagguuu

SEQ ID NO: 102025 - RNA, 22 nt, Human
agaguucaguuguagccauauu

SEQ ID NO: 102026 - RNA, 22 nt, Human
agaguugcuauagaaggaugga

SEQ ID NO: 102027 - RNA, 22 nt, Human
agaguuggagaaauuaaaauuu

SEQ ID NO: 102028 - RNA, 22 nt, Human
agaguuguuguacaaacuaaau

SEQ ID NO: 102029 - RNA, 22 nt, Human
agaguuuaaacacugucacaga

SEQ ID NO: 102030 - RNA, 19 nt, Human
agaguuuaggucuaucagg

SEQ ID NO: 102031 - RNA, 22 nt, Human
agaguuuggagguguuccugga

SEQ ID NO: 102032 - RNA, 20 nt, Human
agaguuuggggucauuuugg

SEQ ID NO: 102033 - RNA, 22 nt, Human
agaguuuguacuuuacccugag

SEQ ID NO: 102034 - RNA, 23 nt, Human
agaguuuucuguuuucuguaggg

SEQ ID NO: 102035 - RNA, 22 nt, Human
agauaaaguccaaacuguguag

SEQ ID NO: 102036 - RNA, 22 nt, Human
agauaacauguugcagauucug

SEQ ID NO: 102037 - RNA, 22 nt, Human
agauaagucuuccauauuucua

SEQ ID NO: 102038 - RNA, 22 nt, Human
agauaauaagucugguaauaau

SEQ ID NO: 102039 - RNA, 22 nt, Human
agauaaugucaaauucugucug

SEQ ID NO: 102040 - RNA, 22 nt, Human
agauaauguucugauccauuuc

SEQ ID NO: 102041 - RNA, 22 nt, Human
agauaauuaugucaauuucuug

SEQ ID NO: 102042 - RNA, 22 nt, Human
agauacaacuguuuaaacauua

SEQ ID NO: 102043 - RNA, 22 nt, Human
agauacaagaggccugacgugu

SEQ ID NO: 102044 - RNA, 22 nt, Human
agauacacagagguaaagauga

SEQ ID NO: 102045 - RNA, 22 nt, Human
agauacaccggaaccugaggcu

SEQ ID NO: 102046 - RNA, 23 nt, Human
agauacagaucuacgugucaaug

SEQ ID NO: 102047 - RNA, 22 nt, Human
agauacauauagaaaacaucaa

SEQ ID NO: 102048 - RNA, 22 nt, Human
agauacaucuugaacuucuaga

SEQ ID NO: 102049 - RNA, 22 nt, Human
agauacaugucaagagacuuau

SEQ ID NO: 102050 - RNA, 22 nt, Human
agauacauugaguuuccuccug

SEQ ID NO: 102051 - RNA, 22 nt, Human
agauacauugcacgaugcagau

SEQ ID NO: 102052 - RNA, 22 nt, Human
agauacauuugugugcauguau

SEQ ID NO: 102053 - RNA, 22 nt, Human
agauacugaaauccaauggcca

SEQ ID NO: 102054 - RNA, 22 nt, Human
agauacugauucucaauggcuc

SEQ ID NO: 102055 - RNA, 22 nt, Human
agauauaguuguugagaagaac

SEQ ID NO: 102056 - RNA, 22 nt, Human
agauaucaccucuaggcuggug

SEQ ID NO: 102057 - RNA, 22 nt, Human
agauaucugcaauauaauuuaa

SEQ ID NO: 102058 - RNA, 22 nt, Human
agauaugacuagaagcucauuu

SEQ ID NO: 102059 - RNA, 22 nt, Human
agauauguuuguauauauuugu

SEQ ID NO: 102060 - RNA, 22 nt, Human
agauauuaggaggauucauaau

SEQ ID NO: 102061 - RNA, 22 nt, Human
agauauucugccuaacagguuu

SEQ ID NO: 102062 - RNA, 22 nt, Human
agaucaaugugucagaagagau

SEQ ID NO: 102063 - RNA, 22 nt, Human
agaucacauaauuuccugugac

SEQ ID NO: 102064 - RNA, 22 nt, Human
agaucacugguuacuuaaugaa

SEQ ID NO: 102065 - RNA, 22 nt, Human
agaucagaaauguaauggcagu

SEQ ID NO: 102066 - RNA, 22 nt, Human
agaucaguaagaggaagaaugg

SEQ ID NO: 102067 - RNA, 22 nt, Human
agaucauacuacuuguacuaaa

SEQ ID NO: 102068 - RNA, 22 nt, Human
agaucauaugaaaaauuucaag

SEQ ID NO: 102069 - RNA, 22 nt, Human
agaucauaugcaguaaugaacu

SEQ ID NO: 102070 - RNA, 22 nt, Human
agauccacucgaauccaggaau

SEQ ID NO: 102071 - RNA, 22 nt, Human
agauccagauccuuccugguug

SEQ ID NO: 102072 - RNA, 22 nt, Human
agauccaguuaauagcuucauu

SEQ ID NO: 102073 - RNA, 22 nt, Human
agauccaugugauuuggaguuc

SEQ ID NO: 102074 - RNA, 22 nt, Human
agauccugccaauggaagcagg

SEQ ID NO: 102075 - RNA, 21 nt, Human
agauccuguggcugagaagua

SEQ ID NO: 102076 - RNA, 22 nt, Human
agaucuauuagcaaacugccau

SEQ ID NO: 102077 - RNA, 22 nt, Human
agaucugaguggcugcauguaa

SEQ ID NO: 102078 - RNA, 20 nt, Human
agaucugccugcacccucuc

SEQ ID NO: 102079 - RNA, 22 nt, Human
agaucuggcccucagcuugauu

SEQ ID NO: 102080 - RNA, 22 nt, Human
agaucugguuggaguccugaca

SEQ ID NO: 102081 - RNA, 22 nt, Human
agaucuuguuaaaugcugccuc

SEQ ID NO: 102082 - RNA, 22 nt, Human
agaucuuuagaagauagaauca

SEQ ID NO: 102083 - RNA, 22 nt, Human
agaucuuuagugaagcuaaauc

SEQ ID NO: 102084 - RNA, 20 nt, Human
agaucuuuucuauagaagug

SEQ ID NO: 102085 - RNA, 22 nt, Human
agaugaaaagauaagcagcaau

SEQ ID NO: 102086 - RNA, 21 nt, Human
agcaacucugacuagaugagg

SEQ ID NO: 102087 - RNA, 22 nt, Human
agcaagaauauuucugccacug

SEQ ID NO: 102088 - RNA, 22 nt, Human
agcaagagcaugucggccuggu

SEQ ID NO: 102089 - RNA, 20 nt, Human
agcaagaguguaccuggcca

SEQ ID NO: 102090 - RNA, 22 nt, Human
agcaagaugcaaacauccgucc

SEQ ID NO: 102091 - RNA, 22 nt, Human
agcaagaugcauuauuucuuau

SEQ ID NO: 102092 - RNA, 22 nt, Human
agcaagauugaggcuuccucag

SEQ ID NO: 102093 - RNA, 22 nt, Human
agcaagauuuuccuugaauguu

SEQ ID NO: 102094 - RNA, 22 nt, Human
agcaagcacacuucaugugaac

SEQ ID NO: 102095 - RNA, 22 nt, Human
agcaagcagaaaugccauggca

SEQ ID NO: 102096 - RNA, 22 nt, Human
agcaagcuaccuagauagucua

SEQ ID NO: 102097 - RNA, 22 nt, Human
agcaaggaaacuauggagagau

SEQ ID NO: 102098 - RNA, 22 nt, Human
agcaaggaguagaacaagagug

SEQ ID NO: 102099 - RNA, 17 nt, Human
agcaaggcuuaaguaaa

SEQ ID NO: 102100 - RNA, 22 nt, Human
agcaaggucucccugcaccugg

SEQ ID NO: 102101 - RNA, 22 nt, Human
agcaaggugacaucaugcugag

SEQ ID NO: 102102 - RNA, 22 nt, Human
agcaagguggagaaggaugggu

SEQ ID NO: 102103 - RNA, 22 nt, Human
agcaauaaauguaaagguuaag

SEQ ID NO: 102104 - RNA, 22 nt, Human
agcaauaacagaaaacuuuccu

SEQ ID NO: 102105 - RNA, 22 nt, Human
agcaauauuuaaagguuugcaa

SEQ ID NO: 102106 - RNA, 22 nt, Human
agcaaucaccaccucuauauuu

SEQ ID NO: 102107 - RNA, 22 nt, Human
agcaaugauguuuucaaguagg

SEQ ID NO: 102108 - RNA, 22 nt, Human
agcaaugcuaccgggugauucg

SEQ ID NO: 102109 - RNA, 22 nt, Human
agcaauguaaacccugaaguug

SEQ ID NO: 102110 - RNA, 22 nt, Human
agcaauguggaccagcucaggg

SEQ ID NO: 102111 - RNA, 19 nt, Human
agcaauuaagacugugggc

SEQ ID NO: 102112 - RNA, 22 nt, Human
agcaauuuucccuuagucuuug

SEQ ID NO: 102113 - RNA, 22 nt, Human
agcacacaggccaccuccacuu

SEQ ID NO: 102114 - RNA, 22 nt, Human
agcacacugaccugaagccuug

SEQ ID NO: 102115 - RNA, 22 nt, Human
agcacagagauuauuuacaaga

SEQ ID NO: 102116 - RNA, 22 nt, Human
agcacagagcuaggaguggagg

SEQ ID NO: 102117 - RNA, 20 nt, Human
agcacagcgcgguguuccuu

SEQ ID NO: 102118 - RNA, 21 nt, Human
agcacagcuuuaagccaugug

SEQ ID NO: 102119 - RNA, 22 nt, Human
agaggcucagaggccugguccu

SEQ ID NO: 102120 - RNA, 22 nt, Human
agaggcuccucggugccucgug

SEQ ID NO: 102121 - RNA, 22 nt, Human
agaggcuccuucacucuggcac

SEQ ID NO: 102122 - RNA, 22 nt, Human
agaggcucuaauaccagcaugg

SEQ ID NO: 102123 - RNA, 22 nt, Human
agaggcucugccgccucaggua

SEQ ID NO: 102124 - RNA, 22 nt, Human
agaggcugaaugaugucaucau

SEQ ID NO: 102125 - RNA, 22 nt, Human
agaggcugagaaacccucuucu

SEQ ID NO: 102126 - RNA, 23 nt, Human
agaggcugcaggguauugagaau

SEQ ID NO: 102127 - RNA, 18 nt, Human
agaggcuggacaggggau

SEQ ID NO: 102128 - RNA, 22 nt, Human
agaggcugggaaggguccccgg

SEQ ID NO: 102129 - RNA, 22 nt, Human
agaggcuggguacgggccaccu

SEQ ID NO: 102130 - RNA, 22 nt, Human
agaggcugucccuugcuauucc

SEQ ID NO: 102131 - RNA, 22 nt, Human
agaggcugucucauauuuugua

SEQ ID NO: 102132 - RNA, 22 nt, Human
agaggcuuccugccaccugaga

SEQ ID NO: 102133 - RNA, 22 nt, Human
agaggcuuggaggugcaagguu

SEQ ID NO: 102134 - RNA, 22 nt, Human
agagggaaauccaggagugcuu

SEQ ID NO: 102135 - RNA, 22 nt, Human
agagggaacggaucccagcgcg

SEQ ID NO: 102136 - RNA, 18 nt, Human
agagggaaucaguuggau

SEQ ID NO: 102137 - RNA, 21 nt, Human
agagggagaguggcccuucca

SEQ ID NO: 102138 - RNA, 22 nt, Human
agagggaucacccuguuucugg

SEQ ID NO: 102139 - RNA, 22 nt, Human
agagggauggccccguaacuca

SEQ ID NO: 102140 - RNA, 22 nt, Human
agagggcagggcgguaaguccu

SEQ ID NO: 102141 - RNA, 22 nt, Human
agagggcagucucagauuggga

SEQ ID NO: 102142 - RNA, 22 nt, Human
agagggcccauguugggcugcu

SEQ ID NO: 102143 - RNA, 22 nt, Human
agagggcgcccaggcccacgcc

SEQ ID NO: 102144 - RNA, 22 nt, Human
agagggcuaagguuugggagau

SEQ ID NO: 102145 - RNA, 22 nt, Human
agagggcugccucagucagcua

SEQ ID NO: 102146 - RNA, 23 nt, Human
agaggggagcaucugcuggcuga

SEQ ID NO: 102147 - RNA, 22 nt, Human
agaggggaggcgaaccagaguc

SEQ ID NO: 102148 - RNA, 18 nt, Human
agaggggagguaagucug

SEQ ID NO: 102149 - RNA, 22 nt, Human
agaggggcgggaacucaaccuc

SEQ ID NO: 102150 - RNA, 22 nt, Human
agaggggcucaagcaguggucu

SEQ ID NO: 102151 - RNA, 22 nt, Human
agagggggaaaauagagguguu

SEQ ID NO: 102152 - RNA, 22 nt, Human
agagggggcagcggaccaguga

SEQ ID NO: 102153 - RNA, 22 nt, Human
agagggguuaagugcuaguccg

SEQ ID NO: 102154 - RNA, 22 nt, Human
agagggguuaugcuugacauuu

SEQ ID NO: 102155 - RNA, 22 nt, Human
agagggugaaugagauagaaaa

SEQ ID NO: 102156 - RNA, 22 nt, Human
agagguagaaaauaauggagag

SEQ ID NO: 102157 - RNA, 22 nt, Human
agagguagagguugcagugagc

SEQ ID NO: 102158 - RNA, 22 nt, Human
agagguauuagauuugcauagg

SEQ ID NO: 102159 - RNA, 22 nt, Human
agaggucagcugcaugccacau

SEQ ID NO: 102160 - RNA, 22 nt, Human
agaggucugagcaaucucaagc

SEQ ID NO: 102161 - RNA, 22 nt, Human
agaggugagucauuaccuagug

SEQ ID NO: 102162 - RNA, 22 nt, Human
agagguugggucugaggugaga

SEQ ID NO: 102163 - RNA, 20 nt, Human
agaguaacuggcacauaggg

SEQ ID NO: 102164 - RNA, 22 nt, Human
agaguaacuuuuaacuuuacgu

SEQ ID NO: 102165 - RNA, 21 nt, Human
agaguaauuccugcuggaaag

SEQ ID NO: 102166 - RNA, 22 nt, Human
agaguacacuguacacacaauu

SEQ ID NO: 102167 - RNA, 22 nt, Human
agagucagcuuaugacacaguc

SEQ ID NO: 102168 - RNA, 22 nt, Human
agagucaguaacauauauggua

SEQ ID NO: 102169 - RNA, 18 nt, Human
agaguccagggugaggug

SEQ ID NO: 102170 - RNA, 22 nt, Human
agagucccagggacacuccaga

SEQ ID NO: 102171 - RNA, 19 nt, Human
agagucggggggacauagg

SEQ ID NO: 102172 - RNA, 22 nt, Human
agagucugaaugcucagaguug

SEQ ID NO: 102173 - RNA, 22 nt, Human
agagucugaggcagcugcagcc

SEQ ID NO: 102174 - RNA, 22 nt, Human
agagucugcauuucuacaagcu

SEQ ID NO: 102175 - RNA, 22 nt, Human
agagucuguuacuuguccccua

SEQ ID NO: 102176 - RNA, 22 nt, Human
agagucuuagccucauuaguca

SEQ ID NO: 102177 - RNA, 22 nt, Human
agagucuucuggggccacuuuc

SEQ ID NO: 102178 - RNA, 22 nt, Human
agagucuuggcauucaugcguu

SEQ ID NO: 102179 - RNA, 22 nt, Human
agagucuuggcugagaacaaga

SEQ ID NO: 102180 - RNA, 22 nt, Human
agagugaagguugacacuucac

SEQ ID NO: 102181 - RNA, 22 nt, Human
agagugaaguuuuugaaaguga

SEQ ID NO: 102182 - RNA, 23 nt, Human
agagugcagagauaugcuugugu

SEQ ID NO: 102183 - RNA, 22 nt, Human
agagugcagaggucaaagaaca

SEQ ID NO: 102184 - RNA, 22 nt, Human
agagugcagauaagagaauguu

SEQ ID NO: 102185 - RNA, 22 nt, Human
agagugcucagaugcaugucuu

SEQ ID NO: 102186 - RNA, 22 nt, Human
agagugcuuaaagcuggcuuug

SEQ ID NO: 102187 - RNA, 17 nt, Human
agaguggcuaaggcuca

SEQ ID NO: 102188 - RNA, 22 nt, Human
agaguggcucugcugggcacag

SEQ ID NO: 102189 - RNA, 22 nt, Human
agaguggcuucuuugacaugcu

SEQ ID NO: 102190 - RNA, 22 nt, Human
agagugguggccguggugucac

SEQ ID NO: 102191 - RNA, 22 nt, Human
agaguguaauaagggcaagggc

SEQ ID NO: 102192 - RNA, 22 nt, Human
agaguguaccaaauauccuaca

SEQ ID NO: 102193 - RNA, 22 nt, Human
agagugucugguagcugcucug

SEQ ID NO: 102194 - RNA, 22 nt, Human
agaguguggaacuugaggagcu

SEQ ID NO: 102195 - RNA, 22 nt, Human
agcagcaauggaaagcaacaca

SEQ ID NO: 102196 - RNA, 22 nt, Human
agcagcaauuuucacugucaau

SEQ ID NO: 102197 - RNA, 22 nt, Human
agcagcacacgggagaaagaca

SEQ ID NO: 102198 - RNA, 22 nt, Human
agcagcacauggggcuggcaac

SEQ ID NO: 102199 - RNA, 21 nt, Human
agcagcagaucuggugagggc

SEQ ID NO: 102200 - RNA, 20 nt, Human
agcagcagauguuggaggug

SEQ ID NO: 102201 - RNA, 22 nt, Human
agcagcagauuauggucuacau

SEQ ID NO: 102202 - RNA, 22 nt, Human
agcagcagcucauucuuccugu

SEQ ID NO: 102203 - RNA, 22 nt, Human
agcagcagcucuguugcccuac

SEQ ID NO: 102204 - RNA, 22 nt, Human
agcagcaggagccgugggguga

SEQ ID NO: 102205 - RNA, 22 nt, Human
agcagcaggauuuucguuggga

SEQ ID NO: 102206 - RNA, 22 nt, Human
agcagcaggcuagggaacugcu

SEQ ID NO: 102207 - RNA, 22 nt, Human
agcagcagggugauagugccca

SEQ ID NO: 102208 - RNA, 22 nt, Human
agcagcaguacauauaagacua

SEQ ID NO: 102209 - RNA, 22 nt, Human
agcagcagugacagccgaaagc

SEQ ID NO: 102210 - RNA, 23 nt, Human
agcagcagugagaggugucuuac

SEQ ID NO: 102211 - RNA, 22 nt, Human
agcagcauagaagcugggagga

SEQ ID NO: 102212 - RNA, 22 nt, Human
agcagcaucaacccucccgugu

SEQ ID NO: 102213 - RNA, 22 nt, Human
agcagcaucucuuauugcagug

SEQ ID NO: 102214 - RNA, 22 nt, Human
agcagcaugaugacagagucuc

SEQ ID NO: 102215 - RNA, 22 nt, Human
agcagcauggaugggccucagc

SEQ ID NO: 102216 - RNA, 22 nt, Human
agcagcauuaugauauaucuua

SEQ ID NO: 102217 - RNA, 22 nt, Human
agcagcauucucugguaugggg

SEQ ID NO: 102218 - RNA, 20 nt, Human
agcagcauuguucuagagca

SEQ ID NO: 102219 - RNA, 22 nt, Human
agcagcauuuaaggauccaagu

SEQ ID NO: 102220 - RNA, 22 nt, Human
agcagccaaaugaagauuuuac

SEQ ID NO: 102221 - RNA, 22 nt, Human
agcagccaagguaaccugugcu

SEQ ID NO: 102222 - RNA, 22 nt, Human
agcagccacagcagaucugagu

SEQ ID NO: 102223 - RNA, 22 nt, Human
agcagccagaaauccagaggug

SEQ ID NO: 102224 - RNA, 22 nt, Human
agcagccagugggagugauaca

SEQ ID NO: 102225 - RNA, 23 nt, Human
agcagccauagggaagcaauaca

SEQ ID NO: 102226 - RNA, 21 nt, Human
agcagccauggaugguaugua

SEQ ID NO: 102227 - RNA, 22 nt, Human
agcagccauuuaaaaugaauug

SEQ ID NO: 102228 - RNA, 22 nt, Human
agcagccuuagguauugugauu

SEQ ID NO: 102229 - RNA, 22 nt, Human
agcagccuugcaggggucgcac

SEQ ID NO: 102230 - RNA, 22 nt, Human
agcagccuugugacuccggggu

SEQ ID NO: 102231 - RNA, 19 nt, Human
agcagcguuuaaaaaaugc

SEQ ID NO: 102232 - RNA, 22 nt, Human
agcagcuccccucaugcuccac

SEQ ID NO: 102233 - RNA, 22 nt, Human
agcagcucgggcuacagagggg

SEQ ID NO: 102234 - RNA, 22 nt, Human
agcagcucuguuuaccuggagg

SEQ ID NO: 102235 - RNA, 22 nt, Human
agcagcugauggggaaggaguu

SEQ ID NO: 102236 - RNA, 22 nt, Human
agcagcugccagagagaguucc

SEQ ID NO: 102237 - RNA, 22 nt, Human
agcagcugcuuuucuucauugg

SEQ ID NO: 102238 - RNA, 22 nt, Human
agcaauguugggguuagaggac

SEQ ID NO: 102239 - RNA, 22 nt, Human
agcaauuucccaucucuucugc

SEQ ID NO: 102240 - RNA, 22 nt, Human
agcaauuuuugauuuucagugu

SEQ ID NO: 102241 - RNA, 22 nt, Human
agcacaaaaacauucccagagu

SEQ ID NO: 102242 - RNA, 22 nt, Human
agcacaaaagcagccacagaug

SEQ ID NO: 102243 - RNA, 22 nt, Human
agcacaaauauaaaaaugucug

SEQ ID NO: 102244 - RNA, 22 nt, Human
agcacaaugugaaaagagcucu

SEQ ID NO: 102245 - RNA, 19 nt, Human
agcacagacaagaccagca

SEQ ID NO: 102246 - RNA, 22 nt, Human
agcacagagaaacuaagacauu

SEQ ID NO: 102247 - RNA, 19 nt, Human
agcacagagagucuauagc

SEQ ID NO: 102248 - RNA, 22 nt, Human
agcacagagguggaaguguaua

SEQ ID NO: 102249 - RNA, 22 nt, Human
agcacagauguacuuugagggg

SEQ ID NO: 102250 - RNA, 22 nt, Human
agcacagauuugucaacauaga

SEQ ID NO: 102251 - RNA, 22 nt, Human
agcacagcuucaccgagcccau

SEQ ID NO: 102252 - RNA, 22 nt, Human
agcacaggaacauggagauggg

SEQ ID NO: 102253 - RNA, 22 nt, Human
agcacaggaccaaggaagcugu

SEQ ID NO: 102254 - RNA, 22 nt, Human
agcacaguaaagcagugucaca

SEQ ID NO: 102255 - RNA, 22 nt, Human
agcacaguaauugauauuacug

SEQ ID NO: 102256 - RNA, 22 nt, Human
agcacauaccagaaccacaggu

SEQ ID NO: 102257 - RNA, 22 nt, Human
agcacaugacuuuuagucgagu

SEQ ID NO: 102258 - RNA, 22 nt, Human
agcacaugcacagugcuacacu

SEQ ID NO: 102259 - RNA, 22 nt, Human
agcacauuaguaucuaagaaca

SEQ ID NO: 102260 - RNA, 21 nt, Human
agcaccaaaugcaggcucugg

SEQ ID NO: 102261 - RNA, 16 nt, Human
agcaccagaucauauc

SEQ ID NO: 102262 - RNA, 23 nt, Human
agcaccaggaacagugugguccu

SEQ ID NO: 102263 - RNA, 22 nt, Human
agcaccaggcaccaaagggccu

SEQ ID NO: 102264 - RNA, 22 nt, Human
agcaccaguuucgucgugacaa

SEQ ID NO: 102265 - RNA, 22 nt, Human
agcacccuuugugagcauaagu

SEQ ID NO: 102266 - RNA, 22 nt, Human
agcaccuauagaaguuguguuc

SEQ ID NO: 102267 - RNA, 20 nt, Human
agcaccucccauaugcuaga

SEQ ID NO: 102268 - RNA, 22 nt, Human
agcaccuccgugcagcguggcc

SEQ ID NO: 102269 - RNA, 22 nt, Human
agcaccugccugcauuggcuau

SEQ ID NO: 102270 - RNA, 22 nt, Human
agcaccugggcuggaagacccc

SEQ ID NO: 102271 - RNA, 17 nt, Human
agcaccuguccaguccc

SEQ ID NO: 102272 - RNA, 19 nt, Human
agcaccugugagagccugg

SEQ ID NO: 102273 - RNA, 23 nt, Human
agcaccugugauuuccuagcucu

SEQ ID NO: 102274 - RNA, 22 nt, Human
agcaccugugcccugauggaga

SEQ ID NO: 102275 - RNA, 20 nt, Human
agcaccuguguagaagcauc

SEQ ID NO: 102276 - RNA, 17 nt, Human
agcacuaaggauaauac

SEQ ID NO: 102277 - RNA, 22 nt, Human
agcacuagacauguaagugagc

SEQ ID NO: 102278 - RNA, 22 nt, Human
agcacuagccuguuuugcugug

SEQ ID NO: 102279 - RNA, 22 nt, Human
agcacuccugucuuuccccuuu

SEQ ID NO: 102280 - RNA, 22 nt, Human
agcacuguaguuauagcuaaca

SEQ ID NO: 102281 - RNA, 22 nt, Human
agcacuuaaguuaauugaacug

SEQ ID NO: 102282 - RNA, 22 nt, Human
agcacuuaugugauuaggacag

SEQ ID NO: 102283 - RNA, 17 nt, Human
agcacuugaaaauuucu

SEQ ID NO: 102284 - RNA, 22 nt, Human
agcacuuuccuggcaaaugugg

SEQ ID NO: 102285 - RNA, 22 nt, Human
agcacuuugagcagaugaagga

SEQ ID NO: 102286 - RNA, 22 nt, Human
agcacuuugugcauuucugaag

SEQ ID NO: 102287 - RNA, 22 nt, Human
agcagaaaacuuucaugcucug

SEQ ID NO: 102288 - RNA, 22 nt, Human
agcagaaauagaagucaaugau

SEQ ID NO: 102289 - RNA, 22 nt, Human
agcagaacauuuucagggcugu

SEQ ID NO: 102290 - RNA, 21 nt, Human
agcagacagaugcacgcacac

SEQ ID NO: 102291 - RNA, 22 nt, Human
agcagacagguaggaggauaaa

SEQ ID NO: 102292 - RNA, 22 nt, Human
agcagaccaggagugcacaggu

SEQ ID NO: 102293 - RNA, 22 nt, Human
agcagacucuucuccuggggcu

SEQ ID NO: 102294 - RNA, 22 nt, Human
agcagagaagacacaggcuuca

SEQ ID NO: 102295 - RNA, 22 nt, Human
agcagagacaugaaauaugcuu

SEQ ID NO: 102296 - RNA, 22 nt, Human
agcagagaggagguggcccugu

SEQ ID NO: 102297 - RNA, 22 nt, Human
agcagagcaaagcucagaaaug

SEQ ID NO: 102298 - RNA, 22 nt, Human
agcagagccagaauuggaccag

SEQ ID NO: 102299 - RNA, 22 nt, Human
agcagagccaggucucucugua

SEQ ID NO: 102300 - RNA, 22 nt, Human
agcagagcggggccuccggaag

SEQ ID NO: 102301 - RNA, 22 nt, Human
agcagaggaggauuuaguuagg

SEQ ID NO: 102302 - RNA, 21 nt, Human
agcagaggcagaauguaugca

SEQ ID NO: 102303 - RNA, 22 nt, Human
agcagagguuuguuggaaaccu

SEQ ID NO: 102304 - RNA, 22 nt, Human
agcagggcuuugcagacuuggg

SEQ ID NO: 102305 - RNA, 22 nt, Human
agcagggggcauccuugcccuu

SEQ ID NO: 102306 - RNA, 22 nt, Human
agcagggggccacagucacagc

SEQ ID NO: 102307 - RNA, 22 nt, Human
agcagggguggaagguagcuuu

SEQ ID NO: 102308 - RNA, 22 nt, Human
agcaggguccugaggugaguca

SEQ ID NO: 102309 - RNA, 22 nt, Human
agcagggugugguggcccugga

SEQ ID NO: 102310 - RNA, 22 nt, Human
agcaggguucucaguuggugcu

SEQ ID NO: 102311 - RNA, 21 nt, Human
agcagguaggcauucauacug

SEQ ID NO: 102312 - RNA, 22 nt, Human
agcaggucgccgaagauagcuc

SEQ ID NO: 102313 - RNA, 21 nt, Human
agcaggucuacagguucauag

SEQ ID NO: 102314 - RNA, 22 nt, Human
agcaggucuugcucucaacagg

SEQ ID NO: 102315 - RNA, 22 nt, Human
agcaggugaugugagucuggaa

SEQ ID NO: 102316 - RNA, 22 nt, Human
agcaggugcauggcgagcgcgg

SEQ ID NO: 102317 - RNA, 21 nt, Human
agcaggugcuguuggaggaaa

SEQ ID NO: 102318 - RNA, 22 nt, Human
agcagguggaaaauucuuauca

SEQ ID NO: 102319 - RNA, 22 nt, Human
agcagguggccacgaggaggag

SEQ ID NO: 102320 - RNA, 22 nt, Human
agcagguggccuccugucuguc

SEQ ID NO: 102321 - RNA, 19 nt, Human
agcagguggguaagaaaau

SEQ ID NO: 102322 - RNA, 22 nt, Human
agcagguguagggcucuuugua

SEQ ID NO: 102323 - RNA, 22 nt, Human
agcaggugucggcgagggucuu

SEQ ID NO: 102324 - RNA, 22 nt, Human
agcagguuuaaacucuaaugca

SEQ ID NO: 102325 - RNA, 22 nt, Human
agcagucaguccugaaugaagg

SEQ ID NO: 102326 - RNA, 22 nt, Human
agcaguccaacugagguggcau

SEQ ID NO: 102327 - RNA, 22 nt, Human
agcaguccuucuuuagagagcc

SEQ ID NO: 102328 - RNA, 22 nt, Human
agcagugcccauucugcccccu

SEQ ID NO: 102329 - RNA, 22 nt, Human
agcaguggaccucagugcuauu

SEQ ID NO: 102330 - RNA, 22 nt, Human
agcaguggcauacauuuugagu

SEQ ID NO: 102331 - RNA, 22 nt, Human
agcagugggggaguguuaguuu

SEQ ID NO: 102332 - RNA, 22 nt, Human
agcagugggugacagagcugag

SEQ ID NO: 102333 - RNA, 22 nt, Human
agcagugggugguuuuugagca

SEQ ID NO: 102334 - RNA, 22 nt, Human
agcaguggugugaggagggcuc

SEQ ID NO: 102335 - RNA, 22 nt, Human
agcaguguggccuuagacccgg

SEQ ID NO: 102336 - RNA, 22 nt, Human
agcaguguucuaaucuggcuag

SEQ ID NO: 102337 - RNA, 22 nt, Human
agcaguguuggugggagcaucu

SEQ ID NO: 102338 - RNA, 20 nt, Human
agcaguguuucuugacucua

SEQ ID NO: 102339 - RNA, 22 nt, Human
agcaguuaccaaggaaccuggu

SEQ ID NO: 102340 - RNA, 22 nt, Human
agcaguuacgggccuaucuagg

SEQ ID NO: 102341 - RNA, 22 nt, Human
agcaguuaugugucucuugacu

SEQ ID NO: 102342 - RNA, 22 nt, Human
agcaguucauaaacauuuugag

SEQ ID NO: 102343 - RNA, 22 nt, Human
agcaguuguagucauggaaaau

SEQ ID NO: 102344 - RNA, 22 nt, Human
agcaguuuauccucauaaugga

SEQ ID NO: 102345 - RNA, 22 nt, Human
agcaguuuggcccgagcaguuc

SEQ ID NO: 102346 - RNA, 23 nt, Human
agcauaaaccucuguggcuuuag

SEQ ID NO: 102347 - RNA, 22 nt, Human
agcauacaaacauuugaggcag

SEQ ID NO: 102348 - RNA, 20 nt, Human
agcauacaucauaagaaacc

SEQ ID NO: 102349 - RNA, 19 nt, Human
agcauagacuucucaggaa

SEQ ID NO: 102350 - RNA, 22 nt, Human
agcauagauacauugagccaca

SEQ ID NO: 102351 - RNA, 22 nt, Human
agcauaggcggugguaggaccc

SEQ ID NO: 102352 - RNA, 22 nt, Human
agcaucaguacuaaucuggcca

SEQ ID NO: 102353 - RNA, 22 nt, Human
agcaucucugggagucauccgu

SEQ ID NO: 102354 - RNA, 22 nt, Human
agcaucuggcagaaagucagaa

SEQ ID NO: 102355 - RNA, 22 nt, Human
agcaucuggccugguuacuuuu

SEQ ID NO: 102356 - RNA, 23 nt, Human
agcaucuggcuuccccuggaugg

SEQ ID NO: 102357 - RNA, 22 nt, Human
agcaucuguuaagugccuucaa

SEQ ID NO: 102358 - RNA, 22 nt, Human
aggcgcauugaggcccuguugc

SEQ ID NO: 102359 - RNA, 22 nt, Human
aggcggagcucaguguguccaa

SEQ ID NO: 102360 - RNA, 22 nt, Human
aggcggcugguguccugcaggu

SEQ ID NO: 102361 - RNA, 22 nt, Human
aggcggguacccuggcucgaaa

SEQ ID NO: 102362 - RNA, 22 nt, Human
aggcggugcuguggacagugac

SEQ ID NO: 102363 - RNA, 22 nt, Human
aggcuaaggugggaggaucgcu

SEQ ID NO: 102364 - RNA, 22 nt, Human
aggcuacaaauaagcauguaau

SEQ ID NO: 102365 - RNA, 22 nt, Human
aggcuacauguugggguggaag

SEQ ID NO: 102366 - RNA, 22 nt, Human
aggcuagaggcuucuggcuuca

SEQ ID NO: 102367 - RNA, 22 nt, Human
aggcuagcugauugccuuagaa

SEQ ID NO: 102368 - RNA, 22 nt, Human
aggcuaggaaucaagccuuucu

SEQ ID NO: 102369 - RNA, 22 nt, Human
aggcuaggcaugugcuaccaca

SEQ ID NO: 102370 - RNA, 22 nt, Human
aggcuaggcugaugccucuucc

SEQ ID NO: 102371 - RNA, 22 nt, Human
aggcuagggccauggcugguga

SEQ ID NO: 102372 - RNA, 22 nt, Human
aggcuaugguggggccaguggc

SEQ ID NO: 102373 - RNA, 22 nt, Human
aggcuauuuccacucuucucau

SEQ ID NO: 102374 - RNA, 21 nt, Human
aggcucagagaucaaacagua

SEQ ID NO: 102375 - RNA, 22 nt, Human
aggcucagagaugaguaagcac

SEQ ID NO: 102376 - RNA, 22 nt, Human
aggcucagauucacauuugguu

SEQ ID NO: 102377 - RNA, 21 nt, Human
aggcucagcagguguauaaag

SEQ ID NO: 102378 - RNA, 22 nt, Human
aggcucagcccaagguggagag

SEQ ID NO: 102379 - RNA, 22 nt, Human
aggcucaggcaggaauggcgga

SEQ ID NO: 102380 - RNA, 22 nt, Human
aggcucagggacggggccccuu

SEQ ID NO: 102381 - RNA, 22 nt, Human
aggcucaggucucaggucuggc

SEQ ID NO: 102382 - RNA, 22 nt, Human
aggcucaguuugguuuccauug

SEQ ID NO: 102383 - RNA, 16 nt, Human
aggcuccaagagcugu

SEQ ID NO: 102384 - RNA, 23 nt, Human
aggcuccacaugggcacuuugca

SEQ ID NO: 102385 - RNA, 22 nt, Human
aggcuccacggcaggaugcugu

SEQ ID NO: 102386 - RNA, 22 nt, Human
aggcuccagcccaaggcugcag

SEQ ID NO: 102387 - RNA, 22 nt, Human
aggcuccaggcaaaauuucgga

SEQ ID NO: 102388 - RNA, 22 nt, Human
aggcuccagucuccucuggcag

SEQ ID NO: 102389 - RNA, 22 nt, Human
aggcuccauaccaucuccggag

SEQ ID NO: 102390 - RNA, 22 nt, Human
aggcuccaugcuaagcgauaug

SEQ ID NO: 102391 - RNA, 22 nt, Human
aggcucccaagcacugacccca

SEQ ID NO: 102392 - RNA, 22 nt, Human
aggcucccaugguguggcagga

SEQ ID NO: 102393 - RNA, 22 nt, Human
aggcuccugcaggccuuguagg

SEQ ID NO: 102394 - RNA, 22 nt, Human
aggcuccuugcucacaggcuca

SEQ ID NO: 102395 - RNA, 22 nt, Human
aggcuccuuuaccauucuggag

SEQ ID NO: 102396 - RNA, 22 nt, Human
aggcucgcaugcccugcaccac

SEQ ID NO: 102397 - RNA, 22 nt, Human
aggcucuauaccgcugggaguu

SEQ ID NO: 102398 - RNA, 22 nt, Human
aggcucucucugccagccgugc

SEQ ID NO: 102399 - RNA, 22 nt, Human
aggcucucucugccccugggac

SEQ ID NO: 102400 - RNA, 22 nt, Human
aggcucugagucuggugucugc

SEQ ID NO: 102401 - RNA, 22 nt, Human
aggcucuggacagugaggaguu

SEQ ID NO: 102402 - RNA, 22 nt, Human
aggcucuggaguuagccaggca

SEQ ID NO: 102403 - RNA, 22 nt, Human
aggcucuggcaacagcuggugu

SEQ ID NO: 102404 - RNA, 22 nt, Human
aggcucuggcuacuacagagcu

SEQ ID NO: 102405 - RNA, 22 nt, Human
aggcucugggaagcagugaguu

SEQ ID NO: 102406 - RNA, 22 nt, Human
aggcucuguuugcugugguacc

SEQ ID NO: 102407 - RNA, 22 nt, Human
aggcugaaaacgagauggcaau

SEQ ID NO: 102408 - RNA, 22 nt, Human
aggcugagagcaacgugucaga

SEQ ID NO: 102409 - RNA, 22 nt, Human
aggcugagcaaagggccuuacc

SEQ ID NO: 102410 - RNA, 22 nt, Human
aggcugagccacggggcuggcu

SEQ ID NO: 102411 - RNA, 22 nt, Human
aggcugaggagggauguugcuu

SEQ ID NO: 102412 - RNA, 22 nt, Human
aggcugagucaaguuaggguga

SEQ ID NO: 102413 - RNA, 23 nt, Human
aggaaacugaaggggcccucuau

SEQ ID NO: 102414 - RNA, 22 nt, Human
aggaaacugggccucagguuag

SEQ ID NO: 102415 - RNA, 22 nt, Human
aggaaacuggguaugguuauac

SEQ ID NO: 102416 - RNA, 22 nt, Human
aggaaacuuucuuuugcuucau

SEQ ID NO: 102417 - RNA, 22 nt, Human
aggaaagaaguacauucucaug

SEQ ID NO: 102418 - RNA, 18 nt, Human
aggaaagacgaagagggc

SEQ ID NO: 102419 - RNA, 22 nt, Human
aggaaaggauuggcuucucugu

SEQ ID NO: 102420 - RNA, 22 nt, Human
aggaaaggccuuugcauuuggu

SEQ ID NO: 102421 - RNA, 22 nt, Human
aggaaagggguagguguggacg

SEQ ID NO: 102422 - RNA, 22 nt, Human
aggaaaggugagagcggccgcg

SEQ ID NO: 102423 - RNA, 19 nt, Human
aggaaagguggccuuagca

SEQ ID NO: 102424 - RNA, 22 nt, Human
aggaaaguggugggaaaucagg

SEQ ID NO: 102425 - RNA, 22 nt, Human
aggaaauugagaaucagaauaa

SEQ ID NO: 102426 - RNA, 22 nt, Human
aggaacaagggagccuuuucuc

SEQ ID NO: 102427 - RNA, 22 nt, Human
aggaacacacugagcaacuccu

SEQ ID NO: 102428 - RNA, 22 nt, Human
aggaacacccccuuccuaccag

SEQ ID NO: 102429 - RNA, 23 nt, Human
aggaacugcuucauuuuugaaag

SEQ ID NO: 102430 - RNA, 22 nt, Human
aggaacuggugaaguguaguga

SEQ ID NO: 102431 - RNA, 22 nt, Human
aggaagacaaucugugugcugu

SEQ ID NO: 102432 - RNA, 18 nt, Human
aggaagaccaucagauau

SEQ ID NO: 102433 - RNA, 22 nt, Human
aggaagagcauucacaugguag

SEQ ID NO: 102434 - RNA, 22 nt, Human
aggaagauguguuuagcagguu

SEQ ID NO: 102435 - RNA, 22 nt, Human
aggaagcaaaaggcagggucua

SEQ ID NO: 102436 - RNA, 18 nt, Human
aggaagcaggaggaaggc

SEQ ID NO: 102437 - RNA, 22 nt, Human
aggaagccacgaguggcacggg

SEQ ID NO: 102438 - RNA, 22 nt, Human
aggaagccugggagguuuggga

SEQ ID NO: 102439 - RNA, 22 nt, Human
aggaagcgugggucuggcugga

SEQ ID NO: 102440 - RNA, 23 nt, Human
aggaagcuaaguguggcugcgga

SEQ ID NO: 102441 - RNA, 22 nt, Human
aggaagcucggagagggcaaau

SEQ ID NO: 102442 - RNA, 22 nt, Human
aggaagcucucugcuuuuaaga

SEQ ID NO: 102443 - RNA, 22 nt, Human
aggaagcugggguguucuucau

SEQ ID NO: 102444 - RNA, 22 nt, Human
aggaagcuuguguguauugguc

SEQ ID NO: 102445 - RNA, 20 nt, Human
aggaaggaaguuugcaugga

SEQ ID NO: 102446 - RNA, 22 nt, Human
aggaaggagggcagauauuaag

SEQ ID NO: 102447 - RNA, 23 nt, Human
aggaaggagguccuaacaguauc

SEQ ID NO: 102448 - RNA, 22 nt, Human
aggaaggcacauuguuggcuaa

SEQ ID NO: 102449 - RNA, 22 nt, Human
aggaaggcaugagguguucaca

SEQ ID NO: 102450 - RNA, 19 nt, Human
aggaaggcggcggcugccc

SEQ ID NO: 102451 - RNA, 22 nt, Human
aggaagggauacauaggauagu

SEQ ID NO: 102452 - RNA, 22 nt, Human
aggaaggggagaaguuaaagcu

SEQ ID NO: 102453 - RNA, 22 nt, Human
aggaaggguggauaguaacgug

SEQ ID NO: 102454 - RNA, 22 nt, Human
aggaagugaaagggaaggaguu

SEQ ID NO: 102455 - RNA, 22 nt, Human
aggaaguggauaaaauagcuuu

SEQ ID NO: 102456 - RNA, 22 nt, Human
aggaaucugggcccaacugugc

SEQ ID NO: 102457 - RNA, 22 nt, Human
aggaaugacaggccucccgcag

SEQ ID NO: 102458 - RNA, 22 nt, Human
aggaaugacauagaaaggggag

SEQ ID NO: 102459 - RNA, 23 nt, Human
aggaauggcuagaagugugaccc

SEQ ID NO: 102460 - RNA, 22 nt, Human
aggaauguauuauuccuucugg

SEQ ID NO: 102461 - RNA, 22 nt, Human
aggaaugucugagaaagaggca

SEQ ID NO: 102462 - RNA, 22 nt, Human
aggaaugugaccacuagacucu

SEQ ID NO: 102463 - RNA, 22 nt, Human
aggaauguggccuagggaggag

SEQ ID NO: 102464 - RNA, 22 nt, Human
aggaauguuaguucuguauaca

SEQ ID NO: 102465 - RNA, 22 nt, Human
aggaauguuuagaaugucagaa

SEQ ID NO: 102466 - RNA, 22 nt, Human
aggaauuaauaaccaguaagcc

SEQ ID NO: 102467 - RNA, 22 nt, Human
aggaauuauaguaguauuuguc

SEQ ID NO: 102468 - RNA, 22 nt, Human
aggaauuccugggaaggcacag

SEQ ID NO: 102469 - RNA, 22 nt, Human
aggaauugagauccuagguuuu

SEQ ID NO: 102470 - RNA, 22 nt, Human
aggaauugccuggggccuggga

SEQ ID NO: 102471 - RNA, 22 nt, Human
aggaauuuaagggcucagagag

SEQ ID NO: 102472 - RNA, 22 nt, Human
aggaauuugcuggaacacagau

SEQ ID NO: 102473 - RNA, 22 nt, Human
aggaauuuuacaucucagagag

SEQ ID NO: 102474 - RNA, 22 nt, Human
aggaauuuuucuagccggaguu

SEQ ID NO: 102475 - RNA, 22 nt, Human
aggacacacuguucucacguaa

SEQ ID NO: 102476 - RNA, 22 nt, Human
aggacacagguaagccagugga

SEQ ID NO: 102477 - RNA, 18 nt, Human
aggacacauucuucccuc

SEQ ID NO: 102478 - RNA, 22 nt, Human
aggacagagcccuaguuucaua

SEQ ID NO: 102479 - RNA, 22 nt, Human
aggacagagccugugcagaccg

SEQ ID NO: 102480 - RNA, 22 nt, Human
aggacagcaaccguuauucaca

SEQ ID NO: 102481 - RNA, 22 nt, Human
aggacagcaguuggugagguuc

SEQ ID NO: 102482 - RNA, 22 nt, Human
aggacagcauaugggaaccagu

SEQ ID NO: 102483 - RNA, 22 nt, Human
aggacagcccuugagagcacau

SEQ ID NO: 102484 - RNA, 22 nt, Human
aggacaggauuccuugccuugc

SEQ ID NO: 102485 - RNA, 22 nt, Human
aggacagguguagugggcucug

SEQ ID NO: 102486 - RNA, 22 nt, Human
aggacaguuaaaaauagauggc

SEQ ID NO: 102487 - RNA, 22 nt, Human
aggacauguuuguaucuuccuu

SEQ ID NO: 102488 - RNA, 22 nt, Human
aggaccagaccgaacuagcuaa

SEQ ID NO: 102489 - RNA, 22 nt, Human
aggaccagaggccagagucagc

SEQ ID NO: 102490 - RNA, 22 nt, Human
aggacccaagcacaguuccugg

SEQ ID NO: 102491 - RNA, 22 nt, Human
aggacccacgcacaggaacccc

SEQ ID NO: 102492 - RNA, 22 nt, Human
agguucaggcugcacaccugag

SEQ ID NO: 102493 - RNA, 22 nt, Human
agguucauucccaaauuuggag

SEQ ID NO: 102494 - RNA, 22 nt, Human
agguuccagguucgaaucccau

SEQ ID NO: 102495 - RNA, 22 nt, Human
agguuccaucaccugcagugga

SEQ ID NO: 102496 - RNA, 22 nt, Human
agguuccucuucauguucaaca

SEQ ID NO: 102497 - RNA, 21 nt, Human
agguuccugagucaugccuua

SEQ ID NO: 102498 - RNA, 20 nt, Human
agguuccuuuguggagaauu

SEQ ID NO: 102499 - RNA, 23 nt, Human
agguucucuuaucaucucugccc

SEQ ID NO: 102500 - RNA, 22 nt, Human
agguucugguaagcuguugcuu

SEQ ID NO: 102501 - RNA, 22 nt, Human
agguucuguuuggcugaggauc

SEQ ID NO: 102502 - RNA, 22 nt, Human
agguucuugacucuaccuucca

SEQ ID NO: 102503 - RNA, 22 nt, Human
agguugaacccccaagaccuau

SEQ ID NO: 102504 - RNA, 22 nt, Human
agguuggccaagcugcuggccc

SEQ ID NO: 102505 - RNA, 22 nt, Human
agguugggaugagugggugagc

SEQ ID NO: 102506 - RNA, 19 nt, Human
agguuuauggggaggguga

SEQ ID NO: 102507 - RNA, 22 nt, Human
agguuuauguuuggugcaggag

SEQ ID NO: 102508 - RNA, 22 nt, Human
agguuuccagcauggggaaggc

SEQ ID NO: 102509 - RNA, 22 nt, Human
agguuucuaugcuguuuaucuu

SEQ ID NO: 102510 - RNA, 22 nt, Human
agguuucuucuuaggaauaugu

SEQ ID NO: 102511 - RNA, 22 nt, Human
agguuuguuaaaccagauugcu

SEQ ID NO: 102512 - RNA, 22 nt, Human
agguuuucagcuguauccugag

SEQ ID NO: 102513 - RNA, 22 nt, Human
aguaaaauuguauuggaaaaca

SEQ ID NO: 102514 - RNA, 22 nt, Human
aguaaacacgugggguuucuuu

SEQ ID NO: 102515 - RNA, 22 nt, Human
aguaaacaguaggaacugagaa

SEQ ID NO: 102516 - RNA, 22 nt, Human
aguaaacauaauuuaccuguag

SEQ ID NO: 102517 - RNA, 22 nt, Human
aguaaacugugugccuuugacu

SEQ ID NO: 102518 - RNA, 22 nt, Human
aguaaagcauugucuucagagu

SEQ ID NO: 102519 - RNA, 18 nt, Human
aguaaagcuuauuacaug

SEQ ID NO: 102520 - RNA, 22 nt, Human
aguaaauaacagagaaaauggg

SEQ ID NO: 102521 - RNA, 22 nt, Human
aguaaauggcccaggguuauca

SEQ ID NO: 102522 - RNA, 22 nt, Human
cugagaaaccaggugcucugau

SEQ ID NO: 102523 - RNA, 22 nt, Human
cugagaacaucauucagauauu

SEQ ID NO: 102524 - RNA, 22 nt, Human
cugagaagcacugucugcaaga

SEQ ID NO: 102525 - RNA, 22 nt, Human
cugagaagguguggagaugggc

SEQ ID NO: 102526 - RNA, 22 nt, Human
cugagaauguuuucugauugau

SEQ ID NO: 102527 - RNA, 22 nt, Human
cugagacacggagaggcugugu

SEQ ID NO: 102528 - RNA, 22 nt, Human
cugagagaagagcgcaguuugu

SEQ ID NO: 102529 - RNA, 22 nt, Human
cugagagaguaaaguagaauua

SEQ ID NO: 102530 - RNA, 22 nt, Human
cugagagaucaagccacaggau

SEQ ID NO: 102531 - RNA, 19 nt, Human
cugagagaugcuucacaca

SEQ ID NO: 102532 - RNA, 22 nt, Human
cugagagaugguguguuuauaa

SEQ ID NO: 102533 - RNA, 22 nt, Human
cugagaggaacaucuuaugcuu

SEQ ID NO: 102534 - RNA, 22 nt, Human
cugagaggaugcugcaguggag

SEQ ID NO: 102535 - RNA, 22 nt, Human
cugagaggugacagcgugcugg

SEQ ID NO: 102536 - RNA, 22 nt, Human
cugagaggugcugguggcugca

SEQ ID NO: 102537 - RNA, 22 nt, Human
cugagaguucguuccacccucc

SEQ ID NO: 102538 - RNA, 22 nt, Human
cugagaucccaggcaggguggc

SEQ ID NO: 102539 - RNA, 22 nt, Human
cugagauggucucuuuguuacu

SEQ ID NO: 102540 - RNA, 23 nt, Human
cugagcaaagggggaagcugcuu

SEQ ID NO: 102541 - RNA, 22 nt, Human
cugagcaauuucagcucucacu

SEQ ID NO: 102542 - RNA, 22 nt, Human
cugagcagauguugcccagaag

SEQ ID NO: 102543 - RNA, 22 nt, Human
cugagcagccccaccagccauu

SEQ ID NO: 102544 - RNA, 22 nt, Human
cugagcagcguggggagcuggc

SEQ ID NO: 102545 - RNA, 22 nt, Human
cugagcagucuagccagguguu

SEQ ID NO: 102546 - RNA, 22 nt, Human
cugagcagugcuuugcaguggg

SEQ ID NO: 102547 - RNA, 17 nt, Human
cugagcauccgugcucu

SEQ ID NO: 102548 - RNA, 22 nt, Human
cugagcaugcuccucuuuucca

SEQ ID NO: 102549 - RNA, 22 nt, Human
cugagcauggccgguccauggu

SEQ ID NO: 102550 - RNA, 22 nt, Human
cugagccagggccacacaugga

SEQ ID NO: 102551 - RNA, 22 nt, Human
cugagcccauugggugcuguua

SEQ ID NO: 102552 - RNA, 22 nt, Human
cugagccccaucugaggugccc

SEQ ID NO: 102553 - RNA, 22 nt, Human
cugagcccguugugaauauucc

SEQ ID NO: 102554 - RNA, 22 nt, Human
cugagcccuggcucgccuggag

SEQ ID NO: 102555 - RNA, 22 nt, Human
cugagcccuugucuuccugguc

SEQ ID NO: 102556 - RNA, 22 nt, Human
cugagccuccauuucaucaggu

SEQ ID NO: 102557 - RNA, 22 nt, Human
cugagcgcaugguugcugggga

SEQ ID NO: 102558 - RNA, 22 nt, Human
cugagcucaagugaucugccca

SEQ ID NO: 102559 - RNA, 22 nt, Human
cugagcucagucccagcucuac

SEQ ID NO: 102560 - RNA, 22 nt, Human
cugagcugcuuugcuuuugggg

SEQ ID NO: 102561 - RNA, 22 nt, Human
cugagcugggcucucuugaggg

SEQ ID NO: 102562 - RNA, 22 nt, Human
cugagcugugcuaagugaaaug

SEQ ID NO: 102563 - RNA, 22 nt, Human
cucuuauacauauuuuuaggcg

SEQ ID NO: 102564 - RNA, 22 nt, Human
cucuuauagacacucuucuaua

SEQ ID NO: 102565 - RNA, 20 nt, Human
cucuuauugcauuaguuucu

SEQ ID NO: 102566 - RNA, 22 nt, Human
cucuucaaaagucuaauccuua

SEQ ID NO: 102567 - RNA, 20 nt, Human
cucuucaaauauuuuauucu

SEQ ID NO: 102568 - RNA, 22 nt, Human
cucuuccuacagucugcuaugc

SEQ ID NO: 102569 - RNA, 22 nt, Human
cucuuccuuucccuugagggug

SEQ ID NO: 102570 - RNA, 22 nt, Human
cucuucuuauggccguggcuga

SEQ ID NO: 102571 - RNA, 22 nt, Human
cucuucuugaaagaggaauuca

SEQ ID NO: 102572 - RNA, 22 nt, Human
cucuucuugcuagacugagugc

SEQ ID NO: 102573 - RNA, 22 nt, Human
cucuucuugucucugguuagaa

SEQ ID NO: 102574 - RNA, 22 nt, Human
cucuugaagggcaucugaguua

SEQ ID NO: 102575 - RNA, 21 nt, Human
cucuugcugaugucuccuuua

SEQ ID NO: 102576 - RNA, 22 nt, Human
cucuugcuugcaaguggggaua

SEQ ID NO: 102577 - RNA, 22 nt, Human
cucuuggccagacacagaggca

SEQ ID NO: 102578 - RNA, 22 nt, Human
cucuuguauuggaguuaguggg

SEQ ID NO: 102579 - RNA, 21 nt, Human
cucuugucuuugcucaguagc

SEQ ID NO: 102580 - RNA, 21 nt, Human
cucuugugucagagccagagg

SEQ ID NO: 102581 - RNA, 22 nt, Human
cucuuuacugcuacuacaaaga

SEQ ID NO: 102582 - RNA, 22 nt, Human
cucuuuagucacagggcuucau

SEQ ID NO: 102583 - RNA, 22 nt, Human
cucuuuagucuguguggagaag

SEQ ID NO: 102584 - RNA, 22 nt, Human
cucuuuaguggugaugaugcua

SEQ ID NO: 102585 - RNA, 21 nt, Human
cucuuuauauaguaaagauau

SEQ ID NO: 102586 - RNA, 22 nt, Human
cucuuuccaggguaccccaggu

SEQ ID NO: 102587 - RNA, 19 nt, Human
cucuuuccauuguauuugc

SEQ ID NO: 102588 - RNA, 22 nt, Human
cucuuucucauugucagcagaa

SEQ ID NO: 102589 - RNA, 18 nt, Human
cucuuucuuuggcacaaa

SEQ ID NO: 102590 - RNA, 22 nt, Human
cucuuuggcccccgaugauuca

SEQ ID NO: 102591 - RNA, 22 nt, Human
cucuuuggcguuggcagagcca

SEQ ID NO: 102592 - RNA, 22 nt, Human
cucuuugguuaaucacacagau

SEQ ID NO: 102593 - RNA, 22 nt, Human
cucuuuguaaagaagugguagg

SEQ ID NO: 102594 - RNA, 22 nt, Human
cucuuugucacucauacaguca

SEQ ID NO: 102595 - RNA, 22 nt, Human
cucuuugugcuauuaugauccu

SEQ ID NO: 102596 - RNA, 22 nt, Human
cucuuuguggaacggcaguguc

SEQ ID NO: 102597 - RNA, 21 nt, Human
cucuuuguggcaauguauuuu

SEQ ID NO: 102598 - RNA, 22 nt, Human
cucuuuucaaaccuguuuaugg

SEQ ID NO: 102599 - RNA, 20 nt, Human
cucuuuugacucuuugcaag

SEQ ID NO: 102600 - RNA, 22 nt, Human
cugaaaagugucuguugaguua

SEQ ID NO: 102601 - RNA, 22 nt, Human
cugaaacauugcaauaacaaag

SEQ ID NO: 102602 - RNA, 22 nt, Human
cugaaacuggucaauuaaucug

SEQ ID NO: 102603 - RNA, 22 nt, Human
cugaaagcaaaguaauucuuaa

SEQ ID NO: 102604 - RNA, 22 nt, Human
cugaaagcaaauacaugaaucu

SEQ ID NO: 102605 - RNA, 22 nt, Human
cugaaaggaauaaggcucuuug

SEQ ID NO: 102606 - RNA, 22 nt, Human
cugaaauaaaguugcuaaaauu

SEQ ID NO: 102607 - RNA, 23 nt, Human
cugaaauaccagaaaaucagugu

SEQ ID NO: 102608 - RNA, 22 nt, Human
cugaaaucaauuuugauuaucu

SEQ ID NO: 102609 - RNA, 22 nt, Human
cugaaaugguugccuggagaau

SEQ ID NO: 102610 - RNA, 22 nt, Human
cugaaauuauuguuuaaucaaa

SEQ ID NO: 102611 - RNA, 22 nt, Human
cugaaauugaugacagggaugg

SEQ ID NO: 102612 - RNA, 22 nt, Human
cugaacaacuugucauuccaag

SEQ ID NO: 102613 - RNA, 22 nt, Human
cugaacaucauagaguguacuu

SEQ ID NO: 102614 - RNA, 22 nt, Human
cugaagagaaagggagcucuuc

SEQ ID NO: 102615 - RNA, 22 nt, Human
cugaagagaaauguacacaugg

SEQ ID NO: 102616 - RNA, 22 nt, Human
cugaagagacuggagggggcau

SEQ ID NO: 102617 - RNA, 22 nt, Human
cugaagagcucuccuguccccu

SEQ ID NO: 102618 - RNA, 22 nt, Human
cugaagagguuguugaggaaua

SEQ ID NO: 102619 - RNA, 22 nt, Human
cugaagaugucugagaugcuca

SEQ ID NO: 102620 - RNA, 22 nt, Human
cugaagcaggaggggaggcgcu

SEQ ID NO: 102621 - RNA, 22 nt, Human
cugaagcauaucaugccaaguu

SEQ ID NO: 102622 - RNA, 22 nt, Human
cugaagccaguuugcugcccuu

SEQ ID NO: 102623 - RNA, 22 nt, Human
cugaagcuaggucaaaaaaggg

SEQ ID NO: 102624 - RNA, 22 nt, Human
cugaagcucuccaguuuguuuc

SEQ ID NO: 102625 - RNA, 22 nt, Human
cugaaggacacgugaggagcca

SEQ ID NO: 102626 - RNA, 18 nt, Human
cugaaggauccaggugua

SEQ ID NO: 102627 - RNA, 22 nt, Human
cugaaggauuuaguucuuugcu

SEQ ID NO: 102628 - RNA, 22 nt, Human
cugaaggcaccaggggugccag

SEQ ID NO: 102629 - RNA, 22 nt, Human
cugaagggucuggggcugugcc

SEQ ID NO: 102630 - RNA, 22 nt, Human
cugaaguggacaaauggagugg

SEQ ID NO: 102631 - RNA, 22 nt, Human
cugagggcaugaacauuccaua

SEQ ID NO: 102632 - RNA, 23 nt, Human
cugagggcuggucugaagucugc

SEQ ID NO: 102633 - RNA, 22 nt, Human
cugaggggaaaagucaggauga

SEQ ID NO: 102634 - RNA, 22 nt, Human
cugaggggauguuuuugacgga

SEQ ID NO: 102635 - RNA, 22 nt, Human
cugaggggucgugggagcccag

SEQ ID NO: 102636 - RNA, 23 nt, Human
cugagguaaaauauucugaagga

SEQ ID NO: 102637 - RNA, 22 nt, Human
cugagguacaagaaaggcaccu

SEQ ID NO: 102638 - RNA, 22 nt, Human
cugaggucaauuaaucaacaac

SEQ ID NO: 102639 - RNA, 22 nt, Human
cugaggucuagacaccccaggg

SEQ ID NO: 102640 - RNA, 22 nt, Human
cugaggucucuuuccauaguga

SEQ ID NO: 102641 - RNA, 19 nt, Human
cugaggugcaguaagaggc

SEQ ID NO: 102642 - RNA, 22 nt, Human
cugaggugcuagggucccugcu

SEQ ID NO: 102643 - RNA, 22 nt, Human
cugagguggcauccuagcucua

SEQ ID NO: 102644 - RNA, 22 nt, Human
cugaggugugaaaugguggcaa

SEQ ID NO: 102645 - RNA, 22 nt, Human
cugagguguugaugaccuaugc

SEQ ID NO: 102646 - RNA, 22 nt, Human
cugagguguuuaguaggggcgg

SEQ ID NO: 102647 - RNA, 22 nt, Human
cugagucauugcagauguggag

SEQ ID NO: 102648 - RNA, 22 nt, Human
cugagucucccggcaguggagg

SEQ ID NO: 102649 - RNA, 22 nt, Human
cugagucuguacguuagccaua

SEQ ID NO: 102650 - RNA, 22 nt, Human
cugaguggaacauaggaugaua

SEQ ID NO: 102651 - RNA, 22 nt, Human
cugaguucugcccaaggucugg

SEQ ID NO: 102652 - RNA, 22 nt, Human
cugauaauguccugcaguaaau

SEQ ID NO: 102653 - RNA, 22 nt, Human
cugauacaaugucugcuuuaua

SEQ ID NO: 102654 - RNA, 22 nt, Human
cugauaugaugggugauuuuca

SEQ ID NO: 102655 - RNA, 22 nt, Human
cugauauuaacaggcaagugag

SEQ ID NO: 102656 - RNA, 22 nt, Human
cugauauuauugaagcuggagu

SEQ ID NO: 102657 - RNA, 22 nt, Human
cugauauucauuauggagcucc

SEQ ID NO: 102658 - RNA, 22 nt, Human
cugauauucuauuuugcuugcu

SEQ ID NO: 102659 - RNA, 22 nt, Human
cugauccagagccaaccaaggc

SEQ ID NO: 102660 - RNA, 22 nt, Human
cugauccuccuuuaaguagcug

SEQ ID NO: 102661 - RNA, 22 nt, Human
cugaucuguccuccucagagcc

SEQ ID NO: 102662 - RNA, 22 nt, Human
cugaucuuaaguaacauuauuu

SEQ ID NO: 102663 - RNA, 22 nt, Human
cugaugagucggcugccaccag

SEQ ID NO: 102664 - RNA, 22 nt, Human
cugaugauagugauuuauugag

SEQ ID NO: 102665 - RNA, 22 nt, Human
cugauggagagugugauuuggg

SEQ ID NO: 102666 - RNA, 22 nt, Human
cugauggauggacagggguagu

SEQ ID NO: 102667 - RNA, 20 nt, Human
cugauguucgugcuuccugg

SEQ ID NO: 102668 - RNA, 22 nt, Human
cugauuaacugaacugaauuua

SEQ ID NO: 102669 - RNA, 22 nt, Human
cugauuagaguguuaaugagga

SEQ ID NO: 102670 - RNA, 22 nt, Human
cugauuccagagucuguguucu

SEQ ID NO: 102671 - RNA, 22 nt, Human
cugauucccuggugccuccguu

SEQ ID NO: 102672 - RNA, 22 nt, Human
cugauucucugacucuuggcuu

SEQ ID NO: 102673 - RNA, 22 nt, Human
cugauucuguaauuuuuccuaa

SEQ ID NO: 102674 - RNA, 22 nt, Human
cugauucuuucuucuugccagg

SEQ ID NO: 102675 - RNA, 23 nt, Human
cugauuugagcagaauaaaauag

SEQ ID NO: 102676 - RNA, 22 nt, Human
cugcaaaagucauugugguuuu

SEQ ID NO: 102677 - RNA, 22 nt, Human
cugcaaaggugggggaggagcu

SEQ ID NO: 102678 - RNA, 22 nt, Human
cugcaaaucccuacugggcaca

SEQ ID NO: 102679 - RNA, 21 nt, Human
cugcaaauguaaugaguuugg

SEQ ID NO: 102680 - RNA, 21 nt, Human
cugcaagacaugcuguucuug

SEQ ID NO: 102681 - RNA, 22 nt, Human
cugcaagcaaaucaacucuuug

SEQ ID NO: 102682 - RNA, 22 nt, Human
gcccucucggcauagcaggggc

SEQ ID NO: 102683 - RNA, 22 nt, Human
gcccucugaugcucaccgagga

SEQ ID NO: 102684 - RNA, 22 nt, Human
gcccugaaauauuuccacggcc

SEQ ID NO: 102685 - RNA, 22 nt, Human
gcccugaagcugaggguguuaa

SEQ ID NO: 102686 - RNA, 22 nt, Human
gcccugaaggcagagguggagc

SEQ ID NO: 102687 - RNA, 19 nt, Human
gcccugaccuuggcugcuc

SEQ ID NO: 102688 - RNA, 23 nt, Human
gcccugacugcggccucccacuc

SEQ ID NO: 102689 - RNA, 22 nt, Human
gcccugagaaugugugugucua

SEQ ID NO: 102690 - RNA, 22 nt, Human
gcccugaggauuugcauuuccu

SEQ ID NO: 102691 - RNA, 22 nt, Human
gcccugagggguggugucugua

SEQ ID NO: 102692 - RNA, 22 nt, Human
gcccugagggucuggguuccca

SEQ ID NO: 102693 - RNA, 22 nt, Human
gcccugagugccuguguaagaa

SEQ ID NO: 102694 - RNA, 19 nt, Human
gcccugcaggagguggggc

SEQ ID NO: 102695 - RNA, 22 nt, Human
gcccugcagugcggagguggca

SEQ ID NO: 102696 - RNA, 22 nt, Human
gcccugcuccuccgucccacga

SEQ ID NO: 102697 - RNA, 22 nt, Human
gcccugcugaguccggcucaga

SEQ ID NO: 102698 - RNA, 23 nt, Human
gcccugcugggaccuccugcuac

SEQ ID NO: 102699 - RNA, 22 nt, Human
gcccugcuucuggcaugcagaa

SEQ ID NO: 102700 - RNA, 17 nt, Human
gcccuggagccaggcua

SEQ ID NO: 102701 - RNA, 20 nt, Human
gcccuggagccuuguccugg

SEQ ID NO: 102702 - RNA, 22 nt, Human
gcccuggccuccuggaacaggc

SEQ ID NO: 102703 - RNA, 22 nt, Human
gcccugguuuuagaggagcagg

SEQ ID NO: 102704 - RNA, 22 nt, Human
gcccugugcgacucuagagguu

SEQ ID NO: 102705 - RNA, 22 nt, Human
gcccugugcucaugggaacauc

SEQ ID NO: 102706 - RNA, 22 nt, Human
gcccugugcuuggauggcagau

SEQ ID NO: 102707 - RNA, 22 nt, Human
gcccuuagguacuacuuauucu

SEQ ID NO: 102708 - RNA, 22 nt, Human
gcccuuagucagcacuuucacu

SEQ ID NO: 102709 - RNA, 22 nt, Human
gcccuuccuuagacagcaggau

SEQ ID NO: 102710 - RNA, 22 nt, Human
gcccuucugcuguuagguagcc

SEQ ID NO: 102711 - RNA, 22 nt, Human
gccggccagcaagcuucaggug

SEQ ID NO: 102712 - RNA, 22 nt, Human
gccgggaccaaggccacggagc

SEQ ID NO: 102713 - RNA, 22 nt, Human
gccggucuuaagcugacuguga

SEQ ID NO: 102714 - RNA, 22 nt, Human
gccguggccagagcccagucuc

SEQ ID NO: 102715 - RNA, 22 nt, Human
gccuaaggauaugcuuugcuug

SEQ ID NO: 102716 - RNA, 22 nt, Human
gccuacaguuggcugagggccu

SEQ ID NO: 102717 - RNA, 22 nt, Human
gccuacauuucccaguugaaug

SEQ ID NO: 102718 - RNA, 22 nt, Human
gccuacuuaguagcugggauua

SEQ ID NO: 102719 - RNA, 22 nt, Human
gccuagagagggagugccacac

SEQ ID NO: 102720 - RNA, 22 nt, Human
gccuagggugcucagggacgag

SEQ ID NO: 102721 - RNA, 22 nt, Human
gccuagguaccagcagagagcc

SEQ ID NO: 102722 - RNA, 22 nt, Human
gccuauggauuggagaaggagc

SEQ ID NO: 102723 - RNA, 22 nt, Human
gccucaaaaguguuguagaggg

SEQ ID NO: 102724 - RNA, 19 nt, Human
gccucacaggucucaggcc

SEQ ID NO: 102725 - RNA, 22 nt, Human
gccucagaaucauuuaucaucu

SEQ ID NO: 102726 - RNA, 22 nt, Human
gccucagacacugccugggugu

SEQ ID NO: 102727 - RNA, 23 nt, Human
gccucagagaaacagcugcacac

SEQ ID NO: 102728 - RNA, 22 nt, Human
gccucagagggcccuagggaca

SEQ ID NO: 102729 - RNA, 20 nt, Human
gccucagaggguuugaguuu

SEQ ID NO: 102730 - RNA, 22 nt, Human
gccucagccggcggacgccagg

SEQ ID NO: 102731 - RNA, 22 nt, Human
gccucaggccuauagcugcugu

SEQ ID NO: 102732 - RNA, 22 nt, Human
gccucagggauaggaugagcau

SEQ ID NO: 102733 - RNA, 20 nt, Human
gccuccacacucaccccuua

SEQ ID NO: 102734 - RNA, 22 nt, Human
gccuccaccgaacgcucucuug

SEQ ID NO: 102735 - RNA, 22 nt, Human
gccuccaguuuuuuucugaacu

SEQ ID NO: 102736 - RNA, 22 nt, Human
gccuccccugcaauuguccuug

SEQ ID NO: 102737 - RNA, 22 nt, Human
gccuccggaguugcagugucuu

SEQ ID NO: 102738 - RNA, 22 nt, Human
gccuccuaccacacccucaguc

SEQ ID NO: 102739 - RNA, 22 nt, Human
gccuccuauuaaaauuuaccuu

SEQ ID NO: 102740 - RNA, 22 nt, Human
cugucucaagacugcaggcacu

SEQ ID NO: 102741 - RNA, 23 nt, Human
cugucuccugggcuagguggaau

SEQ ID NO: 102742 - RNA, 22 nt, Human
cugucugcaggauaguacccuc

SEQ ID NO: 102743 - RNA, 22 nt, Human
cugucugcccuggccagagccc

SEQ ID NO: 102744 - RNA, 22 nt, Human
cugucuggauauaccuuggcca

SEQ ID NO: 102745 - RNA, 22 nt, Human
cugucuggaugugagucaccua

SEQ ID NO: 102746 - RNA, 22 nt, Human
cugucuggccggcccagcuucc

SEQ ID NO: 102747 - RNA, 22 nt, Human
cugucuggucaacaacugagug

SEQ ID NO: 102748 - RNA, 19 nt, Human
cugucugugcagagaugug

SEQ ID NO: 102749 - RNA, 22 nt, Human
cugucuguggucucaguaggcc

SEQ ID NO: 102750 - RNA, 22 nt, Human
cugucuguguggacacggcugc

SEQ ID NO: 102751 - RNA, 22 nt, Human
cugucuguuuuaccuucuccag

SEQ ID NO: 102752 - RNA, 20 nt, Human
cugucuugugggcuuccccu

SEQ ID NO: 102753 - RNA, 22 nt, Human
cugucuuuaguacaaaaaaugu

SEQ ID NO: 102754 - RNA, 22 nt, Human
cugucuuuucauacuuucccuc

SEQ ID NO: 102755 - RNA, 22 nt, Human
cugucuuuucuucucauugaug

SEQ ID NO: 102756 - RNA, 22 nt, Human
cugucuuuuuagagaguaggau

SEQ ID NO: 102757 - RNA, 22 nt, Human
cugugaaaucaaccuugagccc

SEQ ID NO: 102758 - RNA, 22 nt, Human
cugugaaaugcuuugcgauggu

SEQ ID NO: 102759 - RNA, 22 nt, Human
cugugaacaauagcagcaucuu

SEQ ID NO: 102760 - RNA, 22 nt, Human
cugugaauguugaauaaauccu

SEQ ID NO: 102761 - RNA, 22 nt, Human
cugugaauuaaguauuguuauc

SEQ ID NO: 102762 - RNA, 22 nt, Human
cugugaauugaauaugacuaug

SEQ ID NO: 102763 - RNA, 22 nt, Human
cugugacaaaagcagccugccu

SEQ ID NO: 102764 - RNA, 22 nt, Human
cugugacaguuucucagaauuu

SEQ ID NO: 102765 - RNA, 22 nt, Human
cugugacuggaaucuggcucuu

SEQ ID NO: 102766 - RNA, 22 nt, Human
cugugacuguguuggaugcaca

SEQ ID NO: 102767 - RNA, 22 nt, Human
cugugacuuuugcccuguacca

SEQ ID NO: 102768 - RNA, 22 nt, Human
cugugagaccugauuucuucau

SEQ ID NO: 102769 - RNA, 22 nt, Human
cugugagacugauagggaagag

SEQ ID NO: 102770 - RNA, 22 nt, Human
cugugagcuggguggccaggac

SEQ ID NO: 102771 - RNA, 22 nt, Human
cugugaggcccugggugcugga

SEQ ID NO: 102772 - RNA, 22 nt, Human
cugugaggccuuuggccagaua

SEQ ID NO: 102773 - RNA, 22 nt, Human
cugugauguuagcucuguguua

SEQ ID NO: 102774 - RNA, 21 nt, Human
cugugauguugccgggguagg

SEQ ID NO: 102775 - RNA, 22 nt, Human
cugugcaaaggccuuauguuuu

SEQ ID NO: 102776 - RNA, 22 nt, Human
cugugcacuaaccacacccacg

SEQ ID NO: 102777 - RNA, 22 nt, Human
cugugcacuucucuuuauuugu

SEQ ID NO: 102778 - RNA, 19 nt, Human
cugugcaggccgggcugag

SEQ ID NO: 102779 - RNA, 22 nt, Human
cugugcagugugggguaggccu

SEQ ID NO: 102780 - RNA, 22 nt, Human
cugugcauugucuugucuguag

SEQ ID NO: 102781 - RNA, 22 nt, Human
cugugcauuguugaguguuuag

SEQ ID NO: 102782 - RNA, 22 nt, Human
cugugccaccugagggacucua

SEQ ID NO: 102783 - RNA, 22 nt, Human
cugugccagagggugaccaagg

SEQ ID NO: 102784 - RNA, 22 nt, Human
cugugcccaccuggcucugagg

SEQ ID NO: 102785 - RNA, 22 nt, Human
cugugcccaggcuggagugcag

SEQ ID NO: 102786 - RNA, 23 nt, Human
cugugcccggggcuccaccugau

SEQ ID NO: 102787 - RNA, 19 nt, Human
cugugcccuaugacuugua

SEQ ID NO: 102788 - RNA, 22 nt, Human
cugugcccuggccaggccucuc

SEQ ID NO: 102789 - RNA, 22 nt, Human
cugugcccuuucgcugcacugu

SEQ ID NO: 102790 - RNA, 20 nt, Human
cugugccuaaaccuccgggu

SEQ ID NO: 102791 - RNA, 20 nt, Human
cugugccuccugcuaguccu

SEQ ID NO: 102792 - RNA, 22 nt, Human
cugugccugcaggccacaucaa

SEQ ID NO: 102793 - RNA, 22 nt, Human
cugugccuggggggcagagcug

SEQ ID NO: 102794 - RNA, 22 nt, Human
cugugccuuaguauucucauuu

SEQ ID NO: 102795 - RNA, 22 nt, Human
cugugccuuggcgcugugccac

SEQ ID NO: 102796 - RNA, 22 nt, Human
cugugcguugugaaauguuuag

SEQ ID NO: 102797 - RNA, 20 nt, Human
cugugcuccggguuccugga

SEQ ID NO: 102798 - RNA, 22 nt, Human
cugugcucugagcgugggguug

SEQ ID NO: 102799 - RNA, 22 nt, Human
cugugcugauucagcacaggcc

SEQ ID NO: 102800 - RNA, 22 nt, Human
cugugcugcuagaccuggauuc

SEQ ID NO: 102801 - RNA, 22 nt, Human
cugugcugucuugggagccuua

SEQ ID NO: 102802 - RNA, 22 nt, Human
cugugcuucgcaacuccaaggu

SEQ ID NO: 102803 - RNA, 22 nt, Human
cugugcuugcggguguggagcc

SEQ ID NO: 102804 - RNA, 20 nt, Human
cugugcuuuggaaccuggaa

SEQ ID NO: 102805 - RNA, 22 nt, Human
cuguggaacuuagugggagaca

SEQ ID NO: 102806 - RNA, 22 nt, Human
cuguggaaggacuuagcgauac

SEQ ID NO: 102807 - RNA, 21 nt, Human
cuguggacaggcuggggcaug

SEQ ID NO: 102808 - RNA, 22 nt, Human
cuguggaguguagaugcugggu

SEQ ID NO: 102809 - RNA, 22 nt, Human
cuguggaguuccaucaggggag

SEQ ID NO: 102810 - RNA, 22 nt, Human
cuguggauuuacuugagaagcu

SEQ ID NO: 102811 - RNA, 22 nt, Human
cuguggcccugugaucuggcac

SEQ ID NO: 102812 - RNA, 22 nt, Human
cuguggccuuggaccagcaucu

SEQ ID NO: 102813 - RNA, 22 nt, Human
cuguggcuaauaauuaguauuu

SEQ ID NO: 102814 - RNA, 22 nt, Human
cuguggcucaggccuguaagcc

SEQ ID NO: 102815 - RNA, 22 nt, Human
cuguggcucauaucuguaaucu

SEQ ID NO: 102816 - RNA, 20 nt, Human
cuguggcucaugcaucugcc

SEQ ID NO: 102817 - RNA, 22 nt, Human
cuguggcucucugcaggguccc

SEQ ID NO: 102818 - RNA, 22 nt, Human
cuguggcugaacucugaagagg

SEQ ID NO: 102819 - RNA, 23 nt, Human
cuguggcugaguccuguuggagu

SEQ ID NO: 102820 - RNA, 22 nt, Human
cuguggcugcgcccugggggag

SEQ ID NO: 102821 - RNA, 22 nt, Human
cuguggcuucugggucaguuca

SEQ ID NO: 102822 - RNA, 22 nt, Human
cuguggcuuucucugccuccuu

SEQ ID NO: 102823 - RNA, 22 nt, Human
cuguggcuuuuccggggagccu

SEQ ID NO: 102824 - RNA, 22 nt, Human
cugugggagcacaugacagaua

SEQ ID NO: 102825 - RNA, 22 nt, Human
cugugggagggugagagaacca

SEQ ID NO: 102826 - RNA, 22 nt, Human
cugugggaugggaccucagcug

SEQ ID NO: 102827 - RNA, 22 nt, Human
cugugggcgccugucagccuca

SEQ ID NO: 102828 - RNA, 22 nt, Human
cugugggcucccagcuucucuc

SEQ ID NO: 102829 - RNA, 22 nt, Human
cugugggcugaaagugcucccg

SEQ ID NO: 102830 - RNA, 22 nt, Human
cuguggggaaaggguccugcuc

SEQ ID NO: 102831 - RNA, 22 nt, Human
cuguggggccaaauucuccucu

SEQ ID NO: 102832 - RNA, 22 nt, Human
cuucaaggaagccacguuggga

SEQ ID NO: 102833 - RNA, 22 nt, Human
cuucaaguaauucugauggcua

SEQ ID NO: 102834 - RNA, 20 nt, Human
cuucaaguuaugguuggcaa

SEQ ID NO: 102835 - RNA, 22 nt, Human
cuucaauaggaacugcauggca

SEQ ID NO: 102836 - RNA, 22 nt, Human
cuucacagaauaaacucauuau

SEQ ID NO: 102837 - RNA, 22 nt, Human
cuucacagaugcugagagggcu

SEQ ID NO: 102838 - RNA, 22 nt, Human
cuucacagcaugagcuuuggag

SEQ ID NO: 102839 - RNA, 22 nt, Human
cuucacaggcaagucuguuuuu

SEQ ID NO: 102840 - RNA, 23 nt, Human
cuucacagguucaggggauuaag

SEQ ID NO: 102841 - RNA, 22 nt, Human
cuucacagucacccugcugugu

SEQ ID NO: 102842 - RNA, 22 nt, Human
cuucacagucuuuauuuccucc

SEQ ID NO: 102843 - RNA, 19 nt, Human
cuucacaucugugagggga

SEQ ID NO: 102844 - RNA, 22 nt, Human
cuucacugaguagucuagacuc

SEQ ID NO: 102845 - RNA, 22 nt, Human
cuucagaaacuaguaacagcua

SEQ ID NO: 102846 - RNA, 22 nt, Human
cuucagaaccagccagaagagg

SEQ ID NO: 102847 - RNA, 22 nt, Human
cuucagaauccagaaucagaau

SEQ ID NO: 102848 - RNA, 22 nt, Human
cuucagaaugggacuguguuug

SEQ ID NO: 102849 - RNA, 22 nt, Human
cugggccuugagaaucauguuu

SEQ ID NO: 102850 - RNA, 22 nt, Human
cugggccuugaucacacaggug

SEQ ID NO: 102851 - RNA, 22 nt, Human
cugggccuugccaggggugucu

SEQ ID NO: 102852 - RNA, 22 nt, Human
cugggccuuugggaguucggug

SEQ ID NO: 102853 - RNA, 18 nt, Human
cugggccuuuguauuuuu

SEQ ID NO: 102854 - RNA, 22 nt, Human
cugggcgcguccccugaggcgg

SEQ ID NO: 102855 - RNA, 22 nt, Human
cugggcuaauuaagcacagcug

SEQ ID NO: 102856 - RNA, 20 nt, Human
cugggcucaagugauccucc

SEQ ID NO: 102857 - RNA, 22 nt, Human
cugggcucagaugagaggaagg

SEQ ID NO: 102858 - RNA, 22 nt, Human
cugggcucuaggaaccauuccu

SEQ ID NO: 102859 - RNA, 22 nt, Human
cugggcucuucucacccuguuu

SEQ ID NO: 102860 - RNA, 19 nt, Human
cugggcugaggucugccuu

SEQ ID NO: 102861 - RNA, 22 nt, Human
cugggcugauuuagucacguuu

SEQ ID NO: 102862 - RNA, 22 nt, Human
cugggcugcaguuccugguccu

SEQ ID NO: 102863 - RNA, 22 nt, Human
cugggcugcgguucucugaagc

SEQ ID NO: 102864 - RNA, 22 nt, Human
cugggcugcuguccacuagggu

SEQ ID NO: 102865 - RNA, 21 nt, Human
cugggcuggcaggcauuaccu

SEQ ID NO: 102866 - RNA, 22 nt, Human
cugggcuggguuuacccucuuc

SEQ ID NO: 102867 - RNA, 22 nt, Human
cugggcuugaguuccugcucgu

SEQ ID NO: 102868 - RNA, 22 nt, Human
cugggcuuugaagccaggcugc

SEQ ID NO: 102869 - RNA, 22 nt, Human
cuggggaacaauuugccacacu

SEQ ID NO: 102870 - RNA, 22 nt, Human
cuggggaacgcagcgagcagcg

SEQ ID NO: 102871 - RNA, 22 nt, Human
cuggggaccgagcaagcucugg

SEQ ID NO: 102872 - RNA, 22 nt, Human
cuggggacuuugguucuccaug

SEQ ID NO: 102873 - RNA, 22 nt, Human
cuggggagaagcgacucggcug

SEQ ID NO: 102874 - RNA, 20 nt, Human
cuggggagcugcucccacga

SEQ ID NO: 102875 - RNA, 22 nt, Human
cuggggaggcagggcugccccu

SEQ ID NO: 102876 - RNA, 22 nt, Human
cuggggagugaagguaauuaca

SEQ ID NO: 102877 - RNA, 22 nt, Human
cuggggaugggaccuggcauaa

SEQ ID NO: 102878 - RNA, 17 nt, Human
cuggggaugugggacuc

SEQ ID NO: 102879 - RNA, 22 nt, Human
cuggggccagugaggaggcuuu

SEQ ID NO: 102880 - RNA, 22 nt, Human
cuggggcucacuccagcccugg

SEQ ID NO: 102881 - RNA, 22 nt, Human
cuggggcugcgguggaggagcc

SEQ ID NO: 102882 - RNA, 19 nt, Human
cugggggugcucacgcucu

SEQ ID NO: 102883 - RNA, 22 nt, Human
cuggggucucaauucuagcggg

SEQ ID NO: 102884 - RNA, 22 nt, Human
cugggucagucugucccuaggg

SEQ ID NO: 102885 - RNA, 22 nt, Human
cuggguccugcucucccuaaga

SEQ ID NO: 102886 - RNA, 22 nt, Human
cugggucucaggaguucugagg

SEQ ID NO: 102887 - RNA, 22 nt, Human
cugggucuuuuucuuccauuga

SEQ ID NO: 102888 - RNA, 22 nt, Human
cugggugaguugaugaaggaga

SEQ ID NO: 102889 - RNA, 22 nt, Human
cugggugauuccuguccaggca

SEQ ID NO: 102890 - RNA, 22 nt, Human
cuggguggagccuggucaucug

SEQ ID NO: 102891 - RNA, 22 nt, Human
cugggugguucuaacuguugau

SEQ ID NO: 102892 - RNA, 22 nt, Human
cuggguuccauguagccaagag

SEQ ID NO: 102893 - RNA, 22 nt, Human
cuggguucuauuuuuggcuuca

SEQ ID NO: 102894 - RNA, 22 nt, Human
cuggguucucugcuuagggccu

SEQ ID NO: 102895 - RNA, 22 nt, Human
cuggguugcccugggccuguga

SEQ ID NO: 102896 - RNA, 22 nt, Human
cuggguuuagggucuccccuug

SEQ ID NO: 102897 - RNA, 22 nt, Human
cuggguuuuauuacagugagcu

SEQ ID NO: 102898 - RNA, 22 nt, Human
cugguagcagugaagcuguuga

SEQ ID NO: 102899 - RNA, 22 nt, Human
cuggucaccagguagcauugua

SEQ ID NO: 102900 - RNA, 22 nt, Human
cuggucaccuccuucccagcua

SEQ ID NO: 102901 - RNA, 22 nt, Human
cuggucacuggucucauccagc

SEQ ID NO: 102902 - RNA, 23 nt, Human
cuggucagaggcugcuggaaggg

SEQ ID NO: 102903 - RNA, 22 nt, Human
cuggucaggaagguggggacag

SEQ ID NO: 102904 - RNA, 22 nt, Human
cuggucaggggauggggcucag

SEQ ID NO: 102905 - RNA, 22 nt, Human
cugguccaguggaugcugaggg

SEQ ID NO: 102906 - RNA, 22 nt, Human
cuggucccagcagagcucugag

SEQ ID NO: 102907 - RNA, 22 nt, Human
cugguccuccuugccuucagau

SEQ ID NO: 102908 - RNA, 22 nt, Human
cuggucugagggcucuugaggc

SEQ ID NO: 102909 - RNA, 22 nt, Human
cuggucugcgggaaggcguggg

SEQ ID NO: 102910 - RNA, 22 nt, Human
cuggucugggaugagggaugua

SEQ ID NO: 102911 - RNA, 16 nt, Human
cuggucuugcugccga

SEQ ID NO: 102912 - RNA, 22 nt, Human
cuggugaauggauaaacuguug

SEQ ID NO: 102913 - RNA, 22 nt, Human
cuggugagacucagggaugcuu

SEQ ID NO: 102914 - RNA, 22 nt, Human
cuggugauuacaaugaugacaa

SEQ ID NO: 102915 - RNA, 22 nt, Human
cuggugcacauucgcucucaua

SEQ ID NO: 102916 - RNA, 22 nt, Human
cuggugcuggagccuagucccu

SEQ ID NO: 102917 - RNA, 22 nt, Human
cugguggaagccugggcucaga

SEQ ID NO: 102918 - RNA, 22 nt, Human
cugguggaccagccuccccagc

SEQ ID NO: 102919 - RNA, 22 nt, Human
cugguggggaguccuggucucc

SEQ ID NO: 102920 - RNA, 22 nt, Human
cugguggguagagggcaucagg

SEQ ID NO: 102921 - RNA, 21 nt, Human
cugguguagcacucaggugcu

SEQ ID NO: 102922 - RNA, 22 nt, Human
cuggugucuacuacaugguuga

SEQ ID NO: 102923 - RNA, 22 nt, Human
cuggugucugcucccucacagc

SEQ ID NO: 102924 - RNA, 22 nt, Human
cugguguuguccgggugagagu

SEQ ID NO: 102925 - RNA, 22 nt, Human
cugguguuuaucugacugccua

SEQ ID NO: 102926 - RNA, 22 nt, Human
cugguuaaaugaaaaaguauua

SEQ ID NO: 102927 - RNA, 22 nt, Human
cugguucaauggggcugagccc

SEQ ID NO: 102928 - RNA, 22 nt, Human
cugguucagugaaaggcauggg

SEQ ID NO: 102929 - RNA, 22 nt, Human
cugguuggugccacaugguggc

SEQ ID NO: 102930 - RNA, 22 nt, Human
cugguuuacccaagauuugcug

SEQ ID NO: 102931 - RNA, 22 nt, Human
cugguuuagugaaauaggccag

SEQ ID NO: 102932 - RNA, 22 nt, Human
cugguuuauaaaucuguggcca

SEQ ID NO: 102933 - RNA, 22 nt, Human
cugguuuaugagggaagggaug

SEQ ID NO: 102934 - RNA, 17 nt, Human
cugguuuaugggcagug

SEQ ID NO: 102935 - RNA, 22 nt, Human
cugguuuuauguuauagaugga

SEQ ID NO: 102936 - RNA, 22 nt, Human
cugguuuuccaauguuuugacu

SEQ ID NO: 102937 - RNA, 22 nt, Human
cuguaaaacacuguaguaucug

SEQ ID NO: 102938 - RNA, 22 nt, Human
cuguaaaacugcuuaaguaugc

SEQ ID NO: 102939 - RNA, 22 nt, Human
cuguaaacuucuggaggucaag

SEQ ID NO: 102940 - RNA, 22 nt, Human
cuguaaagaucacagagcuggu

SEQ ID NO: 102941 - RNA, 22 nt, Human
cuguaaauggaacuauguagua

SEQ ID NO: 102942 - RNA, 22 nt, Human
cuguaauucacuagggucagcg

SEQ ID NO: 102943 - RNA, 22 nt, Human
cuguacaaaguagcugcuggga

SEQ ID NO: 102944 - RNA, 22 nt, Human
cuguacaaauggcaguugaguu

SEQ ID NO: 102945 - RNA, 22 nt, Human
cuguacaaguccuucaucaggg

SEQ ID NO: 102946 - RNA, 22 nt, Human
cuguacagaagcuagagcaaau

SEQ ID NO: 102947 - RNA, 22 nt, Human
cuguacagauugcacacgggga

SEQ ID NO: 102948 - RNA, 22 nt, Human
cuguacagcaaguucaccuugg

SEQ ID NO: 102949 - RNA, 22 nt, Human
cuguacauaugucuccagagug

SEQ ID NO: 102950 - RNA, 20 nt, Human
cuguacaucaccaaggugac

SEQ ID NO: 102951 - RNA, 22 nt, Human
cuguacaucccgagagccagua

SEQ ID NO: 102952 - RNA, 22 nt, Human
cuguggguggcugugccccagg

SEQ ID NO: 102953 - RNA, 22 nt, Human
cuguggucacuguuggggaaug

SEQ ID NO: 102954 - RNA, 22 nt, Human
cugugguggcacagcgggcugg

SEQ ID NO: 102955 - RNA, 22 nt, Human
cuguguaugacuccagagggua

SEQ ID NO: 102956 - RNA, 22 nt, Human
cugugucacucacugcguuaug

SEQ ID NO: 102957 - RNA, 22 nt, Human
cugugucccagccaggauaaug

SEQ ID NO: 102958 - RNA, 22 nt, Human
cuuuccaggcugaguuugcuug

SEQ ID NO: 102959 - RNA, 22 nt, Human
cuuuccaguuucuaaguacagu

SEQ ID NO: 102960 - RNA, 22 nt, Human
cuuucccagaguaguugaugcu

SEQ ID NO: 102961 - RNA, 22 nt, Human
cuuuccccaagcaccacagugc

SEQ ID NO: 102962 - RNA, 22 nt, Human
cuuuccucuggcacugucuggu

SEQ ID NO: 102963 - RNA, 22 nt, Human
cuuucuaguaggaaguagauca

SEQ ID NO: 102964 - RNA, 22 nt, Human
cuuucucaguguuaauuacuuu

SEQ ID NO: 102965 - RNA, 22 nt, Human
cuuucucuuacccaaggaucug

SEQ ID NO: 102966 - RNA, 22 nt, Human
cuuucucuugagcaagagcugu

SEQ ID NO: 102967 - RNA, 22 nt, Human
cuuucugaggagacgggcuuug

SEQ ID NO: 102968 - RNA, 22 nt, Human
cuuucugauguaaggaacuagg

SEQ ID NO: 102969 - RNA, 22 nt, Human
cuuucuggacaagacagaggga

SEQ ID NO: 102970 - RNA, 22 nt, Human
cuuucuggcacagccgcgggau

SEQ ID NO: 102971 - RNA, 22 nt, Human
cuuucuucaaccucauucugca

SEQ ID NO: 102972 - RNA, 22 nt, Human
cuuucuucaagcuggucucaau

SEQ ID NO: 102973 - RNA, 22 nt, Human
cuuucuucaucaagugccacgu

SEQ ID NO: 102974 - RNA, 22 nt, Human
cuuucuugcauaauuugaaacc

SEQ ID NO: 102975 - RNA, 22 nt, Human
cuuucuugguccugaagauggc

SEQ ID NO: 102976 - RNA, 22 nt, Human
cuuugaaaacacacgaauagac

SEQ ID NO: 102977 - RNA, 22 nt, Human
cuuugaaaccugcucugcagaa

SEQ ID NO: 102978 - RNA, 22 nt, Human
cuuugaauugccguuucaucug

SEQ ID NO: 102979 - RNA, 22 nt, Human
cuuugacuuuguccucaggaaa

SEQ ID NO: 102980 - RNA, 22 nt, Human
cuuugauauaaguauacauagu

SEQ ID NO: 102981 - RNA, 22 nt, Human
cuuugauucagacuuugucggc

SEQ ID NO: 102982 - RNA, 22 nt, Human
cuuugcaaaaguuaauuguuga

SEQ ID NO: 102983 - RNA, 22 nt, Human
cuuugcaagggauuucaugucu

SEQ ID NO: 102984 - RNA, 22 nt, Human
cuuugcaagugcuuuguagucc

SEQ ID NO: 102985 - RNA, 22 nt, Human
cuuugcagagggggugggagcu

SEQ ID NO: 102986 - RNA, 20 nt, Human
cuuugcaggagaacagagaa

SEQ ID NO: 102987 - RNA, 22 nt, Human
cuuugcaguauagccuaguaga

SEQ ID NO: 102988 - RNA, 22 nt, Human
cuuugcagugauuguucuugga

SEQ ID NO: 102989 - RNA, 22 nt, Human
cuuugcauacaauuuuuagaaa

SEQ ID NO: 102990 - RNA, 22 nt, Human
ggaugcccacuaucugcuggcu

SEQ ID NO: 102991 - RNA, 22 nt, Human
ggaugcugauuccagucuccag

SEQ ID NO: 102992 - RNA, 22 nt, Human
ggaugcugggagacagcaggca

SEQ ID NO: 102993 - RNA, 22 nt, Human
ggaugcugucuaagcugaggac

SEQ ID NO: 102994 - RNA, 22 nt, Human
ggauggagaugaccauggugac

SEQ ID NO: 102995 - RNA, 23 nt, Human
ggauggagccacuuugaaaccac

SEQ ID NO: 102996 - RNA, 22 nt, Human
ggaugucucccagcaccaaagu

SEQ ID NO: 102997 - RNA, 22 nt, Human
ggauguucugggguucucuugu

SEQ ID NO: 102998 - RNA, 22 nt, Human
ggauguuuauccuaucuuaguu

SEQ ID NO: 102999 - RNA, 22 nt, Human
ggauguuuggcguuugaauugc

SEQ ID NO: 103000 - RNA, 22 nt, Human
ggauucuaacugaacagaauau

SEQ ID NO: 103001 - RNA, 19 nt, Human
ggauucugcaguuuucaca

SEQ ID NO: 103002 - RNA, 22 nt, Human
ggauuuacaaguuuaacucuca

SEQ ID NO: 103003 - RNA, 22 nt, Human
ggauuuacacaccugccuguca

SEQ ID NO: 103004 - RNA, 20 nt, Human
ggauuuacaggggaaaagug

SEQ ID NO: 103005 - RNA, 23 nt, Human
ggauuuaguggaugagcugagug

SEQ ID NO: 103006 - RNA, 22 nt, Human
ggauuuccucuugacucuaaag

SEQ ID NO: 103007 - RNA, 22 nt, Human
ggcaaaaacagcaaugacuuuu

SEQ ID NO: 103008 - RNA, 22 nt, Human
ggcaaacagacuugaccaucuu

SEQ ID NO: 103009 - RNA, 22 nt, Human
ggcaaacaggagaguaaagaga

SEQ ID NO: 103010 - RNA, 22 nt, Human
ggcaaagccuuacucuaacuga

SEQ ID NO: 103011 - RNA, 22 nt, Human
ggcaaagcugggauucaaaccc

SEQ ID NO: 103012 - RNA, 22 nt, Human
ggcaaaggaaaacgucucagcu

SEQ ID NO: 103013 - RNA, 22 nt, Human
ggcaaaguuuucaucucauaac

SEQ ID NO: 103014 - RNA, 21 nt, Human
ggcaagaaacacaaucaagua

SEQ ID NO: 103015 - RNA, 22 nt, Human
ggcaagaaggcuucagguagcu

SEQ ID NO: 103016 - RNA, 22 nt, Human
ggcaagagguccaagaggucuc

SEQ ID NO: 103017 - RNA, 22 nt, Human
ggcaagaguugaagcuccagga

SEQ ID NO: 103018 - RNA, 22 nt, Human
ggcaagauccaaggggcuagga

SEQ ID NO: 103019 - RNA, 19 nt, Human
ggcaagcacaaaagcuuug

SEQ ID NO: 103020 - RNA, 22 nt, Human
ggcaagugugagaagggacugg

SEQ ID NO: 103021 - RNA, 22 nt, Human
ggcaauaaaugacuucugcauu

SEQ ID NO: 103022 - RNA, 20 nt, Human
ggcaaugccagaugacagga

SEQ ID NO: 103023 - RNA, 22 nt, Human
ggcacaaguuugaugugaguua

SEQ ID NO: 103024 - RNA, 22 nt, Human
ggcacacauggugguuggugaa

SEQ ID NO: 103025 - RNA, 22 nt, Human
ggcacacucacuucugcccuga

SEQ ID NO: 103026 - RNA, 22 nt, Human
ggcacagagcccagcuuccuag

SEQ ID NO: 103027 - RNA, 22 nt, Human
ggcacagagguugccuccagau

SEQ ID NO: 103028 - RNA, 22 nt, Human
ggcacagauagaucaagugucu

SEQ ID NO: 103029 - RNA, 23 nt, Human
ggcacagaugcugagcaugugca

SEQ ID NO: 103030 - RNA, 22 nt, Human
ggcacaggagcuagucaaagcc

SEQ ID NO: 103031 - RNA, 22 nt, Human
ggcacagggagaggcggauuuu

SEQ ID NO: 103032 - RNA, 22 nt, Human
ggcacagggaggcccuggugug

SEQ ID NO: 103033 - RNA, 22 nt, Human
ggcacagugauuaagagccagu

SEQ ID NO: 103034 - RNA, 22 nt, Human
ggcacauggagacuuggcauca

SEQ ID NO: 103035 - RNA, 22 nt, Human
ggcaccagcacuugggauggcu

SEQ ID NO: 103036 - RNA, 22 nt, Human
ggcaccagggacaauccucuuc

SEQ ID NO: 103037 - RNA, 22 nt, Human
ggcacccuuggggggccacagc

SEQ ID NO: 103038 - RNA, 22 nt, Human
ggcaccugaugacugcuucccu

SEQ ID NO: 103039 - RNA, 22 nt, Human
ggcaccuggagguuuacuggau

SEQ ID NO: 103040 - RNA, 22 nt, Human
ggcaccuggauguagcagugaa

SEQ ID NO: 103041 - RNA, 19 nt, Human
ggcaccuuggcuaugccug

SEQ ID NO: 103042 - RNA, 21 nt, Human
ggcacuaggcccggaggaagc

SEQ ID NO: 103043 - RNA, 22 nt, Human
ggcacugacacuagcauggcac

SEQ ID NO: 103044 - RNA, 22 nt, Human
ggcacugacugugcagcgcacc

SEQ ID NO: 103045 - RNA, 22 nt, Human
ggcacuggcaaagcaaagucug

SEQ ID NO: 103046 - RNA, 16 nt, Human
ggcacuggcagguccu

SEQ ID NO: 103047 - RNA, 22 nt, Human
ggcacuggccuggggccaagag

SEQ ID NO: 103048 - RNA, 22 nt, Human
ggcacugggagaggugagacgg

SEQ ID NO: 103049 - RNA, 19 nt, Human
ggcacuggggccaggacca

SEQ ID NO: 103050 - RNA, 22 nt, Human
ggcacuguguacacacagagac

SEQ ID NO: 103051 - RNA, 22 nt, Human
ggcacuuggaucuuaguugggg

SEQ ID NO: 103052 - RNA, 22 nt, Human
ggcacuuugccuuuaugcacug

SEQ ID NO: 103053 - RNA, 22 nt, Human
ggcagaagaaaggcuaagucuc

SEQ ID NO: 103054 - RNA, 22 nt, Human
ggcagaaggccucccagcuccu

SEQ ID NO: 103055 - RNA, 19 nt, Human
ggcagaagguguaggggga

SEQ ID NO: 103056 - RNA, 21 nt, Human
ggcagaaguagcauggacggg

SEQ ID NO: 103057 - RNA, 22 nt, Human
ggcagacacaaaaacauaaggu

SEQ ID NO: 103058 - RNA, 22 nt, Human
ggcagagaguucuccaccucuc

SEQ ID NO: 103059 - RNA, 22 nt, Human
ggcagagaugugggucagaauc

SEQ ID NO: 103060 - RNA, 22 nt, Human
ggcagagccuucuggagcucgc

SEQ ID NO: 103061 - RNA, 22 nt, Human
ggcagagcgcaugcgucgcaga

SEQ ID NO: 103062 - RNA, 22 nt, Human
ggcagagcuaguggcuucucuu

SEQ ID NO: 103063 - RNA, 20 nt, Human
ggcagagcuaugucuguugc

SEQ ID NO: 103064 - RNA, 21 nt, Human
ggcagagcuggggccuccagc

SEQ ID NO: 103065 - RNA, 22 nt, Human
ggcagaggaaggaugaauucac

SEQ ID NO: 103066 - RNA, 22 nt, Human
ggcagaggaggggugaauuugc

SEQ ID NO: 103067 - RNA, 22 nt, Human
gacccuuugacuugugacauua

SEQ ID NO: 103068 - RNA, 22 nt, Human
gacccuuuggagguagucacca

SEQ ID NO: 103069 - RNA, 22 nt, Human
gaccuagauuaacauucuguga

SEQ ID NO: 103070 - RNA, 22 nt, Human
gaccucaggcuucuguaauuaa

SEQ ID NO: 103071 - RNA, 22 nt, Human
gaccucagguuuguaauggaca

SEQ ID NO: 103072 - RNA, 22 nt, Human
gaccuccauucugucaugacug

SEQ ID NO: 103073 - RNA, 22 nt, Human
gaccucuugcacccuggcucuu

SEQ ID NO: 103074 - RNA, 22 nt, Human
gaccugaaagagauuaaaugac

SEQ ID NO: 103075 - RNA, 22 nt, Human
gaccugaaauuugugguagaac

SEQ ID NO: 103076 - RNA, 22 nt, Human
gaccugcuccacgacaaguggu

SEQ ID NO: 103077 - RNA, 22 nt, Human
gaccuggaagaugguccucacc

SEQ ID NO: 103078 - RNA, 22 nt, Human
gaccuggaggcuuuucccaaga

SEQ ID NO: 103079 - RNA, 22 nt, Human
gaccuggccugcacagcccuua

SEQ ID NO: 103080 - RNA, 22 nt, Human
gaccuggguaaggggcugacaa

SEQ ID NO: 103081 - RNA, 22 nt, Human
gaccugguccuuguacuuugaa

SEQ ID NO: 103082 - RNA, 22 nt, Human
gaccuucaagcaccauauuuau

SEQ ID NO: 103083 - RNA, 22 nt, Human
gaccuucuguuggaggcauuua

SEQ ID NO: 103084 - RNA, 22 nt, Human
gaccuugugauccagccaccuu

SEQ ID NO: 103085 - RNA, 22 nt, Human
gaccuugugcuccgaggcgggc

SEQ ID NO: 103086 - RNA, 22 nt, Human
gaccuuuuuacuguguacgcug

SEQ ID NO: 103087 - RNA, 22 nt, Human
gacggagcugguugcugcggcu

SEQ ID NO: 103088 - RNA, 19 nt, Human
gacuaaauaauaauagcag

SEQ ID NO: 103089 - RNA, 22 nt, Human
gacuaaaugcuuugugcaugca

SEQ ID NO: 103090 - RNA, 22 nt, Human
gacuaacagucuccgcuugaaa

SEQ ID NO: 103091 - RNA, 22 nt, Human
gacuacagauagccaauuaagu

SEQ ID NO: 103092 - RNA, 22 nt, Human
gacuacaggugugugccaccau

SEQ ID NO: 103093 - RNA, 22 nt, Human
gacuagaagggcaagagucccu

SEQ ID NO: 103094 - RNA, 22 nt, Human
gacuagucauuugcauuccguc

SEQ ID NO: 103095 - RNA, 22 nt, Human
gacuauuuuuaucuaacugggu

SEQ ID NO: 103096 - RNA, 19 nt, Human
gacucacaccuuccgcugu

SEQ ID NO: 103097 - RNA, 22 nt, Human
gacucagauuuagaggguaaga

SEQ ID NO: 103098 - RNA, 22 nt, Human
gacuccagguguccaggccucc

SEQ ID NO: 103099 - RNA, 22 nt, Human
gacuccccugggccccauccag

SEQ ID NO: 103100 - RNA, 22 nt, Human
gacuccucucuaacccacugga

SEQ ID NO: 103101 - RNA, 22 nt, Human
gacuccugggccucugagaggc

SEQ ID NO: 103102 - RNA, 22 nt, Human
gacucguucauaguuccaauuu

SEQ ID NO: 103103 - RNA, 22 nt, Human
gacucugcuaggaaaaucucag

SEQ ID NO: 103104 - RNA, 22 nt, Human
gacucugugggaggaggcucag

SEQ ID NO: 103105 - RNA, 22 nt, Human
gacugaacaguaagaggcuuua

SEQ ID NO: 103106 - RNA, 22 nt, Human
gacugaaggucucagcauguga

SEQ ID NO: 103107 - RNA, 22 nt, Human
gaagauuaaauggcucccauau

SEQ ID NO: 103108 - RNA, 22 nt, Human
gaagauuaccugagaccacuug

SEQ ID NO: 103109 - RNA, 22 nt, Human
gaagauuucaguuaaguaucua

SEQ ID NO: 103110 - RNA, 22 nt, Human
gaagauuugaaacacauagaca

SEQ ID NO: 103111 - RNA, 22 nt, Human
gaagauuuggauuccaugucac

SEQ ID NO: 103112 - RNA, 22 nt, Human
gaagcaaaaugucugcacauau

SEQ ID NO: 103113 - RNA, 22 nt, Human
gaagcacagauaauucaaguau

SEQ ID NO: 103114 - RNA, 22 nt, Human
gaagcacugccauaauucagac

SEQ ID NO: 103115 - RNA, 22 nt, Human
gaagcagaaguacgauuuacua

SEQ ID NO: 103116 - RNA, 16 nt, Human
gaagcagaggguguug

SEQ ID NO: 103117 - RNA, 22 nt, Human
gaagcagcaaaucugcaguauc

SEQ ID NO: 103118 - RNA, 22 nt, Human
gaagcagcuggugagauggagc

SEQ ID NO: 103119 - RNA, 22 nt, Human
gaagcaguagauuccuacucau

SEQ ID NO: 103120 - RNA, 22 nt, Human
gaagcaguuucuguaaugaaau

SEQ ID NO: 103121 - RNA, 18 nt, Human
gaagcauauuuguucuuc

SEQ ID NO: 103122 - RNA, 22 nt, Human
gaagcaugcuaaggauucucag

SEQ ID NO: 103123 - RNA, 22 nt, Human
gaagccaacauuccaaguagaa

SEQ ID NO: 103124 - RNA, 22 nt, Human
gaagccacagagauuguggggg

SEQ ID NO: 103125 - RNA, 22 nt, Human
gaagccacguuaaauuggcugu

SEQ ID NO: 103126 - RNA, 22 nt, Human
gaagccagauuuggggcauauc

SEQ ID NO: 103127 - RNA, 22 nt, Human
gaagccaguacugugcucugca

SEQ ID NO: 103128 - RNA, 22 nt, Human
gaagccaucuuuguuccccacc

SEQ ID NO: 103129 - RNA, 22 nt, Human
gaagcccuaauacacaguaccu

SEQ ID NO: 103130 - RNA, 22 nt, Human
gaagcccuauccucuccuggga

SEQ ID NO: 103131 - RNA, 19 nt, Human
gaagcccugcauucuccgc

SEQ ID NO: 103132 - RNA, 22 nt, Human
gaagcccuggggucagugucgu

SEQ ID NO: 103133 - RNA, 22 nt, Human
gaagcccuguaggugcaaaggu

SEQ ID NO: 103134 - RNA, 22 nt, Human
gaagccugguucgcuggccacc

SEQ ID NO: 103135 - RNA, 22 nt, Human
gaagcggcaucaggaggcugcc

SEQ ID NO: 103136 - RNA, 22 nt, Human
gaagcuaaaagagaugugguuu

SEQ ID NO: 103137 - RNA, 22 nt, Human
gaagcuaaugauuuauuuucug

SEQ ID NO: 103138 - RNA, 22 nt, Human
gaagcugagcugaggcauguug

SEQ ID NO: 103139 - RNA, 22 nt, Human
gaagcuggggugcugagggcaa

SEQ ID NO: 103140 - RNA, 22 nt, Human
gaagcugggucgcugggauccu

SEQ ID NO: 103141 - RNA, 22 nt, Human
gaagcuguguugauggcaugga

SEQ ID NO: 103142 - RNA, 22 nt, Human
gaagcuuggauaacuguauggg

SEQ ID NO: 103143 - RNA, 22 nt, Human
gaagcuuuauugcaagugaggc

SEQ ID NO: 103144 - RNA, 22 nt, Human
gaagcuuugucuugucuccugg

SEQ ID NO: 103145 - RNA, 22 nt, Human
gaaggaaaucugugauuuaugc

SEQ ID NO: 103146 - RNA, 22 nt, Human
gaaggaagccguuucucuccag

SEQ ID NO: 103147 - RNA, 22 nt, Human
gaaggaaggaaaaauauauuua

SEQ ID NO: 103148 - RNA, 22 nt, Human
gaaggaagucauuagugcagac

SEQ ID NO: 103149 - RNA, 22 nt, Human
gaaggaaguuuauuuuagaaga

SEQ ID NO: 103150 - RNA, 16 nt, Human
gaaggagauucagaaa

SEQ ID NO: 103151 - RNA, 22 nt, Human
gaaggagcuaccaagacugaau

SEQ ID NO: 103152 - RNA, 22 nt, Human
gaaggagcuacuaauaagaggg

SEQ ID NO: 103153 - RNA, 22 nt, Human
gaaggagggugcggaucugagc

SEQ ID NO: 103154 - RNA, 22 nt, Human
gaaggcaagcagcauaaauguc

SEQ ID NO: 103155 - RNA, 22 nt, Human
gaaggcaagugagccaagagaa

SEQ ID NO: 103156 - RNA, 22 nt, Human
gaaggcaguaaauggcuguuuu

SEQ ID NO: 103157 - RNA, 22 nt, Human
gaaggcaucacagaggcugugg

SEQ ID NO: 103158 - RNA, 22 nt, Human
gaaggcauuuaggaacugcaau

SEQ ID NO: 103159 - RNA, 22 nt, Human
gaaggcauuucagagaucucug

SEQ ID NO: 103160 - RNA, 22 nt, Human
gaaggccaagaggcuccaagau

SEQ ID NO: 103161 - RNA, 22 nt, Human
gaaggccacuuuguguugagaa

SEQ ID NO: 103162 - RNA, 22 nt, Human
gaaggccauuuuuagguagaau

SEQ ID NO: 103163 - RNA, 22 nt, Human
gaaggcccagcuugaaugcugc

SEQ ID NO: 103164 - RNA, 22 nt, Human
gaaggcuacuucuccucagggc

SEQ ID NO: 103165 - RNA, 22 nt, Human
gaaggcuagaaacgaugcuuau

SEQ ID NO: 103166 - RNA, 22 nt, Human
gaaggcuauaugacucagcccu

SEQ ID NO: 103167 - RNA, 22 nt, Human
gaaggcugaguggguacggagg

SEQ ID NO: 103168 - RNA, 22 nt, Human
gaaggcugcauggaggcugugg

SEQ ID NO: 103169 - RNA, 22 nt, Human
gaaggcugcgaggggagugccg

SEQ ID NO: 103170 - RNA, 22 nt, Human
gaaggcugcugggaaguguggu

SEQ ID NO: 103171 - RNA, 22 nt, Human
gaaggcuguaggcaaaguagga

SEQ ID NO: 103172 - RNA, 22 nt, Human
gaaggcuguuucugguagugau

SEQ ID NO: 103173 - RNA, 22 nt, Human
gaaggcuuccugaugccaacca

SEQ ID NO: 103174 - RNA, 22 nt, Human
gaaggcuuccuggaggaggugg

SEQ ID NO: 103175 - RNA, 22 nt, Human
gaaggcuucuccagggcuuacu

SEQ ID NO: 103176 - RNA, 22 nt, Human
gaggaaccaaucugugauauuc

SEQ ID NO: 103177 - RNA, 20 nt, Human
gaggaaccacugggaggaga

SEQ ID NO: 103178 - RNA, 22 nt, Human
gaggaacccaagcucaccguca

SEQ ID NO: 103179 - RNA, 22 nt, Human
gaggaacuggagcuuucauuuu

SEQ ID NO: 103180 - RNA, 22 nt, Human
gaggaagccccauugaagccag

SEQ ID NO: 103181 - RNA, 22 nt, Human
gaggaagcuuuugaucgcccag

SEQ ID NO: 103182 - RNA, 22 nt, Human
gaggaaggcuaaggggcuuaga

SEQ ID NO: 103183 - RNA, 22 nt, Human
gaggacacaaaguggcugagau

SEQ ID NO: 103184 - RNA, 22 nt, Human
gaggacacggccuuuuggaaaa

SEQ ID NO: 103185 - RNA, 22 nt, Human
gaggacagcucuaacuaaaguc

SEQ ID NO: 103186 - RNA, 17 nt, Human
gaggacagggaaguagg

SEQ ID NO: 103187 - RNA, 22 nt, Human
gaggacauaguccagauggcaa

SEQ ID NO: 103188 - RNA, 22 nt, Human
gaggacgggcuucauggggccu

SEQ ID NO: 103189 - RNA, 22 nt, Human
gaggagacggggugccuggagc

SEQ ID NO: 103190 - RNA, 22 nt, Human
gaggagagaacauuccuccaua

SEQ ID NO: 103191 - RNA, 22 nt, Human
gaggagagggcugcgggcccac

SEQ ID NO: 103192 - RNA, 20 nt, Human
gaggagccaccuugagcugg

SEQ ID NO: 103193 - RNA, 22 nt, Human
gaggagcucugcuccauccuuc

SEQ ID NO: 103194 - RNA, 22 nt, Human
gaggagcugagccacguccugg

SEQ ID NO: 103195 - RNA, 22 nt, Human
gaggagcuggcugucgggaggc

SEQ ID NO: 103196 - RNA, 22 nt, Human
gaggagcugucaccgugacuca

SEQ ID NO: 103197 - RNA, 22 nt, Human
gaggagcugucuuugugaucuu

SEQ ID NO: 103198 - RNA, 22 nt, Human
gaggagcuugaggcuaggagcc

SEQ ID NO: 103199 - RNA, 22 nt, Human
gaggagcuugugagaagauguc

SEQ ID NO: 103200 - RNA, 22 nt, Human
gaggaggaaaggaguugaaaug

SEQ ID NO: 103201 - RNA, 22 nt, Human
gaggaggaaguucucuguaggc

SEQ ID NO: 103202 - RNA, 22 nt, Human
gaggaggcuaucagcaaucagg

SEQ ID NO: 103203 - RNA, 22 nt, Human
gaggaggcugaacaaugcccug

SEQ ID NO: 103204 - RNA, 19 nt, Human
gaggaggcuucagcuuucu

SEQ ID NO: 103205 - RNA, 22 nt, Human
gaggagggagaauuaggcuuaa

SEQ ID NO: 103206 - RNA, 22 nt, Human
gaggagggcaguuccucuuuua

SEQ ID NO: 103207 - RNA, 22 nt, Human
gaggagggccuggugucccuuc

SEQ ID NO: 103208 - RNA, 22 nt, Human
gaggagggcuuuguugauguua

SEQ ID NO: 103209 - RNA, 22 nt, Human
gaggaggggcacuugucuccua

SEQ ID NO: 103210 - RNA, 23 nt, Human
gaggagggucugacaaguguagc

SEQ ID NO: 103211 - RNA, 22 nt, Human
gaggaggucuccuccgcagggg

SEQ ID NO: 103212 - RNA, 22 nt, Human
gaggagguggagucaugcagag

SEQ ID NO: 103213 - RNA, 20 nt, Human
gaggagucuuguagaaaaug

SEQ ID NO: 103214 - RNA, 22 nt, Human
gaggagugccagccguggaguc

SEQ ID NO: 103215 - RNA, 22 nt, Human
gaggaguggguuagugcuuauu

SEQ ID NO: 103216 - RNA, 22 nt, Human
gaggaguguauuccacaccacu

SEQ ID NO: 103217 - RNA, 20 nt, Human
gaggaugcagacagagggca

SEQ ID NO: 103218 - RNA, 18 nt, Human
gaggauggaaggagaugc

SEQ ID NO: 103219 - RNA, 22 nt, Human
gaggauggaggcaguuagggcc

SEQ ID NO: 103220 - RNA, 22 nt, Human
gaggauggugagcaggacccag

SEQ ID NO: 103221 - RNA, 22 nt, Human
gaggauguaaaauagacaaaau

SEQ ID NO: 103222 - RNA, 22 nt, Human
gaggauuugauggcuuucuccc

SEQ ID NO: 103223 - RNA, 22 nt, Human
gaggcaaagcauguggcucagg

SEQ ID NO: 103224 - RNA, 22 nt, Human
gaggcaagcccagugggucuaa

SEQ ID NO: 103225 - RNA, 19 nt, Human
gaggcaaggaguuuaagcc

SEQ ID NO: 103226 - RNA, 22 nt, Human
gaggcacaguguuuggucagug

SEQ ID NO: 103227 - RNA, 18 nt, Human
gaggcacauaguuggggc

SEQ ID NO: 103228 - RNA, 22 nt, Human
gaggcacaucacuuggugcauu

SEQ ID NO: 103229 - RNA, 22 nt, Human
gaggcacugagagugggggaug

SEQ ID NO: 103230 - RNA, 22 nt, Human
gaggcacugcaguacagugacu

SEQ ID NO: 103231 - RNA, 22 nt, Human
gaggcagaggaagguggucucu

SEQ ID NO: 103232 - RNA, 22 nt, Human
gaggcagagguuguugcaguga

SEQ ID NO: 103233 - RNA, 22 nt, Human
gaggcagagucacaaagagucu

SEQ ID NO: 103234 - RNA, 22 nt, Human
gaggcagcucuucugaaugggg

SEQ ID NO: 103235 - RNA, 22 nt, Human
gaggcagcugaaggagugacag

SEQ ID NO: 103236 - RNA, 22 nt, Human
gaggcagcuggguccggucggg

SEQ ID NO: 103237 - RNA, 22 nt, Human
gaggcaguccaguggguaagaa

SEQ ID NO: 103238 - RNA, 22 nt, Human
gaggcaucugggcacagaagug

SEQ ID NO: 103239 - RNA, 22 nt, Human
gaggcaugcagagcuggagcag

SEQ ID NO: 103240 - RNA, 22 nt, Human
gaggcauuaaagggaaucuucu

SEQ ID NO: 103241 - RNA, 22 nt, Human
gaggccacagucaguguucauc

SEQ ID NO: 103242 - RNA, 23 nt, Human
gaggccacauuccccugcuugag

SEQ ID NO: 103243 - RNA, 22 nt, Human
gaggccacgguuuuccuugggg

SEQ ID NO: 103244 - RNA, 22 nt, Human
gaggccagaagucugagaucag

SEQ ID NO: 103245 - RNA, 22 nt, Human
gaggccagaagugccucgggcu

SEQ ID NO: 103246 - RNA, 22 nt, Human
gaggccagaaugagcugaaugc

SEQ ID NO: 103247 - RNA, 22 nt, Human
gaggccagacugccuuuuauga

SEQ ID NO: 103248 - RNA, 22 nt, Human
gaggccagauacucucuucugc

SEQ ID NO: 103249 - RNA, 22 nt, Human
gaggccagaugucaugucuuau

SEQ ID NO: 103250 - RNA, 22 nt, Human
gaggccaugaauggauguuccu

SEQ ID NO: 103251 - RNA, 22 nt, Human
gaggcccaaggacucugucccg

SEQ ID NO: 103252 - RNA, 22 nt, Human
gaggcccaaugcuucccuccuu

SEQ ID NO: 103253 - RNA, 22 nt, Human
gaggcccagcagcgcaggucuu

SEQ ID NO: 103254 - RNA, 22 nt, Human
gaggcccaggguacaggccgcu

SEQ ID NO: 103255 - RNA, 22 nt, Human
gaggcccaguccugcaagcacg

SEQ ID NO: 103256 - RNA, 21 nt, Human
gaggcccaugggacaggggcu

SEQ ID NO: 103257 - RNA, 22 nt, Human
gaggccucaggaaugucgugug

SEQ ID NO: 103258 - RNA, 22 nt, Human
gaggccucuucuuuguuaaccu

SEQ ID NO: 103259 - RNA, 22 nt, Human
gaggccugaaaggggaccuaug

SEQ ID NO: 103260 - RNA, 22 nt, Human
gaggguccuggcuaagucugac

SEQ ID NO: 103261 - RNA, 22 nt, Human
gagggugacaguucuggucucu

SEQ ID NO: 103262 - RNA, 22 nt, Human
gaggguggaagagcugcugaga

SEQ ID NO: 103263 - RNA, 22 nt, Human
gaggguggagcuccagaaucug

SEQ ID NO: 103264 - RNA, 22 nt, Human
gaggguggggaauagacugcua

SEQ ID NO: 103265 - RNA, 22 nt, Human
gagggugugaacacuggcugug

SEQ ID NO: 103266 - RNA, 22 nt, Human
gagguaacaacugaaaugagaa

SEQ ID NO: 103267 - RNA, 22 nt, Human
gagguagccacagauagagacu

SEQ ID NO: 103268 - RNA, 22 nt, Human
gagguauuggccauugucuguu

SEQ ID NO: 103269 - RNA, 22 nt, Human
gaggucaggugaggaauuaaga

SEQ ID NO: 103270 - RNA, 22 nt, Human
gaggucaucaccaauauaugcc

SEQ ID NO: 103271 - RNA, 22 nt, Human
gaggucaucuguuuugguuacu

SEQ ID NO: 103272 - RNA, 22 nt, Human
gagguccacugaggcaacaggg

SEQ ID NO: 103273 - RNA, 22 nt, Human
gagguccucucggaaccccuuu

SEQ ID NO: 103274 - RNA, 22 nt, Human
gagguccugucugagaauggag

SEQ ID NO: 103275 - RNA, 22 nt, Human
gaggucucacuauguugcccag

SEQ ID NO: 103276 - RNA, 22 nt, Human
gaggucuggaccaagucgcccc

SEQ ID NO: 103277 - RNA, 22 nt, Human
gaggucugggcuugggccuggu

SEQ ID NO: 103278 - RNA, 22 nt, Human
gaggucuucacaaagaacagca

SEQ ID NO: 103279 - RNA, 22 nt, Human
gaggugaaaguuauucauuuau

SEQ ID NO: 103280 - RNA, 22 nt, Human
gaggugccuggcgaugucucug

SEQ ID NO: 103281 - RNA, 22 nt, Human
gagguggauguugcagugagcu

SEQ ID NO: 103282 - RNA, 22 nt, Human
gagguggcagaggccuggaccu

SEQ ID NO: 103283 - RNA, 22 nt, Human
gagguggccucaagcagucuuc

SEQ ID NO: 103284 - RNA, 22 nt, Human
gagguggcugcuugcugggaaa

SEQ ID NO: 103285 - RNA, 22 nt, Human
gaguugaacauaugcaaucucu

SEQ ID NO: 103286 - RNA, 22 nt, Human
gaguugccucuaagucccuggu

SEQ ID NO: 103287 - RNA, 22 nt, Human
gaguuuaaucauuguucuaucc

SEQ ID NO: 103288 - RNA, 22 nt, Human
gaguuuaguggaauuuccuucu

SEQ ID NO: 103289 - RNA, 22 nt, Human
gaguuuaugucuuucauuguuc

SEQ ID NO: 103290 - RNA, 22 nt, Human
gaguuuccaaaucccugaaggg

SEQ ID NO: 103291 - RNA, 22 nt, Human
gaguuucuucauggugcagagg

SEQ ID NO: 103292 - RNA, 22 nt, Human
gaguuuguaaacuauucacuaa

SEQ ID NO: 103293 - RNA, 22 nt, Human
gauaaaagaggaaauuuguuca

SEQ ID NO: 103294 - RNA, 22 nt, Human
gauaaacacaaggugauuucau

SEQ ID NO: 103295 - RNA, 22 nt, Human
gauaaacaugaaguucugugua

SEQ ID NO: 103296 - RNA, 22 nt, Human
gauaaacuggaaccauugccuc

SEQ ID NO: 103297 - RNA, 22 nt, Human
gauaaacuuguggaguuuuggu

SEQ ID NO: 103298 - RNA, 22 nt, Human
gauaaagcaaggaugacugaag

SEQ ID NO: 103299 - RNA, 22 nt, Human
gauaacaugguuaguguuuuua

SEQ ID NO: 103300 - RNA, 22 nt, Human
gauaacauuauaaguucacugu

SEQ ID NO: 103301 - RNA, 22 nt, Human
gauaacauuuguauagcgcuuu

SEQ ID NO: 103302 - RNA, 22 nt, Human
gauaagcuaacccaagcccuuu

SEQ ID NO: 103303 - RNA, 22 nt, Human
gauaauaagcacagcaggaugu

SEQ ID NO: 103304 - RNA, 22 nt, Human
gauaauguggauuuauugugau

SEQ ID NO: 103305 - RNA, 22 nt, Human
gauacaaauucaugucugaauu

SEQ ID NO: 103306 - RNA, 22 nt, Human
gauacacaaguggaaggagacg

SEQ ID NO: 103307 - RNA, 22 nt, Human
gauacacacccuugauaggacu

SEQ ID NO: 103308 - RNA, 20 nt, Human
gauacacagcuucacuguug

SEQ ID NO: 103309 - RNA, 22 nt, Human
gauacacuggagcuuccugaca

SEQ ID NO: 103310 - RNA, 22 nt, Human
gauacacuggccaaguggagga

SEQ ID NO: 103311 - RNA, 22 nt, Human
gauacauaaaaaugugcucuau

SEQ ID NO: 103312 - RNA, 22 nt, Human
gauaccagacagggagggagaa

SEQ ID NO: 103313 - RNA, 22 nt, Human
gauacuuuguggaauccuggau

SEQ ID NO: 103314 - RNA, 22 nt, Human
gauauacagagcauucuuugau

SEQ ID NO: 103315 - RNA, 22 nt, Human
gauauaguaauauuccugaacu

SEQ ID NO: 103316 - RNA, 18 nt, Human
gauauauaggaggaaagu

SEQ ID NO: 103317 - RNA, 22 nt, Human
gauauauguaaaaguagacaga

SEQ ID NO: 103318 - RNA, 22 nt, Human
gauaugcacauucaaaaauugc

SEQ ID NO: 103319 - RNA, 22 nt, Human
gauauucauaggcagguauuua

SEQ ID NO: 103320 - RNA, 22 nt, Human
gauauucuauguagaaugagcu

SEQ ID NO: 103321 - RNA, 19 nt, Human
gauauugcuugaguaacug

SEQ ID NO: 103322 - RNA, 22 nt, Human
gauauuuaacucucacaggucc

SEQ ID NO: 103323 - RNA, 22 nt, Human
gauauuuacauuaagcacauug

SEQ ID NO: 103324 - RNA, 22 nt, Human
gauauuuauuaagugguuggua

SEQ ID NO: 103325 - RNA, 22 nt, Human
gauauuuucagucuccuuucaa

SEQ ID NO: 103326 - RNA, 22 nt, Human
gauauuuuuaggugaugcaggc

SEQ ID NO: 103327 - RNA, 22 nt, Human
gauauuuuugcagacaccuggg

SEQ ID NO: 103328 - RNA, 22 nt, Human
gaucaaagccagugaggaguga

SEQ ID NO: 103329 - RNA, 22 nt, Human
gaucaggacauagcuauaggcu

SEQ ID NO: 103330 - RNA, 22 nt, Human
gaucaguaagugaauaaugagu

SEQ ID NO: 103331 - RNA, 22 nt, Human
gaucaguguuuugugcauucuu

SEQ ID NO: 103332 - RNA, 22 nt, Human
gaucaucuuuuccugcuuccag

SEQ ID NO: 103333 - RNA, 22 nt, Human
gaucauuagcuuuucaaaggag

SEQ ID NO: 103334 - RNA, 22 nt, Human
gauccacagggcccuggcccag

SEQ ID NO: 103335 - RNA, 21 nt, Human
gauccacugaccuggggaucc

SEQ ID NO: 103336 - RNA, 22 nt, Human
gauccagauauuugggcuggua

SEQ ID NO: 103337 - RNA, 22 nt, Human
gauccagcuucuacacagagcu

SEQ ID NO: 103338 - RNA, 22 nt, Human
gaucccugcccucagccuggac

SEQ ID NO: 103339 - RNA, 22 nt, Human
gaucccuugggccaaggaguug

SEQ ID NO: 103340 - RNA, 22 nt, Human
gauccguuccaccagucuuuau

SEQ ID NO: 103341 - RNA, 22 nt, Human
gauccguuuuaacaaugggagu

SEQ ID NO: 103342 - RNA, 22 nt, Human
gauccucuuuuccuaggaaggu

SEQ ID NO: 103343 - RNA, 22 nt, Human
gauccugggacugaaugggugc

SEQ ID NO: 103344 - RNA, 22 nt, Human
gauccugggcccuucuggguca

SEQ ID NO: 103345 - RNA, 22 nt, Human
gauccuguuagaaauguagacu

SEQ ID NO: 103346 - RNA, 22 nt, Human
gaucuagaccagaagcuguugu

SEQ ID NO: 103347 - RNA, 21 nt, Human
gaucuagacuugggcccagua

SEQ ID NO: 103348 - RNA, 22 nt, Human
gaucuauuuacucuuuuccuag

SEQ ID NO: 103349 - RNA, 22 nt, Human
gaucuccuggacgucuuguuaa

SEQ ID NO: 103350 - RNA, 21 nt, Human
gaucucuggaaggagaaagcu

SEQ ID NO: 103351 - RNA, 22 nt, Human
gaucugaagagcaaugaaauau

SEQ ID NO: 103352 - RNA, 22 nt, Human
gaucugaagauaugaaauauuu

SEQ ID NO: 103353 - RNA, 22 nt, Human
gaucugaaucaauagaauaacu

SEQ ID NO: 103354 - RNA, 22 nt, Human
gaucuguuugccuagagauuua

SEQ ID NO: 103355 - RNA, 22 nt, Human
gaucuguuuuuucuuagacagu

SEQ ID NO: 103356 - RNA, 22 nt, Human
gaucuucuauguaaugaagugu

SEQ ID NO: 103357 - RNA, 22 nt, Human
gaucuugaaauaucuuuuccua

SEQ ID NO: 103358 - RNA, 22 nt, Human
gaucuuuacuacugccuucucu

SEQ ID NO: 103359 - RNA, 22 nt, Human
gaucuuuagccaagacacacca

SEQ ID NO: 103360 - RNA, 22 nt, Human
gaucuuuauacuguaauaauga

SEQ ID NO: 103361 - RNA, 22 nt, Human
gaucuuugcaaacuuugucacu

SEQ ID NO: 103362 - RNA, 19 nt, Human
gaucuuugccaauuuaagc

SEQ ID NO: 103363 - RNA, 22 nt, Human
gaucuuuucagaauuuaucagu

SEQ ID NO: 103364 - RNA, 22 nt, Human
gaugaaaaaagacgagcauaua

SEQ ID NO: 103365 - RNA, 22 nt, Human
gaugaaaaucuugagaugucga

SEQ ID NO: 103366 - RNA, 22 nt, Human
gaugaaauccagaucacaggug

SEQ ID NO: 103367 - RNA, 22 nt, Human
gaugaaauucagaauugagggg

SEQ ID NO: 103368 - RNA, 22 nt, Human
gaugaaauuugaaaauaguguu

SEQ ID NO: 103369 - RNA, 22 nt, Human
gaugaagccccaguguaaguaa

SEQ ID NO: 103370 - RNA, 22 nt, Human
gaugaauucuggcuuggacaga

SEQ ID NO: 103371 - RNA, 22 nt, Human
gaugaauugaaaucauugggca

SEQ ID NO: 103372 - RNA, 22 nt, Human
gaugacacuugugagaaaucaa

SEQ ID NO: 103373 - RNA, 22 nt, Human
gaugagaaggcucagauccaaa

SEQ ID NO: 103374 - RNA, 22 nt, Human
gaugagaauguuuaucaaaugc

SEQ ID NO: 103375 - RNA, 22 nt, Human
gaugagacagaauagcccaagg

SEQ ID NO: 103376 - RNA, 22 nt, Human
gaugagcugucuagcuguugga

SEQ ID NO: 103377 - RNA, 22 nt, Human
gagcaggcaaagaugaaaggag

SEQ ID NO: 103378 - RNA, 22 nt, Human
gagcaggcauucuaguggcuga

SEQ ID NO: 103379 - RNA, 22 nt, Human
gagcaggccuggggugaggccu

SEQ ID NO: 103380 - RNA, 22 nt, Human
gagcagggagacaacucuggug

SEQ ID NO: 103381 - RNA, 22 nt, Human
gagcaggugccuguagcucucu

SEQ ID NO: 103382 - RNA, 22 nt, Human
gagcagguuucaaugcugaugc

SEQ ID NO: 103383 - RNA, 20 nt, Human
gagcaguggaguuuccaggg

SEQ ID NO: 103384 - RNA, 22 nt, Human
gagcaguggucugaucuucuaa

SEQ ID NO: 103385 - RNA, 22 nt, Human
gagcaguuuuauuucaugagac

SEQ ID NO: 103386 - RNA, 22 nt, Human
gagcaucacuguccucuccccg

SEQ ID NO: 103387 - RNA, 22 nt, Human
gagcaucucuauagugacugug

SEQ ID NO: 103388 - RNA, 22 nt, Human
gagcaucugugguccaucagaa

SEQ ID NO: 103389 - RNA, 22 nt, Human
gagcauggaucaugugcugggu

SEQ ID NO: 103390 - RNA, 18 nt, Human
gagcaugggcagugggga

SEQ ID NO: 103391 - RNA, 22 nt, Human
gagcaugguuccauagguuggu

SEQ ID NO: 103392 - RNA, 22 nt, Human
gagcauuuuugucugcauuuua

SEQ ID NO: 103393 - RNA, 22 nt, Human
gagccaagcaauauacccaacc

SEQ ID NO: 103394 - RNA, 22 nt, Human
aguggcagggacuucauauaaa

SEQ ID NO: 103395 - RNA, 22 nt, Human
aguggcagguguguaguauccc

SEQ ID NO: 103396 - RNA, 22 nt, Human
aguggcaguaacauuccacaau

SEQ ID NO: 103397 - RNA, 22 nt, Human
aguggcaguggcugggcagagc

SEQ ID NO: 103398 - RNA, 22 nt, Human
aguggccaauaugucaugcucu

SEQ ID NO: 103399 - RNA, 22 nt, Human
aguggcuagaucaugagugagc

SEQ ID NO: 103400 - RNA, 22 nt, Human
aguggcuaugcaugacuggaau

SEQ ID NO: 103401 - RNA, 22 nt, Human
aguggcucuugggucacugggc

SEQ ID NO: 103402 - RNA, 22 nt, Human
aguggcugacaacuggguuaac

SEQ ID NO: 103403 - RNA, 23 nt, Human
aguggcugagaguguuucauaug

SEQ ID NO: 103404 - RNA, 22 nt, Human
aguggcugauguaggcaguggg

SEQ ID NO: 103405 - RNA, 22 nt, Human
aguggcuggcauaggaacagac

SEQ ID NO: 103406 - RNA, 22 nt, Human
aguggcugugaaauacauggga

SEQ ID NO: 103407 - RNA, 22 nt, Human
aguggcuuccuucauaagcuuu

SEQ ID NO: 103408 - RNA, 22 nt, Human
agugggaauuucagugcuaaaa

SEQ ID NO: 103409 - RNA, 20 nt, Human
agugggagagggcagacugc

SEQ ID NO: 103410 - RNA, 22 nt, Human
agugggagccagcagcuugggg

SEQ ID NO: 103411 - RNA, 22 nt, Human
agugggagcggcagucggggac

SEQ ID NO: 103412 - RNA, 22 nt, Human
agugggaggaaguggugauauu

SEQ ID NO: 103413 - RNA, 22 nt, Human
agugggaggcggcugacgggcg

SEQ ID NO: 103414 - RNA, 22 nt, Human
agugggcagcccaggaggucuu

SEQ ID NO: 103415 - RNA, 22 nt, Human
agugggcaggcagggugcgcag

SEQ ID NO: 103416 - RNA, 23 nt, Human
agugggcucaguccuccaacccc

SEQ ID NO: 103417 - RNA, 22 nt, Human
agugggcuuuuuuccguuccau

SEQ ID NO: 103418 - RNA, 22 nt, Human
aguggggaagagcaugggcccu

SEQ ID NO: 103419 - RNA, 22 nt, Human
aguggggacaaugagagcaggu

SEQ ID NO: 103420 - RNA, 20 nt, Human
aguggggagucaggagugcc

SEQ ID NO: 103421 - RNA, 22 nt, Human
aguggggccgcgguccugcccu

SEQ ID NO: 103422 - RNA, 22 nt, Human
agugggggcagagccucucucg

SEQ ID NO: 103423 - RNA, 22 nt, Human
agugggggcuggcucugucugu

SEQ ID NO: 103424 - RNA, 21 nt, Human
aguggggucucuguggaggcc

SEQ ID NO: 103425 - RNA, 22 nt, Human
aguggguacugggcaggcagag

SEQ ID NO: 103426 - RNA, 22 nt, Human
aguggguaggccucuggugccu

SEQ ID NO: 103427 - RNA, 22 nt, Human
agugggucagagagcuccagau

SEQ ID NO: 103428 - RNA, 18 nt, Human
aguggucuguuauaucau

SEQ ID NO: 103429 - RNA, 21 nt, Human
aguggucuuuuucacccagug

SEQ ID NO: 103430 - RNA, 22 nt, Human
aguggugccauuaaaaucauug

SEQ ID NO: 103431 - RNA, 22 nt, Human
aguggugccggguggguuuugc

SEQ ID NO: 103432 - RNA, 22 nt, Human
aguguaaacuuaagagaauauc

SEQ ID NO: 103433 - RNA, 22 nt, Human
aguguagaaggagaaauggauc

SEQ ID NO: 103434 - RNA, 21 nt, Human
aguguaggucauuagcuguug

SEQ ID NO: 103435 - RNA, 22 nt, Human
aguguaucuagguaucuauagu

SEQ ID NO: 103436 - RNA, 20 nt, Human
aguguaugaacagaugcggg

SEQ ID NO: 103437 - RNA, 20 nt, Human
aguguaugaaucuggauggg

SEQ ID NO: 103438 - RNA, 22 nt, Human
aguguaugcagguuuucaaugu

SEQ ID NO: 103439 - RNA, 22 nt, Human
aguguaugucaaguauauacac

SEQ ID NO: 103440 - RNA, 22 nt, Human
aguguauuaucagaaacugugg

SEQ ID NO: 103441 - RNA, 22 nt, Human
aguguauucugcaugggagacu

SEQ ID NO: 103442 - RNA, 22 nt, Human
agugucaacucggaauaaggau

SEQ ID NO: 103443 - RNA, 22 nt, Human
agugucagccugggcaaggaac

SEQ ID NO: 103444 - RNA, 17 nt, Human
agugucagggcccuucc

SEQ ID NO: 103445 - RNA, 22 nt, Human
agugucaguugccuugucauaa

SEQ ID NO: 103446 - RNA, 22 nt, Human
agugucauuuccacgacauuca

SEQ ID NO: 103447 - RNA, 22 nt, Human
aguguccccuacagaggcauuc

SEQ ID NO: 103448 - RNA, 22 nt, Human
aguguccucaucuguaaaauga

SEQ ID NO: 103449 - RNA, 22 nt, Human
aguguccuuaguuagcuuuggg

SEQ ID NO: 103450 - RNA, 21 nt, Human
aguguccuuuuacugugaaua

SEQ ID NO: 103451 - RNA, 22 nt, Human
agugucuaaacuggcuuccugg

SEQ ID NO: 103452 - RNA, 22 nt, Human
agugucugcagugaugucucuu

SEQ ID NO: 103453 - RNA, 22 nt, Human
agugucugcuagguucaucaac

SEQ ID NO: 103454 - RNA, 22 nt, Human
agugucugcuuugagucaggug

SEQ ID NO: 103455 - RNA, 22 nt, Human
agugucuggaggcauucuuggu

SEQ ID NO: 103456 - RNA, 22 nt, Human
agugucuggucucugaacuaaa

SEQ ID NO: 103457 - RNA, 20 nt, Human
agugucuggugcagggccuc

SEQ ID NO: 103458 - RNA, 22 nt, Human
agugucuguugaguuucaaaag

SEQ ID NO: 103459 - RNA, 22 nt, Human
agugucuuaguccauuugggcu

SEQ ID NO: 103460 - RNA, 22 nt, Human
agugucuuucucucuccaagug

SEQ ID NO: 103461 - RNA, 22 nt, Human
agugucuuugacacauucaaag

SEQ ID NO: 103462 - RNA, 22 nt, Human
agugugacaaaucuauggcuca

SEQ ID NO: 103463 - RNA, 22 nt, Human
agugugaccuuauuuggaaaca

SEQ ID NO: 103464 - RNA, 19 nt, Human
agugugagacuccaucuca

SEQ ID NO: 103465 - RNA, 22 nt, Human
agugugcauuccucuccucagg

SEQ ID NO: 103466 - RNA, 22 nt, Human
agugugcuagcaagaacugggg

SEQ ID NO: 103467 - RNA, 22 nt, Human
agugugcuauugcaccaucaua

SEQ ID NO: 103468 - RNA, 22 nt, Human
aguguggaccuucacacagaga

SEQ ID NO: 103469 - RNA, 22 nt, Human
aguguggccaaugaggaugggc

SEQ ID NO: 103470 - RNA, 20 nt, Human
agugugguuuucaggaauau

SEQ ID NO: 103471 - RNA, 22 nt, Human
aguguguacucauauacuucca

SEQ ID NO: 103472 - RNA, 19 nt, Human
aguguguacugaaagcacu

SEQ ID NO: 103473 - RNA, 22 nt, Human
agugugucugaucacuugugag

SEQ ID NO: 103474 - RNA, 22 nt, Human
agugugugcaugcauucgugca

SEQ ID NO: 103475 - RNA, 22 nt, Human
aguguguuuggagcgagggagg

SEQ ID NO: 103476 - RNA, 22 nt, Human
aguguuaaggcugguugcuaua

SEQ ID NO: 103477 - RNA, 22 nt, Human
aguguuaguggcugcagcuggu

SEQ ID NO: 103478 - RNA, 22 nt, Human
aguguuauugaggcaaaacugu

SEQ ID NO: 103479 - RNA, 22 nt, Human
aguguucagugauugucaaccg

SEQ ID NO: 103480 - RNA, 20 nt, Human
aguguuccggaagacuggca

SEQ ID NO: 103481 - RNA, 22 nt, Human
aguguucucagcuacuagagag

SEQ ID NO: 103482 - RNA, 18 nt, Human
aguguucucguuuuauaa

SEQ ID NO: 103483 - RNA, 22 nt, Human
aguguucuuccuaucugcuguu

SEQ ID NO: 103484 - RNA, 22 nt, Human
aguguugcaugaggcaguacca

SEQ ID NO: 103485 - RNA, 22 nt, Human
aguguugucaaacggcucagca

SEQ ID NO: 103486 - RNA, 22 nt, Human
aguguuuaccccaaucaguuua

SEQ ID NO: 103487 - RNA, 22 nt, Human
aguguuuagcaugaaguucauu

SEQ ID NO: 103488 - RNA, 22 nt, Human
aguguuuagggaaucaaggggu

SEQ ID NO: 103489 - RNA, 22 nt, Human
agcuuguuaaacagccuccacu

SEQ ID NO: 103490 - RNA, 22 nt, Human
agcuuguuagaaauguagacuc

SEQ ID NO: 103491 - RNA, 21 nt, Human
agcuuguuauuaauucagaac

SEQ ID NO: 103492 - RNA, 22 nt, Human
agcuuguuuuguugaauacuua

SEQ ID NO: 103493 - RNA, 22 nt, Human
agcuuuaaaaauccaauaucca

SEQ ID NO: 103494 - RNA, 22 nt, Human
agcuuuaaagcauauuucuaag

SEQ ID NO: 103495 - RNA, 22 nt, Human
agcuuuaaaucaauccagugag

SEQ ID NO: 103496 - RNA, 23 nt, Human
agcuuuaacccuuucaggagcau

SEQ ID NO: 103497 - RNA, 22 nt, Human
agcuuuagagagccaagacuca

SEQ ID NO: 103498 - RNA, 22 nt, Human
agcuuuauauaaaagaguacau

SEQ ID NO: 103499 - RNA, 22 nt, Human
agcuuuaucccuugcccaucga

SEQ ID NO: 103500 - RNA, 22 nt, Human
agcuuuaugaggagaccuuagu

SEQ ID NO: 103501 - RNA, 22 nt, Human
agcuuuaugcuuccuacaagcu

SEQ ID NO: 103502 - RNA, 22 nt, Human
agcuuuaugggagcuuagauaa

SEQ ID NO: 103503 - RNA, 22 nt, Human
agcuuuauuugucauucacggc

SEQ ID NO: 103504 - RNA, 22 nt, Human
agcuuucacugauaugcuuuga

SEQ ID NO: 103505 - RNA, 22 nt, Human
agcuuucaggauaaugaaaaag

SEQ ID NO: 103506 - RNA, 22 nt, Human
agcuuucuaccagguccugucu

SEQ ID NO: 103507 - RNA, 22 nt, Human
agcuuucucccugacgcuuugg

SEQ ID NO: 103508 - RNA, 22 nt, Human
agcuuucuucuaguuguacagu

SEQ ID NO: 103509 - RNA, 22 nt, Human
agcuuugaaguauuuggucucc

SEQ ID NO: 103510 - RNA, 22 nt, Human
agcuuugaaugagugcauugca

SEQ ID NO: 103511 - RNA, 19 nt, Human
agcuuugccaaaaacuuag

SEQ ID NO: 103512 - RNA, 22 nt, Human
agcuuugcuucugggagccaag

SEQ ID NO: 103513 - RNA, 22 nt, Human
agcuuugcuucuuuuccauagc

SEQ ID NO: 103514 - RNA, 19 nt, Human
agcuuuggacuugcauuuc

SEQ ID NO: 103515 - RNA, 22 nt, Human
agcuuuggaugaucuuugauac

SEQ ID NO: 103516 - RNA, 22 nt, Human
agcuuuggcuguguugcucugu

SEQ ID NO: 103517 - RNA, 22 nt, Human
agcuuugggauucaggcaggaa

SEQ ID NO: 103518 - RNA, 22 nt, Human
agcuuugggcagaagaggauuc

SEQ ID NO: 103519 - RNA, 22 nt, Human
agcuuugggccacuggcuggau

SEQ ID NO: 103520 - RNA, 20 nt, Human
agcuuugguuaagccagugg

SEQ ID NO: 103521 - RNA, 22 nt, Human
agcuuugguugaggggagugug

SEQ ID NO: 103522 - RNA, 22 nt, Human
agcuuugucuucucacauaucc

SEQ ID NO: 103523 - RNA, 23 nt, Human
agcuuugugaaagcagacauggg

SEQ ID NO: 103524 - RNA, 20 nt, Human
aggaaaaauggaaacuggag

SEQ ID NO: 103525 - RNA, 20 nt, Human
aggaaaaggguggugguaga

SEQ ID NO: 103526 - RNA, 22 nt, Human
aggaaaaucgagucuggaggca

SEQ ID NO: 103527 - RNA, 22 nt, Human
aggaaaaugauauucugcuguu

SEQ ID NO: 103528 - RNA, 22 nt, Human
aggaaaauggaccagaguuguu

SEQ ID NO: 103529 - RNA, 22 nt, Human
aggaaaauuaucaugagagcca

SEQ ID NO: 103530 - RNA, 22 nt, Human
aggaaacagagugaagcuuggg

SEQ ID NO: 103531 - RNA, 22 nt, Human
aggaaacaggcagccuuugaac

SEQ ID NO: 103532 - RNA, 22 nt, Human
aggaaacaguugguaaugcaua

SEQ ID NO: 103533 - RNA, 17 nt, Human
aggaaacauuuucuuuc

SEQ ID NO: 103534 - RNA, 22 nt, Human
aggaaacuaaagcccagagagg

SEQ ID NO: 103535 - RNA, 22 nt, Human
aggaaacuaauuaguagaauaa

SEQ ID NO: 103536 - RNA, 22 nt, Human
aggaaacucaaagugucaggua

SEQ ID NO: 103537 - RNA, 22 nt, Human
aggaaacuccccuacaucucaa

SEQ ID NO: 103538 - RNA, 19 nt, Human
aggaaacugucuuuuccag

SEQ ID NO: 103539 - RNA, 22 nt, Human
aggaaacuucagaguuuugguc

SEQ ID NO: 103540 - RNA, 23 nt, Human
aggaaagcauucauuuuuaccau

SEQ ID NO: 103541 - RNA, 22 nt, Human
aggaaagccaaucucucuugac

SEQ ID NO: 103542 - RNA, 22 nt, Human
aggaaagcucccaguagggcuc

SEQ ID NO: 103543 - RNA, 22 nt, Human
aggaaagcuuggcaaacuaaau

SEQ ID NO: 103544 - RNA, 22 nt, Human
aggaaagguagcgugccagcag

SEQ ID NO: 103545 - RNA, 22 nt, Human
aggaaauaagggcacuucagau

SEQ ID NO: 103546 - RNA, 22 nt, Human
aggaaaugccgcggcucucuuu

SEQ ID NO: 103547 - RNA, 22 nt, Human
aggaaaugcugaugcuccugga

SEQ ID NO: 103548 - RNA, 22 nt, Human
aggaaaugggaauagaugguau

SEQ ID NO: 103549 - RNA, 22 nt, Human
aggaaauguacaaaugaagaug

SEQ ID NO: 103550 - RNA, 22 nt, Human
aggaaauguaguccucaucucc

SEQ ID NO: 103551 - RNA, 22 nt, Human
aggaaauuuugaaucagugucu

SEQ ID NO: 103552 - RNA, 22 nt, Human
aggaacaauugauaaacucaca

SEQ ID NO: 103553 - RNA, 22 nt, Human
aggaacacaagcuaugauccac

SEQ ID NO: 103554 - RNA, 22 nt, Human
aggaacacaaugcuucugugug

SEQ ID NO: 103555 - RNA, 22 nt, Human
aggaacacauggacauuucuga

SEQ ID NO: 103556 - RNA, 22 nt, Human
aggaacagaagagcaaugcagg

SEQ ID NO: 103557 - RNA, 22 nt, Human
aggaacaggccucguuuucuau

SEQ ID NO: 103558 - RNA, 22 nt, Human
aggaacccggucugucacugug

SEQ ID NO: 103559 - RNA, 22 nt, Human
aggaaccugagucugaucauuu

SEQ ID NO: 103560 - RNA, 22 nt, Human
aggaacuagugcaacaggagcg

SEQ ID NO: 103561 - RNA, 23 nt, Human
aggaacugaggccuagggaggua

SEQ ID NO: 103562 - RNA, 22 nt, Human
aggaacugauuuauaacuuuag

SEQ ID NO: 103563 - RNA, 22 nt, Human
aggaacuggauauaaugugaga

SEQ ID NO: 103564 - RNA, 22 nt, Human
aggaacugucauguauugcuca

SEQ ID NO: 103565 - RNA, 20 nt, Human
aggaacuuuguagaauacaa

SEQ ID NO: 103566 - RNA, 22 nt, Human
aggaagaaaacuaauuagaugg

SEQ ID NO: 103567 - RNA, 22 nt, Human
aggaagaaaccuacuagaguuu

SEQ ID NO: 103568 - RNA, 22 nt, Human
aggaagaaacugagcucugaca

SEQ ID NO: 103569 - RNA, 21 nt, Human
aggaagaaagguuggagguug

SEQ ID NO: 103570 - RNA, 22 nt, Human
aggaagagcuggaccagaggac

SEQ ID NO: 103571 - RNA, 22 nt, Human
aggaagagguagcugucaaggg

SEQ ID NO: 103572 - RNA, 22 nt, Human
aggaagaguguuaccuaugggu

SEQ ID NO: 103573 - RNA, 20 nt, Human
aggaagauccuuucuuuuaa

SEQ ID NO: 103574 - RNA, 22 nt, Human
aggaagaugugcaaaguuggaa

SEQ ID NO: 103575 - RNA, 22 nt, Human
aggaagcaccggaaugaugacu

SEQ ID NO: 103576 - RNA, 22 nt, Human
aggaagcacuggaagggguugg

SEQ ID NO: 103577 - RNA, 20 nt, Human
aggaagccaaaggcugucuu

SEQ ID NO: 103578 - RNA, 22 nt, Human
aggaagccaagccugacacuca

SEQ ID NO: 103579 - RNA, 22 nt, Human
aggaagccaugguggacgucua

SEQ ID NO: 103580 - RNA, 22 nt, Human
aggaagcccaagucucaucuuc

SEQ ID NO: 103581 - RNA, 22 nt, Human
aggaagccugcaggugacugcu

SEQ ID NO: 103582 - RNA, 22 nt, Human
aggaagccuggaguccugccca

SEQ ID NO: 103583 - RNA, 22 nt, Human
aggaagccuggggcugcccucg

SEQ ID NO: 103584 - RNA, 22 nt, Human
aggaagcuaaccagggagugag

SEQ ID NO: 103585 - RNA, 22 nt, Human
aggaagcuagaaggucuucuuu

SEQ ID NO: 103586 - RNA, 22 nt, Human
aggaagcucauuuugacauauc

SEQ ID NO: 103587 - RNA, 22 nt, Human
aggaagcuuggggcagggcuac

SEQ ID NO: 103588 - RNA, 22 nt, Human
aggaaggcugaucacugcuugu

SEQ ID NO: 103589 - RNA, 20 nt, Human
aggaaggcuguuggccuugc

SEQ ID NO: 103590 - RNA, 22 nt, Human
aggaagggugucaugagcccuu

SEQ ID NO: 103591 - RNA, 22 nt, Human
aggaaggguucuuucuguuuau

SEQ ID NO: 103592 - RNA, 22 nt, Human
aggaagugcagggggaaguacu

SEQ ID NO: 103593 - RNA, 22 nt, Human
aggaauaaccucauugcuuuuu

SEQ ID NO: 103594 - RNA, 22 nt, Human
aggaauaugagcugcugcagug

SEQ ID NO: 103595 - RNA, 22 nt, Human
aggaaucagaauucuuagaauu

SEQ ID NO: 103596 - RNA, 22 nt, Human
aggaaucaggagaugagcacgg

SEQ ID NO: 103597 - RNA, 22 nt, Human
aggaaugaacucgagugaucug

SEQ ID NO: 103598 - RNA, 22 nt, Human
aggaaugacagauguccgcacc

SEQ ID NO: 103599 - RNA, 19 nt, Human
aggaauggaauuaauucug

SEQ ID NO: 103600 - RNA, 22 nt, Human
aguguuuagugaugaaagagaa

SEQ ID NO: 103601 - RNA, 22 nt, Human
aguguuuaucagacaagcccug

SEQ ID NO: 103602 - RNA, 22 nt, Human
aguguuuauggaaucuuaguua

SEQ ID NO: 103603 - RNA, 22 nt, Human
aguguuucaccguauguucuca

SEQ ID NO: 103604 - RNA, 22 nt, Human
aguguuucccaguaggaugaaa

SEQ ID NO: 103605 - RNA, 22 nt, Human
aguguuuuauuucagcacuuug

SEQ ID NO: 103606 - RNA, 22 nt, Human
aguguuuugcuaauccuauuaa

SEQ ID NO: 103607 - RNA, 22 nt, Human
aguguuuuggagugggaaggca

SEQ ID NO: 103608 - RNA, 22 nt, Human
aguuaaacuugccuuuauuccu

SEQ ID NO: 103609 - RNA, 22 nt, Human
aguuaaaugucaguagcuuaac

SEQ ID NO: 103610 - RNA, 22 nt, Human
aguuaaauguguuagccagggu

SEQ ID NO: 103611 - RNA, 22 nt, Human
aguuaacauuugagcuaaaagg

SEQ ID NO: 103612 - RNA, 22 nt, Human
aggagguguugauagaagguuu

SEQ ID NO: 103613 - RNA, 22 nt, Human
aggagucacucagggcuucauc

SEQ ID NO: 103614 - RNA, 22 nt, Human
aggaguccucaugucugugcga

SEQ ID NO: 103615 - RNA, 22 nt, Human
aggagucuguugaaaugucuau

SEQ ID NO: 103616 - RNA, 22 nt, Human
aggagugcaaauaguccagaga

SEQ ID NO: 103617 - RNA, 22 nt, Human
aggagugugaagagccuagauc

SEQ ID NO: 103618 - RNA, 21 nt, Human
aggaguugagugcacaguugg

SEQ ID NO: 103619 - RNA, 22 nt, Human
aggauaaaggucauuauuccca

SEQ ID NO: 103620 - RNA, 22 nt, Human
aggauaaaugaucuagauuuuc

SEQ ID NO: 103621 - RNA, 22 nt, Human
aggauaaauucuccaaagugug

SEQ ID NO: 103622 - RNA, 22 nt, Human
aggcaguugaguggcuuuuuca

SEQ ID NO: 103623 - RNA, 22 nt, Human
aggcauaggacaucuaugucau

SEQ ID NO: 103624 - RNA, 22 nt, Human
aggcauaugauuguaaccuuua

SEQ ID NO: 103625 - RNA, 22 nt, Human
aggcaucugcugcccuucugga

SEQ ID NO: 103626 - RNA, 22 nt, Human
aggcauggauggauccagggcu

SEQ ID NO: 103627 - RNA, 22 nt, Human
aggcauggcacugagcagcuuc

SEQ ID NO: 103628 - RNA, 23 nt, Human
aggcauggcauggaugguggcuc

SEQ ID NO: 103629 - RNA, 22 nt, Human
aggcauggcauggggcagaugu

SEQ ID NO: 103630 - RNA, 19 nt, Human
aggcaugggaagagaaguc

SEQ ID NO: 103631 - RNA, 17 nt, Human
aggcauggucuggggug

SEQ ID NO: 103632 - RNA, 22 nt, Human
aggcauguauaugugcacaugu

SEQ ID NO: 103633 - RNA, 22 nt, Human
aggcaugugcuguuugucucca

SEQ ID NO: 103634 - RNA, 22 nt, Human
aggcauuacaucuaaauauuua

SEQ ID NO: 103635 - RNA, 22 nt, Human
aggccaaauagcagguuugcua

SEQ ID NO: 103636 - RNA, 22 nt, Human
aggccaaauugaucaucuuuag

SEQ ID NO: 103637 - RNA, 22 nt, Human
aggccacacaacucuuagagau

SEQ ID NO: 103638 - RNA, 18 nt, Human
aggccacacuccagaaca

SEQ ID NO: 103639 - RNA, 22 nt, Human
aggccacagagagugcaugugc

SEQ ID NO: 103640 - RNA, 22 nt, Human
aggccacagauacugugaagua

SEQ ID NO: 103641 - RNA, 22 nt, Human
aggccacagccugggaggugac

SEQ ID NO: 103642 - RNA, 22 nt, Human
aggccacaggaguacugucggu

SEQ ID NO: 103643 - RNA, 22 nt, Human
aggccacaguacuuugcagacc

SEQ ID NO: 103644 - RNA, 22 nt, Human
aggccacauagcuugcauguag

SEQ ID NO: 103645 - RNA, 22 nt, Human
aggccacucagggggccaagau

SEQ ID NO: 103646 - RNA, 22 nt, Human
aggccagaaauuuggaguaugu

SEQ ID NO: 103647 - RNA, 22 nt, Human
aggccagaacagcucugcacca

SEQ ID NO: 103648 - RNA, 22 nt, Human
aggccagcagcaugacggcauc

SEQ ID NO: 103649 - RNA, 22 nt, Human
aggccagcauucucucuccagg

SEQ ID NO: 103650 - RNA, 22 nt, Human
aggccagcccucaccuguguuc

SEQ ID NO: 103651 - RNA, 22 nt, Human
aggccagcccugggcugagaga

SEQ ID NO: 103652 - RNA, 23 nt, Human
aggccagcgcagacaccgagcac

SEQ ID NO: 103653 - RNA, 22 nt, Human
aggccagcugccacccgguccg

SEQ ID NO: 103654 - RNA, 22 nt, Human
aggccagcuguuacuagagcca

SEQ ID NO: 103655 - RNA, 22 nt, Human
aggccaggauagcauggaucag

SEQ ID NO: 103656 - RNA, 22 nt, Human
aggccagggccagauuagccac

SEQ ID NO: 103657 - RNA, 22 nt, Human
aggccaggguagggcccauugu

SEQ ID NO: 103658 - RNA, 22 nt, Human
aggccagugguucucugugucc

SEQ ID NO: 103659 - RNA, 22 nt, Human
aggccaguguggcuggagcaca

SEQ ID NO: 103660 - RNA, 22 nt, Human
aggccaucaaaucauguagugc

SEQ ID NO: 103661 - RNA, 22 nt, Human
aggccaugggauuuccaauugg

SEQ ID NO: 103662 - RNA, 22 nt, Human
aggccauguggccccagagucu

SEQ ID NO: 103663 - RNA, 22 nt, Human
aggcccagagagccaguuagug

SEQ ID NO: 103664 - RNA, 21 nt, Human
aggcccagagucuugggggga

SEQ ID NO: 103665 - RNA, 22 nt, Human
aggcccagcccguccucgugcu

SEQ ID NO: 103666 - RNA, 19 nt, Human
aggcccagcgcugggggcu

SEQ ID NO: 103667 - RNA, 22 nt, Human
aggcccagcugggccaggaaca

SEQ ID NO: 103668 - RNA, 21 nt, Human
aggcccaggaauaugcauuuu

SEQ ID NO: 103669 - RNA, 22 nt, Human
aggcccagggcugcucucugaa

SEQ ID NO: 103670 - RNA, 23 nt, Human
aggcccagguauguuuguuuugg

SEQ ID NO: 103671 - RNA, 22 nt, Human
aggccccaaagcagugcaagua

SEQ ID NO: 103672 - RNA, 22 nt, Human
aggcccgagguucgugugcacc

SEQ ID NO: 103673 - RNA, 22 nt, Human
aggcccucacagucuauuguga

SEQ ID NO: 103674 - RNA, 22 nt, Human
aggcccugaccugggagaucua

SEQ ID NO: 103675 - RNA, 20 nt, Human
aggcccugccagggacggag

SEQ ID NO: 103676 - RNA, 22 nt, Human
aggcccuggacacucaagccgg

SEQ ID NO: 103677 - RNA, 22 nt, Human
aggcccuggguuagggcccacu

SEQ ID NO: 103678 - RNA, 22 nt, Human
aggcccuguaagguguggagau

SEQ ID NO: 103679 - RNA, 20 nt, Human
aggcccugugcaucuuguuu

SEQ ID NO: 103680 - RNA, 22 nt, Human
aggccgccuggggagaggcccu

SEQ ID NO: 103681 - RNA, 17 nt, Human
aggccucaggugaaacc

SEQ ID NO: 103682 - RNA, 22 nt, Human
aggccucagugaucaucaucag

SEQ ID NO: 103683 - RNA, 22 nt, Human
aggccucaugucaaagcagcaa

SEQ ID NO: 103684 - RNA, 22 nt, Human
aggccuccagcugaguuuugcu

SEQ ID NO: 103685 - RNA, 22 nt, Human
aggccuccuggcuccaggccuu

SEQ ID NO: 103686 - RNA, 22 nt, Human
aggccucucugcuuagcuugua

SEQ ID NO: 103687 - RNA, 17 nt, Human
aggccucugccggugcc

SEQ ID NO: 103688 - RNA, 22 nt, Human
aggccucugcuggaaagaguug

SEQ ID NO: 103689 - RNA, 22 nt, Human
aggccucuggagguggcagugu

SEQ ID NO: 103690 - RNA, 22 nt, Human
aggccucugggccugcggguuu

SEQ ID NO: 103691 - RNA, 22 nt, Human
aggccucugggucuccucugac

SEQ ID NO: 103692 - RNA, 22 nt, Human
aggccugaaggaagaugagcug

SEQ ID NO: 103693 - RNA, 22 nt, Human
aggccugaaguguggagugggg

SEQ ID NO: 103694 - RNA, 22 nt, Human
aggccugagccccagguuuguu

SEQ ID NO: 103695 - RNA, 22 nt, Human
aggccugaggaccuucuggagg

SEQ ID NO: 103696 - RNA, 22 nt, Human
aggccugagguuccugugcuca

SEQ ID NO: 103697 - RNA, 22 nt, Human
aggccugcuguguagccuguug

SEQ ID NO: 103698 - RNA, 22 nt, Human
aggccuggccugggcggcauug

SEQ ID NO: 103699 - RNA, 22 nt, Human
aggccuggccuuuauguucaag

SEQ ID NO: 103700 - RNA, 18 nt, Human
aggccugggaagcugagg

SEQ ID NO: 103701 - RNA, 22 nt, Human
aggccugggcaagaaggggcgu

SEQ ID NO: 103702 - RNA, 19 nt, Human
aggccugggguuuugcacu

SEQ ID NO: 103703 - RNA, 22 nt, Human
aggccuuaucuccaaauacagu

SEQ ID NO: 103704 - RNA, 22 nt, Human
aggccuuccucggagacaggga

SEQ ID NO: 103705 - RNA, 22 nt, Human
aggcgaagggaccagacgguag

SEQ ID NO: 103706 - RNA, 22 nt, Human
aggcgcaggguuuggacccagg

SEQ ID NO: 103707 - RNA, 22 nt, Human
aggcggcuucugaggaggcugc

SEQ ID NO: 103708 - RNA, 22 nt, Human
aggcggugugcuuugcagagca

SEQ ID NO: 103709 - RNA, 22 nt, Human
aggcgugggaggaucugaggcc

SEQ ID NO: 103710 - RNA, 22 nt, Human
aggcgugguugaggcgagcaua

SEQ ID NO: 103711 - RNA, 22 nt, Human
aggcuaagauguggucugagca

SEQ ID NO: 103712 - RNA, 22 nt, Human
aggcuaagggaugacuggagug

SEQ ID NO: 103713 - RNA, 22 nt, Human
aggcuacagccucaagagugca

SEQ ID NO: 103714 - RNA, 19 nt, Human
aggcuaguguuacaccugc

SEQ ID NO: 103715 - RNA, 22 nt, Human
aggcuaguuaguauuuacaaaa

SEQ ID NO: 103716 - RNA, 23 nt, Human
aggcuaguuugugacuuucuuug

SEQ ID NO: 103717 - RNA, 21 nt, Human
aggcucagagagaaacucuug

SEQ ID NO: 103718 - RNA, 22 nt, Human
aggcucagagagcuguguccau

SEQ ID NO: 103719 - RNA, 22 nt, Human
aggcucagaggugagcaucugc

SEQ ID NO: 103720 - RNA, 22 nt, Human
aggcucagccccugggaggaga

SEQ ID NO: 103721 - RNA, 22 nt, Human
auccuuuaucuuuccuaggaau

SEQ ID NO: 103722 - RNA, 22 nt, Human
aucgagggugaguacagcggac

SEQ ID NO: 103723 - RNA, 22 nt, Human
aucgaguucugaugucccuucu

SEQ ID NO: 103724 - RNA, 22 nt, Human
aucgcaaguuuaaaaaucuuug

SEQ ID NO: 103725 - RNA, 22 nt, Human
aucgcuuuacagccugcuuccu

SEQ ID NO: 103726 - RNA, 20 nt, Human
aucggcuugccuggaaacaa

SEQ ID NO: 103727 - RNA, 22 nt, Human
aucgugcauuuuuauuaacccu

SEQ ID NO: 103728 - RNA, 22 nt, Human
aucuaaacagguguucuuuaga

SEQ ID NO: 103729 - RNA, 22 nt, Human
aucuaacuuauguuuuaccaaa

SEQ ID NO: 103730 - RNA, 22 nt, Human
aucuaagacaaugagugagacu

SEQ ID NO: 103731 - RNA, 22 nt, Human
aucuaagagagagagcaugucu

SEQ ID NO: 103732 - RNA, 22 nt, Human
aucuaauuuucacucauuugcu

SEQ ID NO: 103733 - RNA, 22 nt, Human
aucuacaaaaacugucucagga

SEQ ID NO: 103734 - RNA, 22 nt, Human
aucuacaacaucacauggcauu

SEQ ID NO: 103735 - RNA, 22 nt, Human
aucuacaggcugaggugggagg

SEQ ID NO: 103736 - RNA, 22 nt, Human
aucuacagugcacaggacagcc

SEQ ID NO: 103737 - RNA, 22 nt, Human
aucuacuccugaauauaucuag

SEQ ID NO: 103738 - RNA, 22 nt, Human
aucuagaaagccaggggccugc

SEQ ID NO: 103739 - RNA, 22 nt, Human
aucuagaagucauggcuuucuu

SEQ ID NO: 103740 - RNA, 22 nt, Human
aucuagaggagggcugcuggau

SEQ ID NO: 103741 - RNA, 22 nt, Human
aucuagguuuggaagauagagu

SEQ ID NO: 103742 - RNA, 22 nt, Human
aucuauacccaucaugauuuaa

SEQ ID NO: 103743 - RNA, 22 nt, Human
aucucaaaugauuacaccaagc

SEQ ID NO: 103744 - RNA, 22 nt, Human
aucucaccaaguuauuacgaga

SEQ ID NO: 103745 - RNA, 22 nt, Human
aucucaggaggacccugaugcu

SEQ ID NO: 103746 - RNA, 22 nt, Human
aucucauaaacacacauauaug

SEQ ID NO: 103747 - RNA, 22 nt, Human
aucucauaaucgucauugcuuu

SEQ ID NO: 103748 - RNA, 22 nt, Human
aucucauuuugguuucuacuua

SEQ ID NO: 103749 - RNA, 22 nt, Human
aucuccagaugccuggaaauga

SEQ ID NO: 103750 - RNA, 22 nt, Human
aucuccaguccugguuuccugg

SEQ ID NO: 103751 - RNA, 22 nt, Human
aucuccagugcccaaaggaaau

SEQ ID NO: 103752 - RNA, 22 nt, Human
aucucccagccacagcauucuu

SEQ ID NO: 103753 - RNA, 22 nt, Human
aucuccccgagcuuaccuccug

SEQ ID NO: 103754 - RNA, 22 nt, Human
aucuccucccgcgccgagcucg

SEQ ID NO: 103755 - RNA, 22 nt, Human
aucuccuuggaucacguuuagu

SEQ ID NO: 103756 - RNA, 22 nt, Human
aucucuaaagucuguucagcuc

SEQ ID NO: 103757 - RNA, 22 nt, Human
aucucuaauuuaaaaaguaaca

SEQ ID NO: 103758 - RNA, 22 nt, Human
aucucuagcuaacccucuggca

SEQ ID NO: 103759 - RNA, 15 nt, Human
aucucucuagcugcu

SEQ ID NO: 103760 - RNA, 22 nt, Human
aucucugauuuacagcaucucu

SEQ ID NO: 103761 - RNA, 22 nt, Human
aucucugcuagccuucuucagg

SEQ ID NO: 103762 - RNA, 22 nt, Human
aucucuggccccugggguccga

SEQ ID NO: 103763 - RNA, 22 nt, Human
aucucugguuguuuugcuccca

SEQ ID NO: 103764 - RNA, 22 nt, Human
aucucuguaaaccauaaauuga

SEQ ID NO: 103765 - RNA, 22 nt, Human
aucucuucccaacuccacauuc

SEQ ID NO: 103766 - RNA, 22 nt, Human
aucucuucuagcucugaaauua

SEQ ID NO: 103767 - RNA, 22 nt, Human
aucugaaaaaucuccuuuguca

SEQ ID NO: 103768 - RNA, 23 nt, Human
aucugaaaaggcauuuucuuccc

SEQ ID NO: 103769 - RNA, 22 nt, Human
aucugaagaaugaauggaauua

SEQ ID NO: 103770 - RNA, 22 nt, Human
aucugaagaggucauggcugac

SEQ ID NO: 103771 - RNA, 22 nt, Human
aucugaagcuaucugcacuuca

SEQ ID NO: 103772 - RNA, 22 nt, Human
aucugaagggaaguggaaggca

SEQ ID NO: 103773 - RNA, 22 nt, Human
aucugaauaaauuucuuuuagu

SEQ ID NO: 103774 - RNA, 22 nt, Human
aucugagacugaguuuggauuu

SEQ ID NO: 103775 - RNA, 19 nt, Human
aucugagauuauaaacaga

SEQ ID NO: 103776 - RNA, 22 nt, Human
aucugagucucugacagcaugu

SEQ ID NO: 103777 - RNA, 18 nt, Human
aucugaugcaauucaaua

SEQ ID NO: 103778 - RNA, 21 nt, Human
aucugauguauaaauaccucu

SEQ ID NO: 103779 - RNA, 22 nt, Human
aucugcacuuaagcgaggccug

SEQ ID NO: 103780 - RNA, 22 nt, Human
aucugcaggauguuaggaugau

SEQ ID NO: 103781 - RNA, 22 nt, Human
aucugccuccaaguccaugugu

SEQ ID NO: 103782 - RNA, 22 nt, Human
aucugccugagucuagguuuuc

SEQ ID NO: 103783 - RNA, 22 nt, Human
aucugccugcaguggagguggg

SEQ ID NO: 103784 - RNA, 19 nt, Human
aucugccuuagugcugcug

SEQ ID NO: 103785 - RNA, 17 nt, Human
aucugcugacauucugu

SEQ ID NO: 103786 - RNA, 22 nt, Human
aucugcuuagaauucauugucc

SEQ ID NO: 103787 - RNA, 22 nt, Human
aucugcuuccugggcuccauga

SEQ ID NO: 103788 - RNA, 22 nt, Human
aucugcuugaaacuucuuauac

SEQ ID NO: 103789 - RNA, 20 nt, Human
aucugcuugccuguccucgg

SEQ ID NO: 103790 - RNA, 22 nt, Human
aucuggaaaacacaguguagac

SEQ ID NO: 103791 - RNA, 21 nt, Human
aucuggaaauucugccagaga

SEQ ID NO: 103792 - RNA, 17 nt, Human
aucuggaagcuagcuga

SEQ ID NO: 103793 - RNA, 22 nt, Human
aucuggagaucagcugguggca

SEQ ID NO: 103794 - RNA, 22 nt, Human
aucuggaguuucaguuuucugg

SEQ ID NO: 103795 - RNA, 22 nt, Human
aucuggcuauuucuggucgggg

SEQ ID NO: 103796 - RNA, 22 nt, Human
aucuggcucaccuggguaaaua

SEQ ID NO: 103797 - RNA, 22 nt, Human
aucuggcucccuuggaauccgu

SEQ ID NO: 103798 - RNA, 22 nt, Human
aucuggcuccuacacuugaaga

SEQ ID NO: 103799 - RNA, 17 nt, Human
aucuggcugcuucuaga

SEQ ID NO: 103800 - RNA, 22 nt, Human
aucuggcuggauucuuagcguu

SEQ ID NO: 103801 - RNA, 22 nt, Human
aucuggcuuacgaagcacuggu

SEQ ID NO: 103802 - RNA, 22 nt, Human
aucuggcuuggguguggguagc

SEQ ID NO: 103803 - RNA, 22 nt, Human
aucuggcuuucuuaaugacuua

SEQ ID NO: 103804 - RNA, 22 nt, Human
aucugggaauggaagccuucug

SEQ ID NO: 103805 - RNA, 22 nt, Human
aucugggagacccuugcgggaa

SEQ ID NO: 103806 - RNA, 22 nt, Human
aucugggcagggcagcaaggcg

SEQ ID NO: 103807 - RNA, 20 nt, Human
aucugggcaucaauuuugug

SEQ ID NO: 103808 - RNA, 22 nt, Human
aucuggguuucaaagaagccuu

SEQ ID NO: 103809 - RNA, 22 nt, Human
aucuggugcuaacaaaugugga

SEQ ID NO: 103810 - RNA, 22 nt, Human
aucuguacaagauuuuaugcgu

SEQ ID NO: 103811 - RNA, 22 nt, Human
aucuguauauuuuucaaugcaa

SEQ ID NO: 103812 - RNA, 22 nt, Human
aucugucaagauagacucugca

SEQ ID NO: 103813 - RNA, 22 nt, Human
aucugucccuccucacagccuc

SEQ ID NO: 103814 - RNA, 22 nt, Human
aucuguccugugacagugggag

SEQ ID NO: 103815 - RNA, 22 nt, Human
aucugucugagugcuuaggacc

SEQ ID NO: 103816 - RNA, 22 nt, Human
aucugucuuccaccacacaucc

SEQ ID NO: 103817 - RNA, 22 nt, Human
aucugugaucaagacagacagu

SEQ ID NO: 103818 - RNA, 22 nt, Human
aucuguggauaugcacagagca

SEQ ID NO: 103819 - RNA, 22 nt, Human
aucuguguaugaaaguauaacu

SEQ ID NO: 103820 - RNA, 22 nt, Human
aucuguguguuauuguuuauca

SEQ ID NO: 103821 - RNA, 22 nt, Human
aucuguguguucaggaaguccu

SEQ ID NO: 103822 - RNA, 22 nt, Human
aucuguuauuuacccaucucug

SEQ ID NO: 103823 - RNA, 22 nt, Human
aucuguuguuuucucauauguu

SEQ ID NO: 103824 - RNA, 22 nt, Human
aucuuaaacagaggaaugacuu

SEQ ID NO: 103825 - RNA, 18 nt, Human
aucuuaacuugauggagu

SEQ ID NO: 103826 - RNA, 22 nt, Human
aucuuacaauuacaagacacuc

SEQ ID NO: 103827 - RNA, 22 nt, Human
aucuuacacgauaacuguuagu

SEQ ID NO: 103828 - RNA, 22 nt, Human
aucuuacacuguuggguuucuc

SEQ ID NO: 103829 - RNA, 22 nt, Human
aucuuacagcagcaaggaagua

SEQ ID NO: 103830 - RNA, 22 nt, Human
agggcuccuaugccccauggac

SEQ ID NO: 103831 - RNA, 22 nt, Human
agggcuccugaggcccuucugg

SEQ ID NO: 103832 - RNA, 22 nt, Human
agggcucugugacuaucacugc

SEQ ID NO: 103833 - RNA, 22 nt, Human
agggcucuuuaggccgaggcca

SEQ ID NO: 103834 - RNA, 22 nt, Human
agggcugaagggaggugcucau

SEQ ID NO: 103835 - RNA, 22 nt, Human
agggcugacacaccuuauccuc

SEQ ID NO: 103836 - RNA, 22 nt, Human
agggcugacaguaaaaguauga

SEQ ID NO: 103837 - RNA, 20 nt, Human
agggcugagaagggacuagc

SEQ ID NO: 103838 - RNA, 22 nt, Human
agggcugagacuaaggccagau

SEQ ID NO: 103839 - RNA, 22 nt, Human
agggcugcaccggggcuucgcg

SEQ ID NO: 103840 - RNA, 22 nt, Human
agggcugccugcucugcauuga

SEQ ID NO: 103841 - RNA, 22 nt, Human
agggcugcuauguugauucaga

SEQ ID NO: 103842 - RNA, 22 nt, Human
agggcugcugaggaagccuugc

SEQ ID NO: 103843 - RNA, 22 nt, Human
agggcugcuuaccuggaauggc

SEQ ID NO: 103844 - RNA, 22 nt, Human
agggcuggcaagggauugaaau

SEQ ID NO: 103845 - RNA, 22 nt, Human
agggcuguaccaucagguuccu

SEQ ID NO: 103846 - RNA, 22 nt, Human
agggcuugcagaaaugagaaau

SEQ ID NO: 103847 - RNA, 22 nt, Human
agggcuuguuuccuguuucaua

SEQ ID NO: 103848 - RNA, 22 nt, Human
agggcuuuaaugauuauuuucu

SEQ ID NO: 103849 - RNA, 22 nt, Human
agggcuuucuuuguaaaagaag

SEQ ID NO: 103850 - RNA, 22 nt, Human
aggggaaggccagccuguagag

SEQ ID NO: 103851 - RNA, 22 nt, Human
aggggaauggguagacuguuga

SEQ ID NO: 103852 - RNA, 21 nt, Human
aggggacagaguagcuccagg

SEQ ID NO: 103853 - RNA, 22 nt, Human
aggggaccaaaauguccugccu

SEQ ID NO: 103854 - RNA, 22 nt, Human
aggggagaauuucaacucaggu

SEQ ID NO: 103855 - RNA, 22 nt, Human
aggggagacuggaaucuaacau

SEQ ID NO: 103856 - RNA, 22 nt, Human
aggggagcaaggccguggugua

SEQ ID NO: 103857 - RNA, 22 nt, Human
aggggagccagggcugcgaguu

SEQ ID NO: 103858 - RNA, 22 nt, Human
aggcaguccccagggguguugc

SEQ ID NO: 103859 - RNA, 22 nt, Human
aggcagugcaugcaaaggucgg

SEQ ID NO: 103860 - RNA, 23 nt, Human
aggcaguggugguaacaugucaa

SEQ ID NO: 103861 - RNA, 20 nt, Human
aggcaguguagagaugagua

SEQ ID NO: 103862 - RNA, 22 nt, Human
aggcaguguggagggcuguugc

SEQ ID NO: 103863 - RNA, 22 nt, Human
aggcagugugggccaagcuucc

SEQ ID NO: 103864 - RNA, 22 nt, Human
aggcaguguucuucuaagggca

SEQ ID NO: 103865 - RNA, 21 nt, Human
aggcaguugagcauguuauga

SEQ ID NO: 103866 - RNA, 22 nt, Human
aggcaguuggucauugcucuuu

SEQ ID NO: 103867 - RNA, 22 nt, Human
aggcaguuuaggcagcgauuua

SEQ ID NO: 103868 - RNA, 22 nt, Human
aggcaguuuauccccagagccu

SEQ ID NO: 103869 - RNA, 22 nt, Human
aggcaguuucugggacagcaua

SEQ ID NO: 103870 - RNA, 22 nt, Human
aggcauauacucucagaaaaaa

SEQ ID NO: 103871 - RNA, 22 nt, Human
aggcauccucucugccuugagg

SEQ ID NO: 103872 - RNA, 20 nt, Human
aggcaucugagucacaucuu

SEQ ID NO: 103873 - RNA, 17 nt, Human
aggcaugaggcaucacu

SEQ ID NO: 103874 - RNA, 22 nt, Human
aggcaugcgccaauuuauuaga

SEQ ID NO: 103875 - RNA, 22 nt, Human
aggcauggauguagcagugacc

SEQ ID NO: 103876 - RNA, 22 nt, Human
aggcauggcuuuaggcaggcgu

SEQ ID NO: 103877 - RNA, 20 nt, Human
aggcaugggaugcccagauu

SEQ ID NO: 103878 - RNA, 18 nt, Human
aggcaugguggugcgcac

SEQ ID NO: 103879 - RNA, 21 nt, Human
aggcauuauaaauuucaccug

SEQ ID NO: 103880 - RNA, 22 nt, Human
aggcauucuagaaguagaagua

SEQ ID NO: 103881 - RNA, 22 nt, Human
aggcauuuccuaugggcagaga

SEQ ID NO: 103882 - RNA, 16 nt, Human
aggccaaaaaggggca

SEQ ID NO: 103883 - RNA, 20 nt, Human
aggccaaacccagcgcgccc

SEQ ID NO: 103884 - RNA, 22 nt, Human
aggccaaaccggauggaaaagg

SEQ ID NO: 103885 - RNA, 22 nt, Human
aggccaaagcacagagcuggaa

SEQ ID NO: 103886 - RNA, 22 nt, Human
aggccaaauguguauaaaacau

SEQ ID NO: 103887 - RNA, 22 nt, Human
aggccaagcucccagagaagcu

SEQ ID NO: 103888 - RNA, 22 nt, Human
aggccaagggcaaagcggagag

SEQ ID NO: 103889 - RNA, 22 nt, Human
aggccaagugaacaaugcuagu

SEQ ID NO: 103890 - RNA, 22 nt, Human
aggccaagugcugggacaggug

SEQ ID NO: 103891 - RNA, 22 nt, Human
aggccacaagaaaaugcuucau

SEQ ID NO: 103892 - RNA, 22 nt, Human
aggccacaagaacuaccccauc

SEQ ID NO: 103893 - RNA, 22 nt, Human
aggccacaggauugcacagcau

SEQ ID NO: 103894 - RNA, 22 nt, Human
aggccacagguggaagccagag

SEQ ID NO: 103895 - RNA, 22 nt, Human
aggccacagucagugggugcug

SEQ ID NO: 103896 - RNA, 22 nt, Human
aggccacaguugaggccagcaa

SEQ ID NO: 103897 - RNA, 22 nt, Human
aggccaccacccuaucuccugg

SEQ ID NO: 103898 - RNA, 22 nt, Human
aggccagaugucgggcuagaag

SEQ ID NO: 103899 - RNA, 22 nt, Human
aggccagcagacgugggacuga

SEQ ID NO: 103900 - RNA, 22 nt, Human
aggccagcuaugacucugcucc

SEQ ID NO: 103901 - RNA, 22 nt, Human
aggccaggaauccuugucccag

SEQ ID NO: 103902 - RNA, 22 nt, Human
aggccaggacacuuaaguaaga

SEQ ID NO: 103903 - RNA, 22 nt, Human
aggccaggccuuucuccauucc

SEQ ID NO: 103904 - RNA, 22 nt, Human
aggccaggcgagacacccggcu

SEQ ID NO: 103905 - RNA, 22 nt, Human
aggccaggggugagcacuucug

SEQ ID NO: 103906 - RNA, 22 nt, Human
aggccagggucccacacucgca

SEQ ID NO: 103907 - RNA, 22 nt, Human
aggccagugcagcuggaacaga

SEQ ID NO: 103908 - RNA, 22 nt, Human
aggccaguuguucagugggccg

SEQ ID NO: 103909 - RNA, 22 nt, Human
aggcccagacucagcggggcgg

SEQ ID NO: 103910 - RNA, 22 nt, Human
aggcccagcuggacaaacugcu

SEQ ID NO: 103911 - RNA, 22 nt, Human
aggcccaugugagucuuguccu

SEQ ID NO: 103912 - RNA, 22 nt, Human
aggcccauguucacuugcucag

SEQ ID NO: 103913 - RNA, 22 nt, Human
aggcccccacaggcuugaggca

SEQ ID NO: 103914 - RNA, 22 nt, Human
aggcccuaauccaacaugacug

SEQ ID NO: 103915 - RNA, 22 nt, Human
aggcccuauucaauggggccca

SEQ ID NO: 103916 - RNA, 22 nt, Human
aggcccucucauuccagaggca

SEQ ID NO: 103917 - RNA, 22 nt, Human
aggcccugcaggaguggggaca

SEQ ID NO: 103918 - RNA, 22 nt, Human
aggcccugcccagugccacaag

SEQ ID NO: 103919 - RNA, 22 nt, Human
aggcccugcuuuccagagcuca

SEQ ID NO: 103920 - RNA, 22 nt, Human
aggcccuggcacugccugggag

SEQ ID NO: 103921 - RNA, 22 nt, Human
aggcccuggcccccagagauuc

SEQ ID NO: 103922 - RNA, 22 nt, Human
aggcccuggggucuguuaaauu

SEQ ID NO: 103923 - RNA, 22 nt, Human
aggcccuggucaggucuggcug

SEQ ID NO: 103924 - RNA, 22 nt, Human
aggccgugugagcaugugugag

SEQ ID NO: 103925 - RNA, 22 nt, Human
aggccuagaggaauggccaggg

SEQ ID NO: 103926 - RNA, 22 nt, Human
aggccucacauugggcuucaag

SEQ ID NO: 103927 - RNA, 22 nt, Human
aggccucacucucagagcuucu

SEQ ID NO: 103928 - RNA, 22 nt, Human
aggccucagcucagugugacag

SEQ ID NO: 103929 - RNA, 22 nt, Human
aggccucaguucuugccaggug

SEQ ID NO: 103930 - RNA, 22 nt, Human
aggccucauugcccaccugugg

SEQ ID NO: 103931 - RNA, 21 nt, Human
aggccucccuguugacagggc

SEQ ID NO: 103932 - RNA, 22 nt, Human
aggccucuguagggcccugaag

SEQ ID NO: 103933 - RNA, 18 nt, Human
aggccucugugugcccag

SEQ ID NO: 103934 - RNA, 22 nt, Human
aggccugacuugaauuuagggc

SEQ ID NO: 103935 - RNA, 22 nt, Human
aggccugccuggagccuggcug

SEQ ID NO: 103936 - RNA, 22 nt, Human
aggccuggcaugagaccugaga

SEQ ID NO: 103937 - RNA, 22 nt, Human
aggccuggccccaguugcuagg

SEQ ID NO: 103938 - RNA, 22 nt, Human
aggccugggacgggagccguga

SEQ ID NO: 103939 - RNA, 22 nt, Human
agggcagcagcuccuccuagcu

SEQ ID NO: 103940 - RNA, 22 nt, Human
agggcagcauugccuuucucca

SEQ ID NO: 103941 - RNA, 22 nt, Human
agggcagccauugagggauucu

SEQ ID NO: 103942 - RNA, 22 nt, Human
agggcagcuaaggugcugacug

SEQ ID NO: 103943 - RNA, 22 nt, Human
agggcagcuagcuguagaaaga

SEQ ID NO: 103944 - RNA, 22 nt, Human
agggcagcuggaagguggcuuc

SEQ ID NO: 103945 - RNA, 22 nt, Human
agggcagcuuccauagucuggc

SEQ ID NO: 103946 - RNA, 22 nt, Human
agggcaguguggugggacugac

SEQ ID NO: 103947 - RNA, 22 nt, Human
agggcaucuaguucccucucuu

SEQ ID NO: 103948 - RNA, 23 nt, Human
agggcaugaagcagaggacgugg

SEQ ID NO: 103949 - RNA, 22 nt, Human
agggcaugugggagaggagccu

SEQ ID NO: 103950 - RNA, 22 nt, Human
agggcauuggcacagaucugcu

SEQ ID NO: 103951 - RNA, 22 nt, Human
agggccaccucucuggguuccc

SEQ ID NO: 103952 - RNA, 22 nt, Human
agggccacgugcaccgcggucu

SEQ ID NO: 103953 - RNA, 22 nt, Human
agggccacuggcugacggcugc

SEQ ID NO: 103954 - RNA, 22 nt, Human
agggccagaggcaccuugcagc

SEQ ID NO: 103955 - RNA, 22 nt, Human
agggccagcagcuuggccaacc

SEQ ID NO: 103956 - RNA, 22 nt, Human
agggccagcugaugagaaugag

SEQ ID NO: 103957 - RNA, 18 nt, Human
agggccagcugugaguag

SEQ ID NO: 103958 - RNA, 22 nt, Human
agggccaggaacaccugaaggg

SEQ ID NO: 103959 - RNA, 19 nt, Human
agggccaggauucuggaac

SEQ ID NO: 103960 - RNA, 22 nt, Human
agggccaggcucccaugucagg

SEQ ID NO: 103961 - RNA, 23 nt, Human
agggccaggugcggaaacagcuc

SEQ ID NO: 103962 - RNA, 22 nt, Human
agggcccaccuuggugcugagg

SEQ ID NO: 103963 - RNA, 20 nt, Human
agggcccaggaagagaguua

SEQ ID NO: 103964 - RNA, 22 nt, Human
agggcccaggacagcaucaggg

SEQ ID NO: 103965 - RNA, 22 nt, Human
agggcccaguggagagcugagc

SEQ ID NO: 103966 - RNA, 22 nt, Human
agggcccuuacgcaggcccuuc

SEQ ID NO: 103967 - RNA, 23 nt, Human
agggccucugucccccagcacuc

SEQ ID NO: 103968 - RNA, 22 nt, Human
agggccugcaucaggagcuugg

SEQ ID NO: 103969 - RNA, 22 nt, Human
agggccuggaacuggagaccac

SEQ ID NO: 103970 - RNA, 22 nt, Human
agggccuggacuaauuggaucc

SEQ ID NO: 103971 - RNA, 22 nt, Human
agggccuggcgcguggccgccg

SEQ ID NO: 103972 - RNA, 22 nt, Human
agggccugggccagcacccuuu

SEQ ID NO: 103973 - RNA, 22 nt, Human
agggccugggguagcuuacugc

SEQ ID NO: 103974 - RNA, 22 nt, Human
agggccuggugaccuggguccu

SEQ ID NO: 103975 - RNA, 22 nt, Human
agggccugguucuguguaggga

SEQ ID NO: 103976 - RNA, 22 nt, Human
aggggagcgacauuccgugccg

SEQ ID NO: 103977 - RNA, 22 nt, Human
aggggagcuaacaccagagccc

SEQ ID NO: 103978 - RNA, 22 nt, Human
aggggagcuugaggcauggccu

SEQ ID NO: 103979 - RNA, 22 nt, Human
aggggagcuugccuggucaccc

SEQ ID NO: 103980 - RNA, 22 nt, Human
aggggaggcagcgauaaaccug

SEQ ID NO: 103981 - RNA, 22 nt, Human
aggggagguggcagaaaugugc

SEQ ID NO: 103982 - RNA, 22 nt, Human
aggggcacgaguagagcucuag

SEQ ID NO: 103983 - RNA, 23 nt, Human
aggggcagcaaguuuugguguua

SEQ ID NO: 103984 - RNA, 22 nt, Human
aggggcaguuccaaguuuugug

SEQ ID NO: 103985 - RNA, 22 nt, Human
aggggccaccuguggcacccug

SEQ ID NO: 103986 - RNA, 22 nt, Human
aggggccuggcacugagcuggc

SEQ ID NO: 103987 - RNA, 22 nt, Human
aggggccugguuggccucuguu

SEQ ID NO: 103988 - RNA, 22 nt, Human
aggggcgaggggagccgugcca

SEQ ID NO: 103989 - RNA, 22 nt, Human
aggggcgcugcgguccucagcc

SEQ ID NO: 103990 - RNA, 22 nt, Human
aggggcgucuguaggcaguggg

SEQ ID NO: 103991 - RNA, 22 nt, Human
aggggcuccuggccuggagagc

SEQ ID NO: 103992 - RNA, 22 nt, Human
aggggcucugagugggccagga

SEQ ID NO: 103993 - RNA, 22 nt, Human
aggggcugacuggaaagugcca

SEQ ID NO: 103994 - RNA, 22 nt, Human
aggggcugccuggcuuggcacu

SEQ ID NO: 103995 - RNA, 22 nt, Human
aggggcuggaguucgagguuac

SEQ ID NO: 103996 - RNA, 22 nt, Human
aggggcuuauguuucuccaggc

SEQ ID NO: 103997 - RNA, 17 nt, Human
agggggaaccugggagg

SEQ ID NO: 103998 - RNA, 22 nt, Human
agggggaggcugugcugcgucu

SEQ ID NO: 103999 - RNA, 22 nt, Human
agggggcaggagagaccugcug

SEQ ID NO: 104000 - RNA, 22 nt, Human
agggggcucagugacugaagug

SEQ ID NO: 104001 - RNA, 22 nt, Human
agggggcuccuccggugcuucc

SEQ ID NO: 104002 - RNA, 22 nt, Human
agggggcuggagacaccuccuc

SEQ ID NO: 104003 - RNA, 22 nt, Human
agggggugaaugucugucuaca

SEQ ID NO: 104004 - RNA, 22 nt, Human
agggggugcccagaugaaggau

SEQ ID NO: 104005 - RNA, 22 nt, Human
aggggugaaagagggcccucaa

SEQ ID NO: 104006 - RNA, 22 nt, Human
aggggugugcauccuggaggau

SEQ ID NO: 104007 - RNA, 22 nt, Human
aggguaagcuuggggcuggcag

SEQ ID NO: 104008 - RNA, 19 nt, Human
aggguacacgagagaagag

SEQ ID NO: 104009 - RNA, 22 nt, Human
aggguagggcccggagacagac

SEQ ID NO: 104010 - RNA, 22 nt, Human
aggguagggccguagggccaug

SEQ ID NO: 104011 - RNA, 22 nt, Human
aggguaggguaaaugaugcauc

SEQ ID NO: 104012 - RNA, 22 nt, Human
aggguauguuuuaggcugaguu

SEQ ID NO: 104013 - RNA, 22 nt, Human
agggucaccaguucauaggcac

SEQ ID NO: 104014 - RNA, 20 nt, Human
agggucagagagcgugagug

SEQ ID NO: 104015 - RNA, 22 nt, Human
agggucagagaucggccaugug

SEQ ID NO: 104016 - RNA, 22 nt, Human
agggucagagucaggugcagua

SEQ ID NO: 104017 - RNA, 21 nt, Human
agggucaggaaccaggguacc

SEQ ID NO: 104018 - RNA, 22 nt, Human
agggucagggagugaguauuua

SEQ ID NO: 104019 - RNA, 22 nt, Human
agggucagguuaagggagucau

SEQ ID NO: 104020 - RNA, 23 nt, Human
aggguccagggaucaccaggugu

SEQ ID NO: 104021 - RNA, 21 nt, Human
aggguccuacagggcucagga

SEQ ID NO: 104022 - RNA, 22 nt, Human
aggguccuucuguuccugagca

SEQ ID NO: 104023 - RNA, 22 nt, Human
agggucuaucucucugccuuug

SEQ ID NO: 104024 - RNA, 22 nt, Human
agggucucugggaguagggcac

SEQ ID NO: 104025 - RNA, 22 nt, Human
agggucugacuccucuggcaag

SEQ ID NO: 104026 - RNA, 22 nt, Human
agggucugacugaauggaaaag

SEQ ID NO: 104027 - RNA, 20 nt, Human
agggucugaugugguggccc

SEQ ID NO: 104028 - RNA, 23 nt, Human
agggucugcucagugucguucaa

SEQ ID NO: 104029 - RNA, 20 nt, Human
agggucugcuggguaggaca

SEQ ID NO: 104030 - RNA, 22 nt, Human
agggucuguuguuuguucugga

SEQ ID NO: 104031 - RNA, 22 nt, Human
agggugcaaaagcaaggacagu

SEQ ID NO: 104032 - RNA, 22 nt, Human
agggugcagucacaggaaaugu

SEQ ID NO: 104033 - RNA, 22 nt, Human
agggugccugcugcagguucag

SEQ ID NO: 104034 - RNA, 22 nt, Human
agggugccuggaagccacucac

SEQ ID NO: 104035 - RNA, 22 nt, Human
agggugcguucuaugagaaucu

SEQ ID NO: 104036 - RNA, 22 nt, Human
aggguggcacugguggcucuau

SEQ ID NO: 104037 - RNA, 22 nt, Human
aggguggccaccaaguauguca

SEQ ID NO: 104038 - RNA, 23 nt, Human
aggguggcuugcuuugcuuccuu

SEQ ID NO: 104039 - RNA, 22 nt, Human
aggguggggugcuacaucuuua

SEQ ID NO: 104040 - RNA, 22 nt, Human
agggugguucuuuuaguggaag

SEQ ID NO: 104041 - RNA, 22 nt, Human
agggugugcuguugggucuuuc

SEQ ID NO: 104042 - RNA, 22 nt, Human
aggguuaauugguguccugagg

SEQ ID NO: 104043 - RNA, 22 nt, Human
aggguucagugagguguacucc

SEQ ID NO: 104044 - RNA, 22 nt, Human
aggguuuucauuucugagcauu

SEQ ID NO: 104045 - RNA, 22 nt, Human
agguaaaaugagucuccauuau

SEQ ID NO: 104046 - RNA, 22 nt, Human
agguaaagaaagguguaacauu

SEQ ID NO: 104047 - RNA, 22 nt, Human
agguaaagacagugaaagaggg

SEQ ID NO: 104048 - RNA, 21 nt, Human
agugaaaugaaguguaugcuc

SEQ ID NO: 104049 - RNA, 17 nt, Human
agugaaauuuacauugc

SEQ ID NO: 104050 - RNA, 22 nt, Human
agugaacuguggcccgugaacu

SEQ ID NO: 104051 - RNA, 21 nt, Human
agugaagagugaaacacaugg

SEQ ID NO: 104052 - RNA, 22 nt, Human
agugaagcuaaccugcugauuu

SEQ ID NO: 104053 - RNA, 22 nt, Human
agugaaggaaguuugucuuggg

SEQ ID NO: 104054 - RNA, 22 nt, Human
agugaagugauaguuugccuag

SEQ ID NO: 104055 - RNA, 22 nt, Human
agugaauaugcagcaagaaguu

SEQ ID NO: 104056 - RNA, 22 nt, Human
agugaauuguugccacagagac

SEQ ID NO: 104057 - RNA, 22 nt, Human
agugacaaggccugaagcuccu

SEQ ID NO: 104058 - RNA, 22 nt, Human
agugacaaggugguaaugaagc

SEQ ID NO: 104059 - RNA, 22 nt, Human
agugacaauaugugcuagguau

SEQ ID NO: 104060 - RNA, 21 nt, Human
agugacagaggaaggugcaua

SEQ ID NO: 104061 - RNA, 22 nt, Human
agugacaguauuuguugccaau

SEQ ID NO: 104062 - RNA, 22 nt, Human
agugaccaaucaugguuagauu

SEQ ID NO: 104063 - RNA, 22 nt, Human
agugacucacacaaacaugugu

SEQ ID NO: 104064 - RNA, 21 nt, Human
agugacucugaaccacuugaa

SEQ ID NO: 104065 - RNA, 20 nt, Human
agugacugggagaauggauu

SEQ ID NO: 104066 - RNA, 22 nt, Human
agugacuggugugaaguuaaau

SEQ ID NO: 104067 - RNA, 22 nt, Human
agugacuuaaaggaacuuacug

SEQ ID NO: 104068 - RNA, 22 nt, Human
agugacuucuccguggcaggau

SEQ ID NO: 104069 - RNA, 22 nt, Human
agugacuucuccuaaugucaua

SEQ ID NO: 104070 - RNA, 22 nt, Human
agugagaguauuaaugugaacu

SEQ ID NO: 104071 - RNA, 22 nt, Human
agugaggauaccaauguguaga

SEQ ID NO: 104072 - RNA, 20 nt, Human
agugaggcaguucagugggc

SEQ ID NO: 104073 - RNA, 22 nt, Human
agugaggcuaauaggcaauggu

SEQ ID NO: 104074 - RNA, 22 nt, Human
agugagggaugaagaacugcgg

SEQ ID NO: 104075 - RNA, 22 nt, Human
agugagguaauuagagcugcug

SEQ ID NO: 104076 - RNA, 22 nt, Human
agugagguggggucacagggac

SEQ ID NO: 104077 - RNA, 22 nt, Human
agugagucaaacauauccugac

SEQ ID NO: 104078 - RNA, 20 nt, Human
agugaguuaucagcuacagu

SEQ ID NO: 104079 - RNA, 22 nt, Human
agugauaaugugguaauuauuu

SEQ ID NO: 104080 - RNA, 22 nt, Human
agugauaggacauauggauuuu

SEQ ID NO: 104081 - RNA, 23 nt, Human
agugaucuguguuugaagaaugc

SEQ ID NO: 104082 - RNA, 22 nt, Human
agugaugucuaacuugaucccu

SEQ ID NO: 104083 - RNA, 22 nt, Human
agugauguuaauaaaugauguu

SEQ ID NO: 104084 - RNA, 22 nt, Human
agugauguugacuagcuauaag

SEQ ID NO: 104085 - RNA, 22 nt, Human
agugauugcuugcuuaaggaca

SEQ ID NO: 104086 - RNA, 22 nt, Human
agugauuucaucauuuuaucaa

SEQ ID NO: 104087 - RNA, 20 nt, Human
agugauuuguuaguacauug

SEQ ID NO: 104088 - RNA, 22 nt, Human
agugauuuuaucaauuuacuca

SEQ ID NO: 104089 - RNA, 22 nt, Human
agugauuuugcuuugaagugac

SEQ ID NO: 104090 - RNA, 22 nt, Human
agugcaaacuuuauugugaccu

SEQ ID NO: 104091 - RNA, 22 nt, Human
agugcaauagcaaagaacaaca

SEQ ID NO: 104092 - RNA, 22 nt, Human
agugcacaccuuaguacaaagu

SEQ ID NO: 104093 - RNA, 22 nt, Human
agugcacagcgugauguauugg

SEQ ID NO: 104094 - RNA, 22 nt, Human
agugcagagaccuggucaggca

SEQ ID NO: 104095 - RNA, 22 nt, Human
agugcagcugggacuguagggu

SEQ ID NO: 104096 - RNA, 22 nt, Human
agugcaggcucgcuugugaggc

SEQ ID NO: 104097 - RNA, 23 nt, Human
agugcaugcuugacuuagcaagc

SEQ ID NO: 104098 - RNA, 20 nt, Human
agugcauggagggagagggc

SEQ ID NO: 104099 - RNA, 22 nt, Human
agugcauguucacuggcauggu

SEQ ID NO: 104100 - RNA, 22 nt, Human
agugcauuauauguuucaaugg

SEQ ID NO: 104101 - RNA, 22 nt, Human
agugcauucuggcagaacaggu

SEQ ID NO: 104102 - RNA, 22 nt, Human
agugcauucugucaucuugguu

SEQ ID NO: 104103 - RNA, 22 nt, Human
agugccaggagcaaggagcucc

SEQ ID NO: 104104 - RNA, 21 nt, Human
agugccaguagguauggagga

SEQ ID NO: 104105 - RNA, 23 nt, Human
agugccauugacccuaugucuau

SEQ ID NO: 104106 - RNA, 22 nt, Human
agugcccucgugcccagggccu

SEQ ID NO: 104107 - RNA, 22 nt, Human
agugcccugggccuuccaggac

SEQ ID NO: 104108 - RNA, 22 nt, Human
agugccuaaccccuuguaugaa

SEQ ID NO: 104109 - RNA, 22 nt, Human
agugccucugcagguccgaguu

SEQ ID NO: 104110 - RNA, 19 nt, Human
agugccuugcucucuaggu

SEQ ID NO: 104111 - RNA, 22 nt, Human
agugcgugggcaggcauggaag

SEQ ID NO: 104112 - RNA, 22 nt, Human
agugcuaaaggaucacaggguc

SEQ ID NO: 104113 - RNA, 22 nt, Human
agugcucauaaaaaugugaaac

SEQ ID NO: 104114 - RNA, 22 nt, Human
auguuuguguuucccauucagg

SEQ ID NO: 104115 - RNA, 22 nt, Human
auguuuguugaucauuuaugaa

SEQ ID NO: 104116 - RNA, 22 nt, Human
auguuuuacccuuugcacaaac

SEQ ID NO: 104117 - RNA, 20 nt, Human
auguuuuauaaaagaacggg

SEQ ID NO: 104118 - RNA, 19 nt, Human
auguuuuaugcugauggga

SEQ ID NO: 104119 - RNA, 23 nt, Human
auguuuuaugucucuagcugcca

SEQ ID NO: 104120 - RNA, 22 nt, Human
auguuuuucauaccaguguugg

SEQ ID NO: 104121 - RNA, 22 nt, Human
auuaaaagagauaauguguguu

SEQ ID NO: 104122 - RNA, 22 nt, Human
auuaaacugagcaaauuaacau

SEQ ID NO: 104123 - RNA, 22 nt, Human
auuaaagaaacccagcauguga

SEQ ID NO: 104124 - RNA, 22 nt, Human
auuaaaguugaaauugaacuga

SEQ ID NO: 104125 - RNA, 22 nt, Human
auuaaauacugcaggcuaagca

SEQ ID NO: 104126 - RNA, 22 nt, Human
auuaaauuagcaaacugugaaa

SEQ ID NO: 104127 - RNA, 20 nt, Human
auuaacacugagcuaugggu

SEQ ID NO: 104128 - RNA, 19 nt, Human
auuaacaucaguguuggcc

SEQ ID NO: 104129 - RNA, 22 nt, Human
auuaacaugcagccagacacac

SEQ ID NO: 104130 - RNA, 22 nt, Human
auuaagcugguccagacaaguu

SEQ ID NO: 104131 - RNA, 18 nt, Human
auuaaggaauucuuuaga

SEQ ID NO: 104132 - RNA, 22 nt, Human
auuaaggagguaaacuaugguu

SEQ ID NO: 104133 - RNA, 22 nt, Human
auuaaggcguuggcgugcuuau

SEQ ID NO: 104134 - RNA, 18 nt, Human
auuaaggcuuugauagua

SEQ ID NO: 104135 - RNA, 22 nt, Human
auuaagggccaauccuccagcc

SEQ ID NO: 104136 - RNA, 22 nt, Human
auuaauaaaauaccacuuuguu

SEQ ID NO: 104137 - RNA, 18 nt, Human
auuaaucauaaaaugcug

SEQ ID NO: 104138 - RNA, 20 nt, Human
auuaaugaauacauuuugau

SEQ ID NO: 104139 - RNA, 22 nt, Human
auuaaugucuaccaguugugug

SEQ ID NO: 104140 - RNA, 22 nt, Human
auuacaacaagaaaaggguaag

SEQ ID NO: 104141 - RNA, 22 nt, Human
auuacaagaugcauccauauuu

SEQ ID NO: 104142 - RNA, 22 nt, Human
auuacaauaauacaugcucauu

SEQ ID NO: 104143 - RNA, 22 nt, Human
auuacacaggauuugccuuacu

SEQ ID NO: 104144 - RNA, 22 nt, Human
auuacacaggcuggcucuuuga

SEQ ID NO: 104145 - RNA, 22 nt, Human
auuacagagggucggucguuuu

SEQ ID NO: 104146 - RNA, 22 nt, Human
auuacaguaaaugcuacaggca

SEQ ID NO: 104147 - RNA, 22 nt, Human
auuacaguagcaaaagaccgga

SEQ ID NO: 104148 - RNA, 22 nt, Human
auuacaguaggauuggaaagga

SEQ ID NO: 104149 - RNA, 22 nt, Human
auuacagugccaccucgugguc

SEQ ID NO: 104150 - RNA, 22 nt, Human
auuacaguggacagcuaugcac

SEQ ID NO: 104151 - RNA, 22 nt, Human
auuacaguuaauuuaccuucuu

SEQ ID NO: 104152 - RNA, 21 nt, Human
auuacaucccuggugauacau

SEQ ID NO: 104153 - RNA, 22 nt, Human
auuaccuaugcucuaguaauca

SEQ ID NO: 104154 - RNA, 22 nt, Human
auuacugaggcaaaguaguuuu

SEQ ID NO: 104155 - RNA, 22 nt, Human
auuacugugacuagccaucugg

SEQ ID NO: 104156 - RNA, 22 nt, Human
auuagaaaauacaugggcuguc

SEQ ID NO: 104157 - RNA, 22 nt, Human
aggucugaguuuguuguuggcu

SEQ ID NO: 104158 - RNA, 22 nt, Human
aggucugaucaugggcccacuu

SEQ ID NO: 104159 - RNA, 22 nt, Human
aggucugguguugaugaauucc

SEQ ID NO: 104160 - RNA, 18 nt, Human
aggucuguggucaccagg

SEQ ID NO: 104161 - RNA, 22 nt, Human
aggugaaguugaggaggcagaa

SEQ ID NO: 104162 - RNA, 22 nt, Human
aggugaaugcucacauucuaau

SEQ ID NO: 104163 - RNA, 22 nt, Human
aggugacaugaaaaauguugag

SEQ ID NO: 104164 - RNA, 22 nt, Human
aggugacugguuuaucuggcag

SEQ ID NO: 104165 - RNA, 22 nt, Human
aggugaguuacaggaggagguc

SEQ ID NO: 104166 - RNA, 19 nt, Human
aggugaugugacucuagaa

SEQ ID NO: 104167 - RNA, 20 nt, Human
aggugcaaggcauggcaugu

SEQ ID NO: 104168 - RNA, 22 nt, Human
aggugcaccugagggugucauc

SEQ ID NO: 104169 - RNA, 22 nt, Human
aggugcacugucuaauuagguc

SEQ ID NO: 104170 - RNA, 22 nt, Human
aggugcagcaugaguccaacgg

SEQ ID NO: 104171 - RNA, 23 nt, Human
aggugcagcccuggaccugcccc

SEQ ID NO: 104172 - RNA, 18 nt, Human
aggugcagccucugaggc

SEQ ID NO: 104173 - RNA, 22 nt, Human
aggugcaggagcugugcaggga

SEQ ID NO: 104174 - RNA, 22 nt, Human
aggugcaugaugcagagugcag

SEQ ID NO: 104175 - RNA, 21 nt, Human
aggugccaaggagaagcaggc

SEQ ID NO: 104176 - RNA, 22 nt, Human
aggugccagaugcacagcugaa

SEQ ID NO: 104177 - RNA, 22 nt, Human
aggugccagcucucaggcagga

SEQ ID NO: 104178 - RNA, 22 nt, Human
aggugccauugcuugccaguuu

SEQ ID NO: 104179 - RNA, 18 nt, Human
aggugcccuccuuacacu

SEQ ID NO: 104180 - RNA, 22 nt, Human
aggugccuaucuggucucugca

SEQ ID NO: 104181 - RNA, 22 nt, Human
aggugcugaacuggugaggucu

SEQ ID NO: 104182 - RNA, 22 nt, Human
aggugcugccccgagaaggaug

SEQ ID NO: 104183 - RNA, 22 nt, Human
aggugcuguuaacauaugaggu

SEQ ID NO: 104184 - RNA, 22 nt, Human
aggugcuuggcucgugcacaca

SEQ ID NO: 104185 - RNA, 22 nt, Human
agguggagacccagagaaggcg

SEQ ID NO: 104186 - RNA, 22 nt, Human
agguggcagacuaacagaagga

SEQ ID NO: 104187 - RNA, 22 nt, Human
agguggcagaggacuccuccug

SEQ ID NO: 104188 - RNA, 22 nt, Human
agguggcagaugggggugcucg

SEQ ID NO: 104189 - RNA, 22 nt, Human
agguggcaguuguggaaccauc

SEQ ID NO: 104190 - RNA, 22 nt, Human
agguggcuccucccauggcugg

SEQ ID NO: 104191 - RNA, 22 nt, Human
agguggcugagcugugccccug

SEQ ID NO: 104192 - RNA, 22 nt, Human
agguggcugccuccccgcgcgg

SEQ ID NO: 104193 - RNA, 17 nt, Human
agguggcugcugcgccu

SEQ ID NO: 104194 - RNA, 22 nt, Human
aggugggcaaugaggccugagu

SEQ ID NO: 104195 - RNA, 22 nt, Human
aggugggcccagugggcuccag

SEQ ID NO: 104196 - RNA, 22 nt, Human
agguggggaggagugucucuuu

SEQ ID NO: 104197 - RNA, 22 nt, Human
aggugggguguuggauguuuau

SEQ ID NO: 104198 - RNA, 22 nt, Human
agguggguccuggcucugccau

SEQ ID NO: 104199 - RNA, 22 nt, Human
aggugggugccuauguauguau

SEQ ID NO: 104200 - RNA, 17 nt, Human
agguggguggaucaccu

SEQ ID NO: 104201 - RNA, 22 nt, Human
agguggucuuaaacugcucugg

SEQ ID NO: 104202 - RNA, 22 nt, Human
agguggucuuguggaugccgca

SEQ ID NO: 104203 - RNA, 22 nt, Human
aggugugagaaacgugaccagu

SEQ ID NO: 104204 - RNA, 22 nt, Human
agguuacagugauuauagguuu

SEQ ID NO: 104205 - RNA, 22 nt, Human
agguuagauaagaagguugugg

SEQ ID NO: 104206 - RNA, 22 nt, Human
agguuaggaaugggagguaaug

SEQ ID NO: 104207 - RNA, 23 nt, Human
agguuaugauuauagagcgagga

SEQ ID NO: 104208 - RNA, 22 nt, Human
agguuauuaaaguguauuuuug

SEQ ID NO: 104209 - RNA, 22 nt, Human
agguuauuguagauuauaggca

SEQ ID NO: 104210 - RNA, 22 nt, Human
agguuauuuuugcuuagaaaga

SEQ ID NO: 104211 - RNA, 22 nt, Human
agguucaaauuguugcaguuuc

SEQ ID NO: 104212 - RNA, 22 nt, Human
agguucacacacacaaaaagau

SEQ ID NO: 104213 - RNA, 23 nt, Human
agguucagcuuucuuacucuggg

SEQ ID NO: 104214 - RNA, 17 nt, Human
agguucagguuacauuc

SEQ ID NO: 104215 - RNA, 22 nt, Human
agguucagugccuggaacaggg

SEQ ID NO: 104216 - RNA, 22 nt, Human
agguuccaggucuggguuaugu

SEQ ID NO: 104217 - RNA, 22 nt, Human
agguucccagagauagagcugu

SEQ ID NO: 104218 - RNA, 23 nt, Human
agguucccccgccaggacccugc

SEQ ID NO: 104219 - RNA, 22 nt, Human
agguuccucuuccucuggccug

SEQ ID NO: 104220 - RNA, 22 nt, Human
agguucgggcacuuacaaaugg

SEQ ID NO: 104221 - RNA, 22 nt, Human
agguucucacacgucuacaccc

SEQ ID NO: 104222 - RNA, 22 nt, Human
agguucuggagaacuuggaggu

SEQ ID NO: 104223 - RNA, 22 nt, Human
agguugaagagacuuuaaauua

SEQ ID NO: 104224 - RNA, 22 nt, Human
agguuguuuugccucauuaucc

SEQ ID NO: 104225 - RNA, 22 nt, Human
agguuuauaggaaauuuguucc

SEQ ID NO: 104226 - RNA, 22 nt, Human
agguuuaucucauagaaagaau

SEQ ID NO: 104227 - RNA, 22 nt, Human
agguuuaugccuuggagcuggg

SEQ ID NO: 104228 - RNA, 19 nt, Human
agguuucuaacuauucaag

SEQ ID NO: 104229 - RNA, 22 nt, Human
agguuucuacuguguuaagaaa

SEQ ID NO: 104230 - RNA, 21 nt, Human
agguuucucuuuuauggaggg

SEQ ID NO: 104231 - RNA, 22 nt, Human
agguuucugcaauguguguaca

SEQ ID NO: 104232 - RNA, 22 nt, Human
aguccaggcggguauagaggcu

SEQ ID NO: 104233 - RNA, 22 nt, Human
aguccagucucacucuuggcag

SEQ ID NO: 104234 - RNA, 22 nt, Human
aguccagugucaaggugccauu

SEQ ID NO: 104235 - RNA, 22 nt, Human
aguccauagaggcugcuuucau

SEQ ID NO: 104236 - RNA, 20 nt, Human
agucccaacauucagcucug

SEQ ID NO: 104237 - RNA, 22 nt, Human
agucccagccuaggcugugcug

SEQ ID NO: 104238 - RNA, 22 nt, Human
agucccagccuguaggauuggg

SEQ ID NO: 104239 - RNA, 22 nt, Human
agucccagcuucccccaugcag

SEQ ID NO: 104240 - RNA, 22 nt, Human
agucccaggcagccgagccggu

SEQ ID NO: 104241 - RNA, 19 nt, Human
agucccaggcccgaaagag

SEQ ID NO: 104242 - RNA, 21 nt, Human
aguccccuguccuuacuucua

SEQ ID NO: 104243 - RNA, 22 nt, Human
agucccuuuagucuggagagcu

SEQ ID NO: 104244 - RNA, 22 nt, Human
aguccgccugcugccguggcag

SEQ ID NO: 104245 - RNA, 22 nt, Human
aguccguuucuccuugaaggca

SEQ ID NO: 104246 - RNA, 22 nt, Human
aguccugaugcucuggcaggag

SEQ ID NO: 104247 - RNA, 18 nt, Human
aguccuggcucuaccacc

SEQ ID NO: 104248 - RNA, 22 nt, Human
aguccuggcucuacgggcuuca

SEQ ID NO: 104249 - RNA, 22 nt, Human
aguccuggguccagcagguccu

SEQ ID NO: 104250 - RNA, 22 nt, Human
aguccugggugugcaaggcaga

SEQ ID NO: 104251 - RNA, 22 nt, Human
aguccuggugacacuccucuuc

SEQ ID NO: 104252 - RNA, 22 nt, Human
aguccugguucugauucugaca

SEQ ID NO: 104253 - RNA, 22 nt, Human
aguccuguugguuccagaggug

SEQ ID NO: 104254 - RNA, 22 nt, Human
aguccuuagaacacuguaucug

SEQ ID NO: 104255 - RNA, 22 nt, Human
aguccuuccggcagauuucacu

SEQ ID NO: 104256 - RNA, 22 nt, Human
aguccuucuuuuaguugcuugg

SEQ ID NO: 104257 - RNA, 22 nt, Human
aguccuuugggaaaaaugacua

SEQ ID NO: 104258 - RNA, 22 nt, Human
agucuaauguuuguaaaaucau

SEQ ID NO: 104259 - RNA, 22 nt, Human
agucuacaacgcaagcaacaug

SEQ ID NO: 104260 - RNA, 22 nt, Human
agucuagaugauccuaggaaua

SEQ ID NO: 104261 - RNA, 22 nt, Human
agucuagauguguacuagguua

SEQ ID NO: 104262 - RNA, 22 nt, Human
agucuauuugcuguccgagcaa

SEQ ID NO: 104263 - RNA, 22 nt, Human
agucuauuuugcuuauucuaug

SEQ ID NO: 104264 - RNA, 22 nt, Human
agucucaagcaccgaaagcugu

SEQ ID NO: 104265 - RNA, 19 nt, Human
agucucacccaagcagucu

SEQ ID NO: 104266 - RNA, 22 nt, Human
ggugagaaaaaugaguaugauu

SEQ ID NO: 104267 - RNA, 17 nt, Human
ggugagaccucccacuc

SEQ ID NO: 104268 - RNA, 22 nt, Human
ggugagaggcagugcuguggaa

SEQ ID NO: 104269 - RNA, 18 nt, Human
ggugaggcggcggccagc

SEQ ID NO: 104270 - RNA, 22 nt, Human
ggugaggcguccccaccauggg

SEQ ID NO: 104271 - RNA, 22 nt, Human
ggugagggaguggaacgaggug

SEQ ID NO: 104272 - RNA, 22 nt, Human
ggugaggggcaccucugcccgg

SEQ ID NO: 104273 - RNA, 22 nt, Human
ggugaggggcgccucugcccag

SEQ ID NO: 104274 - RNA, 22 nt, Human
ggugaguuucaugguuguuuac

SEQ ID NO: 104275 - RNA, 22 nt, Human
ggugcaaacguaauugugguuu

SEQ ID NO: 104276 - RNA, 22 nt, Human
ggugcagaagaaagcagucauu

SEQ ID NO: 104277 - RNA, 22 nt, Human
ggugcagcuggacagagaagcc

SEQ ID NO: 104278 - RNA, 22 nt, Human
ggugcaggaaucugcaauugaa

SEQ ID NO: 104279 - RNA, 22 nt, Human
ggugcagugcaggguaauuaua

SEQ ID NO: 104280 - RNA, 22 nt, Human
ggugccagaguggcccaggggc

SEQ ID NO: 104281 - RNA, 22 nt, Human
ggugccagccuagugcaguggu

SEQ ID NO: 104282 - RNA, 22 nt, Human
ggugcccagagccaggaaugag

SEQ ID NO: 104283 - RNA, 22 nt, Human
ggugcccagcaagcuuucaaug

SEQ ID NO: 104284 - RNA, 22 nt, Human
ggugcccagcgaaguggcugug

SEQ ID NO: 104285 - RNA, 22 nt, Human
ggugccuguauuuggggcacag

SEQ ID NO: 104286 - RNA, 22 nt, Human
ggugcucaaggugacaggacau

SEQ ID NO: 104287 - RNA, 22 nt, Human
ggugcugaauucuggaggaggc

SEQ ID NO: 104288 - RNA, 22 nt, Human
ggugcugacauucagagucugg

SEQ ID NO: 104289 - RNA, 22 nt, Human
ggugcugacuucacagucuuac

SEQ ID NO: 104290 - RNA, 22 nt, Human
ggugcugagagccuaggagggc

SEQ ID NO: 104291 - RNA, 22 nt, Human
ggugcugaggccuuggcaggga

SEQ ID NO: 104292 - RNA, 22 nt, Human
ggugcugagugagcuagaggcu

SEQ ID NO: 104293 - RNA, 22 nt, Human
ggugcugauaguaacaauaaua

SEQ ID NO: 104294 - RNA, 22 nt, Human
ggugcugaugaagauguagccu

SEQ ID NO: 104295 - RNA, 22 nt, Human
ggugcugaugaguuaggagagg

SEQ ID NO: 104296 - RNA, 22 nt, Human
ggugcuggacacguggcacucc

SEQ ID NO: 104297 - RNA, 22 nt, Human
ggugcugggaacgaggaauuca

SEQ ID NO: 104298 - RNA, 22 nt, Human
ggugcugguucaggguggcugu

SEQ ID NO: 104299 - RNA, 22 nt, Human
ggugcuguggcagcuccuccuc

SEQ ID NO: 104300 - RNA, 22 nt, Human
gguggacaguguuagcucuggg

SEQ ID NO: 104301 - RNA, 22 nt, Human
gguggagcuauacgggauggcu

SEQ ID NO: 104302 - RNA, 22 nt, Human
gguggaguaauucgcagagguu

SEQ ID NO: 104303 - RNA, 22 nt, Human
gguggauagguacauggacuuu

SEQ ID NO: 104304 - RNA, 22 nt, Human
gguggauggacucucgggggcc

SEQ ID NO: 104305 - RNA, 22 nt, Human
gguggcaccuuacccugcgcag

SEQ ID NO: 104306 - RNA, 22 nt, Human
gguggcaccuugaucuuggacu

SEQ ID NO: 104307 - RNA, 22 nt, Human
gguggcagagaggagguaguuu

SEQ ID NO: 104308 - RNA, 23 nt, Human
gguggcaggaguggaugcugagc

SEQ ID NO: 104309 - RNA, 22 nt, Human
gguggccauucuaccgccuucu

SEQ ID NO: 104310 - RNA, 22 nt, Human
gguggccucgguggugcacagg

SEQ ID NO: 104311 - RNA, 22 nt, Human
gguggccucucaugcaagguag

SEQ ID NO: 104312 - RNA, 17 nt, Human
gguggccugcaguggcu

SEQ ID NO: 104313 - RNA, 18 nt, Human
gguggcucagucaugggg

SEQ ID NO: 104314 - RNA, 22 nt, Human
gguggcucccacccagcuuuga

SEQ ID NO: 104315 - RNA, 22 nt, Human
gguggcugcacccuggcuaacu

SEQ ID NO: 104316 - RNA, 22 nt, Human
gguggcuggaggagcugaugga

SEQ ID NO: 104317 - RNA, 22 nt, Human
ggugggaaggggccagugugcg

SEQ ID NO: 104318 - RNA, 22 nt, Human
ggugggagagcucugucuccag

SEQ ID NO: 104319 - RNA, 22 nt, Human
ggugggagggcugcguuccucu

SEQ ID NO: 104320 - RNA, 16 nt, Human
ggugggaggugaggug

SEQ ID NO: 104321 - RNA, 22 nt, Human
ggugggcaggcgaggcccaggu

SEQ ID NO: 104322 - RNA, 22 nt, Human
ggugggcgacugagagggguuu

SEQ ID NO: 104323 - RNA, 22 nt, Human
gguggggagucaggcauucuug

SEQ ID NO: 104324 - RNA, 22 nt, Human
gguggggcccaggcaucugaug

SEQ ID NO: 104325 - RNA, 21 nt, Human
ggugggguaccuaagguagcu

SEQ ID NO: 104326 - RNA, 22 nt, Human
gguggguauaguuagggccucu

SEQ ID NO: 104327 - RNA, 19 nt, Human
ggugggugaccuccccacc

SEQ ID NO: 104328 - RNA, 22 nt, Human
ggugggugcagggggcuucuua

SEQ ID NO: 104329 - RNA, 22 nt, Human
gguggugacuguccuagggaug

SEQ ID NO: 104330 - RNA, 22 nt, Human
gguggugggagagcuuucugga

SEQ ID NO: 104331 - RNA, 22 nt, Human
gguguagaaaagggaaggguuu

SEQ ID NO: 104332 - RNA, 22 nt, Human
ggugucaaugcucccaccuugg

SEQ ID NO: 104333 - RNA, 22 nt, Human
ggugucauccaacaggacaggg

SEQ ID NO: 104334 - RNA, 22 nt, Human
gguguccacucagcccguccug

SEQ ID NO: 104335 - RNA, 22 nt, Human
gguguccgcgcuguagaagguc

SEQ ID NO: 104336 - RNA, 22 nt, Human
gguguccucggauucagggcag

SEQ ID NO: 104337 - RNA, 22 nt, Human
gguguccugucagcuagaguga

SEQ ID NO: 104338 - RNA, 22 nt, Human
gguguccuuagaaagcagaccu

SEQ ID NO: 104339 - RNA, 22 nt, Human
gguguccuuguccuuugguacc

SEQ ID NO: 104340 - RNA, 22 nt, Human
gguguccuuugggggcuccgag

SEQ ID NO: 104341 - RNA, 22 nt, Human
ggugucugauuccaaggccaca

SEQ ID NO: 104342 - RNA, 19 nt, Human
ggugugaagugaggaguua

SEQ ID NO: 104343 - RNA, 22 nt, Human
ggugugggagagauucuuuccu

SEQ ID NO: 104344 - RNA, 22 nt, Human
gguguggguccuugugcuugcu

SEQ ID NO: 104345 - RNA, 22 nt, Human
gguguguagcauguuuaagacc

SEQ ID NO: 104346 - RNA, 22 nt, Human
ggugugugguccucucacuuag

SEQ ID NO: 104347 - RNA, 22 nt, Human
ggugugugguuuugauacaguc

SEQ ID NO: 104348 - RNA, 22 nt, Human
gguuaaacacuuuggaaguggc

SEQ ID NO: 104349 - RNA, 22 nt, Human
gguucacagguccgacugcugg

SEQ ID NO: 104350 - RNA, 22 nt, Human
gguucacagguccugggagcag

SEQ ID NO: 104351 - RNA, 22 nt, Human
gguucaguggaauguguugacc

SEQ ID NO: 104352 - RNA, 22 nt, Human
gguuccacgguguuuggaggca

SEQ ID NO: 104353 - RNA, 22 nt, Human
gguuccugugcccaugucaugg

SEQ ID NO: 104354 - RNA, 22 nt, Human
gguuccuguguacuguggcuua

SEQ ID NO: 104355 - RNA, 22 nt, Human
gguucugacaagcugggauggu

SEQ ID NO: 104356 - RNA, 22 nt, Human
gguuggacacuagguaggagcg

SEQ ID NO: 104357 - RNA, 22 nt, Human
gguuggaggugggaauagcuag

SEQ ID NO: 104358 - RNA, 22 nt, Human
gguuggggcgagcuggaggccc

SEQ ID NO: 104359 - RNA, 22 nt, Human
gguugguaacucccugugcagu

SEQ ID NO: 104360 - RNA, 22 nt, Human
gguuggugagugcaggguguua

SEQ ID NO: 104361 - RNA, 22 nt, Human
gguuguaguuggagguuguaua

SEQ ID NO: 104362 - RNA, 19 nt, Human
gguuuaucuguuucuucuc

SEQ ID NO: 104363 - RNA, 22 nt, Human
gguuuauuaaugugaacuguau

SEQ ID NO: 104364 - RNA, 22 nt, Human
gguuuauuguuaauaaguuuga

SEQ ID NO: 104365 - RNA, 22 nt, Human
gguuucaaauuaaagucuuaag

SEQ ID NO: 104366 - RNA, 22 nt, Human
gguuuccaccuugcuaugagaa

SEQ ID NO: 104367 - RNA, 22 nt, Human
gguuuccugcauugggaaauuu

SEQ ID NO: 104368 - RNA, 22 nt, Human
gguuugguuuuggccaucuucc

SEQ ID NO: 104369 - RNA, 22 nt, Human
gguuuucaguuugugagcucug

SEQ ID NO: 104370 - RNA, 22 nt, Human
gguuuuggaaguauaaagaugu

SEQ ID NO: 104371 - RNA, 22 nt, Human
guaaaaccugcuuuucaacacc

SEQ ID NO: 104372 - RNA, 22 nt, Human
guaaaacugcagaacuuggagg

SEQ ID NO: 104373 - RNA, 22 nt, Human
guaaaaucuuuccuauuugccu

SEQ ID NO: 104374 - RNA, 22 nt, Human
guaaaauugcaauuacuuuugc

SEQ ID NO: 104375 - RNA, 22 nt, Human
gcagggccagguacaagaagca

SEQ ID NO: 104376 - RNA, 20 nt, Human
gcagggcgacacgggggagg

SEQ ID NO: 104377 - RNA, 22 nt, Human
gcagggcuaggucuucuagggc

SEQ ID NO: 104378 - RNA, 22 nt, Human
gcagggcucaacaggacacccc

SEQ ID NO: 104379 - RNA, 22 nt, Human
gcagggcuccacuguggccaag

SEQ ID NO: 104380 - RNA, 22 nt, Human
gcagggcucugcuguaguccua

SEQ ID NO: 104381 - RNA, 22 nt, Human
gcagggcugacucagccacccu

SEQ ID NO: 104382 - RNA, 22 nt, Human
gcagggcugagucaugugugcc

SEQ ID NO: 104383 - RNA, 18 nt, Human
gcagggcugcacacgcau

SEQ ID NO: 104384 - RNA, 22 nt, Human
gcagggcuguucaggagggugg

SEQ ID NO: 104385 - RNA, 22 nt, Human
gcagggcuugcagcagcuagac

SEQ ID NO: 104386 - RNA, 22 nt, Human
gcaggggcggcuggguuuccag

SEQ ID NO: 104387 - RNA, 22 nt, Human
gcaggggcuacucugagcuucc

SEQ ID NO: 104388 - RNA, 22 nt, Human
gcagggggauggaguugaaaug

SEQ ID NO: 104389 - RNA, 22 nt, Human
gcaggguacauugggaugggau

SEQ ID NO: 104390 - RNA, 21 nt, Human
gcaggguccuuuccauuccua

SEQ ID NO: 104391 - RNA, 22 nt, Human
gcaggguggauggcagggccag

SEQ ID NO: 104392 - RNA, 22 nt, Human
gcagguagugaucgagggugac

SEQ ID NO: 104393 - RNA, 19 nt, Human
gcaggucauuaggcuaggu

SEQ ID NO: 104394 - RNA, 22 nt, Human
gcaggucucaaucugagcaggc

SEQ ID NO: 104395 - RNA, 22 nt, Human
gcaggucuggcauagagccugc

SEQ ID NO: 104396 - RNA, 22 nt, Human
gcaggucuguugauuacaguca

SEQ ID NO: 104397 - RNA, 22 nt, Human
gcaggugaaugauggacuagga

SEQ ID NO: 104398 - RNA, 22 nt, Human
gcaggugauucacccugggccu

SEQ ID NO: 104399 - RNA, 22 nt, Human
gcagguggagcaguagucuggu

SEQ ID NO: 104400 - RNA, 22 nt, Human
gcagguggauauugcuacuuga

SEQ ID NO: 104401 - RNA, 14 nt, Human
gcagguggaucacc

SEQ ID NO: 104402 - RNA, 22 nt, Human
gcaggugggagccgcugccuga

SEQ ID NO: 104403 - RNA, 16 nt, Human
gcagguggggcgcgca

SEQ ID NO: 104404 - RNA, 22 nt, Human
gcaggugggggagaaguuguga

SEQ ID NO: 104405 - RNA, 22 nt, Human
gcagguggucacucauccccag

SEQ ID NO: 104406 - RNA, 22 nt, Human
gcaggugucaguccccaaggug

SEQ ID NO: 104407 - RNA, 22 nt, Human
gcaggugugaaugugaauuaag

SEQ ID NO: 104408 - RNA, 22 nt, Human
gcaggugugcugaauuacguga

SEQ ID NO: 104409 - RNA, 22 nt, Human
gcagguguggagaguggucggg

SEQ ID NO: 104410 - RNA, 22 nt, Human
guacaaaugagaguucuguuuu

SEQ ID NO: 104411 - RNA, 22 nt, Human
guacaaauuaggaagcuuugug

SEQ ID NO: 104412 - RNA, 22 nt, Human
guacaacaggauugauguacca

SEQ ID NO: 104413 - RNA, 22 nt, Human
guacaacaugauuuuacucucu

SEQ ID NO: 104414 - RNA, 22 nt, Human
guacaagaggagaaaauggagu

SEQ ID NO: 104415 - RNA, 21 nt, Human
guacaagcucaccaaguggac

SEQ ID NO: 104416 - RNA, 22 nt, Human
guacaauuccugucaagcuggc

SEQ ID NO: 104417 - RNA, 22 nt, Human
guacacauacuauucaaagaga

SEQ ID NO: 104418 - RNA, 23 nt, Human
guacacauaguguaguuauauuu

SEQ ID NO: 104419 - RNA, 22 nt, Human
guacagaaaugugaugacgcaa

SEQ ID NO: 104420 - RNA, 22 nt, Human
guacagaaggauuucuaguagu

SEQ ID NO: 104421 - RNA, 22 nt, Human
guacagagaagguuacauauga

SEQ ID NO: 104422 - RNA, 22 nt, Human
guacagagguugcuggaggcuc

SEQ ID NO: 104423 - RNA, 22 nt, Human
guacaggaaggagggaguuuca

SEQ ID NO: 104424 - RNA, 22 nt, Human
guacaggccaccacugaauuuu

SEQ ID NO: 104425 - RNA, 22 nt, Human
guacaguacuucagaaccagcc

SEQ ID NO: 104426 - RNA, 22 nt, Human
guacauaagaaauuacuacaga

SEQ ID NO: 104427 - RNA, 22 nt, Human
guacaugagcauaaacacacau

SEQ ID NO: 104428 - RNA, 22 nt, Human
guacauguugguuguuuccagu

SEQ ID NO: 104429 - RNA, 22 nt, Human
guacauuggcaacucucuuaga

SEQ ID NO: 104430 - RNA, 22 nt, Human
guacauuuacugaugaaaagua

SEQ ID NO: 104431 - RNA, 22 nt, Human
guacauuuaggauucauugaaa

SEQ ID NO: 104432 - RNA, 22 nt, Human
guaccaaaucuguauuaggaaa

SEQ ID NO: 104433 - RNA, 22 nt, Human
guaccaugggaucuagggccca

SEQ ID NO: 104434 - RNA, 22 nt, Human
guaccugggggauccacuucuu

SEQ ID NO: 104435 - RNA, 22 nt, Human
guacuacaguuucucauuaaau

SEQ ID NO: 104436 - RNA, 20 nt, Human
guacucagaucaagucagcu

SEQ ID NO: 104437 - RNA, 22 nt, Human
guacugaauaacaaagucuguc

SEQ ID NO: 104438 - RNA, 22 nt, Human
guacugcuguaaauauucuuca

SEQ ID NO: 104439 - RNA, 22 nt, Human
guacuuuaagacuccaguagca

SEQ ID NO: 104440 - RNA, 22 nt, Human
guagaaauguaaccaggagaua

SEQ ID NO: 104441 - RNA, 20 nt, Human
guagaaccaugugugcuggg

SEQ ID NO: 104442 - RNA, 22 nt, Human
guagaaccuucuuuacuagagu

SEQ ID NO: 104443 - RNA, 22 nt, Human
guagaacucccagugguauugu

SEQ ID NO: 104444 - RNA, 22 nt, Human
guagaauaaauguacacaucug

SEQ ID NO: 104445 - RNA, 22 nt, Human
guagaauuaccucucuaugucc

SEQ ID NO: 104446 - RNA, 22 nt, Human
guagacaaauuucuucucucaa

SEQ ID NO: 104447 - RNA, 22 nt, Human
guagacaucuagauuuaugugu

SEQ ID NO: 104448 - RNA, 22 nt, Human
guagagcagggagcaggaagcu

SEQ ID NO: 104449 - RNA, 22 nt, Human
guagcaauguugaacacugcgu

SEQ ID NO: 104450 - RNA, 22 nt, Human
guagcagcagagcagguccucc

SEQ ID NO: 104451 - RNA, 22 nt, Human
guagcagcucuccaggguucac

SEQ ID NO: 104452 - RNA, 22 nt, Human
guagcagcucugagcaugcugc

SEQ ID NO: 104453 - RNA, 22 nt, Human
guagcagcuucagcccaaauua

SEQ ID NO: 104454 - RNA, 22 nt, Human
guagcauucugaguucgcagag

SEQ ID NO: 104455 - RNA, 22 nt, Human
guagcugauccugaggacaggg

SEQ ID NO: 104456 - RNA, 22 nt, Human
guagcugucucggucaggaguu

SEQ ID NO: 104457 - RNA, 22 nt, Human
guagcuuauuagggauaauagu

SEQ ID NO: 104458 - RNA, 22 nt, Human
guagcuuccagaaagugucuuu

SEQ ID NO: 104459 - RNA, 23 nt, Human
guaggaauuuucacuuccucuug

SEQ ID NO: 104460 - RNA, 22 nt, Human
guaggcagggcuguggggagaa

SEQ ID NO: 104461 - RNA, 22 nt, Human
guaggcagugguuggaagagaa

SEQ ID NO: 104462 - RNA, 22 nt, Human
guaggcugugugaggcuagaga

SEQ ID NO: 104463 - RNA, 21 nt, Human
guagggacagagaguugguga

SEQ ID NO: 104464 - RNA, 22 nt, Human
guagggacaugccauuaucuca

SEQ ID NO: 104465 - RNA, 22 nt, Human
guagggcaacaugggcacuagg

SEQ ID NO: 104466 - RNA, 22 nt, Human
guaggggugcugagaucuggaa

SEQ ID NO: 104467 - RNA, 18 nt, Human
guaggucaguaccaagca

SEQ ID NO: 104468 - RNA, 22 nt, Human
guaguaaagcagguuuugcugu

SEQ ID NO: 104469 - RNA, 22 nt, Human
guagucacaaaccauucauaug

SEQ ID NO: 104470 - RNA, 22 nt, Human
guaguguguaggcacugugcuc

SEQ ID NO: 104471 - RNA, 22 nt, Human
guauaacugcuaccaccugaug

SEQ ID NO: 104472 - RNA, 22 nt, Human
guauacaauacacaaugcucug

SEQ ID NO: 104473 - RNA, 22 nt, Human
guauacacugguaagauuuguc

SEQ ID NO: 104474 - RNA, 22 nt, Human
guauacauacuucuagauuaaa

SEQ ID NO: 104475 - RNA, 22 nt, Human
guauacauuuauuacaggucuu

SEQ ID NO: 104476 - RNA, 22 nt, Human
guauacuugcagacauuuauau

SEQ ID NO: 104477 - RNA, 22 nt, Human
guauagaaacccagaaagauag

SEQ ID NO: 104478 - RNA, 22 nt, Human
guauagaaggaucuggugaauu

SEQ ID NO: 104479 - RNA, 20 nt, Human
guauauaaccauagugacua

SEQ ID NO: 104480 - RNA, 22 nt, Human
guauaucaccccaagcagcuga

SEQ ID NO: 104481 - RNA, 22 nt, Human
guauaucaggcagaauguucuc

SEQ ID NO: 104482 - RNA, 22 nt, Human
guauaugagaaccauggaggug

SEQ ID NO: 104483 - RNA, 22 nt, Human
guauccaugggggauugguucc

SEQ ID NO: 104484 - RNA, 18 nt, Human
gccuggcugccaacccag

SEQ ID NO: 104485 - RNA, 23 nt, Human
gccuggcuuccaagguaggggag

SEQ ID NO: 104486 - RNA, 18 nt, Human
gccuggcuucggagccgc

SEQ ID NO: 104487 - RNA, 22 nt, Human
gccuggcuugccagcccuggcg

SEQ ID NO: 104488 - RNA, 21 nt, Human
gccugggaaaucugggaagcc

SEQ ID NO: 104489 - RNA, 22 nt, Human
gccugggaagacuaagugggag

SEQ ID NO: 104490 - RNA, 22 nt, Human
gccugggagagggauagugcag

SEQ ID NO: 104491 - RNA, 22 nt, Human
gccugggagcacaucggggucc

SEQ ID NO: 104492 - RNA, 18 nt, Human
gccugggaggaggaaaug

SEQ ID NO: 104493 - RNA, 16 nt, Human
gccugggagggaacag

SEQ ID NO: 104494 - RNA, 22 nt, Human
gccuggggaacuugauccuguc

SEQ ID NO: 104495 - RNA, 22 nt, Human
gccuggggcaugcagcugauac

SEQ ID NO: 104496 - RNA, 22 nt, Human
gccugggugaauuugauccuaa

SEQ ID NO: 104497 - RNA, 22 nt, Human
gccugggugagggucuccuuca

SEQ ID NO: 104498 - RNA, 22 nt, Human
gccuggguuccaugaucuccag

SEQ ID NO: 104499 - RNA, 22 nt, Human
gccuggucucugggguugggua

SEQ ID NO: 104500 - RNA, 22 nt, Human
gccuggugguauccuggcaaga

SEQ ID NO: 104501 - RNA, 22 nt, Human
gccuguccccaggagaguccgg

SEQ ID NO: 104502 - RNA, 22 nt, Human
gccugucucuuggaacuuggua

SEQ ID NO: 104503 - RNA, 22 nt, Human
gccugugacccagggcccagga

SEQ ID NO: 104504 - RNA, 22 nt, Human
gccugugacucgucuugggcca

SEQ ID NO: 104505 - RNA, 22 nt, Human
gccugugcuuaacugacgugag

SEQ ID NO: 104506 - RNA, 22 nt, Human
gccuguggcccaacugucuguc

SEQ ID NO: 104507 - RNA, 22 nt, Human
gccugugguuugauuaagcauu

SEQ ID NO: 104508 - RNA, 22 nt, Human
gccuguguccuucccagugggg

SEQ ID NO: 104509 - RNA, 22 nt, Human
gccuguucuccagcauccaggu

SEQ ID NO: 104510 - RNA, 22 nt, Human
gccuguuuaaguauucugacau

SEQ ID NO: 104511 - RNA, 22 nt, Human
gccuguuuccaucaacacaugc

SEQ ID NO: 104512 - RNA, 22 nt, Human
gccuguuuguuaugucauggua

SEQ ID NO: 104513 - RNA, 22 nt, Human
gccuuaauacagauggguggug

SEQ ID NO: 104514 - RNA, 22 nt, Human
gccuuaauuaguaacagaccau

SEQ ID NO: 104515 - RNA, 22 nt, Human
gccuuaauuuuuuauaaucucu

SEQ ID NO: 104516 - RNA, 22 nt, Human
gccuuagcaucuuaaagcugug

SEQ ID NO: 104517 - RNA, 18 nt, Human
gccuucagacugcaugcu

SEQ ID NO: 104518 - RNA, 22 nt, Human
gccuucagaguaccauguccuc

SEQ ID NO: 104519 - RNA, 22 nt, Human
gccuucaggaaaucaguccuug

SEQ ID NO: 104520 - RNA, 22 nt, Human
gccuucaggaggguuccagaca

SEQ ID NO: 104521 - RNA, 22 nt, Human
gccuucaggugcugccaggcua

SEQ ID NO: 104522 - RNA, 22 nt, Human
gccuucaguaguauccucauga

SEQ ID NO: 104523 - RNA, 22 nt, Human
gccuucaguagugucagcugua

SEQ ID NO: 104524 - RNA, 17 nt, Human
gccuuccagcauguggg

SEQ ID NO: 104525 - RNA, 22 nt, Human
gccuucccacccugcgaggcug

SEQ ID NO: 104526 - RNA, 22 nt, Human
gccuucuguccaaccccacgau

SEQ ID NO: 104527 - RNA, 22 nt, Human
gccuucugugcuccuggccuuu

SEQ ID NO: 104528 - RNA, 22 nt, Human
gccuugaacucauguauauuga

SEQ ID NO: 104529 - RNA, 22 nt, Human
gccuugaucugcuguguuugag

SEQ ID NO: 104530 - RNA, 21 nt, Human
gccuugccgugaaagcccuuu

SEQ ID NO: 104531 - RNA, 22 nt, Human
gccuuggaaagcuggagcaguu

SEQ ID NO: 104532 - RNA, 22 nt, Human
gccuuggaacaauuauugcugc

SEQ ID NO: 104533 - RNA, 22 nt, Human
gccuuggacuaccacucccaca

SEQ ID NO: 104534 - RNA, 23 nt, Human
gccuuggagaagucacucaggga

SEQ ID NO: 104535 - RNA, 22 nt, Human
gccuugggccagcugcucugga

SEQ ID NO: 104536 - RNA, 17 nt, Human
gccuuuauacaugcugc

SEQ ID NO: 104537 - RNA, 22 nt, Human
gccuuuauauuuuucugguguu

SEQ ID NO: 104538 - RNA, 22 nt, Human
gccuuuaucccuguacaaggug

SEQ ID NO: 104539 - RNA, 18 nt, Human
gccuuuggacugcuccca

SEQ ID NO: 104540 - RNA, 22 nt, Human
gccuuuggugacaggcaugugu

SEQ ID NO: 104541 - RNA, 22 nt, Human
gccuuuuaaggcagagggagau

SEQ ID NO: 104542 - RNA, 22 nt, Human
gccuuuuuuguugcucugucac

SEQ ID NO: 104543 - RNA, 22 nt, Human
gcgacuguacagaauugccccu

SEQ ID NO: 104544 - RNA, 19 nt, Human
gcgaggaagucacuguggu

SEQ ID NO: 104545 - RNA, 22 nt, Human
gcgcaccaccuccagguggccg

SEQ ID NO: 104546 - RNA, 22 nt, Human
gcgcaggagccgcggagggccg

SEQ ID NO: 104547 - RNA, 22 nt, Human
gcgcaggcccgggucagggccg

SEQ ID NO: 104548 - RNA, 22 nt, Human
gcgccuauuuucauuaucaagg

SEQ ID NO: 104549 - RNA, 22 nt, Human
gcgcgcuaccgccagggcugca

SEQ ID NO: 104550 - RNA, 22 nt, Human
gcgcucaggugccaggccugcg

SEQ ID NO: 104551 - RNA, 22 nt, Human
gcgcuccucccggcccuggugg

SEQ ID NO: 104552 - RNA, 22 nt, Human
gcgcugaggcuggaggcgcacg

SEQ ID NO: 104553 - RNA, 23 nt, Human
gcggaaggggucauaauggagac

SEQ ID NO: 104554 - RNA, 22 nt, Human
gcggcaggaagagcgcagcccc

SEQ ID NO: 104555 - RNA, 22 nt, Human
gcggcccgagcaggacgggugg

SEQ ID NO: 104556 - RNA, 22 nt, Human
gcggccugcgcugcucccgacg

SEQ ID NO: 104557 - RNA, 18 nt, Human
gcgggcggugcagugggc

SEQ ID NO: 104558 - RNA, 22 nt, Human
gcggggccauguccaacggccu

SEQ ID NO: 104559 - RNA, 22 nt, Human
gcgguagcucaagcuuguaauc

SEQ ID NO: 104560 - RNA, 22 nt, Human
gcgucucaaggcccccaggcca

SEQ ID NO: 104561 - RNA, 22 nt, Human
gcgugcaacagccucuuccauu

SEQ ID NO: 104562 - RNA, 22 nt, Human
gcgugggcuggacugggaugaa

SEQ ID NO: 104563 - RNA, 22 nt, Human
gcgugggguagguagacaugga

SEQ ID NO: 104564 - RNA, 22 nt, Human
gccacccuggaccacccugggc

SEQ ID NO: 104565 - RNA, 22 nt, Human
gccaccuccuuauuccaccugu

SEQ ID NO: 104566 - RNA, 20 nt, Human
gccaccucucuagcaguaga

SEQ ID NO: 104567 - RNA, 22 nt, Human
gccaccuggacucagagccagg

SEQ ID NO: 104568 - RNA, 22 nt, Human
gccaccuguuucgcuugcccag

SEQ ID NO: 104569 - RNA, 21 nt, Human
gccacguuucagucuucucag

SEQ ID NO: 104570 - RNA, 22 nt, Human
gccacucaugggaggugugcaa

SEQ ID NO: 104571 - RNA, 19 nt, Human
gccacuccugaugcugccc

SEQ ID NO: 104572 - RNA, 22 nt, Human
gccacugaacauuagagcuagu

SEQ ID NO: 104573 - RNA, 20 nt, Human
gccacugggcaccagcaggg

SEQ ID NO: 104574 - RNA, 22 nt, Human
gccacugucauacccuggcaau

SEQ ID NO: 104575 - RNA, 22 nt, Human
gccacuguccugugccugugcu

SEQ ID NO: 104576 - RNA, 21 nt, Human
gccacugugcacacuaaccca

SEQ ID NO: 104577 - RNA, 22 nt, Human
gccacuguugcuccucaggaaa

SEQ ID NO: 104578 - RNA, 22 nt, Human
gccagagaaugaaaaucagauu

SEQ ID NO: 104579 - RNA, 22 nt, Human
gccagagagauggaaaagcuua

SEQ ID NO: 104580 - RNA, 22 nt, Human
gccagagcagaauagaguggcc

SEQ ID NO: 104581 - RNA, 21 nt, Human
gccagagcaguacaaugaggu

SEQ ID NO: 104582 - RNA, 22 nt, Human
gccagagcaucgcacccuccau

SEQ ID NO: 104583 - RNA, 22 nt, Human
gccagagccggcuucacaggau

SEQ ID NO: 104584 - RNA, 22 nt, Human
gccagagcugagugagguucuu

SEQ ID NO: 104585 - RNA, 23 nt, Human
gccagagcugccugcccuugcug

SEQ ID NO: 104586 - RNA, 22 nt, Human
gccagaggcccaaggacagcug

SEQ ID NO: 104587 - RNA, 18 nt, Human
gccagagggcccaagguc

SEQ ID NO: 104588 - RNA, 18 nt, Human
gccagagguacuacugau

SEQ ID NO: 104589 - RNA, 22 nt, Human
gccagagguaucaaagauagua

SEQ ID NO: 104590 - RNA, 22 nt, Human
gccagagguucaacaacugucu

SEQ ID NO: 104591 - RNA, 20 nt, Human
gccagaguuaugaugagagg

SEQ ID NO: 104592 - RNA, 22 nt, Human
gccagaguugaggcaguuuauu

SEQ ID NO: 104593 - RNA, 22 nt, Human
gccagcaaagcaaguugucagc

SEQ ID NO: 104594 - RNA, 22 nt, Human
gcuagcagguugcaucugucuu

SEQ ID NO: 104595 - RNA, 20 nt, Human
gcuaggaaggggaaaaagug

SEQ ID NO: 104596 - RNA, 22 nt, Human
gcuaggaguaaggagaccuuca

SEQ ID NO: 104597 - RNA, 22 nt, Human
gcuaggcucggaagcagcaggg

SEQ ID NO: 104598 - RNA, 19 nt, Human
gcuaggcuggccuugaggg

SEQ ID NO: 104599 - RNA, 20 nt, Human
gcuaggcuggugauugucaa

SEQ ID NO: 104600 - RNA, 20 nt, Human
gcuaggcuguguccugccca

SEQ ID NO: 104601 - RNA, 22 nt, Human
gcuagggaucugauuugcuguu

SEQ ID NO: 104602 - RNA, 22 nt, Human
gcuagugagcucuuugucaucu

SEQ ID NO: 104603 - RNA, 22 nt, Human
gcuaucuaccacaucagccagg

SEQ ID NO: 104604 - RNA, 22 nt, Human
gcuaugaauauccaugaucagc

SEQ ID NO: 104605 - RNA, 22 nt, Human
gcuauguucccuuuugcuauaa

SEQ ID NO: 104606 - RNA, 22 nt, Human
gcuauucauggagcauguacug

SEQ ID NO: 104607 - RNA, 22 nt, Human
gcuauugugacagcuuuucgcc

SEQ ID NO: 104608 - RNA, 22 nt, Human
gcuauuuccaaagcugcuguuc

SEQ ID NO: 104609 - RNA, 22 nt, Human
gcuauuucuauauuauaaagaa

SEQ ID NO: 104610 - RNA, 22 nt, Human
gcucaaagaccagacagaggag

SEQ ID NO: 104611 - RNA, 22 nt, Human
gcucaaagaggccuccaaaucc

SEQ ID NO: 104612 - RNA, 22 nt, Human
gcucaaagcauaagacaucuaa

SEQ ID NO: 104613 - RNA, 22 nt, Human
gcucaaaggcuaucaauagugu

SEQ ID NO: 104614 - RNA, 21 nt, Human
gcucaaagggcuugccaugcu

SEQ ID NO: 104615 - RNA, 22 nt, Human
gcucaaaucccagcgggcuccu

SEQ ID NO: 104616 - RNA, 22 nt, Human
gcucaagggaugggagugggug

SEQ ID NO: 104617 - RNA, 21 nt, Human
gcucaaguuucucuggcaaca

SEQ ID NO: 104618 - RNA, 22 nt, Human
gcucacagaacuucucuuccca

SEQ ID NO: 104619 - RNA, 22 nt, Human
gcucacagcccaggccagcgug

SEQ ID NO: 104620 - RNA, 22 nt, Human
gcucacagccggcuggcagggg

SEQ ID NO: 104621 - RNA, 23 nt, Human
gcucacaggguguaacuccuagu

SEQ ID NO: 104622 - RNA, 22 nt, Human
gcucaccaagcagagacucugg

SEQ ID NO: 104623 - RNA, 22 nt, Human
gcucacuggccugaagaggacg

SEQ ID NO: 104624 - RNA, 22 nt, Human
gcucagaagauauuugaugcug

SEQ ID NO: 104625 - RNA, 22 nt, Human
gcucagagaaaacuggggcuug

SEQ ID NO: 104626 - RNA, 22 nt, Human
gcucagagaagcgguuucgccu

SEQ ID NO: 104627 - RNA, 22 nt, Human
gcucagagaaguugugccuggc

SEQ ID NO: 104628 - RNA, 19 nt, Human
gcucagagacaccuguugc

SEQ ID NO: 104629 - RNA, 22 nt, Human
gcucagagcaucccagugaaug

SEQ ID NO: 104630 - RNA, 20 nt, Human
gcucagagccugaacuucau

SEQ ID NO: 104631 - RNA, 22 nt, Human
gcucagaggcacgaccucuugg

SEQ ID NO: 104632 - RNA, 19 nt, Human
gcucagagucccccugcgg

SEQ ID NO: 104633 - RNA, 22 nt, Human
gcucaggaucagccaccucuuu

SEQ ID NO: 104634 - RNA, 22 nt, Human
gcucaggcaccauaugaugugu

SEQ ID NO: 104635 - RNA, 22 nt, Human
gcucaggccucacuccauuugg

SEQ ID NO: 104636 - RNA, 22 nt, Human
gcucaggccuggcuauccauug

SEQ ID NO: 104637 - RNA, 21 nt, Human
gcucaggcucagguucagguu

SEQ ID NO: 104638 - RNA, 22 nt, Human
gcucaggcucucccaggggaau

SEQ ID NO: 104639 - RNA, 22 nt, Human
gcucagggaaggccacgugaga

SEQ ID NO: 104640 - RNA, 22 nt, Human
gcucagggaguuucacagugua

SEQ ID NO: 104641 - RNA, 22 nt, Human
gcucagguagaugggguugucc

SEQ ID NO: 104642 - RNA, 20 nt, Human
gcucagguuugggcuuugug

SEQ ID NO: 104643 - RNA, 22 nt, Human
gcucagugaaacaucaaauagu

SEQ ID NO: 104644 - RNA, 22 nt, Human
gcucagugaauuuuugcccaug

SEQ ID NO: 104645 - RNA, 22 nt, Human
gcucagugugcacgaguacucu

SEQ ID NO: 104646 - RNA, 22 nt, Human
gcucagugugguccucagaugu

SEQ ID NO: 104647 - RNA, 18 nt, Human
gcucaguguguuaacacu

SEQ ID NO: 104648 - RNA, 22 nt, Human
gcucaguguguucaagggcuca

SEQ ID NO: 104649 - RNA, 23 nt, Human
gcucauccacggagaggggcucc

SEQ ID NO: 104650 - RNA, 22 nt, Human
gcuccagaguguggcaucuggg

SEQ ID NO: 104651 - RNA, 22 nt, Human
gcuccagcucguggcucccagc

SEQ ID NO: 104652 - RNA, 22 nt, Human
gcuccaggauaauaaaguuguu

SEQ ID NO: 104653 - RNA, 22 nt, Human
gcuccaggcagagccucuuucg

SEQ ID NO: 104654 - RNA, 22 nt, Human
gcuccaggcagcauaguggaug

SEQ ID NO: 104655 - RNA, 22 nt, Human
gcuccaggccacggcuucuugg

SEQ ID NO: 104656 - RNA, 17 nt, Human
gcuccaggcgugaguga

SEQ ID NO: 104657 - RNA, 22 nt, Human
gcuccagggucagcucagaacu

SEQ ID NO: 104658 - RNA, 22 nt, Human
gcuccaggugaauccucucacc

SEQ ID NO: 104659 - RNA, 22 nt, Human
gcuccaggugucccagguaaaa

SEQ ID NO: 104660 - RNA, 22 nt, Human
gcuccaguggauacagcagugg

SEQ ID NO: 104661 - RNA, 22 nt, Human
gcucccacaaccuucuugcucc

SEQ ID NO: 104662 - RNA, 22 nt, Human
gcucccaccaggcagaccuacc

SEQ ID NO: 104663 - RNA, 22 nt, Human
gcucccagaaccaaggcugggg

SEQ ID NO: 104664 - RNA, 22 nt, Human
gcucccagcauugcugcugaau

SEQ ID NO: 104665 - RNA, 22 nt, Human
gcucccaggaugaggagccagg

SEQ ID NO: 104666 - RNA, 22 nt, Human
gcucccaggcauggagguaauu

SEQ ID NO: 104667 - RNA, 22 nt, Human
gcucccaguucccaaagugacc

SEQ ID NO: 104668 - RNA, 22 nt, Human
gcuccccauugaucugcaggcu

SEQ ID NO: 104669 - RNA, 22 nt, Human
gcuccccuugguccuccuggga

SEQ ID NO: 104670 - RNA, 22 nt, Human
gcucccugaagagauuuggucu

SEQ ID NO: 104671 - RNA, 22 nt, Human
gcucccugacucaguuccugag

SEQ ID NO: 104672 - RNA, 22 nt, Human
gcucccugccuacacggaccuu

SEQ ID NO: 104673 - RNA, 21 nt, Human
gcucccugcucagcuccuggg

SEQ ID NO: 104674 - RNA, 22 nt, Human
gcucccuggcuuuuacagugua

SEQ ID NO: 104675 - RNA, 22 nt, Human
gcucccugucucugggguccau

SEQ ID NO: 104676 - RNA, 22 nt, Human
gcucccuuaggccuugccggga

SEQ ID NO: 104677 - RNA, 22 nt, Human
gcuccucuauuccccacauuuu

SEQ ID NO: 104678 - RNA, 22 nt, Human
gcuccucucccagagcugcagg

SEQ ID NO: 104679 - RNA, 22 nt, Human
gcuccugaaggcucugcagggu

SEQ ID NO: 104680 - RNA, 18 nt, Human
gcuccuggagucugacuc

SEQ ID NO: 104681 - RNA, 19 nt, Human
gcuccuggaugaccugugg

SEQ ID NO: 104682 - RNA, 22 nt, Human
guuacaauguucuucaguucug

SEQ ID NO: 104683 - RNA, 22 nt, Human
guuacagugagaagauagccua

SEQ ID NO: 104684 - RNA, 22 nt, Human
guuacagugcauguggcuucug

SEQ ID NO: 104685 - RNA, 22 nt, Human
guuacagugcuuggcaauaagu

SEQ ID NO: 104686 - RNA, 22 nt, Human
guuacauggagcaaugaugcau

SEQ ID NO: 104687 - RNA, 22 nt, Human
guuacauuacuugugcaguugu

SEQ ID NO: 104688 - RNA, 22 nt, Human
guuacauuaggauaauuugcug

SEQ ID NO: 104689 - RNA, 22 nt, Human
guuacauuuauuagaggucucu

SEQ ID NO: 104690 - RNA, 22 nt, Human
guuacauuuggugauuuggugc

SEQ ID NO: 104691 - RNA, 22 nt, Human
guuacucuuccccggggucugg

SEQ ID NO: 104692 - RNA, 22 nt, Human
guuagagggcugccuuuuguuu

SEQ ID NO: 104693 - RNA, 22 nt, Human
guuagcaacaagucucaaugac

SEQ ID NO: 104694 - RNA, 20 nt, Human
guuaggagguuggacaugga

SEQ ID NO: 104695 - RNA, 22 nt, Human
guuaggauauggugaaauggag

SEQ ID NO: 104696 - RNA, 22 nt, Human
guuaggauuauauaucccauga

SEQ ID NO: 104697 - RNA, 22 nt, Human
guuaggcaguuuucuucauucu

SEQ ID NO: 104698 - RNA, 22 nt, Human
guuagggagggugcauaugugu

SEQ ID NO: 104699 - RNA, 22 nt, Human
guuauaaaaugcacaguuguuu

SEQ ID NO: 104700 - RNA, 22 nt, Human
guuauaaauaccuaauaggauu

SEQ ID NO: 104701 - RNA, 22 nt, Human
guuauacaguuuugggucugcu

SEQ ID NO: 104702 - RNA, 22 nt, Human
guuauauuggcagaagagaaga

SEQ ID NO: 104703 - RNA, 22 nt, Human
gcuuaaauuguuuguggauagu

SEQ ID NO: 104704 - RNA, 22 nt, Human
gcuuacaagaucgugcuccagu

SEQ ID NO: 104705 - RNA, 22 nt, Human
gcuuacaaggguaggaagucua

SEQ ID NO: 104706 - RNA, 22 nt, Human
gcuuacaggugaggcagcaaga

SEQ ID NO: 104707 - RNA, 22 nt, Human
gcuuagaaagugauugauacau

SEQ ID NO: 104708 - RNA, 22 nt, Human
gcuuagaaguuccuauaaaaug

SEQ ID NO: 104709 - RNA, 22 nt, Human
gcuuagagcagcucacaacaug

SEQ ID NO: 104710 - RNA, 22 nt, Human
gcuuagcaaacaucuguagucc

SEQ ID NO: 104711 - RNA, 22 nt, Human
gcuuagcacagaaugagaguuc

SEQ ID NO: 104712 - RNA, 22 nt, Human
gcuuaggaaaaugguggaguug

SEQ ID NO: 104713 - RNA, 22 nt, Human
gcuuaucuugaaauccaccagc

SEQ ID NO: 104714 - RNA, 22 nt, Human
gcuuaugauguuuacauaaaag

SEQ ID NO: 104715 - RNA, 22 nt, Human
gcuucacacuaaaaauguuaaa

SEQ ID NO: 104716 - RNA, 22 nt, Human
gcuucacaggcaaguuaagccu

SEQ ID NO: 104717 - RNA, 22 nt, Human
gcuucagaccugaaaggaaaaa

SEQ ID NO: 104718 - RNA, 22 nt, Human
gcuucagauucuuuucaugucu

SEQ ID NO: 104719 - RNA, 21 nt, Human
gcuucagcaaggcuugcuggu

SEQ ID NO: 104720 - RNA, 22 nt, Human
gcuucagccucacacugauauc

SEQ ID NO: 104721 - RNA, 22 nt, Human
gcuucagcuuugucuccuuggg

SEQ ID NO: 104722 - RNA, 22 nt, Human
gcuucaggaggucggucuccuu

SEQ ID NO: 104723 - RNA, 22 nt, Human
gcuucaugccaggagguuuaag

SEQ ID NO: 104724 - RNA, 22 nt, Human
uacaugcauguguguaaauaua

SEQ ID NO: 104725 - RNA, 22 nt, Human
uacaugcauuggauggcaauag

SEQ ID NO: 104726 - RNA, 22 nt, Human
uacaugcucuucaaggacucau

SEQ ID NO: 104727 - RNA, 22 nt, Human
uacauggauguuauccuuacug

SEQ ID NO: 104728 - RNA, 22 nt, Human
uacauggguagguuaagucaua

SEQ ID NO: 104729 - RNA, 22 nt, Human
uacauguacauugggcauuaau

SEQ ID NO: 104730 - RNA, 22 nt, Human
uacauguauguguuaauaucug

SEQ ID NO: 104731 - RNA, 22 nt, Human
uacauguauugauuucucuucu

SEQ ID NO: 104732 - RNA, 22 nt, Human
uacaugucuacagccaugucug

SEQ ID NO: 104733 - RNA, 22 nt, Human
uacaugucuggguuuuguuucc

SEQ ID NO: 104734 - RNA, 22 nt, Human
uacaugugcuauuuguuuugua

SEQ ID NO: 104735 - RNA, 17 nt, Human
uacauguguaucugauu

SEQ ID NO: 104736 - RNA, 22 nt, Human
uacauuaaggauauggacauga

SEQ ID NO: 104737 - RNA, 22 nt, Human
uacauuacaggaaagauaaaga

SEQ ID NO: 104738 - RNA, 22 nt, Human
uacauuagcaaacaucuuggug

SEQ ID NO: 104739 - RNA, 22 nt, Human
uacauucacaguuguucaucuc

SEQ ID NO: 104740 - RNA, 22 nt, Human
uacauucagagaaaguuuccau

SEQ ID NO: 104741 - RNA, 22 nt, Human
uacauucauggugacuuguaug

SEQ ID NO: 104742 - RNA, 22 nt, Human
uacauuccacuagugacuggcg

SEQ ID NO: 104743 - RNA, 22 nt, Human
uacauuccauguguguguauuc

SEQ ID NO: 104744 - RNA, 22 nt, Human
uacauuccuguuagcaucuaag

SEQ ID NO: 104745 - RNA, 22 nt, Human
uacauuccuucguuuagagauu

SEQ ID NO: 104746 - RNA, 22 nt, Human
uacauucucuucccauugucuc

SEQ ID NO: 104747 - RNA, 22 nt, Human
uacauucugaaauaaaugguuu

SEQ ID NO: 104748 - RNA, 22 nt, Human
uacauugaccuuuguuagguug

SEQ ID NO: 104749 - RNA, 22 nt, Human
uacauugagcacguacuaugug

SEQ ID NO: 104750 - RNA, 22 nt, Human
uacauugcuagaaauguauuuu

SEQ ID NO: 104751 - RNA, 22 nt, Human
uacauugcucauuauauugcuu

SEQ ID NO: 104752 - RNA, 19 nt, Human
uacauugcugguggggaug

SEQ ID NO: 104753 - RNA, 22 nt, Human
uacauuugggacaauaagagaa

SEQ ID NO: 104754 - RNA, 22 nt, Human
uaccaaaaccaagccauuaucu

SEQ ID NO: 104755 - RNA, 22 nt, Human
uaccaaaagcuuguuucauaca

SEQ ID NO: 104756 - RNA, 19 nt, Human
uaccaaucccuugguuuac

SEQ ID NO: 104757 - RNA, 22 nt, Human
uaccacagacagauuucaguaa

SEQ ID NO: 104758 - RNA, 22 nt, Human
uaccacagcaaaugaggccaac

SEQ ID NO: 104759 - RNA, 22 nt, Human
uaccagcaucacagcauguugg

SEQ ID NO: 104760 - RNA, 22 nt, Human
uaccagccuuuuaacaugggcc

SEQ ID NO: 104761 - RNA, 22 nt, Human
uaccauuuugaaacauuucauc

SEQ ID NO: 104762 - RNA, 22 nt, Human
uacccagaagauugucagcaaa

SEQ ID NO: 104763 - RNA, 22 nt, Human
uacccagucuggagugcaguga

SEQ ID NO: 104764 - RNA, 20 nt, Human
uacccagugguggaugguaa

SEQ ID NO: 104765 - RNA, 22 nt, Human
uacccuggagcaaguuuccuca

SEQ ID NO: 104766 - RNA, 22 nt, Human
uaccguacacauuaacuacagu

SEQ ID NO: 104767 - RNA, 22 nt, Human
uaccucauuacaucugcaauga

SEQ ID NO: 104768 - RNA, 22 nt, Human
uaccugaauuaccaaaagcuuu

SEQ ID NO: 104769 - RNA, 22 nt, Human
uaccugcaaaguuccuuuugcc

SEQ ID NO: 104770 - RNA, 22 nt, Human
uaccuggaaauggcuuuaguua

SEQ ID NO: 104771 - RNA, 22 nt, Human
uaccuggaauagagucucucca

SEQ ID NO: 104772 - RNA, 22 nt, Human
uaccuggaaucacagaggcuga

SEQ ID NO: 104773 - RNA, 22 nt, Human
uaccuggaauuuauauagcuau

SEQ ID NO: 104774 - RNA, 22 nt, Human
uaccuggagcaggaggcagaau

SEQ ID NO: 104775 - RNA, 22 nt, Human
uaccugggaagugggaccugag

SEQ ID NO: 104776 - RNA, 22 nt, Human
uaccuucaccagcgaauguuug

SEQ ID NO: 104777 - RNA, 22 nt, Human
uaccuugagccguugcugauga

SEQ ID NO: 104778 - RNA, 22 nt, Human
uaccuuggaaaugcuagaguaa

SEQ ID NO: 104779 - RNA, 22 nt, Human
uaccuugggagacgccaggccc

SEQ ID NO: 104780 - RNA, 22 nt, Human
uaccuugggguuuuguugcucu

SEQ ID NO: 104781 - RNA, 22 nt, Human
uacgugcaaggucccugccccu

SEQ ID NO: 104782 - RNA, 22 nt, Human
uacguuuagcuuuaugagacau

SEQ ID NO: 104783 - RNA, 19 nt, Human
uacuaaacaugcauauugg

SEQ ID NO: 104784 - RNA, 22 nt, Human
uacuaaauaguuuaauuccuca

SEQ ID NO: 104785 - RNA, 22 nt, Human
uacuaacaaugagaacaagcca

SEQ ID NO: 104786 - RNA, 23 nt, Human
uacuacagggucuugcuaugaau

SEQ ID NO: 104787 - RNA, 22 nt, Human
uacuacaguauguguguuauac

SEQ ID NO: 104788 - RNA, 21 nt, Human
uacuacagucucuuuaucagu

SEQ ID NO: 104789 - RNA, 22 nt, Human
uacuacauacagaauuuagaga

SEQ ID NO: 104790 - RNA, 22 nt, Human
uacuagaaaaacacaugcucug

SEQ ID NO: 104791 - RNA, 22 nt, Human
uacuaguuucuaccuuacagaa

SEQ ID NO: 104792 - RNA, 22 nt, Human
uacuaguuuuuaggaaaaguga

SEQ ID NO: 104793 - RNA, 22 nt, Human
uacuauaaagucuuaaugaguc

SEQ ID NO: 104794 - RNA, 22 nt, Human
uacuauaccauguaagauauga

SEQ ID NO: 104795 - RNA, 22 nt, Human
uacuauacucuccauuuuauag

SEQ ID NO: 104796 - RNA, 22 nt, Human
uacuauuuggaauuuuaaauug

SEQ ID NO: 104797 - RNA, 22 nt, Human
uacucacuauucuaucagauag

SEQ ID NO: 104798 - RNA, 22 nt, Human
uacuccacacgcuauuauaaug

SEQ ID NO: 104799 - RNA, 22 nt, Human
uacucuaaaaagaagcagaucu

SEQ ID NO: 104800 - RNA, 22 nt, Human
uacucuaacauuuguuagaugu

SEQ ID NO: 104801 - RNA, 22 nt, Human
uacucugcaaguugaagguggc

SEQ ID NO: 104802 - RNA, 22 nt, Human
uacucugcaggauggacuaugg

SEQ ID NO: 104803 - RNA, 22 nt, Human
uacucugcucauuggagugugu

SEQ ID NO: 104804 - RNA, 22 nt, Human
uacugaaauacuaagaaguuaa

SEQ ID NO: 104805 - RNA, 22 nt, Human
uacugaagcaccauuaaagaca

SEQ ID NO: 104806 - RNA, 22 nt, Human
uacugaauuguaagaugaugcc

SEQ ID NO: 104807 - RNA, 22 nt, Human
uacugacacaaagccaaucccu

SEQ ID NO: 104808 - RNA, 22 nt, Human
uacugagggcaaagagugaagc

SEQ ID NO: 104809 - RNA, 22 nt, Human
uacugaggguaugaagccaagg

SEQ ID NO: 104810 - RNA, 20 nt, Human
uacugcaggaaucagcuagc

SEQ ID NO: 104811 - RNA, 22 nt, Human
uacugccuggagcauuggugcu

SEQ ID NO: 104812 - RNA, 22 nt, Human
gcuuucugggcuauagaacggg

SEQ ID NO: 104813 - RNA, 22 nt, Human
gcuuucugguuugugcuacagg

SEQ ID NO: 104814 - RNA, 18 nt, Human
gcuuucuguagaaaaggg

SEQ ID NO: 104815 - RNA, 22 nt, Human
gcuuucugugcagugaacacua

SEQ ID NO: 104816 - RNA, 22 nt, Human
gcuuugacacucgcccagcccu

SEQ ID NO: 104817 - RNA, 22 nt, Human
gcuuugcacagauuagguuauu

SEQ ID NO: 104818 - RNA, 22 nt, Human
gcuuugcacagugcuguguuaa

SEQ ID NO: 104819 - RNA, 22 nt, Human
gcuuugcccaagggcccuaccc

SEQ ID NO: 104820 - RNA, 22 nt, Human
gcuuugcugaggucugaggauu

SEQ ID NO: 104821 - RNA, 22 nt, Human
gcuuugcuggaaucaacgaaug

SEQ ID NO: 104822 - RNA, 22 nt, Human
gcuuugcugggugcuucaugua

SEQ ID NO: 104823 - RNA, 22 nt, Human
gcuuugcuuccuuccccuucaa

SEQ ID NO: 104824 - RNA, 22 nt, Human
gcuuuggaaauaagaggcuaaa

SEQ ID NO: 104825 - RNA, 17 nt, Human
gcuuuggaaggguagac

SEQ ID NO: 104826 - RNA, 22 nt, Human
gcuuuggagccuguguucugcc

SEQ ID NO: 104827 - RNA, 22 nt, Human
gcuuuggagggcaagagcuguu

SEQ ID NO: 104828 - RNA, 22 nt, Human
gcuuuggaugugugccugaggu

SEQ ID NO: 104829 - RNA, 22 nt, Human
gcuuugggggcugcagugcgug

SEQ ID NO: 104830 - RNA, 22 nt, Human
gcuuuggucagguguccagccc

SEQ ID NO: 104831 - RNA, 22 nt, Human
gcuuuggucuucuagcugugag

SEQ ID NO: 104832 - RNA, 19 nt, Human
gcuuuuauugcucaggugc

SEQ ID NO: 104833 - RNA, 22 nt, Human
gcuuuuauugucuuuacgacga

SEQ ID NO: 104834 - RNA, 22 nt, Human
gcuuuucuucagcagccugaug

SEQ ID NO: 104835 - RNA, 22 nt, Human
gcuuuugagguccugcucagcc

SEQ ID NO: 104836 - RNA, 22 nt, Human
gcuuuugugagauuaagcuacu

SEQ ID NO: 104837 - RNA, 22 nt, Human
ggaaaaaugacacauaucucaa

SEQ ID NO: 104838 - RNA, 17 nt, Human
ggaaaaggaugauacag

SEQ ID NO: 104839 - RNA, 22 nt, Human
ggaaaauuggcgcguggggcug

SEQ ID NO: 104840 - RNA, 22 nt, Human
ggaaacagagggcaccugagcc

SEQ ID NO: 104841 - RNA, 22 nt, Human
ggaaacagcucuuuggggcugu

SEQ ID NO: 104842 - RNA, 22 nt, Human
ggaaacaugccugcuggacagu

SEQ ID NO: 104843 - RNA, 22 nt, Human
ggaaaccaggacugcaccgucu

SEQ ID NO: 104844 - RNA, 22 nt, Human
ggaaaccauucccgacucuccu

SEQ ID NO: 104845 - RNA, 22 nt, Human
ggaaacuuggcauaauuuuaag

SEQ ID NO: 104846 - RNA, 22 nt, Human
ggaaagagcccagcagugcuug

SEQ ID NO: 104847 - RNA, 22 nt, Human
ggaaagagcuaaaagggugaga

SEQ ID NO: 104848 - RNA, 22 nt, Human
ggaaagcauccaggugccccca

SEQ ID NO: 104849 - RNA, 22 nt, Human
ggaaagggcauggccuuuucac

SEQ ID NO: 104850 - RNA, 22 nt, Human
ggaaaguccuucuaaagccaga

SEQ ID NO: 104851 - RNA, 22 nt, Human
ggaaauacaaagauacaccacu

SEQ ID NO: 104852 - RNA, 22 nt, Human
ggaaaucaagaagcagaugagu

SEQ ID NO: 104853 - RNA, 22 nt, Human
ggaaaucaugggagaguuggaa

SEQ ID NO: 104854 - RNA, 22 nt, Human
ggaaaucuggugguagauggga

SEQ ID NO: 104855 - RNA, 22 nt, Human
ggaacacuggcucaauuauauc

SEQ ID NO: 104856 - RNA, 22 nt, Human
ggaacaguugagaugauguacc

SEQ ID NO: 104857 - RNA, 22 nt, Human
ggaacauaccgaaaauacuuaa

SEQ ID NO: 104858 - RNA, 22 nt, Human
ggaaccaguggaaugauaugcu

SEQ ID NO: 104859 - RNA, 22 nt, Human
ggaacccagagcucauaaaauu

SEQ ID NO: 104860 - RNA, 22 nt, Human
ggaaccuguacguuguccuuga

SEQ ID NO: 104861 - RNA, 22 nt, Human
ggaaccuugcuagaugcugagg

SEQ ID NO: 104862 - RNA, 19 nt, Human
ggaacucacuuagagaaac

SEQ ID NO: 104863 - RNA, 22 nt, Human
ggaacugagaagcagcuaugcc

SEQ ID NO: 104864 - RNA, 19 nt, Human
ggaacuuggccuuuaccca

SEQ ID NO: 104865 - RNA, 22 nt, Human
ggaacuuuuuaacaagcugcug

SEQ ID NO: 104866 - RNA, 18 nt, Human
ggaagaaaaggaacucag

SEQ ID NO: 104867 - RNA, 22 nt, Human
ggaagaaaaugggcaacaggug

SEQ ID NO: 104868 - RNA, 22 nt, Human
ggaagaaagacauuuauuuuga

SEQ ID NO: 104869 - RNA, 22 nt, Human
ggaagaaagguggacaacaggu

SEQ ID NO: 104870 - RNA, 22 nt, Human
ggaagaaaucugguuaagagau

SEQ ID NO: 104871 - RNA, 22 nt, Human
ggaagaacagguuuauuuuccu

SEQ ID NO: 104872 - RNA, 22 nt, Human
ggaagaagcagggcauuugaau

SEQ ID NO: 104873 - RNA, 22 nt, Human
ggaagacagaagccuacagcuu

SEQ ID NO: 104874 - RNA, 22 nt, Human
ggaagagaaugauggcuauggg

SEQ ID NO: 104875 - RNA, 22 nt, Human
ggaagagauucuuuacauucau

SEQ ID NO: 104876 - RNA, 22 nt, Human
ggaagagccuggggugucaggc

SEQ ID NO: 104877 - RNA, 22 nt, Human
ggaagaggaggagccaggcuuu

SEQ ID NO: 104878 - RNA, 22 nt, Human
ggaagaggcucucauugagggc

SEQ ID NO: 104879 - RNA, 22 nt, Human
ggaagaggcugaggccaugcug

SEQ ID NO: 104880 - RNA, 22 nt, Human
ggaagauucagcauauaugagu

SEQ ID NO: 104881 - RNA, 22 nt, Human
ggaagcacagcauaaaguuacu

SEQ ID NO: 104882 - RNA, 20 nt, Human
ggaagcagagaacuguuuuc

SEQ ID NO: 104883 - RNA, 21 nt, Human
ggaagcaguggcggcaacucc

SEQ ID NO: 104884 - RNA, 22 nt, Human
ggaagccacccagcuuugauag

SEQ ID NO: 104885 - RNA, 22 nt, Human
ggaagccaggccaaugagaaca

SEQ ID NO: 104886 - RNA, 20 nt, Human
ggaagccagggugcagggga

SEQ ID NO: 104887 - RNA, 22 nt, Human
ggaagccaguugcuuggugugg

SEQ ID NO: 104888 - RNA, 19 nt, Human
ggaagcccugggucagagc

SEQ ID NO: 104889 - RNA, 22 nt, Human
ggaagcuggcucuuauaaauau

SEQ ID NO: 104890 - RNA, 22 nt, Human
ggaagcuggggagcuuuggaga

SEQ ID NO: 104891 - RNA, 22 nt, Human
ggaaggaaauuggggcaguugu

SEQ ID NO: 104892 - RNA, 18 nt, Human
ggaaggaagaaugcauuu

SEQ ID NO: 104893 - RNA, 22 nt, Human
ggaaggcagugaaggggcugau

SEQ ID NO: 104894 - RNA, 22 nt, Human
ggaaggcugugcaguguuugca

SEQ ID NO: 104895 - RNA, 22 nt, Human
ggaaggcugugccagaagaacu

SEQ ID NO: 104896 - RNA, 22 nt, Human
ggaaggcuguucacuaacaugu

SEQ ID NO: 104897 - RNA, 20 nt, Human
ggaaggcuguuuuuccacca

SEQ ID NO: 104898 - RNA, 22 nt, Human
ggaaggcuuuguagaagugcca

SEQ ID NO: 104899 - RNA, 22 nt, Human
ggaagggaguaguuggaaugca

SEQ ID NO: 104900 - RNA, 22 nt, Human
ggaaggggagcuaaaucuacug

SEQ ID NO: 104901 - RNA, 22 nt, Human
ggaaggggugucgcccauggau

SEQ ID NO: 104902 - RNA, 22 nt, Human
ggaagggguuaggggucccuga

SEQ ID NO: 104903 - RNA, 18 nt, Human
ggaaggugaugugaaaag

SEQ ID NO: 104904 - RNA, 22 nt, Human
ggaaguagaaguaaugaaauca

SEQ ID NO: 104905 - RNA, 18 nt, Human
ggaaguaggaagaggaag

SEQ ID NO: 104906 - RNA, 22 nt, Human
ggaaguguggcuaagccaagaa

SEQ ID NO: 104907 - RNA, 22 nt, Human
ggaaguuuauugaguucaagua

SEQ ID NO: 104908 - RNA, 22 nt, Human
ggaaguuucaggaaucugcauu

SEQ ID NO: 104909 - RNA, 22 nt, Human
ggaauaaaaauuguuuacugua

SEQ ID NO: 104910 - RNA, 22 nt, Human
ggaauacuaugacacacaggug

SEQ ID NO: 104911 - RNA, 21 nt, Human
ggaauagcuuaaagugagggg

SEQ ID NO: 104912 - RNA, 22 nt, Human
ggaauaggauuuaccucuguaa

SEQ ID NO: 104913 - RNA, 22 nt, Human
ggaauagggagagaaucguuug

SEQ ID NO: 104914 - RNA, 22 nt, Human
ggaaucuucagccaugccaaga

SEQ ID NO: 104915 - RNA, 22 nt, Human
ggaaugaaacacuucugauucu

SEQ ID NO: 104916 - RNA, 22 nt, Human
ggaaugaauuuccagcuggguc

SEQ ID NO: 104917 - RNA, 22 nt, Human
ggaaugagcucggagcagaagg

SEQ ID NO: 104918 - RNA, 22 nt, Human
ggaaugcacuagacugugaaac

SEQ ID NO: 104919 - RNA, 22 nt, Human
ggaaugcucaguucuuggugcu

SEQ ID NO: 104920 - RNA, 22 nt, Human
ggaauguaacgugaccaaguuc

SEQ ID NO: 104921 - RNA, 22 nt, Human
ggaauguagaaucucuggucuc

SEQ ID NO: 104922 - RNA, 22 nt, Human
uaugcacaacaugcagguuugu

SEQ ID NO: 104923 - RNA, 22 nt, Human
uaugcacacaggcuuaauucau

SEQ ID NO: 104924 - RNA, 22 nt, Human
uaugcacacauuagcacagggu

SEQ ID NO: 104925 - RNA, 22 nt, Human
uaugcacauuaucuaauccauu

SEQ ID NO: 104926 - RNA, 22 nt, Human
uaugcacgucuauuuaugaaga

SEQ ID NO: 104927 - RNA, 22 nt, Human
uaugcagcaccacucacugcag

SEQ ID NO: 104928 - RNA, 20 nt, Human
uaugcaguauguguguauaa

SEQ ID NO: 104929 - RNA, 22 nt, Human
uaugcauaauuggauaaguaga

SEQ ID NO: 104930 - RNA, 22 nt, Human
uaugcauagguaucuauacuca

SEQ ID NO: 104931 - RNA, 22 nt, Human
uaugcauagugauuuagaacag

SEQ ID NO: 104932 - RNA, 22 nt, Human
uaugcauaguggaauuagcaaa

SEQ ID NO: 104933 - RNA, 22 nt, Human
uaugcauauauuuucccaucuu

SEQ ID NO: 104934 - RNA, 22 nt, Human
uaugcaugucuuugcacacaaa

SEQ ID NO: 104935 - RNA, 22 nt, Human
uaugcauucagagguugggugu

SEQ ID NO: 104936 - RNA, 22 nt, Human
uaugcauugugagacuguggga

SEQ ID NO: 104937 - RNA, 22 nt, Human
uaugcauuuuauagugcaaagc

SEQ ID NO: 104938 - RNA, 23 nt, Human
uaugccaaaauggaaaguguaua

SEQ ID NO: 104939 - RNA, 22 nt, Human
uaugcccagcuuaaaguacaca

SEQ ID NO: 104940 - RNA, 22 nt, Human
uaugccuaccuccaaaauauau

SEQ ID NO: 104941 - RNA, 22 nt, Human
uaugccuggaaccuuucucuuu

SEQ ID NO: 104942 - RNA, 22 nt, Human
uaugcgugccucugucugucug

SEQ ID NO: 104943 - RNA, 22 nt, Human
uaugcuaaauauguucacauug

SEQ ID NO: 104944 - RNA, 22 nt, Human
uaugcuaauuguuagucacaug

SEQ ID NO: 104945 - RNA, 22 nt, Human
uaugcugaauuugguuugcuau

SEQ ID NO: 104946 - RNA, 22 nt, Human
uaugcuguauucuguauguuag

SEQ ID NO: 104947 - RNA, 22 nt, Human
uaugcuguggaaaauacaaaga

SEQ ID NO: 104948 - RNA, 20 nt, Human
uaugcuuuuuauaagauuga

SEQ ID NO: 104949 - RNA, 22 nt, Human
uauggaaauaauuagacaagug

SEQ ID NO: 104950 - RNA, 22 nt, Human
uauggauauaaucagacuggaa

SEQ ID NO: 104951 - RNA, 22 nt, Human
uauggcaauugucuaaguuuua

SEQ ID NO: 104952 - RNA, 22 nt, Human
uauggcagaggagaggcacuag

SEQ ID NO: 104953 - RNA, 22 nt, Human
uauggcauauaguccagcauaa

SEQ ID NO: 104954 - RNA, 22 nt, Human
uauggcauuguuggugaugaua

SEQ ID NO: 104955 - RNA, 22 nt, Human
uauggcauuuagaaaugucaga

SEQ ID NO: 104956 - RNA, 22 nt, Human
uauggcuggaauacugaaaggc

SEQ ID NO: 104957 - RNA, 22 nt, Human
uauggcuucucagucaugaaaa

SEQ ID NO: 104958 - RNA, 22 nt, Human
uauggcuucugcuuucuugacu

SEQ ID NO: 104959 - RNA, 22 nt, Human
uauggcuugucuuuauaccagg

SEQ ID NO: 104960 - RNA, 22 nt, Human
uauggcuuugaaagggcuuuuc

SEQ ID NO: 104961 - RNA, 22 nt, Human
uauggcuuuucauuccuaugug

SEQ ID NO: 104962 - RNA, 22 nt, Human
uauggcuuuucuuccuccccca

SEQ ID NO: 104963 - RNA, 22 nt, Human
uauggcuuuuuauucaucuuac

SEQ ID NO: 104964 - RNA, 22 nt, Human
uauggguacuuugauuuagaaa

SEQ ID NO: 104965 - RNA, 22 nt, Human
uauggguagagauggggguuag

SEQ ID NO: 104966 - RNA, 22 nt, Human
uauggguaggccugccgccugu

SEQ ID NO: 104967 - RNA, 22 nt, Human
uauggguaucuguacugauugu

SEQ ID NO: 104968 - RNA, 22 nt, Human
uauggguauuuuauacauaacc

SEQ ID NO: 104969 - RNA, 22 nt, Human
uaugggucuggaaaauggcuug

SEQ ID NO: 104970 - RNA, 22 nt, Human
uauggguguuaauggugagaga

SEQ ID NO: 104971 - RNA, 22 nt, Human
uaugguagaaaaacugaguccc

SEQ ID NO: 104972 - RNA, 22 nt, Human
uauguacacacacaugcaugua

SEQ ID NO: 104973 - RNA, 22 nt, Human
uauguacacauacacuuguaau

SEQ ID NO: 104974 - RNA, 22 nt, Human
uauguacauaacaugaaaugca

SEQ ID NO: 104975 - RNA, 22 nt, Human
uauguacaugauuucauuugcu

SEQ ID NO: 104976 - RNA, 22 nt, Human
uauguacuaacuuucauucuag

SEQ ID NO: 104977 - RNA, 22 nt, Human
uauguacuacacuagaacauuu

SEQ ID NO: 104978 - RNA, 22 nt, Human
uauguacucaucaacuauugaa

SEQ ID NO: 104979 - RNA, 22 nt, Human
uauguagaagcugcucaaagaa

SEQ ID NO: 104980 - RNA, 17 nt, Human
uauguaguacuuauaaa

SEQ ID NO: 104981 - RNA, 22 nt, Human
uauguauauaggugugugucuc

SEQ ID NO: 104982 - RNA, 22 nt, Human
uaugucaugggucaaaaugaag

SEQ ID NO: 104983 - RNA, 22 nt, Human
uauguccugcuacucucucaug

SEQ ID NO: 104984 - RNA, 22 nt, Human
uaugucuggaaguguacuuguc

SEQ ID NO: 104985 - RNA, 22 nt, Human
uaugucuggaauuugagguuca

SEQ ID NO: 104986 - RNA, 22 nt, Human
uaugucuggaccacugcagccc

SEQ ID NO: 104987 - RNA, 22 nt, Human
uaugucuuaacucuagaaaggu

SEQ ID NO: 104988 - RNA, 22 nt, Human
uaugucuuguguuugcuaaucu

SEQ ID NO: 104989 - RNA, 22 nt, Human
uaugucuuuguccaugugcagu

SEQ ID NO: 104990 - RNA, 22 nt, Human
uaugucuuuuccaaugcugucu

SEQ ID NO: 104991 - RNA, 22 nt, Human
uaugugaagagauuaaaaaaua

SEQ ID NO: 104992 - RNA, 22 nt, Human
uaugugaccuucugaaugagua

SEQ ID NO: 104993 - RNA, 22 nt, Human
uaugugauauaggcuauuugau

SEQ ID NO: 104994 - RNA, 22 nt, Human
ggagaaaggcauagcagaaccu

SEQ ID NO: 104995 - RNA, 22 nt, Human
ggagaacaggcaagcaucuggc

SEQ ID NO: 104996 - RNA, 19 nt, Human
ggagaagcaucuagaaaua

SEQ ID NO: 104997 - RNA, 22 nt, Human
ggagaaggaagaaagcuacuau

SEQ ID NO: 104998 - RNA, 22 nt, Human
ggagaagggcaugguaguuuua

SEQ ID NO: 104999 - RNA, 22 nt, Human
ggagacaauggaggccaaaaga

SEQ ID NO: 105000 - RNA, 22 nt, Human
ggagacacagagcaacaaaaua

SEQ ID NO: 105001 - RNA, 22 nt, Human
ggagacacuggaaaguauuaca

SEQ ID NO: 105002 - RNA, 17 nt, Human
ggagacagggucuuuaa

SEQ ID NO: 105003 - RNA, 22 nt, Human
ggagacaguauggcuuguagcu

SEQ ID NO: 105004 - RNA, 22 nt, Human
ggagaccuuaaggugcuuccua

SEQ ID NO: 105005 - RNA, 22 nt, Human
ggagacuaccuagcaggcuguu

SEQ ID NO: 105006 - RNA, 19 nt, Human
ggagacucagcccaugccu

SEQ ID NO: 105007 - RNA, 22 nt, Human
ggagagaaucugaaccugcucc

SEQ ID NO: 105008 - RNA, 22 nt, Human
ggagagaggagcccacugcugu

SEQ ID NO: 105009 - RNA, 22 nt, Human
ggagagcagggaggcugcucug

SEQ ID NO: 105010 - RNA, 22 nt, Human
ggagagcaggguccugagauac

SEQ ID NO: 105011 - RNA, 22 nt, Human
ggagagcuuggagugcgauuuu

SEQ ID NO: 105012 - RNA, 19 nt, Human
ggagaggcuggagggaugc

SEQ ID NO: 105013 - RNA, 22 nt, Human
ggagaggggcaaguuuaucuag

SEQ ID NO: 105014 - RNA, 23 nt, Human
ggagaggggugugggcaucuuua

SEQ ID NO: 105015 - RNA, 22 nt, Human
ggagauagacuuggugagccac

SEQ ID NO: 105016 - RNA, 22 nt, Human
ggagauaguccaggugaaggga

SEQ ID NO: 105017 - RNA, 22 nt, Human
ggagaucugagagcuggaagug

SEQ ID NO: 105018 - RNA, 22 nt, Human
ggagaugcaauguagaaucugg

SEQ ID NO: 105019 - RNA, 22 nt, Human
ggagaugcuacaguucagcucu

SEQ ID NO: 105020 - RNA, 22 nt, Human
ggagaugcuauguaguuugguu

SEQ ID NO: 105021 - RNA, 23 nt, Human
ggagaugcuuaagagugguugag

SEQ ID NO: 105022 - RNA, 22 nt, Human
ggagaugcuucuuguguuuauu

SEQ ID NO: 105023 - RNA, 22 nt, Human
ggagaugcuuuccaguggggau

SEQ ID NO: 105024 - RNA, 22 nt, Human
ggagauggaauagauucugacu

SEQ ID NO: 105025 - RNA, 22 nt, Human
ggagauggccaaaaacacaaau

SEQ ID NO: 105026 - RNA, 22 nt, Human
ggagauggccacgucacucagu

SEQ ID NO: 105027 - RNA, 22 nt, Human
ggagauggcuggcagguagaug

SEQ ID NO: 105028 - RNA, 22 nt, Human
ggagaugguggaagcuggugca

SEQ ID NO: 105029 - RNA, 22 nt, Human
ggagcaagagguggugaaaaau

SEQ ID NO: 105030 - RNA, 22 nt, Human
ggagcaagucccaggcacuagu

SEQ ID NO: 105031 - RNA, 22 nt, Human
ggcagggagagcaugcugauaa

SEQ ID NO: 105032 - RNA, 20 nt, Human
ggcagggagggauacugagg

SEQ ID NO: 105033 - RNA, 22 nt, Human
ggcagggaguggagacucccua

SEQ ID NO: 105034 - RNA, 20 nt, Human
ggcagggcaucaacagcucu

SEQ ID NO: 105035 - RNA, 22 nt, Human
ggcaggguaaaccgagguaagu

SEQ ID NO: 105036 - RNA, 22 nt, Human
ggcaggguggcccuccagugag

SEQ ID NO: 105037 - RNA, 22 nt, Human
ggcaggguguggaguugggaca

SEQ ID NO: 105038 - RNA, 22 nt, Human
ggcaggguuuacaauagcaaua

SEQ ID NO: 105039 - RNA, 22 nt, Human
ggcaggguuucuccauucugcc

SEQ ID NO: 105040 - RNA, 22 nt, Human
ggcagguacuggggagugaaga

SEQ ID NO: 105041 - RNA, 17 nt, Human
ggcaggugacagacacc

SEQ ID NO: 105042 - RNA, 22 nt, Human
ggcaggugaguucauuaucugc

SEQ ID NO: 105043 - RNA, 22 nt, Human
ggcaggugcccagagagcacga

SEQ ID NO: 105044 - RNA, 22 nt, Human
ggcaggugccuucugugcuagc

SEQ ID NO: 105045 - RNA, 20 nt, Human
ggcaggugcucgcuuggucu

SEQ ID NO: 105046 - RNA, 22 nt, Human
ggcagguggaaguuggcagagc

SEQ ID NO: 105047 - RNA, 15 nt, Human
ggcagguggaucacu

SEQ ID NO: 105048 - RNA, 22 nt, Human
ggcaggugugagaucgaggcca

SEQ ID NO: 105049 - RNA, 19 nt, Human
ggcaggugugcuuaugcuu

SEQ ID NO: 105050 - RNA, 22 nt, Human
ggcagucaagagggagucugaa

SEQ ID NO: 105051 - RNA, 22 nt, Human
ggcagucacuuuugcuugugcc

SEQ ID NO: 105052 - RNA, 22 nt, Human
ggcagugacuggggacccccaa

SEQ ID NO: 105053 - RNA, 22 nt, Human
ggcagugagaggucuccugguc

SEQ ID NO: 105054 - RNA, 22 nt, Human
ggcagugcaaggcuggcacagu

SEQ ID NO: 105055 - RNA, 18 nt, Human
ggcagugcagucucaggg

SEQ ID NO: 105056 - RNA, 22 nt, Human
ggcagugccugaugcugcagga

SEQ ID NO: 105057 - RNA, 22 nt, Human
ggcaguggaggacccugugucu

SEQ ID NO: 105058 - RNA, 22 nt, Human
ggcaguggcuccucucuacucc

SEQ ID NO: 105059 - RNA, 22 nt, Human
ggcagugggaaauaagugagaa

SEQ ID NO: 105060 - RNA, 22 nt, Human
ggcaguggguuccccaaggcac

SEQ ID NO: 105061 - RNA, 22 nt, Human
ggcagugguuagaaacaugagc

SEQ ID NO: 105062 - RNA, 22 nt, Human
ggcagugucaaaauaggcagaa

SEQ ID NO: 105063 - RNA, 22 nt, Human
ggcagugugcaucuguguggcc

SEQ ID NO: 105064 - RNA, 22 nt, Human
ggcaguguuuauggguaacaca

SEQ ID NO: 105065 - RNA, 22 nt, Human
ggcaguuccagaauuucaguac

SEQ ID NO: 105066 - RNA, 22 nt, Human
ggcaguucuggaugcauuguca

SEQ ID NO: 105067 - RNA, 22 nt, Human
ggcaucagcccgguccugggcu

SEQ ID NO: 105068 - RNA, 22 nt, Human
ggcaucaggagcuucuucaggu

SEQ ID NO: 105069 - RNA, 19 nt, Human
ggcauccacagcuggagag

SEQ ID NO: 105070 - RNA, 21 nt, Human
ggcaucccaggccagugacug

SEQ ID NO: 105071 - RNA, 22 nt, Human
ggcaucccuagaauagccaggu

SEQ ID NO: 105072 - RNA, 22 nt, Human
ggcauccucuagaagcuggaaa

SEQ ID NO: 105073 - RNA, 22 nt, Human
ggcaucguccugggcauaggga

SEQ ID NO: 105074 - RNA, 22 nt, Human
ggcaucuccaaaacaugaacuc

SEQ ID NO: 105075 - RNA, 22 nt, Human
ggcaucuucaaaauugccaaau

SEQ ID NO: 105076 - RNA, 22 nt, Human
ggcaucuuguugcucaaaucua

SEQ ID NO: 105077 - RNA, 22 nt, Human
ggcaugcaaaacaacucagaga

SEQ ID NO: 105078 - RNA, 22 nt, Human
ggcaugcauguuguuuuaggug

SEQ ID NO: 105079 - RNA, 22 nt, Human
ggcauggacgucucugaggcca

SEQ ID NO: 105080 - RNA, 19 nt, Human
ggcaugggguccggggacc

SEQ ID NO: 105081 - RNA, 22 nt, Human
ggcaugggguguauguggcacg

SEQ ID NO: 105082 - RNA, 20 nt, Human
ggcauggguggggcucccag

SEQ ID NO: 105083 - RNA, 22 nt, Human
ggcauguguugggaacagcaug

SEQ ID NO: 105084 - RNA, 22 nt, Human
ggcauuaagaauaucauuaaaa

SEQ ID NO: 105085 - RNA, 22 nt, Human
ggcauuagcguugaauuuuauu

SEQ ID NO: 105086 - RNA, 22 nt, Human
ggcauucaaagaaugguaauua

SEQ ID NO: 105087 - RNA, 22 nt, Human
ggcauuuagauugaauuucugu

SEQ ID NO: 105088 - RNA, 22 nt, Human
ggcauuuaggaucuuuaguuga

SEQ ID NO: 105089 - RNA, 22 nt, Human
ggcauuuaggcagauaacagac

SEQ ID NO: 105090 - RNA, 22 nt, Human
ggcauuuauuugucucauucuu

SEQ ID NO: 105091 - RNA, 22 nt, Human
ggccaaaagcauaauccucaca

SEQ ID NO: 105092 - RNA, 22 nt, Human
ggccaaaugaaggcaaugggac

SEQ ID NO: 105093 - RNA, 22 nt, Human
ggccaaauuuggccaugagcau

SEQ ID NO: 105094 - RNA, 22 nt, Human
ggccacagagggcgggaugcug

SEQ ID NO: 105095 - RNA, 22 nt, Human
ggccacaugaauucuuggacag

SEQ ID NO: 105096 - RNA, 22 nt, Human
ggccaccuuccaguugccugca

SEQ ID NO: 105097 - RNA, 19 nt, Human
ggccacuccuggugacugg

SEQ ID NO: 105098 - RNA, 22 nt, Human
ggccacugcccuggcuacaccg

SEQ ID NO: 105099 - RNA, 22 nt, Human
ggccacugcugcucugguggag

SEQ ID NO: 105100 - RNA, 22 nt, Human
ggccacuguccucuagcccaga

SEQ ID NO: 105101 - RNA, 22 nt, Human
ggccagacauaucgcucccaaa

SEQ ID NO: 105102 - RNA, 22 nt, Human
ggccagagaagucagacccuug

SEQ ID NO: 105103 - RNA, 18 nt, Human
ggccagagggaggguccc

SEQ ID NO: 105104 - RNA, 22 nt, Human
ggccagcagaccucagggacuc

SEQ ID NO: 105105 - RNA, 22 nt, Human
ggccagcaguauauagcuaauu

SEQ ID NO: 105106 - RNA, 18 nt, Human
ggccagccccaggccagc

SEQ ID NO: 105107 - RNA, 22 nt, Human
ggccagcccuccucccuggguu

SEQ ID NO: 105108 - RNA, 22 nt, Human
ggccagcuggaugugggugacg

SEQ ID NO: 105109 - RNA, 19 nt, Human
ggccagcugucuccugcua

SEQ ID NO: 105110 - RNA, 22 nt, Human
ggccagguaagagugcagccgc

SEQ ID NO: 105111 - RNA, 22 nt, Human
ggagggcaucaaucaggccugg

SEQ ID NO: 105112 - RNA, 22 nt, Human
ggagggccaucuugggugugau

SEQ ID NO: 105113 - RNA, 22 nt, Human
ggagggccccuccagugggcag

SEQ ID NO: 105114 - RNA, 22 nt, Human
ggagggcucgucauccaccacu

SEQ ID NO: 105115 - RNA, 22 nt, Human
ggaggggaugguuugacccugg

SEQ ID NO: 105116 - RNA, 22 nt, Human
ggagggggaagaagcuaaagac

SEQ ID NO: 105117 - RNA, 22 nt, Human
ggaggguccacugugaggcaga

SEQ ID NO: 105118 - RNA, 22 nt, Human
ggaggguccaucuugugaaaag

SEQ ID NO: 105119 - RNA, 22 nt, Human
ggagggugcuuaaguuguguuu

SEQ ID NO: 105120 - RNA, 20 nt, Human
ggaggguggaagaaagcaag

SEQ ID NO: 105121 - RNA, 22 nt, Human
ggaggguggcagcguccugggc

SEQ ID NO: 105122 - RNA, 22 nt, Human
ggaggguuagcaaaggcacaga

SEQ ID NO: 105123 - RNA, 22 nt, Human
ggagguagucugagucauaggc

SEQ ID NO: 105124 - RNA, 22 nt, Human
ggagguaugauagcuguguccu

SEQ ID NO: 105125 - RNA, 22 nt, Human
ggaggucccaggccuggcagca

SEQ ID NO: 105126 - RNA, 22 nt, Human
ggaggugacgaaaagaaauugu

SEQ ID NO: 105127 - RNA, 22 nt, Human
ggaggugacuggaucaugggca

SEQ ID NO: 105128 - RNA, 22 nt, Human
ggaggugaucagaguuuugagg

SEQ ID NO: 105129 - RNA, 22 nt, Human
ggaggugcagaguaggguuggu

SEQ ID NO: 105130 - RNA, 22 nt, Human
ggaggugcugaucccagucaac

SEQ ID NO: 105131 - RNA, 22 nt, Human
ggaggugcuggcggccagcucu

SEQ ID NO: 105132 - RNA, 22 nt, Human
ggagguggcagggaacauaauu

SEQ ID NO: 105133 - RNA, 22 nt, Human
ggagguggccugaaaauguggc

SEQ ID NO: 105134 - RNA, 22 nt, Human
ggaggugggaguuuaguucuug

SEQ ID NO: 105135 - RNA, 22 nt, Human
ggaggugggcuaaggacucucu

SEQ ID NO: 105136 - RNA, 22 nt, Human
ggaguaggaguagaacucauca

SEQ ID NO: 105137 - RNA, 22 nt, Human
ggagucaccaaguaggagucuu

SEQ ID NO: 105138 - RNA, 22 nt, Human
ggagucagaauggcaggguggu

SEQ ID NO: 105139 - RNA, 22 nt, Human
ggagucagaggaaggcuugcuc

SEQ ID NO: 105140 - RNA, 22 nt, Human
ggaguccaugcagcuugagaca

SEQ ID NO: 105141 - RNA, 22 nt, Human
auugaagagaagcuaaauagag

SEQ ID NO: 105142 - RNA, 22 nt, Human
auugaagaucagggaaagauuc

SEQ ID NO: 105143 - RNA, 22 nt, Human
auugaaugcuugcuaacacuuu

SEQ ID NO: 105144 - RNA, 22 nt, Human
auugacaaauggauguugacau

SEQ ID NO: 105145 - RNA, 22 nt, Human
auugacaacccugguaugagca

SEQ ID NO: 105146 - RNA, 22 nt, Human
auugacaaggaaacuauaccag

SEQ ID NO: 105147 - RNA, 22 nt, Human
auugacaauguauuuguaucug

SEQ ID NO: 105148 - RNA, 22 nt, Human
auugacacaaugggauguaagg

SEQ ID NO: 105149 - RNA, 23 nt, Human
auugaccuguuuagucucucccu

SEQ ID NO: 105150 - RNA, 22 nt, Human
auugagaaaggcuuauguuugc

SEQ ID NO: 105151 - RNA, 22 nt, Human
auugagaagaaaaucuaauaua

SEQ ID NO: 105152 - RNA, 22 nt, Human
auugagaauccauuugagauga

SEQ ID NO: 105153 - RNA, 22 nt, Human
auugagcaauaguguuugcagc

SEQ ID NO: 105154 - RNA, 22 nt, Human
auugagcaccuacaguauuacc

SEQ ID NO: 105155 - RNA, 22 nt, Human
auugagcagcuucucugccauc

SEQ ID NO: 105156 - RNA, 18 nt, Human
auugagcaugacagaccu

SEQ ID NO: 105157 - RNA, 22 nt, Human
auugaguaccuccagauucaua

SEQ ID NO: 105158 - RNA, 22 nt, Human
auugaguaguaggaaaauaacu

SEQ ID NO: 105159 - RNA, 22 nt, Human
auugauauauuauuucuaacug

SEQ ID NO: 105160 - RNA, 23 nt, Human
auugaugacuugauuacacuuuu

SEQ ID NO: 105161 - RNA, 22 nt, Human
auugauucuaccagcuacuuug

SEQ ID NO: 105162 - RNA, 22 nt, Human
auugauuuagcucaagacacau

SEQ ID NO: 105163 - RNA, 22 nt, Human
auugcaaauaacuguacugaau

SEQ ID NO: 105164 - RNA, 22 nt, Human
auugcacagcugaauauuuugg

SEQ ID NO: 105165 - RNA, 22 nt, Human
auugcaccuuggguuuugaaag

SEQ ID NO: 105166 - RNA, 22 nt, Human
auugcaggauacccagguagag

SEQ ID NO: 105167 - RNA, 22 nt, Human
auugcauuguauuguaaauguu

SEQ ID NO: 105168 - RNA, 22 nt, Human
auugcccaauaauaaaauggua

SEQ ID NO: 105169 - RNA, 22 nt, Human
auugcuaggaacagguugcacc

SEQ ID NO: 105170 - RNA, 22 nt, Human
auugcucugcaauccuccccaa

SEQ ID NO: 105171 - RNA, 21 nt, Human
auugcucuguugugucuagaa

SEQ ID NO: 105172 - RNA, 22 nt, Human
auugcugaaaguauuuuaugac

SEQ ID NO: 105173 - RNA, 22 nt, Human
auugcugaacuuauaaaugaau

SEQ ID NO: 105174 - RNA, 22 nt, Human
auugcuggcaucagugacaaua

SEQ ID NO: 105175 - RNA, 22 nt, Human
auugcuguacacuucuagaucu

SEQ ID NO: 105176 - RNA, 22 nt, Human
auugcuuucuuuggggaacugu

SEQ ID NO: 105177 - RNA, 22 nt, Human
auuggaaauacugagagauaaa

SEQ ID NO: 105178 - RNA, 22 nt, Human
auuggaacccuaggcaggcaga

SEQ ID NO: 105179 - RNA, 22 nt, Human
auuggcaaugucccggcugcug

SEQ ID NO: 105180 - RNA, 22 nt, Human
auuggcauacuuucuauauuca

SEQ ID NO: 105181 - RNA, 20 nt, Human
auuggcugggguucugaugc

SEQ ID NO: 105182 - RNA, 22 nt, Human
auuggcuuaguuggcaauuguu

SEQ ID NO: 105183 - RNA, 22 nt, Human
auuggcuugcacuguauuuuaa

SEQ ID NO: 105184 - RNA, 22 nt, Human
auugggcuggccuucuggagag

SEQ ID NO: 105185 - RNA, 22 nt, Human
auugguaaaauucuucccauuu

SEQ ID NO: 105186 - RNA, 22 nt, Human
auugguauguauucugaaaacu

SEQ ID NO: 105187 - RNA, 22 nt, Human
auuggucaggacuggcaugugg

SEQ ID NO: 105188 - RNA, 22 nt, Human
auuggucauaaauugagugauu

SEQ ID NO: 105189 - RNA, 22 nt, Human
auuggucucuagagucuauugu

SEQ ID NO: 105190 - RNA, 22 nt, Human
auuggugcauguaggugaugcu

SEQ ID NO: 105191 - RNA, 22 nt, Human
auugguggugaggacaugccag

SEQ ID NO: 105192 - RNA, 22 nt, Human
auugguuacucaauuugacuga

SEQ ID NO: 105193 - RNA, 22 nt, Human
auuguacauaaaauguaugucu

SEQ ID NO: 105194 - RNA, 22 nt, Human
auuguacauaugauguauguaa

SEQ ID NO: 105195 - RNA, 22 nt, Human
auuguacucccucuccugcccg

SEQ ID NO: 105196 - RNA, 22 nt, Human
auuguauaauuguauugccaaa

SEQ ID NO: 105197 - RNA, 22 nt, Human
auuguaucccccagguguuuaa

SEQ ID NO: 105198 - RNA, 22 nt, Human
auuguauucaguuacaggucuu

SEQ ID NO: 105199 - RNA, 22 nt, Human
auugucagggguuguggaguuu

SEQ ID NO: 105200 - RNA, 22 nt, Human
auugucucugaauuuccagcug

SEQ ID NO: 105201 - RNA, 22 nt, Human
auugucucugaauuuucagcug

SEQ ID NO: 105202 - RNA, 22 nt, Human
auugucucuuaaauguggaaau

SEQ ID NO: 105203 - RNA, 22 nt, Human
auugucuuggcauucaaauuag

SEQ ID NO: 105204 - RNA, 22 nt, Human
auugucuuuaaaaauauacaac

SEQ ID NO: 105205 - RNA, 22 nt, Human
auugugaauaaugcugcaauaa

SEQ ID NO: 105206 - RNA, 22 nt, Human
auugugaauagugccgcaguaa

SEQ ID NO: 105207 - RNA, 22 nt, Human
auugugaauagugcugcaauaa

SEQ ID NO: 105208 - RNA, 22 nt, Human
auugugcaccuacugugugcag

SEQ ID NO: 105209 - RNA, 22 nt, Human
auugugcagaauuggaauugca

SEQ ID NO: 105210 - RNA, 22 nt, Human
auugugcaggucaguuauugca

SEQ ID NO: 105211 - RNA, 14 nt, Human
auugugcaugccau

SEQ ID NO: 105212 - RNA, 22 nt, Human
auuguggacugaucagggcuag

SEQ ID NO: 105213 - RNA, 22 nt, Human
auuguuaaaaagguggaaaugc

SEQ ID NO: 105214 - RNA, 22 nt, Human
auuguuaauguugcacuaaggu

SEQ ID NO: 105215 - RNA, 21 nt, Human
auuguuaucauugugcugugu

SEQ ID NO: 105216 - RNA, 22 nt, Human
auuguuaugaaaauaagauguu

SEQ ID NO: 105217 - RNA, 22 nt, Human
auuguucauguaugaauaaaua

SEQ ID NO: 105218 - RNA, 22 nt, Human
auuguugaggcaguucaucuug

SEQ ID NO: 105219 - RNA, 22 nt, Human
auuguugauaaucguguuguca

SEQ ID NO: 105220 - RNA, 22 nt, Human
auuguuucugcuuuauuuaggg

SEQ ID NO: 105221 - RNA, 22 nt, Human
auuguuuuaauuccauugugaa

SEQ ID NO: 105222 - RNA, 22 nt, Human
agguuucugcacugucacuggu

SEQ ID NO: 105223 - RNA, 18 nt, Human
agguuugguggaaacaua

SEQ ID NO: 105224 - RNA, 22 nt, Human
agguuuguuuuggaaagaucau

SEQ ID NO: 105225 - RNA, 22 nt, Human
agguuuucacaggaaguauguu

SEQ ID NO: 105226 - RNA, 22 nt, Human
aguaaaaauugaggugcaaaau

SEQ ID NO: 105227 - RNA, 22 nt, Human
aguaaaacagagaaaucacuca

SEQ ID NO: 105228 - RNA, 22 nt, Human
aguaaacacuaaaaugacugcg

SEQ ID NO: 105229 - RNA, 22 nt, Human
aguaaacacugucuuuauauau

SEQ ID NO: 105230 - RNA, 22 nt, Human
aguaaacaguaucuuuaguguc

SEQ ID NO: 105231 - RNA, 22 nt, Human
aguaaacaguuucuuagaagaa

SEQ ID NO: 105232 - RNA, 22 nt, Human
aguaaacauguaauuguucauu

SEQ ID NO: 105233 - RNA, 22 nt, Human
aguaaacuguggguacagaugu

SEQ ID NO: 105234 - RNA, 22 nt, Human
aguaaagcagaguugcaguaca

SEQ ID NO: 105235 - RNA, 22 nt, Human
aguaaaguaccaaagugugagu

SEQ ID NO: 105236 - RNA, 18 nt, Human
aguaaauguuaaauauug

SEQ ID NO: 105237 - RNA, 22 nt, Human
aguaacaaagaaagccuuugga

SEQ ID NO: 105238 - RNA, 22 nt, Human
aguaacaaauauucauuggauu

SEQ ID NO: 105239 - RNA, 22 nt, Human
aguaacaagugccaacguuaga

SEQ ID NO: 105240 - RNA, 22 nt, Human
aguaacacuuggaaugauagca

SEQ ID NO: 105241 - RNA, 22 nt, Human
aguaacagagcauggguucaga

SEQ ID NO: 105242 - RNA, 22 nt, Human
aguaacagcaucuccacuggaa

SEQ ID NO: 105243 - RNA, 22 nt, Human
aguaacaggguauuuguguggg

SEQ ID NO: 105244 - RNA, 22 nt, Human
aguaacaugaguuuuucuaaug

SEQ ID NO: 105245 - RNA, 23 nt, Human
aguaacaugcaaauaacagucug

SEQ ID NO: 105246 - RNA, 22 nt, Human
aguaacucauguaaaccucaca

SEQ ID NO: 105247 - RNA, 22 nt, Human
aguaacuuaggagauacauggg

SEQ ID NO: 105248 - RNA, 22 nt, Human
aguaagcaccgggauggucaag

SEQ ID NO: 105249 - RNA, 22 nt, Human
aguaaguuuugauagcauuagg

SEQ ID NO: 105250 - RNA, 22 nt, Human
auuuagacuucccagcacugug

SEQ ID NO: 105251 - RNA, 22 nt, Human
auuuagacuucuugcagguaau

SEQ ID NO: 105252 - RNA, 22 nt, Human
auuuagcaaaaaaugaugaagc

SEQ ID NO: 105253 - RNA, 22 nt, Human
auuuagcuuaccucguuacuga

SEQ ID NO: 105254 - RNA, 22 nt, Human
auuuagucucccuuaucaagga

SEQ ID NO: 105255 - RNA, 22 nt, Human
auuuagugaccugaacugaaac

SEQ ID NO: 105256 - RNA, 22 nt, Human
auuuaguuuaggaaaaguaggu

SEQ ID NO: 105257 - RNA, 18 nt, Human
auuuaugcuaaugggaua

SEQ ID NO: 105258 - RNA, 22 nt, Human
auuuauguaucuguguagauca

SEQ ID NO: 105259 - RNA, 22 nt, Human
auuuauuauugugguuacuucu

SEQ ID NO: 105260 - RNA, 22 nt, Human
auuucaacagaguuugaaggca

SEQ ID NO: 105261 - RNA, 22 nt, Human
auuucacaaagaacagaugcag

SEQ ID NO: 105262 - RNA, 22 nt, Human
auuucacucucccugccacuua

SEQ ID NO: 105263 - RNA, 22 nt, Human
auuucagagaaugaaccuaauc

SEQ ID NO: 105264 - RNA, 22 nt, Human
auuucagagugagagugcucaa

SEQ ID NO: 105265 - RNA, 22 nt, Human
auuucagauucagaaauguagg

SEQ ID NO: 105266 - RNA, 22 nt, Human
auuucagcaaaguuuugauugg

SEQ ID NO: 105267 - RNA, 22 nt, Human
auuucagcagcccauguuugga

SEQ ID NO: 105268 - RNA, 22 nt, Human
auuucagcuaaaauucuuaauu

SEQ ID NO: 105269 - RNA, 22 nt, Human
auuucaggguaaaaaguguuca

SEQ ID NO: 105270 - RNA, 22 nt, Human
auuucagguaccugugggaucc

SEQ ID NO: 105271 - RNA, 22 nt, Human
auuucaguagaaaaucuugauu

SEQ ID NO: 105272 - RNA, 22 nt, Human
auuucauagauuguaaaucccu

SEQ ID NO: 105273 - RNA, 22 nt, Human
auuucaugaaugcugcuguuga

SEQ ID NO: 105274 - RNA, 22 nt, Human
auuucaugagcuaauggaucuc

SEQ ID NO: 105275 - RNA, 22 nt, Human
auuucauggacaucuuuggagg

SEQ ID NO: 105276 - RNA, 22 nt, Human
auuucauguuaacugaacagaa

SEQ ID NO: 105277 - RNA, 22 nt, Human
auuucauguuucaucuaccuaa

SEQ ID NO: 105278 - RNA, 22 nt, Human
auuucauugaaguuaauucuuc

SEQ ID NO: 105279 - RNA, 22 nt, Human
auuuccaaaaccacuuauugcc

SEQ ID NO: 105280 - RNA, 21 nt, Human
auuuccacauaaucauaagac

SEQ ID NO: 105281 - RNA, 22 nt, Human
auuuccauacacccauuucuga

SEQ ID NO: 105282 - RNA, 22 nt, Human
auuuccaugaauucccacucau

SEQ ID NO: 105283 - RNA, 22 nt, Human
auuuccauguccaaaaauuagu

SEQ ID NO: 105284 - RNA, 22 nt, Human
auuucccagcuuugaucaguuu

SEQ ID NO: 105285 - RNA, 22 nt, Human
auuucccagggccugggauuug

SEQ ID NO: 105286 - RNA, 22 nt, Human
auuucccaugugaaucaauugg

SEQ ID NO: 105287 - RNA, 23 nt, Human
auuucccauugugucagcagagc

SEQ ID NO: 105288 - RNA, 22 nt, Human
auuucccuccagggaaagcuua

SEQ ID NO: 105289 - RNA, 23 nt, Human
auuuccuaaaagauaaucauuac

SEQ ID NO: 105290 - RNA, 22 nt, Human
auuuccuaacagaggcaacagu

SEQ ID NO: 105291 - RNA, 22 nt, Human
auuuccuagccucucuugcagu

SEQ ID NO: 105292 - RNA, 22 nt, Human
auuuccuaggugcucgagugcu

SEQ ID NO: 105293 - RNA, 22 nt, Human
auuuccuauacaguuguccaua

SEQ ID NO: 105294 - RNA, 22 nt, Human
auuuccugcaaggaguggguuu

SEQ ID NO: 105295 - RNA, 22 nt, Human
auuuccuggaggaauggaagca

SEQ ID NO: 105296 - RNA, 22 nt, Human
auuuccugguugcauuggcuuu

SEQ ID NO: 105297 - RNA, 22 nt, Human
auuuccuucaguguuuaauacu

SEQ ID NO: 105298 - RNA, 22 nt, Human
auuucuaaagagggugguuugg

SEQ ID NO: 105299 - RNA, 22 nt, Human
auuucuacaguacacaugcauu

SEQ ID NO: 105300 - RNA, 22 nt, Human
auuucuagacuuagaacucuua

SEQ ID NO: 105301 - RNA, 22 nt, Human
auuucuagcaaaggcucugcua

SEQ ID NO: 105302 - RNA, 22 nt, Human
auuucuagccucugaaguagga

SEQ ID NO: 105303 - RNA, 22 nt, Human
auuucuaguccuuguguaguca

SEQ ID NO: 105304 - RNA, 22 nt, Human
auuucucacaguggaaucucug

SEQ ID NO: 105305 - RNA, 22 nt, Human
auuucucagaccagagaggugu

SEQ ID NO: 105306 - RNA, 22 nt, Human
auuucucagcacuuccuaucuc

SEQ ID NO: 105307 - RNA, 22 nt, Human
auuucucaggacuccaugggcg

SEQ ID NO: 105308 - RNA, 22 nt, Human
auuucucagggcugaggaggag

SEQ ID NO: 105309 - RNA, 22 nt, Human
auuucucagugugaucaggccu

SEQ ID NO: 105310 - RNA, 22 nt, Human
auuucucaucuuugugaauggu

SEQ ID NO: 105311 - RNA, 18 nt, Human
auuucucuggggugauuc

SEQ ID NO: 105312 - RNA, 22 nt, Human
auuucucuuccuccuaggguug

SEQ ID NO: 105313 - RNA, 22 nt, Human
auuucugauaaacguaagcugc

SEQ ID NO: 105314 - RNA, 22 nt, Human
auuucugccaaaguggggaccu

SEQ ID NO: 105315 - RNA, 22 nt, Human
auuucugccauagccaggggau

SEQ ID NO: 105316 - RNA, 22 nt, Human
auuucugugcaguaaaugguga

SEQ ID NO: 105317 - RNA, 22 nt, Human
auuucuuacauaacaaauuguu

SEQ ID NO: 105318 - RNA, 22 nt, Human
auuucuucaggucagaaauaga

SEQ ID NO: 105319 - RNA, 19 nt, Human
auuugaaagcugugcuugc

SEQ ID NO: 105320 - RNA, 22 nt, Human
auuugaaugcagguagcugagu

SEQ ID NO: 105321 - RNA, 22 nt, Human
auuugacaacuucugguggcau

SEQ ID NO: 105322 - RNA, 22 nt, Human
auuugacauuauucucucaguc

SEQ ID NO: 105323 - RNA, 22 nt, Human
auuugaggauaguuggguacuc

SEQ ID NO: 105324 - RNA, 22 nt, Human
auuugcaauuacucaugucauu

SEQ ID NO: 105325 - RNA, 22 nt, Human
auuugcagaagggagggggacc

SEQ ID NO: 105326 - RNA, 22 nt, Human
auuugcagauucugucagguuu

SEQ ID NO: 105327 - RNA, 22 nt, Human
auuugcauaucugauagacuaa

SEQ ID NO: 105328 - RNA, 22 nt, Human
auuugcaugaccuuugcaagug

SEQ ID NO: 105329 - RNA, 23 nt, Human
auuugcauggccggauuauggau

SEQ ID NO: 105330 - RNA, 22 nt, Human
auuugcauuuagaaagaucacu

SEQ ID NO: 105331 - RNA, 22 nt, Human
auuugccuuacugaagaaggag

SEQ ID NO: 105332 - RNA, 22 nt, Human
auuugccuuucgaaucaacagg

SEQ ID NO: 105333 - RNA, 22 nt, Human
auuugccuuuuaaacucacaau

SEQ ID NO: 105334 - RNA, 22 nt, Human
auuugcugaucaucuagcuaau

SEQ ID NO: 105335 - RNA, 22 nt, Human
auuugcugugugcuuuagagac

SEQ ID NO: 105336 - RNA, 22 nt, Human
auuugcuuagauucagcacuuu

SEQ ID NO: 105337 - RNA, 22 nt, Human
auuugcuucuagucaguuccau

SEQ ID NO: 105338 - RNA, 22 nt, Human
auuugcuucugcuaaacaacuu

SEQ ID NO: 105339 - RNA, 22 nt, Human
auuugcuucugugaaaucaagu

SEQ ID NO: 105340 - RNA, 23 nt, Human
agugaauucaguuuaaaacagag

SEQ ID NO: 105341 - RNA, 22 nt, Human
agugaauucuccacccaguagg

SEQ ID NO: 105342 - RNA, 22 nt, Human
agugaauucugcacuacugaag

SEQ ID NO: 105343 - RNA, 22 nt, Human
agugacaaaacggaacauacag

SEQ ID NO: 105344 - RNA, 22 nt, Human
agugacaacaaguugacuagaa

SEQ ID NO: 105345 - RNA, 22 nt, Human
agugacaagguaguuaguugga

SEQ ID NO: 105346 - RNA, 20 nt, Human
agugacagagacuguguggc

SEQ ID NO: 105347 - RNA, 22 nt, Human
agugacagauuaccggcagagc

SEQ ID NO: 105348 - RNA, 22 nt, Human
agugacaggaccaggucuggaa

SEQ ID NO: 105349 - RNA, 22 nt, Human
agugacagucugauuucucaaa

SEQ ID NO: 105350 - RNA, 22 nt, Human
agugacauuauuuuguguacua

SEQ ID NO: 105351 - RNA, 22 nt, Human
agugaccaaucacugaaugauu

SEQ ID NO: 105352 - RNA, 22 nt, Human
agugacuaaagguuuuaauggc

SEQ ID NO: 105353 - RNA, 22 nt, Human
agugacuacugauuuuuacuuu

SEQ ID NO: 105354 - RNA, 21 nt, Human
agugacuaugacauuauuacc

SEQ ID NO: 105355 - RNA, 22 nt, Human
agugacucacuagcucucagug

SEQ ID NO: 105356 - RNA, 22 nt, Human
agugacuuuaguugaaucuugu

SEQ ID NO: 105357 - RNA, 17 nt, Human
agugagaaugucaugua

SEQ ID NO: 105358 - RNA, 22 nt, Human
agugagacaguauacugagcag

SEQ ID NO: 105359 - RNA, 23 nt, Human
auauuagggagauuagcccucua

SEQ ID NO: 105360 - RNA, 22 nt, Human
auauuaguuuggagacuacaau

SEQ ID NO: 105361 - RNA, 22 nt, Human
auauuauagacagagucuucug

SEQ ID NO: 105362 - RNA, 18 nt, Human
auauucaagaagacagag

SEQ ID NO: 105363 - RNA, 22 nt, Human
caagauuuccaacccuggguaa

SEQ ID NO: 105364 - RNA, 22 nt, Human
caagauuugccaguggccaacu

SEQ ID NO: 105365 - RNA, 22 nt, Human
caagauuuggcaacuuugucau

SEQ ID NO: 105366 - RNA, 22 nt, Human
caagauuuuaucuccguuucug

SEQ ID NO: 105367 - RNA, 22 nt, Human
caagcacuguggcacucgcagg

SEQ ID NO: 105368 - RNA, 22 nt, Human
caagcagagaagucucuaggcu

SEQ ID NO: 105369 - RNA, 22 nt, Human
caagcagagaggucaacuaaua

SEQ ID NO: 105370 - RNA, 22 nt, Human
caagcagagagguuagaacaca

SEQ ID NO: 105371 - RNA, 22 nt, Human
caagcaggaggagaaguuucug

SEQ ID NO: 105372 - RNA, 22 nt, Human
caagcaggaugaagcccaggga

SEQ ID NO: 105373 - RNA, 22 nt, Human
caagcaggguuuaugcauggag

SEQ ID NO: 105374 - RNA, 22 nt, Human
caagcagguuugcuauuuucuu

SEQ ID NO: 105375 - RNA, 22 nt, Human
caagcauacucauuccagacuc

SEQ ID NO: 105376 - RNA, 22 nt, Human
caagccagcaguuuaaugacuc

SEQ ID NO: 105377 - RNA, 22 nt, Human
caagccagcuccugccacagag

SEQ ID NO: 105378 - RNA, 22 nt, Human
caagccagugauguuugcugcc

SEQ ID NO: 105379 - RNA, 22 nt, Human
caagccauauuuugaagaauga

SEQ ID NO: 105380 - RNA, 22 nt, Human
caagcccaggauuccccaguua

SEQ ID NO: 105381 - RNA, 22 nt, Human
caagccucagaaucuucuccau

SEQ ID NO: 105382 - RNA, 22 nt, Human
caagccugucucaccagugcua

SEQ ID NO: 105383 - RNA, 22 nt, Human
caagcuccuuacauccacaggg

SEQ ID NO: 105384 - RNA, 22 nt, Human
caagcucugggauagcagagag

SEQ ID NO: 105385 - RNA, 22 nt, Human
caagcucuuuaaacuuauguca

SEQ ID NO: 105386 - RNA, 22 nt, Human
caagcugcagcgccugcgccgg

SEQ ID NO: 105387 - RNA, 22 nt, Human
caagcugccaccagaagagcau

SEQ ID NO: 105388 - RNA, 22 nt, Human
caagcugcuauagguugcuggg

SEQ ID NO: 105389 - RNA, 22 nt, Human
caaggaaacaugaaaugcauug

SEQ ID NO: 105390 - RNA, 22 nt, Human
caaggaagacccacgcagauau

SEQ ID NO: 105391 - RNA, 22 nt, Human
caaggacacucccugcugggca

SEQ ID NO: 105392 - RNA, 22 nt, Human
caaggacagcgucaggugcaac

SEQ ID NO: 105393 - RNA, 22 nt, Human
caaggagauaaaauguugagcu

SEQ ID NO: 105394 - RNA, 22 nt, Human
caaggcaagucauaugggcaag

SEQ ID NO: 105395 - RNA, 20 nt, Human
caaggcagaccagagugagu

SEQ ID NO: 105396 - RNA, 22 nt, Human
caaggcauacuccuuucucagc

SEQ ID NO: 105397 - RNA, 22 nt, Human
caaggcaugcaaugucuucagg

SEQ ID NO: 105398 - RNA, 22 nt, Human
caaggcauuguguaagcacuug

SEQ ID NO: 105399 - RNA, 22 nt, Human
caaggccaagguuuugugaacu

SEQ ID NO: 105400 - RNA, 19 nt, Human
caaggccaccauuucuccg

SEQ ID NO: 105401 - RNA, 22 nt, Human
caaggccacugcucagguuucc

SEQ ID NO: 105402 - RNA, 22 nt, Human
caaggccauauugccuguaugu

SEQ ID NO: 105403 - RNA, 22 nt, Human
caaggcccugcaaccugacuug

SEQ ID NO: 105404 - RNA, 22 nt, Human
caaggccuaaucauacugcuaa

SEQ ID NO: 105405 - RNA, 22 nt, Human
caaggccuccugggcccagaga

SEQ ID NO: 105406 - RNA, 22 nt, Human
caaggccugccucuggcagaaa

SEQ ID NO: 105407 - RNA, 22 nt, Human
caaggccuucgucuccuagcuu

SEQ ID NO: 105408 - RNA, 22 nt, Human
caaggccuugcugucuccuccu

SEQ ID NO: 105409 - RNA, 22 nt, Human
caaggcucuggaccaaauccca

SEQ ID NO: 105410 - RNA, 22 nt, Human
caaggcugcuggcuucugagcu

SEQ ID NO: 105411 - RNA, 22 nt, Human
caaggcugcuucagacuaguga

SEQ ID NO: 105412 - RNA, 22 nt, Human
caaggcuguguuagcugcccuc

SEQ ID NO: 105413 - RNA, 21 nt, Human
caaggcuuaaacauuaaucua

SEQ ID NO: 105414 - RNA, 22 nt, Human
caaggcuuagguggcucccugu

SEQ ID NO: 105415 - RNA, 20 nt, Human
caaggcuucuuugauggggu

SEQ ID NO: 105416 - RNA, 22 nt, Human
caaggcuugaauucugaugggu

SEQ ID NO: 105417 - RNA, 22 nt, Human
caaggcuuggagagaaugccau

SEQ ID NO: 105418 - RNA, 22 nt, Human
caagggaagaggacagggaccu

SEQ ID NO: 105419 - RNA, 22 nt, Human
caagggcauugcuugggaccuu

SEQ ID NO: 105420 - RNA, 22 nt, Human
caagguaguucuggucauugac

SEQ ID NO: 105421 - RNA, 22 nt, Human
caaggucacauaacuugucaaa

SEQ ID NO: 105422 - RNA, 22 nt, Human
caagguuuacauugggcuauca

SEQ ID NO: 105423 - RNA, 22 nt, Human
caagguuucgaguucccaacca

SEQ ID NO: 105424 - RNA, 22 nt, Human
caagguuucuaugcucaaagga

SEQ ID NO: 105425 - RNA, 22 nt, Human
caagguuuuggaagauuuucgu

SEQ ID NO: 105426 - RNA, 22 nt, Human
caaguaaacaauaugugauuca

SEQ ID NO: 105427 - RNA, 22 nt, Human
caaguaaagaaucacauuucuu

SEQ ID NO: 105428 - RNA, 22 nt, Human
caaguaaugguuuuauaauagu

SEQ ID NO: 105429 - RNA, 22 nt, Human
caaguaauucugcaagaaacca

SEQ ID NO: 105430 - RNA, 22 nt, Human
caaguauuuuaaggacuagugg

SEQ ID NO: 105431 - RNA, 22 nt, Human
caagucaaagacuagaacuagu

SEQ ID NO: 105432 - RNA, 22 nt, Human
caagucauuguuuagucauguu

SEQ ID NO: 105433 - RNA, 22 nt, Human
caaguccaggugggcaaauaaa

SEQ ID NO: 105434 - RNA, 22 nt, Human
caaguccucaaagggcucugcu

SEQ ID NO: 105435 - RNA, 22 nt, Human
caaguccuccaugugacuaggu

SEQ ID NO: 105436 - RNA, 22 nt, Human
caaguccuuuucuuggcucagg

SEQ ID NO: 105437 - RNA, 22 nt, Human
caagugacugugcuggcaacau

SEQ ID NO: 105438 - RNA, 22 nt, Human
caaguggggcagauucucuucc

SEQ ID NO: 105439 - RNA, 20 nt, Human
caaguguagaaacuaauaag

SEQ ID NO: 105440 - RNA, 22 nt, Human
caagugucuauaucagugcuug

SEQ ID NO: 105441 - RNA, 20 nt, Human
caaguguuauugugcauuua

SEQ ID NO: 105442 - RNA, 22 nt, Human
caaguuaaauuugcauuucaga

SEQ ID NO: 105443 - RNA, 22 nt, Human
caaguuaauugguauuuugauc

SEQ ID NO: 105444 - RNA, 22 nt, Human
caaguuacauuagaaaucaugc

SEQ ID NO: 105445 - RNA, 22 nt, Human
caaguuaucagaaggcacuuuu

SEQ ID NO: 105446 - RNA, 22 nt, Human
caaguuauuccuuuacacuaua

SEQ ID NO: 105447 - RNA, 23 nt, Human
caaguuauucugacacucaucaa

SEQ ID NO: 105448 - RNA, 21 nt, Human
caaguucugcugaaucuucuu

SEQ ID NO: 105449 - RNA, 22 nt, Human
caaguucuggacaggggaauau

SEQ ID NO: 105450 - RNA, 22 nt, Human
caaguugugaaugacagacuuc

SEQ ID NO: 105451 - RNA, 22 nt, Human
caaguuguuuaggagguguugu

SEQ ID NO: 105452 - RNA, 22 nt, Human
caaguuuagucauggugguagu

SEQ ID NO: 105453 - RNA, 22 nt, Human
caaguuuuagaaauaucuggau

SEQ ID NO: 105454 - RNA, 22 nt, Human
caaguuuucuggguucagagca

SEQ ID NO: 105455 - RNA, 22 nt, Human
caauaaaguggaggcccgggcu

SEQ ID NO: 105456 - RNA, 22 nt, Human
caauaacuuugauauuuugcgg

SEQ ID NO: 105457 - RNA, 22 nt, Human
caauaagugcuuuuguuuagca

SEQ ID NO: 105458 - RNA, 22 nt, Human
caauaauugcuuuccagaguua

SEQ ID NO: 105459 - RNA, 22 nt, Human
caauacaauuaccaguuaauca

SEQ ID NO: 105460 - RNA, 22 nt, Human
caauacacuaaacuucucugaa

SEQ ID NO: 105461 - RNA, 22 nt, Human
caauacugaguuuacauucauc

SEQ ID NO: 105462 - RNA, 22 nt, Human
caauacuuccuuguuagaggca

SEQ ID NO: 105463 - RNA, 22 nt, Human
caauagcagcuucugaaugcaa

SEQ ID NO: 105464 - RNA, 22 nt, Human
caauagcaggucuacagagaga

SEQ ID NO: 105465 - RNA, 22 nt, Human
caauagcuaggcugguaaagga

SEQ ID NO: 105466 - RNA, 22 nt, Human
caauaguauuuauugaacaccu

SEQ ID NO: 105467 - RNA, 22 nt, Human
caauauagagagaaaauuaugu

SEQ ID NO: 105468 - RNA, 22 nt, Human
cacagaagaaucaugcuguguu

SEQ ID NO: 105469 - RNA, 22 nt, Human
cacagaaguguguauaacucuu

SEQ ID NO: 105470 - RNA, 22 nt, Human
cacagacccagaagggaugaag

SEQ ID NO: 105471 - RNA, 22 nt, Human
cacagagaacugugggagugug

SEQ ID NO: 105472 - RNA, 22 nt, Human
cacagagauggccagggcacau

SEQ ID NO: 105473 - RNA, 22 nt, Human
cacagagcugaaccugggucau

SEQ ID NO: 105474 - RNA, 22 nt, Human
cacagaggaugcccaagcgauc

SEQ ID NO: 105475 - RNA, 22 nt, Human
cacagaggcggaaaauucugaa

SEQ ID NO: 105476 - RNA, 22 nt, Human
cacagaggucugggcccagcag

SEQ ID NO: 105477 - RNA, 22 nt, Human
cacagaguggaggcuuggccug

SEQ ID NO: 105478 - RNA, 22 nt, Human
cacagaugagcugaauagcuuu

SEQ ID NO: 105479 - RNA, 22 nt, Human
cacagcagaacuuaauuucaaa

SEQ ID NO: 105480 - RNA, 22 nt, Human
cacagcagauccagggguugug

SEQ ID NO: 105481 - RNA, 22 nt, Human
cacagcagggcauggcuguugu

SEQ ID NO: 105482 - RNA, 20 nt, Human
auacacuugcccagcuugug

SEQ ID NO: 105483 - RNA, 22 nt, Human
auacagagaagggaggcaaaau

SEQ ID NO: 105484 - RNA, 22 nt, Human
auacagauauaagauugaggag

SEQ ID NO: 105485 - RNA, 22 nt, Human
auacagaucccacagcauguga

SEQ ID NO: 105486 - RNA, 22 nt, Human
auacagaugaaauacuaagcua

SEQ ID NO: 105487 - RNA, 22 nt, Human
auacagauugcuauacuuacaa

SEQ ID NO: 105488 - RNA, 22 nt, Human
auacagcagugaauaagauaaa

SEQ ID NO: 105489 - RNA, 22 nt, Human
auacagcaguuugugauccuag

SEQ ID NO: 105490 - RNA, 22 nt, Human
auacagcugccuucuaacuaug

SEQ ID NO: 105491 - RNA, 22 nt, Human
auacaggaugcugaacaucucu

SEQ ID NO: 105492 - RNA, 22 nt, Human
auacagguggacuucaguuagu

SEQ ID NO: 105493 - RNA, 22 nt, Human
auacaguaauugcauaggcuuc

SEQ ID NO: 105494 - RNA, 20 nt, Human
auacaguaggugcucaauau

SEQ ID NO: 105495 - RNA, 22 nt, Human
auacagucagacuuuagccauu

SEQ ID NO: 105496 - RNA, 22 nt, Human
auacagugaauacuuacagugu

SEQ ID NO: 105497 - RNA, 22 nt, Human
auacagugagaauaauucuuag

SEQ ID NO: 105498 - RNA, 22 nt, Human
auacaguggcugugagcugggc

SEQ ID NO: 105499 - RNA, 22 nt, Human
auacauaauuacuuccgauguu

SEQ ID NO: 105500 - RNA, 23 nt, Human
auacauacagucuuacugacuuu

SEQ ID NO: 105501 - RNA, 22 nt, Human
auacauacguacauacguaugu

SEQ ID NO: 105502 - RNA, 22 nt, Human
auacauagcagagucaauuaau

SEQ ID NO: 105503 - RNA, 22 nt, Human
auacaucaauuucuuaguuauc

SEQ ID NO: 105504 - RNA, 22 nt, Human
auacaucauuuaugaugugugu

SEQ ID NO: 105505 - RNA, 22 nt, Human
auacaucauuuauggaauaagg

SEQ ID NO: 105506 - RNA, 22 nt, Human
auacaucauuucccaucaaucg

SEQ ID NO: 105507 - RNA, 22 nt, Human
auacaucuggauguaugcauuu

SEQ ID NO: 105508 - RNA, 22 nt, Human
auacaugacucacacauucugc

SEQ ID NO: 105509 - RNA, 22 nt, Human
auacaugaggaggcuggaaaca

SEQ ID NO: 105510 - RNA, 22 nt, Human
auacaugauacuuaguacguag

SEQ ID NO: 105511 - RNA, 22 nt, Human
auacaugauggguguauaguuu

SEQ ID NO: 105512 - RNA, 22 nt, Human
auacaugcacauuuuuauacau

SEQ ID NO: 105513 - RNA, 17 nt, Human
auacauguaaagugcuu

SEQ ID NO: 105514 - RNA, 22 nt, Human
auacaugugggucuaaacauau

SEQ ID NO: 105515 - RNA, 22 nt, Human
auacaugugugagcgaagaugu

SEQ ID NO: 105516 - RNA, 22 nt, Human
auacauuagcucauaugauuaa

SEQ ID NO: 105517 - RNA, 22 nt, Human
auacauuagugaacaaaagaga

SEQ ID NO: 105518 - RNA, 22 nt, Human
auacauucagcagugcucauga

SEQ ID NO: 105519 - RNA, 21 nt, Human
auacauucuauuaagcauuua

SEQ ID NO: 105520 - RNA, 22 nt, Human
auaccacaacauggcucagagg

SEQ ID NO: 105521 - RNA, 22 nt, Human
auaccauaggaaaggaucagcc

SEQ ID NO: 105522 - RNA, 22 nt, Human
auaccauggcaguuuauucacg

SEQ ID NO: 105523 - RNA, 22 nt, Human
auacccagaguggguagaguua

SEQ ID NO: 105524 - RNA, 22 nt, Human
auacccagcucuuucguuuugg

SEQ ID NO: 105525 - RNA, 22 nt, Human
auaccucuggcacucaagacuu

SEQ ID NO: 105526 - RNA, 22 nt, Human
auaccuuuuagacauguaguug

SEQ ID NO: 105527 - RNA, 22 nt, Human
auacgccauaggcuccucacuu

SEQ ID NO: 105528 - RNA, 22 nt, Human
auacuacaaucauaauuguaca

SEQ ID NO: 105529 - RNA, 22 nt, Human
auacucagcugcuagacagaag

SEQ ID NO: 105530 - RNA, 23 nt, Human
auacugaaacuguuguuuaucug

SEQ ID NO: 105531 - RNA, 22 nt, Human
auacugaacauguuugcaguca

SEQ ID NO: 105532 - RNA, 22 nt, Human
auacugauuaguugagaaagca

SEQ ID NO: 105533 - RNA, 22 nt, Human
auacuguaauaccuaaaugaac

SEQ ID NO: 105534 - RNA, 22 nt, Human
auacuguacgucccagauagga

SEQ ID NO: 105535 - RNA, 22 nt, Human
auacuguagaggcauagcuagu

SEQ ID NO: 105536 - RNA, 22 nt, Human
auacuuacuuuucuucagacua

SEQ ID NO: 105537 - RNA, 22 nt, Human
auacuugagguagcaacuuaag

SEQ ID NO: 105538 - RNA, 22 nt, Human
auacuuggugguguuccauagg

SEQ ID NO: 105539 - RNA, 22 nt, Human
auacuuuagagcuagauugccu

SEQ ID NO: 105540 - RNA, 22 nt, Human
auacuuugcuacauuguacauu

SEQ ID NO: 105541 - RNA, 22 nt, Human
auacuuuggggguuaguguaga

SEQ ID NO: 105542 - RNA, 22 nt, Human
auagaaacagaggucaggcauu

SEQ ID NO: 105543 - RNA, 18 nt, Human
auagaaaccuuuaaucag

SEQ ID NO: 105544 - RNA, 23 nt, Human
auagaaacuaacaauuuggcuua

SEQ ID NO: 105545 - RNA, 22 nt, Human
auagaaaggucuuuggcagaca

SEQ ID NO: 105546 - RNA, 21 nt, Human
auagaacaccaggcauauaua

SEQ ID NO: 105547 - RNA, 22 nt, Human
auagaaccacccagagccuuuu

SEQ ID NO: 105548 - RNA, 19 nt, Human
auagaaccugcaguuucaa

SEQ ID NO: 105549 - RNA, 22 nt, Human
auagaacucgggcuuuggaauc

SEQ ID NO: 105550 - RNA, 22 nt, Human
auagaauaaugguugucaggag

SEQ ID NO: 105551 - RNA, 22 nt, Human
auagaauccugcagcaagccuu

SEQ ID NO: 105552 - RNA, 22 nt, Human
auagaauuauggaaagcaucuu

SEQ ID NO: 105553 - RNA, 22 nt, Human
auagaauucguguuuguaauuc

SEQ ID NO: 105554 - RNA, 20 nt, Human
auagacaaagacaugccaga

SEQ ID NO: 105555 - RNA, 22 nt, Human
auagacaacacuuauuauuccu

SEQ ID NO: 105556 - RNA, 22 nt, Human
auagacacauguuauuauacuu

SEQ ID NO: 105557 - RNA, 22 nt, Human
auagacagaaagauaauagaau

SEQ ID NO: 105558 - RNA, 22 nt, Human
auagacauauggcuuuguuucu

SEQ ID NO: 105559 - RNA, 22 nt, Human
auagacauuauaacacagagcu

SEQ ID NO: 105560 - RNA, 22 nt, Human
auagaccuucuacacaggacaa

SEQ ID NO: 105561 - RNA, 22 nt, Human
auagacgcggccgcugaugcag

SEQ ID NO: 105562 - RNA, 22 nt, Human
auagagcuauaagaauuuugug

SEQ ID NO: 105563 - RNA, 22 nt, Human
auagagcucuucuucuuuuaac

SEQ ID NO: 105564 - RNA, 22 nt, Human
auagaguccaaaguaugaauau

SEQ ID NO: 105565 - RNA, 22 nt, Human
auagagugauguaagguaugug

SEQ ID NO: 105566 - RNA, 22 nt, Human
auagauacauuguuauauuugu

SEQ ID NO: 105567 - RNA, 22 nt, Human
auagauacuuauaacaauugug

SEQ ID NO: 105568 - RNA, 22 nt, Human
auagauccagaaaauuuauuau

SEQ ID NO: 105569 - RNA, 22 nt, Human
auagaugucauugucauccauc

SEQ ID NO: 105570 - RNA, 22 nt, Human
auagauguuuucuccuaauugg

SEQ ID NO: 105571 - RNA, 22 nt, Human
auagauuagcccuauaguuuua

SEQ ID NO: 105572 - RNA, 22 nt, Human
auagauugcuaguuuuaaaauu

SEQ ID NO: 105573 - RNA, 22 nt, Human
auagauuugaauuuaagacuug

SEQ ID NO: 105574 - RNA, 22 nt, Human
auagcaaacuggagcuugcuuu

SEQ ID NO: 105575 - RNA, 22 nt, Human
auagcaaagccuggcacaauga

SEQ ID NO: 105576 - RNA, 22 nt, Human
auagcaaauauuuuaaugagca

SEQ ID NO: 105577 - RNA, 22 nt, Human
cacugcuuaguugguaaaugug

SEQ ID NO: 105578 - RNA, 22 nt, Human
cacugcuuauaaauucuaggca

SEQ ID NO: 105579 - RNA, 22 nt, Human
cacugcuucuggaggaauuugg

SEQ ID NO: 105580 - RNA, 22 nt, Human
cacugcuuuaaggcugaguaac

SEQ ID NO: 105581 - RNA, 22 nt, Human
cacugcuuucacaguuuguucc

SEQ ID NO: 105582 - RNA, 18 nt, Human
cacuggaagauuaggguc

SEQ ID NO: 105583 - RNA, 22 nt, Human
cacuggaauagcauugauucuu

SEQ ID NO: 105584 - RNA, 22 nt, Human
cacuggaauauggcguugaacc

SEQ ID NO: 105585 - RNA, 22 nt, Human
cacuggaauucaagauacugag

SEQ ID NO: 105586 - RNA, 22 nt, Human
cacuggcaaauggagagaaugu

SEQ ID NO: 105587 - RNA, 22 nt, Human
cacuggcaugugaggcgguggc

SEQ ID NO: 105588 - RNA, 22 nt, Human
cacuggcauuagucacgaggca

SEQ ID NO: 105589 - RNA, 22 nt, Human
cacuggcccauuccugucuggc

SEQ ID NO: 105590 - RNA, 22 nt, Human
cacugggagucguaagacacgg

SEQ ID NO: 105591 - RNA, 20 nt, Human
cacugggcuggagucagggc

SEQ ID NO: 105592 - RNA, 22 nt, Human
cacugggcuuuguaguuagcau

SEQ ID NO: 105593 - RNA, 22 nt, Human
cacuggugacuucugagcugga

SEQ ID NO: 105594 - RNA, 22 nt, Human
cacuggugccagagaacagaau

SEQ ID NO: 105595 - RNA, 22 nt, Human
cacugguguauuagagcuagaa

SEQ ID NO: 105596 - RNA, 22 nt, Human
cacuggugucugagcaggguga

SEQ ID NO: 105597 - RNA, 22 nt, Human
cacugguuggcugagauccaua

SEQ ID NO: 105598 - RNA, 22 nt, Human
cacuguaauggaauuuucuuua

SEQ ID NO: 105599 - RNA, 22 nt, Human
cacuguacccauuuaaauaaau

SEQ ID NO: 105600 - RNA, 22 nt, Human
cacuguacuggguugaaggacg

SEQ ID NO: 105601 - RNA, 22 nt, Human
auagcaauggcaacaacuaagc

SEQ ID NO: 105602 - RNA, 22 nt, Human
auagcaccaugacuaaacaauu

SEQ ID NO: 105603 - RNA, 22 nt, Human
auagcaguaacacugacauuuu

SEQ ID NO: 105604 - RNA, 22 nt, Human
auagcauuauuuacaauuagua

SEQ ID NO: 105605 - RNA, 22 nt, Human
auagccuugacucacagcucuu

SEQ ID NO: 105606 - RNA, 22 nt, Human
auagcugacuccagacauagcu

SEQ ID NO: 105607 - RNA, 22 nt, Human
auagcuguuuuuaggccaaaua

SEQ ID NO: 105608 - RNA, 22 nt, Human
auagcuuuacagaagaguuuag

SEQ ID NO: 105609 - RNA, 22 nt, Human
auagcuuucuuaaauauauaaa

SEQ ID NO: 105610 - RNA, 22 nt, Human
auagcuuugagggcuccuuagg

SEQ ID NO: 105611 - RNA, 22 nt, Human
auaggaaugugauuuauaaaug

SEQ ID NO: 105612 - RNA, 22 nt, Human
auaggcaagggauacaauauac

SEQ ID NO: 105613 - RNA, 22 nt, Human
auaggccaauacuguagaguuu

SEQ ID NO: 105614 - RNA, 22 nt, Human
auaggcuugagcuaagagagaa

SEQ ID NO: 105615 - RNA, 22 nt, Human
auagggcagucaggccgccacu

SEQ ID NO: 105616 - RNA, 22 nt, Human
auaggugaaauauucaaaaugu

SEQ ID NO: 105617 - RNA, 22 nt, Human
auaguaaauuaucguggagaga

SEQ ID NO: 105618 - RNA, 22 nt, Human
auaguaugagcucauacacuug

SEQ ID NO: 105619 - RNA, 22 nt, Human
auaguauuuaauaguuagcuca

SEQ ID NO: 105620 - RNA, 22 nt, Human
auaguauuuccagaaauagucu

SEQ ID NO: 105621 - RNA, 22 nt, Human
auagucacugccuuccauuugu

SEQ ID NO: 105622 - RNA, 22 nt, Human
auagucagugucuauaucguug

SEQ ID NO: 105623 - RNA, 23 nt, Human
auagucauguaaaauauuugaag

SEQ ID NO: 105624 - RNA, 22 nt, Human
auagucuuagaaucuugagugu

SEQ ID NO: 105625 - RNA, 22 nt, Human
auagucuucagcacuuugauca

SEQ ID NO: 105626 - RNA, 22 nt, Human
auagucuuuacugcugaauuga

SEQ ID NO: 105627 - RNA, 22 nt, Human
auagugcauuuuauuaucagca

SEQ ID NO: 105628 - RNA, 22 nt, Human
auaguggggacaggaugguugg

SEQ ID NO: 105629 - RNA, 22 nt, Human
auaguggguacaggggcagaga

SEQ ID NO: 105630 - RNA, 22 nt, Human
auaguguguuagugacauaggc

SEQ ID NO: 105631 - RNA, 22 nt, Human
auaguguuagagccaguauguu

SEQ ID NO: 105632 - RNA, 22 nt, Human
auaguuacauacagaaauauuu

SEQ ID NO: 105633 - RNA, 22 nt, Human
auaguuauaagaaaacguugaa

SEQ ID NO: 105634 - RNA, 22 nt, Human
auaguugguccaugaaaaaagu

SEQ ID NO: 105635 - RNA, 22 nt, Human
auaguuguguggggauucuggu

SEQ ID NO: 105636 - RNA, 22 nt, Human
auaguuugaaggcuguucuacu

SEQ ID NO: 105637 - RNA, 22 nt, Human
auaguuuuaaaaccucaggaag

SEQ ID NO: 105638 - RNA, 22 nt, Human
auaguuuuauagauauugugua

SEQ ID NO: 105639 - RNA, 23 nt, Human
auaguuuucccugguucuugcca

SEQ ID NO: 105640 - RNA, 22 nt, Human
auauaaagaaguggaaaaugag

SEQ ID NO: 105641 - RNA, 22 nt, Human
auauaacucuccauuaagggcc

SEQ ID NO: 105642 - RNA, 22 nt, Human
auauaacucuuguucuuauagu

SEQ ID NO: 105643 - RNA, 20 nt, Human
auauaauaaauuuugguuac

SEQ ID NO: 105644 - RNA, 22 nt, Human
auauaauuaauuuagcugccuc

SEQ ID NO: 105645 - RNA, 22 nt, Human
auauaauuguucugaaguguuu

SEQ ID NO: 105646 - RNA, 22 nt, Human
auauaauuuuugguuagcucaa

SEQ ID NO: 105647 - RNA, 22 nt, Human
auauacagggagaaacagcuua

SEQ ID NO: 105648 - RNA, 22 nt, Human
auauacaggugguauguguaaa

SEQ ID NO: 105649 - RNA, 19 nt, Human
auauacauacugugugcau

SEQ ID NO: 105650 - RNA, 22 nt, Human
auauacguauauuccaaagggu

SEQ ID NO: 105651 - RNA, 22 nt, Human
auauacuuccccauuauggggg

SEQ ID NO: 105652 - RNA, 22 nt, Human
auauagaaggugcuauuuacau

SEQ ID NO: 105653 - RNA, 22 nt, Human
auauagacagaugacagggaua

SEQ ID NO: 105654 - RNA, 22 nt, Human
auauaggcuucaugacagaggg

SEQ ID NO: 105655 - RNA, 22 nt, Human
auauaguaagcagucuguaaau

SEQ ID NO: 105656 - RNA, 22 nt, Human
auauagugagagauuacagaag

SEQ ID NO: 105657 - RNA, 22 nt, Human
auauauaagcugaugagccaca

SEQ ID NO: 105658 - RNA, 22 nt, Human
auauaucuucauuaggucgaga

SEQ ID NO: 105659 - RNA, 22 nt, Human
auauaugcgcaggcacccagcu

SEQ ID NO: 105660 - RNA, 21 nt, Human
auaucacaaacauauggucug

SEQ ID NO: 105661 - RNA, 23 nt, Human
auaucacacccaguacagucucc

SEQ ID NO: 105662 - RNA, 22 nt, Human
auaucacagaugcagaaagaga

SEQ ID NO: 105663 - RNA, 22 nt, Human
auaucacaguaguuguuuaguu

SEQ ID NO: 105664 - RNA, 22 nt, Human
auaucacuagagaaguuguuaa

SEQ ID NO: 105665 - RNA, 22 nt, Human
auaucagaaauaguaagcagag

SEQ ID NO: 105666 - RNA, 22 nt, Human
auauccagcagcaggugaguau

SEQ ID NO: 105667 - RNA, 18 nt, Human
auaucugugggauggaga

SEQ ID NO: 105668 - RNA, 22 nt, Human
auaucuucuuuauuuugugagg

SEQ ID NO: 105669 - RNA, 22 nt, Human
auaucuuuguaugguucagcag

SEQ ID NO: 105670 - RNA, 22 nt, Human
auaugaaaagaagucaccauug

SEQ ID NO: 105671 - RNA, 22 nt, Human
auaugaauuuggggaggacaca

SEQ ID NO: 105672 - RNA, 22 nt, Human
auaugagagaggaaagauuuua

SEQ ID NO: 105673 - RNA, 22 nt, Human
auaugagaguaaaugccgaucu

SEQ ID NO: 105674 - RNA, 22 nt, Human
auaugcaagcacauagaauacu

SEQ ID NO: 105675 - RNA, 22 nt, Human
auaugcauuaacauuguaggag

SEQ ID NO: 105676 - RNA, 22 nt, Human
auaugcuagugugcuuauacuu

SEQ ID NO: 105677 - RNA, 22 nt, Human
auaugcuauugcuguaauuuaa

SEQ ID NO: 105678 - RNA, 20 nt, Human
auaugcuuaaucucacuaca

SEQ ID NO: 105679 - RNA, 22 nt, Human
auaugcuuaugaugguuaauuu

SEQ ID NO: 105680 - RNA, 22 nt, Human
auaugcuuccccuucuuuuugg

SEQ ID NO: 105681 - RNA, 18 nt, Human
auaugcuugagcuaagga

SEQ ID NO: 105682 - RNA, 22 nt, Human
auauggaaauagcaauaugguu

SEQ ID NO: 105683 - RNA, 22 nt, Human
auauggaacuauucuguguaga

SEQ ID NO: 105684 - RNA, 22 nt, Human
auauggaaguuaccugacuuca

SEQ ID NO: 105685 - RNA, 22 nt, Human
auauggcuguugcacaucuaag

SEQ ID NO: 105686 - RNA, 22 nt, Human
augcugucccugcccuucaccc

SEQ ID NO: 105687 - RNA, 22 nt, Human
augcugugagugugccgcagag

SEQ ID NO: 105688 - RNA, 22 nt, Human
augcugugauuguagaaauauu

SEQ ID NO: 105689 - RNA, 22 nt, Human
augcuguggaaguuccugaagc

SEQ ID NO: 105690 - RNA, 22 nt, Human
augcuguggggagugaggguag

SEQ ID NO: 105691 - RNA, 22 nt, Human
augcugugucaggaauuugaua

SEQ ID NO: 105692 - RNA, 22 nt, Human
augcuguguggccaccuccaug

SEQ ID NO: 105693 - RNA, 22 nt, Human
augcuguuaagaaucucuuccu

SEQ ID NO: 105694 - RNA, 22 nt, Human
augcuuaaugaggguauauaug

SEQ ID NO: 105695 - RNA, 22 nt, Human
augcuuagguuaaauuuguaau

SEQ ID NO: 105696 - RNA, 22 nt, Human
augcuuccaaggcuaagacaag

SEQ ID NO: 105697 - RNA, 22 nt, Human
augcuuccacuguucugcucuc

SEQ ID NO: 105698 - RNA, 20 nt, Human
augcuuccagggugugucug

SEQ ID NO: 105699 - RNA, 22 nt, Human
augcuuccccucucauuucagc

SEQ ID NO: 105700 - RNA, 22 nt, Human
augcuuccuaaccauggccgug

SEQ ID NO: 105701 - RNA, 22 nt, Human
augcuuccucccuuccacucaa

SEQ ID NO: 105702 - RNA, 22 nt, Human
augcuuccucuacggccucuga

SEQ ID NO: 105703 - RNA, 22 nt, Human
augcuuccuuuuucccuuaagg

SEQ ID NO: 105704 - RNA, 22 nt, Human
augcuucuguguauguuucagg

SEQ ID NO: 105705 - RNA, 22 nt, Human
augcuugaaaguuauuucauuu

SEQ ID NO: 105706 - RNA, 22 nt, Human
augcuugcccauguuucugaag

SEQ ID NO: 105707 - RNA, 22 nt, Human
augcuugggacucccuguagca

SEQ ID NO: 105708 - RNA, 22 nt, Human
augcuuuaaacuauaaauccac

SEQ ID NO: 105709 - RNA, 22 nt, Human
augcuuuacaguuuuccaaaca

SEQ ID NO: 105710 - RNA, 22 nt, Human
augcuuuauuguuaggucaugu

SEQ ID NO: 105711 - RNA, 22 nt, Human
augcuuucucuuaguucauuga

SEQ ID NO: 105712 - RNA, 20 nt, Human
augcuuucuugugugcugcu

SEQ ID NO: 105713 - RNA, 22 nt, Human
augcuuuuaugucacaugguca

SEQ ID NO: 105714 - RNA, 19 nt, Human
auggaaaaugccagacuga

SEQ ID NO: 105715 - RNA, 22 nt, Human
auggaaaucagguucauccaag

SEQ ID NO: 105716 - RNA, 22 nt, Human
auggaaauccaagucaccguag

SEQ ID NO: 105717 - RNA, 22 nt, Human
auggaaauggagugugcuugcu

SEQ ID NO: 105718 - RNA, 21 nt, Human
auggaaauuggcaaaugcuac

SEQ ID NO: 105719 - RNA, 22 nt, Human
auggaacagauuaaagugaggg

SEQ ID NO: 105720 - RNA, 22 nt, Human
auggaacaggcucagagaugcu

SEQ ID NO: 105721 - RNA, 22 nt, Human
auggaagacuaacagaaacaug

SEQ ID NO: 105722 - RNA, 22 nt, Human
auggaagaguccccauggauga

SEQ ID NO: 105723 - RNA, 22 nt, Human
auggaagcugaaaaagacacgg

SEQ ID NO: 105724 - RNA, 22 nt, Human
auggaagggacagaagggcaag

SEQ ID NO: 105725 - RNA, 22 nt, Human
auggaagugcaacuugcucauc

SEQ ID NO: 105726 - RNA, 22 nt, Human
auggaauaauuguuucacagaa

SEQ ID NO: 105727 - RNA, 22 nt, Human
auggaauaggcugcucuuuaaa

SEQ ID NO: 105728 - RNA, 22 nt, Human
auggaauauuugacacauaggg

SEQ ID NO: 105729 - RNA, 22 nt, Human
auggaaugaaaaacacaugcaa

SEQ ID NO: 105730 - RNA, 22 nt, Human
auggaaugcgguaguaugugca

SEQ ID NO: 105731 - RNA, 22 nt, Human
auggaauggccugucauaaucu

SEQ ID NO: 105732 - RNA, 22 nt, Human
auggaaugugaacaugauggca

SEQ ID NO: 105733 - RNA, 22 nt, Human
auggaauguuuccucuuuuauu

SEQ ID NO: 105734 - RNA, 22 nt, Human
auggacagugugucuguuucca

SEQ ID NO: 105735 - RNA, 22 nt, Human
auggagacgcaagggaccuagg

SEQ ID NO: 105736 - RNA, 22 nt, Human
aucucagaaggcauuuccaaga

SEQ ID NO: 105737 - RNA, 22 nt, Human
aucucagagaaauuugaaugca

SEQ ID NO: 105738 - RNA, 22 nt, Human
aucucaggugaaacuucuaggu

SEQ ID NO: 105739 - RNA, 22 nt, Human
aucucaguucaggcuccacugu

SEQ ID NO: 105740 - RNA, 22 nt, Human
aucucauucucccgugccaugg

SEQ ID NO: 105741 - RNA, 22 nt, Human
aucuccagaauggcuuguuaau

SEQ ID NO: 105742 - RNA, 22 nt, Human
aucuccaggaagugucauuuac

SEQ ID NO: 105743 - RNA, 22 nt, Human
aucuccagggugcccuuguucu

SEQ ID NO: 105744 - RNA, 22 nt, Human
aucuccaguuagcaguacugau

SEQ ID NO: 105745 - RNA, 22 nt, Human
aucucccaaauuagccucuuga

SEQ ID NO: 105746 - RNA, 22 nt, Human
aucucccacaggcugcuacuuc

SEQ ID NO: 105747 - RNA, 21 nt, Human
aucucgggcuucucgcccagc

SEQ ID NO: 105748 - RNA, 22 nt, Human
aucucucuaugcacugaggacu

SEQ ID NO: 105749 - RNA, 22 nt, Human
aucucugggcuuugaguuuguu

SEQ ID NO: 105750 - RNA, 22 nt, Human
aucucuggguccauagaagaga

SEQ ID NO: 105751 - RNA, 22 nt, Human
aucucuguaauuacaugauauu

SEQ ID NO: 105752 - RNA, 22 nt, Human
aucucuguuagaucugcuuaaa

SEQ ID NO: 105753 - RNA, 22 nt, Human
aucucuguuuuaggagauagug

SEQ ID NO: 105754 - RNA, 21 nt, Human
aucucuucaaggcugauuuac

SEQ ID NO: 105755 - RNA, 22 nt, Human
aucucuugccagucagaauggu

SEQ ID NO: 105756 - RNA, 22 nt, Human
aucugaaaagcuuuaaugagcu

SEQ ID NO: 105757 - RNA, 19 nt, Human
aucugaaguaggugcagcu

SEQ ID NO: 105758 - RNA, 22 nt, Human
aucugaaguccuuauaaucuga

SEQ ID NO: 105759 - RNA, 22 nt, Human
aucugauucauugaaaugggug

SEQ ID NO: 105760 - RNA, 22 nt, Human
aucugcagaggacaggcgagga

SEQ ID NO: 105761 - RNA, 22 nt, Human
aucugcaguuuguuuucucuug

SEQ ID NO: 105762 - RNA, 22 nt, Human
aucugcauguaucucucugcau

SEQ ID NO: 105763 - RNA, 22 nt, Human
aucugcauguccccauggaucc

SEQ ID NO: 105764 - RNA, 22 nt, Human
aucugcauuuacauugcuugua

SEQ ID NO: 105765 - RNA, 22 nt, Human
aucugcuauguuauuucccacu

SEQ ID NO: 105766 - RNA, 22 nt, Human
aucugcuuguugcaugucuguu

SEQ ID NO: 105767 - RNA, 22 nt, Human
aucugcuuuugagaauuuacuu

SEQ ID NO: 105768 - RNA, 21 nt, Human
aucuggaagaacugguaagug

SEQ ID NO: 105769 - RNA, 22 nt, Human
aucuggagaauaaauguccaag

SEQ ID NO: 105770 - RNA, 22 nt, Human
aucuggagaugggucugucacc

SEQ ID NO: 105771 - RNA, 22 nt, Human
aucuggcucacuuagucuagga

SEQ ID NO: 105772 - RNA, 22 nt, Human
aucuggcucucucauuuacaaa

SEQ ID NO: 105773 - RNA, 22 nt, Human
aucuggcugacuuugugggaca

SEQ ID NO: 105774 - RNA, 22 nt, Human
aucugggcauggaggaaagaga

SEQ ID NO: 105775 - RNA, 22 nt, Human
aucugggccagccccaagagac

SEQ ID NO: 105776 - RNA, 22 nt, Human
aucugggcguauaggugcaagu

SEQ ID NO: 105777 - RNA, 22 nt, Human
aucugggcucgaauccuagcuc

SEQ ID NO: 105778 - RNA, 22 nt, Human
aucuggggagguaucuguaguc

SEQ ID NO: 105779 - RNA, 22 nt, Human
aucugggggagcugcucaugga

SEQ ID NO: 105780 - RNA, 22 nt, Human
aucuggggucagacagcccugg

SEQ ID NO: 105781 - RNA, 22 nt, Human
aucuggguagugcaagacauga

SEQ ID NO: 105782 - RNA, 22 nt, Human
aucugggucacaguggcaucua

SEQ ID NO: 105783 - RNA, 22 nt, Human
aucuggugacacgaggagcugg

SEQ ID NO: 105784 - RNA, 22 nt, Human
aucugguucuuuguauuuccuu

SEQ ID NO: 105785 - RNA, 22 nt, Human
aucugguuuuggcugugucccu

SEQ ID NO: 105786 - RNA, 22 nt, Human
aucuguaacugcuaucaucucc

SEQ ID NO: 105787 - RNA, 22 nt, Human
aucuguaauuuugaaugcaaau

SEQ ID NO: 105788 - RNA, 22 nt, Human
aucuguacuaauuaauuaaugu

SEQ ID NO: 105789 - RNA, 22 nt, Human
aucuguagaagauacucugaga

SEQ ID NO: 105790 - RNA, 22 nt, Human
aucugucaggagcaaggacuac

SEQ ID NO: 105791 - RNA, 22 nt, Human
aucugucuauguggcuauguau

SEQ ID NO: 105792 - RNA, 22 nt, Human
aucuguggcagugaugagucuu

SEQ ID NO: 105793 - RNA, 22 nt, Human
aucuguguaugugaccuuaucu

SEQ ID NO: 105794 - RNA, 22 nt, Human
aucuguguccuuauaagagaca

SEQ ID NO: 105795 - RNA, 22 nt, Human
augaaugaugcaaaagacacug

SEQ ID NO: 105796 - RNA, 22 nt, Human
augaaugauuugucagucacag

SEQ ID NO: 105797 - RNA, 22 nt, Human
augaaugcauacauuugucaag

SEQ ID NO: 105798 - RNA, 22 nt, Human
augaauggugaagucugauaag

SEQ ID NO: 105799 - RNA, 22 nt, Human
augaauguaaguggauuucuuu

SEQ ID NO: 105800 - RNA, 22 nt, Human
augaaugugaugauucuguuac

SEQ ID NO: 105801 - RNA, 19 nt, Human
augaauguguucuuaccuc

SEQ ID NO: 105802 - RNA, 22 nt, Human
augaauuaaggauaacuggucu

SEQ ID NO: 105803 - RNA, 22 nt, Human
augaauugaaagaagaauaucu

SEQ ID NO: 105804 - RNA, 22 nt, Human
augaauugaggaaaacagucgu

SEQ ID NO: 105805 - RNA, 22 nt, Human
augacaaaagaagacaugaggu

SEQ ID NO: 105806 - RNA, 23 nt, Human
augacaaacaggacaucuugugc

SEQ ID NO: 105807 - RNA, 22 nt, Human
augacaaacccaggauguaaca

SEQ ID NO: 105808 - RNA, 22 nt, Human
augacaaaggcugaaagggaaa

SEQ ID NO: 105809 - RNA, 22 nt, Human
augacaacacauggugcugaau

SEQ ID NO: 105810 - RNA, 22 nt, Human
augacaaggguugacacauguc

SEQ ID NO: 105811 - RNA, 22 nt, Human
augacaauacuucaauaagcug

SEQ ID NO: 105812 - RNA, 22 nt, Human
augacacaagagcagaagccau

SEQ ID NO: 105813 - RNA, 22 nt, Human
augacacaagcagaggcucuaa

SEQ ID NO: 105814 - RNA, 22 nt, Human
augacacauaaaacaaggacug

SEQ ID NO: 105815 - RNA, 22 nt, Human
augacacccaaaaccagugcag

SEQ ID NO: 105816 - RNA, 22 nt, Human
augacacucgaaaaauugaugc

SEQ ID NO: 105817 - RNA, 22 nt, Human
augacagaggagugcaggugau

SEQ ID NO: 105818 - RNA, 22 nt, Human
augacagaggauuguaaagagg

SEQ ID NO: 105819 - RNA, 19 nt, Human
augacagaguugauaagug

SEQ ID NO: 105820 - RNA, 21 nt, Human
augacagaugcugcagaucgu

SEQ ID NO: 105821 - RNA, 22 nt, Human
augacaggaggcagcugggcag

SEQ ID NO: 105822 - RNA, 22 nt, Human
augacaguacuggugacaauac

SEQ ID NO: 105823 - RNA, 22 nt, Human
augacaguucuuuagagaugua

SEQ ID NO: 105824 - RNA, 22 nt, Human
augacaugaggcaucuuuggag

SEQ ID NO: 105825 - RNA, 22 nt, Human
augaccacauuccagcugucca

SEQ ID NO: 105826 - RNA, 22 nt, Human
augaccagccgagauaaacaga

SEQ ID NO: 105827 - RNA, 22 nt, Human
augacccuuacugcaucauaca

SEQ ID NO: 105828 - RNA, 22 nt, Human
augacucaaaauuauuguuuug

SEQ ID NO: 105829 - RNA, 22 nt, Human
augacuucguuuucucucugca

SEQ ID NO: 105830 - RNA, 22 nt, Human
augagaaauuuauuacaagcua

SEQ ID NO: 105831 - RNA, 22 nt, Human
augagaauaugauuuacuauug

SEQ ID NO: 105832 - RNA, 22 nt, Human
augagacuaccuguaauguggc

SEQ ID NO: 105833 - RNA, 22 nt, Human
augagacuugagggccucaagu

SEQ ID NO: 105834 - RNA, 22 nt, Human
augagagccaccaugcuucugu

SEQ ID NO: 105835 - RNA, 22 nt, Human
augagauagacuaugucauaca

SEQ ID NO: 105836 - RNA, 22 nt, Human
augagauguucaggagucugag

SEQ ID NO: 105837 - RNA, 22 nt, Human
augagauuuuauagugucuuga

SEQ ID NO: 105838 - RNA, 22 nt, Human
augagcagauauggauuuuaga

SEQ ID NO: 105839 - RNA, 22 nt, Human
augagcagguuuaagagaggcc

SEQ ID NO: 105840 - RNA, 22 nt, Human
augagcaguagguucauggcug

SEQ ID NO: 105841 - RNA, 22 nt, Human
augagcaugugacucaaaccaa

SEQ ID NO: 105842 - RNA, 22 nt, Human
augagcccuggaggcauuuuuu

SEQ ID NO: 105843 - RNA, 22 nt, Human
augagcuaagcagaaagcacac

SEQ ID NO: 105844 - RNA, 22 nt, Human
augagcucaggugugcaaaaua

SEQ ID NO: 105845 - RNA, 19 nt, Human
augagcuggcauuucaggu

SEQ ID NO: 105846 - RNA, 22 nt, Human
augagcugggccauccagugau

SEQ ID NO: 105847 - RNA, 22 nt, Human
augagcuguaagguggcuuccu

SEQ ID NO: 105848 - RNA, 22 nt, Human
augagcugugggauuccagagg

SEQ ID NO: 105849 - RNA, 22 nt, Human
augaggaacagacuugcuggau

SEQ ID NO: 105850 - RNA, 19 nt, Human
augaggaacugaggcucag

SEQ ID NO: 105851 - RNA, 22 nt, Human
augaggaggccaguaagagccu

SEQ ID NO: 105852 - RNA, 22 nt, Human
augaggaggucaggccuuacaa

SEQ ID NO: 105853 - RNA, 22 nt, Human
auggagagugaaagucucucua

SEQ ID NO: 105854 - RNA, 22 nt, Human
auggagaguucacuucuaaguu

SEQ ID NO: 105855 - RNA, 21 nt, Human
auggagccuaagaguggaggu

SEQ ID NO: 105856 - RNA, 23 nt, Human
auggagcugguacuagcuaccuc

SEQ ID NO: 105857 - RNA, 22 nt, Human
auggagcuguagggagcagugg

SEQ ID NO: 105858 - RNA, 17 nt, Human
auggaggcagacagguc

SEQ ID NO: 105859 - RNA, 18 nt, Human
auggaggcagagagcuga

SEQ ID NO: 105860 - RNA, 22 nt, Human
auggagggugguaagacagaga

SEQ ID NO: 105861 - RNA, 22 nt, Human
auggagggugucagagagcgaa

SEQ ID NO: 105862 - RNA, 21 nt, Human
auggagucaggggaaugggcc

SEQ ID NO: 105863 - RNA, 22 nt, Human
auggagucuacaaaguguugga

SEQ ID NO: 105864 - RNA, 20 nt, Human
auggagugaagagugaaagc

SEQ ID NO: 105865 - RNA, 22 nt, Human
auggaguggggacugcagugga

SEQ ID NO: 105866 - RNA, 22 nt, Human
auggaguucuuuaaauucacag

SEQ ID NO: 105867 - RNA, 22 nt, Human
auggauaaucaugaacuuugag

SEQ ID NO: 105868 - RNA, 22 nt, Human
auggauaauggugauaguugca

SEQ ID NO: 105869 - RNA, 22 nt, Human
auggaugcuucuuucuaguuuu

SEQ ID NO: 105870 - RNA, 21 nt, Human
auggauuuaaacaggccacaa

SEQ ID NO: 105871 - RNA, 22 nt, Human
auggcacaggagaggagggcug

SEQ ID NO: 105872 - RNA, 22 nt, Human
auggcacagugggaaaugaccu

SEQ ID NO: 105873 - RNA, 22 nt, Human
auggcagaaaggcaugugggcc

SEQ ID NO: 105874 - RNA, 22 nt, Human
auggcagaauccauaguaggug

SEQ ID NO: 105875 - RNA, 22 nt, Human
auggcagaauuaggauuucaag

SEQ ID NO: 105876 - RNA, 22 nt, Human
auggcagaccuccuggccacaa

SEQ ID NO: 105877 - RNA, 22 nt, Human
auggcagacgaggcagcagggg

SEQ ID NO: 105878 - RNA, 22 nt, Human
auggcagagaaagcgagccaca

SEQ ID NO: 105879 - RNA, 22 nt, Human
auggcagcauaguggcaaguua

SEQ ID NO: 105880 - RNA, 22 nt, Human
auggcagccugaacacuuccug

SEQ ID NO: 105881 - RNA, 22 nt, Human
auggcagcuggcuugggcaccu

SEQ ID NO: 105882 - RNA, 22 nt, Human
auggcagcuuugaauuucuuga

SEQ ID NO: 105883 - RNA, 22 nt, Human
auggcaggauacccaguccggc

SEQ ID NO: 105884 - RNA, 22 nt, Human
auggcaggcccagguguucauu

SEQ ID NO: 105885 - RNA, 22 nt, Human
auggcagggacuguggcccuug

SEQ ID NO: 105886 - RNA, 22 nt, Human
auggcaguauuucugaaaggcu

SEQ ID NO: 105887 - RNA, 20 nt, Human
auggcaguccguguucaggg

SEQ ID NO: 105888 - RNA, 22 nt, Human
auggcaguguuucaguuuuugg

SEQ ID NO: 105889 - RNA, 22 nt, Human
auggcauucacauuuccagaga

SEQ ID NO: 105890 - RNA, 22 nt, Human
auggcauuuauguugacaaugg

SEQ ID NO: 105891 - RNA, 22 nt, Human
auggcauuugaccgcuuugugg

SEQ ID NO: 105892 - RNA, 22 nt, Human
auggccaaagccacagcagagg

SEQ ID NO: 105893 - RNA, 22 nt, Human
auggccaaauaacagcuugcau

SEQ ID NO: 105894 - RNA, 22 nt, Human
auggccaagaaauugccgacug

SEQ ID NO: 105895 - RNA, 22 nt, Human
auggccagagaaggcaggguca

SEQ ID NO: 105896 - RNA, 22 nt, Human
auggccagagagagcacaccug

SEQ ID NO: 105897 - RNA, 22 nt, Human
auggccagagaggccagccugg

SEQ ID NO: 105898 - RNA, 22 nt, Human
auggccagucugacuaguuucc

SEQ ID NO: 105899 - RNA, 22 nt, Human
auggccaguuagaaaucaaaaa

SEQ ID NO: 105900 - RNA, 22 nt, Human
auggcccaggcaggcugguacu

SEQ ID NO: 105901 - RNA, 22 nt, Human
auggcccuaucaccuuugcuuc

SEQ ID NO: 105902 - RNA, 22 nt, Human
auggcccucuccuuaggucagc

SEQ ID NO: 105903 - RNA, 22 nt, Human
auggcccuggaaagagcuugag

SEQ ID NO: 105904 - RNA, 20 nt, Human
ggcugcugugggcagagagg

SEQ ID NO: 105905 - RNA, 22 nt, Human
ggcugcuugcuguuucuuggau

SEQ ID NO: 105906 - RNA, 22 nt, Human
ggcugcuuuaucggcugcugaa

SEQ ID NO: 105907 - RNA, 22 nt, Human
ggcuggaaaggauauuuuaggu

SEQ ID NO: 105908 - RNA, 22 nt, Human
ggcuggacauagacauagccau

SEQ ID NO: 105909 - RNA, 22 nt, Human
ggcuggacucugggccucucca

SEQ ID NO: 105910 - RNA, 22 nt, Human
ggcuggacugccucccagaguc

SEQ ID NO: 105911 - RNA, 22 nt, Human
ggcuggauaccaggagacaggg

SEQ ID NO: 105912 - RNA, 22 nt, Human
ggcuggcaagucagugcugaug

SEQ ID NO: 105913 - RNA, 22 nt, Human
ggcuggcacaaagcuccaaauc

SEQ ID NO: 105914 - RNA, 23 nt, Human
ggcuggcccggggcugcuccuga

SEQ ID NO: 105915 - RNA, 22 nt, Human
ucaggauguuaauauagcauua

SEQ ID NO: 105916 - RNA, 22 nt, Human
ucaggcaaucugacagcuggag

SEQ ID NO: 105917 - RNA, 22 nt, Human
ucaggcacuggcugagugaugg

SEQ ID NO: 105918 - RNA, 22 nt, Human
ucaggcagaaaaaucacuaauu

SEQ ID NO: 105919 - RNA, 22 nt, Human
ucaggcagaccaccgugggcag

SEQ ID NO: 105920 - RNA, 22 nt, Human
ucaggcagagcuguggagcucu

SEQ ID NO: 105921 - RNA, 22 nt, Human
ucaggcagaguggaagcugcaa

SEQ ID NO: 105922 - RNA, 22 nt, Human
ucaggcaggcagagggcaaaug

SEQ ID NO: 105923 - RNA, 22 nt, Human
ucaggcaggcucagaggaaaac

SEQ ID NO: 105924 - RNA, 21 nt, Human
ucaggcagugcaaauacaugg

SEQ ID NO: 105925 - RNA, 19 nt, Human
ucaggcaguuauucacaaa

SEQ ID NO: 105926 - RNA, 22 nt, Human
ucaggccaaagaaacagcauga

SEQ ID NO: 105927 - RNA, 22 nt, Human
ucaggccagcaccaucccuauc

SEQ ID NO: 105928 - RNA, 22 nt, Human
ucaggcccuuugcugcugcccc

SEQ ID NO: 105929 - RNA, 22 nt, Human
ucaggccuagggagaaaauuca

SEQ ID NO: 105930 - RNA, 22 nt, Human
ucaggccuagggagccacacca

SEQ ID NO: 105931 - RNA, 22 nt, Human
ucaggccuccagguuaccauuu

SEQ ID NO: 105932 - RNA, 22 nt, Human
ucaggccugagaaaaauccuuu

SEQ ID NO: 105933 - RNA, 22 nt, Human
ucaggccugcaaaugaauggua

SEQ ID NO: 105934 - RNA, 22 nt, Human
ucaggccugcagugccaaccca

SEQ ID NO: 105935 - RNA, 22 nt, Human
ucaggccugugcuggaggagau

SEQ ID NO: 105936 - RNA, 22 nt, Human
ucaggccuucagaccuggcccg

SEQ ID NO: 105937 - RNA, 22 nt, Human
ucaggcgaggcuuaauccaagg

SEQ ID NO: 105938 - RNA, 22 nt, Human
ucaggcuaacccuaggcagaag

SEQ ID NO: 105939 - RNA, 22 nt, Human
ucaggcucaaagggccggauga

SEQ ID NO: 105940 - RNA, 22 nt, Human
ucaggcucugccaccuagauua

SEQ ID NO: 105941 - RNA, 22 nt, Human
ucaggcugaaggaggccuaucu

SEQ ID NO: 105942 - RNA, 22 nt, Human
ucaggcugaccagguuuugcuc

SEQ ID NO: 105943 - RNA, 22 nt, Human
ucaggcugauuucuuuugaggg

SEQ ID NO: 105944 - RNA, 22 nt, Human
ucaggcugcagcugucagcagc

SEQ ID NO: 105945 - RNA, 22 nt, Human
ucaggcugcccguucagggcuc

SEQ ID NO: 105946 - RNA, 22 nt, Human
ucaggcugccuaucagacugug

SEQ ID NO: 105947 - RNA, 22 nt, Human
ucaggcugcuuucaugcuuaga

SEQ ID NO: 105948 - RNA, 22 nt, Human
ucaggcuggagugcaguggcgc

SEQ ID NO: 105949 - RNA, 22 nt, Human
ucaggcugggagacaaucacug

SEQ ID NO: 105950 - RNA, 22 nt, Human
ucaggcugggcuccucucccca

SEQ ID NO: 105951 - RNA, 20 nt, Human
ucaggcuggugggcuuuccc

SEQ ID NO: 105952 - RNA, 22 nt, Human
ucaggcugguggucagauggcu

SEQ ID NO: 105953 - RNA, 17 nt, Human
ucaggcugugccuggua

SEQ ID NO: 105954 - RNA, 22 nt, Human
ucaggcuguggcuuugaccgca

SEQ ID NO: 105955 - RNA, 22 nt, Human
ucaggcuuauagguagugguua

SEQ ID NO: 105956 - RNA, 22 nt, Human
ucaggcuugaggucuguaugug

SEQ ID NO: 105957 - RNA, 22 nt, Human
ucaggcuugcgauggaagucac

SEQ ID NO: 105958 - RNA, 18 nt, Human
ucaggcuuugagagaauc

SEQ ID NO: 105959 - RNA, 22 nt, Human
ucagggaaaccuaaggaagcca

SEQ ID NO: 105960 - RNA, 22 nt, Human
ucagggaacaauguuauggcuu

SEQ ID NO: 105961 - RNA, 22 nt, Human
ucagggaaccucuccuguuucu

SEQ ID NO: 105962 - RNA, 22 nt, Human
ucagggaacuacuucucccuau

SEQ ID NO: 105963 - RNA, 22 nt, Human
ucagggaagaaaugggacuuua

SEQ ID NO: 105964 - RNA, 22 nt, Human
ucagggaagacuucuuagagga

SEQ ID NO: 105965 - RNA, 22 nt, Human
ucagggaauaaguagaugagug

SEQ ID NO: 105966 - RNA, 22 nt, Human
ucagggaaugugauacaggaag

SEQ ID NO: 105967 - RNA, 22 nt, Human
ucagggacgugagcucagaguc

SEQ ID NO: 105968 - RNA, 22 nt, Human
ucagggacuuacaaaccagaag

SEQ ID NO: 105969 - RNA, 22 nt, Human
ucagggaggugucugccagaga

SEQ ID NO: 105970 - RNA, 22 nt, Human
ucagggauugcaaaauucaucc

SEQ ID NO: 105971 - RNA, 22 nt, Human
ucagggcaagucucagaagguu

SEQ ID NO: 105972 - RNA, 22 nt, Human
ucagggcagccuaaggcaccuc

SEQ ID NO: 105973 - RNA, 22 nt, Human
ucagggcagguuaacuugggug

SEQ ID NO: 105974 - RNA, 22 nt, Human
ucagggcauucaagaggccugg

SEQ ID NO: 105975 - RNA, 22 nt, Human
ucagggccgccggggaucucgc

SEQ ID NO: 105976 - RNA, 22 nt, Human
ucagggccuuugcaguuguuuu

SEQ ID NO: 105977 - RNA, 22 nt, Human
ucagggcugcauacaggagaua

SEQ ID NO: 105978 - RNA, 22 nt, Human
ucagggcugugguuccuuuucu

SEQ ID NO: 105979 - RNA, 22 nt, Human
ucagggcuuuggcuuuuacucu

SEQ ID NO: 105980 - RNA, 22 nt, Human
ucaggggaaaucucucagcgaa

SEQ ID NO: 105981 - RNA, 22 nt, Human
ucaggggacagccagcuggagg

SEQ ID NO: 105982 - RNA, 22 nt, Human
ucaggggacuuaggagagaagu

SEQ ID NO: 105983 - RNA, 22 nt, Human
ucaggggcugugcauuucccag

SEQ ID NO: 105984 - RNA, 22 nt, Human
ucagggggaggagacugccagu

SEQ ID NO: 105985 - RNA, 19 nt, Human
ucagggggcugauaggagg

SEQ ID NO: 105986 - RNA, 22 nt, Human
ucaggguauguucuagaucuga

SEQ ID NO: 105987 - RNA, 22 nt, Human
ucagggucaggacccagcuguu

SEQ ID NO: 105988 - RNA, 22 nt, Human
ucaggguugcugugaucagucc

SEQ ID NO: 105989 - RNA, 20 nt, Human
ucaggguuucccauucuugg

SEQ ID NO: 105990 - RNA, 22 nt, Human
ucaggucaggaaaauaagauug

SEQ ID NO: 105991 - RNA, 22 nt, Human
ucaggucccacugcuaguaagu

SEQ ID NO: 105992 - RNA, 22 nt, Human
ucagguccuuuugguguauauu

SEQ ID NO: 105993 - RNA, 22 nt, Human
ucaggucugaugccucauccau

SEQ ID NO: 105994 - RNA, 22 nt, Human
ucagguggagaccuccuuggcc

SEQ ID NO: 105995 - RNA, 21 nt, Human
ucagguggcagaguguuuaug

SEQ ID NO: 105996 - RNA, 22 nt, Human
ucaggugggaguagaaugcuag

SEQ ID NO: 105997 - RNA, 22 nt, Human
ucaggugggcguuccggugcgg

SEQ ID NO: 105998 - RNA, 22 nt, Human
ucaggugggucuacaauuaguu

SEQ ID NO: 105999 - RNA, 22 nt, Human
ucaggugucaagcagggagcug

SEQ ID NO: 106000 - RNA, 22 nt, Human
ucaggugucuugugggauuuua

SEQ ID NO: 106001 - RNA, 16 nt, Human
ucaggugugacuuuuu

SEQ ID NO: 106002 - RNA, 22 nt, Human
ucagguguggaccgaggucaga

SEQ ID NO: 106003 - RNA, 22 nt, Human
ucaggugugggcagagaaacca

SEQ ID NO: 106004 - RNA, 22 nt, Human
ucagguguguuguauuuuacca

SEQ ID NO: 106005 - RNA, 22 nt, Human
ucagguguuuaaggauagugau

SEQ ID NO: 106006 - RNA, 18 nt, Human
ucagguguuuucuguaua

SEQ ID NO: 106007 - RNA, 22 nt, Human
ucaguaaaguucuuucuugcug

SEQ ID NO: 106008 - RNA, 22 nt, Human
ucaguaaaugccuuucugugaa

SEQ ID NO: 106009 - RNA, 22 nt, Human
ucaguaaaugguugcuguuauu

SEQ ID NO: 106010 - RNA, 22 nt, Human
ucaguaacuuggccgaggucau

SEQ ID NO: 106011 - RNA, 22 nt, Human
ucaguacaaaggugcucucaag

SEQ ID NO: 106012 - RNA, 22 nt, Human
ucaguagucuaggauuucaccu

SEQ ID NO: 106013 - RNA, 22 nt, Human
ucauuucaaugauacuacuaag

SEQ ID NO: 106014 - RNA, 22 nt, Human
ucauuucaguggcacagaagau

SEQ ID NO: 106015 - RNA, 23 nt, Human
ucauuucauccagccuugagagu

SEQ ID NO: 106016 - RNA, 22 nt, Human
ucauuucaugucucaggcacug

SEQ ID NO: 106017 - RNA, 17 nt, Human
ucauuucuaggcacucc

SEQ ID NO: 106018 - RNA, 22 nt, Human
ucauuucuauugcuacugucug

SEQ ID NO: 106019 - RNA, 22 nt, Human
ucauuucucccggccaaaaacu

SEQ ID NO: 106020 - RNA, 22 nt, Human
ucauuugucuggcacagggaau

SEQ ID NO: 106021 - RNA, 22 nt, Human
ucauuuguucaucugcucuucu

SEQ ID NO: 106022 - RNA, 22 nt, Human
ucauuuucaaguuugaacagga

SEQ ID NO: 106023 - RNA, 22 nt, Human
ucauuuuggccaugauacagac

SEQ ID NO: 106024 - RNA, 18 nt, Human
uccaaaaucauguauuuu

SEQ ID NO: 106025 - RNA, 22 nt, Human
uccaaacacccuccaugcugca

SEQ ID NO: 106026 - RNA, 23 nt, Human
uccaaacucaagacauuaauaag

SEQ ID NO: 106027 - RNA, 19 nt, Human
uccaaagaaguucacauuu

SEQ ID NO: 106028 - RNA, 22 nt, Human
uccaaagccgacugacaucuga

SEQ ID NO: 106029 - RNA, 18 nt, Human
uccaaagcugcugguuuu

SEQ ID NO: 106030 - RNA, 21 nt, Human
uccaaaggagacugagugugu

SEQ ID NO: 106031 - RNA, 22 nt, Human
uccaaaggcaaaacuguggugu

SEQ ID NO: 106032 - RNA, 22 nt, Human
uccaaaggcccuaauaagcuug

SEQ ID NO: 106033 - RNA, 22 nt, Human
uccaaauagcuggaugauggug

SEQ ID NO: 106034 - RNA, 22 nt, Human
uccaaauauagaugaguuguaa

SEQ ID NO: 106035 - RNA, 22 nt, Human
uccaaauaucuuggugguuagg

SEQ ID NO: 106036 - RNA, 22 nt, Human
uccaaauauucaucuacuucug

SEQ ID NO: 106037 - RNA, 22 nt, Human
gggcuucucagagaggcuuuag

SEQ ID NO: 106038 - RNA, 22 nt, Human
gggcuucucccuaaggacucug

SEQ ID NO: 106039 - RNA, 22 nt, Human
gggcuucucucaggggcaugag

SEQ ID NO: 106040 - RNA, 22 nt, Human
gggcuucucuuuagugagcuga

SEQ ID NO: 106041 - RNA, 22 nt, Human
gggcuucugcucuuuuggugcu

SEQ ID NO: 106042 - RNA, 22 nt, Human
gggcuucuggucauuccucauc

SEQ ID NO: 106043 - RNA, 22 nt, Human
gggcuucuugagcugccggccc

SEQ ID NO: 106044 - RNA, 22 nt, Human
gggcuucuugccauggggacgg

SEQ ID NO: 106045 - RNA, 22 nt, Human
gggcuugcuaagaagagcgcau

SEQ ID NO: 106046 - RNA, 22 nt, Human
gggcuuggcacaugggcucagc

SEQ ID NO: 106047 - RNA, 22 nt, Human
gggcuuggccccagaagagcua

SEQ ID NO: 106048 - RNA, 22 nt, Human
gggcuuggcucauaaguggaug

SEQ ID NO: 106049 - RNA, 19 nt, Human
gggcuuggggcugaagccu

SEQ ID NO: 106050 - RNA, 22 nt, Human
gggcuuggguauugugagaggu

SEQ ID NO: 106051 - RNA, 22 nt, Human
gggcuuuagauugcagaggauu

SEQ ID NO: 106052 - RNA, 22 nt, Human
gggcuuuaggggccagugacca

SEQ ID NO: 106053 - RNA, 22 nt, Human
gggcuuuaugagauugagaucu

SEQ ID NO: 106054 - RNA, 21 nt, Human
gggcuuuuuauuuagcacugu

SEQ ID NO: 106055 - RNA, 18 nt, Human
ggggaaaagccagguguc

SEQ ID NO: 106056 - RNA, 22 nt, Human
ggggaaacauguuguucagacc

SEQ ID NO: 106057 - RNA, 22 nt, Human
ggggaacaccgggcagaggcgc

SEQ ID NO: 106058 - RNA, 20 nt, Human
ggggaagaaaaggaugugau

SEQ ID NO: 106059 - RNA, 22 nt, Human
ggggaagaaccgggauucccau

SEQ ID NO: 106060 - RNA, 22 nt, Human
ggggaagauuuuuaauuaguaa

SEQ ID NO: 106061 - RNA, 22 nt, Human
ggggaaggauugaguugaccca

SEQ ID NO: 106062 - RNA, 23 nt, Human
ggggaaguggcagugagugaggc

SEQ ID NO: 106063 - RNA, 23 nt, Human
ggggacaguucccacuggggucu

SEQ ID NO: 106064 - RNA, 22 nt, Human
ggggaccuggccacccauccuu

SEQ ID NO: 106065 - RNA, 22 nt, Human
ggggaccuucccagagcaguug

SEQ ID NO: 106066 - RNA, 22 nt, Human
ggggacucugcuucugggauca

SEQ ID NO: 106067 - RNA, 22 nt, Human
ggggagaauuacauggcgugga

SEQ ID NO: 106068 - RNA, 22 nt, Human
ggggagaguccuuuccaguucc

SEQ ID NO: 106069 - RNA, 22 nt, Human
ggggagcaauaguugaggugug

SEQ ID NO: 106070 - RNA, 22 nt, Human
ggggagcaauugcccccuuaga

SEQ ID NO: 106071 - RNA, 22 nt, Human
ggggagcagaagcagcaacaac

SEQ ID NO: 106072 - RNA, 22 nt, Human
ggggagcaggcugggcugucug

SEQ ID NO: 106073 - RNA, 22 nt, Human
ggggagcugggaggugaguuac

SEQ ID NO: 106074 - RNA, 22 nt, Human
ggggagcuuagggucucugaau

SEQ ID NO: 106075 - RNA, 22 nt, Human
ggggaggaagcucucaguucca

SEQ ID NO: 106076 - RNA, 22 nt, Human
ggggaggcugaugugggcaaag

SEQ ID NO: 106077 - RNA, 21 nt, Human
ggggaugcgaccacaggcucc

SEQ ID NO: 106078 - RNA, 22 nt, Human
ggggcaaagggagagucccuac

SEQ ID NO: 106079 - RNA, 22 nt, Human
ggggcacuuccaggcugaggcu

SEQ ID NO: 106080 - RNA, 22 nt, Human
ggggcagaaagcccacagagug

SEQ ID NO: 106081 - RNA, 22 nt, Human
ggggcagagagaaggaagcuug

SEQ ID NO: 106082 - RNA, 22 nt, Human
ggggcagagcauagcuccaauu

SEQ ID NO: 106083 - RNA, 21 nt, Human
ggggcagagcuaggcccugca

SEQ ID NO: 106084 - RNA, 22 nt, Human
ggggcagagucuggacuguugu

SEQ ID NO: 106085 - RNA, 20 nt, Human
ggggcagguuuuuauggcua

SEQ ID NO: 106086 - RNA, 20 nt, Human
ggggcaguggcucaugccug

SEQ ID NO: 106087 - RNA, 22 nt, Human
ggggccagagaggacccaggug

SEQ ID NO: 106088 - RNA, 20 nt, Human
ggggcccaagcccucuugcc

SEQ ID NO: 106089 - RNA, 22 nt, Human
ggggcccagggcagcagugcag

SEQ ID NO: 106090 - RNA, 22 nt, Human
ggggccgaccgcgguucaggcc

SEQ ID NO: 106091 - RNA, 22 nt, Human
ggggccuauuuguucaacuucc

SEQ ID NO: 106092 - RNA, 22 nt, Human
ggggccuuggaucugugccccg

SEQ ID NO: 106093 - RNA, 22 nt, Human
ggggcgcucggagggauccccu

SEQ ID NO: 106094 - RNA, 22 nt, Human
ggggcuaacuuucugaggguag

SEQ ID NO: 106095 - RNA, 22 nt, Human
ggggcuccagucuucacauuuu

SEQ ID NO: 106096 - RNA, 22 nt, Human
ggggcugagaauucagucucgg

SEQ ID NO: 106097 - RNA, 22 nt, Human
ggggcugauggaacucaggccu

SEQ ID NO: 106098 - RNA, 22 nt, Human
ggggcugcuucaccuuuuuacg

SEQ ID NO: 106099 - RNA, 22 nt, Human
ggggcuuuugcacgugggaggc

SEQ ID NO: 106100 - RNA, 22 nt, Human
gggggaaagcucaggagccugu

SEQ ID NO: 106101 - RNA, 22 nt, Human
gggggaaaguggagguucguga

SEQ ID NO: 106102 - RNA, 22 nt, Human
gggggacaggaugaauaucugu

SEQ ID NO: 106103 - RNA, 23 nt, Human
gggggagcuggacuccuagaucc

SEQ ID NO: 106104 - RNA, 22 nt, Human
gggggccuuguuaguggaugga

SEQ ID NO: 106105 - RNA, 22 nt, Human
gggggcgcacagucaccacaaa

SEQ ID NO: 106106 - RNA, 22 nt, Human
gggggcgggagacagcagugac

SEQ ID NO: 106107 - RNA, 22 nt, Human
gggggcuagagagaugaaauau

SEQ ID NO: 106108 - RNA, 22 nt, Human
gggggcucugacucccucagcu

SEQ ID NO: 106109 - RNA, 22 nt, Human
gggggcugaggcuguucugagg

SEQ ID NO: 106110 - RNA, 22 nt, Human
gggggcuggaauauccaucaac

SEQ ID NO: 106111 - RNA, 22 nt, Human
gggggcuguccugugcauugua

SEQ ID NO: 106112 - RNA, 22 nt, Human
gggggggucuucagaccucaga

SEQ ID NO: 106113 - RNA, 22 nt, Human
ggggggugacaaguagagguug

SEQ ID NO: 106114 - RNA, 22 nt, Human
gggggugguucuaaguccuaua

SEQ ID NO: 106115 - RNA, 21 nt, Human
ggggucaagugaaugguguug

SEQ ID NO: 106116 - RNA, 22 nt, Human
gggguccucggagccugggucu

SEQ ID NO: 106117 - RNA, 22 nt, Human
ggggucugggcuuagcuggaau

SEQ ID NO: 106118 - RNA, 22 nt, Human
gggguggagaugguggcccuuu

SEQ ID NO: 106119 - RNA, 22 nt, Human
gggguggauuccuacaggucca

SEQ ID NO: 106120 - RNA, 22 nt, Human
gggguggccuguaggcagcaug

SEQ ID NO: 106121 - RNA, 22 nt, Human
gggguggcuggcaccuccuggu

SEQ ID NO: 106122 - RNA, 21 nt, Human
ggucaguggcuuucuugcacc

SEQ ID NO: 106123 - RNA, 22 nt, Human
ggucaguguauguauugauaag

SEQ ID NO: 106124 - RNA, 22 nt, Human
ggucauacaaggcacuggugau

SEQ ID NO: 106125 - RNA, 22 nt, Human
ggucauagagcuggaaauuggc

SEQ ID NO: 106126 - RNA, 22 nt, Human
ggucaucugccuccaaagcacu

SEQ ID NO: 106127 - RNA, 20 nt, Human
ggucaucuuccaaucccagg

SEQ ID NO: 106128 - RNA, 22 nt, Human
ggucaugagggagcagugcagg

SEQ ID NO: 106129 - RNA, 22 nt, Human
ggucauuguucuuuucugugau

SEQ ID NO: 106130 - RNA, 22 nt, Human
ggucauuuucacuuucaaguua

SEQ ID NO: 106131 - RNA, 19 nt, Human
gguccagacuucagacuag

SEQ ID NO: 106132 - RNA, 22 nt, Human
gguccagcacaacacuggcaug

SEQ ID NO: 106133 - RNA, 22 nt, Human
gguccagccaggugcucaugcc

SEQ ID NO: 106134 - RNA, 23 nt, Human
gguccaggaaaggcagcagcacc

SEQ ID NO: 106135 - RNA, 22 nt, Human
gguccaguccugcucaccacuu

SEQ ID NO: 106136 - RNA, 22 nt, Human
gguccaucucuugagcccacau

SEQ ID NO: 106137 - RNA, 22 nt, Human
ggucccaagugcuuuuccugca

SEQ ID NO: 106138 - RNA, 22 nt, Human
ggucccagaauugguuagcaca

SEQ ID NO: 106139 - RNA, 22 nt, Human
ggucccaggauugguugcgcag

SEQ ID NO: 106140 - RNA, 23 nt, Human
ggucccaguggagaggccucacc

SEQ ID NO: 106141 - RNA, 22 nt, Human
gguccccagcaguggcugcuuc

SEQ ID NO: 106142 - RNA, 22 nt, Human
ggucccuagagugggaugacuu

SEQ ID NO: 106143 - RNA, 22 nt, Human
ggucccugccugaggcuggccu

SEQ ID NO: 106144 - RNA, 22 nt, Human
ggucccuggggaacuaggcugu

SEQ ID NO: 106145 - RNA, 22 nt, Human
gguccucaaucccaacaaggca

SEQ ID NO: 106146 - RNA, 22 nt, Human
gguccucuccagcgccacagug

SEQ ID NO: 106147 - RNA, 22 nt, Human
gguccugaggggagcugaaggu

SEQ ID NO: 106148 - RNA, 22 nt, Human
gguccugcauugccagcaagcu

SEQ ID NO: 106149 - RNA, 22 nt, Human
gguccuggaugagacagguagu

SEQ ID NO: 106150 - RNA, 22 nt, Human
gguccuggcagucuuugguugu

SEQ ID NO: 106151 - RNA, 22 nt, Human
gguccugggaagaugcucauga

SEQ ID NO: 106152 - RNA, 20 nt, Human
gguccuguacucucauugaa

SEQ ID NO: 106153 - RNA, 22 nt, Human
gguccuucaguagguuccagac

SEQ ID NO: 106154 - RNA, 20 nt, Human
gguccuugucacaaggagag

SEQ ID NO: 106155 - RNA, 22 nt, Human
gguccuuugaaagggguguguc

SEQ ID NO: 106156 - RNA, 22 nt, Human
ggucgcacccgggcgcugcugg

SEQ ID NO: 106157 - RNA, 22 nt, Human
ggucuagaguggggccuggaaa

SEQ ID NO: 106158 - RNA, 22 nt, Human
ggucuagaucaagaacagaacu

SEQ ID NO: 106159 - RNA, 22 nt, Human
ggucucagcaguugcuuugacu

SEQ ID NO: 106160 - RNA, 22 nt, Human
ggucucagcccucgccagcagc

SEQ ID NO: 106161 - RNA, 22 nt, Human
ggucuccagcugggacccugca

SEQ ID NO: 106162 - RNA, 22 nt, Human
ggucucgagccaggcagcugca

SEQ ID NO: 106163 - RNA, 22 nt, Human
ggucugaaaugugacuuuugaa

SEQ ID NO: 106164 - RNA, 22 nt, Human
ggucugaaucacugugccuauc

SEQ ID NO: 106165 - RNA, 22 nt, Human
ggucugagcuugagcccaugcu

SEQ ID NO: 106166 - RNA, 22 nt, Human
ggucugaggcuccaaggaggug

SEQ ID NO: 106167 - RNA, 22 nt, Human
ggucugccacaagauuuuugag

SEQ ID NO: 106168 - RNA, 22 nt, Human
ggucugcuuuccuugccacugu

SEQ ID NO: 106169 - RNA, 22 nt, Human
ggucuggaauggaguaggggug

SEQ ID NO: 106170 - RNA, 22 nt, Human
ggucuggagcuuggcuaaggga

SEQ ID NO: 106171 - RNA, 22 nt, Human
ggucuggaguagaugagucaug

SEQ ID NO: 106172 - RNA, 22 nt, Human
ggucuggauuuuaucuacugua

SEQ ID NO: 106173 - RNA, 22 nt, Human
ggucuggcaggugaggacucag

SEQ ID NO: 106174 - RNA, 22 nt, Human
ggucuucucuaugagcuggucu

SEQ ID NO: 106175 - RNA, 22 nt, Human
ggucuucuggaaagcagacugu

SEQ ID NO: 106176 - RNA, 22 nt, Human
ggucuugaaggacauccagucc

SEQ ID NO: 106177 - RNA, 22 nt, Human
ggucuuguuuauauaagguggu

SEQ ID NO: 106178 - RNA, 22 nt, Human
ggucuuuucacagugguuugag

SEQ ID NO: 106179 - RNA, 22 nt, Human
ggugaaauauuuuugauauguu

SEQ ID NO: 106180 - RNA, 22 nt, Human
ggugaagcucuaccauucccag

SEQ ID NO: 106181 - RNA, 22 nt, Human
ggugaaggcacaagagggcaag

SEQ ID NO: 106182 - RNA, 22 nt, Human
ggugacaucuagagacauccaa

SEQ ID NO: 106183 - RNA, 22 nt, Human
ggugacggggcccagguuuccu

SEQ ID NO: 106184 - RNA, 22 nt, Human
ggugacuggagggacccaggcc

SEQ ID NO: 106185 - RNA, 22 nt, Human
ggugacugguuuaucuggcagu

SEQ ID NO: 106186 - RNA, 22 nt, Human
ggugagaaagggauuccuguuc

SEQ ID NO: 106187 - RNA, 22 nt, Human
ggugagagucuuguggucccag

SEQ ID NO: 106188 - RNA, 22 nt, Human
ggugagcaaagcuucaucugua

SEQ ID NO: 106189 - RNA, 22 nt, Human
ggucugagugccagggagagaa

SEQ ID NO: 106190 - RNA, 22 nt, Human
ggucugaguggugcugacucag

SEQ ID NO: 106191 - RNA, 22 nt, Human
ggucugcccacuacucuccauu

SEQ ID NO: 106192 - RNA, 22 nt, Human
ggucuggaagcgcaguaggcug

SEQ ID NO: 106193 - RNA, 22 nt, Human
ggucuggaccauggacgccggg

SEQ ID NO: 106194 - RNA, 22 nt, Human
ggucuggauaauuccaguaccu

SEQ ID NO: 106195 - RNA, 22 nt, Human
ggucuggauuucugcuucuuuc

SEQ ID NO: 106196 - RNA, 22 nt, Human
ggucuggauuuugaacaaaauu

SEQ ID NO: 106197 - RNA, 22 nt, Human
ggucuggcacucaugcagcagg

SEQ ID NO: 106198 - RNA, 22 nt, Human
ggucugggcuugaguccuuuug

SEQ ID NO: 106199 - RNA, 22 nt, Human
ggucuggggcaggcaucugaca

SEQ ID NO: 106200 - RNA, 22 nt, Human
ggucugugaucuuauggauucu

SEQ ID NO: 106201 - RNA, 22 nt, Human
ggucugugcucuggagccucug

SEQ ID NO: 106202 - RNA, 22 nt, Human
ggucuucaggucuaguugguau

SEQ ID NO: 106203 - RNA, 22 nt, Human
ggucuugcuauguugcccaggc

SEQ ID NO: 106204 - RNA, 22 nt, Human
ggucuuucuuugauaguggaga

SEQ ID NO: 106205 - RNA, 22 nt, Human
ggugaaauguagucuugugaga

SEQ ID NO: 106206 - RNA, 22 nt, Human
ggugaaggaggaagcugaugga

SEQ ID NO: 106207 - RNA, 22 nt, Human
ggugaagggugucauggcauuu

SEQ ID NO: 106208 - RNA, 22 nt, Human
ggugaaggucagagcaggaaaa

SEQ ID NO: 106209 - RNA, 22 nt, Human
ggugaaggucuacugugugcca

SEQ ID NO: 106210 - RNA, 22 nt, Human
ggugaagguggaacgcagagca

SEQ ID NO: 106211 - RNA, 22 nt, Human
ggugacacagggaccagagucu

SEQ ID NO: 106212 - RNA, 21 nt, Human
ggugacacguggccccgcucu

SEQ ID NO: 106213 - RNA, 22 nt, Human
ggugacagcgggucaagaggag

SEQ ID NO: 106214 - RNA, 22 nt, Human
ggugacaguuccggagguacag

SEQ ID NO: 106215 - RNA, 22 nt, Human
ggugacauuaucauuauuuuaa

SEQ ID NO: 106216 - RNA, 22 nt, Human
ggugaccucaccuggucccacc

SEQ ID NO: 106217 - RNA, 22 nt, Human
ggugacgaauccauagcaucga

SEQ ID NO: 106218 - RNA, 22 nt, Human
ggugagagaaaagaaacacugu

SEQ ID NO: 106219 - RNA, 22 nt, Human
ggugagaggccugagagcugga

SEQ ID NO: 106220 - RNA, 22 nt, Human
ggugagaguuaugauuccaauu

SEQ ID NO: 106221 - RNA, 22 nt, Human
ggugagcacugcccugggucuc

SEQ ID NO: 106222 - RNA, 22 nt, Human
ggugaggcuaagugacacaggg

SEQ ID NO: 106223 - RNA, 22 nt, Human
ggugaggcuggcuugccuucuu

SEQ ID NO: 106224 - RNA, 22 nt, Human
ggugaggggagagugaaagaaa

SEQ ID NO: 106225 - RNA, 22 nt, Human
ggugaggggcgccucugcccgg

SEQ ID NO: 106226 - RNA, 22 nt, Human
ggugaggggcuccucugcccgg

SEQ ID NO: 106227 - RNA, 22 nt, Human
ggugaguccagaguccaaaucc

SEQ ID NO: 106228 - RNA, 22 nt, Human
ggugagugccuggccuggccac

SEQ ID NO: 106229 - RNA, 17 nt, Human
ggugaguguccaggugg

SEQ ID NO: 106230 - RNA, 22 nt, Human
ggugaugaaaagugccuuuauc

SEQ ID NO: 106231 - RNA, 22 nt, Human
gguucucuuccuccugacugag

SEQ ID NO: 106232 - RNA, 23 nt, Human
gguucugccgcuuacugcugugc

SEQ ID NO: 106233 - RNA, 22 nt, Human
gguugacagaagaaggaugaca

SEQ ID NO: 106234 - RNA, 18 nt, Human
gguugauaacuugugauu

SEQ ID NO: 106235 - RNA, 19 nt, Human
gguuggagaagagcggccc

SEQ ID NO: 106236 - RNA, 22 nt, Human
gguuuaaaagccaugcaugggg

SEQ ID NO: 106237 - RNA, 22 nt, Human
gguuuaagacaggcuucacagu

SEQ ID NO: 106238 - RNA, 17 nt, Human
gguuuaauccuuaccug

SEQ ID NO: 106239 - RNA, 22 nt, Human
gguuuaauggagauauuucaga

SEQ ID NO: 106240 - RNA, 22 nt, Human
gguuuccaaugacaaacacugu

SEQ ID NO: 106241 - RNA, 22 nt, Human
gguuuccacauccauggaaugg

SEQ ID NO: 106242 - RNA, 22 nt, Human
gguuuccauuauuuuaugggug

SEQ ID NO: 106243 - RNA, 14 nt, Human
gguuuccauuuuua

SEQ ID NO: 106244 - RNA, 22 nt, Human
gguuugaacagcuuuggagaag

SEQ ID NO: 106245 - RNA, 22 nt, Human
gguuuguugggguccaggccca

SEQ ID NO: 106246 - RNA, 22 nt, Human
gguuuuaaccauucacaaguga

SEQ ID NO: 106247 - RNA, 22 nt, Human
gguuuuauagcaguacuaucag

SEQ ID NO: 106248 - RNA, 22 nt, Human
gguuuuauuaacuuuaacauca

SEQ ID NO: 106249 - RNA, 22 nt, Human
guaaaacauguuuuaacuagga

SEQ ID NO: 106250 - RNA, 23 nt, Human
guaaaauacgcagugcaguguga

SEQ ID NO: 106251 - RNA, 22 nt, Human
guaaacugaauuggauacugug

SEQ ID NO: 106252 - RNA, 20 nt, Human
guaaagcauucuuggcauac

SEQ ID NO: 106253 - RNA, 22 nt, Human
guaaaguaaacccacuuuguag

SEQ ID NO: 106254 - RNA, 22 nt, Human
guaaauaacugguaauuggggu

SEQ ID NO: 106255 - RNA, 22 nt, Human
guaaaugagucaaaugggggaa

SEQ ID NO: 106256 - RNA, 22 nt, Human
guaaauguccugcuacagagug

SEQ ID NO: 106257 - RNA, 22 nt, Human
guaaaugugcuaaaaugugucg

SEQ ID NO: 106258 - RNA, 22 nt, Human
guaaauguuugcugaugauucu

SEQ ID NO: 106259 - RNA, 22 nt, Human
guaaauuauuucaagaucaucu

SEQ ID NO: 106260 - RNA, 22 nt, Human
guaaauuucccgggccauuuaa

SEQ ID NO: 106261 - RNA, 22 nt, Human
guaacaaaggauaacuugguuu

SEQ ID NO: 106262 - RNA, 22 nt, Human
guaacagaggguuugcagauau

SEQ ID NO: 106263 - RNA, 19 nt, Human
guaacaguggacauuuuag

SEQ ID NO: 106264 - RNA, 20 nt, Human
guaacucuggcuaaguaaau

SEQ ID NO: 106265 - RNA, 22 nt, Human
guaacucuuuggaaaacauuuu

SEQ ID NO: 106266 - RNA, 22 nt, Human
guaacuuuggauuuaggguacc

SEQ ID NO: 106267 - RNA, 22 nt, Human
guaagaagaugaauccaggcug

SEQ ID NO: 106268 - RNA, 22 nt, Human
guaagacaagcggacugccguu

SEQ ID NO: 106269 - RNA, 18 nt, Human
guaagcaaagacuuuaua

SEQ ID NO: 106270 - RNA, 22 nt, Human
guaagcaucugucucuucugca

SEQ ID NO: 106271 - RNA, 22 nt, Human
guaagccucugcucuaucuggu

SEQ ID NO: 106272 - RNA, 22 nt, Human
guaaggcuaaugucuuuguggu

SEQ ID NO: 106273 - RNA, 22 nt, Human
guaaguuuuguauaggcauggg

SEQ ID NO: 106274 - RNA, 22 nt, Human
guaaguuuuucccuagauguag

SEQ ID NO: 106275 - RNA, 22 nt, Human
guaauaauuugcuaccuggugg

SEQ ID NO: 106276 - RNA, 22 nt, Human
guaauagucucaaacuccugga

SEQ ID NO: 106277 - RNA, 17 nt, Human
guaauauaauaagccuu

SEQ ID NO: 106278 - RNA, 22 nt, Human
guaaucucagcuacuugggagg

SEQ ID NO: 106279 - RNA, 20 nt, Human
guaaugaauguaaacaguaa

SEQ ID NO: 106280 - RNA, 22 nt, Human
guaauguguuuugaaaaacagu

SEQ ID NO: 106281 - RNA, 22 nt, Human
guaauuacaugaguacuguaag

SEQ ID NO: 106282 - RNA, 22 nt, Human
guaauucugugugaaucuauua

SEQ ID NO: 106283 - RNA, 22 nt, Human
guaauugaguuaccuggaccag

SEQ ID NO: 106284 - RNA, 22 nt, Human
guaauuuaauucucugacuuga

SEQ ID NO: 106285 - RNA, 22 nt, Human
guaauuuuggaguauaaccugg

SEQ ID NO: 106286 - RNA, 22 nt, Human
guaauuuuuaguucauucuauc

SEQ ID NO: 106287 - RNA, 22 nt, Human
guacaaaggcagaauuggguag

SEQ ID NO: 106288 - RNA, 22 nt, Human
guacaaaugcagguuuguuaca

SEQ ID NO: 106289 - RNA, 22 nt, Human
guacaaauguacacuuguauaa

SEQ ID NO: 106290 - RNA, 22 nt, Human
guacaaauuuugacaucuagga

SEQ ID NO: 106291 - RNA, 19 nt, Human
guacaagaaugacugagca

SEQ ID NO: 106292 - RNA, 22 nt, Human
guacaaguucuacucuauaaau

SEQ ID NO: 106293 - RNA, 22 nt, Human
guacaauaacuagucuuauagu

SEQ ID NO: 106294 - RNA, 19 nt, Human
guacaauguguuguuggua

SEQ ID NO: 106295 - RNA, 22 nt, Human
guacaauuaagugcacaaauag

SEQ ID NO: 106296 - RNA, 22 nt, Human
guacacaaaagaggaaaccgga

SEQ ID NO: 106297 - RNA, 22 nt, Human
guacacacuguuugaucauuuc

SEQ ID NO: 106298 - RNA, 22 nt, Human
guacacagagugguggaagaaa

SEQ ID NO: 106299 - RNA, 22 nt, Human
guacacauagguuacugauuaa

SEQ ID NO: 106300 - RNA, 22 nt, Human
guacacauauauuaaaaauugu

SEQ ID NO: 106301 - RNA, 22 nt, Human
guacagaaugcuugguaaggca

SEQ ID NO: 106302 - RNA, 22 nt, Human
guacagcauuugaaauuacugg

SEQ ID NO: 106303 - RNA, 22 nt, Human
guacaggacauagacagaguag

SEQ ID NO: 106304 - RNA, 21 nt, Human
guacagggauaguagugucaa

SEQ ID NO: 106305 - RNA, 22 nt, Human
guacaguaguaaaagugaauga

SEQ ID NO: 106306 - RNA, 22 nt, Human
guacaguuuucaguguucacug

SEQ ID NO: 106307 - RNA, 22 nt, Human
uccugggacucugccucaggcu

SEQ ID NO: 106308 - RNA, 22 nt, Human
uccugggagacccagcugugga

SEQ ID NO: 106309 - RNA, 22 nt, Human
uccugggagagugggacuguau

SEQ ID NO: 106310 - RNA, 22 nt, Human
uccugggagcauggugccguga

SEQ ID NO: 106311 - RNA, 22 nt, Human
uccugggaguaauugagucaug

SEQ ID NO: 106312 - RNA, 22 nt, Human
uccugggaguggccauguaaug

SEQ ID NO: 106313 - RNA, 22 nt, Human
uccugggauacuaagaaauuuu

SEQ ID NO: 106314 - RNA, 22 nt, Human
uccugggaugacuuuugaaaug

SEQ ID NO: 106315 - RNA, 22 nt, Human
uccugggauuaagguggugauu

SEQ ID NO: 106316 - RNA, 22 nt, Human
uccugggcaaaaguaucuguga

SEQ ID NO: 106317 - RNA, 22 nt, Human
uccugggcacaagugagucucc

SEQ ID NO: 106318 - RNA, 22 nt, Human
uccugggcgguuaugugaucug

SEQ ID NO: 106319 - RNA, 19 nt, Human
uccugggcguugacuuugg

SEQ ID NO: 106320 - RNA, 22 nt, Human
uccugggcugcagggaagagca

SEQ ID NO: 106321 - RNA, 22 nt, Human
uccugggcuuaagugauccucc

SEQ ID NO: 106322 - RNA, 22 nt, Human
uccugggcuucacagacucugu

SEQ ID NO: 106323 - RNA, 19 nt, Human
uccuggggaggggcauggc

SEQ ID NO: 106324 - RNA, 22 nt, Human
uccuggggccaggcaccucugg

SEQ ID NO: 106325 - RNA, 22 nt, Human
uccuggggcucaugggauuugu

SEQ ID NO: 106326 - RNA, 22 nt, Human
uccuggggcucugagcgagaca

SEQ ID NO: 106327 - RNA, 22 nt, Human
uccuggggcucuuugaugugau

SEQ ID NO: 106328 - RNA, 22 nt, Human
uccuggguaaacacugaccuuu

SEQ ID NO: 106329 - RNA, 22 nt, Human
uccuggguagccuguccaagau

SEQ ID NO: 106330 - RNA, 22 nt, Human
uccugggucugggugucugagg

SEQ ID NO: 106331 - RNA, 22 nt, Human
uccuggguggugguaggagcag

SEQ ID NO: 106332 - RNA, 22 nt, Human
uccuggguuaauuaugauucac

SEQ ID NO: 106333 - RNA, 22 nt, Human
uccuggucagugccaaacuggu

SEQ ID NO: 106334 - RNA, 22 nt, Human
uccuggucuacacugcauuggg

SEQ ID NO: 106335 - RNA, 22 nt, Human
uccuggugaaugacuuuuuauu

SEQ ID NO: 106336 - RNA, 23 nt, Human
uccuggugacaugccugagcauc

SEQ ID NO: 106337 - RNA, 22 nt, Human
uccuggugaggcuagaaguguc

SEQ ID NO: 106338 - RNA, 22 nt, Human
uccuggugcuuguauuugaagu

SEQ ID NO: 106339 - RNA, 20 nt, Human
uccugguggauacugcuuaa

SEQ ID NO: 106340 - RNA, 22 nt, Human
uccuggugggacagaaaaccuc

SEQ ID NO: 106341 - RNA, 22 nt, Human
guuuuuaucuaauagcaguuau

SEQ ID NO: 106342 - RNA, 22 nt, Human
guuuuucuagaaaucuccuccu

SEQ ID NO: 106343 - RNA, 22 nt, Human
guuuuucuagacugggaguuug

SEQ ID NO: 106344 - RNA, 22 nt, Human
guuuuucuaggaccaugugauu

SEQ ID NO: 106345 - RNA, 22 nt, Human
guuuuugucgaguuccuugacc

SEQ ID NO: 106346 - RNA, 22 nt, Human
gugagagugguuuauguccaug

SEQ ID NO: 106347 - RNA, 22 nt, Human
gugagaguguuuggaaauagaa

SEQ ID NO: 106348 - RNA, 22 nt, Human
gugagauuugaguggggauaca

SEQ ID NO: 106349 - RNA, 22 nt, Human
gugagcagaauaaggguugaga

SEQ ID NO: 106350 - RNA, 18 nt, Human
gugagcagagagcaucac

SEQ ID NO: 106351 - RNA, 22 nt, Human
gugagcaggauaggggcucccu

SEQ ID NO: 106352 - RNA, 22 nt, Human
gugagcaguuguauaaagacuu

SEQ ID NO: 106353 - RNA, 22 nt, Human
gugagcaguugugagccccaaa

SEQ ID NO: 106354 - RNA, 22 nt, Human
gugagcaucuuggcagauauga

SEQ ID NO: 106355 - RNA, 22 nt, Human
gugagccaguucgacuguuucu

SEQ ID NO: 106356 - RNA, 22 nt, Human
gugagcugggugaaugguaggg

SEQ ID NO: 106357 - RNA, 22 nt, Human
gugagcuucugacagaugcacc

SEQ ID NO: 106358 - RNA, 19 nt, Human
gugagcuucuuguaagagg

SEQ ID NO: 106359 - RNA, 22 nt, Human
gugaggaagucugagagccaca

SEQ ID NO: 106360 - RNA, 19 nt, Human
gugaggaguguuuacagaa

SEQ ID NO: 106361 - RNA, 22 nt, Human
gugaggcagaaguucccuuuua

SEQ ID NO: 106362 - RNA, 22 nt, Human
gugaggcagcaggagccucugu

SEQ ID NO: 106363 - RNA, 22 nt, Human
gugaggcuacucagcuguccga

SEQ ID NO: 106364 - RNA, 22 nt, Human
gugagggcagcuuggucagugu

SEQ ID NO: 106365 - RNA, 22 nt, Human
gugaggggccaagaguagggca

SEQ ID NO: 106366 - RNA, 22 nt, Human
gugagguaaacuguaguucaga

SEQ ID NO: 106367 - RNA, 22 nt, Human
gugagguagcagagacagugaa

SEQ ID NO: 106368 - RNA, 22 nt, Human
gugaggucaaagccuuggguau

SEQ ID NO: 106369 - RNA, 22 nt, Human
gugagguccaguaacuugucca

SEQ ID NO: 106370 - RNA, 22 nt, Human
gugagguccugagaggcuugug

SEQ ID NO: 106371 - RNA, 22 nt, Human
gugaggugacuagcaggugggg

SEQ ID NO: 106372 - RNA, 22 nt, Human
gugagucuguggaccgggcacu

SEQ ID NO: 106373 - RNA, 22 nt, Human
gugagucugugggugggaacug

SEQ ID NO: 106374 - RNA, 22 nt, Human
gugagucuuaagcaccaccuuu

SEQ ID NO: 106375 - RNA, 22 nt, Human
gugaguguuaacccacugcuuc

SEQ ID NO: 106376 - RNA, 22 nt, Human
gugauaaaggggaggaagugug

SEQ ID NO: 106377 - RNA, 22 nt, Human
gugauaacucaggcagagaaua

SEQ ID NO: 106378 - RNA, 22 nt, Human
gugauacaaauaaacauaugcu

SEQ ID NO: 106379 - RNA, 22 nt, Human
gugauaggcauuuaacucuaag

SEQ ID NO: 106380 - RNA, 23 nt, Human
gugauauuaaggauagagacaag

SEQ ID NO: 106381 - RNA, 22 nt, Human
gugauggagucaaggcuagaac

SEQ ID NO: 106382 - RNA, 22 nt, Human
gugaugucacagaauaagugau

SEQ ID NO: 106383 - RNA, 22 nt, Human
gugauuaaugccaaugggccuu

SEQ ID NO: 106384 - RNA, 22 nt, Human
gugauucucacucuagugcuug

SEQ ID NO: 106385 - RNA, 22 nt, Human
gugauucugccuggaagguccu

SEQ ID NO: 106386 - RNA, 22 nt, Human
gugauucuggcaggcagaaggg

SEQ ID NO: 106387 - RNA, 19 nt, Human
gugauuucuuuccacaagc

SEQ ID NO: 106388 - RNA, 22 nt, Human
gugcaaaagcaguugugguuuu

SEQ ID NO: 106389 - RNA, 22 nt, Human
gugcaaaaguaauuacaguuuu

SEQ ID NO: 106390 - RNA, 22 nt, Human
gugcaaaaguaauugcaguacu

SEQ ID NO: 106391 - RNA, 22 nt, Human
gugcaaaaguaauugcaguuuu

SEQ ID NO: 106392 - RNA, 22 nt, Human
gugcaaaaguaauugugguuuu

SEQ ID NO: 106393 - RNA, 22 nt, Human
gugcaaaaguacuugcggauuu

SEQ ID NO: 106394 - RNA, 22 nt, Human
gugcaaaagucauugugguuuu

SEQ ID NO: 106395 - RNA, 16 nt, Human
gugcaaaagugaggag

SEQ ID NO: 106396 - RNA, 22 nt, Human
gugcaaaaugauauccugaagc

SEQ ID NO: 106397 - RNA, 22 nt, Human
gugcaaacaucauagaguguac

SEQ ID NO: 106398 - RNA, 22 nt, Human
gugcaaauacauaugcugugga

SEQ ID NO: 106399 - RNA, 18 nt, Human
gugcaaauacuugcugac

SEQ ID NO: 106400 - RNA, 22 nt, Human
gugcaaaugagauggauucaag

SEQ ID NO: 106401 - RNA, 22 nt, Human
gugcaaccaucaccacugacuc

SEQ ID NO: 106402 - RNA, 22 nt, Human
gugcaagguacauccuugaugu

SEQ ID NO: 106403 - RNA, 22 nt, Human
gugcaauagacugugguauuaa

SEQ ID NO: 106404 - RNA, 20 nt, Human
gugcaauggcaccaucucag

SEQ ID NO: 106405 - RNA, 20 nt, Human
gugcaauggcgcaaucucgg

SEQ ID NO: 106406 - RNA, 22 nt, Human
gugcacaaucuucauauggcgu

SEQ ID NO: 106407 - RNA, 22 nt, Human
gugcacacaagcaaugcacuua

SEQ ID NO: 106408 - RNA, 22 nt, Human
gugcacagaagcagaagcuaga

SEQ ID NO: 106409 - RNA, 22 nt, Human
gugcacagagcccagggccgcg

SEQ ID NO: 106410 - RNA, 22 nt, Human
gugcacagauucagagguuuug

SEQ ID NO: 106411 - RNA, 22 nt, Human
gugcacccccaaggagguggag

SEQ ID NO: 106412 - RNA, 22 nt, Human
gugcagaaucaguacagaacga

SEQ ID NO: 106413 - RNA, 22 nt, Human
gugcagaccuuaguucaagcca

SEQ ID NO: 106414 - RNA, 22 nt, Human
gugcagaccuuccagaaagaac

SEQ ID NO: 106415 - RNA, 22 nt, Human
gugcagagaaaugagaagucga

SEQ ID NO: 106416 - RNA, 21 nt, Human
gugcagaggaauguagggggc

SEQ ID NO: 106417 - RNA, 22 nt, Human
gugcagaggacguggcggccuc

SEQ ID NO: 106418 - RNA, 20 nt, Human
gugcagauguccuuucacac

SEQ ID NO: 106419 - RNA, 23 nt, Human
gugcagcagugucugcagucaug

SEQ ID NO: 106420 - RNA, 22 nt, Human
gugcagcugagggccucuucua

SEQ ID NO: 106421 - RNA, 22 nt, Human
gugcagcugugguggagccagg

SEQ ID NO: 106422 - RNA, 22 nt, Human
gugcagcugugugagagcucca

SEQ ID NO: 106423 - RNA, 22 nt, Human
gugcagcuuccuggucucagcc

SEQ ID NO: 106424 - RNA, 22 nt, Human
gugcaggaguaggagagggcuu

SEQ ID NO: 106425 - RNA, 22 nt, Human
gugcagggcagccgaaugggcu

SEQ ID NO: 106426 - RNA, 22 nt, Human
gugcagggcuggcaccggaggc

SEQ ID NO: 106427 - RNA, 22 nt, Human
gugcaggugaccuaauccaugu

SEQ ID NO: 106428 - RNA, 22 nt, Human
gugcagucccuccucccaaggc

SEQ ID NO: 106429 - RNA, 22 nt, Human
gugcaguugaagcauggggaga

SEQ ID NO: 106430 - RNA, 22 nt, Human
gugcaguugagacaauaggcug

SEQ ID NO: 106431 - RNA, 22 nt, Human
gugcaguugauaguuuuaguga

SEQ ID NO: 106432 - RNA, 22 nt, Human
gugcaguuguggacaugacaac

SEQ ID NO: 106433 - RNA, 22 nt, Human
gugcauaugguuacagcaccgc

SEQ ID NO: 106434 - RNA, 22 nt, Human
gugcaucaauuucccauguguc

SEQ ID NO: 106435 - RNA, 21 nt, Human
gugcaucagaucaguggaguc

SEQ ID NO: 106436 - RNA, 22 nt, Human
gugcaucaggaucugaccagau

SEQ ID NO: 106437 - RNA, 22 nt, Human
gugcaucugaauuugaaaaucu

SEQ ID NO: 106438 - RNA, 18 nt, Human
gugcaugcaugcucugcc

SEQ ID NO: 106439 - RNA, 22 nt, Human
gugcauggggagggaagcgcuc

SEQ ID NO: 106440 - RNA, 22 nt, Human
gugcaugugucuuuauaguagc

SEQ ID NO: 106441 - RNA, 22 nt, Human
gugcauugcgaugcagacgacc

SEQ ID NO: 106442 - RNA, 22 nt, Human
gugcauuuaggucacaugaugu

SEQ ID NO: 106443 - RNA, 22 nt, Human
gugcauuucucauacacuaaau

SEQ ID NO: 106444 - RNA, 22 nt, Human
gugccaaaagcuauaauuuggu

SEQ ID NO: 106445 - RNA, 22 nt, Human
gugccagagacaugacuagcug

SEQ ID NO: 106446 - RNA, 22 nt, Human
gugccagaggcagugaggaguu

SEQ ID NO: 106447 - RNA, 22 nt, Human
gugccagaggccccaaacaagu

SEQ ID NO: 106448 - RNA, 22 nt, Human
gugccagaguuugaggacaauu

SEQ ID NO: 106449 - RNA, 22 nt, Human
gugccagccgcaccccaggaga

SEQ ID NO: 106450 - RNA, 22 nt, Human
guuucaaaagucaggcuauucu

SEQ ID NO: 106451 - RNA, 22 nt, Human
guuucaaagggaagacgcugga

SEQ ID NO: 106452 - RNA, 22 nt, Human
guuucaauuugaaugcgaggcu

SEQ ID NO: 106453 - RNA, 22 nt, Human
guuucacagauggggagacacg

SEQ ID NO: 106454 - RNA, 22 nt, Human
guuucacagaugguguucauau

SEQ ID NO: 106455 - RNA, 22 nt, Human
guuucacagguuggagccagca

SEQ ID NO: 106456 - RNA, 22 nt, Human
guuucacugcaaacugacuuuu

SEQ ID NO: 106457 - RNA, 22 nt, Human
guuucagaaauguucuccugcu

SEQ ID NO: 106458 - RNA, 22 nt, Human
guuucagacuauucuguuucug

SEQ ID NO: 106459 - RNA, 22 nt, Human
guuucagaguagaaccucaagg

SEQ ID NO: 106460 - RNA, 22 nt, Human
guuucagauuugguuucagaag

SEQ ID NO: 106461 - RNA, 22 nt, Human
guuucauaauucaaucaaauga

SEQ ID NO: 106462 - RNA, 22 nt, Human
guuucauacagauuauucaugg

SEQ ID NO: 106463 - RNA, 22 nt, Human
guuucauaugcaguuaacagca

SEQ ID NO: 106464 - RNA, 22 nt, Human
guuucaugguuguuugauggca

SEQ ID NO: 106465 - RNA, 22 nt, Human
guuuccaagaugcugccaucag

SEQ ID NO: 106466 - RNA, 22 nt, Human
guuuccagagugagggcacuug

SEQ ID NO: 106467 - RNA, 22 nt, Human
guuuccagcuugggcccgggga

SEQ ID NO: 106468 - RNA, 22 nt, Human
guuuccaugaaaauguuucugc

SEQ ID NO: 106469 - RNA, 22 nt, Human
guuucccaggcuguggggcccu

SEQ ID NO: 106470 - RNA, 22 nt, Human
guuuccgcccugggccuguggg

SEQ ID NO: 106471 - RNA, 22 nt, Human
guuuccuauggcugcugcagga

SEQ ID NO: 106472 - RNA, 22 nt, Human
guuuccucugcugguuuucauu

SEQ ID NO: 106473 - RNA, 22 nt, Human
guuuccugaaauagaguacugg

SEQ ID NO: 106474 - RNA, 22 nt, Human
guuuccugcacacguguuauau

SEQ ID NO: 106475 - RNA, 22 nt, Human
guuuccugcccugucuuaucca

SEQ ID NO: 106476 - RNA, 22 nt, Human
guuuccuggagguuauuuuuga

SEQ ID NO: 106477 - RNA, 22 nt, Human
guuuccugugggaacucggcug

SEQ ID NO: 106478 - RNA, 22 nt, Human
guuuccuuuaauagugauauug

SEQ ID NO: 106479 - RNA, 22 nt, Human
guuuccuuugccaguaaauggg

SEQ ID NO: 106480 - RNA, 22 nt, Human
guuuccuuuuggaauuagagcu

SEQ ID NO: 106481 - RNA, 22 nt, Human
guuucuaugguuuauauuacug

SEQ ID NO: 106482 - RNA, 22 nt, Human
guuucucaaauuauuucagcuu

SEQ ID NO: 106483 - RNA, 22 nt, Human
guuucucagcaacuauaugacu

SEQ ID NO: 106484 - RNA, 22 nt, Human
guuucucuuugaagccuggcug

SEQ ID NO: 106485 - RNA, 22 nt, Human
guuucugagagccacacacagc

SEQ ID NO: 106486 - RNA, 22 nt, Human
guuucuguguuagaugagucuu

SEQ ID NO: 106487 - RNA, 22 nt, Human
guuucuguugcucagauaaugc

SEQ ID NO: 106488 - RNA, 22 nt, Human
guuucuuaaaagaggaguuaga

SEQ ID NO: 106489 - RNA, 22 nt, Human
guuucuuaaauguagcaggacc

SEQ ID NO: 106490 - RNA, 22 nt, Human
guuucuuagacauaugccauga

SEQ ID NO: 106491 - RNA, 22 nt, Human
guuucuuauuucaacuggaaca

SEQ ID NO: 106492 - RNA, 20 nt, Human
guuugaaaugauugguuggu

SEQ ID NO: 106493 - RNA, 22 nt, Human
guuugaaugcaguaugcauuuu

SEQ ID NO: 106494 - RNA, 22 nt, Human
guuugauucaagaacaaagagu

SEQ ID NO: 106495 - RNA, 22 nt, Human
guuugcaaagaucauuuucucc

SEQ ID NO: 106496 - RNA, 22 nt, Human
guuugcaggaacucuggggaga

SEQ ID NO: 106497 - RNA, 22 nt, Human
guuugcagggagagauguggug

SEQ ID NO: 106498 - RNA, 21 nt, Human
guuugcaguugaguccuuccc

SEQ ID NO: 106499 - RNA, 22 nt, Human
guuugcaguugucauccuccug

SEQ ID NO: 106500 - RNA, 22 nt, Human
guuugcauauuugcacaggaau

SEQ ID NO: 106501 - RNA, 21 nt, Human
guuugcaugaacaagucagcc

SEQ ID NO: 106502 - RNA, 22 nt, Human
ucuuuaugcacauaaagaaacu

SEQ ID NO: 106503 - RNA, 22 nt, Human
ucuuuaugccuaccugggaaga

SEQ ID NO: 106504 - RNA, 22 nt, Human
ucuuuauggaaaaugaauggca

SEQ ID NO: 106505 - RNA, 22 nt, Human
ucuuucaaugagcauucuuucc

SEQ ID NO: 106506 - RNA, 22 nt, Human
ucuuucauguauaugcaaccua

SEQ ID NO: 106507 - RNA, 22 nt, Human
ucuuucccuguguuagccugua

SEQ ID NO: 106508 - RNA, 22 nt, Human
ucuuuccuuagaauaauucuuu

SEQ ID NO: 106509 - RNA, 22 nt, Human
ucuuucugaauauuugaccuca

SEQ ID NO: 106510 - RNA, 22 nt, Human
ucuuucugaugggaagggucaa

SEQ ID NO: 106511 - RNA, 22 nt, Human
ucuuucugguuauguauagaga

SEQ ID NO: 106512 - RNA, 22 nt, Human
ucuuucuguaagcuccauggaa

SEQ ID NO: 106513 - RNA, 22 nt, Human
ucuuucuuauuaugcucaaugu

SEQ ID NO: 106514 - RNA, 22 nt, Human
ucuuucuucagcccuguaagau

SEQ ID NO: 106515 - RNA, 22 nt, Human
ucuuucuugguauaaagcaggg

SEQ ID NO: 106516 - RNA, 22 nt, Human
ucuuugaaaagggagauagaaa

SEQ ID NO: 106517 - RNA, 22 nt, Human
ucuuugaacucuguguauuaac

SEQ ID NO: 106518 - RNA, 22 nt, Human
ucuuugaauucaaacuguucaa

SEQ ID NO: 106519 - RNA, 22 nt, Human
ucuuugaugcuucugaaggugu

SEQ ID NO: 106520 - RNA, 22 nt, Human
ucuuugaugugguuaauuauga

SEQ ID NO: 106521 - RNA, 21 nt, Human
ucuuugauuaagcuugacuag

SEQ ID NO: 106522 - RNA, 22 nt, Human
ucuuugauuugacaauaucuug

SEQ ID NO: 106523 - RNA, 22 nt, Human
ucuuugauuuuguuacuaagac

SEQ ID NO: 106524 - RNA, 22 nt, Human
ucuuugcaaacuauggagugug

SEQ ID NO: 106525 - RNA, 22 nt, Human
ucuuugcacacagcgauucuuc

SEQ ID NO: 106526 - RNA, 22 nt, Human
ucuuugcacugugcaagcagaa

SEQ ID NO: 106527 - RNA, 22 nt, Human
ucuuugcagaacgaugaagaug

SEQ ID NO: 106528 - RNA, 22 nt, Human
ucuuugcagaauuuaacuuugc

SEQ ID NO: 106529 - RNA, 22 nt, Human
ucuuugcaggagcccuuugaac

SEQ ID NO: 106530 - RNA, 22 nt, Human
ucuuugcaguggugaauaaaga

SEQ ID NO: 106531 - RNA, 22 nt, Human
ucuuugcaugaguucccucugu

SEQ ID NO: 106532 - RNA, 22 nt, Human
ucuuugcaugugcuucuuggcc

SEQ ID NO: 106533 - RNA, 22 nt, Human
ucuuugcauuccugugugcuuu

SEQ ID NO: 106534 - RNA, 22 nt, Human
ucuuugcugaguacaucuccaa

SEQ ID NO: 106535 - RNA, 18 nt, Human
ucuuuggacaacuacugg

SEQ ID NO: 106536 - RNA, 22 nt, Human
ucuuuggcauuuaggagcagga

SEQ ID NO: 106537 - RNA, 22 nt, Human
ucuuuggcugccugaagcccaa

SEQ ID NO: 106538 - RNA, 22 nt, Human
ucuuuggcuugucuccucaguu

SEQ ID NO: 106539 - RNA, 22 nt, Human
ucuuugggcuaggaguuuggau

SEQ ID NO: 106540 - RNA, 22 nt, Human
ucuuugguauucacuugugaag

SEQ ID NO: 106541 - RNA, 16 nt, Human
ucuuuguaaucagcag

SEQ ID NO: 106542 - RNA, 22 nt, Human
ucuuuguacuuucuggcugucc

SEQ ID NO: 106543 - RNA, 22 nt, Human
ucuuuguaguuauaaacgacuu

SEQ ID NO: 106544 - RNA, 22 nt, Human
ucuuuguauguauguuucaaag

SEQ ID NO: 106545 - RNA, 22 nt, Human
ucuuugucugaacagggacauu

SEQ ID NO: 106546 - RNA, 22 nt, Human
ucuuugugccaugcagugaggc

SEQ ID NO: 106547 - RNA, 21 nt, Human
ucuuuuaacaccaggaauucc

SEQ ID NO: 106548 - RNA, 22 nt, Human
ucuuuuaguaauaaauauuugu

SEQ ID NO: 106549 - RNA, 22 nt, Human
ucuuuuaucuguuguguaacaa

SEQ ID NO: 106550 - RNA, 18 nt, Human
ucuuuuccuuccacuucc

SEQ ID NO: 106551 - RNA, 22 nt, Human
ucuuuuccuugaugguuaaaua

SEQ ID NO: 106552 - RNA, 21 nt, Human
ucuuuucucagcuuugugguu

SEQ ID NO: 106553 - RNA, 22 nt, Human
ucuuuucuucuuaaugguuaau

SEQ ID NO: 106554 - RNA, 22 nt, Human
ucuuuuguagcuaacacauuca

SEQ ID NO: 106555 - RNA, 22 nt, Human
ucuuuugucgguguaucaugga

SEQ ID NO: 106556 - RNA, 22 nt, Human
ucuuuugugccaaguaaugaau

SEQ ID NO: 106557 - RNA, 22 nt, Human
ucuuuuguugauggaauuaaug

SEQ ID NO: 106558 - RNA, 22 nt, Human
ucuuuuguugccuacuuauuaa

SEQ ID NO: 106559 - RNA, 22 nt, Human
ugaagcauaagaggguucuuuu

SEQ ID NO: 106560 - RNA, 22 nt, Human
ugaagcaucuggucugagaauu

SEQ ID NO: 106561 - RNA, 22 nt, Human
ugaagccaaggaugccuuucuc

SEQ ID NO: 106562 - RNA, 22 nt, Human
ugaagccaaucugccaggcaga

SEQ ID NO: 106563 - RNA, 22 nt, Human
ugaagccagucaauguuaaguu

SEQ ID NO: 106564 - RNA, 22 nt, Human
ugaagccaucaggaagccagca

SEQ ID NO: 106565 - RNA, 22 nt, Human
ugaagccaucccucagauggcc

SEQ ID NO: 106566 - RNA, 22 nt, Human
ugaagccucaccugcucaguau

SEQ ID NO: 106567 - RNA, 21 nt, Human
ugaagccugaggcauagcccc

SEQ ID NO: 106568 - RNA, 22 nt, Human
ugaagcuagucaagcuuagaua

SEQ ID NO: 106569 - RNA, 22 nt, Human
ugaagcuauauaaguuacagca

SEQ ID NO: 106570 - RNA, 22 nt, Human
ugaagcuggaagcaugcagacu

SEQ ID NO: 106571 - RNA, 22 nt, Human
ugaagcuggaaguuagguagac

SEQ ID NO: 106572 - RNA, 22 nt, Human
ugaaggaaagagggaacauccc

SEQ ID NO: 106573 - RNA, 22 nt, Human
ugaaggaaaugacggcagaaga

SEQ ID NO: 106574 - RNA, 22 nt, Human
ugaaggaagaauaggcaguguu

SEQ ID NO: 106575 - RNA, 22 nt, Human
ugaaggaaugagggaguggguc

SEQ ID NO: 106576 - RNA, 22 nt, Human
ugaaggagcucaaugaugaugc

SEQ ID NO: 106577 - RNA, 22 nt, Human
ugaaggagcucaggagauaguc

SEQ ID NO: 106578 - RNA, 22 nt, Human
ugaaggaggaauguggccucca

SEQ ID NO: 106579 - RNA, 22 nt, Human
ugaaggcaaaacauguuacacc

SEQ ID NO: 106580 - RNA, 22 nt, Human
ugaaggcaaccucugugguccu

SEQ ID NO: 106581 - RNA, 22 nt, Human
ugaaggcacuugccuaggggca

SEQ ID NO: 106582 - RNA, 22 nt, Human
ugaaggcagcaugcacacuagu

SEQ ID NO: 106583 - RNA, 22 nt, Human
ugaaggcauuugaguuggugag

SEQ ID NO: 106584 - RNA, 20 nt, Human
ugaaggccagcagcauaggg

SEQ ID NO: 106585 - RNA, 22 nt, Human
ugaaggccagcucuuuaucagc

SEQ ID NO: 106586 - RNA, 22 nt, Human
ugaaggcccuaucuccauauac

SEQ ID NO: 106587 - RNA, 22 nt, Human
ugaaggccuaacuuccagugcu

SEQ ID NO: 106588 - RNA, 23 nt, Human
ugaaggccuggaggacgcguugu

SEQ ID NO: 106589 - RNA, 22 nt, Human
ugaaggcuugacugaggcagga

SEQ ID NO: 106590 - RNA, 22 nt, Human
ugaagggcaaccccaggcccag

SEQ ID NO: 106591 - RNA, 22 nt, Human
ugaagggguucagcaugggggu

SEQ ID NO: 106592 - RNA, 22 nt, Human
ugaaggucaugguaauauuuuu

SEQ ID NO: 106593 - RNA, 22 nt, Human
ugaaggugagcauuugcugauu

SEQ ID NO: 106594 - RNA, 19 nt, Human
ugaagguguaugugcuggg

SEQ ID NO: 106595 - RNA, 22 nt, Human
ugaaguaacuguccaggaucca

SEQ ID NO: 106596 - RNA, 22 nt, Human
ugaaguaucuauggauauaaga

SEQ ID NO: 106597 - RNA, 23 nt, Human
ugaagugaaauuucacaagggac

SEQ ID NO: 106598 - RNA, 22 nt, Human
ugaagugaccuggggcagugua

SEQ ID NO: 106599 - RNA, 22 nt, Human
ugaaguucaagggcuacauuug

SEQ ID NO: 106600 - RNA, 22 nt, Human
ugaaguuucuugaaucuuggag

SEQ ID NO: 106601 - RNA, 22 nt, Human
ugaauaaaguauguccugggaa

SEQ ID NO: 106602 - RNA, 22 nt, Human
ugaauaaauugagagcgaaugu

SEQ ID NO: 106603 - RNA, 22 nt, Human
ugaauagauuuuuaacauauaa

SEQ ID NO: 106604 - RNA, 20 nt, Human
ugaauaugaccuuauuugga

SEQ ID NO: 106605 - RNA, 22 nt, Human
ugaauaugauugcaaauuuggc

SEQ ID NO: 106606 - RNA, 22 nt, Human
ugaaucaguauaaauucucaaa

SEQ ID NO: 106607 - RNA, 22 nt, Human
ugaauccuaauucuaucacuua

SEQ ID NO: 106608 - RNA, 22 nt, Human
ugaaucugauuucccuggaggc

SEQ ID NO: 106609 - RNA, 22 nt, Human
ugaaugagaacacugaaagagg

SEQ ID NO: 106610 - RNA, 21 nt, Human
ugaaugagcaucuggacuuuu

SEQ ID NO: 106611 - RNA, 22 nt, Human
ugaaugaucuccgauuaguccu

SEQ ID NO: 106612 - RNA, 21 nt, Human
ugaaugaucugguugccuuuu

SEQ ID NO: 106613 - RNA, 22 nt, Human
ugaaugauguauaauauugaga

SEQ ID NO: 106614 - RNA, 23 nt, Human
ugaaugauuguacugagcuuuua

SEQ ID NO: 106615 - RNA, 22 nt, Human
ugaaugcacugcucuccuagga

SEQ ID NO: 106616 - RNA, 22 nt, Human
ugaaugugaugcuaaacauaug

SEQ ID NO: 106617 - RNA, 22 nt, Human
ugaaugugggagagcuggcaau

SEQ ID NO: 106618 - RNA, 22 nt, Human
ugaauguucucuaaauacuccu

SEQ ID NO: 106619 - RNA, 22 nt, Human
uagaaucauugagaauaacagg

SEQ ID NO: 106620 - RNA, 22 nt, Human
uagaaucccagccagcuggaag

SEQ ID NO: 106621 - RNA, 23 nt, Human
uagaauccucugagauggaauag

SEQ ID NO: 106622 - RNA, 22 nt, Human
uagaaucuccagcauugguugu

SEQ ID NO: 106623 - RNA, 23 nt, Human
uagaaucuguauuucugcaguuc

SEQ ID NO: 106624 - RNA, 18 nt, Human
uagaaucuguuauugccu

SEQ ID NO: 106625 - RNA, 22 nt, Human
uagaaucuuuaaaauucauagu

SEQ ID NO: 106626 - RNA, 21 nt, Human
uagaaugcuauugucuuuucu

SEQ ID NO: 106627 - RNA, 22 nt, Human
uagaauguggagguaacagacu

SEQ ID NO: 106628 - RNA, 23 nt, Human
uagaauucaaucuguuccacauc

SEQ ID NO: 106629 - RNA, 22 nt, Human
uagaauugaguuucacuguucc

SEQ ID NO: 106630 - RNA, 22 nt, Human
uagacaaucucagcaaacacac

SEQ ID NO: 106631 - RNA, 22 nt, Human
uagacacaagagaaggguauaa

SEQ ID NO: 106632 - RNA, 22 nt, Human
uagacacaggggaaugugaggu

SEQ ID NO: 106633 - RNA, 22 nt, Human
uagacacuagggauuuaguacu

SEQ ID NO: 106634 - RNA, 23 nt, Human
uagacacuccuuugucuguccuu

SEQ ID NO: 106635 - RNA, 22 nt, Human
uagacagaauccagcccacgcc

SEQ ID NO: 106636 - RNA, 22 nt, Human
uagacagagugaagacaagugg

SEQ ID NO: 106637 - RNA, 22 nt, Human
uagacaggaaacauuaggaugg

SEQ ID NO: 106638 - RNA, 22 nt, Human
uagacaggagucaggcuagaau

SEQ ID NO: 106639 - RNA, 22 nt, Human
uagacaggguggcuuagaaaca

SEQ ID NO: 106640 - RNA, 22 nt, Human
uagacauuagguagguucaugg

SEQ ID NO: 106641 - RNA, 22 nt, Human
uagacauuauguauuaaguucu

SEQ ID NO: 106642 - RNA, 22 nt, Human
uagacauuggccauuccugugg

SEQ ID NO: 106643 - RNA, 22 nt, Human
uagacauuuaucuccaugugga

SEQ ID NO: 106644 - RNA, 22 nt, Human
uagacauuuggaguuuuaugac

SEQ ID NO: 106645 - RNA, 22 nt, Human
uagacauuugucaagaaugacu

SEQ ID NO: 106646 - RNA, 21 nt, Human
uagaccagcugugcuccucgg

SEQ ID NO: 106647 - RNA, 22 nt, Human
uagaccagguugaccagguagg

SEQ ID NO: 106648 - RNA, 22 nt, Human
uagacuauuucuuuugcauagg

SEQ ID NO: 106649 - RNA, 22 nt, Human
uagacucagacagaaaaugugu

SEQ ID NO: 106650 - RNA, 22 nt, Human
uagacuuuucaaaaucuagacc

SEQ ID NO: 106651 - RNA, 20 nt, Human
uagacuuuucaucaaccuua

SEQ ID NO: 106652 - RNA, 22 nt, Human
uagagaauggccuugaaguagu

SEQ ID NO: 106653 - RNA, 22 nt, Human
uagagaggccgcggguccccuc

SEQ ID NO: 106654 - RNA, 22 nt, Human
uagagcagaacuuguuaacacc

SEQ ID NO: 106655 - RNA, 22 nt, Human
uagagcaguggguaccauggca

SEQ ID NO: 106656 - RNA, 20 nt, Human
uagagcaugaaguccuaucc

SEQ ID NO: 106657 - RNA, 22 nt, Human
uagagcauucuaucuccaacag

SEQ ID NO: 106658 - RNA, 21 nt, Human
uagagccagugguguucugac

SEQ ID NO: 106659 - RNA, 22 nt, Human
uagagcuagcuucaaaaugcga

SEQ ID NO: 106660 - RNA, 22 nt, Human
uagagcuauuuaucagccagaa

SEQ ID NO: 106661 - RNA, 22 nt, Human
uagagcugaguugacuccauuu

SEQ ID NO: 106662 - RNA, 23 nt, Human
uagagcuucagcgaaugugcuca

SEQ ID NO: 106663 - RNA, 19 nt, Human
uagagcuuguuuuaggaag

SEQ ID NO: 106664 - RNA, 22 nt, Human
uagaggaaauuuccaaggugag

SEQ ID NO: 106665 - RNA, 22 nt, Human
uagaggagaguugcuggaugga

SEQ ID NO: 106666 - RNA, 22 nt, Human
uagaggagggcuguucuucagu

SEQ ID NO: 106667 - RNA, 22 nt, Human
uagaggcaaccaguguugagaa

SEQ ID NO: 106668 - RNA, 22 nt, Human
augcugugccuucucugugcca

SEQ ID NO: 106669 - RNA, 22 nt, Human
augcuguggccagaguucaacu

SEQ ID NO: 106670 - RNA, 22 nt, Human
augcugugucaccuuaggauuu

SEQ ID NO: 106671 - RNA, 22 nt, Human
augcuguguccuagugaaagaa

SEQ ID NO: 106672 - RNA, 22 nt, Human
augcugugucuagcaggaacac

SEQ ID NO: 106673 - RNA, 22 nt, Human
augcuuaaaaggcugcguuaga

SEQ ID NO: 106674 - RNA, 22 nt, Human
augcuuaacuuccuagucuaua

SEQ ID NO: 106675 - RNA, 22 nt, Human
augcuuaauacacuguuaaagg

SEQ ID NO: 106676 - RNA, 22 nt, Human
augcuucagauuugggguauua

SEQ ID NO: 106677 - RNA, 22 nt, Human
augcuucaugauuuggccaugu

SEQ ID NO: 106678 - RNA, 22 nt, Human
augcuuccaacaguucugugaa

SEQ ID NO: 106679 - RNA, 23 nt, Human
augcuuccacagagcuugcagcc

SEQ ID NO: 106680 - RNA, 22 nt, Human
augcuuccaugaacguucuugu

SEQ ID NO: 106681 - RNA, 22 nt, Human
augcuucccucacauauccugg

SEQ ID NO: 106682 - RNA, 22 nt, Human
augcuucugcucauauuucauu

SEQ ID NO: 106683 - RNA, 22 nt, Human
augcuucuguaaugugggaaug

SEQ ID NO: 106684 - RNA, 22 nt, Human
augcuuggaugcugccauggga

SEQ ID NO: 106685 - RNA, 22 nt, Human
augcuuggccccuuuauagccu

SEQ ID NO: 106686 - RNA, 22 nt, Human
augcuuuaaaacguauguguaa

SEQ ID NO: 106687 - RNA, 22 nt, Human
augcuuuaaaugucuuuugcuu

SEQ ID NO: 106688 - RNA, 22 nt, Human
augcuuuacgacaaaaaacuca

SEQ ID NO: 106689 - RNA, 22 nt, Human
augcuuuaguucaaaggacuua

SEQ ID NO: 106690 - RNA, 22 nt, Human
augcuuuauacaaaacacuuaa

SEQ ID NO: 106691 - RNA, 22 nt, Human
augcuuuauguucuggcauuuu

SEQ ID NO: 106692 - RNA, 22 nt, Human
augcuuucuucuuuccuguaag

SEQ ID NO: 106693 - RNA, 22 nt, Human
auggaaagggaagcaaggaaca

SEQ ID NO: 106694 - RNA, 22 nt, Human
auggaaauacagccagagcaga

SEQ ID NO: 106695 - RNA, 23 nt, Human
auggaaauagcaugugucauuua

SEQ ID NO: 106696 - RNA, 22 nt, Human
auggaaaucgaugucuaaguua

SEQ ID NO: 106697 - RNA, 22 nt, Human
auggaaauggagggugcuagaa

SEQ ID NO: 106698 - RNA, 22 nt, Human
auggaaauguuccauauauuga

SEQ ID NO: 106699 - RNA, 22 nt, Human
auggaacaagaacucagauuua

SEQ ID NO: 106700 - RNA, 22 nt, Human
auggaacaucagguuaagaaau

SEQ ID NO: 106701 - RNA, 22 nt, Human
auggaacugagcuugccaaacu

SEQ ID NO: 106702 - RNA, 22 nt, Human
auggaacugcuaauaauaguug

SEQ ID NO: 106703 - RNA, 22 nt, Human
auggaagaacgcucaggguuac

SEQ ID NO: 106704 - RNA, 22 nt, Human
auggaagacagauaaggcagaa

SEQ ID NO: 106705 - RNA, 22 nt, Human
auggaagcagacagguaauucc

SEQ ID NO: 106706 - RNA, 23 nt, Human
auggaagucacuguuuucuuguc

SEQ ID NO: 106707 - RNA, 22 nt, Human
auggaaugccaaguucacugcu

SEQ ID NO: 106708 - RNA, 22 nt, Human
auggaauuaaaagucaaguaau

SEQ ID NO: 106709 - RNA, 22 nt, Human
auggaauugagcaucaguuguu

SEQ ID NO: 106710 - RNA, 22 nt, Human
auggaauuucuccggcuccacc

SEQ ID NO: 106711 - RNA, 22 nt, Human
auggaauuugcaauaacaggau

SEQ ID NO: 106712 - RNA, 21 nt, Human
auggacaauugagugucuguc

SEQ ID NO: 106713 - RNA, 22 nt, Human
auggacagaagguagcaccuau

SEQ ID NO: 106714 - RNA, 22 nt, Human
auggacagagcugagcuccacc

SEQ ID NO: 106715 - RNA, 22 nt, Human
auggacagauuaacacaguaga

SEQ ID NO: 106716 - RNA, 22 nt, Human
auggacagcucuuaugugggca

SEQ ID NO: 106717 - RNA, 22 nt, Human
auggacaggcuuauaacagcaa

SEQ ID NO: 106718 - RNA, 23 nt, Human
auggacaggguuucagggucaca

SEQ ID NO: 106719 - RNA, 22 nt, Human
auggacagguacugcagugggu

SEQ ID NO: 106720 - RNA, 22 nt, Human
auggacaguacugaguggacua

SEQ ID NO: 106721 - RNA, 21 nt, Human
auggagggaccagggaagcag

SEQ ID NO: 106722 - RNA, 22 nt, Human
auggagguguuugauaauuugg

SEQ ID NO: 106723 - RNA, 22 nt, Human
auggaguaauauuaacauguua

SEQ ID NO: 106724 - RNA, 22 nt, Human
auggagugggccaauuuuagug

SEQ ID NO: 106725 - RNA, 22 nt, Human
auggaguucugccagcgcugcu

SEQ ID NO: 106726 - RNA, 22 nt, Human
auggauaguggugaaggcugua

SEQ ID NO: 106727 - RNA, 22 nt, Human
auggaucuaccuucaggcucug

SEQ ID NO: 106728 - RNA, 22 nt, Human
auggaugaguccuugagacaca

SEQ ID NO: 106729 - RNA, 22 nt, Human
auggauucauuaaugacuucuc

SEQ ID NO: 106730 - RNA, 22 nt, Human
auggcaauguggcuuauuugga

SEQ ID NO: 106731 - RNA, 22 nt, Human
auggcacacaggucugcaaggg

SEQ ID NO: 106732 - RNA, 18 nt, Human
auggcacagucuuucccu

SEQ ID NO: 106733 - RNA, 22 nt, Human
auggcacuaagagggagcugga

SEQ ID NO: 106734 - RNA, 22 nt, Human
auggcacugaccucccuuguaa

SEQ ID NO: 106735 - RNA, 22 nt, Human
auggcagaagucaagaugaguu

SEQ ID NO: 106736 - RNA, 22 nt, Human
auggcagacacaggcaggcaga

SEQ ID NO: 106737 - RNA, 18 nt, Human
auggcagaugauaagugc

SEQ ID NO: 106738 - RNA, 22 nt, Human
auggcagauggcuggagcaggu

SEQ ID NO: 106739 - RNA, 22 nt, Human
auggcagcaaaugucuggcugg

SEQ ID NO: 106740 - RNA, 22 nt, Human
auggcagcagcuuuagcugugg

SEQ ID NO: 106741 - RNA, 22 nt, Human
cagccuuugggucagaagauuc

SEQ ID NO: 106742 - RNA, 22 nt, Human
cagccuuugugaacaucaggug

SEQ ID NO: 106743 - RNA, 22 nt, Human
cagcgcugugggaacagggcua

SEQ ID NO: 106744 - RNA, 22 nt, Human
cagcggaggacagaugggagcu

SEQ ID NO: 106745 - RNA, 22 nt, Human
cagcgucucguugugggccucg

SEQ ID NO: 106746 - RNA, 22 nt, Human
cagcuaaggcuccuucuaggua

SEQ ID NO: 106747 - RNA, 22 nt, Human
cagcuaauccucucuauccaag

SEQ ID NO: 106748 - RNA, 22 nt, Human
cagcuacaaauacuuuuguaug

SEQ ID NO: 106749 - RNA, 22 nt, Human
cagcuacacuucuggguguguc

SEQ ID NO: 106750 - RNA, 22 nt, Human
cagcuacaggaccugaugcacc

SEQ ID NO: 106751 - RNA, 22 nt, Human
cagcuaccaugguuuguuccag

SEQ ID NO: 106752 - RNA, 22 nt, Human
cagcuagaaagucuguuaggga

SEQ ID NO: 106753 - RNA, 22 nt, Human
cagcuagcggugcuggcggcuc

SEQ ID NO: 106754 - RNA, 22 nt, Human
cagcuauugauaaauguugggg

SEQ ID NO: 106755 - RNA, 22 nt, Human
cagcuauuggcaagaaguggug

SEQ ID NO: 106756 - RNA, 22 nt, Human
cagcuauugguccacagguaug

SEQ ID NO: 106757 - RNA, 22 nt, Human
cagcucagcuuccugggugugu

SEQ ID NO: 106758 - RNA, 19 nt, Human
cagcucaguuugauucucu

SEQ ID NO: 106759 - RNA, 22 nt, Human
cagcuccacuugaguggggccu

SEQ ID NO: 106760 - RNA, 22 nt, Human
cagcuccccaugguuccugaag

SEQ ID NO: 106761 - RNA, 22 nt, Human
cagcuccuaugaguaugauucc

SEQ ID NO: 106762 - RNA, 22 nt, Human
cagcuccucuguuagcccuggg

SEQ ID NO: 106763 - RNA, 22 nt, Human
cagcuccugcagcugcugccgu

SEQ ID NO: 106764 - RNA, 22 nt, Human
cagcucuacguuucuaugaauc

SEQ ID NO: 106765 - RNA, 22 nt, Human
cagcucucacacccuccuccca

SEQ ID NO: 106766 - RNA, 22 nt, Human
cagcucucacacuuagcuucua

SEQ ID NO: 106767 - RNA, 22 nt, Human
cagcucucuaaggucuugcuuu

SEQ ID NO: 106768 - RNA, 22 nt, Human
cagcucugaagaaaggugucua

SEQ ID NO: 106769 - RNA, 22 nt, Human
cagcucugacacaguacaaaau

SEQ ID NO: 106770 - RNA, 17 nt, Human
cagcucugcaucuuccu

SEQ ID NO: 106771 - RNA, 22 nt, Human
cagcucugcuuccuuguacagg

SEQ ID NO: 106772 - RNA, 20 nt, Human
cagcucugggcaggucgagg

SEQ ID NO: 106773 - RNA, 22 nt, Human
cagcucuguucauagauggugc

SEQ ID NO: 106774 - RNA, 22 nt, Human
cagcucuguugccaaagugggc

SEQ ID NO: 106775 - RNA, 22 nt, Human
cagcucuuauuuucucuccuaa

SEQ ID NO: 106776 - RNA, 22 nt, Human
cagcucuuccuagccaugccac

SEQ ID NO: 106777 - RNA, 22 nt, Human
auggcuagcaccgcguugcugg

SEQ ID NO: 106778 - RNA, 22 nt, Human
auggcucagcccauggaagaaa

SEQ ID NO: 106779 - RNA, 22 nt, Human
auggcucagcgccuuucugugg

SEQ ID NO: 106780 - RNA, 22 nt, Human
auggcucauuuaucuugcagcc

SEQ ID NO: 106781 - RNA, 22 nt, Human
auggcuccaagauggagagcca

SEQ ID NO: 106782 - RNA, 22 nt, Human
auggcuccuucugugcaguuuu

SEQ ID NO: 106783 - RNA, 22 nt, Human
auggcucugcugggcaaagcaa

SEQ ID NO: 106784 - RNA, 20 nt, Human
auggcucuguuuggcaguga

SEQ ID NO: 106785 - RNA, 21 nt, Human
auggcugaugauauugaacau

SEQ ID NO: 106786 - RNA, 22 nt, Human
auggcugcaguccgugcccugg

SEQ ID NO: 106787 - RNA, 22 nt, Human
auggcugcugccuuccccugcu

SEQ ID NO: 106788 - RNA, 22 nt, Human
auggcugcuucaguaccaguuc

SEQ ID NO: 106789 - RNA, 22 nt, Human
auggcugcuuucccuuagcacc

SEQ ID NO: 106790 - RNA, 22 nt, Human
auggcuggaagagucgaagagu

SEQ ID NO: 106791 - RNA, 22 nt, Human
auggcuggaggccgggcuuccu

SEQ ID NO: 106792 - RNA, 22 nt, Human
auggcuggauaguugaagcucu

SEQ ID NO: 106793 - RNA, 22 nt, Human
auggcuggauuugauccauggg

SEQ ID NO: 106794 - RNA, 22 nt, Human
auggcugggcuuuuagucagau

SEQ ID NO: 106795 - RNA, 22 nt, Human
auggcugugagcaggcagcuuc

SEQ ID NO: 106796 - RNA, 22 nt, Human
auggcuguguuguuccucugaa

SEQ ID NO: 106797 - RNA, 22 nt, Human
auggcuguuccugggaguucua

SEQ ID NO: 106798 - RNA, 22 nt, Human
auggcuuaagaaugcuuuugug

SEQ ID NO: 106799 - RNA, 22 nt, Human
auggcuuaugguaaauauuucu

SEQ ID NO: 106800 - RNA, 22 nt, Human
auggcuucucgcuggcaccugu

SEQ ID NO: 106801 - RNA, 22 nt, Human
auggcuugcagagaaaagaggu

SEQ ID NO: 106802 - RNA, 22 nt, Human
auggcuuggcaccaucuccuug

SEQ ID NO: 106803 - RNA, 22 nt, Human
auggcuuucagauuucuauguu

SEQ ID NO: 106804 - RNA, 22 nt, Human
auggcuuucuguguuuccguag

SEQ ID NO: 106805 - RNA, 22 nt, Human
auggcuuugaaguucagcuuuu

SEQ ID NO: 106806 - RNA, 22 nt, Human
auggcuuuguguucagagcuga

SEQ ID NO: 106807 - RNA, 22 nt, Human
auggcuuuugaugcuaagccaa

SEQ ID NO: 106808 - RNA, 19 nt, Human
augggaagcggccagcgga

SEQ ID NO: 106809 - RNA, 22 nt, Human
augggaagcugaccugcaugga

SEQ ID NO: 106810 - RNA, 22 nt, Human
augggaauauaauuuuagcaac

SEQ ID NO: 106811 - RNA, 22 nt, Human
augggacacacaaggaaguaaa

SEQ ID NO: 106812 - RNA, 22 nt, Human
augggacagguacuagaaaggg

SEQ ID NO: 106813 - RNA, 22 nt, Human
augggaggaaggaggcccuuga

SEQ ID NO: 106814 - RNA, 22 nt, Human
augggaggcaaagaucgcagaa

SEQ ID NO: 106815 - RNA, 22 nt, Human
augggaggcaggcucagaaccg

SEQ ID NO: 106816 - RNA, 22 nt, Human
augggaugcauggcuguggcca

SEQ ID NO: 106817 - RNA, 22 nt, Human
augggcagagcuggugggaggc

SEQ ID NO: 106818 - RNA, 22 nt, Human
augggcagcagcugccauucau

SEQ ID NO: 106819 - RNA, 22 nt, Human
augggcagcugcagcaguggug

SEQ ID NO: 106820 - RNA, 22 nt, Human
augggcaugcuucuaguugaaa

SEQ ID NO: 106821 - RNA, 22 nt, Human
augggccuugacacauggagug

SEQ ID NO: 106822 - RNA, 22 nt, Human
augggcugacaagacaugcaua

SEQ ID NO: 106823 - RNA, 22 nt, Human
augggcugaggaagcuccugag

SEQ ID NO: 106824 - RNA, 22 nt, Human
augggcugcuucuccagcaccu

SEQ ID NO: 106825 - RNA, 22 nt, Human
augggcuggggaagcucacucc

SEQ ID NO: 106826 - RNA, 20 nt, Human
augggcugguuaggaagugu

SEQ ID NO: 106827 - RNA, 22 nt, Human
augggcuguccuaguccagccc

SEQ ID NO: 106828 - RNA, 23 nt, Human
augggcuuagaaagcaaguggga

SEQ ID NO: 106829 - RNA, 22 nt, Human
auggggagagaagggcugagcu

SEQ ID NO: 106830 - RNA, 22 nt, Human
auggggagagccucugucccca

SEQ ID NO: 106831 - RNA, 22 nt, Human
auggggcuguucucugcccugc

SEQ ID NO: 106832 - RNA, 22 nt, Human
auggguaaggcugaaggaaagu

SEQ ID NO: 106833 - RNA, 22 nt, Human
auggguaaggguguuugguuag

SEQ ID NO: 106834 - RNA, 22 nt, Human
auggguagacugacaaagucaa

SEQ ID NO: 106835 - RNA, 22 nt, Human
augggugugaaaauggucaucu

SEQ ID NO: 106836 - RNA, 22 nt, Human
augguaaauuuuaccuuaugua

SEQ ID NO: 106837 - RNA, 22 nt, Human
augguacaaugauggauagugg

SEQ ID NO: 106838 - RNA, 22 nt, Human
augguacaauguguuuguuagg

SEQ ID NO: 106839 - RNA, 22 nt, Human
augguacaauuuucauuugugg

SEQ ID NO: 106840 - RNA, 22 nt, Human
auggucacagagcuuaauuaau

SEQ ID NO: 106841 - RNA, 22 nt, Human
auggucaguugcagcuaauguu

SEQ ID NO: 106842 - RNA, 23 nt, Human
augguccagccagcugcacagga

SEQ ID NO: 106843 - RNA, 22 nt, Human
augguccuuuuugccuggaugc

SEQ ID NO: 106844 - RNA, 22 nt, Human
auggucuguuaggagcuacuuu

SEQ ID NO: 106845 - RNA, 22 nt, Human
auggucuugugagaguaacagu

SEQ ID NO: 106846 - RNA, 22 nt, Human
augguggaaucggcgugaaugg

SEQ ID NO: 106847 - RNA, 22 nt, Human
augguggacgggagacaggacu

SEQ ID NO: 106848 - RNA, 22 nt, Human
augguggagguguauucuggau

SEQ ID NO: 106849 - RNA, 22 nt, Human
augguggugaagagcacaguga

SEQ ID NO: 106850 - RNA, 22 nt, Human
augguuaaauugguuauuuaug

SEQ ID NO: 106851 - RNA, 22 nt, Human
augguuauuacugcuguuccag

SEQ ID NO: 106852 - RNA, 22 nt, Human
augguucauauuaugcaucuga

SEQ ID NO: 106853 - RNA, 22 nt, Human
augguugaacuuaaagggaaug

SEQ ID NO: 106854 - RNA, 22 nt, Human
augguuuauaggacagcucugu

SEQ ID NO: 106855 - RNA, 22 nt, Human
augguuuuagaaucaggaaaaa

SEQ ID NO: 106856 - RNA, 22 nt, Human
augguuuuccucugcugcuuaa

SEQ ID NO: 106857 - RNA, 20 nt, Human
auguaaaagacagggaguag

SEQ ID NO: 106858 - RNA, 21 nt, Human
caggaaacugaggccaugggg

SEQ ID NO: 106859 - RNA, 22 nt, Human
caggaaacugugggcuuaaauc

SEQ ID NO: 106860 - RNA, 22 nt, Human
caggaaaggugugucaugaugg

SEQ ID NO: 106861 - RNA, 22 nt, Human
caggaaauaguucagucaaacu

SEQ ID NO: 106862 - RNA, 22 nt, Human
caggaaauauaggaaaaggaac

SEQ ID NO: 106863 - RNA, 22 nt, Human
caggaaauucuuuuguuugugc

SEQ ID NO: 106864 - RNA, 22 nt, Human
caggaaauuuauguucuacuua

SEQ ID NO: 106865 - RNA, 22 nt, Human
caggaacaaucuuacuacuauu

SEQ ID NO: 106866 - RNA, 22 nt, Human
caggaacacaaguucagggaug

SEQ ID NO: 106867 - RNA, 22 nt, Human
caggaacacaaugagucucaaa

SEQ ID NO: 106868 - RNA, 22 nt, Human
caggaacaugucuccaauuaga

SEQ ID NO: 106869 - RNA, 22 nt, Human
caggaacauuguagaauugaaa

SEQ ID NO: 106870 - RNA, 22 nt, Human
caggaacccaaugggccaggcc

SEQ ID NO: 106871 - RNA, 22 nt, Human
caggaaccuaaagagacauuac

SEQ ID NO: 106872 - RNA, 18 nt, Human
caggaaccucuccuuuuu

SEQ ID NO: 106873 - RNA, 22 nt, Human
caggaagaccagggcuguggcu

SEQ ID NO: 106874 - RNA, 14 nt, Human
caggaagacucagc

SEQ ID NO: 106875 - RNA, 22 nt, Human
caggaagagguggggcuaaagu

SEQ ID NO: 106876 - RNA, 22 nt, Human
caggaagauuguggaggugguu

SEQ ID NO: 106877 - RNA, 22 nt, Human
caggaagcaucuggcuagcuaa

SEQ ID NO: 106878 - RNA, 22 nt, Human
caggaagcuggucagauccugu

SEQ ID NO: 106879 - RNA, 22 nt, Human
caggaagcugugaaggagacgg

SEQ ID NO: 106880 - RNA, 22 nt, Human
caggaaggaaaggguguggaga

SEQ ID NO: 106881 - RNA, 22 nt, Human
caggaagggaaaauaguucggg

SEQ ID NO: 106882 - RNA, 19 nt, Human
caggaaggggcgaaucugg

SEQ ID NO: 106883 - RNA, 22 nt, Human
caggaagucgcagagcuggggg

SEQ ID NO: 106884 - RNA, 22 nt, Human
caggaagugcucgcugugggga

SEQ ID NO: 106885 - RNA, 22 nt, Human
caggaaguggcugggcuggguu

SEQ ID NO: 106886 - RNA, 22 nt, Human
caguaaaugaugauagugccuu

SEQ ID NO: 106887 - RNA, 22 nt, Human
caguaaaugcagauauagauac

SEQ ID NO: 106888 - RNA, 22 nt, Human
caguaaauuugagggaucuaau

SEQ ID NO: 106889 - RNA, 22 nt, Human
caguaacagugaucaccugugg

SEQ ID NO: 106890 - RNA, 22 nt, Human
caguaacaugucuguuaagaaa

SEQ ID NO: 106891 - RNA, 22 nt, Human
caguaaguauucgagucuccau

SEQ ID NO: 106892 - RNA, 22 nt, Human
caguaauagcagagucuuccau

SEQ ID NO: 106893 - RNA, 22 nt, Human
caguaauuccaagugcuuauac

SEQ ID NO: 106894 - RNA, 22 nt, Human
caguacauaaugcgcaaaaccg

SEQ ID NO: 106895 - RNA, 22 nt, Human
caguaccagucaccacauugau

SEQ ID NO: 106896 - RNA, 22 nt, Human
caguacugcuugugggagcaga

SEQ ID NO: 106897 - RNA, 22 nt, Human
caguacuucuuggaaacuggau

SEQ ID NO: 106898 - RNA, 22 nt, Human
caguacuugggaaugcugggga

SEQ ID NO: 106899 - RNA, 22 nt, Human
caguacuuguccucagguguua

SEQ ID NO: 106900 - RNA, 22 nt, Human
caguacuuuucuggcuuucuac

SEQ ID NO: 106901 - RNA, 22 nt, Human
caguagaagcuuguuuuucaga

SEQ ID NO: 106902 - RNA, 22 nt, Human
caguagauuugguaaacuagga

SEQ ID NO: 106903 - RNA, 22 nt, Human
caguagcacucugucagugaag

SEQ ID NO: 106904 - RNA, 22 nt, Human
caguagcaggcacucagcacgu

SEQ ID NO: 106905 - RNA, 22 nt, Human
caguagccuuauuuggaucauu

SEQ ID NO: 106906 - RNA, 22 nt, Human
caguaggaaggaugcagaaaaa

SEQ ID NO: 106907 - RNA, 22 nt, Human
caguaguaguuaaacuguguau

SEQ ID NO: 106908 - RNA, 22 nt, Human
caguagucuuuuuccuccuaga

SEQ ID NO: 106909 - RNA, 21 nt, Human
caguagugagguauuugccaa

SEQ ID NO: 106910 - RNA, 18 nt, Human
caguauaaccagcaacuc

SEQ ID NO: 106911 - RNA, 22 nt, Human
caguauaagagugaggaagggc

SEQ ID NO: 106912 - RNA, 22 nt, Human
caguauagaaaguuuuaaauug

SEQ ID NO: 106913 - RNA, 20 nt, Human
caguaucugaagccacacaa

SEQ ID NO: 106914 - RNA, 22 nt, Human
caguaugagaguugaaucaagg

SEQ ID NO: 106915 - RNA, 22 nt, Human
caguaugauugccaguucuauc

SEQ ID NO: 106916 - RNA, 22 nt, Human
caguaugcaguugaaaauaagc

SEQ ID NO: 106917 - RNA, 22 nt, Human
caguauguucuuccaggacaga

SEQ ID NO: 106918 - RNA, 22 nt, Human
caguauucaucuaaggagcuug

SEQ ID NO: 106919 - RNA, 22 nt, Human
caguauuuccucuucuuaacuu

SEQ ID NO: 106920 - RNA, 22 nt, Human
caguauuuguuacagcauuagc

SEQ ID NO: 106921 - RNA, 22 nt, Human
caguauuuucaggauuuggaag

SEQ ID NO: 106922 - RNA, 22 nt, Human
caguauuuuccuuguuaacuua

SEQ ID NO: 106923 - RNA, 22 nt, Human
cagucacauagguauacacaua

SEQ ID NO: 106924 - RNA, 22 nt, Human
cagucacauggaugauggauag

SEQ ID NO: 106925 - RNA, 22 nt, Human
cagucaccauagaauaaaacau

SEQ ID NO: 106926 - RNA, 22 nt, Human
cagucaccuugaggacucagac

SEQ ID NO: 106927 - RNA, 22 nt, Human
cagucagaggucuucuaaaaca

SEQ ID NO: 106928 - RNA, 22 nt, Human
cagucagagucacaguaauuug

SEQ ID NO: 106929 - RNA, 22 nt, Human
cagucaggggugggaucaaggc

SEQ ID NO: 106930 - RNA, 20 nt, Human
caguccaaucagaggccacc

SEQ ID NO: 106931 - RNA, 22 nt, Human
caguccagcccccugcuaaaag

SEQ ID NO: 106932 - RNA, 20 nt, Human
caguccaggcuagaaaacaa

SEQ ID NO: 106933 - RNA, 22 nt, Human
cagucccaaggaggaagcaguc

SEQ ID NO: 106934 - RNA, 22 nt, Human
cagucccagacccagaaggugg

SEQ ID NO: 106935 - RNA, 22 nt, Human
caguccucucugugucugcacc

SEQ ID NO: 106936 - RNA, 22 nt, Human
caguccugagccaaucaugaug

SEQ ID NO: 106937 - RNA, 21 nt, Human
caguccugcaaauaauucuuu

SEQ ID NO: 106938 - RNA, 20 nt, Human
caguccugccccuuggggac

SEQ ID NO: 106939 - RNA, 22 nt, Human
caguccugcuggccuucccugg

SEQ ID NO: 106940 - RNA, 22 nt, Human
caguccuggagcccuucuuggc

SEQ ID NO: 106941 - RNA, 22 nt, Human
caguccugggcaggucaggcca

SEQ ID NO: 106942 - RNA, 22 nt, Human
caguccuuaaggaaacauuugu

SEQ ID NO: 106943 - RNA, 22 nt, Human
caguccuucuccauuaaggcuc

SEQ ID NO: 106944 - RNA, 22 nt, Human
caguccuugauccaauaguggg

SEQ ID NO: 106945 - RNA, 22 nt, Human
caguccuugcuaugacccugag

SEQ ID NO: 106946 - RNA, 22 nt, Human
caguccuugcucaaagucuaca

SEQ ID NO: 106947 - RNA, 22 nt, Human
cagucuaacuucacagccugga

SEQ ID NO: 106948 - RNA, 22 nt, Human
cagucuaaguuaauuuccacaa

SEQ ID NO: 106949 - RNA, 22 nt, Human
cagucuaaucuguuacucauua

SEQ ID NO: 106950 - RNA, 22 nt, Human
cagucuagaugcuagaaaauau

SEQ ID NO: 106951 - RNA, 22 nt, Human
cagucucagaggugggaguggg

SEQ ID NO: 106952 - RNA, 22 nt, Human
cagucuccaaaucagucugaau

SEQ ID NO: 106953 - RNA, 23 nt, Human
cagucucuccccggacagcaaaa

SEQ ID NO: 106954 - RNA, 22 nt, Human
cagucucucugaaguauuaaga

SEQ ID NO: 106955 - RNA, 22 nt, Human
cagucucugccacuucuaagcu

SEQ ID NO: 106956 - RNA, 22 nt, Human
cagucucuggcagcugcuggcc

SEQ ID NO: 106957 - RNA, 22 nt, Human
cagucucuugcuucauuaguug

SEQ ID NO: 106958 - RNA, 22 nt, Human
cagucucuuuauccaccaagcc

SEQ ID NO: 106959 - RNA, 22 nt, Human
cagucugauguucgcaggugaa

SEQ ID NO: 106960 - RNA, 22 nt, Human
cagucuuaggagaaacuacaga

SEQ ID NO: 106961 - RNA, 22 nt, Human
cagugaaauaguggacaucaaa

SEQ ID NO: 106962 - RNA, 22 nt, Human
cagugagagagaacgcauucau

SEQ ID NO: 106963 - RNA, 22 nt, Human
cagugagcuccugucugucccu

SEQ ID NO: 106964 - RNA, 22 nt, Human
cagugaggaagcugucuggacc

SEQ ID NO: 106965 - RNA, 18 nt, Human
cagugaggaugaaggguu

SEQ ID NO: 106966 - RNA, 17 nt, Human
cagugaggccuuuccuc

SEQ ID NO: 106967 - RNA, 22 nt, Human
cagugagggcauucagugcugg

SEQ ID NO: 106968 - RNA, 22 nt, Human
cagugagguagacagcuuuuuc

SEQ ID NO: 106969 - RNA, 22 nt, Human
cagugaggugcccagccugccc

SEQ ID NO: 106970 - RNA, 22 nt, Human
cagugaguaaguagacagcuua

SEQ ID NO: 106971 - RNA, 22 nt, Human
cagugaguccaagauggcugaa

SEQ ID NO: 106972 - RNA, 22 nt, Human
cagugaguucaucaagacauga

SEQ ID NO: 106973 - RNA, 22 nt, Human
cagugauaggacagcuagaacu

SEQ ID NO: 106974 - RNA, 22 nt, Human
cagugaugaucauuguaacauc

SEQ ID NO: 106975 - RNA, 22 nt, Human
cagugauggauauggagaaguc

SEQ ID NO: 106976 - RNA, 22 nt, Human
cagugauucagacucaucauuu

SEQ ID NO: 106977 - RNA, 22 nt, Human
cagugauuuuaaacuauggaug

SEQ ID NO: 106978 - RNA, 22 nt, Human
cagugauuuucucagaacuuga

SEQ ID NO: 106979 - RNA, 22 nt, Human
cagugcaacagauucgagaagc

SEQ ID NO: 106980 - RNA, 22 nt, Human
cagugcaacguugugcauucaa

SEQ ID NO: 106981 - RNA, 22 nt, Human
cagugcaauguuaaauaggaaa

SEQ ID NO: 106982 - RNA, 22 nt, Human
cagugcacacaauccucugccg

SEQ ID NO: 106983 - RNA, 22 nt, Human
cagugcagaggugcaagcaugu

SEQ ID NO: 106984 - RNA, 23 nt, Human
cagugcagggcaacucagacucc

SEQ ID NO: 106985 - RNA, 21 nt, Human
cagugcagggguuagcgugua

SEQ ID NO: 106986 - RNA, 22 nt, Human
cagugcaguggcugagcuggag

SEQ ID NO: 106987 - RNA, 22 nt, Human
cagugcaguugguggcaggggu

SEQ ID NO: 106988 - RNA, 20 nt, Human
cagugcauugcuucugauuu

SEQ ID NO: 106989 - RNA, 22 nt, Human
cagugccaggagacaagaucag

SEQ ID NO: 106990 - RNA, 22 nt, Human
cagugccauauugaaagacauu

SEQ ID NO: 106991 - RNA, 22 nt, Human
auuauuguugcggcuguuaccg

SEQ ID NO: 106992 - RNA, 22 nt, Human
auuauuuagaaaucgauugaaa

SEQ ID NO: 106993 - RNA, 22 nt, Human
auuauuucagucagacacuggc

SEQ ID NO: 106994 - RNA, 22 nt, Human
auuauuuccuugcuuugaggaa

SEQ ID NO: 106995 - RNA, 22 nt, Human
auugacuuaaaggcucugguua

SEQ ID NO: 106996 - RNA, 22 nt, Human
auugacuuucccuucuccucau

SEQ ID NO: 106997 - RNA, 22 nt, Human
auucucaguucacuaguuucuu

SEQ ID NO: 106998 - RNA, 22 nt, Human
auucuccagcucacuguccaua

SEQ ID NO: 106999 - RNA, 22 nt, Human
auucuccaucaccacuggcacu

SEQ ID NO: 107000 - RNA, 19 nt, Human
auucucccuagaauuuuga

SEQ ID NO: 107001 - RNA, 22 nt, Human
auucucugaagucaauggaaau

SEQ ID NO: 107002 - RNA, 22 nt, Human
auucucugaugcagguggaaga

SEQ ID NO: 107003 - RNA, 22 nt, Human
auucucuggaagaagauaaaaa

SEQ ID NO: 107004 - RNA, 22 nt, Human
auucucuggcuaaaaccugaag

SEQ ID NO: 107005 - RNA, 22 nt, Human
auucucuggguuccaguaaaug

SEQ ID NO: 107006 - RNA, 22 nt, Human
auucucuggucauugaguauaa

SEQ ID NO: 107007 - RNA, 19 nt, Human
auucucugguuugcuggcu

SEQ ID NO: 107008 - RNA, 21 nt, Human
auucucugugaugggauuagg

SEQ ID NO: 107009 - RNA, 22 nt, Human
auucucugugcagauuuaagac

SEQ ID NO: 107010 - RNA, 22 nt, Human
auucucuguggugaugcuggug

SEQ ID NO: 107011 - RNA, 22 nt, Human
auucucuucugaugucuugcca

SEQ ID NO: 107012 - RNA, 22 nt, Human
auucugaauucugagccuuuca

SEQ ID NO: 107013 - RNA, 22 nt, Human
auucugagacaauugccgucag

SEQ ID NO: 107014 - RNA, 22 nt, Human
auucugaguacaacaagauguu

SEQ ID NO: 107015 - RNA, 23 nt, Human
auucugagucagaaaguuugggg

SEQ ID NO: 107016 - RNA, 22 nt, Human
auucugaugcuucacaaaggua

SEQ ID NO: 107017 - RNA, 22 nt, Human
auucugcaacuguuguuggugg

SEQ ID NO: 107018 - RNA, 22 nt, Human
auucugcacauccaagaacagg

SEQ ID NO: 107019 - RNA, 22 nt, Human
auucugcacuuccuuugcuucc

SEQ ID NO: 107020 - RNA, 22 nt, Human
auucugcauaauuuccuggcag

SEQ ID NO: 107021 - RNA, 22 nt, Human
auucugcauugcucacaaagau

SEQ ID NO: 107022 - RNA, 22 nt, Human
auucugcuaguuaauaucucuc

SEQ ID NO: 107023 - RNA, 22 nt, Human
auucugcugccuaguuuaugaa

SEQ ID NO: 107024 - RNA, 22 nt, Human
auucuggaaagcuauucucucu

SEQ ID NO: 107025 - RNA, 22 nt, Human
auucuggacaaggcaagcuccu

SEQ ID NO: 107026 - RNA, 22 nt, Human
auucuggauuaucaguccacca

SEQ ID NO: 107027 - RNA, 22 nt, Human
auucugggccccaucccagacc

SEQ ID NO: 107028 - RNA, 22 nt, Human
auucugggcgccuauggcugca

SEQ ID NO: 107029 - RNA, 22 nt, Human
auucuggguucaugagugagcu

SEQ ID NO: 107030 - RNA, 22 nt, Human
auucuggguuuuugucuucugu

SEQ ID NO: 107031 - RNA, 22 nt, Human
auucuguauggaaaagcacuau

SEQ ID NO: 107032 - RNA, 22 nt, Human
auucugugauaguugauccuua

SEQ ID NO: 107033 - RNA, 22 nt, Human
auucuuauuauaguaaaacagu

SEQ ID NO: 107034 - RNA, 22 nt, Human
auucuucacaaauauauagaag

SEQ ID NO: 107035 - RNA, 22 nt, Human
auucuucacuguuucagaauga

SEQ ID NO: 107036 - RNA, 22 nt, Human
auucuucagaauaucuggcacu

SEQ ID NO: 107037 - RNA, 22 nt, Human
auucuucauuguugauucaugu

SEQ ID NO: 107038 - RNA, 22 nt, Human
auucuucuugagucuuggacuc

SEQ ID NO: 107039 - RNA, 22 nt, Human
auucuuggagcagucaaagaag

SEQ ID NO: 107040 - RNA, 22 nt, Human
auucuuggcaaggagauuuaaa

SEQ ID NO: 107041 - RNA, 22 nt, Human
auucuuuagccagcagguauau

SEQ ID NO: 107042 - RNA, 22 nt, Human
auucuuucauauaaaggcucag

SEQ ID NO: 107043 - RNA, 22 nt, Human
auucuuuccagacacugauugc

SEQ ID NO: 107044 - RNA, 22 nt, Human
auucuuuuguccuagcuugaua

SEQ ID NO: 107045 - RNA, 22 nt, Human
auugaaacaaguugcuuucuau

SEQ ID NO: 107046 - RNA, 22 nt, Human
auugaaagagaauguagcucuu

SEQ ID NO: 107047 - RNA, 22 nt, Human
auugaaagauaggcuacugugg

SEQ ID NO: 107048 - RNA, 22 nt, Human
auugaaagauauacuguucuca

SEQ ID NO: 107049 - RNA, 22 nt, Human
auugaaaguccuaucuaaggga

SEQ ID NO: 107050 - RNA, 20 nt, Human
auugaaauuuuucugagauu

SEQ ID NO: 107051 - RNA, 23 nt, Human
auugaacagagagaaaaacaucc

SEQ ID NO: 107052 - RNA, 22 nt, Human
auugaagaaacccaaauaaugg

SEQ ID NO: 107053 - RNA, 22 nt, Human
auugaagaguugauuauuaucu

SEQ ID NO: 107054 - RNA, 22 nt, Human
auugaagauuaaaugcuuccuu

SEQ ID NO: 107055 - RNA, 22 nt, Human
auugaagcauggagaugaggca

SEQ ID NO: 107056 - RNA, 22 nt, Human
auugaaguccuaaucuccagua

SEQ ID NO: 107057 - RNA, 22 nt, Human
auugaauagaugcauuauacua

SEQ ID NO: 107058 - RNA, 22 nt, Human
auugacaaaaacaggugguuga

SEQ ID NO: 107059 - RNA, 22 nt, Human
auugacaagacaauggcucuua

SEQ ID NO: 107060 - RNA, 22 nt, Human
auugacaguguuaaaguugccu

SEQ ID NO: 107061 - RNA, 23 nt, Human
auugaccagcugucucauuuuca

SEQ ID NO: 107062 - RNA, 22 nt, Human
auugacuagagucacaguugca

SEQ ID NO: 107063 - RNA, 22 nt, Human
auugacuuccauagcuaccugg

SEQ ID NO: 107064 - RNA, 22 nt, Human
auugagaaaauucgagcaaguu

SEQ ID NO: 107065 - RNA, 22 nt, Human
auugagaaggagauuggcaucu

SEQ ID NO: 107066 - RNA, 22 nt, Human
auugagaaugaagggacauuuu

SEQ ID NO: 107067 - RNA, 22 nt, Human
auugagaauugugaguuuggag

SEQ ID NO: 107068 - RNA, 22 nt, Human
auugagcacaugcuaugugcca

SEQ ID NO: 107069 - RNA, 22 nt, Human
auugagcaccuacuaugugcua

SEQ ID NO: 107070 - RNA, 22 nt, Human
auugagcaccuacuuugugcca

SEQ ID NO: 107071 - RNA, 22 nt, Human
auugagcaggcaaaguaucaua

SEQ ID NO: 107072 - RNA, 22 nt, Human
auugaggagcagagauggggua

SEQ ID NO: 107073 - RNA, 22 nt, Human
auugaggcagcauaguucaggg

SEQ ID NO: 107074 - RNA, 22 nt, Human
auugaguaauaauugaucuugg

SEQ ID NO: 107075 - RNA, 22 nt, Human
auugaguauuguaaauaaaaca

SEQ ID NO: 107076 - RNA, 22 nt, Human
auugauaaauugcaauggggcu

SEQ ID NO: 107077 - RNA, 22 nt, Human
auugauaucaguuugcugauug

SEQ ID NO: 107078 - RNA, 22 nt, Human
auugaucaugcagaugcuucac

SEQ ID NO: 107079 - RNA, 22 nt, Human
auugaugagcauuacucucuaa

SEQ ID NO: 107080 - RNA, 23 nt, Human
auugauucccucuuggaagggau

SEQ ID NO: 107081 - RNA, 22 nt, Human
auugauucuguaagucaacaau

SEQ ID NO: 107082 - RNA, 22 nt, Human
auugcaaagcguagacucuaaa

SEQ ID NO: 107083 - RNA, 22 nt, Human
auugcaaauaaugcgagccagu

SEQ ID NO: 107084 - RNA, 22 nt, Human
auugcaaaugguuuggucaucu

SEQ ID NO: 107085 - RNA, 22 nt, Human
auugcaagugcuagcuaaaaua

SEQ ID NO: 107086 - RNA, 22 nt, Human
auugcaaucuggugaaaacagu

SEQ ID NO: 107087 - RNA, 22 nt, Human
auugcacaaacacagucagacu

SEQ ID NO: 107088 - RNA, 22 nt, Human
auugcagauucuucucagggag

SEQ ID NO: 107089 - RNA, 19 nt, Human
auugcagcuauagacugcc

SEQ ID NO: 107090 - RNA, 22 nt, Human
auugcagcucagggugaugacu

SEQ ID NO: 107091 - RNA, 22 nt, Human
auugcaggcaaagugcuguguc

SEQ ID NO: 107092 - RNA, 22 nt, Human
auugcaguguguguuccaugag

SEQ ID NO: 107093 - RNA, 22 nt, Human
auugcauucauugacauaugag

SEQ ID NO: 107094 - RNA, 22 nt, Human
auugcauuguuugaggcagagg

SEQ ID NO: 107095 - RNA, 22 nt, Human
auugccaccuguugcuauggag

SEQ ID NO: 107096 - RNA, 23 nt, Human
auugccagacggccccugcucgc

SEQ ID NO: 107097 - RNA, 22 nt, Human
auugccaggaggguugagaaua

SEQ ID NO: 107098 - RNA, 22 nt, Human
auugccaugcucauagggucga

SEQ ID NO: 107099 - RNA, 22 nt, Human
auugccuugucagauuucuuuu

SEQ ID NO: 107100 - RNA, 22 nt, Human
auugcucagcacaagcagcaga

SEQ ID NO: 107101 - RNA, 22 nt, Human
auugcugacaccaaguaguagc

SEQ ID NO: 107102 - RNA, 22 nt, Human
auugcugacuuuaauauuauau

SEQ ID NO: 107103 - RNA, 22 nt, Human
auugcuggaugagcucuuggau

SEQ ID NO: 107104 - RNA, 22 nt, Human
cauccuucucaaagagugcaug

SEQ ID NO: 107105 - RNA, 22 nt, Human
caucuaaauuugacuccaagga

SEQ ID NO: 107106 - RNA, 22 nt, Human
caucuaauaccucauuuaaucu

SEQ ID NO: 107107 - RNA, 22 nt, Human
caucuacuuuaaggauucuggg

SEQ ID NO: 107108 - RNA, 22 nt, Human
caucucauccugcccuaaaaca

SEQ ID NO: 107109 - RNA, 22 nt, Human
caucucaugggcaugccaagcu

SEQ ID NO: 107110 - RNA, 22 nt, Human
caucucccacuuccuugggggu

SEQ ID NO: 107111 - RNA, 19 nt, Human
caucucugcaaggagcugc

SEQ ID NO: 107112 - RNA, 22 nt, Human
caucucuugccaaaguuugacc

SEQ ID NO: 107113 - RNA, 22 nt, Human
caucugaaaucugccuacaagc

SEQ ID NO: 107114 - RNA, 22 nt, Human
auugcacaucugcacuacagcc

SEQ ID NO: 107115 - RNA, 22 nt, Human
auugcacuccagcccugcugac

SEQ ID NO: 107116 - RNA, 22 nt, Human
auugcagcuggucaggguaauu

SEQ ID NO: 107117 - RNA, 22 nt, Human
auugcagggacucaauaagaau

SEQ ID NO: 107118 - RNA, 22 nt, Human
auugcagguuguagcccauuag

SEQ ID NO: 107119 - RNA, 22 nt, Human
auugcagugaugguugcauaau

SEQ ID NO: 107120 - RNA, 22 nt, Human
auugcauugcagcuagauuuug

SEQ ID NO: 107121 - RNA, 22 nt, Human
auugcugaaaugaaaggauaug

SEQ ID NO: 107122 - RNA, 22 nt, Human
auugcugaaucuaaggcuucca

SEQ ID NO: 107123 - RNA, 22 nt, Human
auugcugacucaauaauugaag

SEQ ID NO: 107124 - RNA, 22 nt, Human
auugcuggcugccaucuugccc

SEQ ID NO: 107125 - RNA, 22 nt, Human
auugcugguagucagugucccu

SEQ ID NO: 107126 - RNA, 22 nt, Human
auugcuuacagcuauuucugua

SEQ ID NO: 107127 - RNA, 22 nt, Human
auugcuuaucuaucuuuaaguc

SEQ ID NO: 107128 - RNA, 22 nt, Human
auugcuucaacuguucaauggg

SEQ ID NO: 107129 - RNA, 22 nt, Human
auugcuuuguacaugccuagca

SEQ ID NO: 107130 - RNA, 22 nt, Human
auugcuuuuaagcaccaccuaa

SEQ ID NO: 107131 - RNA, 22 nt, Human
auugcuuuucagacaaugaggc

SEQ ID NO: 107132 - RNA, 22 nt, Human
auugcuuuugagcuagaauuuu

SEQ ID NO: 107133 - RNA, 18 nt, Human
auugcuuuuguaccaacc

SEQ ID NO: 107134 - RNA, 22 nt, Human
auuggaaaauaugguuucugga

SEQ ID NO: 107135 - RNA, 22 nt, Human
auuggaaaugcuacaaguuaga

SEQ ID NO: 107136 - RNA, 22 nt, Human
auuggagaagaacaugaauuag

SEQ ID NO: 107137 - RNA, 22 nt, Human
auuggcaggaaccgaggagggg

SEQ ID NO: 107138 - RNA, 22 nt, Human
auuggccauuugcauguauuau

SEQ ID NO: 107139 - RNA, 22 nt, Human
auuggcuauugagugugugcug

SEQ ID NO: 107140 - RNA, 22 nt, Human
auuggcuuugauaucuaaaggg

SEQ ID NO: 107141 - RNA, 22 nt, Human
auugggaagauuuagauccacu

SEQ ID NO: 107142 - RNA, 22 nt, Human
auugggaugccggcugauaaga

SEQ ID NO: 107143 - RNA, 22 nt, Human
auugggcuggauuaggacuguu

SEQ ID NO: 107144 - RNA, 22 nt, Human
auugguaagcaagauggcaaua

SEQ ID NO: 107145 - RNA, 22 nt, Human
auuggucagaguaaauuuauuu

SEQ ID NO: 107146 - RNA, 22 nt, Human
auuggucuaaaguuaagaagau

SEQ ID NO: 107147 - RNA, 22 nt, Human
auuggucuaggcuuuaaaaaga

SEQ ID NO: 107148 - RNA, 22 nt, Human
auuggugcaauuaugagggugu

SEQ ID NO: 107149 - RNA, 22 nt, Human
auuggugcauuuuacaaaacuc

SEQ ID NO: 107150 - RNA, 22 nt, Human
auugguuaacucugugugucaa

SEQ ID NO: 107151 - RNA, 22 nt, Human
auugguuaagacgcaucaugcu

SEQ ID NO: 107152 - RNA, 22 nt, Human
auugguuaccacuuuaaaucuu

SEQ ID NO: 107153 - RNA, 22 nt, Human
auugguuuuguuaucuccauuc

SEQ ID NO: 107154 - RNA, 22 nt, Human
auuguaacaggaucccuguggc

SEQ ID NO: 107155 - RNA, 22 nt, Human
auuguaacauguucagaucacu

SEQ ID NO: 107156 - RNA, 22 nt, Human
auuguacaaaaaaguagaccuu

SEQ ID NO: 107157 - RNA, 22 nt, Human
auuguacaaugcugagguuugg

SEQ ID NO: 107158 - RNA, 22 nt, Human
auuguacagacaugggaaacaa

SEQ ID NO: 107159 - RNA, 22 nt, Human
auuguacagaugaaccucacuc

SEQ ID NO: 107160 - RNA, 22 nt, Human
auuguacagguuggaggaagug

SEQ ID NO: 107161 - RNA, 22 nt, Human
auuguacucuagccucugggca

SEQ ID NO: 107162 - RNA, 22 nt, Human
auuguauaagucuauuuacaau

SEQ ID NO: 107163 - RNA, 22 nt, Human
auuguauuauaauuaggccaaa

SEQ ID NO: 107164 - RNA, 18 nt, Human
auugucagaagucaugug

SEQ ID NO: 107165 - RNA, 22 nt, Human
auugucagcucgaaaugcauca

SEQ ID NO: 107166 - RNA, 22 nt, Human
auugucagugggauuugucaac

SEQ ID NO: 107167 - RNA, 22 nt, Human
auugucauuggcuucuaugucu

SEQ ID NO: 107168 - RNA, 22 nt, Human
auugucuuaaacaaauguguuu

SEQ ID NO: 107169 - RNA, 22 nt, Human
auugucuucugucuuauaguuc

SEQ ID NO: 107170 - RNA, 23 nt, Human
auugugagauuacuaucacacug

SEQ ID NO: 107171 - RNA, 22 nt, Human
auugugcaauguuuuacaauuu

SEQ ID NO: 107172 - RNA, 22 nt, Human
auugugcuuugcaucuuguucc

SEQ ID NO: 107173 - RNA, 22 nt, Human
auuguggugucaguuauaggca

SEQ ID NO: 107174 - RNA, 22 nt, Human
auuguguaauuuucagcucaua

SEQ ID NO: 107175 - RNA, 22 nt, Human
auuguguggugaaugaucagcu

SEQ ID NO: 107176 - RNA, 22 nt, Human
auuguuaaacugaagcauuacu

SEQ ID NO: 107177 - RNA, 22 nt, Human
auuguucaaagugcuuugcaug

SEQ ID NO: 107178 - RNA, 22 nt, Human
auuguucauuguacaccuagua

SEQ ID NO: 107179 - RNA, 22 nt, Human
auuguuccuggaaaagaacagg

SEQ ID NO: 107180 - RNA, 22 nt, Human
auuguucuguagugacauguag

SEQ ID NO: 107181 - RNA, 22 nt, Human
auuguugaggagacucuucaau

SEQ ID NO: 107182 - RNA, 22 nt, Human
auuguugagugcuucagcugua

SEQ ID NO: 107183 - RNA, 22 nt, Human
auuguuggguaguuuguucagc

SEQ ID NO: 107184 - RNA, 22 nt, Human
auuguuuacacuaacuucauaa

SEQ ID NO: 107185 - RNA, 22 nt, Human
auuguuuuauuaaaugagcccu

SEQ ID NO: 107186 - RNA, 16 nt, Human
auuguuuucaauuaga

SEQ ID NO: 107187 - RNA, 22 nt, Human
auuguuuuguagaaugacccuu

SEQ ID NO: 107188 - RNA, 22 nt, Human
auuguuuuguuucccagugacu

SEQ ID NO: 107189 - RNA, 22 nt, Human
auuuaagacugacuucaccagu

SEQ ID NO: 107190 - RNA, 22 nt, Human
auuuaagauugcguauucaugu

SEQ ID NO: 107191 - RNA, 22 nt, Human
auuuaauaccacuuggugcuuu

SEQ ID NO: 107192 - RNA, 22 nt, Human
auuuaaugucgagcuauuguag

SEQ ID NO: 107193 - RNA, 22 nt, Human
auuuaauuuacauuugacagag

SEQ ID NO: 107194 - RNA, 21 nt, Human
auuuacaaaacagucccuucc

SEQ ID NO: 107195 - RNA, 22 nt, Human
auuuacacuugguuuacuagag

SEQ ID NO: 107196 - RNA, 22 nt, Human
auuuacagaaacuuaaucauag

SEQ ID NO: 107197 - RNA, 22 nt, Human
auuuacagaagcauguaauagc

SEQ ID NO: 107198 - RNA, 22 nt, Human
auuuacagacguggauuagugc

SEQ ID NO: 107199 - RNA, 23 nt, Human
auuuacagcugugugagcaaguu

SEQ ID NO: 107200 - RNA, 22 nt, Human
auuuacaguuuagcauuucaag

SEQ ID NO: 107201 - RNA, 17 nt, Human
auuuacauugucaccga

SEQ ID NO: 107202 - RNA, 22 nt, Human
auuuacauuuauuugagaaggu

SEQ ID NO: 107203 - RNA, 22 nt, Human
auuuacugcuugacacauuggu

SEQ ID NO: 107204 - RNA, 22 nt, Human
auuuacuuugcugagauccauc

SEQ ID NO: 107205 - RNA, 22 nt, Human
auuuagacaacaagccuucucc

SEQ ID NO: 107206 - RNA, 22 nt, Human
auuuagacacaaaagugccaug

SEQ ID NO: 107207 - RNA, 22 nt, Human
auuuagaguguucacucugagc

SEQ ID NO: 107208 - RNA, 22 nt, Human
auuuagcaagcaggcaaauuca

SEQ ID NO: 107209 - RNA, 22 nt, Human
auuuagcaccuccaucucaaca

SEQ ID NO: 107210 - RNA, 22 nt, Human
auuuagcaguccuccucacaau

SEQ ID NO: 107211 - RNA, 22 nt, Human
auuuagccucauuuuugacaua

SEQ ID NO: 107212 - RNA, 22 nt, Human
auuuaguaaguacuuguugaau

SEQ ID NO: 107213 - RNA, 22 nt, Human
caaaugaagaaccuucucaccu

SEQ ID NO: 107214 - RNA, 22 nt, Human
caaaugaagagggcaacuucug

SEQ ID NO: 107215 - RNA, 22 nt, Human
caaaugaagggagcugaagucu

SEQ ID NO: 107216 - RNA, 22 nt, Human
caaaugcaaaauauaacccugu

SEQ ID NO: 107217 - RNA, 22 nt, Human
caaaugcagucccuuuguugcu

SEQ ID NO: 107218 - RNA, 22 nt, Human
caaaugcuaacuucuuuccaaa

SEQ ID NO: 107219 - RNA, 22 nt, Human
caaauggauacaggcaaacauu

SEQ ID NO: 107220 - RNA, 22 nt, Human
caaauggucauuucucuuuugu

SEQ ID NO: 107221 - RNA, 22 nt, Human
caaauguaauggcagguuuugc

SEQ ID NO: 107222 - RNA, 22 nt, Human
caaauguauucucacuucaggg

SEQ ID NO: 107223 - RNA, 22 nt, Human
caaauguuugguggcauuuugu

SEQ ID NO: 107224 - RNA, 22 nt, Human
caaauuacccucaacaucuaga

SEQ ID NO: 107225 - RNA, 22 nt, Human
caaauuagagguuuguuuugau

SEQ ID NO: 107226 - RNA, 22 nt, Human
caaauuccucagaaucagaaaa

SEQ ID NO: 107227 - RNA, 22 nt, Human
caaauugaucugucuuuaugaa

SEQ ID NO: 107228 - RNA, 22 nt, Human
caaauugcuugucuguagugga

SEQ ID NO: 107229 - RNA, 22 nt, Human
caaauuuaaguuagaaagcaau

SEQ ID NO: 107230 - RNA, 22 nt, Human
caacaaguguucguaaagugcc

SEQ ID NO: 107231 - RNA, 22 nt, Human
caacaauaugcugaguuuuuca

SEQ ID NO: 107232 - RNA, 22 nt, Human
caacacagguucugcaaaggaa

SEQ ID NO: 107233 - RNA, 22 nt, Human
caacacauugaagcuaugauga

SEQ ID NO: 107234 - RNA, 22 nt, Human
caacagagagaccagaaacagg

SEQ ID NO: 107235 - RNA, 22 nt, Human
caacagaggaguggccugaucc

SEQ ID NO: 107236 - RNA, 22 nt, Human
caacagucucuauagcuccuug

SEQ ID NO: 107237 - RNA, 22 nt, Human
caacaguguugcaaucugaaaa

SEQ ID NO: 107238 - RNA, 22 nt, Human
caacaguucaguugagcucaac

SEQ ID NO: 107239 - RNA, 22 nt, Human
caacaguuccuccauccucucu

SEQ ID NO: 107240 - RNA, 22 nt, Human
caacaguucucauagcagauuc

SEQ ID NO: 107241 - RNA, 22 nt, Human
caacauauaauauuugaguucu

SEQ ID NO: 107242 - RNA, 22 nt, Human
caacauauauaaggauuuacua

SEQ ID NO: 107243 - RNA, 22 nt, Human
caacauauuuuccaagagugaa

SEQ ID NO: 107244 - RNA, 22 nt, Human
caacaucuguaucauuaguaca

SEQ ID NO: 107245 - RNA, 22 nt, Human
caacauuucaaggucuuuagga

SEQ ID NO: 107246 - RNA, 22 nt, Human
caacauuugaguaaagaaaugg

SEQ ID NO: 107247 - RNA, 22 nt, Human
caacauuugugaugagcaaacu

SEQ ID NO: 107248 - RNA, 22 nt, Human
caaccugaauucugcuuuggca

SEQ ID NO: 107249 - RNA, 22 nt, Human
caaauucaaugaacauguuuaa

SEQ ID NO: 107250 - RNA, 18 nt, Human
caaauucagugcuggaag

SEQ ID NO: 107251 - RNA, 22 nt, Human
caaauucucacccuguuugauu

SEQ ID NO: 107252 - RNA, 22 nt, Human
caacaacaugggauucauuucu

SEQ ID NO: 107253 - RNA, 22 nt, Human
caacacugauuauggcugagcu

SEQ ID NO: 107254 - RNA, 22 nt, Human
caacagaaaucaauuuucccau

SEQ ID NO: 107255 - RNA, 22 nt, Human
caacagaagguguacuacugaa

SEQ ID NO: 107256 - RNA, 22 nt, Human
caacagaccuggauucaaaaac

SEQ ID NO: 107257 - RNA, 22 nt, Human
caacagagcaguugaucaggaa

SEQ ID NO: 107258 - RNA, 20 nt, Human
caacagaggggucuggagua

SEQ ID NO: 107259 - RNA, 22 nt, Human
caacagcucagacacgggaccu

SEQ ID NO: 107260 - RNA, 22 nt, Human
caacaggcuuuauguuuaaagu

SEQ ID NO: 107261 - RNA, 22 nt, Human
caacaguauagcuuuugacugc

SEQ ID NO: 107262 - RNA, 22 nt, Human
caacagugauucugcaugagga

SEQ ID NO: 107263 - RNA, 22 nt, Human
caacaguuuauaguguuaucuu

SEQ ID NO: 107264 - RNA, 22 nt, Human
caacauaugcuuucaugaggua

SEQ ID NO: 107265 - RNA, 20 nt, Human
caacaugagcaagugaacug

SEQ ID NO: 107266 - RNA, 22 nt, Human
caacauguguuagacaauagac

SEQ ID NO: 107267 - RNA, 22 nt, Human
caacauuauauagccacaugcc

SEQ ID NO: 107268 - RNA, 22 nt, Human
caacauucaaccaacauuuaug

SEQ ID NO: 107269 - RNA, 22 nt, Human
caaccaguagcugaguucaaaa

SEQ ID NO: 107270 - RNA, 22 nt, Human
caacccaagguuaguuggucuu

SEQ ID NO: 107271 - RNA, 22 nt, Human
caaccccacuacacguuggaga

SEQ ID NO: 107272 - RNA, 22 nt, Human
caaccucauagaaagaaaaugu

SEQ ID NO: 107273 - RNA, 22 nt, Human
caaccugagacuccaggcaccu

SEQ ID NO: 107274 - RNA, 22 nt, Human
caacuacauccacacuuuguua

SEQ ID NO: 107275 - RNA, 22 nt, Human
caacugaucuauuuccuaacug

SEQ ID NO: 107276 - RNA, 22 nt, Human
caacugguggucaaccuucugu

SEQ ID NO: 107277 - RNA, 22 nt, Human
caacugugaauuuuaugauacc

SEQ ID NO: 107278 - RNA, 22 nt, Human
caacuucacugugccucuaguu

SEQ ID NO: 107279 - RNA, 22 nt, Human
caacuucuuggcuuccuaaugg

SEQ ID NO: 107280 - RNA, 22 nt, Human
caacuuggcucucuggcuaucc

SEQ ID NO: 107281 - RNA, 22 nt, Human
caacuuuagaccccaaguagcu

SEQ ID NO: 107282 - RNA, 22 nt, Human
caagaacaguuugccaaauugg

SEQ ID NO: 107283 - RNA, 22 nt, Human
caagaaccgcaauuacuuuugc

SEQ ID NO: 107284 - RNA, 22 nt, Human
caagaagucauuuagccucuca

SEQ ID NO: 107285 - RNA, 22 nt, Human
caagaauaaaauacauguugau

SEQ ID NO: 107286 - RNA, 22 nt, Human
caagaauauaaauacuuucaaa

SEQ ID NO: 107287 - RNA, 22 nt, Human
caagaauauauauggaguggag

SEQ ID NO: 107288 - RNA, 22 nt, Human
caagaaucagaccugucagggu

SEQ ID NO: 107289 - RNA, 22 nt, Human
caagaaugaauucaaugugugg

SEQ ID NO: 107290 - RNA, 22 nt, Human
caagaccucaaaaugagagggg

SEQ ID NO: 107291 - RNA, 22 nt, Human
caagacuuagagcaucuugaaa

SEQ ID NO: 107292 - RNA, 22 nt, Human
caagagacgggcaaggcaagag

SEQ ID NO: 107293 - RNA, 22 nt, Human
caagagacuuauguggaaaccu

SEQ ID NO: 107294 - RNA, 22 nt, Human
caagagcuagacuuugucagga

SEQ ID NO: 107295 - RNA, 22 nt, Human
caagagcugcaaauagcgugac

SEQ ID NO: 107296 - RNA, 22 nt, Human
caagagcuggagaggcagucua

SEQ ID NO: 107297 - RNA, 22 nt, Human
caagagcuggguggcaagcuag

SEQ ID NO: 107298 - RNA, 22 nt, Human
caagaggagcaggcaggugugc

SEQ ID NO: 107299 - RNA, 22 nt, Human
caagaguuuaaaucaauggcca

SEQ ID NO: 107300 - RNA, 22 nt, Human
caagauaaaaucagcauuccaa

SEQ ID NO: 107301 - RNA, 22 nt, Human
caagauaagaucauuuacacua

SEQ ID NO: 107302 - RNA, 22 nt, Human
caagauaauuuauucugaguuu

SEQ ID NO: 107303 - RNA, 22 nt, Human
caagauaucaaugacauaguau

SEQ ID NO: 107304 - RNA, 22 nt, Human
caagauauguguuguuagcucu

SEQ ID NO: 107305 - RNA, 22 nt, Human
caagaucaaucaauacuccuua

SEQ ID NO: 107306 - RNA, 22 nt, Human
caagaucagggugccagaaugg

SEQ ID NO: 107307 - RNA, 22 nt, Human
caagaucuuccucaauagaccu

SEQ ID NO: 107308 - RNA, 22 nt, Human
caagaugacaaggcuggaggcu

SEQ ID NO: 107309 - RNA, 22 nt, Human
caagauggacauaaggagagaa

SEQ ID NO: 107310 - RNA, 22 nt, Human
caagauggagaagcagcaaggg

SEQ ID NO: 107311 - RNA, 22 nt, Human
caagaugggcaccccagcaccu

SEQ ID NO: 107312 - RNA, 22 nt, Human
caagauguuaaaaccacccuug

SEQ ID NO: 107313 - RNA, 22 nt, Human
caagauuaucuucuucuuguua

SEQ ID NO: 107314 - RNA, 22 nt, Human
caagauuuagcucccuuaucuc

SEQ ID NO: 107315 - RNA, 22 nt, Human
caagauuugggggcacggaauc

SEQ ID NO: 107316 - RNA, 22 nt, Human
caagcaacgacuuucaagcugu

SEQ ID NO: 107317 - RNA, 22 nt, Human
caagcaauauuuuagaaaggua

SEQ ID NO: 107318 - RNA, 22 nt, Human
caagcaaugcuauacucauuau

SEQ ID NO: 107319 - RNA, 22 nt, Human
caagcagggagcaucaagggag

SEQ ID NO: 107320 - RNA, 22 nt, Human
caagcagguccugaaucugguc

SEQ ID NO: 107321 - RNA, 22 nt, Human
caagcauuuauuauaauuauca

SEQ ID NO: 107322 - RNA, 22 nt, Human
caauucuuccuguuggauaugc

SEQ ID NO: 107323 - RNA, 22 nt, Human
caauugcaauagagaaaagagu

SEQ ID NO: 107324 - RNA, 22 nt, Human
caauugcuuucuuaccaagaga

SEQ ID NO: 107325 - RNA, 22 nt, Human
caauugucagugcuguuuaaau

SEQ ID NO: 107326 - RNA, 18 nt, Human
caauuucaauggucugaa

SEQ ID NO: 107327 - RNA, 22 nt, Human
caauuucagucucagagaguuc

SEQ ID NO: 107328 - RNA, 22 nt, Human
caauuucagugcuguggagagg

SEQ ID NO: 107329 - RNA, 20 nt, Human
caauuucaucauuuccugug

SEQ ID NO: 107330 - RNA, 22 nt, Human
caauuucucuuuauaucucaca

SEQ ID NO: 107331 - RNA, 22 nt, Human
cacaaaaucuuucucgauuauu

SEQ ID NO: 107332 - RNA, 22 nt, Human
cacaaacaucaauccuguuuuc

SEQ ID NO: 107333 - RNA, 22 nt, Human
cacaaaguauaacuugauggaa

SEQ ID NO: 107334 - RNA, 22 nt, Human
cacaaaguggguggaaaacuaa

SEQ ID NO: 107335 - RNA, 22 nt, Human
cacaaauaccaguuuccuaaca

SEQ ID NO: 107336 - RNA, 22 nt, Human
cacaaaugguuguagacauuaa

SEQ ID NO: 107337 - RNA, 22 nt, Human
cacaaauguaguagcuuaaaac

SEQ ID NO: 107338 - RNA, 17 nt, Human
cacaacuggcugauuga

SEQ ID NO: 107339 - RNA, 22 nt, Human
cacaacuuagcagcuugaaaca

SEQ ID NO: 107340 - RNA, 22 nt, Human
cacaagauggucacauaagugc

SEQ ID NO: 107341 - RNA, 22 nt, Human
cacaaguggcuggggaaaggga

SEQ ID NO: 107342 - RNA, 22 nt, Human
cacaaugauuugguucaaaaau

SEQ ID NO: 107343 - RNA, 22 nt, Human
cacaaugcguacauauaucaaa

SEQ ID NO: 107344 - RNA, 22 nt, Human
cacaauguaagaguuuguucau

SEQ ID NO: 107345 - RNA, 22 nt, Human
cacaaugucugguaggccacuu

SEQ ID NO: 107346 - RNA, 22 nt, Human
cacaauuagcagcucuuuauuu

SEQ ID NO: 107347 - RNA, 22 nt, Human
cacaauuauagaagaaagcaua

SEQ ID NO: 107348 - RNA, 22 nt, Human
cacaauuauuaucucuuucuac

SEQ ID NO: 107349 - RNA, 22 nt, Human
cacaauuccauggcauucuuug

SEQ ID NO: 107350 - RNA, 22 nt, Human
cacaauuucaguugcaugcaac

SEQ ID NO: 107351 - RNA, 22 nt, Human
cacaauuuccuugcuucacuuu

SEQ ID NO: 107352 - RNA, 22 nt, Human
cacaauuuguauuuugcaucca

SEQ ID NO: 107353 - RNA, 22 nt, Human
cacaauuuguuugcucuuaguc

SEQ ID NO: 107354 - RNA, 22 nt, Human
cacaauuuuucuuagguccugg

SEQ ID NO: 107355 - RNA, 22 nt, Human
cacacacaguuuuguauucugu

SEQ ID NO: 107356 - RNA, 22 nt, Human
cacacaccaaucaaaugucaga

SEQ ID NO: 107357 - RNA, 22 nt, Human
cacacacucuuccuggcaccua

SEQ ID NO: 107358 - RNA, 22 nt, Human
cacacagcuagugacaggagaa

SEQ ID NO: 107359 - RNA, 22 nt, Human
cacacagcucaggggcacugcc

SEQ ID NO: 107360 - RNA, 21 nt, Human
cacacaguggagugcccuugc

SEQ ID NO: 107361 - RNA, 22 nt, Human
cacacaugcauguaagaccucu

SEQ ID NO: 107362 - RNA, 22 nt, Human
cacacaugguagcagguacaag

SEQ ID NO: 107363 - RNA, 22 nt, Human
cacacauggucaguggcuacuc

SEQ ID NO: 107364 - RNA, 22 nt, Human
cacacauuaauaucaaaggcuc

SEQ ID NO: 107365 - RNA, 22 nt, Human
cacacauucaccaugacugaaa

SEQ ID NO: 107366 - RNA, 22 nt, Human
ccagagggagccaccagggugu

SEQ ID NO: 107367 - RNA, 22 nt, Human
ccagagggcaaaaugaagcuua

SEQ ID NO: 107368 - RNA, 22 nt, Human
ccagagggccuuuggaguuauc

SEQ ID NO: 107369 - RNA, 22 nt, Human
ccagaggucucucuauacuggg

SEQ ID NO: 107370 - RNA, 22 nt, Human
ccagaggugcugggagaggucu

SEQ ID NO: 107371 - RNA, 22 nt, Human
ccagagucuaugaguccucauu

SEQ ID NO: 107372 - RNA, 17 nt, Human
ccagaucccaguccuua

SEQ ID NO: 107373 - RNA, 22 nt, Human
ccagaucccuguuugccucugg

SEQ ID NO: 107374 - RNA, 21 nt, Human
ccagauccugcuuccucaccc

SEQ ID NO: 107375 - RNA, 22 nt, Human
ccagaucuaaguccaaaguacu

SEQ ID NO: 107376 - RNA, 22 nt, Human
ccagaucuaguguuguaaagcu

SEQ ID NO: 107377 - RNA, 22 nt, Human
ccagaugaggucaugcuggguu

SEQ ID NO: 107378 - RNA, 22 nt, Human
ccagaugggaagaagcaugacu

SEQ ID NO: 107379 - RNA, 22 nt, Human
ccagauggguuacuucaagcaa

SEQ ID NO: 107380 - RNA, 22 nt, Human
ccagauguuccccuggaggccu

SEQ ID NO: 107381 - RNA, 22 nt, Human
ccagauuugagcgucuuaaacc

SEQ ID NO: 107382 - RNA, 22 nt, Human
ccagauuuguaggggcucuuac

SEQ ID NO: 107383 - RNA, 22 nt, Human
ccagcaagccaggucuguggcu

SEQ ID NO: 107384 - RNA, 22 nt, Human
ccagcaagguccagcauaggga

SEQ ID NO: 107385 - RNA, 20 nt, Human
ccagcacccucucagcugaa

SEQ ID NO: 107386 - RNA, 22 nt, Human
ccagcaccuugaucuuggaguu

SEQ ID NO: 107387 - RNA, 22 nt, Human
ccagcacuguucuaaggaaaca

SEQ ID NO: 107388 - RNA, 22 nt, Human
ccagcagcaggccaggcccucc

SEQ ID NO: 107389 - RNA, 22 nt, Human
ccagcagccaccuucucgaaau

SEQ ID NO: 107390 - RNA, 22 nt, Human
ccagcagccagagaaggaccuc

SEQ ID NO: 107391 - RNA, 22 nt, Human
ccagcagccccucaaugaucug

SEQ ID NO: 107392 - RNA, 21 nt, Human
ccagcagcucaaggaucucuu

SEQ ID NO: 107393 - RNA, 22 nt, Human
ccagcagcucagcuacugguca

SEQ ID NO: 107394 - RNA, 22 nt, Human
ccagcaggacuuuggaaauaug

SEQ ID NO: 107395 - RNA, 22 nt, Human
ccagcaggagagaacauuuccc

SEQ ID NO: 107396 - RNA, 22 nt, Human
ccagcaggcagucauauccuuu

SEQ ID NO: 107397 - RNA, 22 nt, Human
ccagcagggaaaaacccaccaa

SEQ ID NO: 107398 - RNA, 22 nt, Human
ccagcaggguugguuucuucug

SEQ ID NO: 107399 - RNA, 22 nt, Human
ccagcagguguagggcucaugg

SEQ ID NO: 107400 - RNA, 22 nt, Human
ccagcaucuaugugcuguugau

SEQ ID NO: 107401 - RNA, 22 nt, Human
ccagcaucuguccuuucccuca

SEQ ID NO: 107402 - RNA, 22 nt, Human
ccagccacgaagcucccuucau

SEQ ID NO: 107403 - RNA, 22 nt, Human
ccagccacugggccacugccag

SEQ ID NO: 107404 - RNA, 22 nt, Human
ccagccagaugauaagcucuau

SEQ ID NO: 107405 - RNA, 22 nt, Human
ccagccaggcuggcuguggagg

SEQ ID NO: 107406 - RNA, 22 nt, Human
ccagccauaaacccagaugacu

SEQ ID NO: 107407 - RNA, 22 nt, Human
ccagccccgggaaccuggccgu

SEQ ID NO: 107408 - RNA, 23 nt, Human
ccagcccuccaccagcucuaggc

SEQ ID NO: 107409 - RNA, 22 nt, Human
ccagcccugccagagagagcug

SEQ ID NO: 107410 - RNA, 22 nt, Human
ccagcccugucaccaacuggag

SEQ ID NO: 107411 - RNA, 22 nt, Human
ccagcccuucccaacuggccag

SEQ ID NO: 107412 - RNA, 22 nt, Human
ccagccucaucauauuccugcu

SEQ ID NO: 107413 - RNA, 22 nt, Human
ccagccugaaaugccucauccu

SEQ ID NO: 107414 - RNA, 22 nt, Human
ccagccuggacugggucuugug

SEQ ID NO: 107415 - RNA, 22 nt, Human
ccagccuggagggcaguggugg

SEQ ID NO: 107416 - RNA, 22 nt, Human
ccagccuggggaggcagcuucu

SEQ ID NO: 107417 - RNA, 22 nt, Human
ccagccuggguguuagaagaca

SEQ ID NO: 107418 - RNA, 22 nt, Human
ccagccuugcaccgagccagcc

SEQ ID NO: 107419 - RNA, 22 nt, Human
ccagcgacugugaccucagcua

SEQ ID NO: 107420 - RNA, 22 nt, Human
ccagcuaguuggguauuauaag

SEQ ID NO: 107421 - RNA, 22 nt, Human
ccagcucagggucacauggcac

SEQ ID NO: 107422 - RNA, 22 nt, Human
ccagcuccagcauagccaccau

SEQ ID NO: 107423 - RNA, 22 nt, Human
ccagcuccagguagaugggcag

SEQ ID NO: 107424 - RNA, 22 nt, Human
ccagcucccauucuucaccugu

SEQ ID NO: 107425 - RNA, 22 nt, Human
ccagcucccgcaggcugcacag

SEQ ID NO: 107426 - RNA, 22 nt, Human
ccagcucuaaacggcucugugg

SEQ ID NO: 107427 - RNA, 22 nt, Human
ccagcucucuuugaagcauaaa

SEQ ID NO: 107428 - RNA, 22 nt, Human
ccagcucugcauguuucccuug

SEQ ID NO: 107429 - RNA, 22 nt, Human
ccagcucuggcuucuugcuggg

SEQ ID NO: 107430 - RNA, 22 nt, Human
ccagcucuguaagcugugaaau

SEQ ID NO: 107431 - RNA, 19 nt, Human
cacagaugauugacacaua

SEQ ID NO: 107432 - RNA, 22 nt, Human
cacagauuaugagacgagauac

SEQ ID NO: 107433 - RNA, 22 nt, Human
cacagauuuccuaagcaucaau

SEQ ID NO: 107434 - RNA, 22 nt, Human
cacagauuucuggucuucaccc

SEQ ID NO: 107435 - RNA, 22 nt, Human
cacagcaagagcuaaaugacca

SEQ ID NO: 107436 - RNA, 22 nt, Human
cacagcagaaaguguaggagga

SEQ ID NO: 107437 - RNA, 22 nt, Human
cacagcagacagggaggcggcu

SEQ ID NO: 107438 - RNA, 22 nt, Human
cacagcagcaucauuuaucugg

SEQ ID NO: 107439 - RNA, 22 nt, Human
cacagcaggcacuauacagggc

SEQ ID NO: 107440 - RNA, 22 nt, Human
cacagcaggcagaacgugggca

SEQ ID NO: 107441 - RNA, 22 nt, Human
cacagcagggaugaauggagug

SEQ ID NO: 107442 - RNA, 22 nt, Human
cacagcagucuuucacuaaaua

SEQ ID NO: 107443 - RNA, 22 nt, Human
cacagcauugccuuccaaaagg

SEQ ID NO: 107444 - RNA, 22 nt, Human
cacagccuccuucagagagcau

SEQ ID NO: 107445 - RNA, 22 nt, Human
cacagccugcugcacucaagaa

SEQ ID NO: 107446 - RNA, 19 nt, Human
cacagcgaagacaaggugg

SEQ ID NO: 107447 - RNA, 22 nt, Human
cacagcuagacuaauugcuggg

SEQ ID NO: 107448 - RNA, 22 nt, Human
cacagcuaugagcagccuagcu

SEQ ID NO: 107449 - RNA, 19 nt, Human
cacagcucugcucagggaa

SEQ ID NO: 107450 - RNA, 22 nt, Human
cacagcugaccacccugcuccc

SEQ ID NO: 107451 - RNA, 22 nt, Human
cacagcugcccccucucuaacu

SEQ ID NO: 107452 - RNA, 22 nt, Human
cacagcuggggaagcugaggcc

SEQ ID NO: 107453 - RNA, 22 nt, Human
cacagcuuagaaaagaagccau

SEQ ID NO: 107454 - RNA, 22 nt, Human
cacagcuuaugccacugauugg

SEQ ID NO: 107455 - RNA, 22 nt, Human
cacagcuuccauuagaaugaga

SEQ ID NO: 107456 - RNA, 22 nt, Human
cacagcuuguuuagugacucac

SEQ ID NO: 107457 - RNA, 22 nt, Human
cacaggaacuuacuggccacuu

SEQ ID NO: 107458 - RNA, 22 nt, Human
cacaggaagcaagccuggggcc

SEQ ID NO: 107459 - RNA, 22 nt, Human
cacaggaagcugacugcuggca

SEQ ID NO: 107460 - RNA, 22 nt, Human
cacaggacucgacugcagacag

SEQ ID NO: 107461 - RNA, 18 nt, Human
cacaggagaugaccugac

SEQ ID NO: 107462 - RNA, 22 nt, Human
cacaggagguuaggaagugguc

SEQ ID NO: 107463 - RNA, 22 nt, Human
cacaggagugcugcuauuguug

SEQ ID NO: 107464 - RNA, 22 nt, Human
cacaggcagccuuguagaagaa

SEQ ID NO: 107465 - RNA, 22 nt, Human
cacaggccaauacccucucucu

SEQ ID NO: 107466 - RNA, 22 nt, Human
cacaggccugggguugagcggg

SEQ ID NO: 107467 - RNA, 22 nt, Human
cacaggcucuccagggccugga

SEQ ID NO: 107468 - RNA, 23 nt, Human
cacaggcugcgcauaagcuucuc

SEQ ID NO: 107469 - RNA, 22 nt, Human
cacaggcuuuuuuggcugaugu

SEQ ID NO: 107470 - RNA, 22 nt, Human
cacagggaacaacuagaacaaa

SEQ ID NO: 107471 - RNA, 22 nt, Human
cacagggagaggaacagcgcag

SEQ ID NO: 107472 - RNA, 22 nt, Human
cacagggcaccaguuggccauc

SEQ ID NO: 107473 - RNA, 22 nt, Human
cacagggcagaggguccguggc

SEQ ID NO: 107474 - RNA, 22 nt, Human
cacagggcagguacucucagag

SEQ ID NO: 107475 - RNA, 19 nt, Human
cacagggcaggucucaugu

SEQ ID NO: 107476 - RNA, 22 nt, Human
cacagggcagugcugcccacuc

SEQ ID NO: 107477 - RNA, 22 nt, Human
cacagguaauagccuaggcuau

SEQ ID NO: 107478 - RNA, 22 nt, Human
cacagguauauguguauauacu

SEQ ID NO: 107479 - RNA, 22 nt, Human
caagucugaccucugggugaag

SEQ ID NO: 107480 - RNA, 22 nt, Human
caagucugucugcuccugugug

SEQ ID NO: 107481 - RNA, 22 nt, Human
caagugaagauauacagaaaau

SEQ ID NO: 107482 - RNA, 22 nt, Human
caagugcaugguggcaaagaau

SEQ ID NO: 107483 - RNA, 22 nt, Human
caagugggaccugucugauucc

SEQ ID NO: 107484 - RNA, 21 nt, Human
caaguguggauguggaaggua

SEQ ID NO: 107485 - RNA, 22 nt, Human
caaguuaauauauagaauuuug

SEQ ID NO: 107486 - RNA, 22 nt, Human
caaguuaguauugguuuuggga

SEQ ID NO: 107487 - RNA, 22 nt, Human
caaguucacuugucuacaaggg

SEQ ID NO: 107488 - RNA, 22 nt, Human
caaguuguacagauuguauuag

SEQ ID NO: 107489 - RNA, 22 nt, Human
caaguuuaaagugagguuugaa

SEQ ID NO: 107490 - RNA, 22 nt, Human
caaguuuaaggcacugauaagu

SEQ ID NO: 107491 - RNA, 22 nt, Human
caaguuuugauuuugcaguaaa

SEQ ID NO: 107492 - RNA, 22 nt, Human
caauaacugcuaaauucccugu

SEQ ID NO: 107493 - RNA, 22 nt, Human
caauaacugcugaggagaagca

SEQ ID NO: 107494 - RNA, 22 nt, Human
caauaagauguauugagcagag

SEQ ID NO: 107495 - RNA, 22 nt, Human
caauaaguaauaggcaucuaau

SEQ ID NO: 107496 - RNA, 22 nt, Human
caauaauuuacauuggauacca

SEQ ID NO: 107497 - RNA, 22 nt, Human
caauacaucaggucaaaaugug

SEQ ID NO: 107498 - RNA, 16 nt, Human
caauacauggcauuuc

SEQ ID NO: 107499 - RNA, 20 nt, Human
caauagaauguggagauaag

SEQ ID NO: 107500 - RNA, 22 nt, Human
caauagcuauguaaccugaaga

SEQ ID NO: 107501 - RNA, 22 nt, Human
caauaguucgguccugaaggcc

SEQ ID NO: 107502 - RNA, 19 nt, Human
caauauauagugaguggau

SEQ ID NO: 107503 - RNA, 22 nt, Human
caauauucaguggaaaagccau

SEQ ID NO: 107504 - RNA, 22 nt, Human
caaucacaaagagacaaguguc

SEQ ID NO: 107505 - RNA, 22 nt, Human
caaucacucugcaacauuccug

SEQ ID NO: 107506 - RNA, 22 nt, Human
caaucacugaccugcagaugca

SEQ ID NO: 107507 - RNA, 22 nt, Human
caauccaguuucugucagcuac

SEQ ID NO: 107508 - RNA, 22 nt, Human
caaucucuggugcuucugagag

SEQ ID NO: 107509 - RNA, 22 nt, Human
caaucuguuagaaaugcagaca

SEQ ID NO: 107510 - RNA, 22 nt, Human
caaugacacucugcacagugcu

SEQ ID NO: 107511 - RNA, 22 nt, Human
caaugacagguucaugacuccu

SEQ ID NO: 107512 - RNA, 22 nt, Human
caaugauugcuauuuacauaaa

SEQ ID NO: 107513 - RNA, 22 nt, Human
caaugauuuuuccauugcagga

SEQ ID NO: 107514 - RNA, 22 nt, Human
caaugcauacuucgaaauuuca

SEQ ID NO: 107515 - RNA, 22 nt, Human
caaugcauuauucucccacuuc

SEQ ID NO: 107516 - RNA, 22 nt, Human
caauggauauuuuaugugagaa

SEQ ID NO: 107517 - RNA, 21 nt, Human
caauggcgagaucuuggcuca

SEQ ID NO: 107518 - RNA, 22 nt, Human
caaugggccuggagagagcugg

SEQ ID NO: 107519 - RNA, 22 nt, Human
caaugguggugucagaagagau

SEQ ID NO: 107520 - RNA, 22 nt, Human
caaugguucucaaacuaucaug

SEQ ID NO: 107521 - RNA, 22 nt, Human
caauguaaauauuuucuaauca

SEQ ID NO: 107522 - RNA, 22 nt, Human
caauguaucaagaagcaucagu

SEQ ID NO: 107523 - RNA, 22 nt, Human
caaugucaaggagaccaaaacg

SEQ ID NO: 107524 - RNA, 22 nt, Human
caaugucagagaagcucauauc

SEQ ID NO: 107525 - RNA, 22 nt, Human
caaugucaugauuuuccauuag

SEQ ID NO: 107526 - RNA, 22 nt, Human
caaugucauuucacugggcuua

SEQ ID NO: 107527 - RNA, 22 nt, Human
caaugucugaccguuuugccca

SEQ ID NO: 107528 - RNA, 21 nt, Human
caaugucugcucucugccuag

SEQ ID NO: 107529 - RNA, 22 nt, Human
caauguuuacuggggacccaga

SEQ ID NO: 107530 - RNA, 22 nt, Human
caauguuucuuguaaccaguga

SEQ ID NO: 107531 - RNA, 22 nt, Human
caauguuugugaucuacugacu

SEQ ID NO: 107532 - RNA, 22 nt, Human
caauguuuguuagagcucuaga

SEQ ID NO: 107533 - RNA, 18 nt, Human
caauguuuuagaucucua

SEQ ID NO: 107534 - RNA, 22 nt, Human
caauuacauuuauugagcauuc

SEQ ID NO: 107535 - RNA, 22 nt, Human
caauuaccaguaauugagguuu

SEQ ID NO: 107536 - RNA, 21 nt, Human
caauuacuuuugcaccgacuu

SEQ ID NO: 107537 - RNA, 22 nt, Human
caauuagacauuuauuggccag

SEQ ID NO: 107538 - RNA, 22 nt, Human
caauucaaguugaguacagcuu

SEQ ID NO: 107539 - RNA, 22 nt, Human
caauucaugggcugaggaaggg

SEQ ID NO: 107540 - RNA, 22 nt, Human
uacccagcuccucagaagacca

SEQ ID NO: 107541 - RNA, 22 nt, Human
uacccagcuucaagucaggacu

SEQ ID NO: 107542 - RNA, 22 nt, Human
uacccaggaggaaacugaggcu

SEQ ID NO: 107543 - RNA, 22 nt, Human
uacccagggcuuuucugaugca

SEQ ID NO: 107544 - RNA, 19 nt, Human
uacccucagggccucauuu

SEQ ID NO: 107545 - RNA, 22 nt, Human
uacccugcuagcuagcaucucu

SEQ ID NO: 107546 - RNA, 20 nt, Human
uacccuggcuaugcuucuga

SEQ ID NO: 107547 - RNA, 22 nt, Human
uaccuagacaugaacacagaug

SEQ ID NO: 107548 - RNA, 22 nt, Human
uaccuauagguacaauuacaag

SEQ ID NO: 107549 - RNA, 22 nt, Human
uaccucagauugcugccuuggg

SEQ ID NO: 107550 - RNA, 22 nt, Human
uaccucaugcuguacagcacgu

SEQ ID NO: 107551 - RNA, 22 nt, Human
uaccucucuaaacccagggaca

SEQ ID NO: 107552 - RNA, 22 nt, Human
uaccucuggacauuguggagca

SEQ ID NO: 107553 - RNA, 22 nt, Human
uaccugaaguaacaaugaauau

SEQ ID NO: 107554 - RNA, 22 nt, Human
uaccugagccccugcuggugua

SEQ ID NO: 107555 - RNA, 22 nt, Human
uaccugagguaaggaugaugag

SEQ ID NO: 107556 - RNA, 22 nt, Human
uaccugcagcgggaauccauua

SEQ ID NO: 107557 - RNA, 22 nt, Human
uaccuggacaucagagagacac

SEQ ID NO: 107558 - RNA, 22 nt, Human
uaccuggauccugguagacauc

SEQ ID NO: 107559 - RNA, 22 nt, Human
uaccuggauguuuagauuggca

SEQ ID NO: 107560 - RNA, 22 nt, Human
uaccuggcagucagucuuuccg

SEQ ID NO: 107561 - RNA, 22 nt, Human
uaccuggcuggggaauagccag

SEQ ID NO: 107562 - RNA, 22 nt, Human
uaccuggggcugggcuuugauu

SEQ ID NO: 107563 - RNA, 22 nt, Human
uaccuguugucacgauaacacu

SEQ ID NO: 107564 - RNA, 23 nt, Human
uaccuuucccugggagacugcuc

SEQ ID NO: 107565 - RNA, 22 nt, Human
uacgagcgcucuugcuggccaa

SEQ ID NO: 107566 - RNA, 22 nt, Human
uacuaaacaucuggcauuaaau

SEQ ID NO: 107567 - RNA, 22 nt, Human
uacuacaagggcccuaaaaggu

SEQ ID NO: 107568 - RNA, 22 nt, Human
uacuacauuaauaaaacauuca

SEQ ID NO: 107569 - RNA, 22 nt, Human
uacuagaaauuaccuucucacu

SEQ ID NO: 107570 - RNA, 22 nt, Human
uacuagaagcuguaauuuuuca

SEQ ID NO: 107571 - RNA, 22 nt, Human
uacuaggaagcagcugcauugg

SEQ ID NO: 107572 - RNA, 22 nt, Human
uacuagucuucugcuauucccu

SEQ ID NO: 107573 - RNA, 22 nt, Human
uacuaguucucauaugaaauaa

SEQ ID NO: 107574 - RNA, 22 nt, Human
uacuaugugaaaauacuauagu

SEQ ID NO: 107575 - RNA, 22 nt, Human
uacuauguucuuccuaaauagu

SEQ ID NO: 107576 - RNA, 22 nt, Human
uacuauuuauggagugguuauu

SEQ ID NO: 107577 - RNA, 22 nt, Human
uacucaaucuagguggcuuacc

SEQ ID NO: 107578 - RNA, 22 nt, Human
uacucaaugaaguagccugguu

SEQ ID NO: 107579 - RNA, 22 nt, Human
uacucauugauuccuuuacuca

SEQ ID NO: 107580 - RNA, 22 nt, Human
uacuccaggacuccauuugaaa

SEQ ID NO: 107581 - RNA, 22 nt, Human
uacucccaccauggcugauuuc

SEQ ID NO: 107582 - RNA, 22 nt, Human
uacuccugcugauccugccagc

SEQ ID NO: 107583 - RNA, 22 nt, Human
uacugaaaaagaauccagaccu

SEQ ID NO: 107584 - RNA, 22 nt, Human
uacugaaacucuuguaaauauc

SEQ ID NO: 107585 - RNA, 22 nt, Human
uacugaaagaauacauaauuuc

SEQ ID NO: 107586 - RNA, 22 nt, Human
uacugaaagacugaauauuuag

SEQ ID NO: 107587 - RNA, 22 nt, Human
uacugaaaguggucaacagugg

SEQ ID NO: 107588 - RNA, 22 nt, Human
uacugaaauagcacucugaugc

SEQ ID NO: 107589 - RNA, 22 nt, Human
uacugaauggggcaguaagaaa

SEQ ID NO: 107590 - RNA, 22 nt, Human
uacugaggcugaauucuuagca

SEQ ID NO: 107591 - RNA, 17 nt, Human
uacugaggggucuggag

SEQ ID NO: 107592 - RNA, 22 nt, Human
uacugcaugguggaguggagcu

SEQ ID NO: 107593 - RNA, 22 nt, Human
uacugcauguguuugaugaugg

SEQ ID NO: 107594 - RNA, 22 nt, Human
uacugccaaauugcagcaaugu

SEQ ID NO: 107595 - RNA, 23 nt, Human
uacugccuuguucauguguauuu

SEQ ID NO: 107596 - RNA, 22 nt, Human
uacugcuucauauagggaugua

SEQ ID NO: 107597 - RNA, 20 nt, Human
uacuggauuagggcucaccc

SEQ ID NO: 107598 - RNA, 22 nt, Human
uacuggguauacaaagaugaau

SEQ ID NO: 107599 - RNA, 18 nt, Human
uacugguccuuuuaugau

SEQ ID NO: 107600 - RNA, 22 nt, Human
uacuguacauuccguuuguugc

SEQ ID NO: 107601 - RNA, 22 nt, Human
uacuguacugcaguucugcaaa

SEQ ID NO: 107602 - RNA, 22 nt, Human
uacuguauacuacugcuguucu

SEQ ID NO: 107603 - RNA, 22 nt, Human
uacugucuauacacuugauuac

SEQ ID NO: 107604 - RNA, 22 nt, Human
uacugucuuuccauccuugccu

SEQ ID NO: 107605 - RNA, 22 nt, Human
uacugucuuuuccuaaaugggu

SEQ ID NO: 107606 - RNA, 22 nt, Human
uacugugaauacaaaauaaauu

SEQ ID NO: 107607 - RNA, 22 nt, Human
uacugugcagcugugcuuuggg

SEQ ID NO: 107608 - RNA, 16 nt, Human
uacuguggagcaaggc

SEQ ID NO: 107609 - RNA, 18 nt, Human
uacuguggaucagggguu

SEQ ID NO: 107610 - RNA, 22 nt, Human
uacugugggauguugugauuag

SEQ ID NO: 107611 - RNA, 22 nt, Human
uacuguggggauauugauugua

SEQ ID NO: 107612 - RNA, 22 nt, Human
uacuguuuuaaaagguacuugu

SEQ ID NO: 107613 - RNA, 22 nt, Human
uacuuaaauaauugcugcuauu

SEQ ID NO: 107614 - RNA, 22 nt, Human
uacuuaaugccacugaauugua

SEQ ID NO: 107615 - RNA, 22 nt, Human
uacuuacagaaggaagcaauug

SEQ ID NO: 107616 - RNA, 22 nt, Human
uacuuagagcgauaauuuauac

SEQ ID NO: 107617 - RNA, 23 nt, Human
uacuuaggguuuagaucugacug

SEQ ID NO: 107618 - RNA, 18 nt, Human
uacuucaacucccagggc

SEQ ID NO: 107619 - RNA, 22 nt, Human
uacuucauucaaguucgcuaua

SEQ ID NO: 107620 - RNA, 20 nt, Human
uacuucugaggcacucugaa

SEQ ID NO: 107621 - RNA, 22 nt, Human
uacuucuguaagugcgccaagg

SEQ ID NO: 107622 - RNA, 22 nt, Human
uacuuguggcaguuugaauuua

SEQ ID NO: 107623 - RNA, 22 nt, Human
uacuugugugucaugugcagag

SEQ ID NO: 107624 - RNA, 22 nt, Human
uacuuguuuuguguuccuaaac

SEQ ID NO: 107625 - RNA, 22 nt, Human
uacuuuaauauaugugaaguuc

SEQ ID NO: 107626 - RNA, 22 nt, Human
uacuuucuaagacauacaacuu

SEQ ID NO: 107627 - RNA, 22 nt, Human
uacuuucuuucugauccuuaug

SEQ ID NO: 107628 - RNA, 20 nt, Human
uacuuugaucugauaagcaa

SEQ ID NO: 107629 - RNA, 22 nt, Human
uacuuugcagcuugauaaaaug

SEQ ID NO: 107630 - RNA, 22 nt, Human
uacuuugucaugcuaagaguga

SEQ ID NO: 107631 - RNA, 22 nt, Human
uacuuuguggagauuaaaaaua

SEQ ID NO: 107632 - RNA, 22 nt, Human
uacuuuucaagcagcugguuau

SEQ ID NO: 107633 - RNA, 22 nt, Human
uacuuuucuuugucaugcaucu

SEQ ID NO: 107634 - RNA, 19 nt, Human
uacuuuuucaggacagagu

SEQ ID NO: 107635 - RNA, 22 nt, Human
uagaaaagaagucuggccggga

SEQ ID NO: 107636 - RNA, 22 nt, Human
uagaaaagcucuaaggccucuc

SEQ ID NO: 107637 - RNA, 22 nt, Human
uagaaaauagggccuguggagc

SEQ ID NO: 107638 - RNA, 22 nt, Human
uagaaacaagggagaggauucu

SEQ ID NO: 107639 - RNA, 22 nt, Human
uagaaacacagagagacccaug

SEQ ID NO: 107640 - RNA, 22 nt, Human
uagaaacacagaucugguguca

SEQ ID NO: 107641 - RNA, 22 nt, Human
uagaaacagauguuuuugaaga

SEQ ID NO: 107642 - RNA, 22 nt, Human
uagaaacagcauauauuagccc

SEQ ID NO: 107643 - RNA, 22 nt, Human
uaugaaguagagcagagaugcc

SEQ ID NO: 107644 - RNA, 22 nt, Human
uaugaagugaguuaugguugcu

SEQ ID NO: 107645 - RNA, 22 nt, Human
uaugacaaaugauauauuuggc

SEQ ID NO: 107646 - RNA, 22 nt, Human
uaugacauuuucccagauuuau

SEQ ID NO: 107647 - RNA, 22 nt, Human
uaugacuuuggaaaaauuacuu

SEQ ID NO: 107648 - RNA, 18 nt, Human
uaugagaagauuagcaau

SEQ ID NO: 107649 - RNA, 22 nt, Human
uacaguaaucuggacaugauuu

SEQ ID NO: 107650 - RNA, 22 nt, Human
uacaguacagucuagacucugg

SEQ ID NO: 107651 - RNA, 22 nt, Human
uacaguagaaucuuauagccca

SEQ ID NO: 107652 - RNA, 22 nt, Human
uacaguagcugagguucucagg

SEQ ID NO: 107653 - RNA, 22 nt, Human
uacaguaguaagaaugccuuau

SEQ ID NO: 107654 - RNA, 22 nt, Human
uacaguagucgucuuauuuuga

SEQ ID NO: 107655 - RNA, 22 nt, Human
uacaguauggaaaauguauagu

SEQ ID NO: 107656 - RNA, 22 nt, Human
uacagucaacauugaugaugau

SEQ ID NO: 107657 - RNA, 22 nt, Human
uacagucaagcauaagaaguca

SEQ ID NO: 107658 - RNA, 21 nt, Human
uacagucuccccuguugucca

SEQ ID NO: 107659 - RNA, 22 nt, Human
uacagucucuuugagugauugu

SEQ ID NO: 107660 - RNA, 19 nt, Human
uacagugaaccaggaggag

SEQ ID NO: 107661 - RNA, 22 nt, Human
uacagugaaugaauggcugugc

SEQ ID NO: 107662 - RNA, 22 nt, Human
uacagugcgauuuuuaggccuc

SEQ ID NO: 107663 - RNA, 22 nt, Human
uacaguggggagcucaggagag

SEQ ID NO: 107664 - RNA, 20 nt, Human
uacaguguauguauuuaggc

SEQ ID NO: 107665 - RNA, 22 nt, Human
uacaguguuucccccaggauag

SEQ ID NO: 107666 - RNA, 22 nt, Human
uacaguuagccugucuacuccc

SEQ ID NO: 107667 - RNA, 22 nt, Human
uacaguucacaguaucauaaau

SEQ ID NO: 107668 - RNA, 22 nt, Human
uacaguuccaggaucauagggu

SEQ ID NO: 107669 - RNA, 22 nt, Human
uacaguuccucucguggaggug

SEQ ID NO: 107670 - RNA, 22 nt, Human
uacaguucuagucaaaaaucac

SEQ ID NO: 107671 - RNA, 22 nt, Human
uacaguuuagaaccauagaugg

SEQ ID NO: 107672 - RNA, 22 nt, Human
uacaguuuuggugaugaugaug

SEQ ID NO: 107673 - RNA, 22 nt, Human
uacaguuuuuauucaugacaag

SEQ ID NO: 107674 - RNA, 22 nt, Human
uacaguuuuucacugaagaugu

SEQ ID NO: 107675 - RNA, 22 nt, Human
uacauaaugagcuaguuaaguu

SEQ ID NO: 107676 - RNA, 22 nt, Human
uacauacagagaugcuaguuaa

SEQ ID NO: 107677 - RNA, 22 nt, Human
uacauacagccaaguaugaagu

SEQ ID NO: 107678 - RNA, 22 nt, Human
uacauacaguggaugcuuuagg

SEQ ID NO: 107679 - RNA, 22 nt, Human
uacauacauauucauacaggug

SEQ ID NO: 107680 - RNA, 22 nt, Human
uacauacaugguggaaugguua

SEQ ID NO: 107681 - RNA, 22 nt, Human
uacauacauuaccucauuuagu

SEQ ID NO: 107682 - RNA, 22 nt, Human
uacauagaggguaauagcauca

SEQ ID NO: 107683 - RNA, 22 nt, Human
uacauagauuuugaaacuggac

SEQ ID NO: 107684 - RNA, 22 nt, Human
uacauagcaaggaaaugacaga

SEQ ID NO: 107685 - RNA, 22 nt, Human
uacauauacugagugauuugcu

SEQ ID NO: 107686 - RNA, 22 nt, Human
uacauauguaaacauguauaaa

SEQ ID NO: 107687 - RNA, 20 nt, Human
uacaucucucagaugucuaa

SEQ ID NO: 107688 - RNA, 22 nt, Human
uacaucugucuggcuuuccauu

SEQ ID NO: 107689 - RNA, 22 nt, Human
uacaugaaauaggauucuggag

SEQ ID NO: 107690 - RNA, 22 nt, Human
uacaugaacaaaauagcagaaa

SEQ ID NO: 107691 - RNA, 22 nt, Human
uacaugaagaugaauguauggc

SEQ ID NO: 107692 - RNA, 21 nt, Human
uacaugaagcugguguuuguc

SEQ ID NO: 107693 - RNA, 21 nt, Human
uacaugaguguaugagcauau

SEQ ID NO: 107694 - RNA, 22 nt, Human
uacaugcacaugaacaugugug

SEQ ID NO: 107695 - RNA, 22 nt, Human
uacaugcaugauacaaaguugc

SEQ ID NO: 107696 - RNA, 22 nt, Human
uacaugcucaguaacuuucagu

SEQ ID NO: 107697 - RNA, 22 nt, Human
uacaugcuccacuuucuccugu

SEQ ID NO: 107698 - RNA, 22 nt, Human
uacaugcuuccaacugccccau

SEQ ID NO: 107699 - RNA, 22 nt, Human
uacauguaauuuucauaguaag

SEQ ID NO: 107700 - RNA, 22 nt, Human
uacaugugaucagaaagugaaa

SEQ ID NO: 107701 - RNA, 22 nt, Human
uacauguggccagaaauuugag

SEQ ID NO: 107702 - RNA, 22 nt, Human
uacauguggguuaaaaacacuc

SEQ ID NO: 107703 - RNA, 22 nt, Human
uacauguguucuguuucaaguu

SEQ ID NO: 107704 - RNA, 22 nt, Human
uacauuagcucaucuauuuauu

SEQ ID NO: 107705 - RNA, 22 nt, Human
uacauucagaauugggaggcaa

SEQ ID NO: 107706 - RNA, 22 nt, Human
uacauucagcaaaagaaugguu

SEQ ID NO: 107707 - RNA, 19 nt, Human
uacauuccacacaaucucu

SEQ ID NO: 107708 - RNA, 22 nt, Human
uacauucuauaucuguuacauc

SEQ ID NO: 107709 - RNA, 16 nt, Human
uacauucugaucacug

SEQ ID NO: 107710 - RNA, 22 nt, Human
uacauucugguggagaaaguaa

SEQ ID NO: 107711 - RNA, 22 nt, Human
uacauugaaaucaauggaugug

SEQ ID NO: 107712 - RNA, 22 nt, Human
uacauugauucaggauauaggc

SEQ ID NO: 107713 - RNA, 22 nt, Human
uacauugugauaggaagucacc

SEQ ID NO: 107714 - RNA, 22 nt, Human
uacauuguucaugcaugagaaa

SEQ ID NO: 107715 - RNA, 22 nt, Human
uacauuguuuuuucuugccauc

SEQ ID NO: 107716 - RNA, 22 nt, Human
uacauuuauaaggcuucucugu

SEQ ID NO: 107717 - RNA, 22 nt, Human
uacauuuccugucagagauaua

SEQ ID NO: 107718 - RNA, 22 nt, Human
uacauuuccuugacuccucaac

SEQ ID NO: 107719 - RNA, 22 nt, Human
uaccaaaaagugagccccagag

SEQ ID NO: 107720 - RNA, 22 nt, Human
uaccaaagauuaaauagcaaca

SEQ ID NO: 107721 - RNA, 19 nt, Human
uaccaaauugcauuauggc

SEQ ID NO: 107722 - RNA, 20 nt, Human
uaccaacagcaggaagcaua

SEQ ID NO: 107723 - RNA, 21 nt, Human
uaccaauugccuucuaguugu

SEQ ID NO: 107724 - RNA, 22 nt, Human
uaccacaggccaaauuugaggu

SEQ ID NO: 107725 - RNA, 22 nt, Human
uaccacagucugccauuagaug

SEQ ID NO: 107726 - RNA, 22 nt, Human
uaccacugcucccugccuguga

SEQ ID NO: 107727 - RNA, 20 nt, Human
uaccacuuauuugaauaauu

SEQ ID NO: 107728 - RNA, 19 nt, Human
uaccagccuccugccugau

SEQ ID NO: 107729 - RNA, 22 nt, Human
uaccagccugacccugucugac

SEQ ID NO: 107730 - RNA, 22 nt, Human
uaccagcucacacaaucuuugu

SEQ ID NO: 107731 - RNA, 15 nt, Human
uaccagcugauccgu

SEQ ID NO: 107732 - RNA, 22 nt, Human
uaccaggaauuauuuuacauuu

SEQ ID NO: 107733 - RNA, 22 nt, Human
uaccaggcagcugcacagaggc

SEQ ID NO: 107734 - RNA, 22 nt, Human
uaccaggucugugcagguguca

SEQ ID NO: 107735 - RNA, 22 nt, Human
uaccaguaauaguaugugagau

SEQ ID NO: 107736 - RNA, 22 nt, Human
uaccaugcuugagauacaguga

SEQ ID NO: 107737 - RNA, 22 nt, Human
uaccaugucaagcgagacaugu

SEQ ID NO: 107738 - RNA, 22 nt, Human
uaccaugucuucaauaagucua

SEQ ID NO: 107739 - RNA, 22 nt, Human
uaccauuguaccaagguaauuu

SEQ ID NO: 107740 - RNA, 22 nt, Human
uaccauuucaguaaaaacuuag

SEQ ID NO: 107741 - RNA, 22 nt, Human
uaccauuugagagagaacauaa

SEQ ID NO: 107742 - RNA, 22 nt, Human
uacccaggagaaacagcagggc

SEQ ID NO: 107743 - RNA, 22 nt, Human
uacccaguuauuuugucuuugu

SEQ ID NO: 107744 - RNA, 22 nt, Human
uacccaguucaguguuuaaaaa

SEQ ID NO: 107745 - RNA, 22 nt, Human
uacccucacgagacuucaaguc

SEQ ID NO: 107746 - RNA, 22 nt, Human
uacccucucccgguccagcuuu

SEQ ID NO: 107747 - RNA, 22 nt, Human
uaccucaaguuccaggaaagcg

SEQ ID NO: 107748 - RNA, 22 nt, Human
uaccucacugggccucaguuuu

SEQ ID NO: 107749 - RNA, 22 nt, Human
uaccugaaccaagcccagcucu

SEQ ID NO: 107750 - RNA, 22 nt, Human
uaccugagcccagugcagcaua

SEQ ID NO: 107751 - RNA, 22 nt, Human
uaccugaguuauauuaauaauu

SEQ ID NO: 107752 - RNA, 22 nt, Human
uaccugcacagccagccaugug

SEQ ID NO: 107753 - RNA, 22 nt, Human
uaccuggaaaaguuauaugugu

SEQ ID NO: 107754 - RNA, 22 nt, Human
uaccugggcccaccagugccug

SEQ ID NO: 107755 - RNA, 22 nt, Human
uaccugucaaaagacauggaga

SEQ ID NO: 107756 - RNA, 22 nt, Human
uaccuguuuuaaagcuaaaagg

SEQ ID NO: 107757 - RNA, 22 nt, Human
uaccuucaggcugcccuuugau

SEQ ID NO: 107758 - RNA, 22 nt, Human
uaugaagacucauuuauugggu

SEQ ID NO: 107759 - RNA, 22 nt, Human
uaugaagucucugauguugagu

SEQ ID NO: 107760 - RNA, 22 nt, Human
uaugaagugauguugaauuuug

SEQ ID NO: 107761 - RNA, 22 nt, Human
uaugaagugucuguuguaucug

SEQ ID NO: 107762 - RNA, 22 nt, Human
uaugaauucuguucauugauga

SEQ ID NO: 107763 - RNA, 20 nt, Human
uaugacaacgcagcaaggca

SEQ ID NO: 107764 - RNA, 22 nt, Human
uaugacaagguggaguaugagu

SEQ ID NO: 107765 - RNA, 22 nt, Human
uaugacauugcuuuuuagaacu

SEQ ID NO: 107766 - RNA, 22 nt, Human
uaugacauuggccaaguucugu

SEQ ID NO: 107767 - RNA, 22 nt, Human
uaugagaaaauaaauaucuguu

SEQ ID NO: 107768 - RNA, 22 nt, Human
uaugagaaauugcugauauuug

SEQ ID NO: 107769 - RNA, 22 nt, Human
uaugagaacaagaacaaucucc

SEQ ID NO: 107770 - RNA, 23 nt, Human
uaugagaacccauacgcugucuu

SEQ ID NO: 107771 - RNA, 22 nt, Human
uaugagaacgggggcguguggg

SEQ ID NO: 107772 - RNA, 22 nt, Human
uaugagaacugacagagugcca

SEQ ID NO: 107773 - RNA, 22 nt, Human
uaugagaagguauggugacuug

SEQ ID NO: 107774 - RNA, 22 nt, Human
uaugagaaucugcaguaugcuu

SEQ ID NO: 107775 - RNA, 22 nt, Human
uaugagaauuugcuaauuggcu

SEQ ID NO: 107776 - RNA, 22 nt, Human
uaugagauacuacagauuguga

SEQ ID NO: 107777 - RNA, 21 nt, Human
uaugagauauacuuauucuuu

SEQ ID NO: 107778 - RNA, 22 nt, Human
uaugagauuuggauucagugaa

SEQ ID NO: 107779 - RNA, 22 nt, Human
uaugagugguugaaugguaaac

SEQ ID NO: 107780 - RNA, 22 nt, Human
uaugaguguguguagaagguac

SEQ ID NO: 107781 - RNA, 22 nt, Human
uaugcaaaugacugguauguuu

SEQ ID NO: 107782 - RNA, 22 nt, Human
uaugcaauucucuuaauauucu

SEQ ID NO: 107783 - RNA, 22 nt, Human
uaugcacaguuacaagaauauc

SEQ ID NO: 107784 - RNA, 22 nt, Human
uaugcacauauaaccugcacug

SEQ ID NO: 107785 - RNA, 22 nt, Human
uaugcagagcaugacuguacca

SEQ ID NO: 107786 - RNA, 22 nt, Human
uaugcagcugguuaagaacaca

SEQ ID NO: 107787 - RNA, 22 nt, Human
uaugcagugguaucauuuuaaa

SEQ ID NO: 107788 - RNA, 22 nt, Human
uaugcaguguacgauguuuagu

SEQ ID NO: 107789 - RNA, 21 nt, Human
uaugcaguuuacuuagguauu

SEQ ID NO: 107790 - RNA, 22 nt, Human
uaugcauauguguucauuggag

SEQ ID NO: 107791 - RNA, 22 nt, Human
uaugcauuauacauuaauuucu

SEQ ID NO: 107792 - RNA, 22 nt, Human
uaugcccuuacaaugagcacaa

SEQ ID NO: 107793 - RNA, 22 nt, Human
uaugcuaagauaaacagaguua

SEQ ID NO: 107794 - RNA, 22 nt, Human
uaugcuaagugagaaaagacag

SEQ ID NO: 107795 - RNA, 22 nt, Human
uaugcuagauggaaaaauauug

SEQ ID NO: 107796 - RNA, 22 nt, Human
uaugcuccaaagacauguugcc

SEQ ID NO: 107797 - RNA, 22 nt, Human
uaugcucugagaccuuugugca

SEQ ID NO: 107798 - RNA, 22 nt, Human
uaugcuuuacuuuucauuguga

SEQ ID NO: 107799 - RNA, 22 nt, Human
ugcugaaugugcucccuuuuaa

SEQ ID NO: 107800 - RNA, 22 nt, Human
ugcugaauuccagggccccacu

SEQ ID NO: 107801 - RNA, 22 nt, Human
ugcugaauugguaguacuguug

SEQ ID NO: 107802 - RNA, 17 nt, Human
ugcugacagcugugugu

SEQ ID NO: 107803 - RNA, 22 nt, Human
ugcugagaaucacagguuauaa

SEQ ID NO: 107804 - RNA, 22 nt, Human
ugcugagagccagggcuggcau

SEQ ID NO: 107805 - RNA, 22 nt, Human
ugcugaggaaagaggauaaaag

SEQ ID NO: 107806 - RNA, 22 nt, Human
ugcugaggacuaaaggagauga

SEQ ID NO: 107807 - RNA, 22 nt, Human
ugcugaggagggcacccggggg

SEQ ID NO: 107808 - RNA, 19 nt, Human
ugcugaggaugcaagaucc

SEQ ID NO: 107809 - RNA, 22 nt, Human
ugcugaggcccaggagcacuuu

SEQ ID NO: 107810 - RNA, 22 nt, Human
ugcugagggcagaugaauuaga

SEQ ID NO: 107811 - RNA, 22 nt, Human
ugcugagguaaccauauccugc

SEQ ID NO: 107812 - RNA, 22 nt, Human
ugcugaguggcggccucacuuu

SEQ ID NO: 107813 - RNA, 22 nt, Human
ugcugagugggauuccugugcu

SEQ ID NO: 107814 - RNA, 22 nt, Human
ugcugauuuugccuacugaucc

SEQ ID NO: 107815 - RNA, 22 nt, Human
ugcugcacagauugccuuuuac

SEQ ID NO: 107816 - RNA, 22 nt, Human
ugcugcacgauaaauaauuucu

SEQ ID NO: 107817 - RNA, 22 nt, Human
ugcugcagcagugcgggcagcu

SEQ ID NO: 107818 - RNA, 22 nt, Human
ugcugcagcuuugucacaugca

SEQ ID NO: 107819 - RNA, 22 nt, Human
ugcugcaggaacuuaagaagcu

SEQ ID NO: 107820 - RNA, 22 nt, Human
ugcugcaggcagccccucuacu

SEQ ID NO: 107821 - RNA, 22 nt, Human
ugcugcagggauuucagagaca

SEQ ID NO: 107822 - RNA, 19 nt, Human
ugcugcagucaggcgaggg

SEQ ID NO: 107823 - RNA, 22 nt, Human
ugcugcauuugcaguccuuuaa

SEQ ID NO: 107824 - RNA, 23 nt, Human
ugcugccaagcacgaguugaguu

SEQ ID NO: 107825 - RNA, 22 nt, Human
ugcugccaagcccgugcuccug

SEQ ID NO: 107826 - RNA, 22 nt, Human
ugcugccaauuucuggucuuga

SEQ ID NO: 107827 - RNA, 22 nt, Human
ugcugccaccugguggcugaag

SEQ ID NO: 107828 - RNA, 22 nt, Human
ugcugccaccugugguagucug

SEQ ID NO: 107829 - RNA, 22 nt, Human
ugcugccagggcucugcccaca

SEQ ID NO: 107830 - RNA, 21 nt, Human
ugcugccauagaccugaggga

SEQ ID NO: 107831 - RNA, 22 nt, Human
ugcugccauggucgcugguguc

SEQ ID NO: 107832 - RNA, 23 nt, Human
ugcugcccgcuuggcacgcuccc

SEQ ID NO: 107833 - RNA, 22 nt, Human
ugcugccuaacagaacucuuuc

SEQ ID NO: 107834 - RNA, 20 nt, Human
ugcugccuacuaagcccuca

SEQ ID NO: 107835 - RNA, 22 nt, Human
ugcugccuaggaaucuguauuu

SEQ ID NO: 107836 - RNA, 20 nt, Human
ugcugccuguuuuugugaau

SEQ ID NO: 107837 - RNA, 22 nt, Human
ugcugccuuagcagccaggcaa

SEQ ID NO: 107838 - RNA, 22 nt, Human
ugcugccuucuaggcgugcccu

SEQ ID NO: 107839 - RNA, 22 nt, Human
ugcugccuuucugaauggugga

SEQ ID NO: 107840 - RNA, 22 nt, Human
ugcugcgggacccacugugggc

SEQ ID NO: 107841 - RNA, 17 nt, Human
ugcugcuaauuaaaaua

SEQ ID NO: 107842 - RNA, 22 nt, Human
ugcugcucaagcugcagcaaaa

SEQ ID NO: 107843 - RNA, 22 nt, Human
ugcugcucaaugagaugccauc

SEQ ID NO: 107844 - RNA, 22 nt, Human
ugcugcucuguaaagugaugag

SEQ ID NO: 107845 - RNA, 21 nt, Human
ugcugcugaucgggguuggcu

SEQ ID NO: 107846 - RNA, 22 nt, Human
ugcugcuguuuccuacaucuca

SEQ ID NO: 107847 - RNA, 22 nt, Human
ugcugcuuggcacccucagagu

SEQ ID NO: 107848 - RNA, 22 nt, Human
ugcugcuuuaaaaagugcugau

SEQ ID NO: 107849 - RNA, 22 nt, Human
ugcugcuuuuaguuggauagaa

SEQ ID NO: 107850 - RNA, 22 nt, Human
ugcugcuuuuguauaucagaga

SEQ ID NO: 107851 - RNA, 22 nt, Human
ugcuggaaagaauuuucuguua

SEQ ID NO: 107852 - RNA, 22 nt, Human
ugcuggaaagugaggugaauga

SEQ ID NO: 107853 - RNA, 22 nt, Human
ugcuggaaauaggcauuguagc

SEQ ID NO: 107854 - RNA, 20 nt, Human
ugcuggaaauuguucuagga

SEQ ID NO: 107855 - RNA, 19 nt, Human
ugcuggaacaucaguagcu

SEQ ID NO: 107856 - RNA, 22 nt, Human
ugcuggaaccaggaauuugaag

SEQ ID NO: 107857 - RNA, 23 nt, Human
ugcuggaacccagggccuaacac

SEQ ID NO: 107858 - RNA, 22 nt, Human
ugcuggaagaaaauucuuuaac

SEQ ID NO: 107859 - RNA, 22 nt, Human
ugcuggaagagaauacuggugg

SEQ ID NO: 107860 - RNA, 23 nt, Human
ugcuggaagguccaauuugcuca

SEQ ID NO: 107861 - RNA, 22 nt, Human
ugcuggagaaaguuuuucugaa

SEQ ID NO: 107862 - RNA, 22 nt, Human
ugcuggagacauagcaggcagc

SEQ ID NO: 107863 - RNA, 22 nt, Human
ugcuggagaggaaggugggguc

SEQ ID NO: 107864 - RNA, 22 nt, Human
ugcuggagcaucugagagcauc

SEQ ID NO: 107865 - RNA, 22 nt, Human
ugcuggagcuccgggcuguagg

SEQ ID NO: 107866 - RNA, 21 nt, Human
ugcuggaggacaggguuucau

SEQ ID NO: 107867 - RNA, 22 nt, Human
ugcuuuaagagauuguuaguac

SEQ ID NO: 107868 - RNA, 22 nt, Human
ugcuuuacaagccugcuuccuc

SEQ ID NO: 107869 - RNA, 22 nt, Human
ugcuuuauaaccauuucugugg

SEQ ID NO: 107870 - RNA, 22 nt, Human
ugcuuuauucccuucugaugug

SEQ ID NO: 107871 - RNA, 22 nt, Human
ugcuuucaaaggcuuucuagau

SEQ ID NO: 107872 - RNA, 22 nt, Human
ugcuuucaaugaauuguauacu

SEQ ID NO: 107873 - RNA, 22 nt, Human
ugcuuucacuucucugcagcca

SEQ ID NO: 107874 - RNA, 22 nt, Human
ugcuuucagccagugucuggau

SEQ ID NO: 107875 - RNA, 22 nt, Human
ugcuuucauucacaaaauagca

SEQ ID NO: 107876 - RNA, 22 nt, Human
ugcuuugacagggaugacauga

SEQ ID NO: 107877 - RNA, 20 nt, Human
ugcuuugauggaaauacagc

SEQ ID NO: 107878 - RNA, 22 nt, Human
ugcuuugcagugucuaacagaa

SEQ ID NO: 107879 - RNA, 22 nt, Human
ugcuuugcucugucucuagcua

SEQ ID NO: 107880 - RNA, 22 nt, Human
ugcuuugcuuuggagagccagc

SEQ ID NO: 107881 - RNA, 22 nt, Human
ugcuuuggcccaacauugaugc

SEQ ID NO: 107882 - RNA, 22 nt, Human
ugcuuugugacagauuaguuuu

SEQ ID NO: 107883 - RNA, 22 nt, Human
uggaaaaacugagacuuagaca

SEQ ID NO: 107884 - RNA, 19 nt, Human
uggaaaauggauugaauca

SEQ ID NO: 107885 - RNA, 22 nt, Human
uggaaaaugugacuauucuaaa

SEQ ID NO: 107886 - RNA, 22 nt, Human
uggaaacaaagucauaagcuca

SEQ ID NO: 107887 - RNA, 22 nt, Human
uggaaacagaucauaacuaagc

SEQ ID NO: 107888 - RNA, 23 nt, Human
uggaaacauucugaauguccauc

SEQ ID NO: 107889 - RNA, 22 nt, Human
uggaaacuagagugugggaagc

SEQ ID NO: 107890 - RNA, 22 nt, Human
uggaaacucagggccagaagga

SEQ ID NO: 107891 - RNA, 23 nt, Human
uggaaacuuaagggggagauguc

SEQ ID NO: 107892 - RNA, 22 nt, Human
uggaaacuuaccguuuggggaa

SEQ ID NO: 107893 - RNA, 22 nt, Human
uggaaagacauguccuucauua

SEQ ID NO: 107894 - RNA, 21 nt, Human
uggaaagauucaaagaccagg

SEQ ID NO: 107895 - RNA, 22 nt, Human
uggaaagcaguucuuagaaucg

SEQ ID NO: 107896 - RNA, 23 nt, Human
uggaaagcggaccuggggcagag

SEQ ID NO: 107897 - RNA, 22 nt, Human
uggaaaggacaguugcugauag

SEQ ID NO: 107898 - RNA, 22 nt, Human
uggaaauacuugccauaaaacu

SEQ ID NO: 107899 - RNA, 22 nt, Human
uggaaauaguaaugcauaagug

SEQ ID NO: 107900 - RNA, 22 nt, Human
uggaaauauacaaugugucucu

SEQ ID NO: 107901 - RNA, 22 nt, Human
uggaaauauuugcucauuaucu

SEQ ID NO: 107902 - RNA, 22 nt, Human
uggaaauggaucugaugagucu

SEQ ID NO: 107903 - RNA, 22 nt, Human
uggaaauguauuugggcaugcc

SEQ ID NO: 107904 - RNA, 22 nt, Human
uggaaauugcuauuaccgauga

SEQ ID NO: 107905 - RNA, 22 nt, Human
uggaaauuuaucaagauauaca

SEQ ID NO: 107906 - RNA, 22 nt, Human
uggaacaacaugcuggaaaauu

SEQ ID NO: 107907 - RNA, 22 nt, Human
uggaacaauucuugaagggaau

SEQ ID NO: 107908 - RNA, 22 nt, Human
uggaacacaggacuaucagcug

SEQ ID NO: 107909 - RNA, 22 nt, Human
uggaacacuggcuuuccacugu

SEQ ID NO: 107910 - RNA, 22 nt, Human
uggaacacuuucaguagcuauu

SEQ ID NO: 107911 - RNA, 22 nt, Human
uggaacgucguaauguugguua

SEQ ID NO: 107912 - RNA, 22 nt, Human
uggaagaauauggggguacaga

SEQ ID NO: 107913 - RNA, 22 nt, Human
uggaagaauguuugccuuauaa

SEQ ID NO: 107914 - RNA, 22 nt, Human
uggaagacauuuuggaccuugg

SEQ ID NO: 107915 - RNA, 22 nt, Human
uggaagagaaaauccacccuua

SEQ ID NO: 107916 - RNA, 22 nt, Human
uaugcuuugcaauuggaaaagg

SEQ ID NO: 107917 - RNA, 22 nt, Human
uaugcuuugguagagaguugug

SEQ ID NO: 107918 - RNA, 22 nt, Human
uaugcuuuuaaccuguaacuga

SEQ ID NO: 107919 - RNA, 17 nt, Human
uaugcuuuucuucucca

SEQ ID NO: 107920 - RNA, 22 nt, Human
uauggaaaaauguaucuuguca

SEQ ID NO: 107921 - RNA, 22 nt, Human
uauggaaagggaguuuaauuug

SEQ ID NO: 107922 - RNA, 19 nt, Human
uauggcaggccgaggcacu

SEQ ID NO: 107923 - RNA, 22 nt, Human
uauggcaguuacccuugaugau

SEQ ID NO: 107924 - RNA, 22 nt, Human
uauggcuaauucuuuacugacc

SEQ ID NO: 107925 - RNA, 17 nt, Human
uauggcuguguuugugc

SEQ ID NO: 107926 - RNA, 22 nt, Human
uauggcuucuuuugcaacuacu

SEQ ID NO: 107927 - RNA, 21 nt, Human
uauggcuuuacuaagcugcac

SEQ ID NO: 107928 - RNA, 22 nt, Human
uauggcuuucaaaggaacucgg

SEQ ID NO: 107929 - RNA, 22 nt, Human
uauggcuuugggccaaaucuac

SEQ ID NO: 107930 - RNA, 22 nt, Human
uauggcuuuuaacugucguaug

SEQ ID NO: 107931 - RNA, 22 nt, Human
uauggcuuuucuuuccuagugu

SEQ ID NO: 107932 - RNA, 22 nt, Human
uauggguaaauaauaauuuuag

SEQ ID NO: 107933 - RNA, 22 nt, Human
uauggguaagaucuuuuguauu

SEQ ID NO: 107934 - RNA, 22 nt, Human
uauggguagaaguggcccaagc

SEQ ID NO: 107935 - RNA, 22 nt, Human
uauggucauuuguuagugcuuu

SEQ ID NO: 107936 - RNA, 22 nt, Human
uauguaagugagaucauggagu

SEQ ID NO: 107937 - RNA, 22 nt, Human
uauguacauacaugugcauacg

SEQ ID NO: 107938 - RNA, 22 nt, Human
uauguacucuaauuugucucau

SEQ ID NO: 107939 - RNA, 22 nt, Human
uauguagaaaacaaaaguugaa

SEQ ID NO: 107940 - RNA, 22 nt, Human
uauguagacaggcugcuuuucc

SEQ ID NO: 107941 - RNA, 22 nt, Human
uauguagacuucauuguuuacu

SEQ ID NO: 107942 - RNA, 22 nt, Human
uauguagguaaacacagacaua

SEQ ID NO: 107943 - RNA, 22 nt, Human
uauguaguguugagaaugcuug

SEQ ID NO: 107944 - RNA, 18 nt, Human
uauguauaacauaguuca

SEQ ID NO: 107945 - RNA, 22 nt, Human
uauguauauguauacacacaca

SEQ ID NO: 107946 - RNA, 22 nt, Human
uauguauccguguguguacaga

SEQ ID NO: 107947 - RNA, 22 nt, Human
uauguaucuuuuguuuucccug

SEQ ID NO: 107948 - RNA, 22 nt, Human
uauguauuauucaucaguggga

SEQ ID NO: 107949 - RNA, 22 nt, Human
uauguauucugaguacaaguuc

SEQ ID NO: 107950 - RNA, 19 nt, Human
uaugucccuuucccccauu

SEQ ID NO: 107951 - RNA, 22 nt, Human
uaugucuuaauccuuccuuagg

SEQ ID NO: 107952 - RNA, 22 nt, Human
uaugucuugcauuuuucaaacu

SEQ ID NO: 107953 - RNA, 22 nt, Human
uaugucuuuaguaucuuuugga

SEQ ID NO: 107954 - RNA, 22 nt, Human
uaugugaauacagcaguggaug

SEQ ID NO: 107955 - RNA, 22 nt, Human
uaugugacauaucucaguuuga

SEQ ID NO: 107956 - RNA, 22 nt, Human
uaugugacuugacaaagcuucc

SEQ ID NO: 107957 - RNA, 22 nt, Human
uaugugauagaguuacuuuaua

SEQ ID NO: 107958 - RNA, 22 nt, Human
uaugugcaaaaugcuagacuag

SEQ ID NO: 107959 - RNA, 22 nt, Human
uaugugcauaugcauacacaca

SEQ ID NO: 107960 - RNA, 23 nt, Human
uaugugcauauguguaagaauac

SEQ ID NO: 107961 - RNA, 22 nt, Human
uaugugcauuauuaccagugga

SEQ ID NO: 107962 - RNA, 22 nt, Human
uaugugcuaucaaaugcucauu

SEQ ID NO: 107963 - RNA, 22 nt, Human
uauguguaaccuugugauuuau

SEQ ID NO: 107964 - RNA, 22 nt, Human
uauguguacaucugguugagca

SEQ ID NO: 107965 - RNA, 22 nt, Human
uauguguauaucuguaugugca

SEQ ID NO: 107966 - RNA, 19 nt, Human
uauguguauauguaucugu

SEQ ID NO: 107967 - RNA, 22 nt, Human
uauguguauguucauucaugca

SEQ ID NO: 107968 - RNA, 22 nt, Human
uauguguauugagcauuguuac

SEQ ID NO: 107969 - RNA, 22 nt, Human
uaugugucccugcuacucaaca

SEQ ID NO: 107970 - RNA, 22 nt, Human
uaugugucucaguugugauuga

SEQ ID NO: 107971 - RNA, 23 nt, Human
uaugugugggucuacuagaaguc

SEQ ID NO: 107972 - RNA, 22 nt, Human
uauguguguaugacagacagag

SEQ ID NO: 107973 - RNA, 22 nt, Human
uauguuaagugggauaaucaaa

SEQ ID NO: 107974 - RNA, 19 nt, Human
uauguuauguuguuuacuc

SEQ ID NO: 107975 - RNA, 22 nt, Human
uauguuauuuucauacaacaga

SEQ ID NO: 107976 - RNA, 22 nt, Human
ucccacaccugucuauuccuag

SEQ ID NO: 107977 - RNA, 21 nt, Human
ucccacagaaacugcgaaauu

SEQ ID NO: 107978 - RNA, 22 nt, Human
ucccacagcaugaguaacucuc

SEQ ID NO: 107979 - RNA, 22 nt, Human
ucccacagcuucgugcuucccc

SEQ ID NO: 107980 - RNA, 22 nt, Human
ucccacaggagccugaguccca

SEQ ID NO: 107981 - RNA, 22 nt, Human
ucccacagguggagcuugcagu

SEQ ID NO: 107982 - RNA, 22 nt, Human
ucccacccauccugcaucucuu

SEQ ID NO: 107983 - RNA, 22 nt, Human
ucccaccuuccguggaacccgu

SEQ ID NO: 107984 - RNA, 22 nt, Human
ucccacugagcauaugcagaug

SEQ ID NO: 107985 - RNA, 22 nt, Human
ucccacugagccccugcuggug

SEQ ID NO: 107986 - RNA, 22 nt, Human
ucccacuggacgucugugcugg

SEQ ID NO: 107987 - RNA, 22 nt, Human
ucccagaaaaaggaggcuauga

SEQ ID NO: 107988 - RNA, 22 nt, Human
ucccagaauccucacucuauca

SEQ ID NO: 107989 - RNA, 22 nt, Human
ucccagacaaucauuggccacc

SEQ ID NO: 107990 - RNA, 22 nt, Human
ucccagagaaagucaaggucuu

SEQ ID NO: 107991 - RNA, 22 nt, Human
ucccagagacagagccuccucc

SEQ ID NO: 107992 - RNA, 22 nt, Human
ucccagagcucuggagguugga

SEQ ID NO: 107993 - RNA, 22 nt, Human
ucccagagcugauaagccuuua

SEQ ID NO: 107994 - RNA, 22 nt, Human
ucccagaggaaauggcagcuga

SEQ ID NO: 107995 - RNA, 21 nt, Human
ucccagagugcuugggacugc

SEQ ID NO: 107996 - RNA, 22 nt, Human
ucccagaguuuccuguguccca

SEQ ID NO: 107997 - RNA, 22 nt, Human
ucccagauuguugauggcuuaa

SEQ ID NO: 107998 - RNA, 22 nt, Human
ucccagcacgucugcuguuucu

SEQ ID NO: 107999 - RNA, 22 nt, Human
ucccagcagcauagcucagaau

SEQ ID NO: 108000 - RNA, 22 nt, Human
ucccagccuccugacaguuuug

SEQ ID NO: 108001 - RNA, 22 nt, Human
ucccagccuuccagucugguuu

SEQ ID NO: 108002 - RNA, 22 nt, Human
ucccagccuuucuuucuccagc

SEQ ID NO: 108003 - RNA, 22 nt, Human
ucccagcgcggggggaggaucc

SEQ ID NO: 108004 - RNA, 22 nt, Human
ucccagcugcugagauagugcu

SEQ ID NO: 108005 - RNA, 17 nt, Human
ucccaggaacagggaau

SEQ ID NO: 108006 - RNA, 22 nt, Human
ucccaggacaugggcucugcuc

SEQ ID NO: 108007 - RNA, 22 nt, Human
ucccaggacuuccaguuggagg

SEQ ID NO: 108008 - RNA, 16 nt, Human
ucccaggaggcggaac

SEQ ID NO: 108009 - RNA, 22 nt, Human
ucccaggaucugagggcagaga

SEQ ID NO: 108010 - RNA, 22 nt, Human
ucccaggaugaagacaguguug

SEQ ID NO: 108011 - RNA, 22 nt, Human
ucccaggaugugcgugccgccg

SEQ ID NO: 108012 - RNA, 19 nt, Human
ucccaggcaaaggcuucuc

SEQ ID NO: 108013 - RNA, 22 nt, Human
ucccaggccacacuuggggaac

SEQ ID NO: 108014 - RNA, 22 nt, Human
ucccaggcuaggccucugcguu

SEQ ID NO: 108015 - RNA, 22 nt, Human
ucccaggcuggcaggcagcagu

SEQ ID NO: 108016 - RNA, 22 nt, Human
ucccagggacaccaagcuguuu

SEQ ID NO: 108017 - RNA, 22 nt, Human
ucccagggacucucugccuucc

SEQ ID NO: 108018 - RNA, 22 nt, Human
ucccagggacuggaugaugcag

SEQ ID NO: 108019 - RNA, 21 nt, Human
ucccagggccaggugccauca

SEQ ID NO: 108020 - RNA, 22 nt, Human
ucccaggguuacagccagggca

SEQ ID NO: 108021 - RNA, 22 nt, Human
ucccaggugaugcugaggccac

SEQ ID NO: 108022 - RNA, 20 nt, Human
ucccagucagccagagugag

SEQ ID NO: 108023 - RNA, 22 nt, Human
ucccagugggaagcagcacgcu

SEQ ID NO: 108024 - RNA, 22 nt, Human
ucccagugggugacuggaggcu

SEQ ID NO: 108025 - RNA, 22 nt, Human
ucccaguggugggugcacauuu

SEQ ID NO: 108026 - RNA, 22 nt, Human
ucccaguguggcaggccaugga

SEQ ID NO: 108027 - RNA, 22 nt, Human
ucccaucaucuguucuggcuac

SEQ ID NO: 108028 - RNA, 23 nt, Human
ucccaugggcucacugcccugca

SEQ ID NO: 108029 - RNA, 22 nt, Human
ucccauucugccaaggacauug

SEQ ID NO: 108030 - RNA, 22 nt, Human
ucccauuuaucuagaugucaga

SEQ ID NO: 108031 - RNA, 22 nt, Human
ucccauuucaugcuggcugugg

SEQ ID NO: 108032 - RNA, 22 nt, Human
ucccauuucuugcauccuugcu

SEQ ID NO: 108033 - RNA, 22 nt, Human
uccccaccuaagauacccaucu

SEQ ID NO: 108034 - RNA, 22 nt, Human
uccccacucucuccuggagcuu

SEQ ID NO: 108035 - RNA, 22 nt, Human
uccccagcauugagggucucuc

SEQ ID NO: 108036 - RNA, 22 nt, Human
uccccagccgugaaggagagga

SEQ ID NO: 108037 - RNA, 22 nt, Human
uccccagcucugugcuuccacu

SEQ ID NO: 108038 - RNA, 22 nt, Human
uccccaggacuaaguugcaauc

SEQ ID NO: 108039 - RNA, 20 nt, Human
uccccagggcaucaggagca

SEQ ID NO: 108040 - RNA, 22 nt, Human
uccccaggggcaucucucugcu

SEQ ID NO: 108041 - RNA, 22 nt, Human
ucccccacucuaaaggagccuu

SEQ ID NO: 108042 - RNA, 23 nt, Human
uccccucaggcagccagugcccu

SEQ ID NO: 108043 - RNA, 22 nt, Human
uccccucccuuccaacagagcu

SEQ ID NO: 108044 - RNA, 22 nt, Human
uccccuccucuccugauauggg

SEQ ID NO: 108045 - RNA, 22 nt, Human
uccccuuuguaagauggaaacg

SEQ ID NO: 108046 - RNA, 19 nt, Human
ucccgcccacugagcgugc

SEQ ID NO: 108047 - RNA, 22 nt, Human
ucccggcgcugggagguggguc

SEQ ID NO: 108048 - RNA, 22 nt, Human
ucccuagguccuagucacagua

SEQ ID NO: 108049 - RNA, 22 nt, Human
ucccucagaugagcuccuagca

SEQ ID NO: 108050 - RNA, 15 nt, Human
ucccucagcuaaaga

SEQ ID NO: 108051 - RNA, 22 nt, Human
ucccucagcucauauuuaugcc

SEQ ID NO: 108052 - RNA, 22 nt, Human
ucccucagggugcaguugcuuu

SEQ ID NO: 108053 - RNA, 22 nt, Human
ucccucaggugguucuuguuuc

SEQ ID NO: 108054 - RNA, 20 nt, Human
ucccucaguuuccagcccug

SEQ ID NO: 108055 - RNA, 22 nt, Human
ucccucaucucacaugugugug

SEQ ID NO: 108056 - RNA, 22 nt, Human
ucccuccccacuucugagcuuu

SEQ ID NO: 108057 - RNA, 19 nt, Human
ucccucccuguaaucucac

SEQ ID NO: 108058 - RNA, 20 nt, Human
ucccuccugcagauagagaa

SEQ ID NO: 108059 - RNA, 22 nt, Human
ucccuccuggccgucaccgcug

SEQ ID NO: 108060 - RNA, 22 nt, Human
ucccucuaaacuguaagauucu

SEQ ID NO: 108061 - RNA, 22 nt, Human
ucccucugcuagugcuugagcu

SEQ ID NO: 108062 - RNA, 22 nt, Human
ucccugaaacauaauagaugcc

SEQ ID NO: 108063 - RNA, 22 nt, Human
ucccugaaauuugaagaggaau

SEQ ID NO: 108064 - RNA, 22 nt, Human
ucccugaaccacuagugaugag

SEQ ID NO: 108065 - RNA, 22 nt, Human
ucccugagaaagcccaggaggu

SEQ ID NO: 108066 - RNA, 22 nt, Human
ucccugagagcacuggggagcc

SEQ ID NO: 108067 - RNA, 21 nt, Human
ucccugagcccaaggggcucc

SEQ ID NO: 108068 - RNA, 22 nt, Human
ucccugagcuucaucaggcuuu

SEQ ID NO: 108069 - RNA, 22 nt, Human
ucccugaugccuugauccgugg

SEQ ID NO: 108070 - RNA, 22 nt, Human
ucagccucauuuucugcucugu

SEQ ID NO: 108071 - RNA, 22 nt, Human
ucagccuccgaaagugcuggga

SEQ ID NO: 108072 - RNA, 22 nt, Human
ucagccuuugaagggcugcagg

SEQ ID NO: 108073 - RNA, 22 nt, Human
ucagcuaugagguggugguucu

SEQ ID NO: 108074 - RNA, 22 nt, Human
ucagcuccacagcuccucugcc

SEQ ID NO: 108075 - RNA, 22 nt, Human
ucagcucuaaguuuuaugcaaa

SEQ ID NO: 108076 - RNA, 22 nt, Human
ucagcucuacacacaccugugu

SEQ ID NO: 108077 - RNA, 22 nt, Human
ucagcucucugggcucgaaccu

SEQ ID NO: 108078 - RNA, 20 nt, Human
ucagcucugugccugggaug

SEQ ID NO: 108079 - RNA, 22 nt, Human
ucagcugaaguggagaagcaga

SEQ ID NO: 108080 - RNA, 22 nt, Human
ucagcugccccgggcacugccc

SEQ ID NO: 108081 - RNA, 22 nt, Human
ucagcugcugugguauguacau

SEQ ID NO: 108082 - RNA, 22 nt, Human
ucagcugcuucauguucugaau

SEQ ID NO: 108083 - RNA, 23 nt, Human
ucagcugcuuccuccugccugcc

SEQ ID NO: 108084 - RNA, 22 nt, Human
ucagcuggagauccuuguugug

SEQ ID NO: 108085 - RNA, 22 nt, Human
uggcccuuguccugggagaguu

SEQ ID NO: 108086 - RNA, 22 nt, Human
uggccggccaccuccaggguug

SEQ ID NO: 108087 - RNA, 22 nt, Human
uggccgggaagggacagugugg

SEQ ID NO: 108088 - RNA, 22 nt, Human
uggccguguuagauguuuggcu

SEQ ID NO: 108089 - RNA, 22 nt, Human
uggccucaaccguccuaagcac

SEQ ID NO: 108090 - RNA, 22 nt, Human
uggccucaagucugagggccuu

SEQ ID NO: 108091 - RNA, 22 nt, Human
uggccuccccuaacagccucuu

SEQ ID NO: 108092 - RNA, 23 nt, Human
uggccucuccccaccuggcagaa

SEQ ID NO: 108093 - RNA, 22 nt, Human
uggccucugaggcaccuuugcc

SEQ ID NO: 108094 - RNA, 22 nt, Human
uggccucugggaaagcagauuc

SEQ ID NO: 108095 - RNA, 22 nt, Human
uggccugacuguccagccaggg

SEQ ID NO: 108096 - RNA, 22 nt, Human
uggccugaggcucggcaugggu

SEQ ID NO: 108097 - RNA, 22 nt, Human
uggccugcaaagucuucuugcu

SEQ ID NO: 108098 - RNA, 22 nt, Human
uggccugccucccggcuucuuu

SEQ ID NO: 108099 - RNA, 22 nt, Human
uggccugccuucgcugagcuga

SEQ ID NO: 108100 - RNA, 22 nt, Human
uggccugcucugacuuuggggg

SEQ ID NO: 108101 - RNA, 22 nt, Human
uggccuggaagagaggucgagg

SEQ ID NO: 108102 - RNA, 23 nt, Human
uggccuggagagaaaagaugagu

SEQ ID NO: 108103 - RNA, 22 nt, Human
uggccuggcagagcaaggccug

SEQ ID NO: 108104 - RNA, 22 nt, Human
uggccuggcugcccugucugga

SEQ ID NO: 108105 - RNA, 22 nt, Human
uggccugggcaugaagcaucgu

SEQ ID NO: 108106 - RNA, 22 nt, Human
uggccuggggaccugugagacc

SEQ ID NO: 108107 - RNA, 22 nt, Human
uggccugggugcugcugacauc

SEQ ID NO: 108108 - RNA, 22 nt, Human
uggccugguaccacauagauuu

SEQ ID NO: 108109 - RNA, 22 nt, Human
uggccugguccuugucaaggca

SEQ ID NO: 108110 - RNA, 22 nt, Human
uggccuggugucugcgaggccu

SEQ ID NO: 108111 - RNA, 22 nt, Human
uggccugguuguugcugccguu

SEQ ID NO: 108112 - RNA, 22 nt, Human
uggccugucuuguugugcuaga

SEQ ID NO: 108113 - RNA, 22 nt, Human
uggccuguggcuuaaggucugu

SEQ ID NO: 108114 - RNA, 22 nt, Human
uggccuugaaccaggucuccac

SEQ ID NO: 108115 - RNA, 22 nt, Human
uggccuugagagaucaaaaggu

SEQ ID NO: 108116 - RNA, 22 nt, Human
uggccuuggagaggcacggccc

SEQ ID NO: 108117 - RNA, 22 nt, Human
uggccuugguccucuuugcaau

SEQ ID NO: 108118 - RNA, 22 nt, Human
uggccuuguguuuaagcaagaa

SEQ ID NO: 108119 - RNA, 22 nt, Human
uggcgagccccgacugaguguu

SEQ ID NO: 108120 - RNA, 20 nt, Human
uggcggggaugagggaguua

SEQ ID NO: 108121 - RNA, 22 nt, Human
uggcgucucucauaaguaugug

SEQ ID NO: 108122 - RNA, 23 nt, Human
uggcuaaacaguggagaaagcuu

SEQ ID NO: 108123 - RNA, 22 nt, Human
uggcuacagaauuggcccuguu

SEQ ID NO: 108124 - RNA, 22 nt, Human
uggcuacagauuugcugacaau

SEQ ID NO: 108125 - RNA, 22 nt, Human
uggcuacagcaagaggaaagaa

SEQ ID NO: 108126 - RNA, 22 nt, Human
uggcuacauuuguugaucacuu

SEQ ID NO: 108127 - RNA, 22 nt, Human
uggcucagagagggagugugga

SEQ ID NO: 108128 - RNA, 22 nt, Human
uggcucagaugcucuuccagug

SEQ ID NO: 108129 - RNA, 22 nt, Human
uggcucagcuuuccccaucugg

SEQ ID NO: 108130 - RNA, 22 nt, Human
uggcucaggaucuaagcagaau

SEQ ID NO: 108131 - RNA, 22 nt, Human
uggcucaggccuacgacgccuu

SEQ ID NO: 108132 - RNA, 23 nt, Human
uggcucagggucucuuaugaagu

SEQ ID NO: 108133 - RNA, 22 nt, Human
uggcucaggugugagcugaaga

SEQ ID NO: 108134 - RNA, 22 nt, Human
uggcucaguagcagugugguca

SEQ ID NO: 108135 - RNA, 22 nt, Human
uggcucaguuucaguccugguu

SEQ ID NO: 108136 - RNA, 22 nt, Human
uggcucauggaauuagcuauua

SEQ ID NO: 108137 - RNA, 22 nt, Human
uggcuccacaggccagggugug

SEQ ID NO: 108138 - RNA, 22 nt, Human
uggcuccagauuuccugcugca

SEQ ID NO: 108139 - RNA, 20 nt, Human
uggcuccagccuccccuacc

SEQ ID NO: 108140 - RNA, 22 nt, Human
uggcuccagcucaaguauggca

SEQ ID NO: 108141 - RNA, 22 nt, Human
uggcuccagguugaacuuuggg

SEQ ID NO: 108142 - RNA, 22 nt, Human
uggcuccaugauaguucuuaca

SEQ ID NO: 108143 - RNA, 22 nt, Human
uggcucccaaggagcuccugcc

SEQ ID NO: 108144 - RNA, 22 nt, Human
uggcucccacaaacucacuacu

SEQ ID NO: 108145 - RNA, 22 nt, Human
uggcuccguuguacaggcugga

SEQ ID NO: 108146 - RNA, 22 nt, Human
uggcuccuaaucggcuucuuuc

SEQ ID NO: 108147 - RNA, 22 nt, Human
uggcuccucccugugugugcgu

SEQ ID NO: 108148 - RNA, 20 nt, Human
uggcuccucuuggcuguggc

SEQ ID NO: 108149 - RNA, 20 nt, Human
uggcuccuggcuccucccuc

SEQ ID NO: 108150 - RNA, 22 nt, Human
uggcucucagcucccagcagcc

SEQ ID NO: 108151 - RNA, 22 nt, Human
uggcucucugggagguccuggc

SEQ ID NO: 108152 - RNA, 22 nt, Human
uggcucugagcugcaaagcugc

SEQ ID NO: 108153 - RNA, 23 nt, Human
uggcucugagcuuccugguggcc

SEQ ID NO: 108154 - RNA, 17 nt, Human
uggcucugaggcugaau

SEQ ID NO: 108155 - RNA, 22 nt, Human
uggcucugcaccucaguguacc

SEQ ID NO: 108156 - RNA, 22 nt, Human
uggcucugcagcagugugcgug

SEQ ID NO: 108157 - RNA, 18 nt, Human
uggcucugcagccagaug

SEQ ID NO: 108158 - RNA, 21 nt, Human
uggcucugcucagagcagucc

SEQ ID NO: 108159 - RNA, 22 nt, Human
uggcucugcugaaccuagugca

SEQ ID NO: 108160 - RNA, 22 nt, Human
uggcucuggauuaaucuaggaa

SEQ ID NO: 108161 - RNA, 22 nt, Human
uggcucugggaaugggaagaug

SEQ ID NO: 108162 - RNA, 22 nt, Human
uggcucugggcaccguguccac

SEQ ID NO: 108163 - RNA, 22 nt, Human
uggcucugugaacagacgacug

SEQ ID NO: 108164 - RNA, 23 nt, Human
uggcucugugucacauacaggau

SEQ ID NO: 108165 - RNA, 22 nt, Human
uggcucuguucgccaucaggag

SEQ ID NO: 108166 - RNA, 19 nt, Human
uggcucuguuucucuggag

SEQ ID NO: 108167 - RNA, 19 nt, Human
uggcucuuuuuaugacauu

SEQ ID NO: 108168 - RNA, 22 nt, Human
uggcugaauucaucaagaaaau

SEQ ID NO: 108169 - RNA, 22 nt, Human
uggcugacaauguagcaguaac

SEQ ID NO: 108170 - RNA, 22 nt, Human
uggcugagaaaaaagagcuaua

SEQ ID NO: 108171 - RNA, 22 nt, Human
uggcugagaaguucugguggga

SEQ ID NO: 108172 - RNA, 22 nt, Human
uggcugagaaugggaugaugcc

SEQ ID NO: 108173 - RNA, 22 nt, Human
uggcugagagucauccugugug

SEQ ID NO: 108174 - RNA, 22 nt, Human
uggcugagcugcagcguggcuu

SEQ ID NO: 108175 - RNA, 22 nt, Human
uggcugaggcacagcugccgcc

SEQ ID NO: 108176 - RNA, 23 nt, Human
uggcugagguccagguaguuuca

SEQ ID NO: 108177 - RNA, 22 nt, Human
uggcugagugaacauguccauu

SEQ ID NO: 108178 - RNA, 22 nt, Human
uggcugagugauauuugcaaag

SEQ ID NO: 108179 - RNA, 21 nt, Human
uggcugaguggaugcaugaau

SEQ ID NO: 108180 - RNA, 22 nt, Human
uggcugaguucuccaggaguag

SEQ ID NO: 108181 - RNA, 22 nt, Human
uggcugauugauuuccuaugua

SEQ ID NO: 108182 - RNA, 21 nt, Human
uggcugcaagcagcugccucc

SEQ ID NO: 108183 - RNA, 22 nt, Human
uggcugcacuucaacacauccu

SEQ ID NO: 108184 - RNA, 22 nt, Human
uggcugcagaucaagggcaggc

SEQ ID NO: 108185 - RNA, 22 nt, Human
uggcugccaugacgccugggga

SEQ ID NO: 108186 - RNA, 22 nt, Human
uggcugcccucaugggccugau

SEQ ID NO: 108187 - RNA, 22 nt, Human
ucccugcagccccugagccuuc

SEQ ID NO: 108188 - RNA, 22 nt, Human
ucccugcaguaguggcuaagau

SEQ ID NO: 108189 - RNA, 22 nt, Human
ucccugcccucagugcacccgg

SEQ ID NO: 108190 - RNA, 20 nt, Human
ucccugccuuuuacugcugg

SEQ ID NO: 108191 - RNA, 22 nt, Human
ucccugcugggagaugaccuua

SEQ ID NO: 108192 - RNA, 22 nt, Human
ucccugcuuggaaugacccuua

SEQ ID NO: 108193 - RNA, 22 nt, Human
ucccuggaacagagagacaacg

SEQ ID NO: 108194 - RNA, 22 nt, Human
uccccaguaagccugcacugug

SEQ ID NO: 108195 - RNA, 22 nt, Human
ucccccaaaugaaugaggaaua

SEQ ID NO: 108196 - RNA, 22 nt, Human
ucccccaacucuuagcacugua

SEQ ID NO: 108197 - RNA, 22 nt, Human
uccccucucugcgcucccaggu

SEQ ID NO: 108198 - RNA, 22 nt, Human
uccccucugguugacccaggag

SEQ ID NO: 108199 - RNA, 18 nt, Human
uccccugcucuggugcuc

SEQ ID NO: 108200 - RNA, 22 nt, Human
uccccuggcaccuaguccuacu

SEQ ID NO: 108201 - RNA, 22 nt, Human
uccccuuggcuuggucaagagg

SEQ ID NO: 108202 - RNA, 22 nt, Human
ucccgcuucuuccgaaucgcga

SEQ ID NO: 108203 - RNA, 22 nt, Human
ucccgggcaggucgagcgagcc

SEQ ID NO: 108204 - RNA, 22 nt, Human
ucccguugaugacggugcaucc

SEQ ID NO: 108205 - RNA, 22 nt, Human
ucccuaaacucugaacugauuc

SEQ ID NO: 108206 - RNA, 22 nt, Human
ucccuagaggucuucacaagau

SEQ ID NO: 108207 - RNA, 22 nt, Human
ucccuaggagaauugccgcagc

SEQ ID NO: 108208 - RNA, 22 nt, Human
ucccuagucgcaucuguggaga

SEQ ID NO: 108209 - RNA, 22 nt, Human
ucccucagaaauucucucugaa

SEQ ID NO: 108210 - RNA, 21 nt, Human
ucccucagaagcucuugguca

SEQ ID NO: 108211 - RNA, 21 nt, Human
ucccucagaagguagccaagc

SEQ ID NO: 108212 - RNA, 18 nt, Human
ucccucagaauuauagaa

SEQ ID NO: 108213 - RNA, 22 nt, Human
ucccucagcaggaacuggccug

SEQ ID NO: 108214 - RNA, 22 nt, Human
ucccucagcaggaauguggcag

SEQ ID NO: 108215 - RNA, 22 nt, Human
ucccucaggacccaacuuguaa

SEQ ID NO: 108216 - RNA, 23 nt, Human
ucccucaggccuuaucuccaucu

SEQ ID NO: 108217 - RNA, 19 nt, Human
ucccucagucugccaggcc

SEQ ID NO: 108218 - RNA, 22 nt, Human
ucccuccagaauggugaggaag

SEQ ID NO: 108219 - RNA, 18 nt, Human
ucccucccugcuguggcc

SEQ ID NO: 108220 - RNA, 18 nt, Human
ucccuccugccugcuucc

SEQ ID NO: 108221 - RNA, 22 nt, Human
ucccucucccuauugccuggag

SEQ ID NO: 108222 - RNA, 22 nt, Human
ucccucucuagccuguucagua

SEQ ID NO: 108223 - RNA, 22 nt, Human
ucccucucuggcuggggugcgg

SEQ ID NO: 108224 - RNA, 22 nt, Human
ucccucucuugggcguggcuca

SEQ ID NO: 108225 - RNA, 22 nt, Human
ucccucugggcuggagcagggu

SEQ ID NO: 108226 - RNA, 22 nt, Human
ucccucugguccucgguggaga

SEQ ID NO: 108227 - RNA, 22 nt, Human
ucccugaaacaucucuguggau

SEQ ID NO: 108228 - RNA, 22 nt, Human
ucucucuucaacccuuaacuag

SEQ ID NO: 108229 - RNA, 22 nt, Human
ucucucuucuuuguuaagaaug

SEQ ID NO: 108230 - RNA, 22 nt, Human
ucucugaagagucagacauaac

SEQ ID NO: 108231 - RNA, 22 nt, Human
ucucugagaagcugaggcuggg

SEQ ID NO: 108232 - RNA, 22 nt, Human
ucucugagaaguuccuuuguga

SEQ ID NO: 108233 - RNA, 21 nt, Human
ucucugagaggucugcuuaga

SEQ ID NO: 108234 - RNA, 22 nt, Human
ucucugagcaccuaagauauau

SEQ ID NO: 108235 - RNA, 23 nt, Human
ucucugagccauagcagucccaa

SEQ ID NO: 108236 - RNA, 22 nt, Human
ucucugagcccagugucccccu

SEQ ID NO: 108237 - RNA, 22 nt, Human
ucucugagggagauggccugcc

SEQ ID NO: 108238 - RNA, 22 nt, Human
ucucugagguuguuuccagcac

SEQ ID NO: 108239 - RNA, 22 nt, Human
ucucugaucuuuaauucagaua

SEQ ID NO: 108240 - RNA, 22 nt, Human
ucucugcacuugcacauaagcu

SEQ ID NO: 108241 - RNA, 20 nt, Human
ucucugcagcagaggcuggg

SEQ ID NO: 108242 - RNA, 19 nt, Human
ucucugcagcgcgcccggc

SEQ ID NO: 108243 - RNA, 22 nt, Human
ucucugcaucccagggcucagc

SEQ ID NO: 108244 - RNA, 23 nt, Human
ucucugcauguccugagcacauc

SEQ ID NO: 108245 - RNA, 22 nt, Human
ucucugccacagcuucugccuu

SEQ ID NO: 108246 - RNA, 22 nt, Human
ucucugccaccaugagaugggc

SEQ ID NO: 108247 - RNA, 22 nt, Human
ucucugcccauccucaguccac

SEQ ID NO: 108248 - RNA, 22 nt, Human
ucucugcuaagauugugucuag

SEQ ID NO: 108249 - RNA, 22 nt, Human
ucucugcucaggcaccagcccu

SEQ ID NO: 108250 - RNA, 21 nt, Human
ucucuggaauuagaccauguu

SEQ ID NO: 108251 - RNA, 22 nt, Human
ucucuggaauuggcugaggcaa

SEQ ID NO: 108252 - RNA, 22 nt, Human
ucucuggcacucccuuauggcu

SEQ ID NO: 108253 - RNA, 22 nt, Human
ucucuggccccauggcugagcu

SEQ ID NO: 108254 - RNA, 22 nt, Human
ucucuggcuuagguugagugca

SEQ ID NO: 108255 - RNA, 22 nt, Human
ucucugggaaauggagaauuuu

SEQ ID NO: 108256 - RNA, 22 nt, Human
ucucugggagccaggaugacac

SEQ ID NO: 108257 - RNA, 22 nt, Human
ucucuggggaaaaggcugauac

SEQ ID NO: 108258 - RNA, 22 nt, Human
ucucuggggccuuucuacauca

SEQ ID NO: 108259 - RNA, 22 nt, Human
ucucugggguagggcccaggac

SEQ ID NO: 108260 - RNA, 22 nt, Human
ucucuggguccuggcaagcuca

SEQ ID NO: 108261 - RNA, 23 nt, Human
ucucugggugggcugugucuaua

SEQ ID NO: 108262 - RNA, 20 nt, Human
ucucuggguucucacucagc

SEQ ID NO: 108263 - RNA, 22 nt, Human
ucucuguaagagaggcuuucau

SEQ ID NO: 108264 - RNA, 23 nt, Human
ucucuguacagaugaggacacac

SEQ ID NO: 108265 - RNA, 22 nt, Human
ucucuguaguugggcagcugcu

SEQ ID NO: 108266 - RNA, 22 nt, Human
ucucugucacacaaucuacaca

SEQ ID NO: 108267 - RNA, 22 nt, Human
ucucugucucccguguguccgg

SEQ ID NO: 108268 - RNA, 22 nt, Human
ucucugugacauuucugagccu

SEQ ID NO: 108269 - RNA, 22 nt, Human
ucucugugagauuuguauuaag

SEQ ID NO: 108270 - RNA, 22 nt, Human
ucucugugagccagguccuagu

SEQ ID NO: 108271 - RNA, 22 nt, Human
ucucugugaguggaaggcaccc

SEQ ID NO: 108272 - RNA, 22 nt, Human
ucucugugcaggaugcugaguu

SEQ ID NO: 108273 - RNA, 22 nt, Human
ucucuguggcaacaauucacua

SEQ ID NO: 108274 - RNA, 22 nt, Human
ucucuguggcaagcaugcugcu

SEQ ID NO: 108275 - RNA, 22 nt, Human
ucucugugguacugagagucua

SEQ ID NO: 108276 - RNA, 22 nt, Human
ucucugugguuugagagccggg

SEQ ID NO: 108277 - RNA, 21 nt, Human
ucucuguguacagucucaccc

SEQ ID NO: 108278 - RNA, 22 nt, Human
ucucuguguccugaaaugaagg

SEQ ID NO: 108279 - RNA, 19 nt, Human
ucucugugucucuguuuau

SEQ ID NO: 108280 - RNA, 23 nt, Human
ucucugugugccucaguuucuuc

SEQ ID NO: 108281 - RNA, 22 nt, Human
ucucuguguucccuguuuucuc

SEQ ID NO: 108282 - RNA, 22 nt, Human
ucucuguguugcaggaaaaucu

SEQ ID NO: 108283 - RNA, 22 nt, Human
ucucuuaaaggucuucagcuga

SEQ ID NO: 108284 - RNA, 23 nt, Human
ucucuuaccugagacauuuccua

SEQ ID NO: 108285 - RNA, 22 nt, Human
ucucuuaggagaaauucauaaa

SEQ ID NO: 108286 - RNA, 23 nt, Human
ucucuuaucacaauucauuuugc

SEQ ID NO: 108287 - RNA, 22 nt, Human
ucucuucacauuccuggcaaac

SEQ ID NO: 108288 - RNA, 22 nt, Human
ucucuuccuagugaugggcuuu

SEQ ID NO: 108289 - RNA, 22 nt, Human
ucucuuccuugaccuauuguaa

SEQ ID NO: 108290 - RNA, 22 nt, Human
ucucuucuaacacuagaaauuc

SEQ ID NO: 108291 - RNA, 22 nt, Human
ucucuucuaauuuucccgagua

SEQ ID NO: 108292 - RNA, 19 nt, Human
ucucuucucccugguuuua

SEQ ID NO: 108293 - RNA, 22 nt, Human
ucucuucuugauuuucacugga

SEQ ID NO: 108294 - RNA, 18 nt, Human
ucucuucuuggcagucaa

SEQ ID NO: 108295 - RNA, 22 nt, Human
ucucuuggaacacuugcucuua

SEQ ID NO: 108296 - RNA, 22 nt, Human
ucucuuggacauguggcucugc

SEQ ID NO: 108297 - RNA, 22 nt, Human
ucucuugggaggaaagagagaa

SEQ ID NO: 108298 - RNA, 22 nt, Human
ucucuuggugacuuaaaauguu

SEQ ID NO: 108299 - RNA, 22 nt, Human
ucucuuuaaguauaaucuuaua

SEQ ID NO: 108300 - RNA, 22 nt, Human
ucucuuuacuuucaccaauuug

SEQ ID NO: 108301 - RNA, 22 nt, Human
ucucuuuagugcuuagacgucu

SEQ ID NO: 108302 - RNA, 22 nt, Human
ucucuuucucaaaauguaagca

SEQ ID NO: 108303 - RNA, 22 nt, Human
ucugauaauggacuucucaucu

SEQ ID NO: 108304 - RNA, 17 nt, Human
ucugaugacuagaggaa

SEQ ID NO: 108305 - RNA, 22 nt, Human
ucugaugauaaagcauccuuua

SEQ ID NO: 108306 - RNA, 22 nt, Human
ucugauguguuuaagaaagaag

SEQ ID NO: 108307 - RNA, 22 nt, Human
ucugauguugcuucugcagaac

SEQ ID NO: 108308 - RNA, 22 nt, Human
ucugauguugugacaucacuuc

SEQ ID NO: 108309 - RNA, 22 nt, Human
ucugauuccagaaggggcauac

SEQ ID NO: 108310 - RNA, 22 nt, Human
ucugauuuacuggaaaaaagga

SEQ ID NO: 108311 - RNA, 22 nt, Human
ucugcaaauauuagcuuagaca

SEQ ID NO: 108312 - RNA, 22 nt, Human
ucugcaacauuccucuccccac

SEQ ID NO: 108313 - RNA, 22 nt, Human
ucugcaacgcacugcaaaaccu

SEQ ID NO: 108314 - RNA, 22 nt, Human
ucugcaagcgucacaugauucu

SEQ ID NO: 108315 - RNA, 22 nt, Human
ucugcaauguuuucccauccug

SEQ ID NO: 108316 - RNA, 22 nt, Human
ucugcacacaauuuaucuuucu

SEQ ID NO: 108317 - RNA, 22 nt, Human
ucugcacauagguaggcuggaa

SEQ ID NO: 108318 - RNA, 22 nt, Human
ucugcacauggcgcugguccug

SEQ ID NO: 108319 - RNA, 22 nt, Human
ucugcacauguaguaaauauua

SEQ ID NO: 108320 - RNA, 22 nt, Human
ucugcacauuuuaccaauacuc

SEQ ID NO: 108321 - RNA, 22 nt, Human
ucugcacccugaccucuguuuc

SEQ ID NO: 108322 - RNA, 22 nt, Human
ucugcacccugugguccucuag

SEQ ID NO: 108323 - RNA, 22 nt, Human
ucugcacccuucuggguuggaa

SEQ ID NO: 108324 - RNA, 20 nt, Human
ucugcaccuccuuccaauca

SEQ ID NO: 108325 - RNA, 20 nt, Human
ucugcacuccugcaugugcc

SEQ ID NO: 108326 - RNA, 22 nt, Human
ucugcagaaaguggcucagugg

SEQ ID NO: 108327 - RNA, 22 nt, Human
ucugcagaacuuuaugagcaaa

SEQ ID NO: 108328 - RNA, 22 nt, Human
ucugcagaagcucacuaaaucc

SEQ ID NO: 108329 - RNA, 22 nt, Human
ucugcagaauugucucaagcua

SEQ ID NO: 108330 - RNA, 22 nt, Human
ucugcagagcauuauagcaaaa

SEQ ID NO: 108331 - RNA, 22 nt, Human
ucugcagagccucaggagaaca

SEQ ID NO: 108332 - RNA, 19 nt, Human
ucugcagaggaauucuuca

SEQ ID NO: 108333 - RNA, 22 nt, Human
ucugcagccagaggcaugaaaa

SEQ ID NO: 108334 - RNA, 22 nt, Human
ucugcaggaagcuggcggcuga

SEQ ID NO: 108335 - RNA, 18 nt, Human
ucugcaggaccucagggc

SEQ ID NO: 108336 - RNA, 22 nt, Human
ucugcaggagcagggcguggag

SEQ ID NO: 108337 - RNA, 22 nt, Human
ucugcaggaggcuggcugcagg

SEQ ID NO: 108338 - RNA, 22 nt, Human
ucugcaggaugcaaaguguaca

SEQ ID NO: 108339 - RNA, 22 nt, Human
ucugcaggcuguacaggaagca

SEQ ID NO: 108340 - RNA, 22 nt, Human
ucugcagggaugugagggguga

SEQ ID NO: 108341 - RNA, 22 nt, Human
ucugcagggucccagccucagc

SEQ ID NO: 108342 - RNA, 22 nt, Human
ucugcagguguuggaaggguca

SEQ ID NO: 108343 - RNA, 22 nt, Human
ucugcauaccccuuuagcagag

SEQ ID NO: 108344 - RNA, 22 nt, Human
ucugcauauuguuaauggaaug

SEQ ID NO: 108345 - RNA, 22 nt, Human
ucugcaucucaggauucccuuc

SEQ ID NO: 108346 - RNA, 22 nt, Human
ucccugaaucucgaacuagccu

SEQ ID NO: 108347 - RNA, 22 nt, Human
ucccugagacucuggaguguaa

SEQ ID NO: 108348 - RNA, 22 nt, Human
ucccugagcugagcucaacagc

SEQ ID NO: 108349 - RNA, 23 nt, Human
ucccugagcuggagagacugcac

SEQ ID NO: 108350 - RNA, 22 nt, Human
ucccugagcuucucugaaaugg

SEQ ID NO: 108351 - RNA, 22 nt, Human
ucccugaggaagggguguggug

SEQ ID NO: 108352 - RNA, 22 nt, Human
ucccugaguguauguggugaac

SEQ ID NO: 108353 - RNA, 19 nt, Human
ucccugaguuccagcccag

SEQ ID NO: 108354 - RNA, 22 nt, Human
ucccugaguuuucuuucugacu

SEQ ID NO: 108355 - RNA, 22 nt, Human
ucccugaugugggcugcgugac

SEQ ID NO: 108356 - RNA, 22 nt, Human
ucccugcaguaggcagcccucc

SEQ ID NO: 108357 - RNA, 22 nt, Human
ucccugccaaugauuggagcaa

SEQ ID NO: 108358 - RNA, 22 nt, Human
ucccugccuccuggcagugcca

SEQ ID NO: 108359 - RNA, 22 nt, Human
ucccugccucucagacuuccuu

SEQ ID NO: 108360 - RNA, 22 nt, Human
ucccugcucagcucaccuggca

SEQ ID NO: 108361 - RNA, 22 nt, Human
ucccugcugagagugcucuccc

SEQ ID NO: 108362 - RNA, 21 nt, Human
ucccugcuuucuggcccaguc

SEQ ID NO: 108363 - RNA, 23 nt, Human
ucccuggccgcaauggccgccuu

SEQ ID NO: 108364 - RNA, 22 nt, Human
ucccuggccuggaaggauauca

SEQ ID NO: 108365 - RNA, 19 nt, Human
ucccuggcgccucucgggc

SEQ ID NO: 108366 - RNA, 22 nt, Human
ucccugggaacaaaggaugaga

SEQ ID NO: 108367 - RNA, 22 nt, Human
ucccugggagaugaugaugagg

SEQ ID NO: 108368 - RNA, 16 nt, Human
ucccugggaguggugg

SEQ ID NO: 108369 - RNA, 18 nt, Human
ucccugggauauaauuac

SEQ ID NO: 108370 - RNA, 22 nt, Human
ucccugggccuaucuuagcucc

SEQ ID NO: 108371 - RNA, 22 nt, Human
ucccuggggcaguggcucggag

SEQ ID NO: 108372 - RNA, 18 nt, Human
ucccuggggcugccaccc

SEQ ID NO: 108373 - RNA, 22 nt, Human
ucccugguuacguauaaagaug

SEQ ID NO: 108374 - RNA, 22 nt, Human
ucccuguauagagaaucccuuu

SEQ ID NO: 108375 - RNA, 21 nt, Human
ucccugugagcagcucuuccu

SEQ ID NO: 108376 - RNA, 22 nt, Human
ucccugugccuauaugugcuga

SEQ ID NO: 108377 - RNA, 22 nt, Human
ucccuuaaccguaggacagucu

SEQ ID NO: 108378 - RNA, 22 nt, Human
ucccuuaagcaccugaguaguc

SEQ ID NO: 108379 - RNA, 22 nt, Human
ucccuucaauaauucaacauua

SEQ ID NO: 108380 - RNA, 22 nt, Human
ucccuucacagaugcgauguuu

SEQ ID NO: 108381 - RNA, 18 nt, Human
ucccuucucccuugccuc

SEQ ID NO: 108382 - RNA, 22 nt, Human
ucccuuggaaaguagccucaca

SEQ ID NO: 108383 - RNA, 22 nt, Human
ucccuugguuaaauauguagga

SEQ ID NO: 108384 - RNA, 22 nt, Human
ucccuuuggauccaagcuuaug

SEQ ID NO: 108385 - RNA, 22 nt, Human
uccgaggccaaagcugugaaua

SEQ ID NO: 108386 - RNA, 22 nt, Human
uccgauaagcaauucuugugcu

SEQ ID NO: 108387 - RNA, 22 nt, Human
uccgauuagcucuuuauaaaac

SEQ ID NO: 108388 - RNA, 22 nt, Human
uccgccaggacugagggcccau

SEQ ID NO: 108389 - RNA, 22 nt, Human
uccgcccgcacguauggagugg

SEQ ID NO: 108390 - RNA, 22 nt, Human
uccgcgcucucacccgcucccg

SEQ ID NO: 108391 - RNA, 22 nt, Human
uccgggagcugaacgucuugcg

SEQ ID NO: 108392 - RNA, 22 nt, Human
uccgggggugguagauuuccuu

SEQ ID NO: 108393 - RNA, 22 nt, Human
uccguggggccuguggcuuccg

SEQ ID NO: 108394 - RNA, 22 nt, Human
uccguuuucacacugcuauaaa

SEQ ID NO: 108395 - RNA, 22 nt, Human
uccuaacuaauuuguagcaaaa

SEQ ID NO: 108396 - RNA, 20 nt, Human
uccuaacuauaaaguggcuc

SEQ ID NO: 108397 - RNA, 22 nt, Human
uccuaacuccacuagccuuggg

SEQ ID NO: 108398 - RNA, 22 nt, Human
uccuaacugcccugggcaaggu

SEQ ID NO: 108399 - RNA, 20 nt, Human
uccuaagaggauggccacgu

SEQ ID NO: 108400 - RNA, 22 nt, Human
uccuaagauagaagauagugaa

SEQ ID NO: 108401 - RNA, 22 nt, Human
uccuacaucagcucucaguagc

SEQ ID NO: 108402 - RNA, 22 nt, Human
uccuagaacagcccaccuggaa

SEQ ID NO: 108403 - RNA, 22 nt, Human
uccuagaacuccaggacagucc

SEQ ID NO: 108404 - RNA, 22 nt, Human
uccuagaauauuuguggagguu

SEQ ID NO: 108405 - RNA, 22 nt, Human
uccuagaaucuuuguaagauug

SEQ ID NO: 108406 - RNA, 22 nt, Human
uccuagaaugcaccucugcugu

SEQ ID NO: 108407 - RNA, 22 nt, Human
uccuagagaugcaauuugauuu

SEQ ID NO: 108408 - RNA, 22 nt, Human
uccuaggaaguggaggcaccug

SEQ ID NO: 108409 - RNA, 22 nt, Human
uccuaggcccagccugagcugu

SEQ ID NO: 108410 - RNA, 22 nt, Human
uccuaggcuccagaacugugaa

SEQ ID NO: 108411 - RNA, 22 nt, Human
uccuaggguaaucagcauacau

SEQ ID NO: 108412 - RNA, 22 nt, Human
ccauagaugagacaaaguagag

SEQ ID NO: 108413 - RNA, 22 nt, Human
ccauagcaagaggagcagaaau

SEQ ID NO: 108414 - RNA, 22 nt, Human
ccauagugaauugucucagacg

SEQ ID NO: 108415 - RNA, 22 nt, Human
ccauauuugcuucuugcugaua

SEQ ID NO: 108416 - RNA, 22 nt, Human
ccaucagagggcugcucugcaa

SEQ ID NO: 108417 - RNA, 22 nt, Human
ccaucaguggcaaauaaacacc

SEQ ID NO: 108418 - RNA, 22 nt, Human
ccaucauuugauacagcugucu

SEQ ID NO: 108419 - RNA, 22 nt, Human
ccauccagaccaguccaugggu

SEQ ID NO: 108420 - RNA, 22 nt, Human
ccaucccugagucacaggaggg

SEQ ID NO: 108421 - RNA, 22 nt, Human
ccauccuaucugaccuacuugu

SEQ ID NO: 108422 - RNA, 22 nt, Human
ccauccuggccuugcuguccac

SEQ ID NO: 108423 - RNA, 22 nt, Human
ccauccugucuguggccucagg

SEQ ID NO: 108424 - RNA, 22 nt, Human
ccauccuuggcucgcucucugu

SEQ ID NO: 108425 - RNA, 22 nt, Human
ccaugcaacagaauccagauuu

SEQ ID NO: 108426 - RNA, 19 nt, Human
ccaugcagccugggggcag

SEQ ID NO: 108427 - RNA, 22 nt, Human
ccaugcauggcacuggacuggg

SEQ ID NO: 108428 - RNA, 22 nt, Human
ccaugccucgggaagagucugu

SEQ ID NO: 108429 - RNA, 22 nt, Human
ccaugccuggacuccacucuca

SEQ ID NO: 108430 - RNA, 22 nt, Human
ccaugcuggagucccuagcugu

SEQ ID NO: 108431 - RNA, 22 nt, Human
ccaugcugugacacaguaguua

SEQ ID NO: 108432 - RNA, 23 nt, Human
ccauggagcauggcucacuaggc

SEQ ID NO: 108433 - RNA, 22 nt, Human
ccauggaguuccucuggucuau

SEQ ID NO: 108434 - RNA, 22 nt, Human
ccauggaucuggaucuaucuuu

SEQ ID NO: 108435 - RNA, 22 nt, Human
ccauggcaacuggcguccaggg

SEQ ID NO: 108436 - RNA, 23 nt, Human
ccauggccaaugucaagcuacua

SEQ ID NO: 108437 - RNA, 22 nt, Human
ccauggcuccuugcccuguagc

SEQ ID NO: 108438 - RNA, 22 nt, Human
ccauggcucuuaccuuguuaua

SEQ ID NO: 108439 - RNA, 22 nt, Human
ccauggcuuacagauggagcau

SEQ ID NO: 108440 - RNA, 22 nt, Human
ccauggcuuuugagucucaaga

SEQ ID NO: 108441 - RNA, 22 nt, Human
ccaugggaauugggagguccca

SEQ ID NO: 108442 - RNA, 22 nt, Human
ccauguggggucaguguuuggg

SEQ ID NO: 108443 - RNA, 22 nt, Human
ccauguguucaauaagggaguu

SEQ ID NO: 108444 - RNA, 22 nt, Human
ccauguguugagauuccagccu

SEQ ID NO: 108445 - RNA, 22 nt, Human
ccauguugucaaacuuagagua

SEQ ID NO: 108446 - RNA, 22 nt, Human
ccauuaaacuuguggacccagu

SEQ ID NO: 108447 - RNA, 22 nt, Human
ccauuacugaaauaaagagaau

SEQ ID NO: 108448 - RNA, 22 nt, Human
ccauuauuauaggaggcucauu

SEQ ID NO: 108449 - RNA, 23 nt, Human
ccauucaucucagucauugcuuu

SEQ ID NO: 108450 - RNA, 22 nt, Human
ccauucaugugagcaagaacug

SEQ ID NO: 108451 - RNA, 23 nt, Human
ccauucccacugugccuucccug

SEQ ID NO: 108452 - RNA, 22 nt, Human
ccauucugaacaauucuugucu

SEQ ID NO: 108453 - RNA, 22 nt, Human
ccauucuuucagugucucaugu

SEQ ID NO: 108454 - RNA, 22 nt, Human
ccauuguaaagaguauacuuug

SEQ ID NO: 108455 - RNA, 22 nt, Human
ccauuguuuauuuagacuuaau

SEQ ID NO: 108456 - RNA, 22 nt, Human
ccauuucacucuuccugaagga

SEQ ID NO: 108457 - RNA, 18 nt, Human
ccauuucaugauuauuac

SEQ ID NO: 108458 - RNA, 22 nt, Human
ccauuuggaggucauuaggaca

SEQ ID NO: 108459 - RNA, 22 nt, Human
ccauuugugauguggcagcauc

SEQ ID NO: 108460 - RNA, 23 nt, Human
ccauuuuguguuuuggagaaaca

SEQ ID NO: 108461 - RNA, 20 nt, Human
cccaaagcuucauaugagcc

SEQ ID NO: 108462 - RNA, 22 nt, Human
cccaaagguugaggcugcagug

SEQ ID NO: 108463 - RNA, 22 nt, Human
cccaagagguggagguugcagu

SEQ ID NO: 108464 - RNA, 22 nt, Human
cccaagcagggugcagaggcau

SEQ ID NO: 108465 - RNA, 22 nt, Human
cccaagccagacccugacccug

SEQ ID NO: 108466 - RNA, 23 nt, Human
cccaagccugugcccucugacuc

SEQ ID NO: 108467 - RNA, 16 nt, Human
cccaaggagcuccagg

SEQ ID NO: 108468 - RNA, 22 nt, Human
cccaaggcagggauuuucugcu

SEQ ID NO: 108469 - RNA, 22 nt, Human
cccaaggcauggcaugguggca

SEQ ID NO: 108470 - RNA, 22 nt, Human
cccaaggcugcagugagcauga

SEQ ID NO: 108471 - RNA, 21 nt, Human
cccaagggaggcaggauaagg

SEQ ID NO: 108472 - RNA, 22 nt, Human
cccaagggaugcuugaguaguu

SEQ ID NO: 108473 - RNA, 22 nt, Human
cccaagggguguugauggagga

SEQ ID NO: 108474 - RNA, 21 nt, Human
cacaccaaacaggaacaggga

SEQ ID NO: 108475 - RNA, 22 nt, Human
cacaccaaaguauuugguauuu

SEQ ID NO: 108476 - RNA, 22 nt, Human
cacaccagcauggucucagugu

SEQ ID NO: 108477 - RNA, 22 nt, Human
cacaccauaugauuccauuuag

SEQ ID NO: 108478 - RNA, 19 nt, Human
cacacccaugcuugccaag

SEQ ID NO: 108479 - RNA, 22 nt, Human
cacaccucagccauguggaggc

SEQ ID NO: 108480 - RNA, 23 nt, Human
cacaccuguuaagaagagugccu

SEQ ID NO: 108481 - RNA, 22 nt, Human
cacaccuuaggccugagcgcuu

SEQ ID NO: 108482 - RNA, 22 nt, Human
cacacugaccugaacuuagcau

SEQ ID NO: 108483 - RNA, 22 nt, Human
cacacugauaggcuugacaggc

SEQ ID NO: 108484 - RNA, 22 nt, Human
cacacuuuguugaaguuuucau

SEQ ID NO: 108485 - RNA, 22 nt, Human
cacagaaaggcucaaaucccaa

SEQ ID NO: 108486 - RNA, 22 nt, Human
cacagaaauuauuaggaugcuu

SEQ ID NO: 108487 - RNA, 22 nt, Human
cacagaauaaauugguaucaga

SEQ ID NO: 108488 - RNA, 22 nt, Human
cacagaauggaccaguuuuaga

SEQ ID NO: 108489 - RNA, 22 nt, Human
cacagaauuaagggagaaauau

SEQ ID NO: 108490 - RNA, 22 nt, Human
cacagaauuuucucuuuacaau

SEQ ID NO: 108491 - RNA, 22 nt, Human
cacagagaaugaugagucacug

SEQ ID NO: 108492 - RNA, 22 nt, Human
cacagagacagaucuauuuugc

SEQ ID NO: 108493 - RNA, 22 nt, Human
cacagagcaggugcugggaaga

SEQ ID NO: 108494 - RNA, 22 nt, Human
cacagagcuggaaaggcugggc

SEQ ID NO: 108495 - RNA, 22 nt, Human
cacagaggaaaggcaguuggua

SEQ ID NO: 108496 - RNA, 22 nt, Human
cacagaggagugcacacucucu

SEQ ID NO: 108497 - RNA, 22 nt, Human
cacagaggugauaguggucaag

SEQ ID NO: 108498 - RNA, 20 nt, Human
cacagagucuugcagcguuc

SEQ ID NO: 108499 - RNA, 22 nt, Human
cacagauaaggauguuaauuuu

SEQ ID NO: 108500 - RNA, 22 nt, Human
cacagcaaagacacucucaacu

SEQ ID NO: 108501 - RNA, 22 nt, Human
cacagcaaaggcuucggcugau

SEQ ID NO: 108502 - RNA, 22 nt, Human
cacagcaauagcuaacugauac

SEQ ID NO: 108503 - RNA, 22 nt, Human
cacagcauaaugaaauauacuu

SEQ ID NO: 108504 - RNA, 22 nt, Human
cacagccuuacugagauccacu

SEQ ID NO: 108505 - RNA, 22 nt, Human
cacagccuuuaggguacacaca

SEQ ID NO: 108506 - RNA, 22 nt, Human
cacagcgugaugaauguagcgu

SEQ ID NO: 108507 - RNA, 22 nt, Human
cacagcugaaguagccaugugg

SEQ ID NO: 108508 - RNA, 22 nt, Human
cacagcugcuuguuagaauagc

SEQ ID NO: 108509 - RNA, 22 nt, Human
cacagcuguauccaggagaucc

SEQ ID NO: 108510 - RNA, 22 nt, Human
cacagcugugagaagggagccu

SEQ ID NO: 108511 - RNA, 22 nt, Human
cacagcuucaguuucugacuug

SEQ ID NO: 108512 - RNA, 22 nt, Human
cacagcuucccaaaguggaccu

SEQ ID NO: 108513 - RNA, 22 nt, Human
cacagcuucuccccgcugcggc

SEQ ID NO: 108514 - RNA, 22 nt, Human
cacagcuucugucugacccaug

SEQ ID NO: 108515 - RNA, 22 nt, Human
cacagcuugggcucugacaaua

SEQ ID NO: 108516 - RNA, 22 nt, Human
cacaggaaauauuaggagggau

SEQ ID NO: 108517 - RNA, 18 nt, Human
cacaggaaggggaauauc

SEQ ID NO: 108518 - RNA, 22 nt, Human
cacaggaaguggucagugccag

SEQ ID NO: 108519 - RNA, 22 nt, Human
cacaggaauaagucaaacuuca

SEQ ID NO: 108520 - RNA, 22 nt, Human
cacaggagcccugaggccuccc

SEQ ID NO: 108521 - RNA, 22 nt, Human
cagacccugggccacagaggag

SEQ ID NO: 108522 - RNA, 22 nt, Human
cagacccuuuucugagaggacc

SEQ ID NO: 108523 - RNA, 22 nt, Human
cagaccucaaagcugcagugcu

SEQ ID NO: 108524 - RNA, 22 nt, Human
cagaccucaguccucaguagga

SEQ ID NO: 108525 - RNA, 22 nt, Human
cagaccugaggagcacugagcc

SEQ ID NO: 108526 - RNA, 22 nt, Human
cagaccuggaaaacaggcuugc

SEQ ID NO: 108527 - RNA, 23 nt, Human
cagaccuuucuguaucaguuauc

SEQ ID NO: 108528 - RNA, 22 nt, Human
cagacguuggaggaaauauacc

SEQ ID NO: 108529 - RNA, 22 nt, Human
cagacugacuuucuguggcuau

SEQ ID NO: 108530 - RNA, 22 nt, Human
cagacugggagucaggaagaag

SEQ ID NO: 108531 - RNA, 22 nt, Human
cagacugggcugguggaaagcu

SEQ ID NO: 108532 - RNA, 22 nt, Human
cagacuugacggcagcugcuuu

SEQ ID NO: 108533 - RNA, 22 nt, Human
cagagaaacucagauagcugau

SEQ ID NO: 108534 - RNA, 22 nt, Human
cagagaagaaagugacuauaau

SEQ ID NO: 108535 - RNA, 22 nt, Human
cagagacagaaaauggaucuag

SEQ ID NO: 108536 - RNA, 22 nt, Human
cagagacagcaaguugauuucc

SEQ ID NO: 108537 - RNA, 22 nt, Human
cagagacaggcuugcccuccac

SEQ ID NO: 108538 - RNA, 22 nt, Human
cagagacauguggccugcacgu

SEQ ID NO: 108539 - RNA, 22 nt, Human
cagagacauuaagugccaugau

SEQ ID NO: 108540 - RNA, 22 nt, Human
cagagacauucaguaaauuauc

SEQ ID NO: 108541 - RNA, 22 nt, Human
cagagagaauauguaguaugga

SEQ ID NO: 108542 - RNA, 22 nt, Human
cagagagaaucuuggcagcuga

SEQ ID NO: 108543 - RNA, 22 nt, Human
cagagagaggggcugccuggcc

SEQ ID NO: 108544 - RNA, 22 nt, Human
cagagagcacauaggauacuuu

SEQ ID NO: 108545 - RNA, 22 nt, Human
cagagaggaggcuauaugcaaa

SEQ ID NO: 108546 - RNA, 22 nt, Human
cagagagggcggcccuggcuuc

SEQ ID NO: 108547 - RNA, 22 nt, Human
cagagaguggcaguuacugaag

SEQ ID NO: 108548 - RNA, 22 nt, Human
cagagcacagagcuugggacaa

SEQ ID NO: 108549 - RNA, 22 nt, Human
cagagcaccagugggagacaag

SEQ ID NO: 108550 - RNA, 22 nt, Human
cagagcacugcuuggaggauuu

SEQ ID NO: 108551 - RNA, 22 nt, Human
cagagcagacguugagauuaag

SEQ ID NO: 108552 - RNA, 18 nt, Human
cagagcagagguggagcg

SEQ ID NO: 108553 - RNA, 22 nt, Human
cagagcagagugauuguucugg

SEQ ID NO: 108554 - RNA, 22 nt, Human
cagagcagauuucuaaguauug

SEQ ID NO: 108555 - RNA, 22 nt, Human
cagagcagggguuucccagguu

SEQ ID NO: 108556 - RNA, 18 nt, Human
cagagcaguaugaauguu

SEQ ID NO: 108557 - RNA, 22 nt, Human
cagagcaguggagaguaggucu

SEQ ID NO: 108558 - RNA, 22 nt, Human
cagagcagugggguuggucaga

SEQ ID NO: 108559 - RNA, 22 nt, Human
cagagcauaauugacaugaggu

SEQ ID NO: 108560 - RNA, 22 nt, Human
cagagcauuuggaagccacgug

SEQ ID NO: 108561 - RNA, 22 nt, Human
cagagccaacgccaccugccca

SEQ ID NO: 108562 - RNA, 22 nt, Human
cagagccacuuggagaugagaa

SEQ ID NO: 108563 - RNA, 22 nt, Human
cagagccagaacuagaccuugu

SEQ ID NO: 108564 - RNA, 22 nt, Human
cagagccagcccacuguucccg

SEQ ID NO: 108565 - RNA, 22 nt, Human
cagagccagcuguccuuggcau

SEQ ID NO: 108566 - RNA, 22 nt, Human
cagagccaggccugcccucuuu

SEQ ID NO: 108567 - RNA, 22 nt, Human
cagagccagucagucagaaacu

SEQ ID NO: 108568 - RNA, 22 nt, Human
cagagccauaaaggugaaagag

SEQ ID NO: 108569 - RNA, 22 nt, Human
cagagccauccaggugccuguu

SEQ ID NO: 108570 - RNA, 22 nt, Human
cagagccccccuucugaucaca

SEQ ID NO: 108571 - RNA, 22 nt, Human
cagagccccuggguugggagcu

SEQ ID NO: 108572 - RNA, 22 nt, Human
cagagcccugcaugcuccaucu

SEQ ID NO: 108573 - RNA, 22 nt, Human
cagagcccuuccucccacgggg

SEQ ID NO: 108574 - RNA, 19 nt, Human
cagagccucagagcuagaa

SEQ ID NO: 108575 - RNA, 22 nt, Human
cagagccucucagaggucagac

SEQ ID NO: 108576 - RNA, 22 nt, Human
cagagccucugcccugggcacu

SEQ ID NO: 108577 - RNA, 22 nt, Human
cagagccuggcgaugucaugga

SEQ ID NO: 108578 - RNA, 20 nt, Human
cagagcuaucccuuuauuua

SEQ ID NO: 108579 - RNA, 22 nt, Human
cagagcucagagcagggcacuc

SEQ ID NO: 108580 - RNA, 22 nt, Human
cagagcucuauguucauggagg

SEQ ID NO: 108581 - RNA, 21 nt, Human
cagagcugaaggguguagugu

SEQ ID NO: 108582 - RNA, 22 nt, Human
cagagcugagaauguugaugcu

SEQ ID NO: 108583 - RNA, 22 nt, Human
cagagcugcucaugguggccag

SEQ ID NO: 108584 - RNA, 19 nt, Human
cagagcugcuggccucguc

SEQ ID NO: 108585 - RNA, 22 nt, Human
cagagcuggagcuugaauggag

SEQ ID NO: 108586 - RNA, 22 nt, Human
cagagcuggcucugcauguaca

SEQ ID NO: 108587 - RNA, 22 nt, Human
cagagcuggggacuguuggaug

SEQ ID NO: 108588 - RNA, 22 nt, Human
cagagcuguauuuaucuuucca

SEQ ID NO: 108589 - RNA, 22 nt, Human
cagagcugucauuugccaguga

SEQ ID NO: 108590 - RNA, 21 nt, Human
cagagcuguccaaacccugac

SEQ ID NO: 108591 - RNA, 22 nt, Human
cagagcuguugcggggcuuggc

SEQ ID NO: 108592 - RNA, 22 nt, Human
cagagcuucagggaauaagaau

SEQ ID NO: 108593 - RNA, 22 nt, Human
cagagcuugaauguccaugguu

SEQ ID NO: 108594 - RNA, 22 nt, Human
cagagcuuuggcuagaugguug

SEQ ID NO: 108595 - RNA, 22 nt, Human
cagaggaaaugggaaggagaua

SEQ ID NO: 108596 - RNA, 22 nt, Human
cagaggaagcagacacaucuug

SEQ ID NO: 108597 - RNA, 22 nt, Human
cagaggaaguuccuugaugaga

SEQ ID NO: 108598 - RNA, 22 nt, Human
cagaggacaugaaaacucgcuc

SEQ ID NO: 108599 - RNA, 17 nt, Human
cagaggagcuuuggggg

SEQ ID NO: 108600 - RNA, 20 nt, Human
cagaggaguacauauguuca

SEQ ID NO: 108601 - RNA, 22 nt, Human
cagaggauuauuucagaaucua

SEQ ID NO: 108602 - RNA, 22 nt, Human
cagaggauucccuagugaccug

SEQ ID NO: 108603 - RNA, 22 nt, Human
cagaggcacaagaaagcaaggc

SEQ ID NO: 108604 - RNA, 19 nt, Human
cagaggcaccagguauaga

SEQ ID NO: 108605 - RNA, 19 nt, Human
cagaggcacuuucucuuag

SEQ ID NO: 108606 - RNA, 22 nt, Human
cagaggcagaggucaucucugg

SEQ ID NO: 108607 - RNA, 22 nt, Human
cagaggcagccgggggagaacg

SEQ ID NO: 108608 - RNA, 22 nt, Human
cagaggcaggauaagaacugcg

SEQ ID NO: 108609 - RNA, 22 nt, Human
cagagcugauuggauccagaga

SEQ ID NO: 108610 - RNA, 22 nt, Human
cagagcugcacauucuaugaug

SEQ ID NO: 108611 - RNA, 22 nt, Human
cagagcugcgcuuuuuccuggu

SEQ ID NO: 108612 - RNA, 22 nt, Human
cagagcuggacuuaaauauauu

SEQ ID NO: 108613 - RNA, 22 nt, Human
cagagcuggagaaguggauuua

SEQ ID NO: 108614 - RNA, 20 nt, Human
cagagcugggauuugaacac

SEQ ID NO: 108615 - RNA, 22 nt, Human
cagagcuggguuugggaaaccu

SEQ ID NO: 108616 - RNA, 22 nt, Human
cagagcugguaagugguagagg

SEQ ID NO: 108617 - RNA, 22 nt, Human
cagagcugguguuacaagucca

SEQ ID NO: 108618 - RNA, 22 nt, Human
cagagcuuaaaacuccauggaa

SEQ ID NO: 108619 - RNA, 22 nt, Human
cagagcuucugacagcugcugc

SEQ ID NO: 108620 - RNA, 22 nt, Human
cagaggaaggcucugggaaugu

SEQ ID NO: 108621 - RNA, 22 nt, Human
cagaggaccauuguauguauug

SEQ ID NO: 108622 - RNA, 22 nt, Human
cagaggaccuguguggccagag

SEQ ID NO: 108623 - RNA, 22 nt, Human
cagaggaggccaccgcauaggc

SEQ ID NO: 108624 - RNA, 22 nt, Human
cagaggaggcgguauacacugc

SEQ ID NO: 108625 - RNA, 22 nt, Human
cagaggagugggccguuauggu

SEQ ID NO: 108626 - RNA, 22 nt, Human
cagaggcaaaagagguggaggu

SEQ ID NO: 108627 - RNA, 22 nt, Human
cagaggcacagugcgggccacu

SEQ ID NO: 108628 - RNA, 22 nt, Human
cagaggcagaauggagauuugg

SEQ ID NO: 108629 - RNA, 22 nt, Human
cagaggcauacucccagucuug

SEQ ID NO: 108630 - RNA, 22 nt, Human
ccucuguggucugucuaaugca

SEQ ID NO: 108631 - RNA, 22 nt, Human
ccucuuccucaccaucuacaac

SEQ ID NO: 108632 - RNA, 17 nt, Human
ccucuuccucucagcug

SEQ ID NO: 108633 - RNA, 22 nt, Human
ccucuucuaggacguccuugug

SEQ ID NO: 108634 - RNA, 22 nt, Human
ccucuuugacaaguaccugccc

SEQ ID NO: 108635 - RNA, 22 nt, Human
ccucuuugacucucaggucuuu

SEQ ID NO: 108636 - RNA, 22 nt, Human
ccucuuugugccugcaggcugc

SEQ ID NO: 108637 - RNA, 22 nt, Human
ccugaaaauauccucuccuuug

SEQ ID NO: 108638 - RNA, 22 nt, Human
ccugaaaaucaagguaguuugg

SEQ ID NO: 108639 - RNA, 22 nt, Human
ccugaaacaguccuugcccuca

SEQ ID NO: 108640 - RNA, 22 nt, Human
ccugaaauccauaguuuacacu

SEQ ID NO: 108641 - RNA, 22 nt, Human
ccugaagagugaauguggcagu

SEQ ID NO: 108642 - RNA, 22 nt, Human
ccugaagauccauuauagacac

SEQ ID NO: 108643 - RNA, 17 nt, Human
ccugaaggcacuuccag

SEQ ID NO: 108644 - RNA, 22 nt, Human
ccugaagggacuccagagagca

SEQ ID NO: 108645 - RNA, 22 nt, Human
ccugaauacuggugcugaaagu

SEQ ID NO: 108646 - RNA, 22 nt, Human
ccugaaugccugacauuucacu

SEQ ID NO: 108647 - RNA, 22 nt, Human
ccugacagcgugucccuggccc

SEQ ID NO: 108648 - RNA, 22 nt, Human
ccugaccauuugccacaugggu

SEQ ID NO: 108649 - RNA, 23 nt, Human
ccugacccugucucccucacaug

SEQ ID NO: 108650 - RNA, 22 nt, Human
ccugacccuuuccaguguuggc

SEQ ID NO: 108651 - RNA, 22 nt, Human
ccugagacaugaaccaggcucc

SEQ ID NO: 108652 - RNA, 22 nt, Human
ccugagagagugagcccugaca

SEQ ID NO: 108653 - RNA, 22 nt, Human
ccugagagcagcuuccugcuua

SEQ ID NO: 108654 - RNA, 22 nt, Human
ccugagagccagugccugccca

SEQ ID NO: 108655 - RNA, 22 nt, Human
ccugagagugagugccaccuua

SEQ ID NO: 108656 - RNA, 22 nt, Human
ccugagauggccagugcuggga

SEQ ID NO: 108657 - RNA, 22 nt, Human
ccugagauggggauuauuccaa

SEQ ID NO: 108658 - RNA, 18 nt, Human
ccugagcccugcuuacuu

SEQ ID NO: 108659 - RNA, 22 nt, Human
ccugagccugaguggugcaggg

SEQ ID NO: 108660 - RNA, 22 nt, Human
ccugagcugacucuccuuucag

SEQ ID NO: 108661 - RNA, 22 nt, Human
ccugaggauauucaccagcaug

SEQ ID NO: 108662 - RNA, 22 nt, Human
ccugaggaugccagcaugggug

SEQ ID NO: 108663 - RNA, 22 nt, Human
ccugaggcuggcccuuccaucc

SEQ ID NO: 108664 - RNA, 22 nt, Human
ccugagggcguaauuaacagug

SEQ ID NO: 108665 - RNA, 22 nt, Human
ccugaggucagcgguucccaca

SEQ ID NO: 108666 - RNA, 18 nt, Human
ccugaggugggaggaagg

SEQ ID NO: 108667 - RNA, 22 nt, Human
ccugagguugaaguauaaauug

SEQ ID NO: 108668 - RNA, 22 nt, Human
ccugagguuuuuggauaguugu

SEQ ID NO: 108669 - RNA, 22 nt, Human
ccugagucccauaauguugcca

SEQ ID NO: 108670 - RNA, 22 nt, Human
ccugagucuuggcuucuuggcu

SEQ ID NO: 108671 - RNA, 22 nt, Human
ccugagugaccugaggucuagu

SEQ ID NO: 108672 - RNA, 21 nt, Human
ccugagugagaccuggcccgu

SEQ ID NO: 108673 - RNA, 22 nt, Human
ccugagugcuuccagagucaug

SEQ ID NO: 108674 - RNA, 22 nt, Human
ccugaguuaguugcugugucuc

SEQ ID NO: 108675 - RNA, 22 nt, Human
ccugauguccauaauccuguaa

SEQ ID NO: 108676 - RNA, 22 nt, Human
ccugauucaguggugcccagag

SEQ ID NO: 108677 - RNA, 22 nt, Human
ccugauucugaugccucaugga

SEQ ID NO: 108678 - RNA, 23 nt, Human
ccugcaaagaaacaagccaccug

SEQ ID NO: 108679 - RNA, 22 nt, Human
ccugcaagagcggagaagccag

SEQ ID NO: 108680 - RNA, 22 nt, Human
ccugcacuaccuggggcugcug

SEQ ID NO: 108681 - RNA, 22 nt, Human
ccugcagagccacgugccagcg

SEQ ID NO: 108682 - RNA, 21 nt, Human
ccugcagcaccagaaggagau

SEQ ID NO: 108683 - RNA, 18 nt, Human
ccugcagcccaggaggcc

SEQ ID NO: 108684 - RNA, 22 nt, Human
ccugcagccucuucugaaaauc

SEQ ID NO: 108685 - RNA, 22 nt, Human
ccugcagcuccggauuucuggg

SEQ ID NO: 108686 - RNA, 22 nt, Human
ccugcagcuuugccuccugaac

SEQ ID NO: 108687 - RNA, 22 nt, Human
ccugcagggugcugccacagau

SEQ ID NO: 108688 - RNA, 22 nt, Human
ccugcagguaaggcuaacugcc

SEQ ID NO: 108689 - RNA, 22 nt, Human
ccugcagguccccggaugcgca

SEQ ID NO: 108690 - RNA, 22 nt, Human
ccugccagcaucuucagccccu

SEQ ID NO: 108691 - RNA, 22 nt, Human
ccugccagcauggcuuaucucc

SEQ ID NO: 108692 - RNA, 22 nt, Human
ccugccagcgcuuaucucucgg

SEQ ID NO: 108693 - RNA, 22 nt, Human
ccugccaggccagugagcuucc

SEQ ID NO: 108694 - RNA, 22 nt, Human
ccugccaggcuuucagguuugg

SEQ ID NO: 108695 - RNA, 22 nt, Human
ccugccaggcuuugggcuucug

SEQ ID NO: 108696 - RNA, 22 nt, Human
ccugcccacagagagggugcau

SEQ ID NO: 108697 - RNA, 22 nt, Human
ccugcccacuccaggagcaacu

SEQ ID NO: 108698 - RNA, 17 nt, Human
ccugcccagagacagau

SEQ ID NO: 108699 - RNA, 22 nt, Human
ccugcccagcuucccgagugca

SEQ ID NO: 108700 - RNA, 22 nt, Human
ccugcccuagagaugacacaau

SEQ ID NO: 108701 - RNA, 22 nt, Human
ccugcccuucuuuccccagcau

SEQ ID NO: 108702 - RNA, 20 nt, Human
ccugccugccucggcucauu

SEQ ID NO: 108703 - RNA, 22 nt, Human
ccugccugcggcccgcggggag

SEQ ID NO: 108704 - RNA, 22 nt, Human
ccugccuggaucagccauccug

SEQ ID NO: 108705 - RNA, 22 nt, Human
ccugccuggcugucagcagagc

SEQ ID NO: 108706 - RNA, 22 nt, Human
ccugccugggcucacuugccag

SEQ ID NO: 108707 - RNA, 22 nt, Human
ccugccugguguaagucuaagg

SEQ ID NO: 108708 - RNA, 22 nt, Human
ccugccugucccucaguccaca

SEQ ID NO: 108709 - RNA, 22 nt, Human
ccugccuucagcccugaagucu

SEQ ID NO: 108710 - RNA, 22 nt, Human
ccugccuucuaaagcgcccgcc

SEQ ID NO: 108711 - RNA, 22 nt, Human
ccugccuugacguaacgcauga

SEQ ID NO: 108712 - RNA, 22 nt, Human
ccugcucagcuguccucacgcu

SEQ ID NO: 108713 - RNA, 22 nt, Human
ccugcucaugggucccuggcag

SEQ ID NO: 108714 - RNA, 22 nt, Human
ccugcuccaugcucaccaucag

SEQ ID NO: 108715 - RNA, 22 nt, Human
ccugcucuaaaucucauggaac

SEQ ID NO: 108716 - RNA, 22 nt, Human
ccugcucuagacucugggaagg

SEQ ID NO: 108717 - RNA, 22 nt, Human
ccugcucugguuuagucagucu

SEQ ID NO: 108718 - RNA, 19 nt, Human
ccugcugcccacccucugc

SEQ ID NO: 108719 - RNA, 22 nt, Human
ccugcuggccaguggagggcug

SEQ ID NO: 108720 - RNA, 22 nt, Human
ccugcuggcguggcuggcgccc

SEQ ID NO: 108721 - RNA, 22 nt, Human
ccugcugggccugagcaaugag

SEQ ID NO: 108722 - RNA, 22 nt, Human
ccugcugucaguggggcaggca

SEQ ID NO: 108723 - RNA, 22 nt, Human
ccugcugucccucugggcucca

SEQ ID NO: 108724 - RNA, 20 nt, Human
ccugcugugcuuuccaugga

SEQ ID NO: 108725 - RNA, 22 nt, Human
ccuggaaaacaugggaaucaca

SEQ ID NO: 108726 - RNA, 22 nt, Human
ccuggaaagcgguucauuuugu

SEQ ID NO: 108727 - RNA, 22 nt, Human
ccuggaaggacaauagauagug

SEQ ID NO: 108728 - RNA, 22 nt, Human
ccuggacaaugagaugucaggg

SEQ ID NO: 108729 - RNA, 22 nt, Human
ccuggacacccauuccuuggcu

SEQ ID NO: 108730 - RNA, 22 nt, Human
cagcauuuuccauagaaagaag

SEQ ID NO: 108731 - RNA, 22 nt, Human
cagccaaaugagucauaaaugu

SEQ ID NO: 108732 - RNA, 22 nt, Human
cagccaagaaagcagugcucca

SEQ ID NO: 108733 - RNA, 22 nt, Human
cagccacucggccauaaaggcu

SEQ ID NO: 108734 - RNA, 22 nt, Human
cagccacuggugccaggcuguu

SEQ ID NO: 108735 - RNA, 22 nt, Human
cagccacuguggaauagccccc

SEQ ID NO: 108736 - RNA, 22 nt, Human
cagccacuugugaugcugggga

SEQ ID NO: 108737 - RNA, 22 nt, Human
cagccagccucucaaccaugca

SEQ ID NO: 108738 - RNA, 22 nt, Human
cagccagcuggcacugugagua

SEQ ID NO: 108739 - RNA, 22 nt, Human
cagcugcuguucaguuuuguuu

SEQ ID NO: 108740 - RNA, 22 nt, Human
cagcugcuuacuagcuguguga

SEQ ID NO: 108741 - RNA, 22 nt, Human
cagcuggaggagcagcuuccag

SEQ ID NO: 108742 - RNA, 22 nt, Human
cagcuggcaaguggagcagggu

SEQ ID NO: 108743 - RNA, 22 nt, Human
cagcuggcagcccuggcccugc

SEQ ID NO: 108744 - RNA, 22 nt, Human
cagcuggcgccuggggaccaga

SEQ ID NO: 108745 - RNA, 22 nt, Human
cagcuggcuccaccucugggcu

SEQ ID NO: 108746 - RNA, 22 nt, Human
cagcugggcuaagaguagaggc

SEQ ID NO: 108747 - RNA, 22 nt, Human
cagcuggggcagccacgugcgg

SEQ ID NO: 108748 - RNA, 22 nt, Human
cagcuggguuuaguggggugug

SEQ ID NO: 108749 - RNA, 22 nt, Human
cagcugguacucaguucuuguc

SEQ ID NO: 108750 - RNA, 22 nt, Human
cagcuggugagcuuaguagggu

SEQ ID NO: 108751 - RNA, 22 nt, Human
cagcuggugucaggcacugcag

SEQ ID NO: 108752 - RNA, 22 nt, Human
cagcugguguccagggaagugg

SEQ ID NO: 108753 - RNA, 22 nt, Human
cagcugguuaucagagaggccu

SEQ ID NO: 108754 - RNA, 22 nt, Human
cagcugguuggaagggagcuga

SEQ ID NO: 108755 - RNA, 22 nt, Human
cagcugucuggggagugcucgc

SEQ ID NO: 108756 - RNA, 22 nt, Human
cagcugugacagccaguugaug

SEQ ID NO: 108757 - RNA, 22 nt, Human
cagcuguguaaacacaugugua

SEQ ID NO: 108758 - RNA, 22 nt, Human
cagcuguuacugaaguaaaaug

SEQ ID NO: 108759 - RNA, 22 nt, Human
cagcuguugacugguacaugaa

SEQ ID NO: 108760 - RNA, 22 nt, Human
cagcuguugaucucuuaagccu

SEQ ID NO: 108761 - RNA, 22 nt, Human
cagcuguugcagcacugagaga

SEQ ID NO: 108762 - RNA, 22 nt, Human
cagcuguugucaccucacaucc

SEQ ID NO: 108763 - RNA, 22 nt, Human
cagcuguugugcugggcaguua

SEQ ID NO: 108764 - RNA, 22 nt, Human
cagcuguuguuaugucugcagg

SEQ ID NO: 108765 - RNA, 22 nt, Human
cagcuuaccucccacagcucuc

SEQ ID NO: 108766 - RNA, 22 nt, Human
cagcuuauucaguaagcacaua

SEQ ID NO: 108767 - RNA, 22 nt, Human
cagcuucaauaauggcugaugg

SEQ ID NO: 108768 - RNA, 22 nt, Human
cagcuucccuuggcugagcaga

SEQ ID NO: 108769 - RNA, 22 nt, Human
cagcuuccgaccgggggcugca

SEQ ID NO: 108770 - RNA, 22 nt, Human
cagcuucuagcaucggcuuuga

SEQ ID NO: 108771 - RNA, 22 nt, Human
cagcuucugagcaagccagggg

SEQ ID NO: 108772 - RNA, 22 nt, Human
cagcuucugcuaucgaacaucu

SEQ ID NO: 108773 - RNA, 22 nt, Human
cagcuucuguccuagaaacugg

SEQ ID NO: 108774 - RNA, 21 nt, Human
cagcuucuucugugaccuggu

SEQ ID NO: 108775 - RNA, 22 nt, Human
cagcuucuuugggauucuuuau

SEQ ID NO: 108776 - RNA, 22 nt, Human
cagcuugaaauauuaggagaug

SEQ ID NO: 108777 - RNA, 22 nt, Human
cagcuugcacacauauuagacg

SEQ ID NO: 108778 - RNA, 22 nt, Human
cagcuugcaguacuuguuuuug

SEQ ID NO: 108779 - RNA, 22 nt, Human
cagcuugcuaauuuugacuuca

SEQ ID NO: 108780 - RNA, 22 nt, Human
cagcuuggcuucacauucugua

SEQ ID NO: 108781 - RNA, 22 nt, Human
cagcuuggcuuccgcuuuacug

SEQ ID NO: 108782 - RNA, 22 nt, Human
cagcuugugcaaagguccuggg

SEQ ID NO: 108783 - RNA, 22 nt, Human
cagcuugugucauucaucuugu

SEQ ID NO: 108784 - RNA, 22 nt, Human
cagcuuguuuacaugcuuauuc

SEQ ID NO: 108785 - RNA, 22 nt, Human
cagcuuuagagaaaacauauuu

SEQ ID NO: 108786 - RNA, 22 nt, Human
cagcuuuaggacucauaauaaa

SEQ ID NO: 108787 - RNA, 16 nt, Human
cagcuuuaugucagug

SEQ ID NO: 108788 - RNA, 22 nt, Human
cagcuuuauugagguauaauug

SEQ ID NO: 108789 - RNA, 22 nt, Human
cagcuuucaucagugacacuca

SEQ ID NO: 108790 - RNA, 22 nt, Human
cagcuuuccccgugccucagcc

SEQ ID NO: 108791 - RNA, 22 nt, Human
cagcuuugagcagccaguggca

SEQ ID NO: 108792 - RNA, 22 nt, Human
cagcuuuggagugugagugcug

SEQ ID NO: 108793 - RNA, 22 nt, Human
cagcuuugucauuugauuuggg

SEQ ID NO: 108794 - RNA, 22 nt, Human
cagcuuugucugauuccucuuu

SEQ ID NO: 108795 - RNA, 21 nt, Human
cagcuuugucugucuucgggg

SEQ ID NO: 108796 - RNA, 22 nt, Human
caggaaacggcuauucuuuugu

SEQ ID NO: 108797 - RNA, 22 nt, Human
caggaaagaaaugagaacacca

SEQ ID NO: 108798 - RNA, 22 nt, Human
caggaaagggaugggcugccac

SEQ ID NO: 108799 - RNA, 22 nt, Human
caggaaagguagucacaaugua

SEQ ID NO: 108800 - RNA, 22 nt, Human
caggaaauagacacuguaugau

SEQ ID NO: 108801 - RNA, 22 nt, Human
caggaaaucacucugauuuugg

SEQ ID NO: 108802 - RNA, 22 nt, Human
caggaaaucagaacucaagugg

SEQ ID NO: 108803 - RNA, 21 nt, Human
caggaaaucagugugaauuag

SEQ ID NO: 108804 - RNA, 22 nt, Human
caggaaaugaacaggaaugaac

SEQ ID NO: 108805 - RNA, 23 nt, Human
caggaaaugaauccaggaggaug

SEQ ID NO: 108806 - RNA, 22 nt, Human
caggaaaugggguuuaguuauu

SEQ ID NO: 108807 - RNA, 22 nt, Human
caggaaaugggucguuuuauaa

SEQ ID NO: 108808 - RNA, 23 nt, Human
caggaaauguucuugaagccuga

SEQ ID NO: 108809 - RNA, 22 nt, Human
caggaaauuagucucucuguug

SEQ ID NO: 108810 - RNA, 22 nt, Human
caggaaauucaagagaggcugc

SEQ ID NO: 108811 - RNA, 22 nt, Human
caggaaauucuuuuuaacagaa

SEQ ID NO: 108812 - RNA, 22 nt, Human
caggaaauugcaacagucugag

SEQ ID NO: 108813 - RNA, 22 nt, Human
caggaaauuuugugaucuguuc

SEQ ID NO: 108814 - RNA, 22 nt, Human
caggaacaaggccuaugggacu

SEQ ID NO: 108815 - RNA, 22 nt, Human
caggaacaauaccucuugccag

SEQ ID NO: 108816 - RNA, 22 nt, Human
caggaacaauguaagucucauu

SEQ ID NO: 108817 - RNA, 22 nt, Human
caggaacaggguguccuggcag

SEQ ID NO: 108818 - RNA, 22 nt, Human
caggaaccaggagagucccuga

SEQ ID NO: 108819 - RNA, 22 nt, Human
caggaaccuaaugaaggcucac

SEQ ID NO: 108820 - RNA, 16 nt, Human
caggaaccugucuggc

SEQ ID NO: 108821 - RNA, 22 nt, Human
caggaaccuugucuguguuguu

SEQ ID NO: 108822 - RNA, 22 nt, Human
caggaacuggaacccuggccga

SEQ ID NO: 108823 - RNA, 22 nt, Human
caggaagaaagaggugaggugu

SEQ ID NO: 108824 - RNA, 22 nt, Human
caggaagcaagugauuuucuug

SEQ ID NO: 108825 - RNA, 22 nt, Human
caggaagcacagugaggagacc

SEQ ID NO: 108826 - RNA, 22 nt, Human
caggaagcaguagaacuuuucc

SEQ ID NO: 108827 - RNA, 22 nt, Human
caggaagccuuccuugucugcu

SEQ ID NO: 108828 - RNA, 22 nt, Human
caggaagcuagauuuuguugcu

SEQ ID NO: 108829 - RNA, 22 nt, Human
caggaagcugaugucuagucau

SEQ ID NO: 108830 - RNA, 22 nt, Human
caggaaggaccguccagaucag

SEQ ID NO: 108831 - RNA, 22 nt, Human
caggaagggggauccuuggaag

SEQ ID NO: 108832 - RNA, 22 nt, Human
caggaagucuuugcccaggcca

SEQ ID NO: 108833 - RNA, 22 nt, Human
caggaauccagagugagccucc

SEQ ID NO: 108834 - RNA, 22 nt, Human
caggaaugacccaacaguuuca

SEQ ID NO: 108835 - RNA, 19 nt, Human
caggaaugagguaauggcu

SEQ ID NO: 108836 - RNA, 22 nt, Human
caggaaugaggucguaaguguc

SEQ ID NO: 108837 - RNA, 22 nt, Human
caggaauguaugauacaguggu

SEQ ID NO: 108838 - RNA, 22 nt, Human
caggacaaagcccuuugagaaa

SEQ ID NO: 108839 - RNA, 22 nt, Human
caggacacaggguguggcugau

SEQ ID NO: 108840 - RNA, 22 nt, Human
caggacaccuuagcuaaaauuc

SEQ ID NO: 108841 - RNA, 22 nt, Human
caggacacuuguucuucucugc

SEQ ID NO: 108842 - RNA, 22 nt, Human
caggacagacagaaugccuaac

SEQ ID NO: 108843 - RNA, 20 nt, Human
caggacagcgcaaucggagg

SEQ ID NO: 108844 - RNA, 22 nt, Human
caggacaguauaggcuuuagga

SEQ ID NO: 108845 - RNA, 19 nt, Human
caggacaguuugccaagaa

SEQ ID NO: 108846 - RNA, 22 nt, Human
caggacaguuugcuuugcccug

SEQ ID NO: 108847 - RNA, 22 nt, Human
ccuggaccugcagcaucagcau

SEQ ID NO: 108848 - RNA, 22 nt, Human
caggccucuauggucagcugag

SEQ ID NO: 108849 - RNA, 22 nt, Human
caggccugaguguggaagucuu

SEQ ID NO: 108850 - RNA, 22 nt, Human
caggccuggcugcagcucgccu

SEQ ID NO: 108851 - RNA, 22 nt, Human
caggccugggcuggguaucagg

SEQ ID NO: 108852 - RNA, 22 nt, Human
caggccugggcuucggggcuga

SEQ ID NO: 108853 - RNA, 22 nt, Human
caggccugugacaccgugucug

SEQ ID NO: 108854 - RNA, 22 nt, Human
caggccuugggacccagacugg

SEQ ID NO: 108855 - RNA, 22 nt, Human
ccuugggguguuggaggcagcc

SEQ ID NO: 108856 - RNA, 22 nt, Human
ccuuggugaucugggcuggaag

SEQ ID NO: 108857 - RNA, 22 nt, Human
ccuugguucugccuggccugga

SEQ ID NO: 108858 - RNA, 22 nt, Human
ccuuguuuuggaaccaaaggau

SEQ ID NO: 108859 - RNA, 22 nt, Human
ccuuuaaagacugcauaacuuc

SEQ ID NO: 108860 - RNA, 22 nt, Human
ccuuuaaauggauguucaacug

SEQ ID NO: 108861 - RNA, 22 nt, Human
ccuuuaaguccucuuuuauauu

SEQ ID NO: 108862 - RNA, 22 nt, Human
ccuuuacaaaguucuucauggg

SEQ ID NO: 108863 - RNA, 22 nt, Human
ccuuuacaucugacuucuuuca

SEQ ID NO: 108864 - RNA, 22 nt, Human
ccuuuagaauacagacuuucua

SEQ ID NO: 108865 - RNA, 21 nt, Human
ccuuuagauuucuaugcaguu

SEQ ID NO: 108866 - RNA, 22 nt, Human
ccuuuaggagugaggaccgagc

SEQ ID NO: 108867 - RNA, 22 nt, Human
ccuuuauacuaaggcauacaau

SEQ ID NO: 108868 - RNA, 22 nt, Human
ccuuuauucaauuaguccuaau

SEQ ID NO: 108869 - RNA, 22 nt, Human
ccuuucaaaguuuugccaugcu

SEQ ID NO: 108870 - RNA, 22 nt, Human
ccuuuccugccucaggaaguag

SEQ ID NO: 108871 - RNA, 17 nt, Human
ccuuucucuuucaucuc

SEQ ID NO: 108872 - RNA, 22 nt, Human
ccuuucugacagugaugggggg

SEQ ID NO: 108873 - RNA, 22 nt, Human
ccuuucugauggccucccagcc

SEQ ID NO: 108874 - RNA, 22 nt, Human
ccuuucugguauuuaaccaaag

SEQ ID NO: 108875 - RNA, 18 nt, Human
ccuuugcaaaggggguua

SEQ ID NO: 108876 - RNA, 22 nt, Human
ccuuuggggcuuuacuguggaa

SEQ ID NO: 108877 - RNA, 22 nt, Human
ccuuuguaccuuaaauccugug

SEQ ID NO: 108878 - RNA, 22 nt, Human
ccuuuguacucugguccaaacu

SEQ ID NO: 108879 - RNA, 22 nt, Human
ccuuuguggggcgguggguaau

SEQ ID NO: 108880 - RNA, 22 nt, Human
ccuuuguucacuggagagugga

SEQ ID NO: 108881 - RNA, 22 nt, Human
ccuuuuauacucuguccucugg

SEQ ID NO: 108882 - RNA, 22 nt, Human
ccuuuuauagaucaguguguua

SEQ ID NO: 108883 - RNA, 16 nt, Human
ccuuuucucaucucua

SEQ ID NO: 108884 - RNA, 22 nt, Human
ccuuuucuguuuccugucacug

SEQ ID NO: 108885 - RNA, 22 nt, Human
ccuuuugaagguguuguuaagu

SEQ ID NO: 108886 - RNA, 22 nt, Human
ccuuuuggccaggucagugcag

SEQ ID NO: 108887 - RNA, 22 nt, Human
ccuuuuguacacuuacuauaua

SEQ ID NO: 108888 - RNA, 21 nt, Human
ccuuuuugcuuauggacagac

SEQ ID NO: 108889 - RNA, 22 nt, Human
cgaaaucagcaucuugaggcaa

SEQ ID NO: 108890 - RNA, 22 nt, Human
cgaacacacuugggaguucuga

SEQ ID NO: 108891 - RNA, 21 nt, Human
cgacaguguauagauuagagc

SEQ ID NO: 108892 - RNA, 22 nt, Human
cgacugucauacacaagacaug

SEQ ID NO: 108893 - RNA, 22 nt, Human
cgagagauggguuggcaggggc

SEQ ID NO: 108894 - RNA, 22 nt, Human
cgaggagugugaaggcuugucg

SEQ ID NO: 108895 - RNA, 22 nt, Human
cgaggcagacaaaaguuggaag

SEQ ID NO: 108896 - RNA, 22 nt, Human
cgaggcagggaagcugcaaaag

SEQ ID NO: 108897 - RNA, 22 nt, Human
cgaggccacaccugcuucuggg

SEQ ID NO: 108898 - RNA, 22 nt, Human
cgaggccagcucuaagcccuac

SEQ ID NO: 108899 - RNA, 22 nt, Human
cgaggcucagagagggugacuu

SEQ ID NO: 108900 - RNA, 22 nt, Human
cgaggugggcagaucacagagu

SEQ ID NO: 108901 - RNA, 22 nt, Human
cgaguaauuggaaauuugcuau

SEQ ID NO: 108902 - RNA, 22 nt, Human
cgcaacagcguggcgcccagcu

SEQ ID NO: 108903 - RNA, 22 nt, Human
cgcagagggagccgcgggcugc

SEQ ID NO: 108904 - RNA, 22 nt, Human
cgcagcagccccgugguaggug

SEQ ID NO: 108905 - RNA, 22 nt, Human
cgcagcugaccuuuuacaaaac

SEQ ID NO: 108906 - RNA, 22 nt, Human
cgcagcugcaaaggaaacauuu

SEQ ID NO: 108907 - RNA, 22 nt, Human
cgcagcugccuugucagccguu

SEQ ID NO: 108908 - RNA, 22 nt, Human
cgcaggcuccggggugcccugg

SEQ ID NO: 108909 - RNA, 22 nt, Human
cgcaggcucgguucacagagca

SEQ ID NO: 108910 - RNA, 22 nt, Human
cgcaggcuuuagaaucugcuac

SEQ ID NO: 108911 - RNA, 22 nt, Human
cgcagggccgcgagcgggacca

SEQ ID NO: 108912 - RNA, 22 nt, Human
cgcaggugccggcagauggggu

SEQ ID NO: 108913 - RNA, 22 nt, Human
cgcagguguguuuucaggacua

SEQ ID NO: 108914 - RNA, 22 nt, Human
cgcagguguucaguaaauguau

SEQ ID NO: 108915 - RNA, 20 nt, Human
cgcauaguuuccaucauucc

SEQ ID NO: 108916 - RNA, 22 nt, Human
cgcauccagggcgcaggaucug

SEQ ID NO: 108917 - RNA, 22 nt, Human
cgcaugugcguugauugcagug

SEQ ID NO: 108918 - RNA, 23 nt, Human
cgcccagccucagugaccugggc

SEQ ID NO: 108919 - RNA, 22 nt, Human
cgcccagcugaaaucuccaggc

SEQ ID NO: 108920 - RNA, 20 nt, Human
cgcccaggagggcccaugug

SEQ ID NO: 108921 - RNA, 22 nt, Human
cgcccagggcaggaggccgcuc

SEQ ID NO: 108922 - RNA, 22 nt, Human
cgccccagccaguugagcggcg

SEQ ID NO: 108923 - RNA, 22 nt, Human
cgcccuccacacagccccuggc

SEQ ID NO: 108924 - RNA, 22 nt, Human
cgccugcucucacuggacagcu

SEQ ID NO: 108925 - RNA, 19 nt, Human
cgccuggcaggcccugcgc

SEQ ID NO: 108926 - RNA, 22 nt, Human
cgcgcggcucucgcgagaugug

SEQ ID NO: 108927 - RNA, 22 nt, Human
cgcgcuguuuacgugacuuaau

SEQ ID NO: 108928 - RNA, 22 nt, Human
cgcggagcuccgcccggugccc

SEQ ID NO: 108929 - RNA, 22 nt, Human
cgcuggcauuagggcaguggcc

SEQ ID NO: 108930 - RNA, 22 nt, Human
cgcuggccauagccuccugugu

SEQ ID NO: 108931 - RNA, 22 nt, Human
cgcuggggcuuuuugcuugaga

SEQ ID NO: 108932 - RNA, 22 nt, Human
cgcugggggaacagcgagggug

SEQ ID NO: 108933 - RNA, 22 nt, Human
cgcugugugcagacugaaaaug

SEQ ID NO: 108934 - RNA, 22 nt, Human
cggaagagggacagcgccagcc

SEQ ID NO: 108935 - RNA, 22 nt, Human
cggacaggcuccuggagcuccu

SEQ ID NO: 108936 - RNA, 22 nt, Human
cggacccacucggaucccagcc

SEQ ID NO: 108937 - RNA, 20 nt, Human
cggacuuucuucucagggca

SEQ ID NO: 108938 - RNA, 22 nt, Human
cggagccugcuuguugcagcug

SEQ ID NO: 108939 - RNA, 22 nt, Human
cggaggcaaacucaccuggcuc

SEQ ID NO: 108940 - RNA, 22 nt, Human
cggaucaugugaccuuugagug

SEQ ID NO: 108941 - RNA, 22 nt, Human
cggcagagcggcgagccccucc

SEQ ID NO: 108942 - RNA, 18 nt, Human
cggcagagugcuucuagc

SEQ ID NO: 108943 - RNA, 22 nt, Human
cggcagagugugugcgugcaug

SEQ ID NO: 108944 - RNA, 22 nt, Human
cggcagcaaaggaagccagguc

SEQ ID NO: 108945 - RNA, 22 nt, Human
cggcagcaucgaaacuacauuc

SEQ ID NO: 108946 - RNA, 22 nt, Human
cggcaggugugcucacucugcc

SEQ ID NO: 108947 - RNA, 22 nt, Human
cggcccugaccagaccuuaguu

SEQ ID NO: 108948 - RNA, 22 nt, Human
cggcccuggcggaggcgggaga

SEQ ID NO: 108949 - RNA, 22 nt, Human
cggccuucucccugggcaucac

SEQ ID NO: 108950 - RNA, 22 nt, Human
cggcucagcuagcuuggcccca

SEQ ID NO: 108951 - RNA, 22 nt, Human
cggcugcuucugagccccggcg

SEQ ID NO: 108952 - RNA, 22 nt, Human
cggcuggggcuguccccaugac

SEQ ID NO: 108953 - RNA, 22 nt, Human
cggcuucaugagaaaugacaga

SEQ ID NO: 108954 - RNA, 23 nt, Human
cggcuucugaaaucccaucuguu

SEQ ID NO: 108955 - RNA, 22 nt, Human
cggcuucuucaucaggucagca

SEQ ID NO: 108956 - RNA, 22 nt, Human
cgggaaaguuccacagauggau

SEQ ID NO: 108957 - RNA, 22 nt, Human
caguccucucacucaggccuuu

SEQ ID NO: 108958 - RNA, 17 nt, Human
caguccucugcucuaag

SEQ ID NO: 108959 - RNA, 22 nt, Human
caguccugagcuccugggcuga

SEQ ID NO: 108960 - RNA, 22 nt, Human
caguccugggcacagcccuggg

SEQ ID NO: 108961 - RNA, 22 nt, Human
caguccugggugcagcaggaaa

SEQ ID NO: 108962 - RNA, 22 nt, Human
caguccuuagauuuuacugcca

SEQ ID NO: 108963 - RNA, 22 nt, Human
caguccuuagucuggauggcuu

SEQ ID NO: 108964 - RNA, 22 nt, Human
caguccuuauuccuauauuccu

SEQ ID NO: 108965 - RNA, 22 nt, Human
caguccuucauuccuccuuuga

SEQ ID NO: 108966 - RNA, 22 nt, Human
caguccuuggcuucauccgagu

SEQ ID NO: 108967 - RNA, 17 nt, Human
cagucgaggaggaccug

SEQ ID NO: 108968 - RNA, 22 nt, Human
cagucucacccuggaggcccca

SEQ ID NO: 108969 - RNA, 22 nt, Human
cagucuccugggggcuguuguu

SEQ ID NO: 108970 - RNA, 22 nt, Human
cagucucuaaaucaaucugaau

SEQ ID NO: 108971 - RNA, 22 nt, Human
cagucucucuuguagugcagcu

SEQ ID NO: 108972 - RNA, 22 nt, Human
cagucucuuuucagcuccaucc

SEQ ID NO: 108973 - RNA, 22 nt, Human
cagucugaacacugggcuacuc

SEQ ID NO: 108974 - RNA, 22 nt, Human
cagucuggaggucagcuggcuu

SEQ ID NO: 108975 - RNA, 22 nt, Human
cagucuggcacagcacacugaa

SEQ ID NO: 108976 - RNA, 22 nt, Human
cagucugggacugagcuccacc

SEQ ID NO: 108977 - RNA, 22 nt, Human
cagucuguuucugagaaacaga

SEQ ID NO: 108978 - RNA, 22 nt, Human
cagucuuagccuucccucaccc

SEQ ID NO: 108979 - RNA, 22 nt, Human
cagucuuugacaagcccuuuca

SEQ ID NO: 108980 - RNA, 22 nt, Human
cagucuuugaugcauccuagcc

SEQ ID NO: 108981 - RNA, 22 nt, Human
cagucuuuguucccauuacuga

SEQ ID NO: 108982 - RNA, 22 nt, Human
cagugaaguguggacgucacca

SEQ ID NO: 108983 - RNA, 22 nt, Human
cagugaaguuuaaaguguagau

SEQ ID NO: 108984 - RNA, 22 nt, Human
cagugacacccagucuggccca

SEQ ID NO: 108985 - RNA, 22 nt, Human
cagugacagcaagcagugcugg

SEQ ID NO: 108986 - RNA, 22 nt, Human
cagugagaauucaguagguacu

SEQ ID NO: 108987 - RNA, 21 nt, Human
cagugaggcccuccuguuccc

SEQ ID NO: 108988 - RNA, 22 nt, Human
cagugaggcucugcugagcggu

SEQ ID NO: 108989 - RNA, 22 nt, Human
cagugagguggaguaguuccca

SEQ ID NO: 108990 - RNA, 22 nt, Human
caguauguccuuccucguuggc

SEQ ID NO: 108991 - RNA, 22 nt, Human
caguaugugaugcaacggaaua

SEQ ID NO: 108992 - RNA, 22 nt, Human
caguauuucauucagaauuguu

SEQ ID NO: 108993 - RNA, 22 nt, Human
caguauuuggaauauagcuaag

SEQ ID NO: 108994 - RNA, 22 nt, Human
cagucacauuucgacauaacua

SEQ ID NO: 108995 - RNA, 22 nt, Human
cagucaccuagacagaacuuac

SEQ ID NO: 108996 - RNA, 22 nt, Human
cagucacuggaauagcugagga

SEQ ID NO: 108997 - RNA, 22 nt, Human
cagucaggcugcgcuucucuga

SEQ ID NO: 108998 - RNA, 22 nt, Human
cagucagggacaccagcuagga

SEQ ID NO: 108999 - RNA, 22 nt, Human
cagucauuaugggaguuaaucc

SEQ ID NO: 109000 - RNA, 22 nt, Human
cagucauuggcuaaagcucccu

SEQ ID NO: 109001 - RNA, 22 nt, Human
caguccagagcccaccagagga

SEQ ID NO: 109002 - RNA, 22 nt, Human
caguccagccaguagggugugg

SEQ ID NO: 109003 - RNA, 22 nt, Human
caguccauaugccauaauucuu

SEQ ID NO: 109004 - RNA, 22 nt, Human
cagucccaccaggaucgcucuu

SEQ ID NO: 109005 - RNA, 22 nt, Human
cagucccacuagugccaauacc

SEQ ID NO: 109006 - RNA, 22 nt, Human
cagucccagacauaguaaggga

SEQ ID NO: 109007 - RNA, 22 nt, Human
cagucccaggguugguucagcu

SEQ ID NO: 109008 - RNA, 22 nt, Human
cagucccaugagcccagaacau

SEQ ID NO: 109009 - RNA, 22 nt, Human
caguccugcccaggcugacaga

SEQ ID NO: 109010 - RNA, 22 nt, Human
caguccugcuagugugaaaagc

SEQ ID NO: 109011 - RNA, 22 nt, Human
caguccugggagacuuacccag

SEQ ID NO: 109012 - RNA, 22 nt, Human
caguccuggggaccaggcugag

SEQ ID NO: 109013 - RNA, 20 nt, Human
caguccugucccugcugccc

SEQ ID NO: 109014 - RNA, 22 nt, Human
caguccugucuuuaugacuuca

SEQ ID NO: 109015 - RNA, 22 nt, Human
caguccuguguuaaacaagagc

SEQ ID NO: 109016 - RNA, 22 nt, Human
caguccuuccuugccccuuggg

SEQ ID NO: 109017 - RNA, 22 nt, Human
caguccuuggcaaguucucagu

SEQ ID NO: 109018 - RNA, 22 nt, Human
caguccuuucaauggugaccuu

SEQ ID NO: 109019 - RNA, 19 nt, Human
caguccuuuccgcuuucuc

SEQ ID NO: 109020 - RNA, 22 nt, Human
caguccuuucugaaauccuaua

SEQ ID NO: 109021 - RNA, 18 nt, Human
cagucuaauucccuuccc

SEQ ID NO: 109022 - RNA, 22 nt, Human
cagucuccgccagcuccucaca

SEQ ID NO: 109023 - RNA, 22 nt, Human
cagucucucuccuugcaggcgu

SEQ ID NO: 109024 - RNA, 22 nt, Human
cagucucugggaaagaggacag

SEQ ID NO: 109025 - RNA, 22 nt, Human
cagucucuggugaguugacagu

SEQ ID NO: 109026 - RNA, 22 nt, Human
cagucucugugccagauccugg

SEQ ID NO: 109027 - RNA, 22 nt, Human
cagucuggaucugugcugcugu

SEQ ID NO: 109028 - RNA, 22 nt, Human
cagucuuagaggugacugugga

SEQ ID NO: 109029 - RNA, 22 nt, Human
cagucuuauccugaaaacaaca

SEQ ID NO: 109030 - RNA, 22 nt, Human
cagucuucuaaccuagcagccu

SEQ ID NO: 109031 - RNA, 22 nt, Human
cagugaacuugaguacuucauu

SEQ ID NO: 109032 - RNA, 17 nt, Human
cagugaagagacauuaa

SEQ ID NO: 109033 - RNA, 22 nt, Human
cagugacguaaacugcaugugc

SEQ ID NO: 109034 - RNA, 22 nt, Human
cagugagcacggccagagggga

SEQ ID NO: 109035 - RNA, 22 nt, Human
cagugaggaguccagggcagag

SEQ ID NO: 109036 - RNA, 22 nt, Human
cagugaggaugauaauuaaggu

SEQ ID NO: 109037 - RNA, 22 nt, Human
cagugagguggauggauggccu

SEQ ID NO: 109038 - RNA, 22 nt, Human
cagugaguugugcugaggacca

SEQ ID NO: 109039 - RNA, 22 nt, Human
cagugauuguacuguugugccu

SEQ ID NO: 109040 - RNA, 22 nt, Human
cagugcaaugcagaugacacca

SEQ ID NO: 109041 - RNA, 22 nt, Human
cagugcaauuagaacuuauuua

SEQ ID NO: 109042 - RNA, 17 nt, Human
cagugcagagcccuuuc

SEQ ID NO: 109043 - RNA, 22 nt, Human
cagugcaugaaacaauaugcag

SEQ ID NO: 109044 - RNA, 22 nt, Human
cagugcaugcacacacauggua

SEQ ID NO: 109045 - RNA, 22 nt, Human
cagugccagcugcuuggccuac

SEQ ID NO: 109046 - RNA, 22 nt, Human
cagugccaguggaugaacuguu

SEQ ID NO: 109047 - RNA, 22 nt, Human
cagugcccaaaggaacagaaag

SEQ ID NO: 109048 - RNA, 22 nt, Human
cagugcccaagaugugccaugc

SEQ ID NO: 109049 - RNA, 22 nt, Human
cagugcccucaucuaugaaauc

SEQ ID NO: 109050 - RNA, 22 nt, Human
cagugccuggccggcuuccauu

SEQ ID NO: 109051 - RNA, 21 nt, Human
cagugcucaaucugacagugg

SEQ ID NO: 109052 - RNA, 21 nt, Human
cagugcucaggaauagagaga

SEQ ID NO: 109053 - RNA, 22 nt, Human
cagugcuccugauguacccuug

SEQ ID NO: 109054 - RNA, 22 nt, Human
cagugcugacagggaggaaccu

SEQ ID NO: 109055 - RNA, 22 nt, Human
cagugcuggaggcuggagggaa

SEQ ID NO: 109056 - RNA, 23 nt, Human
cagugcugguucugccugugggg

SEQ ID NO: 109057 - RNA, 22 nt, Human
cagugcugugcuggaagcuguu

SEQ ID NO: 109058 - RNA, 22 nt, Human
cagugcuguuaauaaacacaaa

SEQ ID NO: 109059 - RNA, 22 nt, Human
cagugcuguuguaagcucauug

SEQ ID NO: 109060 - RNA, 22 nt, Human
cagugcuuuuaaaacaacauca

SEQ ID NO: 109061 - RNA, 22 nt, Human
caguggaagacucagcucuccc

SEQ ID NO: 109062 - RNA, 22 nt, Human
caguggaauacgagcagauguc

SEQ ID NO: 109063 - RNA, 22 nt, Human
caguggagugggacuggucuga

SEQ ID NO: 109064 - RNA, 22 nt, Human
caguggauccucugacucccuc

SEQ ID NO: 109065 - RNA, 22 nt, Human
caguggaugauuuggcugcuag

SEQ ID NO: 109066 - RNA, 22 nt, Human
ucucuagguugauauaaauuau

SEQ ID NO: 109067 - RNA, 22 nt, Human
ucucuaguauuaaauauagugu

SEQ ID NO: 109068 - RNA, 22 nt, Human
ucucuagugccaugaaaguccu

SEQ ID NO: 109069 - RNA, 22 nt, Human
ucucuaugacaagguuugguug

SEQ ID NO: 109070 - RNA, 20 nt, Human
ucucuauucccacgaggaaa

SEQ ID NO: 109071 - RNA, 22 nt, Human
ucucucaaccucggcacuauug

SEQ ID NO: 109072 - RNA, 22 nt, Human
ucucucacuggugccucuguug

SEQ ID NO: 109073 - RNA, 22 nt, Human
ucucucauaagaugaguacuua

SEQ ID NO: 109074 - RNA, 22 nt, Human
ucucuccaacaugguggugcug

SEQ ID NO: 109075 - RNA, 22 nt, Human
ucucucccuuuccuuaucaguu

SEQ ID NO: 109076 - RNA, 21 nt, Human
ucucuccucaagcucgacccc

SEQ ID NO: 109077 - RNA, 22 nt, Human
ucucuccuccacaccgggugcu

SEQ ID NO: 109078 - RNA, 22 nt, Human
ucucuccucuagucaggguggu

SEQ ID NO: 109079 - RNA, 22 nt, Human
ucucucuacuggggcacuagga

SEQ ID NO: 109080 - RNA, 22 nt, Human
ucucucuauaugucaacagggg

SEQ ID NO: 109081 - RNA, 22 nt, Human
ucucucugccaacucacagcca

SEQ ID NO: 109082 - RNA, 22 nt, Human
ucucucuucagagauaccuugc

SEQ ID NO: 109083 - RNA, 22 nt, Human
ucucucuugucaccccaucugc

SEQ ID NO: 109084 - RNA, 22 nt, Human
ucucugaaagcagcugcucauc

SEQ ID NO: 109085 - RNA, 22 nt, Human
ucucugaacuuccuggaaaggc

SEQ ID NO: 109086 - RNA, 22 nt, Human
ucucugaagagcucagacuagu

SEQ ID NO: 109087 - RNA, 22 nt, Human
ucucugaauuguuuaaguuauu

SEQ ID NO: 109088 - RNA, 21 nt, Human
ucucugagacacucuggagcc

SEQ ID NO: 109089 - RNA, 22 nt, Human
ucucugagacaguagccucugc

SEQ ID NO: 109090 - RNA, 22 nt, Human
ucucugagcaugccauauugcu

SEQ ID NO: 109091 - RNA, 21 nt, Human
ucucugagcccaccaggaucu

SEQ ID NO: 109092 - RNA, 22 nt, Human
ucucugagccccugccucuuuc

SEQ ID NO: 109093 - RNA, 22 nt, Human
ucucugagcgcauuccuccggc

SEQ ID NO: 109094 - RNA, 22 nt, Human
ucucugagcucaggagcugcag

SEQ ID NO: 109095 - RNA, 22 nt, Human
ucucugagcugcuucuugcaua

SEQ ID NO: 109096 - RNA, 22 nt, Human
ucucugaggaagaggcuguaau

SEQ ID NO: 109097 - RNA, 22 nt, Human
ucucugaggacuugggguugcc

SEQ ID NO: 109098 - RNA, 22 nt, Human
ucucugaguucuccuccagccc

SEQ ID NO: 109099 - RNA, 23 nt, Human
ucucugaguuguacuuucccuug

SEQ ID NO: 109100 - RNA, 22 nt, Human
ucucugaugcugccagggaaaa

SEQ ID NO: 109101 - RNA, 22 nt, Human
ucucugauguauaucagagaac

SEQ ID NO: 109102 - RNA, 22 nt, Human
ucucugcagucuugggcaggca

SEQ ID NO: 109103 - RNA, 19 nt, Human
ucucugccgaucagggccc

SEQ ID NO: 109104 - RNA, 22 nt, Human
ucucugcucugugccucaguuu

SEQ ID NO: 109105 - RNA, 22 nt, Human
ucucugcugagaagggcuggca

SEQ ID NO: 109106 - RNA, 16 nt, Human
ucucugcuucauaggu

SEQ ID NO: 109107 - RNA, 22 nt, Human
ucucugcuugguguaugugagu

SEQ ID NO: 109108 - RNA, 22 nt, Human
ucucuggaagcgcagaucuguu

SEQ ID NO: 109109 - RNA, 22 nt, Human
ucucuggaauuuugagagugac

SEQ ID NO: 109110 - RNA, 22 nt, Human
ucucuggagcugcagauccagg

SEQ ID NO: 109111 - RNA, 22 nt, Human
ucucuggaguauaaccagggau

SEQ ID NO: 109112 - RNA, 21 nt, Human
ucucuggaguuagcagagaga

SEQ ID NO: 109113 - RNA, 19 nt, Human
ucucuggaugacagacacu

SEQ ID NO: 109114 - RNA, 22 nt, Human
ucucuggcagacaccucccuga

SEQ ID NO: 109115 - RNA, 22 nt, Human
ucucuggcagcuugugcuguug

SEQ ID NO: 109116 - RNA, 23 nt, Human
ucucuggccuuugaucagguuga

SEQ ID NO: 109117 - RNA, 19 nt, Human
ucucuggcuugucugccug

SEQ ID NO: 109118 - RNA, 22 nt, Human
ucucugggaaugggccugggua

SEQ ID NO: 109119 - RNA, 22 nt, Human
ucucugggacacugggucaguu

SEQ ID NO: 109120 - RNA, 22 nt, Human
ucucugggagcaauuguuugcu

SEQ ID NO: 109121 - RNA, 22 nt, Human
ucucugggaguugagcagcagc

SEQ ID NO: 109122 - RNA, 22 nt, Human
ucucugggcccagaccuuccuu

SEQ ID NO: 109123 - RNA, 21 nt, Human
ucucugggcccuccugugggg

SEQ ID NO: 109124 - RNA, 22 nt, Human
ucucugggccucaguuuucuca

SEQ ID NO: 109125 - RNA, 22 nt, Human
ucucugggccuguuuucucauc

SEQ ID NO: 109126 - RNA, 19 nt, Human
ucucuggggacacuuucac

SEQ ID NO: 109127 - RNA, 22 nt, Human
ucucuggguaaaguucucucau

SEQ ID NO: 109128 - RNA, 22 nt, Human
ucucuggguucucacucagcac

SEQ ID NO: 109129 - RNA, 22 nt, Human
ucucuggguugagaacuaggac

SEQ ID NO: 109130 - RNA, 16 nt, Human
ucucuggguugcacag

SEQ ID NO: 109131 - RNA, 22 nt, Human
ucucuggguuuuuguccuguac

SEQ ID NO: 109132 - RNA, 22 nt, Human
ucucugguggcuccaucaguag

SEQ ID NO: 109133 - RNA, 23 nt, Human
ucucugguuaggggagauuggug

SEQ ID NO: 109134 - RNA, 22 nt, Human
ucucuguaagcugccuucucgu

SEQ ID NO: 109135 - RNA, 22 nt, Human
ucucuguacaguacaugccgug

SEQ ID NO: 109136 - RNA, 22 nt, Human
ucucuguagaccugaccagcac

SEQ ID NO: 109137 - RNA, 22 nt, Human
ucucuguagcagcuuccuuccu

SEQ ID NO: 109138 - RNA, 22 nt, Human
ucucuguccccucagcuggggu

SEQ ID NO: 109139 - RNA, 22 nt, Human
ucucugucccuaggagccuugc

SEQ ID NO: 109140 - RNA, 22 nt, Human
ucucugucugcacccaaucaau

SEQ ID NO: 109141 - RNA, 22 nt, Human
ucucugucuuuguugucuucac

SEQ ID NO: 109142 - RNA, 22 nt, Human
ucucugugaagcucccguuagg

SEQ ID NO: 109143 - RNA, 22 nt, Human
ucucugugaauggcgucaccug

SEQ ID NO: 109144 - RNA, 22 nt, Human
ucucugugacagcuggguaugu

SEQ ID NO: 109145 - RNA, 22 nt, Human
ucucugugcuugacuuucccau

SEQ ID NO: 109146 - RNA, 22 nt, Human
ucucuguggagcaguguguuca

SEQ ID NO: 109147 - RNA, 22 nt, Human
ucucuguggcaacuacuuagcu

SEQ ID NO: 109148 - RNA, 21 nt, Human
ucucuguggccuacccucuac

SEQ ID NO: 109149 - RNA, 22 nt, Human
ucucuguggguuucaccagcgc

SEQ ID NO: 109150 - RNA, 22 nt, Human
ucucugugguaugucauagcaa

SEQ ID NO: 109151 - RNA, 21 nt, Human
ucucugugguccaaucccagc

SEQ ID NO: 109152 - RNA, 22 nt, Human
ucucugugugggagaucuuuuu

SEQ ID NO: 109153 - RNA, 22 nt, Human
ucucuuaaaagauuuuaaugac

SEQ ID NO: 109154 - RNA, 22 nt, Human
ucucuuaacugguucagcaauu

SEQ ID NO: 109155 - RNA, 22 nt, Human
ucucuuaauccggugcuuucug

SEQ ID NO: 109156 - RNA, 22 nt, Human
ucucuuaauuguaaugguuccu

SEQ ID NO: 109157 - RNA, 22 nt, Human
ucucuuagucuuauauguaaaa

SEQ ID NO: 109158 - RNA, 22 nt, Human
ucucuuauuuugccuuugacaa

SEQ ID NO: 109159 - RNA, 22 nt, Human
ucucuucccggauaaaguaagu

SEQ ID NO: 109160 - RNA, 22 nt, Human
ucucuucucuagugagcaacug

SEQ ID NO: 109161 - RNA, 22 nt, Human
ucucuucugaccuagccuugga

SEQ ID NO: 109162 - RNA, 22 nt, Human
ucucuucuuuggggugggcuca

SEQ ID NO: 109163 - RNA, 19 nt, Human
ucucuugaauaggucaaac

SEQ ID NO: 109164 - RNA, 22 nt, Human
ucucuugauauauuacauagag

SEQ ID NO: 109165 - RNA, 18 nt, Human
ucucuugcaucuucugua

SEQ ID NO: 109166 - RNA, 22 nt, Human
ucucuuggagguucuuccuguu

SEQ ID NO: 109167 - RNA, 22 nt, Human
ucucuugugguuuuguaguuga

SEQ ID NO: 109168 - RNA, 17 nt, Human
ucucuuguucacugcug

SEQ ID NO: 109169 - RNA, 22 nt, Human
ucucuuuaaagacucagagauu

SEQ ID NO: 109170 - RNA, 17 nt, Human
ucucuuucccuuucugc

SEQ ID NO: 109171 - RNA, 18 nt, Human
ucucuuuccucaguggag

SEQ ID NO: 109172 - RNA, 22 nt, Human
ucucuuugacccuuuagcucca

SEQ ID NO: 109173 - RNA, 22 nt, Human
ucucuuuucuuucuggauaaaa

SEQ ID NO: 109174 - RNA, 22 nt, Human
ucugaaagcccuaguuuguaau

SEQ ID NO: 109175 - RNA, 22 nt, Human
ucugaaauaagggagaagggaa

SEQ ID NO: 109176 - RNA, 22 nt, Human
uuaacaaaaauaucaggcauca

SEQ ID NO: 109177 - RNA, 22 nt, Human
uuaacaaauauuucccaugccc

SEQ ID NO: 109178 - RNA, 22 nt, Human
uuaacaaggugacugcauuaaa

SEQ ID NO: 109179 - RNA, 22 nt, Human
uuaacacagggggagacaaagu

SEQ ID NO: 109180 - RNA, 22 nt, Human
uuaacacuccuaacuacagucu

SEQ ID NO: 109181 - RNA, 22 nt, Human
uuaacagagaacauagaaguag

SEQ ID NO: 109182 - RNA, 22 nt, Human
uuaacagagugccuggcaugua

SEQ ID NO: 109183 - RNA, 22 nt, Human
uuaacagauguuuauggagcau

SEQ ID NO: 109184 - RNA, 22 nt, Human
uuaacaguggcuaagacugagg

SEQ ID NO: 109185 - RNA, 22 nt, Human
uuaacauacaucaugaacaaug

SEQ ID NO: 109186 - RNA, 22 nt, Human
uuaacauccuguuuaaauuugg

SEQ ID NO: 109187 - RNA, 22 nt, Human
uuaacauuguccuuagcagauu

SEQ ID NO: 109188 - RNA, 22 nt, Human
uuaacuguaucauacuguuuca

SEQ ID NO: 109189 - RNA, 22 nt, Human
uuaagaaugugccuuuugguug

SEQ ID NO: 109190 - RNA, 22 nt, Human
uuaagacacauuucucagacgg

SEQ ID NO: 109191 - RNA, 22 nt, Human
uuaagacaguguauuuguuuuc

SEQ ID NO: 109192 - RNA, 22 nt, Human
uuaagacaugugagcauaacuu

SEQ ID NO: 109193 - RNA, 21 nt, Human
uuaagaccugcaucaucauua

SEQ ID NO: 109194 - RNA, 22 nt, Human
uuaagacuauuguaauagggga

SEQ ID NO: 109195 - RNA, 22 nt, Human
uuaagagaagaguaucuagaac

SEQ ID NO: 109196 - RNA, 22 nt, Human
uuaagagaaggaaugaccuagc

SEQ ID NO: 109197 - RNA, 22 nt, Human
uuaagagauuuaggaacauuau

SEQ ID NO: 109198 - RNA, 22 nt, Human
uuaagaggagaucauacuggag

SEQ ID NO: 109199 - RNA, 22 nt, Human
uuaagagggugaugcuagcauu

SEQ ID NO: 109200 - RNA, 22 nt, Human
uuaagaucaagauaagcaauaa

SEQ ID NO: 109201 - RNA, 22 nt, Human
uuaagauguucagauaauuugg

SEQ ID NO: 109202 - RNA, 22 nt, Human
uuaagauuuguagagaaaaagc

SEQ ID NO: 109203 - RNA, 19 nt, Human
uuaagcuaagauacuagua

SEQ ID NO: 109204 - RNA, 22 nt, Human
uuaagcuagugaagucccucaa

SEQ ID NO: 109205 - RNA, 22 nt, Human
uuaaggaaagauuagcauuugu

SEQ ID NO: 109206 - RNA, 22 nt, Human
uuaaggaaagccaaaaugaauu

SEQ ID NO: 109207 - RNA, 22 nt, Human
uuaaggaacaauucuacacacc

SEQ ID NO: 109208 - RNA, 22 nt, Human
uuaaggaacuugucuuucucuu

SEQ ID NO: 109209 - RNA, 18 nt, Human
uuaaggauaagcagacua

SEQ ID NO: 109210 - RNA, 22 nt, Human
uuaaggauguugugauuuauua

SEQ ID NO: 109211 - RNA, 22 nt, Human
uuaagguagcucacuaaauaug

SEQ ID NO: 109212 - RNA, 22 nt, Human
uuaaguacuucccuguuggaca

SEQ ID NO: 109213 - RNA, 22 nt, Human
uuaaguagauucaguguuaagg

SEQ ID NO: 109214 - RNA, 22 nt, Human
uuaagucaauaucaaucucagc

SEQ ID NO: 109215 - RNA, 22 nt, Human
uuaaguccuugguaauuuucuu

SEQ ID NO: 109216 - RNA, 22 nt, Human
uuaauacagucuccagaaguaa

SEQ ID NO: 109217 - RNA, 22 nt, Human
uuaauagauaugccucuagagu

SEQ ID NO: 109218 - RNA, 22 nt, Human
uuaauaugcugcuucuugaaaa

SEQ ID NO: 109219 - RNA, 22 nt, Human
uuaaucaagaguggggacugug

SEQ ID NO: 109220 - RNA, 22 nt, Human
uuaauccaauaacaagguucaa

SEQ ID NO: 109221 - RNA, 22 nt, Human
uuaaucugaaucaguaaacacu

SEQ ID NO: 109222 - RNA, 22 nt, Human
uuaaucuuauauguaaagguaa

SEQ ID NO: 109223 - RNA, 22 nt, Human
uuaaugaaugugugcuaacguu

SEQ ID NO: 109224 - RNA, 22 nt, Human
uuaaugacuuauauuuaaagca

SEQ ID NO: 109225 - RNA, 21 nt, Human
uuaaugcuaugcagaaaaucu

SEQ ID NO: 109226 - RNA, 22 nt, Human
uuaauguaugggguugagauga

SEQ ID NO: 109227 - RNA, 22 nt, Human
uuaaugucaacauuucugaaga

SEQ ID NO: 109228 - RNA, 22 nt, Human
uuaauguggaaagcucuugagu

SEQ ID NO: 109229 - RNA, 22 nt, Human
uuaauguguguacaggauuuug

SEQ ID NO: 109230 - RNA, 22 nt, Human
uuaauuacuaagcacaaugcaa

SEQ ID NO: 109231 - RNA, 22 nt, Human
uuaauuaguagaggcauuuagu

SEQ ID NO: 109232 - RNA, 22 nt, Human
uuaauuaugcaaaaggccccau

SEQ ID NO: 109233 - RNA, 22 nt, Human
uuaauucuaguuuaacacuuag

SEQ ID NO: 109234 - RNA, 22 nt, Human
uuaauucugccuuucauguaac

SEQ ID NO: 109235 - RNA, 22 nt, Human
uuaauugauauaaagaacuuca

SEQ ID NO: 109236 - RNA, 22 nt, Human
uuaauugguaaccucuggacua

SEQ ID NO: 109237 - RNA, 22 nt, Human
uuaauuugaccauaaauaucuu

SEQ ID NO: 109238 - RNA, 22 nt, Human
uuaauuuugaugagguucaguu

SEQ ID NO: 109239 - RNA, 22 nt, Human
uuacaaacaacagacauuuauu

SEQ ID NO: 109240 - RNA, 22 nt, Human
uuacaaacuccagugagugagc

SEQ ID NO: 109241 - RNA, 22 nt, Human
uuacaaagagaaguuguagaau

SEQ ID NO: 109242 - RNA, 22 nt, Human
uuacaaagaguguucuuuucca

SEQ ID NO: 109243 - RNA, 21 nt, Human
uuacaaagcaagugcuguguc

SEQ ID NO: 109244 - RNA, 22 nt, Human
uuacaaagcaggucagcugaaa

SEQ ID NO: 109245 - RNA, 22 nt, Human
uuacaaagcgcuuuaccucuga

SEQ ID NO: 109246 - RNA, 22 nt, Human
uuacaaagguaguuuugucuau

SEQ ID NO: 109247 - RNA, 22 nt, Human
uuacaaaguguuaugauaaaca

SEQ ID NO: 109248 - RNA, 22 nt, Human
uuacaaaguucugaguucaaac

SEQ ID NO: 109249 - RNA, 22 nt, Human
uuacaacacuacuuauccuuga

SEQ ID NO: 109250 - RNA, 22 nt, Human
uuacaacauaugauaggagucu

SEQ ID NO: 109251 - RNA, 22 nt, Human
uuacaacucugaacuacagagg

SEQ ID NO: 109252 - RNA, 22 nt, Human
uuacaacucugucaguauagcu

SEQ ID NO: 109253 - RNA, 22 nt, Human
uuacaacuugcagaggauguug

SEQ ID NO: 109254 - RNA, 22 nt, Human
uuacaagacacugcugacacag

SEQ ID NO: 109255 - RNA, 22 nt, Human
uuacaagauaaccugaugcugu

SEQ ID NO: 109256 - RNA, 22 nt, Human
uuacaagauaacggagaaagca

SEQ ID NO: 109257 - RNA, 22 nt, Human
uuacaagauugauuugcuuggc

SEQ ID NO: 109258 - RNA, 19 nt, Human
uuacaagcauugaaagaaa

SEQ ID NO: 109259 - RNA, 23 nt, Human
uuacaaggaagugcacagauggg

SEQ ID NO: 109260 - RNA, 22 nt, Human
uuacaagggucaguguguuugu

SEQ ID NO: 109261 - RNA, 22 nt, Human
uuacaaguauuuaagaugcugu

SEQ ID NO: 109262 - RNA, 22 nt, Human
uuacaagugucagguacuggca

SEQ ID NO: 109263 - RNA, 22 nt, Human
uuacaauaguuccuucuuuugu

SEQ ID NO: 109264 - RNA, 22 nt, Human
uuacaaugagaaaugguuggca

SEQ ID NO: 109265 - RNA, 22 nt, Human
ucuauuuucuugccaaaacugc

SEQ ID NO: 109266 - RNA, 22 nt, Human
ucuauuuuguuuccagcucuac

SEQ ID NO: 109267 - RNA, 22 nt, Human
ucuauuuuuauaguugaagugc

SEQ ID NO: 109268 - RNA, 22 nt, Human
ucucaaauauuuggagagagga

SEQ ID NO: 109269 - RNA, 22 nt, Human
ucucaaauggacaauauugugg

SEQ ID NO: 109270 - RNA, 22 nt, Human
ucucaaauuuguuagauaaaau

SEQ ID NO: 109271 - RNA, 23 nt, Human
ucucaagaggaagcagggcucau

SEQ ID NO: 109272 - RNA, 22 nt, Human
ucucaagaucucaagauggccc

SEQ ID NO: 109273 - RNA, 22 nt, Human
ucucaagcuacuaccuuggauc

SEQ ID NO: 109274 - RNA, 22 nt, Human
ucucaaguuauguaacagcugu

SEQ ID NO: 109275 - RNA, 22 nt, Human
ucucaauauuauaugucauaaa

SEQ ID NO: 109276 - RNA, 22 nt, Human
ucucaaucaaacaugucugacu

SEQ ID NO: 109277 - RNA, 22 nt, Human
ucucaaugacuccuauuuacau

SEQ ID NO: 109278 - RNA, 22 nt, Human
ucucacaccgucccuaaaccau

SEQ ID NO: 109279 - RNA, 22 nt, Human
ucucacacuauuuauucugcuu

SEQ ID NO: 109280 - RNA, 22 nt, Human
ucucacacuauuucaggugacu

SEQ ID NO: 109281 - RNA, 22 nt, Human
ucucacagcaggggccaggucu

SEQ ID NO: 109282 - RNA, 22 nt, Human
ucucacagcauuauccagggca

SEQ ID NO: 109283 - RNA, 22 nt, Human
ucucacagcucugcugcaugcu

SEQ ID NO: 109284 - RNA, 20 nt, Human
ucucacaggggcuuuucucu

SEQ ID NO: 109285 - RNA, 22 nt, Human
ucugggucaugacucagcguga

SEQ ID NO: 109286 - RNA, 22 nt, Human
ucugggucuggcugcuggugca

SEQ ID NO: 109287 - RNA, 22 nt, Human
ucugggugcuacaaacaguauu

SEQ ID NO: 109288 - RNA, 22 nt, Human
ucuggguggcugccaaucugcc

SEQ ID NO: 109289 - RNA, 22 nt, Human
ucuggguggcuucagaggccac

SEQ ID NO: 109290 - RNA, 22 nt, Human
ucugggugggcccgagaaaucu

SEQ ID NO: 109291 - RNA, 22 nt, Human
ucuggguuggguuccuggaauu

SEQ ID NO: 109292 - RNA, 22 nt, Human
ucuggguuugaaguagagccca

SEQ ID NO: 109293 - RNA, 23 nt, Human
ucugguacuauugcuguugagca

SEQ ID NO: 109294 - RNA, 22 nt, Human
ucuggucaagacauccuaacau

SEQ ID NO: 109295 - RNA, 20 nt, Human
ucuggugccccuuccugaga

SEQ ID NO: 109296 - RNA, 22 nt, Human
ucugguggcacgugucuugcau

SEQ ID NO: 109297 - RNA, 19 nt, Human
ucugguucauuucugcugu

SEQ ID NO: 109298 - RNA, 22 nt, Human
ucuguaaucuuccccagcucag

SEQ ID NO: 109299 - RNA, 22 nt, Human
ucuguacaacaaagggaugaga

SEQ ID NO: 109300 - RNA, 22 nt, Human
ucuguacaguaccagauaguaa

SEQ ID NO: 109301 - RNA, 22 nt, Human
ucuguagcaucuuaaauguagu

SEQ ID NO: 109302 - RNA, 22 nt, Human
ucuguagcauucaccagcccug

SEQ ID NO: 109303 - RNA, 22 nt, Human
ucuguaggacagagaaaugggg

SEQ ID NO: 109304 - RNA, 20 nt, Human
ucuguaggcaaguuagcagg

SEQ ID NO: 109305 - RNA, 22 nt, Human
uucaggaaaugucugccuacca

SEQ ID NO: 109306 - RNA, 22 nt, Human
uucaggaagguccuauagcaga

SEQ ID NO: 109307 - RNA, 22 nt, Human
uucaggagaauuccaagaagua

SEQ ID NO: 109308 - RNA, 22 nt, Human
uucaggagcuggcugcgaagga

SEQ ID NO: 109309 - RNA, 22 nt, Human
uucaggauaguggugaguggca

SEQ ID NO: 109310 - RNA, 22 nt, Human
uucaggaucauuuguuuuaucu

SEQ ID NO: 109311 - RNA, 22 nt, Human
uucaggaugcagagguuguagu

SEQ ID NO: 109312 - RNA, 22 nt, Human
uucaggauggaguaccuuuuau

SEQ ID NO: 109313 - RNA, 22 nt, Human
uucaggcccaacgcacagcuuc

SEQ ID NO: 109314 - RNA, 22 nt, Human
uucaggcccagcacagcgcgug

SEQ ID NO: 109315 - RNA, 22 nt, Human
uucagggagagcgggacgggug

SEQ ID NO: 109316 - RNA, 22 nt, Human
uucagggcagagaguucaggga

SEQ ID NO: 109317 - RNA, 22 nt, Human
uucagggcguuguggcugacug

SEQ ID NO: 109318 - RNA, 21 nt, Human
uucaggguuucacaauacuaa

SEQ ID NO: 109319 - RNA, 21 nt, Human
uucaggugagaucauguugac

SEQ ID NO: 109320 - RNA, 22 nt, Human
uucagguguggccagaggagaa

SEQ ID NO: 109321 - RNA, 22 nt, Human
uucagguuuuuaaguucugccu

SEQ ID NO: 109322 - RNA, 22 nt, Human
uucaguauacuucauaacauuu

SEQ ID NO: 109323 - RNA, 22 nt, Human
uucaguauauuacucuugucaa

SEQ ID NO: 109324 - RNA, 22 nt, Human
uucaguaugacagacgcauugg

SEQ ID NO: 109325 - RNA, 22 nt, Human
uucaguauguagaacaaguguu

SEQ ID NO: 109326 - RNA, 22 nt, Human
uucagucuuguugaaaacuugg

SEQ ID NO: 109327 - RNA, 22 nt, Human
uucagugacuuaccuggagcca

SEQ ID NO: 109328 - RNA, 22 nt, Human
uucagugccuguccacagcuuc

SEQ ID NO: 109329 - RNA, 22 nt, Human
uucagugcuuacagguuucuuu

SEQ ID NO: 109330 - RNA, 22 nt, Human
uucagugguuugaugauguaua

SEQ ID NO: 109331 - RNA, 22 nt, Human
uucagugucccuaguagaaguu

SEQ ID NO: 109332 - RNA, 22 nt, Human
uucaguguuaaucuugggagaa

SEQ ID NO: 109333 - RNA, 22 nt, Human
uucaguucacauguaucauggc

SEQ ID NO: 109334 - RNA, 22 nt, Human
uucaguuccauuucaggugggu

SEQ ID NO: 109335 - RNA, 22 nt, Human
uucaguuucagucuugcaaaaa

SEQ ID NO: 109336 - RNA, 18 nt, Human
uucaguuucuaguuccuu

SEQ ID NO: 109337 - RNA, 21 nt, Human
uucaguuucuuccucaucuau

SEQ ID NO: 109338 - RNA, 22 nt, Human
uucaguuuguuugacuguuaga

SEQ ID NO: 109339 - RNA, 22 nt, Human
uucaguuuucuuuagaauguag

SEQ ID NO: 109340 - RNA, 22 nt, Human
uucaguuuugcuuuuaaucaug

SEQ ID NO: 109341 - RNA, 22 nt, Human
uucauaaacaaauuaaggccug

SEQ ID NO: 109342 - RNA, 22 nt, Human
uucauaaguuugucacugaugu

SEQ ID NO: 109343 - RNA, 22 nt, Human
uucauacuaaaguguaagaugu

SEQ ID NO: 109344 - RNA, 22 nt, Human
uucauacuguuuaaguucuguu

SEQ ID NO: 109345 - RNA, 22 nt, Human
uucauagaagcagaaaguaaac

SEQ ID NO: 109346 - RNA, 22 nt, Human
uucauagacccaugugaggaag

SEQ ID NO: 109347 - RNA, 23 nt, Human
uucauagagagauggugagaauu

SEQ ID NO: 109348 - RNA, 22 nt, Human
uucauauauaugcacuacguac

SEQ ID NO: 109349 - RNA, 23 nt, Human
uucauauguugcugaaaacagca

SEQ ID NO: 109350 - RNA, 22 nt, Human
uucaucaauguguuuaauaaug

SEQ ID NO: 109351 - RNA, 22 nt, Human
uucaucaccuugguagcacucc

SEQ ID NO: 109352 - RNA, 18 nt, Human
uucaucaugacucugugg

SEQ ID NO: 109353 - RNA, 22 nt, Human
uucaucugcuucuuccuauucc

SEQ ID NO: 109354 - RNA, 22 nt, Human
uucaucuggucuaguuuuuagu

SEQ ID NO: 109355 - RNA, 22 nt, Human
uucaugaaagacagcaacugug

SEQ ID NO: 109356 - RNA, 22 nt, Human
uucaugagguaccugugaucau

SEQ ID NO: 109357 - RNA, 20 nt, Human
uucaugcuggaggggcuggc

SEQ ID NO: 109358 - RNA, 20 nt, Human
uucaugguguauuucuuucu

SEQ ID NO: 109359 - RNA, 22 nt, Human
uucauguaauaggauguguuaa

SEQ ID NO: 109360 - RNA, 22 nt, Human
uucauguaggcugcaaugcaca

SEQ ID NO: 109361 - RNA, 22 nt, Human
uucaugucugccuuuucaagug

SEQ ID NO: 109362 - RNA, 22 nt, Human
uucauguggaaaagggcuuuca

SEQ ID NO: 109363 - RNA, 22 nt, Human
uucauguguauggaacauuuuu

SEQ ID NO: 109364 - RNA, 22 nt, Human
uucaugugucuguagcacauau

SEQ ID NO: 109365 - RNA, 22 nt, Human
uucauguuggauucacugugag

SEQ ID NO: 109366 - RNA, 22 nt, Human
uucauguuucauuuguuacuau

SEQ ID NO: 109367 - RNA, 22 nt, Human
uucauguuuugagccauucuga

SEQ ID NO: 109368 - RNA, 22 nt, Human
uucauuacuuaggcaggcauuu

SEQ ID NO: 109369 - RNA, 22 nt, Human
uucauuagagauuauaaaauga

SEQ ID NO: 109370 - RNA, 22 nt, Human
uucauucagcacauauuuauug

SEQ ID NO: 109371 - RNA, 22 nt, Human
uucauucaucacaugcagcugg

SEQ ID NO: 109372 - RNA, 22 nt, Human
uucauucauucaugaauguuaa

SEQ ID NO: 109373 - RNA, 22 nt, Human
uucauucccaagaguaaacaua

SEQ ID NO: 109374 - RNA, 22 nt, Human
uucauuccuucccuaagcaacu

SEQ ID NO: 109375 - RNA, 22 nt, Human
uucauucugggcucuaaggaac

SEQ ID NO: 109376 - RNA, 22 nt, Human
uucauugaaauguuucuagcug

SEQ ID NO: 109377 - RNA, 22 nt, Human
uucauugaguuacugccugggc

SEQ ID NO: 109378 - RNA, 23 nt, Human
uucauugauugcaaggagauugg

SEQ ID NO: 109379 - RNA, 22 nt, Human
uucauugauuuaacaaacaagu

SEQ ID NO: 109380 - RNA, 22 nt, Human
uucauugcaguucuucagguua

SEQ ID NO: 109381 - RNA, 22 nt, Human
uucauuuagcaugcuaaaccug

SEQ ID NO: 109382 - RNA, 22 nt, Human
uucauuugaguuuauaguugcu

SEQ ID NO: 109383 - RNA, 22 nt, Human
uucauuugccaucaguguaaug

SEQ ID NO: 109384 - RNA, 22 nt, Human
uuccaaaacaauauucugugaa

SEQ ID NO: 109385 - RNA, 22 nt, Human
uuccaaaccucaaauaauuaau

SEQ ID NO: 109386 - RNA, 22 nt, Human
uuccaaagcacuugauguaaag

SEQ ID NO: 109387 - RNA, 22 nt, Human
uuccaaagcugcuuuauuuagu

SEQ ID NO: 109388 - RNA, 22 nt, Human
uuccaaaguuauucaagcagua

SEQ ID NO: 109389 - RNA, 22 nt, Human
uuccaaaugcccaucuacacag

SEQ ID NO: 109390 - RNA, 22 nt, Human
uuccaaauguuggacaacugua

SEQ ID NO: 109391 - RNA, 22 nt, Human
uuccaacuucccaucccugcug

SEQ ID NO: 109392 - RNA, 22 nt, Human
uuccaacuuuaaaauucauucu

SEQ ID NO: 109393 - RNA, 22 nt, Human
uuccaacuuugaaaauguuaug

SEQ ID NO: 109394 - RNA, 22 nt, Human
uuccucaucuagcacagaaauu

SEQ ID NO: 109395 - RNA, 18 nt, Human
uuccuccacagagcgcug

SEQ ID NO: 109396 - RNA, 21 nt, Human
uuccuccucuggagaagaaga

SEQ ID NO: 109397 - RNA, 17 nt, Human
uuccucucacauuuuuu

SEQ ID NO: 109398 - RNA, 22 nt, Human
uuccucugaaauggcuuggaaa

SEQ ID NO: 109399 - RNA, 22 nt, Human
uuccucuggaggcucuaggaga

SEQ ID NO: 109400 - RNA, 22 nt, Human
uuccucuguaugcuuugcugcu

SEQ ID NO: 109401 - RNA, 22 nt, Human
uuccucuuauuuucccagugau

SEQ ID NO: 109402 - RNA, 21 nt, Human
uuccucuugcuuccgccuugc

SEQ ID NO: 109403 - RNA, 22 nt, Human
uuccugaauauaaagacacuag

SEQ ID NO: 109404 - RNA, 22 nt, Human
uuccugaaucccaaggagagcu

SEQ ID NO: 109405 - RNA, 22 nt, Human
uuccugagcuuuuaaccuaguc

SEQ ID NO: 109406 - RNA, 22 nt, Human
uuccugagucgccgagucuaug

SEQ ID NO: 109407 - RNA, 22 nt, Human
uuccugcaagaucuuuaaggag

SEQ ID NO: 109408 - RNA, 22 nt, Human
uuccugccuacaugccuuaugc

SEQ ID NO: 109409 - RNA, 22 nt, Human
uuccugcuuccuggccucacaa

SEQ ID NO: 109410 - RNA, 22 nt, Human
uuccuggaaauuaugcucaccu

SEQ ID NO: 109411 - RNA, 17 nt, Human
uuccuggaagucauucc

SEQ ID NO: 109412 - RNA, 22 nt, Human
uuccuggcacauaguuagugcu

SEQ ID NO: 109413 - RNA, 22 nt, Human
uuccuggcauagagagggcaca

SEQ ID NO: 109414 - RNA, 22 nt, Human
uuccuggccccaccccuggaga

SEQ ID NO: 109415 - RNA, 21 nt, Human
uuccuggcggcagaaacguga

SEQ ID NO: 109416 - RNA, 19 nt, Human
uuccuggcucuucuguuuu

SEQ ID NO: 109417 - RNA, 22 nt, Human
uuccuggcugaacugaacuccu

SEQ ID NO: 109418 - RNA, 22 nt, Human
uuccuggcugaucuaccaaagu

SEQ ID NO: 109419 - RNA, 22 nt, Human
uuccugggccuuaaaucuuuug

SEQ ID NO: 109420 - RNA, 22 nt, Human
uuccugggcugcagagagcacc

SEQ ID NO: 109421 - RNA, 22 nt, Human
uuccuggggcgacuguaucuga

SEQ ID NO: 109422 - RNA, 21 nt, Human
ugaaagaggauguggucauuc

SEQ ID NO: 109423 - RNA, 22 nt, Human
ugaaagaugcucaaugaauggu

SEQ ID NO: 109424 - RNA, 22 nt, Human
ugaaagcaaccuguaacaguga

SEQ ID NO: 109425 - RNA, 22 nt, Human
ugaaagcacaaguucuaacagg

SEQ ID NO: 109426 - RNA, 22 nt, Human
ugaaagcacucacuucugcucu

SEQ ID NO: 109427 - RNA, 22 nt, Human
ugaaagcucugucaucauuccu

SEQ ID NO: 109428 - RNA, 22 nt, Human
ugaaagcugaggacaggagggu

SEQ ID NO: 109429 - RNA, 22 nt, Human
ugaaagcugggcacaagauucu

SEQ ID NO: 109430 - RNA, 22 nt, Human
ugaaagcuguacaugugguaca

SEQ ID NO: 109431 - RNA, 22 nt, Human
ugaaagcuguccacuaggcugu

SEQ ID NO: 109432 - RNA, 20 nt, Human
ugaaaggugggaauuguggg

SEQ ID NO: 109433 - RNA, 22 nt, Human
ugaaagguguccaauauuucuc

SEQ ID NO: 109434 - RNA, 22 nt, Human
ugaaaguauuugauuucuauua

SEQ ID NO: 109435 - RNA, 22 nt, Human
ugaaagugucauagaaacccau

SEQ ID NO: 109436 - RNA, 22 nt, Human
ugaaauaggaaacagauguuuc

SEQ ID NO: 109437 - RNA, 22 nt, Human
ugaaauagucuaaaaaaccaga

SEQ ID NO: 109438 - RNA, 22 nt, Human
ugaaauauccagcccagcagga

SEQ ID NO: 109439 - RNA, 22 nt, Human
ugaaaucaauaauuggugauug

SEQ ID NO: 109440 - RNA, 22 nt, Human
ugaaaucaauugcaauguuuau

SEQ ID NO: 109441 - RNA, 22 nt, Human
ugaaaucaguaugucuuucuca

SEQ ID NO: 109442 - RNA, 22 nt, Human
ugaaaucaugagauagugucac

SEQ ID NO: 109443 - RNA, 22 nt, Human
ugaaaucugcaugcaaaguccu

SEQ ID NO: 109444 - RNA, 22 nt, Human
ugaaaucuuauacuuugguagu

SEQ ID NO: 109445 - RNA, 22 nt, Human
ugaaaucuuuaguuucuguccc

SEQ ID NO: 109446 - RNA, 22 nt, Human
ugaaaugaaacagaacauauca

SEQ ID NO: 109447 - RNA, 22 nt, Human
ugaaaugagauaauuuaagugc

SEQ ID NO: 109448 - RNA, 22 nt, Human
ugaaaugcuugggaccagaagu

SEQ ID NO: 109449 - RNA, 22 nt, Human
ugaaaugcuuuuacaggauauu

SEQ ID NO: 109450 - RNA, 22 nt, Human
ugaaauggaugagagcagaggu

SEQ ID NO: 109451 - RNA, 22 nt, Human
ugaaauggcaaggcagagcuuu

SEQ ID NO: 109452 - RNA, 22 nt, Human
ugaaauguagugaagcauggaa

SEQ ID NO: 109453 - RNA, 22 nt, Human
ugaaaugucugaaagccaaucu

SEQ ID NO: 109454 - RNA, 22 nt, Human
ugaaauguuaaacaaguggcuc

SEQ ID NO: 109455 - RNA, 22 nt, Human
ugaaauguuaaucacacaaagg

SEQ ID NO: 109456 - RNA, 22 nt, Human
ugaaauguuugaagaccacuga

SEQ ID NO: 109457 - RNA, 22 nt, Human
ugaaauguuuggguccagaagu

SEQ ID NO: 109458 - RNA, 22 nt, Human
ugaaauuauucuuaccaaggug

SEQ ID NO: 109459 - RNA, 23 nt, Human
ugaacaaaggcaggagaaggcgg

SEQ ID NO: 109460 - RNA, 22 nt, Human
ugaacaaaugaaucaguguagc

SEQ ID NO: 109461 - RNA, 22 nt, Human
ugaacaaauggaaauaaccagu

SEQ ID NO: 109462 - RNA, 22 nt, Human
ugaacacacacaucuuaauaau

SEQ ID NO: 109463 - RNA, 22 nt, Human
ugaacacacaccuauguacaaa

SEQ ID NO: 109464 - RNA, 22 nt, Human
ugaacacagcauauuuuguuac

SEQ ID NO: 109465 - RNA, 22 nt, Human
ugaacacagggaauggggguuu

SEQ ID NO: 109466 - RNA, 22 nt, Human
ugaacacagggccaaacuugag

SEQ ID NO: 109467 - RNA, 18 nt, Human
ugaacacaguacaauucc

SEQ ID NO: 109468 - RNA, 22 nt, Human
ugaacacauaaggcuuuccugu

SEQ ID NO: 109469 - RNA, 22 nt, Human
ugaacacauauuaggugcucau

SEQ ID NO: 109470 - RNA, 22 nt, Human
ugaacacauuugggaaaaucuu

SEQ ID NO: 109471 - RNA, 22 nt, Human
ugaacacugccauauuuaagaa

SEQ ID NO: 109472 - RNA, 22 nt, Human
ugaacagacugaccucugaccu

SEQ ID NO: 109473 - RNA, 22 nt, Human
ugaacagaugccuucucccaug

SEQ ID NO: 109474 - RNA, 22 nt, Human
ugaacagauggcccagcagagg

SEQ ID NO: 109475 - RNA, 22 nt, Human
ugaacauacaauuauuaagaac

SEQ ID NO: 109476 - RNA, 22 nt, Human
ugaacauuaguugaguaaaguc

SEQ ID NO: 109477 - RNA, 22 nt, Human
ugaaccagagucuccagugguu

SEQ ID NO: 109478 - RNA, 22 nt, Human
ugaaccaggaggcagccagcac

SEQ ID NO: 109479 - RNA, 22 nt, Human
ugaacccuuguagaggauggag

SEQ ID NO: 109480 - RNA, 22 nt, Human
ugaaccuuguuccugcccuccu

SEQ ID NO: 109481 - RNA, 22 nt, Human
ugaacgcagguccacauggcuc

SEQ ID NO: 109482 - RNA, 22 nt, Human
ugaacucuccaggcaaaugauc

SEQ ID NO: 109483 - RNA, 22 nt, Human
ugaacucucucaagugacagaa

SEQ ID NO: 109484 - RNA, 18 nt, Human
ugaacuggcaucagaauc

SEQ ID NO: 109485 - RNA, 22 nt, Human
ugaacuucagugauuugcugca

SEQ ID NO: 109486 - RNA, 22 nt, Human
ugaacuugaauuuuggaaauac

SEQ ID NO: 109487 - RNA, 17 nt, Human
ugaacuuuagguggagc

SEQ ID NO: 109488 - RNA, 22 nt, Human
ugaacuuuguaguaauggagau

SEQ ID NO: 109489 - RNA, 22 nt, Human
ugaacuuuuauuugaugacagg

SEQ ID NO: 109490 - RNA, 22 nt, Human
ugaacuuuugcacagaggauuu

SEQ ID NO: 109491 - RNA, 22 nt, Human
ugaagaaaauaugauuacccca

SEQ ID NO: 109492 - RNA, 22 nt, Human
ugaagaaacagaccaagaggau

SEQ ID NO: 109493 - RNA, 22 nt, Human
ugaagaacgugagauccagaaa

SEQ ID NO: 109494 - RNA, 22 nt, Human
ugaagaaucagauuggccugcg

SEQ ID NO: 109495 - RNA, 15 nt, Human
ugaagacauaaggug

SEQ ID NO: 109496 - RNA, 22 nt, Human
ugaagaggccgugugcagguga

SEQ ID NO: 109497 - RNA, 22 nt, Human
ugaagauccuaucugcaaauau

SEQ ID NO: 109498 - RNA, 22 nt, Human
ugaagauuuagaccucuuugcc

SEQ ID NO: 109499 - RNA, 22 nt, Human
ugaagcaacuggacaaguuggc

SEQ ID NO: 109500 - RNA, 19 nt, Human
ugaagcaauaccauuuuug

SEQ ID NO: 109501 - RNA, 22 nt, Human
ugaagcaaugauagcagaauga

SEQ ID NO: 109502 - RNA, 22 nt, Human
ugaagcacaggcauacacaacc

SEQ ID NO: 109503 - RNA, 22 nt, Human
ugagaagauugggcagagugga

SEQ ID NO: 109504 - RNA, 22 nt, Human
ugagaagcaguuucaguaagaa

SEQ ID NO: 109505 - RNA, 23 nt, Human
ugagaagccaggggagcgugagg

SEQ ID NO: 109506 - RNA, 23 nt, Human
ugagaagccgccgggcagccugg

SEQ ID NO: 109507 - RNA, 20 nt, Human
ugagaaggggucagcuguac

SEQ ID NO: 109508 - RNA, 22 nt, Human
ugagaaggguuggagaaauaau

SEQ ID NO: 109509 - RNA, 22 nt, Human
ugagaaguacuacaagagaggg

SEQ ID NO: 109510 - RNA, 22 nt, Human
ugagaauaggcauagaaccugg

SEQ ID NO: 109511 - RNA, 22 nt, Human
ugagaauauuguuuuagugagg

SEQ ID NO: 109512 - RNA, 22 nt, Human
ugagaaugugcaauauccuucc

SEQ ID NO: 109513 - RNA, 22 nt, Human
ugagaauuugugaacuuuucuc

SEQ ID NO: 109514 - RNA, 22 nt, Human
ugagacaauauccuuuguaacc

SEQ ID NO: 109515 - RNA, 19 nt, Human
ugagacagaagaugagccu

SEQ ID NO: 109516 - RNA, 19 nt, Human
ugagacagagaccaguucu

SEQ ID NO: 109517 - RNA, 22 nt, Human
ugagacagcagauuagcaauga

SEQ ID NO: 109518 - RNA, 22 nt, Human
ugagacagcagucagggaaaua

SEQ ID NO: 109519 - RNA, 17 nt, Human
ugagacagggcaggccc

SEQ ID NO: 109520 - RNA, 22 nt, Human
ugagacagggucuugcucuguu

SEQ ID NO: 109521 - RNA, 22 nt, Human
ugagacaguucugcagcugggu

SEQ ID NO: 109522 - RNA, 22 nt, Human
ugagacaguuggugaaaucuaa

SEQ ID NO: 109523 - RNA, 22 nt, Human
ugagacaguuuuucuauuucca

SEQ ID NO: 109524 - RNA, 22 nt, Human
ugagaccauuugacauacagug

SEQ ID NO: 109525 - RNA, 20 nt, Human
ugagacccgcugacaaguuc

SEQ ID NO: 109526 - RNA, 23 nt, Human
ugagacccuaauuuagcaagugu

SEQ ID NO: 109527 - RNA, 22 nt, Human
ugagacuugugaguccuucuag

SEQ ID NO: 109528 - RNA, 22 nt, Human
ugagagaaacguuccuuacauc

SEQ ID NO: 109529 - RNA, 18 nt, Human
ugagagaauguucaugcu

SEQ ID NO: 109530 - RNA, 22 nt, Human
ugagagagccugaaucucuuac

SEQ ID NO: 109531 - RNA, 22 nt, Human
ugagagagcgccugggaucauu

SEQ ID NO: 109532 - RNA, 22 nt, Human
ugagagaggaugcccucauauu

SEQ ID NO: 109533 - RNA, 21 nt, Human
ugagagaguagcaggacauau

SEQ ID NO: 109534 - RNA, 22 nt, Human
ugagagccagaagggccugagg

SEQ ID NO: 109535 - RNA, 20 nt, Human
ugagagcugggcagggauac

SEQ ID NO: 109536 - RNA, 22 nt, Human
ugagaggagugauuguaaaauu

SEQ ID NO: 109537 - RNA, 22 nt, Human
ugagaggcgcucacucucaggu

SEQ ID NO: 109538 - RNA, 22 nt, Human
ugagaggcuagaucagcucugu

SEQ ID NO: 109539 - RNA, 18 nt, Human
ugagaggcuauuuuuugc

SEQ ID NO: 109540 - RNA, 22 nt, Human
ugagaggucaaagggcauggag

SEQ ID NO: 109541 - RNA, 22 nt, Human
ugagagucucagaccuccuggu

SEQ ID NO: 109542 - RNA, 22 nt, Human
ugagagugaaaugucacauguc

SEQ ID NO: 109543 - RNA, 22 nt, Human
ugagagugccuuguaaaccugc

SEQ ID NO: 109544 - RNA, 22 nt, Human
ugagaguucucucuucaggugg

SEQ ID NO: 109545 - RNA, 22 nt, Human
ugagauaauaaacaucuccuua

SEQ ID NO: 109546 - RNA, 22 nt, Human
ugagauaaucaugugauuucau

SEQ ID NO: 109547 - RNA, 22 nt, Human
ugagauaguauauggaaagagu

SEQ ID NO: 109548 - RNA, 22 nt, Human
ugagaugaauaacuccugcuaa

SEQ ID NO: 109549 - RNA, 22 nt, Human
ugagaugaugggauaagagggc

SEQ ID NO: 109550 - RNA, 22 nt, Human
ugagaugcugcuguaacaaaua

SEQ ID NO: 109551 - RNA, 22 nt, Human
ugagauggagucuugcucuguu

SEQ ID NO: 109552 - RNA, 22 nt, Human
ugagauggcaacaccagcuuug

SEQ ID NO: 109553 - RNA, 22 nt, Human
ugagauggggucaugcuuuguc

SEQ ID NO: 109554 - RNA, 22 nt, Human
ugagauggguguccagggagga

SEQ ID NO: 109555 - RNA, 22 nt, Human
ugagauggugaagaagacagca

SEQ ID NO: 109556 - RNA, 22 nt, Human
ugagauguaagguaugcuuacu

SEQ ID NO: 109557 - RNA, 22 nt, Human
ugagaugucauaguucaguuca

SEQ ID NO: 109558 - RNA, 22 nt, Human
ugagauucagggaugcagagca

SEQ ID NO: 109559 - RNA, 22 nt, Human
ugagauucccugaaugauauau

SEQ ID NO: 109560 - RNA, 22 nt, Human
ugagauugugugcuucagaaau

SEQ ID NO: 109561 - RNA, 22 nt, Human
ugagauuucaggccaaggagug

SEQ ID NO: 109562 - RNA, 22 nt, Human
ugagauuuguuuuauaaaauag

SEQ ID NO: 109563 - RNA, 22 nt, Human
ugagauuuuccuaaauauaaug

SEQ ID NO: 109564 - RNA, 21 nt, Human
ugagcaaaauuuagagugaug

SEQ ID NO: 109565 - RNA, 22 nt, Human
ugagcaacugugcucugcuaaa

SEQ ID NO: 109566 - RNA, 22 nt, Human
ugagcaagacccggccucugcc

SEQ ID NO: 109567 - RNA, 22 nt, Human
ugagcaagagaaacugacugua

SEQ ID NO: 109568 - RNA, 22 nt, Human
ugagcacacuccuggugagcga

SEQ ID NO: 109569 - RNA, 22 nt, Human
ugagcacauuucacaugacagg

SEQ ID NO: 109570 - RNA, 21 nt, Human
ugagcaccagcugcaugcccc

SEQ ID NO: 109571 - RNA, 22 nt, Human
ugagcaccuaccuuguccagug

SEQ ID NO: 109572 - RNA, 22 nt, Human
ugagcagaacacgggauccaug

SEQ ID NO: 109573 - RNA, 22 nt, Human
ugagcagaauguucagauaaau

SEQ ID NO: 109574 - RNA, 22 nt, Human
uugcauccgaaacaauuucucu

SEQ ID NO: 109575 - RNA, 22 nt, Human
uugcaucuaccauaucaaagau

SEQ ID NO: 109576 - RNA, 22 nt, Human
uugcauguguaagguuguuuau

SEQ ID NO: 109577 - RNA, 22 nt, Human
uugcauuacauuugcucagucu

SEQ ID NO: 109578 - RNA, 22 nt, Human
uugcauugaaaauauauuuuaa

SEQ ID NO: 109579 - RNA, 22 nt, Human
uugcauugaugucuauacgcug

SEQ ID NO: 109580 - RNA, 22 nt, Human
uugcauugcuuggucuucaaga

SEQ ID NO: 109581 - RNA, 22 nt, Human
uugcauugggagugaggagacc

SEQ ID NO: 109582 - RNA, 22 nt, Human
uugcauuguaggauguuagaag

SEQ ID NO: 109583 - RNA, 19 nt, Human
uugcauuucauguuugauu

SEQ ID NO: 109584 - RNA, 22 nt, Human
uugcauuugaucuuggguucuc

SEQ ID NO: 109585 - RNA, 22 nt, Human
uugcauuuuuagaugcuucugu

SEQ ID NO: 109586 - RNA, 22 nt, Human
uugccacacaaguaaagaaaca

SEQ ID NO: 109587 - RNA, 22 nt, Human
uugccacaguagcaaaagguuc

SEQ ID NO: 109588 - RNA, 22 nt, Human
uugccacuaacuagcugugaga

SEQ ID NO: 109589 - RNA, 22 nt, Human
uugccaggagacaaagugggcc

SEQ ID NO: 109590 - RNA, 22 nt, Human
uugccaggagacaucuggagcc

SEQ ID NO: 109591 - RNA, 22 nt, Human
uugccauuaucauuuaugauac

SEQ ID NO: 109592 - RNA, 22 nt, Human
uugccauugcucagugaacaga

SEQ ID NO: 109593 - RNA, 22 nt, Human
uugccauuuauacugcaaguca

SEQ ID NO: 109594 - RNA, 22 nt, Human
uugcccaccauccaauaaaaug

SEQ ID NO: 109595 - RNA, 22 nt, Human
uugcccacucaugcuuuugaua

SEQ ID NO: 109596 - RNA, 22 nt, Human
uugcccacuggcuguuggucag

SEQ ID NO: 109597 - RNA, 22 nt, Human
uugccccuggucagaggaggcu

SEQ ID NO: 109598 - RNA, 22 nt, Human
uugcccuagggucuuauccucc

SEQ ID NO: 109599 - RNA, 16 nt, Human
uugcccugaggggagg

SEQ ID NO: 109600 - RNA, 22 nt, Human
uugcccugccucccugagguga

SEQ ID NO: 109601 - RNA, 22 nt, Human
uugcccuggggcuggccuggca

SEQ ID NO: 109602 - RNA, 22 nt, Human
uugcccugucuuaagcuggcaa

SEQ ID NO: 109603 - RNA, 22 nt, Human
uugccuauguaacuuuauauuu

SEQ ID NO: 109604 - RNA, 22 nt, Human
uugcuaaaaggugaaaagugua

SEQ ID NO: 109605 - RNA, 22 nt, Human
uugcuaacgcucacccuuugcc

SEQ ID NO: 109606 - RNA, 22 nt, Human
uugcuacuguucuuugcuagag

SEQ ID NO: 109607 - RNA, 22 nt, Human
uugcucauacucauguugugau

SEQ ID NO: 109608 - RNA, 22 nt, Human
uugcucuaucacagugauggga

SEQ ID NO: 109609 - RNA, 22 nt, Human
uugcucuccagaggcucacagc

SEQ ID NO: 109610 - RNA, 22 nt, Human
uugcucugaacccagggcacca

SEQ ID NO: 109611 - RNA, 22 nt, Human
uugcugaaaguggcaagaagua

SEQ ID NO: 109612 - RNA, 22 nt, Human
uuggcagugacugcgggccccg

SEQ ID NO: 109613 - RNA, 22 nt, Human
uuggcagugucacuagggagcc

SEQ ID NO: 109614 - RNA, 20 nt, Human
uuggcaguuaagaaucuuac

SEQ ID NO: 109615 - RNA, 22 nt, Human
uuggcauucaugggacaacaaa

SEQ ID NO: 109616 - RNA, 22 nt, Human
uuggcauugaaguuucauuggu

SEQ ID NO: 109617 - RNA, 20 nt, Human
uuggcauuuagacaagaguu

SEQ ID NO: 109618 - RNA, 22 nt, Human
uuggcauuuauucuaaggucaa

SEQ ID NO: 109619 - RNA, 22 nt, Human
uuggcauuuuuccucagcugga

SEQ ID NO: 109620 - RNA, 22 nt, Human
uuggccaaaggaaagacuacug

SEQ ID NO: 109621 - RNA, 22 nt, Human
uuggccaaauaaucuugcagau

SEQ ID NO: 109622 - RNA, 20 nt, Human
uuggccaaaucuuagucaug

SEQ ID NO: 109623 - RNA, 22 nt, Human
uuggccaacagcgacagggcca

SEQ ID NO: 109624 - RNA, 22 nt, Human
uuggccaagacucauguccuau

SEQ ID NO: 109625 - RNA, 22 nt, Human
uuggccaagauacgagcacaua

SEQ ID NO: 109626 - RNA, 22 nt, Human
uuggccaaggaccuuuuuggag

SEQ ID NO: 109627 - RNA, 22 nt, Human
uuggccaagugguuaaucucca

SEQ ID NO: 109628 - RNA, 22 nt, Human
uuggccaauuuagaacguguug

SEQ ID NO: 109629 - RNA, 22 nt, Human
uuggccacacucacuagagccc

SEQ ID NO: 109630 - RNA, 22 nt, Human
uuggccagaaucuuccuaguga

SEQ ID NO: 109631 - RNA, 22 nt, Human
uuggccagacugaggugcuggg

SEQ ID NO: 109632 - RNA, 22 nt, Human
uuggcccugaggaggcagcugc

SEQ ID NO: 109633 - RNA, 22 nt, Human
uuggcccugagguuaucaucua

SEQ ID NO: 109634 - RNA, 21 nt, Human
uuggccgugcagaugaacagc

SEQ ID NO: 109635 - RNA, 22 nt, Human
uuggccuccacauuuuccaggu

SEQ ID NO: 109636 - RNA, 21 nt, Human
uuggccugauaucuuggagca

SEQ ID NO: 109637 - RNA, 22 nt, Human
uuggccuucucauuugcuuauu

SEQ ID NO: 109638 - RNA, 22 nt, Human
uuggccuucugguguucauuuu

SEQ ID NO: 109639 - RNA, 22 nt, Human
uuggccuugucuggucuucucc

SEQ ID NO: 109640 - RNA, 22 nt, Human
uuggccuuuauucuguacuucu

SEQ ID NO: 109641 - RNA, 22 nt, Human
uuggccuuugucaucaagauca

SEQ ID NO: 109642 - RNA, 22 nt, Human
uuggcuaacacgcguuuuguuc

SEQ ID NO: 109643 - RNA, 22 nt, Human
uuggcuacaucgaggcuccagc

SEQ ID NO: 109644 - RNA, 22 nt, Human
uuggcucaccuggagccuguug

SEQ ID NO: 109645 - RNA, 22 nt, Human
uuggcucaccugucuacccaga

SEQ ID NO: 109646 - RNA, 20 nt, Human
uuggcucaugcaacaccuac

SEQ ID NO: 109647 - RNA, 22 nt, Human
uuggcucauuaaagaugauaau

SEQ ID NO: 109648 - RNA, 22 nt, Human
uuggcucugauggggaucagga

SEQ ID NO: 109649 - RNA, 22 nt, Human
uuggcugaagacuagauguuua

SEQ ID NO: 109650 - RNA, 22 nt, Human
uuggcugcaaucacagggacuc

SEQ ID NO: 109651 - RNA, 22 nt, Human
uuggcugccgagcgcaucccgg

SEQ ID NO: 109652 - RNA, 22 nt, Human
uuggcugccuguggaucgcauu

SEQ ID NO: 109653 - RNA, 22 nt, Human
uuggcugcucuguguuuaguau

SEQ ID NO: 109654 - RNA, 22 nt, Human
uuggcugcugaaauauguucug

SEQ ID NO: 109655 - RNA, 22 nt, Human
uuggcugcugggaacucaaaca

SEQ ID NO: 109656 - RNA, 22 nt, Human
uuggcuguuuuaucuccuggug

SEQ ID NO: 109657 - RNA, 22 nt, Human
uuggcuucaaugucagagacag

SEQ ID NO: 109658 - RNA, 22 nt, Human
uuggcuucauugaucucacuuu

SEQ ID NO: 109659 - RNA, 22 nt, Human
uuggcuuccugcacuugaguuu

SEQ ID NO: 109660 - RNA, 22 nt, Human
uuggcuucugauguauuccuga

SEQ ID NO: 109661 - RNA, 22 nt, Human
uuggcuuguuaaaaaugcaauu

SEQ ID NO: 109662 - RNA, 22 nt, Human
uuggcuuuagaccugagacugu

SEQ ID NO: 109663 - RNA, 22 nt, Human
uugggaaagaaugagaagguga

SEQ ID NO: 109664 - RNA, 22 nt, Human
uugggaaauuacucugcuagga

SEQ ID NO: 109665 - RNA, 22 nt, Human
uugggaaggcguggaagcagaa

SEQ ID NO: 109666 - RNA, 22 nt, Human
uugggaaguaauaugguggucu

SEQ ID NO: 109667 - RNA, 22 nt, Human
uugggacagcaacgguucuguu

SEQ ID NO: 109668 - RNA, 22 nt, Human
uugggagcauuuagaaaagacg

SEQ ID NO: 109669 - RNA, 22 nt, Human
uugggagcuggaagcaaggccu

SEQ ID NO: 109670 - RNA, 22 nt, Human
uugggagcuuggccgagaugua

SEQ ID NO: 109671 - RNA, 22 nt, Human
uugggaguaauaaaaaauucca

SEQ ID NO: 109672 - RNA, 22 nt, Human
uugggaucucaaauccagcuau

SEQ ID NO: 109673 - RNA, 22 nt, Human
uugggauuacagguguaagcca

SEQ ID NO: 109674 - RNA, 22 nt, Human
uugggcacggacagguggggau

SEQ ID NO: 109675 - RNA, 22 nt, Human
uugggcaggaacagaugcuuga

SEQ ID NO: 109676 - RNA, 22 nt, Human
uugggcagggaaaggacaggca

SEQ ID NO: 109677 - RNA, 22 nt, Human
uugggcagguguggcucuccuu

SEQ ID NO: 109678 - RNA, 22 nt, Human
uugggcagucuggcugcagagu

SEQ ID NO: 109679 - RNA, 22 nt, Human
uugggccaagugauucucugcc

SEQ ID NO: 109680 - RNA, 22 nt, Human
uugggccucacucuagaaggca

SEQ ID NO: 109681 - RNA, 22 nt, Human
uugggccugggguagugucgga

SEQ ID NO: 109682 - RNA, 20 nt, Human
uugggccugucagcacuccc

SEQ ID NO: 109683 - RNA, 22 nt, Human
uugggcugaucuguggaagaag

SEQ ID NO: 109684 - RNA, 22 nt, Human
uugggcuggcagagguggucuu

SEQ ID NO: 109685 - RNA, 22 nt, Human
uugggcuggcccuugucucugg

SEQ ID NO: 109686 - RNA, 22 nt, Human
uugggcuuuaauuccagagagg

SEQ ID NO: 109687 - RNA, 22 nt, Human
uuggggaguuaaugccaaagau

SEQ ID NO: 109688 - RNA, 20 nt, Human
uuggggcauccaccgaaugg

SEQ ID NO: 109689 - RNA, 22 nt, Human
ugcacacacaugaaguagcaug

SEQ ID NO: 109690 - RNA, 20 nt, Human
ugcacacacccuguccucca

SEQ ID NO: 109691 - RNA, 22 nt, Human
ugcacacacucugcauauacuu

SEQ ID NO: 109692 - RNA, 22 nt, Human
ugcacacagcugggccuggcug

SEQ ID NO: 109693 - RNA, 22 nt, Human
ugcacacaggucuaggacaugg

SEQ ID NO: 109694 - RNA, 22 nt, Human
ugcacacauacaugggaagugc

SEQ ID NO: 109695 - RNA, 22 nt, Human
ugcacacauucuauggggcuga

SEQ ID NO: 109696 - RNA, 22 nt, Human
ugcacaccucuccaccacucuc

SEQ ID NO: 109697 - RNA, 22 nt, Human
ugcacagaauaauauauguucu

SEQ ID NO: 109698 - RNA, 22 nt, Human
ugcacagaaucauuuucagcug

SEQ ID NO: 109699 - RNA, 22 nt, Human
ugcacagagagaugagacacgu

SEQ ID NO: 109700 - RNA, 21 nt, Human
ugcacagccauacccuccuug

SEQ ID NO: 109701 - RNA, 20 nt, Human
ugcacagggugggaagcaac

SEQ ID NO: 109702 - RNA, 22 nt, Human
ugcacagguaugcaaagcaugu

SEQ ID NO: 109703 - RNA, 22 nt, Human
ugcacaguguaaugaaucagaa

SEQ ID NO: 109704 - RNA, 22 nt, Human
ugcacaguuggcuacaucgugg

SEQ ID NO: 109705 - RNA, 22 nt, Human
ugcacauggcaaugcugcuccc

SEQ ID NO: 109706 - RNA, 22 nt, Human
ugcaccagagcagggugcccaa

SEQ ID NO: 109707 - RNA, 22 nt, Human
ugcaccauguaaguggccacgu

SEQ ID NO: 109708 - RNA, 22 nt, Human
ugcaccccauuuuacauuuaca

SEQ ID NO: 109709 - RNA, 22 nt, Human
ugcacccugccugccugcgggu

SEQ ID NO: 109710 - RNA, 21 nt, Human
ugcaccugugccccauccuuc

SEQ ID NO: 109711 - RNA, 22 nt, Human
ugcaccuuuaaauucagcagua

SEQ ID NO: 109712 - RNA, 22 nt, Human
ugcacgaaaucuuucuagucuu

SEQ ID NO: 109713 - RNA, 22 nt, Human
ugcacuagccacauuucaaaug

SEQ ID NO: 109714 - RNA, 22 nt, Human
ugcacuccaggcugggugacag

SEQ ID NO: 109715 - RNA, 22 nt, Human
ugcacugauccugaccagugaa

SEQ ID NO: 109716 - RNA, 19 nt, Human
ugcacuugagauguuugua

SEQ ID NO: 109717 - RNA, 22 nt, Human
ugcacuuguguuuucagaaucu

SEQ ID NO: 109718 - RNA, 22 nt, Human
ugcacuuuaaaaaauggugaug

SEQ ID NO: 109719 - RNA, 22 nt, Human
ugcagaaacagaguuuugccau

SEQ ID NO: 109720 - RNA, 22 nt, Human
ugcagaaacagucauuaaugua

SEQ ID NO: 109721 - RNA, 22 nt, Human
uggcuccuaucaaggagugggu

SEQ ID NO: 109722 - RNA, 22 nt, Human
uggcuccucaucacaguuggug

SEQ ID NO: 109723 - RNA, 22 nt, Human
uggcuccucuucuggguguccc

SEQ ID NO: 109724 - RNA, 22 nt, Human
uggcuccugcagaccaucugga

SEQ ID NO: 109725 - RNA, 20 nt, Human
uggcuccugcgguggaacca

SEQ ID NO: 109726 - RNA, 20 nt, Human
uggcucucacccugugcgau

SEQ ID NO: 109727 - RNA, 23 nt, Human
uggcucucucagugcugcagagg

SEQ ID NO: 109728 - RNA, 22 nt, Human
uggcucucuuguaagguaguag

SEQ ID NO: 109729 - RNA, 21 nt, Human
uggcucugaaagagugcugca

SEQ ID NO: 109730 - RNA, 22 nt, Human
ugcuggaggggaugccuucacu

SEQ ID NO: 109731 - RNA, 19 nt, Human
ugcuggagugacauucuga

SEQ ID NO: 109732 - RNA, 22 nt, Human
ugcuggagugagauuaugaguu

SEQ ID NO: 109733 - RNA, 22 nt, Human
ugcuggaguggcacuguguggc

SEQ ID NO: 109734 - RNA, 22 nt, Human
ugcuggaguucgacauugcaaa

SEQ ID NO: 109735 - RNA, 17 nt, Human
ugcuggcaacauacaaa

SEQ ID NO: 109736 - RNA, 20 nt, Human
ugcuggcacggguggacucc

SEQ ID NO: 109737 - RNA, 22 nt, Human
ugcuggcauaccaccuaguuca

SEQ ID NO: 109738 - RNA, 22 nt, Human
ugcuggcauggucuuggugaca

SEQ ID NO: 109739 - RNA, 22 nt, Human
ugcuggcauuucaggacucacc

SEQ ID NO: 109740 - RNA, 21 nt, Human
ugcuggccaugugcugggcau

SEQ ID NO: 109741 - RNA, 22 nt, Human
ugcuggcccaguacuaaugucu

SEQ ID NO: 109742 - RNA, 22 nt, Human
ugcuggcccaguauggacugca

SEQ ID NO: 109743 - RNA, 22 nt, Human
ugcuggcccuggcucagggaac

SEQ ID NO: 109744 - RNA, 22 nt, Human
ugcuggccgugagcucucggga

SEQ ID NO: 109745 - RNA, 22 nt, Human
ugcuggccucggcgcugggccu

SEQ ID NO: 109746 - RNA, 22 nt, Human
ugcuggccugggcugcaccuug

SEQ ID NO: 109747 - RNA, 22 nt, Human
ugcuggcuccucgaggcuucgu

SEQ ID NO: 109748 - RNA, 23 nt, Human
ugcuggcugaaacagccaaagga

SEQ ID NO: 109749 - RNA, 22 nt, Human
ugcuggcugccagguucccugu

SEQ ID NO: 109750 - RNA, 22 nt, Human
ugcuggcugucccuaccuggcu

SEQ ID NO: 109751 - RNA, 22 nt, Human
ugcuggcuuagauaucacugcc

SEQ ID NO: 109752 - RNA, 22 nt, Human
ugcuggcuuggaaggaaagcgc

SEQ ID NO: 109753 - RNA, 22 nt, Human
ugcuggcuuucugucccuggca

SEQ ID NO: 109754 - RNA, 22 nt, Human
ugcuggcuuugcgagaugcauu

SEQ ID NO: 109755 - RNA, 22 nt, Human
ugcugggcauuuaugcagaugg

SEQ ID NO: 109756 - RNA, 22 nt, Human
ugcugggcauuuuuauggcucc

SEQ ID NO: 109757 - RNA, 22 nt, Human
ugcugggccugccccugucagc

SEQ ID NO: 109758 - RNA, 22 nt, Human
ugcugggcuaggguggagcucu

SEQ ID NO: 109759 - RNA, 22 nt, Human
ugcugggcuggagcugccaggg

SEQ ID NO: 109760 - RNA, 22 nt, Human
ugcugggcuggggccucagacc

SEQ ID NO: 109761 - RNA, 22 nt, Human
ugcugggcuguuccuguccaug

SEQ ID NO: 109762 - RNA, 22 nt, Human
ugcugggcuucaacugccugag

SEQ ID NO: 109763 - RNA, 22 nt, Human
ugcuggggagugauugaccauc

SEQ ID NO: 109764 - RNA, 22 nt, Human
ugcuggggcucugaccacucca

SEQ ID NO: 109765 - RNA, 22 nt, Human
ugcugggggugucucaccaggc

SEQ ID NO: 109766 - RNA, 22 nt, Human
ugcuggggguucagaugaguaa

SEQ ID NO: 109767 - RNA, 23 nt, Human
ugcuggguaaauagcugaguaac

SEQ ID NO: 109768 - RNA, 22 nt, Human
ugcuggguggacuuggcucuca

SEQ ID NO: 109769 - RNA, 20 nt, Human
ugcugggugggcagcuguaa

SEQ ID NO: 109770 - RNA, 22 nt, Human
ugcuggguuaccuaagccuaaa

SEQ ID NO: 109771 - RNA, 21 nt, Human
ugcuggguuugcccaucaggc

SEQ ID NO: 109772 - RNA, 22 nt, Human
ugcuggugauuaaauccugaag

SEQ ID NO: 109773 - RNA, 23 nt, Human
ugcugguguuuuugggaccaggg

SEQ ID NO: 109774 - RNA, 22 nt, Human
ugcugguucuuaggagagagau

SEQ ID NO: 109775 - RNA, 22 nt, Human
ugcuguagcccugcacagugca

SEQ ID NO: 109776 - RNA, 22 nt, Human
ugcuguauuacuuuuacaaacu

SEQ ID NO: 109777 - RNA, 23 nt, Human
ugcuguccaacagacuggccaug

SEQ ID NO: 109778 - RNA, 22 nt, Human
ugcugucccccgugucugggcu

SEQ ID NO: 109779 - RNA, 21 nt, Human
ugcuguccuagaaccagggcc

SEQ ID NO: 109780 - RNA, 19 nt, Human
ugcuguccucagaguaagu

SEQ ID NO: 109781 - RNA, 22 nt, Human
ugcuguccuguuuuggaguaau

SEQ ID NO: 109782 - RNA, 22 nt, Human
ugcugucuuuucccaauccugg

SEQ ID NO: 109783 - RNA, 22 nt, Human
ugcuguggcaguuuauguauag

SEQ ID NO: 109784 - RNA, 22 nt, Human
ugcugugguucccagaguggau

SEQ ID NO: 109785 - RNA, 22 nt, Human
ugcuguguggaugugaagaauc

SEQ ID NO: 109786 - RNA, 22 nt, Human
ugcuguguucuccugacucacc

SEQ ID NO: 109787 - RNA, 22 nt, Human
ugcuuaaaggauaguuuaaacu

SEQ ID NO: 109788 - RNA, 22 nt, Human
ugcuuaaaguguuaacccuguu

SEQ ID NO: 109789 - RNA, 22 nt, Human
ugcuuaauauugugauguaaua

SEQ ID NO: 109790 - RNA, 23 nt, Human
ugcuuaauuccucugcuucaccu

SEQ ID NO: 109791 - RNA, 18 nt, Human
ugcuuacaggaguuccug

SEQ ID NO: 109792 - RNA, 21 nt, Human
ugcuuaccgccccagggcucc

SEQ ID NO: 109793 - RNA, 22 nt, Human
ugcuuaccucuggcuguuuucc

SEQ ID NO: 109794 - RNA, 22 nt, Human
ugcuuauucuuuccacaauuca

SEQ ID NO: 109795 - RNA, 22 nt, Human
ugcuuauuugaauuuauucuca

SEQ ID NO: 109796 - RNA, 22 nt, Human
ugcuucagagaagaauggaaag

SEQ ID NO: 109797 - RNA, 22 nt, Human
ugcuucagagacauccuacuca

SEQ ID NO: 109798 - RNA, 22 nt, Human
ugcuucagcacuuugagagccu

SEQ ID NO: 109799 - RNA, 22 nt, Human
ugcuucagcagggaucgggggg

SEQ ID NO: 109800 - RNA, 22 nt, Human
ugcuucaugagguaguggcagu

SEQ ID NO: 109801 - RNA, 22 nt, Human
ugcuucaugcuucugacaauag

SEQ ID NO: 109802 - RNA, 19 nt, Human
ugcuucauuucuuuuaugu

SEQ ID NO: 109803 - RNA, 22 nt, Human
ugcuuccaggaauccaucuggc

SEQ ID NO: 109804 - RNA, 22 nt, Human
ugcuucccaagguuucaugugc

SEQ ID NO: 109805 - RNA, 22 nt, Human
ugcuuccugaggccgucuucuc

SEQ ID NO: 109806 - RNA, 22 nt, Human
ugcuucuaaucuacugcauuag

SEQ ID NO: 109807 - RNA, 21 nt, Human
ugcuucucuagaucaacuacu

SEQ ID NO: 109808 - RNA, 23 nt, Human
ugcuucucugcuugacaguucug

SEQ ID NO: 109809 - RNA, 22 nt, Human
ugcuucucuuuauuuguagguu

SEQ ID NO: 109810 - RNA, 22 nt, Human
ugcuucugaaguggaugggugc

SEQ ID NO: 109811 - RNA, 22 nt, Human
ugcuucugaguugcaggacuug

SEQ ID NO: 109812 - RNA, 22 nt, Human
ugcuucugauucaugguuauug

SEQ ID NO: 109813 - RNA, 22 nt, Human
ugcuucugcaggagcuccugau

SEQ ID NO: 109814 - RNA, 22 nt, Human
ugcuucugcucagcuuccuacu

SEQ ID NO: 109815 - RNA, 22 nt, Human
ugcuucugcuuuacuugguuca

SEQ ID NO: 109816 - RNA, 22 nt, Human
ugcuucuggcacuugagggggu

SEQ ID NO: 109817 - RNA, 22 nt, Human
ugcuucugggccugguguuccc

SEQ ID NO: 109818 - RNA, 22 nt, Human
ugcuucugggucccagccuggc

SEQ ID NO: 109819 - RNA, 22 nt, Human
ugcuucuguauuuugggcuuga

SEQ ID NO: 109820 - RNA, 22 nt, Human
ugcuucuguucuuucaccuacg

SEQ ID NO: 109821 - RNA, 22 nt, Human
ugcuucuguuucauugaucuua

SEQ ID NO: 109822 - RNA, 22 nt, Human
ugcuucuuuaaaugauagucaa

SEQ ID NO: 109823 - RNA, 22 nt, Human
ugcuugaaagggguuucccagu

SEQ ID NO: 109824 - RNA, 22 nt, Human
ugcuugaacaaggauaaauuug

SEQ ID NO: 109825 - RNA, 22 nt, Human
ugcuugaggggaauaaaaagaa

SEQ ID NO: 109826 - RNA, 22 nt, Human
ugcuugauuagggaagucacau

SEQ ID NO: 109827 - RNA, 22 nt, Human
ugcuugcaagagaugcaaugac

SEQ ID NO: 109828 - RNA, 22 nt, Human
ugcuugcauccaacauuaaggg

SEQ ID NO: 109829 - RNA, 22 nt, Human
ugcuugcugggccaauggcaau

SEQ ID NO: 109830 - RNA, 19 nt, Human
ugcuccauugaggugucuc

SEQ ID NO: 109831 - RNA, 22 nt, Human
ugcucccaggacucuugagcca

SEQ ID NO: 109832 - RNA, 22 nt, Human
ugcucccaggcucuguggucug

SEQ ID NO: 109833 - RNA, 23 nt, Human
ugcucccaggugacgcugcuguu

SEQ ID NO: 109834 - RNA, 22 nt, Human
ugcucccauguguggguacaga

SEQ ID NO: 109835 - RNA, 22 nt, Human
ugcucccugcucagagaggcca

SEQ ID NO: 109836 - RNA, 22 nt, Human
ugcucccuugccagaggggaag

SEQ ID NO: 109837 - RNA, 20 nt, Human
ugcuccuaccacuucugccc

SEQ ID NO: 109838 - RNA, 22 nt, Human
ugcuccugagcgguuuccauga

SEQ ID NO: 109839 - RNA, 22 nt, Human
ugcuccugagguuggagaucca

SEQ ID NO: 109840 - RNA, 22 nt, Human
ugcuccuggacuggugugagau

SEQ ID NO: 109841 - RNA, 22 nt, Human
ugcuccuggaugagguacucca

SEQ ID NO: 109842 - RNA, 22 nt, Human
ugcuccuggcuucagguugggc

SEQ ID NO: 109843 - RNA, 17 nt, Human
ugcuccuguggcagccu

SEQ ID NO: 109844 - RNA, 22 nt, Human
ugcucuagagcuauuggcuucc

SEQ ID NO: 109845 - RNA, 22 nt, Human
ugcucuaguggguagagcauug

SEQ ID NO: 109846 - RNA, 22 nt, Human
ugcucucucaggccuggcccac

SEQ ID NO: 109847 - RNA, 22 nt, Human
uuucugugauaggcugcgacgc

SEQ ID NO: 109848 - RNA, 22 nt, Human
uuucuguuaggcaucauuuuaa

SEQ ID NO: 109849 - RNA, 23 nt, Human
uuucuguuccucuagcuuugcau

SEQ ID NO: 109850 - RNA, 23 nt, Human
uuucuguuggguauauauccaag

SEQ ID NO: 109851 - RNA, 22 nt, Human
uuucuguuguacuuaaacuagg

SEQ ID NO: 109852 - RNA, 19 nt, Human
uuucuguuugcuucugguu

SEQ ID NO: 109853 - RNA, 22 nt, Human
uuucuuauacuauauugucauc

SEQ ID NO: 109854 - RNA, 22 nt, Human
uuucuuaugagcaagacucuau

SEQ ID NO: 109855 - RNA, 22 nt, Human
uuucuuaugugcagagugagua

SEQ ID NO: 109856 - RNA, 21 nt, Human
uuucuucacuuugccccaugu

SEQ ID NO: 109857 - RNA, 23 nt, Human
uuucuucagaagccuugcgaggc

SEQ ID NO: 109858 - RNA, 22 nt, Human
uuucuucaguaacacaaaccau

SEQ ID NO: 109859 - RNA, 22 nt, Human
uuucuucauagaccuugucuug

SEQ ID NO: 109860 - RNA, 22 nt, Human
uuucuucuaggacuaauaagag

SEQ ID NO: 109861 - RNA, 23 nt, Human
uuucuucucgaagagggagcuua

SEQ ID NO: 109862 - RNA, 22 nt, Human
uuucuucucuaaucucaaugau

SEQ ID NO: 109863 - RNA, 22 nt, Human
uuucuucuuaauacuggcugcu

SEQ ID NO: 109864 - RNA, 22 nt, Human
uuucuugaaguccuaacccuca

SEQ ID NO: 109865 - RNA, 22 nt, Human
uuucuugaccacuauguugaua

SEQ ID NO: 109866 - RNA, 22 nt, Human
uuucuugauuagcuguggcuca

SEQ ID NO: 109867 - RNA, 22 nt, Human
uuucuuggaugugaaacuaggg

SEQ ID NO: 109868 - RNA, 20 nt, Human
uuucuugucggcuguugcug

SEQ ID NO: 109869 - RNA, 22 nt, Human
uuucuuuaggcuguguugccaa

SEQ ID NO: 109870 - RNA, 22 nt, Human
uuucuuuaucauagcaucuuug

SEQ ID NO: 109871 - RNA, 18 nt, Human
uuucuuucugccuggggc

SEQ ID NO: 109872 - RNA, 22 nt, Human
uuucuuuuacaguguggcuauu

SEQ ID NO: 109873 - RNA, 22 nt, Human
uuugaaaauuuaagugcuacac

SEQ ID NO: 109874 - RNA, 22 nt, Human
uuugaaaccuaguuauaugacu

SEQ ID NO: 109875 - RNA, 22 nt, Human
uuugaaacucaugaucaucacu

SEQ ID NO: 109876 - RNA, 22 nt, Human
uuugaaagcaccauuugaguag

SEQ ID NO: 109877 - RNA, 21 nt, Human
uuugaaagcuacaucuauagc

SEQ ID NO: 109878 - RNA, 17 nt, Human
uuugaaaggaugucagu

SEQ ID NO: 109879 - RNA, 19 nt, Human
uuugaaaggauuguuauuu

SEQ ID NO: 109880 - RNA, 22 nt, Human
uuugaaagggaaauaaacuccu

SEQ ID NO: 109881 - RNA, 22 nt, Human
uuugaaagggacaaagucacug

SEQ ID NO: 109882 - RNA, 22 nt, Human
uuugaaauaugaggcauuauga

SEQ ID NO: 109883 - RNA, 22 nt, Human
uuugaaaucuaaucaaggaaca

SEQ ID NO: 109884 - RNA, 22 nt, Human
uuugaaauuaagauauugucca

SEQ ID NO: 109885 - RNA, 22 nt, Human
uuugaaauuggcucauugguuu

SEQ ID NO: 109886 - RNA, 22 nt, Human
uuugaacaggaguaucuauagu

SEQ ID NO: 109887 - RNA, 22 nt, Human
uuugaacaugcugcaugauaau

SEQ ID NO: 109888 - RNA, 23 nt, Human
uuugaacauuucuagauuacaua

SEQ ID NO: 109889 - RNA, 22 nt, Human
uuugaacugauaaucuucuguu

SEQ ID NO: 109890 - RNA, 22 nt, Human
uuugaagacagaucaauauaag

SEQ ID NO: 109891 - RNA, 22 nt, Human
uuugaagacauauuguuacaua

SEQ ID NO: 109892 - RNA, 22 nt, Human
uuugaagacuacugggagugaa

SEQ ID NO: 109893 - RNA, 22 nt, Human
uuugaagagccacagugaaauu

SEQ ID NO: 109894 - RNA, 22 nt, Human
uuugaaguaccugguucugacu

SEQ ID NO: 109895 - RNA, 22 nt, Human
uuugaagucaggcuuucuaccc

SEQ ID NO: 109896 - RNA, 22 nt, Human
uuugaaguggaaaaggauuuaa

SEQ ID NO: 109897 - RNA, 22 nt, Human
uuugaagugggcauuagaaccu

SEQ ID NO: 109898 - RNA, 21 nt, Human
uuugaauagaaauagugcuua

SEQ ID NO: 109899 - RNA, 22 nt, Human
uuugaauagaggccccucagaa

SEQ ID NO: 109900 - RNA, 22 nt, Human
uuugaauagcauaggauuacau

SEQ ID NO: 109901 - RNA, 22 nt, Human
uuugaauagggcuuugcaggga

SEQ ID NO: 109902 - RNA, 22 nt, Human
uuugaauauacuucaaacaaag

SEQ ID NO: 109903 - RNA, 22 nt, Human
uuugaauaucacaaacuuucaa

SEQ ID NO: 109904 - RNA, 22 nt, Human
uuugaaugacaugauucaggca

SEQ ID NO: 109905 - RNA, 22 nt, Human
uuugaaugagaauuauugucau

SEQ ID NO: 109906 - RNA, 22 nt, Human
uuugaaugauuaucuuucggca

SEQ ID NO: 109907 - RNA, 22 nt, Human
uuugaauguuggauugacuuag

SEQ ID NO: 109908 - RNA, 22 nt, Human
uuugacaaaggaaaaaugcaca

SEQ ID NO: 109909 - RNA, 22 nt, Human
uuugacaaauguaucugcauua

SEQ ID NO: 109910 - RNA, 22 nt, Human
uuugacaaccaggcagguaaga

SEQ ID NO: 109911 - RNA, 22 nt, Human
uuugacaagagggcaucuucag

SEQ ID NO: 109912 - RNA, 20 nt, Human
uuugacaccuugggagagac

SEQ ID NO: 109913 - RNA, 22 nt, Human
uuugacagcauaauccuacacc

SEQ ID NO: 109914 - RNA, 23 nt, Human
uuugacagcgugguuucuguggg

SEQ ID NO: 109915 - RNA, 21 nt, Human
uuugacagcucagagggcauu

SEQ ID NO: 109916 - RNA, 22 nt, Human
uuugacagcuuguuacaaaguu

SEQ ID NO: 109917 - RNA, 22 nt, Human
uuugacaggaauucucucuagg

SEQ ID NO: 109918 - RNA, 22 nt, Human
uuugacaggacuaacauauggc

SEQ ID NO: 109919 - RNA, 22 nt, Human
uuugacagugaugauauauaca

SEQ ID NO: 109920 - RNA, 22 nt, Human
uuugacaugcaaagcacuuuag

SEQ ID NO: 109921 - RNA, 22 nt, Human
uuugacauuaaggaacauauau

SEQ ID NO: 109922 - RNA, 22 nt, Human
uuugacauugaaagcagaaucg

SEQ ID NO: 109923 - RNA, 22 nt, Human
uuugacauugccaauuugcuca

SEQ ID NO: 109924 - RNA, 22 nt, Human
uuugacucaagccuuucuuuag

SEQ ID NO: 109925 - RNA, 22 nt, Human
uuugacuccugccuucuccugu

SEQ ID NO: 109926 - RNA, 22 nt, Human
uuugacuccuguguuucuggaa

SEQ ID NO: 109927 - RNA, 22 nt, Human
uuugacuccuuugugaaaagag

SEQ ID NO: 109928 - RNA, 22 nt, Human
uuugacucuuagcccaggacuc

SEQ ID NO: 109929 - RNA, 22 nt, Human
uuugacucuugcccaguuuggc

SEQ ID NO: 109930 - RNA, 22 nt, Human
uuugacucuugcuuugguggcu

SEQ ID NO: 109931 - RNA, 22 nt, Human
uuugacuucuaucuaguaagaa

SEQ ID NO: 109932 - RNA, 22 nt, Human
uuugagaaacugauuauuaugg

SEQ ID NO: 109933 - RNA, 22 nt, Human
uuugagaagauguaauguuaag

SEQ ID NO: 109934 - RNA, 19 nt, Human
uuugagaaguuauuaucua

SEQ ID NO: 109935 - RNA, 22 nt, Human
uuugagcagagaaaggacauga

SEQ ID NO: 109936 - RNA, 22 nt, Human
uuugaggacauuuuagaaaguu

SEQ ID NO: 109937 - RNA, 22 nt, Human
uuugagguuagcuagcagauca

SEQ ID NO: 109938 - RNA, 22 nt, Human
uuugagucugcuuccauuuuca

SEQ ID NO: 109939 - RNA, 20 nt, Human
cagguccagcacgugcacgg

SEQ ID NO: 109940 - RNA, 22 nt, Human
cagguccagucacuggucugca

SEQ ID NO: 109941 - RNA, 22 nt, Human
cagguccugcagggagaguaaa

SEQ ID NO: 109942 - RNA, 22 nt, Human
cagguccuggcagcugacucag

SEQ ID NO: 109943 - RNA, 22 nt, Human
caggucugagucacauguucau

SEQ ID NO: 109944 - RNA, 22 nt, Human
caggucugcagacagggccaug

SEQ ID NO: 109945 - RNA, 22 nt, Human
caggucuggugagagaacaguu

SEQ ID NO: 109946 - RNA, 22 nt, Human
caggugaagaggauaaaaaguu

SEQ ID NO: 109947 - RNA, 22 nt, Human
caggugaccuuuguccuaaguu

SEQ ID NO: 109948 - RNA, 22 nt, Human
caggugaguuuuccuccuuggu

SEQ ID NO: 109949 - RNA, 22 nt, Human
caggugcagggaguucaggaug

SEQ ID NO: 109950 - RNA, 22 nt, Human
caggugccauagacgggccugg

SEQ ID NO: 109951 - RNA, 22 nt, Human
caggugcccaggggacaguggc

SEQ ID NO: 109952 - RNA, 22 nt, Human
caggugccucaggaugagacaa

SEQ ID NO: 109953 - RNA, 22 nt, Human
caggugcucccagagaagugcu

SEQ ID NO: 109954 - RNA, 22 nt, Human
cagguggcagugccugcauucu

SEQ ID NO: 109955 - RNA, 22 nt, Human
cagguggcaugacugccuacaa

SEQ ID NO: 109956 - RNA, 22 nt, Human
cagguggcuuauuagggucagu

SEQ ID NO: 109957 - RNA, 22 nt, Human
caggugggaccaugauagggca

SEQ ID NO: 109958 - RNA, 22 nt, Human
caggugggagcgaggagcuacu

SEQ ID NO: 109959 - RNA, 22 nt, Human
cagguggggagaguguggagca

SEQ ID NO: 109960 - RNA, 22 nt, Human
cagguggggcgcccucaggcag

SEQ ID NO: 109961 - RNA, 22 nt, Human
cagguggucaggcagaugggcu

SEQ ID NO: 109962 - RNA, 22 nt, Human
cagguggugccuccaggcuggu

SEQ ID NO: 109963 - RNA, 22 nt, Human
cagguguauaaacucagugacu

SEQ ID NO: 109964 - RNA, 22 nt, Human
caggugucuaauucucaccccc

SEQ ID NO: 109965 - RNA, 22 nt, Human
cagguguugcaguugaagacug

SEQ ID NO: 109966 - RNA, 22 nt, Human
cagguguugggagaagagauaa

SEQ ID NO: 109967 - RNA, 22 nt, Human
cagguucuauacugaauaauuu

SEQ ID NO: 109968 - RNA, 22 nt, Human
cagguucucagaaggcagucac

SEQ ID NO: 109969 - RNA, 22 nt, Human
cagguucugaggauggugccug

SEQ ID NO: 109970 - RNA, 22 nt, Human
cagguucuggggcuccacugug

SEQ ID NO: 109971 - RNA, 22 nt, Human
cagguucuuaacuuguucuucc

SEQ ID NO: 109972 - RNA, 22 nt, Human
cagguucuugaagccuucuggc

SEQ ID NO: 109973 - RNA, 22 nt, Human
cagguuggagaucugucuaugg

SEQ ID NO: 109974 - RNA, 22 nt, Human
cagguuuacaaaguaaagugug

SEQ ID NO: 109975 - RNA, 22 nt, Human
cagguuuagguggacgugcagg

SEQ ID NO: 109976 - RNA, 22 nt, Human
cagguuuaguuccacacagcuc

SEQ ID NO: 109977 - RNA, 22 nt, Human
caguaaaaauguugucaaggca

SEQ ID NO: 109978 - RNA, 22 nt, Human
caguaaaugagaagcuaguaau

SEQ ID NO: 109979 - RNA, 22 nt, Human
caguaacaugaagagacaugga

SEQ ID NO: 109980 - RNA, 18 nt, Human
caguaacuauguuguuac

SEQ ID NO: 109981 - RNA, 22 nt, Human
caguaagaguugacaauggcca

SEQ ID NO: 109982 - RNA, 22 nt, Human
caguaauagaggcuuugagucu

SEQ ID NO: 109983 - RNA, 22 nt, Human
caguguggcugagacagaggcu

SEQ ID NO: 109984 - RNA, 22 nt, Human
caguguguggauccucccagga

SEQ ID NO: 109985 - RNA, 22 nt, Human
caguguuuagaucaagaaggcc

SEQ ID NO: 109986 - RNA, 22 nt, Human
caguguuuagcacagugcuugg

SEQ ID NO: 109987 - RNA, 22 nt, Human
caguguuugcuuaaguuauaug

SEQ ID NO: 109988 - RNA, 22 nt, Human
caguguuuguggaauucaggug

SEQ ID NO: 109989 - RNA, 22 nt, Human
caguguuuguugagaaaggcaa

SEQ ID NO: 109990 - RNA, 22 nt, Human
caguuaaauucuccaguuacca

SEQ ID NO: 109991 - RNA, 22 nt, Human
caguuacacaccauugugaaca

SEQ ID NO: 109992 - RNA, 19 nt, Human
caguuacagcagcuaagac

SEQ ID NO: 109993 - RNA, 21 nt, Human
caguuacagccaggacaaggc

SEQ ID NO: 109994 - RNA, 19 nt, Human
caguuacaggcacuguggg

SEQ ID NO: 109995 - RNA, 22 nt, Human
caguuaccagaucgcaggaggu

SEQ ID NO: 109996 - RNA, 22 nt, Human
caguuauuaugaggucauuagg

SEQ ID NO: 109997 - RNA, 22 nt, Human
caguuccuaugggcaaaacaca

SEQ ID NO: 109998 - RNA, 22 nt, Human
caguuccuugagaaugguugcu

SEQ ID NO: 109999 - RNA, 22 nt, Human
caguucugacuuucauaauguc

SEQ ID NO: 110000 - RNA, 22 nt, Human
caguucuggaggcuccacaucu

SEQ ID NO: 110001 - RNA, 22 nt, Human
caguucuuaauaccaugugguu

SEQ ID NO: 110002 - RNA, 22 nt, Human
caguucuuuguggggaguucuc

SEQ ID NO: 110003 - RNA, 22 nt, Human
caguugaucacuauaggcuuca

SEQ ID NO: 110004 - RNA, 22 nt, Human
caguugcagcugugacauugcg

SEQ ID NO: 110005 - RNA, 22 nt, Human
caguugcuggaugugcagcucu

SEQ ID NO: 110006 - RNA, 22 nt, Human
caguuguucccagcaaugaaag

SEQ ID NO: 110007 - RNA, 19 nt, Human
caguuuaacuaauuuuauc

SEQ ID NO: 110008 - RNA, 22 nt, Human
caguuuaaggcaggacauggga

SEQ ID NO: 110009 - RNA, 22 nt, Human
caguuuagcaaauuuguaucaa

SEQ ID NO: 110010 - RNA, 22 nt, Human
caguuuaguccugccaccaugg

SEQ ID NO: 110011 - RNA, 22 nt, Human
caguuuauaugucagagcugua

SEQ ID NO: 110012 - RNA, 22 nt, Human
caguuuauauucuagugcuguu

SEQ ID NO: 110013 - RNA, 20 nt, Human
caguuuaucuuuccggagcu

SEQ ID NO: 110014 - RNA, 22 nt, Human
caguuuauuguugcguucacau

SEQ ID NO: 110015 - RNA, 22 nt, Human
caguuucagaaucaaaacauca

SEQ ID NO: 110016 - RNA, 22 nt, Human
caguuucagcucaagcacucag

SEQ ID NO: 110017 - RNA, 22 nt, Human
caguuucuacgaaggucaaccc

SEQ ID NO: 110018 - RNA, 22 nt, Human
caguuucucucaauaagcaucg

SEQ ID NO: 110019 - RNA, 22 nt, Human
caguuucugggaggaaaggaag

SEQ ID NO: 110020 - RNA, 22 nt, Human
caguuucuguggucucuuuuca

SEQ ID NO: 110021 - RNA, 22 nt, Human
caguuucuuagugacacaaauc

SEQ ID NO: 110022 - RNA, 22 nt, Human
caguuucuuuccauuguuaccu

SEQ ID NO: 110023 - RNA, 22 nt, Human
caguuuguauuuauuacucaua

SEQ ID NO: 110024 - RNA, 22 nt, Human
caguuuuaaauuguuagauaau

SEQ ID NO: 110025 - RNA, 22 nt, Human
caguuuuaugaaugcuuauuag

SEQ ID NO: 110026 - RNA, 22 nt, Human
caguuuucuaaagucucuuuaa

SEQ ID NO: 110027 - RNA, 22 nt, Human
caguuuugguccuuucuaggua

SEQ ID NO: 110028 - RNA, 22 nt, Human
cauaaaagguagcaguuugaaa

SEQ ID NO: 110029 - RNA, 22 nt, Human
cauaaaguaaagaugucuucca

SEQ ID NO: 110030 - RNA, 22 nt, Human
cauaaagucaugaucugaguau

SEQ ID NO: 110031 - RNA, 19 nt, Human
cauaaauguacaagauaca

SEQ ID NO: 110032 - RNA, 22 nt, Human
cauaaauuguacccauuccaac

SEQ ID NO: 110033 - RNA, 22 nt, Human
cauaacaccugauggcaaugau

SEQ ID NO: 110034 - RNA, 22 nt, Human
cauaacugggagauccaagggu

SEQ ID NO: 110035 - RNA, 22 nt, Human
cauaacuggggacacuucucua

SEQ ID NO: 110036 - RNA, 22 nt, Human
cauaacuuuaaagacagugugg

SEQ ID NO: 110037 - RNA, 22 nt, Human
cauaaguuggguaauauaauga

SEQ ID NO: 110038 - RNA, 22 nt, Human
cauaaucagauguguacauaag

SEQ ID NO: 110039 - RNA, 22 nt, Human
cauaauguaugcauuuuccagc

SEQ ID NO: 110040 - RNA, 22 nt, Human
cauaauuucuguaucagcacca

SEQ ID NO: 110041 - RNA, 22 nt, Human
cauaauuuuccaugguuugcua

SEQ ID NO: 110042 - RNA, 22 nt, Human
cauacaguguggcauguagucu

SEQ ID NO: 110043 - RNA, 22 nt, Human
cauacauaccacugcugucuuu

SEQ ID NO: 110044 - RNA, 22 nt, Human
cauacauacugaguggacugau

SEQ ID NO: 110045 - RNA, 22 nt, Human
cauacauugaaggagaaaggaa

SEQ ID NO: 110046 - RNA, 22 nt, Human
cauacuauuacuaggagcagga

SEQ ID NO: 110047 - RNA, 22 nt, Human
cauacuuacuguguaccaggug

SEQ ID NO: 110048 - RNA, 22 nt, Human
cugacccuggaggcauuucucu

SEQ ID NO: 110049 - RNA, 22 nt, Human
cugaccuggccuuggugggcca

SEQ ID NO: 110050 - RNA, 23 nt, Human
cugacucaucccaccaccuccuc

SEQ ID NO: 110051 - RNA, 22 nt, Human
cugacuccuaugccccaugggc

SEQ ID NO: 110052 - RNA, 20 nt, Human
cugacucuccuuggcuugga

SEQ ID NO: 110053 - RNA, 22 nt, Human
cugacuuuagaacccaaaaagu

SEQ ID NO: 110054 - RNA, 22 nt, Human
cugagaaaagacauuucuagau

SEQ ID NO: 110055 - RNA, 22 nt, Human
cugagaaaggaccucaaacagg

SEQ ID NO: 110056 - RNA, 22 nt, Human
cugagaaaguuuauguuuauuu

SEQ ID NO: 110057 - RNA, 22 nt, Human
cugagaaauacccaagucuggu

SEQ ID NO: 110058 - RNA, 22 nt, Human
cugagaaauucuuucuuucacu

SEQ ID NO: 110059 - RNA, 22 nt, Human
cugagaagcaaagaacugcacu

SEQ ID NO: 110060 - RNA, 22 nt, Human
cugagaauggacagcagggcag

SEQ ID NO: 110061 - RNA, 22 nt, Human
cugagaauuacucugaugagua

SEQ ID NO: 110062 - RNA, 22 nt, Human
cugagacaugguuugacuggca

SEQ ID NO: 110063 - RNA, 22 nt, Human
cugagacauuaugacaagugga

SEQ ID NO: 110064 - RNA, 21 nt, Human
cugagaccugcauuagagagg

SEQ ID NO: 110065 - RNA, 22 nt, Human
cugagacuuucaugugcuuuua

SEQ ID NO: 110066 - RNA, 22 nt, Human
cugagagacuguuuguaauauu

SEQ ID NO: 110067 - RNA, 22 nt, Human
cugagagaugauauagcuuaau

SEQ ID NO: 110068 - RNA, 22 nt, Human
cugagagcagggacuugagcca

SEQ ID NO: 110069 - RNA, 22 nt, Human
cugagaggcagccagagaaaau

SEQ ID NO: 110070 - RNA, 22 nt, Human
cugagaggcggagcuugcagug

SEQ ID NO: 110071 - RNA, 22 nt, Human
cugagaggggaccaggguguuu

SEQ ID NO: 110072 - RNA, 22 nt, Human
cugagaguauuggcaggcuugg

SEQ ID NO: 110073 - RNA, 22 nt, Human
cugagagucaguggaguggugu

SEQ ID NO: 110074 - RNA, 20 nt, Human
cugagagucugugcuuaguc

SEQ ID NO: 110075 - RNA, 22 nt, Human
cugagaguguggcuuccaggcc

SEQ ID NO: 110076 - RNA, 22 nt, Human
cugagauggaguuucgcucuuc

SEQ ID NO: 110077 - RNA, 22 nt, Human
cugagcaccccaggaccugcgc

SEQ ID NO: 110078 - RNA, 22 nt, Human
cugagcagaagggugcacgugc

SEQ ID NO: 110079 - RNA, 22 nt, Human
cugagcagcacagggcgccagg

SEQ ID NO: 110080 - RNA, 19 nt, Human
cugagcagcggcagcacuu

SEQ ID NO: 110081 - RNA, 22 nt, Human
cugagcaggauauucacagcag

SEQ ID NO: 110082 - RNA, 22 nt, Human
cugagcaguagagggucucuuu

SEQ ID NO: 110083 - RNA, 22 nt, Human
cugagcaguuucuuagggcuca

SEQ ID NO: 110084 - RNA, 22 nt, Human
cugagcauccagcagguacugc

SEQ ID NO: 110085 - RNA, 22 nt, Human
cugagcauuugugcagcuucuc

SEQ ID NO: 110086 - RNA, 22 nt, Human
cugagccaaccacagcaggagc

SEQ ID NO: 110087 - RNA, 20 nt, Human
cugagccaacucucuucuug

SEQ ID NO: 110088 - RNA, 22 nt, Human
cugagccaccggcagggacauc

SEQ ID NO: 110089 - RNA, 22 nt, Human
cugagccagcuggcaugugcua

SEQ ID NO: 110090 - RNA, 22 nt, Human
cugagccauaagggaggcuggg

SEQ ID NO: 110091 - RNA, 22 nt, Human
cugagccauccauaccagcuua

SEQ ID NO: 110092 - RNA, 22 nt, Human
cugagccaugagccugcgccca

SEQ ID NO: 110093 - RNA, 22 nt, Human
cugagccccucugaccucagag

SEQ ID NO: 110094 - RNA, 19 nt, Human
cugagccucaguuuccuag

SEQ ID NO: 110095 - RNA, 22 nt, Human
cugagccuguguuucucuggca

SEQ ID NO: 110096 - RNA, 22 nt, Human
cugagcgaggaguuggagcuuu

SEQ ID NO: 110097 - RNA, 22 nt, Human
cugagcucuaaugucagccuug

SEQ ID NO: 110098 - RNA, 22 nt, Human
cugagcugacaucuuccucuuu

SEQ ID NO: 110099 - RNA, 20 nt, Human
cugagcugagcuccaugggu

SEQ ID NO: 110100 - RNA, 22 nt, Human
cugagcugcaguccuggcucug

SEQ ID NO: 110101 - RNA, 22 nt, Human
cugagcugcggcaggcaccugg

SEQ ID NO: 110102 - RNA, 22 nt, Human
cugagcugcucccgcugcagcg

SEQ ID NO: 110103 - RNA, 22 nt, Human
caucucuguguccccacaccca

SEQ ID NO: 110104 - RNA, 22 nt, Human
caucucuguguccccagagcuu

SEQ ID NO: 110105 - RNA, 22 nt, Human
caucugaauuugccuuaguuuc

SEQ ID NO: 110106 - RNA, 22 nt, Human
caucugcucugucugccauguu

SEQ ID NO: 110107 - RNA, 22 nt, Human
caucuggacaaaacucugaagg

SEQ ID NO: 110108 - RNA, 22 nt, Human
caucuggguucucagauggaua

SEQ ID NO: 110109 - RNA, 19 nt, Human
caucuguaaggacagaaac

SEQ ID NO: 110110 - RNA, 22 nt, Human
caucugucuuuuguuacaaggc

SEQ ID NO: 110111 - RNA, 22 nt, Human
caucugugccggguguuuguca

SEQ ID NO: 110112 - RNA, 22 nt, Human
caucuguguaucugugcuuaga

SEQ ID NO: 110113 - RNA, 22 nt, Human
caucuguuuccuaaucuguagc

SEQ ID NO: 110114 - RNA, 22 nt, Human
caucuuaaauuaaagcuuaagg

SEQ ID NO: 110115 - RNA, 22 nt, Human
caucuuaccccugcuaaugacc

SEQ ID NO: 110116 - RNA, 22 nt, Human
caucuuauaggcagaguucagu

SEQ ID NO: 110117 - RNA, 22 nt, Human
caucuucaccagagacaagcaa

SEQ ID NO: 110118 - RNA, 22 nt, Human
caucuucagguguuuuccauca

SEQ ID NO: 110119 - RNA, 22 nt, Human
caucuucagguucauggucaua

SEQ ID NO: 110120 - RNA, 22 nt, Human
caucuugagacaugaaaggugu

SEQ ID NO: 110121 - RNA, 22 nt, Human
caucuuugaacucuguauaaac

SEQ ID NO: 110122 - RNA, 22 nt, Human
caucuuugagacagcauuaccc

SEQ ID NO: 110123 - RNA, 22 nt, Human
caucuuugcacccucaaaaccu

SEQ ID NO: 110124 - RNA, 20 nt, Human
caucuuuggcaggacuccuu

SEQ ID NO: 110125 - RNA, 22 nt, Human
caugaaacuuccaaagcugacc

SEQ ID NO: 110126 - RNA, 22 nt, Human
caugaaagcaggaaugguuuua

SEQ ID NO: 110127 - RNA, 22 nt, Human
caugaaauucagcaggugagua

SEQ ID NO: 110128 - RNA, 22 nt, Human
caugaaauugcuccuuuggugc

SEQ ID NO: 110129 - RNA, 22 nt, Human
caugaacaauuugcucacugau

SEQ ID NO: 110130 - RNA, 21 nt, Human
caugaacaugcuuauccucag

SEQ ID NO: 110131 - RNA, 22 nt, Human
caugaacauugcagggauguga

SEQ ID NO: 110132 - RNA, 22 nt, Human
caugaagcucuugcaccucuag

SEQ ID NO: 110133 - RNA, 22 nt, Human
caugaaggaccauuucacgguc

SEQ ID NO: 110134 - RNA, 22 nt, Human
caugaagucaggauuuccauga

SEQ ID NO: 110135 - RNA, 22 nt, Human
caugaaugcuggguucauguaa

SEQ ID NO: 110136 - RNA, 23 nt, Human
caugacaaaggaucucaugggcc

SEQ ID NO: 110137 - RNA, 22 nt, Human
caugacaaaucagaggggcuug

SEQ ID NO: 110138 - RNA, 22 nt, Human
caugacacccaggcauagcacc

SEQ ID NO: 110139 - RNA, 22 nt, Human
caugaccagagaggacggccag

SEQ ID NO: 110140 - RNA, 22 nt, Human
caugagaaccaggucuguguuu

SEQ ID NO: 110141 - RNA, 22 nt, Human
caugagaucugcagggaugggc

SEQ ID NO: 110142 - RNA, 22 nt, Human
caugaggucagggggagccggu

SEQ ID NO: 110143 - RNA, 22 nt, Human
caugagugugccagucugauau

SEQ ID NO: 110144 - RNA, 22 nt, Human
caugauaacuucauuacacaau

SEQ ID NO: 110145 - RNA, 23 nt, Human
caugauauuuaucuucccugggu

SEQ ID NO: 110146 - RNA, 22 nt, Human
caugaugguucuuacaaaggug

SEQ ID NO: 110147 - RNA, 22 nt, Human
caugauguuaucuaaaucuggu

SEQ ID NO: 110148 - RNA, 22 nt, Human
caugcaagacaaucuuuaaaau

SEQ ID NO: 110149 - RNA, 22 nt, Human
caugcacaagggaugaugaaau

SEQ ID NO: 110150 - RNA, 22 nt, Human
caugcacacacaguucuaauua

SEQ ID NO: 110151 - RNA, 22 nt, Human
caugcacagugauaucugaaga

SEQ ID NO: 110152 - RNA, 22 nt, Human
caugcacauguggcuauguaau

SEQ ID NO: 110153 - RNA, 22 nt, Human
caugcacauuauucaaagccca

SEQ ID NO: 110154 - RNA, 22 nt, Human
caugcacuuaccugaaauucaa

SEQ ID NO: 110155 - RNA, 22 nt, Human
caugcagaguuuauuaccaucu

SEQ ID NO: 110156 - RNA, 22 nt, Human
caugcaggcccgccugaauggg

SEQ ID NO: 110157 - RNA, 22 nt, Human
ccacagugguucucaaccaggg

SEQ ID NO: 110158 - RNA, 22 nt, Human
ccacaguguucuuuuuaaaauu

SEQ ID NO: 110159 - RNA, 22 nt, Human
ccacauacaaauggggugcugu

SEQ ID NO: 110160 - RNA, 22 nt, Human
ccacaugaaucuuggaagcagg

SEQ ID NO: 110161 - RNA, 20 nt, Human
ccacaugagcucuuucugac

SEQ ID NO: 110162 - RNA, 22 nt, Human
ccacauggauagauagggacau

SEQ ID NO: 110163 - RNA, 22 nt, Human
ccacauuggccucagagguuag

SEQ ID NO: 110164 - RNA, 22 nt, Human
ccaccagaccaccaagagcaac

SEQ ID NO: 110165 - RNA, 22 nt, Human
ccaccagagggcagacugugau

SEQ ID NO: 110166 - RNA, 22 nt, Human
ccaccagcuucagcagccgcgg

SEQ ID NO: 110167 - RNA, 20 nt, Human
ccacccacgcgggcucugcc

SEQ ID NO: 110168 - RNA, 19 nt, Human
ccaccccuuugcugggccc

SEQ ID NO: 110169 - RNA, 22 nt, Human
ccacccuggacucgaggcccga

SEQ ID NO: 110170 - RNA, 22 nt, Human
ccacccuggguucugaugugga

SEQ ID NO: 110171 - RNA, 22 nt, Human
ccacccugugcaggcgugggua

SEQ ID NO: 110172 - RNA, 22 nt, Human
ccaccgcugaaggcacuggcau

SEQ ID NO: 110173 - RNA, 22 nt, Human
ccaccucucaggguuuccuaau

SEQ ID NO: 110174 - RNA, 22 nt, Human
ccaccucugagcccaaacccug

SEQ ID NO: 110175 - RNA, 16 nt, Human
ccaccugcagcucuca

SEQ ID NO: 110176 - RNA, 22 nt, Human
ccaccugcugguuuugcucucc

SEQ ID NO: 110177 - RNA, 22 nt, Human
ccacguccagcuaauuuucgua

SEQ ID NO: 110178 - RNA, 22 nt, Human
ccacucaggccuccugcucucc

SEQ ID NO: 110179 - RNA, 22 nt, Human
ccacucugcugugcuccaugau

SEQ ID NO: 110180 - RNA, 22 nt, Human
ccacucuugaaucaagagcuca

SEQ ID NO: 110181 - RNA, 22 nt, Human
ccacugagaccuuuuggaggag

SEQ ID NO: 110182 - RNA, 22 nt, Human
ccacugaggcaggcaguaucua

SEQ ID NO: 110183 - RNA, 22 nt, Human
ccacugauccugacuuuggagc

SEQ ID NO: 110184 - RNA, 22 nt, Human
ccacugauucugccaggucucu

SEQ ID NO: 110185 - RNA, 22 nt, Human
ccacugccagccgcccggaggc

SEQ ID NO: 110186 - RNA, 22 nt, Human
ccacugccgugggccuugggga

SEQ ID NO: 110187 - RNA, 22 nt, Human
ccacugcuccugaccaagguca

SEQ ID NO: 110188 - RNA, 21 nt, Human
ccacugcucuucccuagggcc

SEQ ID NO: 110189 - RNA, 22 nt, Human
ccacuggagaugucagacaggu

SEQ ID NO: 110190 - RNA, 22 nt, Human
ccacuggcaaccccgccucaua

SEQ ID NO: 110191 - RNA, 22 nt, Human
ccacuguauuuuggaagcagau

SEQ ID NO: 110192 - RNA, 22 nt, Human
ccacuugacaauaaacugagcu

SEQ ID NO: 110193 - RNA, 22 nt, Human
ccacuuuuucagugugcaugca

SEQ ID NO: 110194 - RNA, 22 nt, Human
ccacuuuuuucuccaucucuga

SEQ ID NO: 110195 - RNA, 22 nt, Human
ccagaaagaaugaacugaaccc

SEQ ID NO: 110196 - RNA, 22 nt, Human
ccagaacagaccugccugaccu

SEQ ID NO: 110197 - RNA, 22 nt, Human
ccagaaccaaaagcauggagua

SEQ ID NO: 110198 - RNA, 22 nt, Human
ccagaacugggcaacagaaagu

SEQ ID NO: 110199 - RNA, 22 nt, Human
ccagaagaccggggagucaggg

SEQ ID NO: 110200 - RNA, 22 nt, Human
ccagaagaggacacagugugga

SEQ ID NO: 110201 - RNA, 22 nt, Human
ccagaagauggcucaaaccaug

SEQ ID NO: 110202 - RNA, 22 nt, Human
ccagaagcaaaacagacaguuu

SEQ ID NO: 110203 - RNA, 20 nt, Human
ccagaagguaggauggaaca

SEQ ID NO: 110204 - RNA, 22 nt, Human
ccagaaguggcuuucucaggga

SEQ ID NO: 110205 - RNA, 22 nt, Human
ccagaauuuggaucaugauuuu

SEQ ID NO: 110206 - RNA, 20 nt, Human
ccagacagcaccugccuggu

SEQ ID NO: 110207 - RNA, 22 nt, Human
ccagacagcaguuaaaggacau

SEQ ID NO: 110208 - RNA, 22 nt, Human
ccagacaugugcccuugaggaa

SEQ ID NO: 110209 - RNA, 21 nt, Human
ccagacuugaguguauguugu

SEQ ID NO: 110210 - RNA, 22 nt, Human
ccagagaagucuugccuggauu

SEQ ID NO: 110211 - RNA, 22 nt, Human
ccagagaauccggagaguccau

SEQ ID NO: 110212 - RNA, 22 nt, Human
ccagagagaaaauggagggcca

SEQ ID NO: 110213 - RNA, 22 nt, Human
ccagagagauugcuucuaaaga

SEQ ID NO: 110214 - RNA, 19 nt, Human
ccagagagcuagguacaga

SEQ ID NO: 110215 - RNA, 22 nt, Human
ccagagaggccuuggcaagaca

SEQ ID NO: 110216 - RNA, 22 nt, Human
ccagagaggggaagggcuugcc

SEQ ID NO: 110217 - RNA, 22 nt, Human
ccagagaguaaacauuuuccgg

SEQ ID NO: 110218 - RNA, 22 nt, Human
ccagagaguaggaggcauuauu

SEQ ID NO: 110219 - RNA, 20 nt, Human
ccagagaguagguuagugau

SEQ ID NO: 110220 - RNA, 17 nt, Human
ccagagaguaguuagga

SEQ ID NO: 110221 - RNA, 22 nt, Human
ccagagaguaucauggagagua

SEQ ID NO: 110222 - RNA, 17 nt, Human
ccagagaugccucaggc

SEQ ID NO: 110223 - RNA, 22 nt, Human
ccagagaugugaaaaugccgga

SEQ ID NO: 110224 - RNA, 22 nt, Human
ccagagcaauucucacagaacu

SEQ ID NO: 110225 - RNA, 22 nt, Human
ccagagcagaaccggaacacca

SEQ ID NO: 110226 - RNA, 22 nt, Human
ccagagcagggcagcagggcuc

SEQ ID NO: 110227 - RNA, 22 nt, Human
ccagagccccugagcuucccug

SEQ ID NO: 110228 - RNA, 22 nt, Human
ccagagccuaagaucugauccu

SEQ ID NO: 110229 - RNA, 21 nt, Human
ccagagccugcugagcccccu

SEQ ID NO: 110230 - RNA, 22 nt, Human
ccagagccuggcaucugcauaa

SEQ ID NO: 110231 - RNA, 17 nt, Human
ccagagcuacugagacu

SEQ ID NO: 110232 - RNA, 22 nt, Human
ccagagcugagggagccugagc

SEQ ID NO: 110233 - RNA, 20 nt, Human
ccagagcugauggcugcccg

SEQ ID NO: 110234 - RNA, 22 nt, Human
ccagagcuugacgugcaacgga

SEQ ID NO: 110235 - RNA, 22 nt, Human
ccagaggagcaggcuggcucca

SEQ ID NO: 110236 - RNA, 22 nt, Human
ccagaggcagacuuacacucca

SEQ ID NO: 110237 - RNA, 22 nt, Human
ccagaggcauguucaaagcaau

SEQ ID NO: 110238 - RNA, 20 nt, Human
ccagaggcugacagacuuug

SEQ ID NO: 110239 - RNA, 22 nt, Human
cuggagauacugcucuccauau

SEQ ID NO: 110240 - RNA, 19 nt, Human
cuggagauagggccuuuaa

SEQ ID NO: 110241 - RNA, 22 nt, Human
cuggagcauccaugcccagggu

SEQ ID NO: 110242 - RNA, 22 nt, Human
cuggagcauuuucugcuucugc

SEQ ID NO: 110243 - RNA, 17 nt, Human
cuggagccaagagggcc

SEQ ID NO: 110244 - RNA, 22 nt, Human
cuggagccacuuuuuauccuuu

SEQ ID NO: 110245 - RNA, 22 nt, Human
cuggagccagccagggcccucu

SEQ ID NO: 110246 - RNA, 22 nt, Human
cuggagcccaggccuggugucu

SEQ ID NO: 110247 - RNA, 22 nt, Human
cuggagcccugaaugggcagga

SEQ ID NO: 110248 - RNA, 22 nt, Human
cuggagccggaccagggacggu

SEQ ID NO: 110249 - RNA, 22 nt, Human
cuggagcucagcccagguucca

SEQ ID NO: 110250 - RNA, 22 nt, Human
cuggagcuccagggucuccucu

SEQ ID NO: 110251 - RNA, 22 nt, Human
cuggagcugccagggcugccgc

SEQ ID NO: 110252 - RNA, 22 nt, Human
cuggagcugcuguccuugggug

SEQ ID NO: 110253 - RNA, 22 nt, Human
cuggagcuggcuuccuuccacu

SEQ ID NO: 110254 - RNA, 17 nt, Human
cuggagcuguguaaccu

SEQ ID NO: 110255 - RNA, 22 nt, Human
cuggaggaaaacaacugcagac

SEQ ID NO: 110256 - RNA, 22 nt, Human
cuggaggaaucacagaaggcuu

SEQ ID NO: 110257 - RNA, 22 nt, Human
cuggaggaccacagaagcuggu

SEQ ID NO: 110258 - RNA, 22 nt, Human
cuggaggagagucugaaugaca

SEQ ID NO: 110259 - RNA, 22 nt, Human
cuggaggagcaauaugguuagg

SEQ ID NO: 110260 - RNA, 22 nt, Human
cuggaggcaguugccccaguca

SEQ ID NO: 110261 - RNA, 22 nt, Human
cuggagggacaagguaugcauu

SEQ ID NO: 110262 - RNA, 22 nt, Human
cuggagggagauucaaaggagg

SEQ ID NO: 110263 - RNA, 22 nt, Human
cuggagggaggaggcugcuauu

SEQ ID NO: 110264 - RNA, 22 nt, Human
cuggagggcuggacuaaggaaa

SEQ ID NO: 110265 - RNA, 22 nt, Human
cuggaggggccauccacagucu

SEQ ID NO: 110266 - RNA, 22 nt, Human
cuggagguaagaggcccugggc

SEQ ID NO: 110267 - RNA, 22 nt, Human
ccagaugguccagagucuagcc

SEQ ID NO: 110268 - RNA, 22 nt, Human
ccagauggugccugucagaagg

SEQ ID NO: 110269 - RNA, 22 nt, Human
ccagaugguuugcaugggaggg

SEQ ID NO: 110270 - RNA, 22 nt, Human
ccagauguauguaugagugcau

SEQ ID NO: 110271 - RNA, 22 nt, Human
ccagaugucccucucagguuug

SEQ ID NO: 110272 - RNA, 22 nt, Human
ccagaugucugagccacacucc

SEQ ID NO: 110273 - RNA, 22 nt, Human
ccagaugugagcagagccuuga

SEQ ID NO: 110274 - RNA, 22 nt, Human
ccagcacugcucucagacugag

SEQ ID NO: 110275 - RNA, 22 nt, Human
ccagcagacacacaggcguggg

SEQ ID NO: 110276 - RNA, 19 nt, Human
ccagcagacacagcugccc

SEQ ID NO: 110277 - RNA, 22 nt, Human
ccagcagagcauggggaggaag

SEQ ID NO: 110278 - RNA, 22 nt, Human
ccagcagaggggcggagugcag

SEQ ID NO: 110279 - RNA, 22 nt, Human
ccagcagaguugguuucuggua

SEQ ID NO: 110280 - RNA, 22 nt, Human
ccagcagcugacaccaguccca

SEQ ID NO: 110281 - RNA, 22 nt, Human
ccagcagcugcaaagccugggu

SEQ ID NO: 110282 - RNA, 22 nt, Human
ccagcagcugcuaugugguuuu

SEQ ID NO: 110283 - RNA, 22 nt, Human
ccagcagcuguggcuuugccuc

SEQ ID NO: 110284 - RNA, 19 nt, Human
ccagcagcuuugauucucu

SEQ ID NO: 110285 - RNA, 22 nt, Human
ccagcagggcagugcccuggac

SEQ ID NO: 110286 - RNA, 22 nt, Human
ccagcaggggaauauuuuuagg

SEQ ID NO: 110287 - RNA, 22 nt, Human
ccagcaucagcauugucuuagg

SEQ ID NO: 110288 - RNA, 22 nt, Human
ccagcaucagucagauuuugcu

SEQ ID NO: 110289 - RNA, 22 nt, Human
ccagcauccucagcucacuucu

SEQ ID NO: 110290 - RNA, 22 nt, Human
ccagcaucgacuuccugccuga

SEQ ID NO: 110291 - RNA, 22 nt, Human
ccagcaugcucagucuaaauug

SEQ ID NO: 110292 - RNA, 22 nt, Human
ccagcauucacacugguuccuu

SEQ ID NO: 110293 - RNA, 22 nt, Human
ccagccagaaguccgggcuucu

SEQ ID NO: 110294 - RNA, 22 nt, Human
ccagccagcugcccuuggggcc

SEQ ID NO: 110295 - RNA, 22 nt, Human
ccagccagggaaacuuuuucuu

SEQ ID NO: 110296 - RNA, 22 nt, Human
ccagccaugggccaccuagcug

SEQ ID NO: 110297 - RNA, 22 nt, Human
ccagcccaaacaagccgccuuc

SEQ ID NO: 110298 - RNA, 19 nt, Human
ccagcccacagugacuuuc

SEQ ID NO: 110299 - RNA, 22 nt, Human
ccagcccaugcccuuauagcau

SEQ ID NO: 110300 - RNA, 22 nt, Human
ccagcccuacaguaucaccugu

SEQ ID NO: 110301 - RNA, 22 nt, Human
ccagcccucacugaggccucuc

SEQ ID NO: 110302 - RNA, 22 nt, Human
ccagcccuccuccaucagagga

SEQ ID NO: 110303 - RNA, 22 nt, Human
ccagcccuguaaggaugaggca

SEQ ID NO: 110304 - RNA, 19 nt, Human
ccagcccugucacuucuug

SEQ ID NO: 110305 - RNA, 22 nt, Human
ccagcccuuagauaaaccuggc

SEQ ID NO: 110306 - RNA, 22 nt, Human
ccagcccuugagauggaaggga

SEQ ID NO: 110307 - RNA, 21 nt, Human
ccagccucagaucagggagcu

SEQ ID NO: 110308 - RNA, 22 nt, Human
ccagccucaucgccugccuguc

SEQ ID NO: 110309 - RNA, 22 nt, Human
ccagccuuacugcccuucagug

SEQ ID NO: 110310 - RNA, 22 nt, Human
ccagccuucugagcugccugga

SEQ ID NO: 110311 - RNA, 22 nt, Human
ccagccuugacugccccagcac

SEQ ID NO: 110312 - RNA, 22 nt, Human
ccagcuaggcuugcacucuugu

SEQ ID NO: 110313 - RNA, 22 nt, Human
ccagcuccaaguuugggcauca

SEQ ID NO: 110314 - RNA, 21 nt, Human
ccagcuccaggaccuuggauc

SEQ ID NO: 110315 - RNA, 22 nt, Human
ccagcuccaggacugggagcug

SEQ ID NO: 110316 - RNA, 22 nt, Human
ccagcuccauugcuuaguguaa

SEQ ID NO: 110317 - RNA, 22 nt, Human
ccagcuccccucagcagguaau

SEQ ID NO: 110318 - RNA, 22 nt, Human
ccagcucccugaagccuggucu

SEQ ID NO: 110319 - RNA, 22 nt, Human
ccagcuccgggaguugcugcug

SEQ ID NO: 110320 - RNA, 23 nt, Human
ccagcuccgugagccucgggcuc

SEQ ID NO: 110321 - RNA, 22 nt, Human
ccagcuccuucugucuguggag

SEQ ID NO: 110322 - RNA, 22 nt, Human
ccagcucucugcagaaaggacu

SEQ ID NO: 110323 - RNA, 22 nt, Human
ccagcucucuguccuccccaca

SEQ ID NO: 110324 - RNA, 22 nt, Human
ccagcucugccaagcgucagcu

SEQ ID NO: 110325 - RNA, 22 nt, Human
ccagcucugcuugcccagucag

SEQ ID NO: 110326 - RNA, 22 nt, Human
ccagcucuuuuggcugagugag

SEQ ID NO: 110327 - RNA, 22 nt, Human
ccagcugacgaugccuggucuc

SEQ ID NO: 110328 - RNA, 22 nt, Human
ccagcugcgggcaucgagaguu

SEQ ID NO: 110329 - RNA, 17 nt, Human
ccagcugcucccucaga

SEQ ID NO: 110330 - RNA, 22 nt, Human
ccagcugcugugaggaccacag

SEQ ID NO: 110331 - RNA, 22 nt, Human
ccagcugcugugcagggaggcu

SEQ ID NO: 110332 - RNA, 22 nt, Human
ccagcugcuugggaaaaugucu

SEQ ID NO: 110333 - RNA, 22 nt, Human
ccagcuggcaggagagucaggg

SEQ ID NO: 110334 - RNA, 22 nt, Human
ccagcugggauuaagggaaaau

SEQ ID NO: 110335 - RNA, 22 nt, Human
ccagcugguaagugauggagcc

SEQ ID NO: 110336 - RNA, 22 nt, Human
ccagcuggugacauccccaacc

SEQ ID NO: 110337 - RNA, 22 nt, Human
ccagcugucacucagaaaggcc

SEQ ID NO: 110338 - RNA, 22 nt, Human
ccagcugugccggggaccuggg

SEQ ID NO: 110339 - RNA, 22 nt, Human
ccagcuucaugggcaugcacca

SEQ ID NO: 110340 - RNA, 22 nt, Human
ccagcuucucucugaugcagcu

SEQ ID NO: 110341 - RNA, 22 nt, Human
ccagcuuggaauaugccauugu

SEQ ID NO: 110342 - RNA, 21 nt, Human
ccagcuuucccaagucccuuu

SEQ ID NO: 110343 - RNA, 22 nt, Human
ccagcuuuggaguguuguugcu

SEQ ID NO: 110344 - RNA, 22 nt, Human
ccagcuuuucagaaucugccug

SEQ ID NO: 110345 - RNA, 22 nt, Human
ccaggaaaaacacauugaagag

SEQ ID NO: 110346 - RNA, 22 nt, Human
ccaggaaaaagagaaacauggu

SEQ ID NO: 110347 - RNA, 16 nt, Human
ccaggaacacacagcu

SEQ ID NO: 110348 - RNA, 22 nt, Human
ccaggaacucagcucugcacuu

SEQ ID NO: 110349 - RNA, 22 nt, Human
ccaggaagacacaugcucaucc

SEQ ID NO: 110350 - RNA, 22 nt, Human
ccaggaagcggugagggcugcc

SEQ ID NO: 110351 - RNA, 22 nt, Human
ccaggaagcucugcuccacggg

SEQ ID NO: 110352 - RNA, 22 nt, Human
ccaggaaggcaggccuccccgc

SEQ ID NO: 110353 - RNA, 22 nt, Human
ccaggaaggcguuguuccucuc

SEQ ID NO: 110354 - RNA, 22 nt, Human
ccaggaagggcucuuuaaagac

SEQ ID NO: 110355 - RNA, 22 nt, Human
ccaggaagguguuuaacuagag

SEQ ID NO: 110356 - RNA, 22 nt, Human
cuggcuccaaauucugauguuc

SEQ ID NO: 110357 - RNA, 22 nt, Human
cuggcuccaaggaagagguuuu

SEQ ID NO: 110358 - RNA, 22 nt, Human
cuggcuccacucccugccugac

SEQ ID NO: 110359 - RNA, 22 nt, Human
cuggcuccaggucaugcacuca

SEQ ID NO: 110360 - RNA, 22 nt, Human
cuggcuccaucacugggugaug

SEQ ID NO: 110361 - RNA, 22 nt, Human
cuggcuccaucuuugcuuccug

SEQ ID NO: 110362 - RNA, 22 nt, Human
cuggcuccauuacucagcaucu

SEQ ID NO: 110363 - RNA, 22 nt, Human
cuggcucccggggaucgagcac

SEQ ID NO: 110364 - RNA, 22 nt, Human
cuggcucccgucugguggccau

SEQ ID NO: 110365 - RNA, 23 nt, Human
cuggcuccgaagacuccaggauc

SEQ ID NO: 110366 - RNA, 22 nt, Human
cuggcuccucaggacugcggga

SEQ ID NO: 110367 - RNA, 22 nt, Human
cuggcuccucaguauuccacuu

SEQ ID NO: 110368 - RNA, 22 nt, Human
cuggcuccuccaaggccuggag

SEQ ID NO: 110369 - RNA, 22 nt, Human
cuggcucgcauuauauuuuggg

SEQ ID NO: 110370 - RNA, 22 nt, Human
cuggcucugaccgcgcuggccu

SEQ ID NO: 110371 - RNA, 23 nt, Human
cuggcucuguagguggcauccuu

SEQ ID NO: 110372 - RNA, 22 nt, Human
cuggcucugugggaccuggccu

SEQ ID NO: 110373 - RNA, 21 nt, Human
cuggcucuguugucacccggc

SEQ ID NO: 110374 - RNA, 22 nt, Human
cuggcucuucagugcuugguuc

SEQ ID NO: 110375 - RNA, 22 nt, Human
cuggcucuuggcuagggagagu

SEQ ID NO: 110376 - RNA, 22 nt, Human
ccagcugugccguguggauagc

SEQ ID NO: 110377 - RNA, 22 nt, Human
ccagcuugcuccucugcaaugg

SEQ ID NO: 110378 - RNA, 22 nt, Human
ccagcuuuagguugccugccag

SEQ ID NO: 110379 - RNA, 22 nt, Human
ccagcuuuaucaagucugagcu

SEQ ID NO: 110380 - RNA, 22 nt, Human
ccagcuuuugcacuggacuggg

SEQ ID NO: 110381 - RNA, 22 nt, Human
ccaggaaauggcuugcuucuuu

SEQ ID NO: 110382 - RNA, 19 nt, Human
ccaggaaccccuagcuacc

SEQ ID NO: 110383 - RNA, 22 nt, Human
ccaggaagcauaauguaguggg

SEQ ID NO: 110384 - RNA, 22 nt, Human
ccaggaagccucagaugcugag

SEQ ID NO: 110385 - RNA, 22 nt, Human
ccaggaaggaucguuugggagu

SEQ ID NO: 110386 - RNA, 22 nt, Human
ccaggacaagccagagggacag

SEQ ID NO: 110387 - RNA, 22 nt, Human
ccaggacaauucgucacuuucu

SEQ ID NO: 110388 - RNA, 22 nt, Human
ccaggacacgauuuuuagucug

SEQ ID NO: 110389 - RNA, 22 nt, Human
ccaggacagugaacauguaaga

SEQ ID NO: 110390 - RNA, 22 nt, Human
ccaggacucaaugaccacaggg

SEQ ID NO: 110391 - RNA, 19 nt, Human
ccaggacuuugcagacacu

SEQ ID NO: 110392 - RNA, 22 nt, Human
ccaggagaaugggauuacccua

SEQ ID NO: 110393 - RNA, 22 nt, Human
ccaggagacccagggaaggagc

SEQ ID NO: 110394 - RNA, 22 nt, Human
ccaggagagcaaaggucacucu

SEQ ID NO: 110395 - RNA, 22 nt, Human
ccaggagagcauugcacagagg

SEQ ID NO: 110396 - RNA, 22 nt, Human
ccaggagaugggagcaucuaaa

SEQ ID NO: 110397 - RNA, 22 nt, Human
ccaggagcaacuugaaggcaag

SEQ ID NO: 110398 - RNA, 22 nt, Human
ccaggagcaccaggccugugcc

SEQ ID NO: 110399 - RNA, 22 nt, Human
ccaggagcagauauggacauaa

SEQ ID NO: 110400 - RNA, 22 nt, Human
ccaggagcaggagcugcagcug

SEQ ID NO: 110401 - RNA, 22 nt, Human
ccaggagccacucaggcccaca

SEQ ID NO: 110402 - RNA, 22 nt, Human
ccaggagcccugccacaauggu

SEQ ID NO: 110403 - RNA, 22 nt, Human
ccaggagccugggccaggcugg

SEQ ID NO: 110404 - RNA, 22 nt, Human
ccaggaggaaauucuaaaggua

SEQ ID NO: 110405 - RNA, 22 nt, Human
ccaggaggaucauccuguuuuc

SEQ ID NO: 110406 - RNA, 22 nt, Human
ccaggaggcagaaguugcagug

SEQ ID NO: 110407 - RNA, 22 nt, Human
ccaggaggcagagguuacagug

SEQ ID NO: 110408 - RNA, 22 nt, Human
ccaggaggcuucguccguggag

SEQ ID NO: 110409 - RNA, 22 nt, Human
ccaggaggucugaguguggaca

SEQ ID NO: 110410 - RNA, 22 nt, Human
ccaggaggugaaacuucaccag

SEQ ID NO: 110411 - RNA, 22 nt, Human
ccaggaucuggguccaugggac

SEQ ID NO: 110412 - RNA, 22 nt, Human
ccaggaugacccccacuuuccu

SEQ ID NO: 110413 - RNA, 22 nt, Human
ccaggcaacggagcccacugcc

SEQ ID NO: 110414 - RNA, 22 nt, Human
ccaggcaaggacaugaaacuga

SEQ ID NO: 110415 - RNA, 22 nt, Human
ccaggcaauucugaaagcauuu

SEQ ID NO: 110416 - RNA, 22 nt, Human
ccaggcaccauguucuuaggac

SEQ ID NO: 110417 - RNA, 22 nt, Human
ccaggcacgguggcucaugccu

SEQ ID NO: 110418 - RNA, 22 nt, Human
ccaggcacugcucgaggugcua

SEQ ID NO: 110419 - RNA, 20 nt, Human
ccaggcacugucccaugcag

SEQ ID NO: 110420 - RNA, 22 nt, Human
ccaggcacuuguuugccaggca

SEQ ID NO: 110421 - RNA, 22 nt, Human
ccaggcagagggaauagcaagu

SEQ ID NO: 110422 - RNA, 22 nt, Human
ccaggcagcucugauuuauguc

SEQ ID NO: 110423 - RNA, 22 nt, Human
ccaggcaggcagcguucucagg

SEQ ID NO: 110424 - RNA, 21 nt, Human
ccaggcaugacugcagagagc

SEQ ID NO: 110425 - RNA, 22 nt, Human
ccaggcauggggagagccagau

SEQ ID NO: 110426 - RNA, 22 nt, Human
ccaggccagagugcaguggcac

SEQ ID NO: 110427 - RNA, 22 nt, Human
ccaggccagccuggagcauggc

SEQ ID NO: 110428 - RNA, 19 nt, Human
ccaggccaucccaguuccc

SEQ ID NO: 110429 - RNA, 22 nt, Human
ccaggcccaccuuggccacuua

SEQ ID NO: 110430 - RNA, 22 nt, Human
ccaggcccaggguacugaccaa

SEQ ID NO: 110431 - RNA, 22 nt, Human
ccaggcccguucccuucuccag

SEQ ID NO: 110432 - RNA, 22 nt, Human
ccaggcccugccugugguuccu

SEQ ID NO: 110433 - RNA, 22 nt, Human
ccaggccuagccccugagggua

SEQ ID NO: 110434 - RNA, 22 nt, Human
ccaggccucccuuuuccagcca

SEQ ID NO: 110435 - RNA, 22 nt, Human
ccaggccuggccaggggaugcc

SEQ ID NO: 110436 - RNA, 22 nt, Human
ccaggccugugcaaggagggag

SEQ ID NO: 110437 - RNA, 22 nt, Human
ccaggcuagagagcaguggcau

SEQ ID NO: 110438 - RNA, 22 nt, Human
ccaggcuagagugcaguggcau

SEQ ID NO: 110439 - RNA, 22 nt, Human
ccaggcuaggaccgauuucccu

SEQ ID NO: 110440 - RNA, 22 nt, Human
ccaggcucaccuggagccccug

SEQ ID NO: 110441 - RNA, 22 nt, Human
ccaggcucagcgcgcacgucug

SEQ ID NO: 110442 - RNA, 17 nt, Human
ccaggcuccaucacugu

SEQ ID NO: 110443 - RNA, 22 nt, Human
ccaggcuccccaggaggcccuu

SEQ ID NO: 110444 - RNA, 21 nt, Human
ccaggcuccugaggcugguca

SEQ ID NO: 110445 - RNA, 22 nt, Human
ccaggcucugcaaaaucaggcu

SEQ ID NO: 110446 - RNA, 22 nt, Human
ccaggcucugccaggcccuuga

SEQ ID NO: 110447 - RNA, 22 nt, Human
ccaggcucugugugggcuagag

SEQ ID NO: 110448 - RNA, 23 nt, Human
ccaggcucuuucaccugcuauuc

SEQ ID NO: 110449 - RNA, 22 nt, Human
ccaggcuggagugcaauggugc

SEQ ID NO: 110450 - RNA, 22 nt, Human
ccaggcuggaguguagucgcau

SEQ ID NO: 110451 - RNA, 21 nt, Human
ccaggcugggagggcaguucc

SEQ ID NO: 110452 - RNA, 22 nt, Human
ccaggcugggcuacaaguugag

SEQ ID NO: 110453 - RNA, 22 nt, Human
ccaggcuucccccauccuagga

SEQ ID NO: 110454 - RNA, 22 nt, Human
ccaggcuuucccagccucucca

SEQ ID NO: 110455 - RNA, 22 nt, Human
ccaggcuuucuccugacucaca

SEQ ID NO: 110456 - RNA, 22 nt, Human
ccaggcuuuuagcugcauggca

SEQ ID NO: 110457 - RNA, 22 nt, Human
ccaggcuuuucucauggaguca

SEQ ID NO: 110458 - RNA, 22 nt, Human
ccagggaagaaagaugaagugc

SEQ ID NO: 110459 - RNA, 22 nt, Human
ccagggaaggacucucuuuccc

SEQ ID NO: 110460 - RNA, 23 nt, Human
ccagggaaggccaucuucaacug

SEQ ID NO: 110461 - RNA, 22 nt, Human
ccagggaaggcucugccugcuu

SEQ ID NO: 110462 - RNA, 22 nt, Human
ccagggaagucacauugucuag

SEQ ID NO: 110463 - RNA, 22 nt, Human
ccagggaaugauauuuuugccu

SEQ ID NO: 110464 - RNA, 23 nt, Human
ccagggagguugauugguuaccc

SEQ ID NO: 110465 - RNA, 22 nt, Human
ccagggaugcagagguugcagu

SEQ ID NO: 110466 - RNA, 22 nt, Human
ccagggcagugggagaaggugc

SEQ ID NO: 110467 - RNA, 22 nt, Human
ccagggcaucacauccaguguu

SEQ ID NO: 110468 - RNA, 22 nt, Human
ccagggcaugggaagaacugaa

SEQ ID NO: 110469 - RNA, 22 nt, Human
cauuucugcagaauugcucuuc

SEQ ID NO: 110470 - RNA, 22 nt, Human
cauuucuguucucuuccuguac

SEQ ID NO: 110471 - RNA, 22 nt, Human
cauuugaaaauacucuuuucca

SEQ ID NO: 110472 - RNA, 22 nt, Human
cauuugaauggcauuucacuuu

SEQ ID NO: 110473 - RNA, 22 nt, Human
cauuugcaagagauaaauguuu

SEQ ID NO: 110474 - RNA, 22 nt, Human
cauuugcauaugaagaaguaag

SEQ ID NO: 110475 - RNA, 22 nt, Human
cauuugcuguauuuucagauuc

SEQ ID NO: 110476 - RNA, 22 nt, Human
cauuuggaaagagacuagagaa

SEQ ID NO: 110477 - RNA, 22 nt, Human
cauuuggaccaaaauagccaac

SEQ ID NO: 110478 - RNA, 22 nt, Human
cauuuggauuuugaagagagua

SEQ ID NO: 110479 - RNA, 22 nt, Human
cauuuguacagaacagcuuuau

SEQ ID NO: 110480 - RNA, 22 nt, Human
cauuuguagaguaggaaagagu

SEQ ID NO: 110481 - RNA, 22 nt, Human
cauuuguagcuauuuacuguau

SEQ ID NO: 110482 - RNA, 22 nt, Human
cauuuguauagugcuuagacca

SEQ ID NO: 110483 - RNA, 22 nt, Human
cauuugucaucacugagcugcc

SEQ ID NO: 110484 - RNA, 22 nt, Human
cauuuguucaaccauucucgcu

SEQ ID NO: 110485 - RNA, 22 nt, Human
cugucaaugacaguuauuuggg

SEQ ID NO: 110486 - RNA, 22 nt, Human
cugucaauuuauguugacaugc

SEQ ID NO: 110487 - RNA, 17 nt, Human
cugucacaauaccucgc

SEQ ID NO: 110488 - RNA, 22 nt, Human
cugucacacugauaucaggcuu

SEQ ID NO: 110489 - RNA, 22 nt, Human
cugucaccugccagcauaccca

SEQ ID NO: 110490 - RNA, 22 nt, Human
cugucaccuguucacugcagca

SEQ ID NO: 110491 - RNA, 22 nt, Human
cugucacuuaaauucaggcuga

SEQ ID NO: 110492 - RNA, 22 nt, Human
cugucagcacucuacuacagau

SEQ ID NO: 110493 - RNA, 19 nt, Human
cugucaggggcuggauguu

SEQ ID NO: 110494 - RNA, 22 nt, Human
cugucagguuucccaucugcaa

SEQ ID NO: 110495 - RNA, 22 nt, Human
cugucaguaggcucccaucauu

SEQ ID NO: 110496 - RNA, 22 nt, Human
cugucaucacaguugagcagcc

SEQ ID NO: 110497 - RNA, 22 nt, Human
cugucauuucuuuagcaauggg

SEQ ID NO: 110498 - RNA, 22 nt, Human
cugucauuuucuuccaauauaa

SEQ ID NO: 110499 - RNA, 19 nt, Human
cuguccacacacucgcuuc

SEQ ID NO: 110500 - RNA, 22 nt, Human
cuguccacauggagaaccuggu

SEQ ID NO: 110501 - RNA, 22 nt, Human
cuguccagcuuggcuccugggg

SEQ ID NO: 110502 - RNA, 22 nt, Human
cuguccagugacuuugggccau

SEQ ID NO: 110503 - RNA, 22 nt, Human
cuguccagugcagagaacagag

SEQ ID NO: 110504 - RNA, 20 nt, Human
cuguccauauuugaaaaugc

SEQ ID NO: 110505 - RNA, 22 nt, Human
cuguccaucagaaaggggcuua

SEQ ID NO: 110506 - RNA, 22 nt, Human
cuguccauuuucgugccuccuu

SEQ ID NO: 110507 - RNA, 22 nt, Human
cugucccacaagcagugugcac

SEQ ID NO: 110508 - RNA, 22 nt, Human
cugucccaggagcuguaagaca

SEQ ID NO: 110509 - RNA, 22 nt, Human
cugucccauacuaucuggguga

SEQ ID NO: 110510 - RNA, 21 nt, Human
cuguccccagugagcaccccc

SEQ ID NO: 110511 - RNA, 20 nt, Human
cuguccccgaggucaccagg

SEQ ID NO: 110512 - RNA, 22 nt, Human
cuguccugagauaaagaugagg

SEQ ID NO: 110513 - RNA, 22 nt, Human
cuguccugaggcagguggccug

SEQ ID NO: 110514 - RNA, 20 nt, Human
cuguccugaucuuuucagaa

SEQ ID NO: 110515 - RNA, 22 nt, Human
cuguccugcaguugggggcagg

SEQ ID NO: 110516 - RNA, 22 nt, Human
cuguccugcccacccugcaggg

SEQ ID NO: 110517 - RNA, 22 nt, Human
cuguccuggccgcccuugugag

SEQ ID NO: 110518 - RNA, 22 nt, Human
cuguccugggggugguccuugc

SEQ ID NO: 110519 - RNA, 22 nt, Human
cuguccugguacuuugagguuc

SEQ ID NO: 110520 - RNA, 21 nt, Human
cuguccuggucuagaggcaca

SEQ ID NO: 110521 - RNA, 22 nt, Human
cuguccugucugcuuuuaauuu

SEQ ID NO: 110522 - RNA, 22 nt, Human
cuguccugugcauugucagaug

SEQ ID NO: 110523 - RNA, 23 nt, Human
cuguccuuggucuuggcugagug

SEQ ID NO: 110524 - RNA, 22 nt, Human
cugucgccugguccucucugga

SEQ ID NO: 110525 - RNA, 22 nt, Human
cugucuacagaugaaauaagca

SEQ ID NO: 110526 - RNA, 22 nt, Human
cugucucagcaggaagucauca

SEQ ID NO: 110527 - RNA, 22 nt, Human
cugucuccuccuuuguucuuaa

SEQ ID NO: 110528 - RNA, 22 nt, Human
cugucucuguugccuguaggug

SEQ ID NO: 110529 - RNA, 22 nt, Human
cugucugaauccuaagcuuccu

SEQ ID NO: 110530 - RNA, 17 nt, Human
cugucugcgcaugaggu

SEQ ID NO: 110531 - RNA, 17 nt, Human
cugucugcugcuuccuc

SEQ ID NO: 110532 - RNA, 22 nt, Human
cugucuggaaugcaguacauag

SEQ ID NO: 110533 - RNA, 21 nt, Human
cugucuggccgcgggcuccgc

SEQ ID NO: 110534 - RNA, 19 nt, Human
cugucugguucauguguuc

SEQ ID NO: 110535 - RNA, 22 nt, Human
cugucuguagacauuuuugguu

SEQ ID NO: 110536 - RNA, 22 nt, Human
cugucuguggagcuucugaugu

SEQ ID NO: 110537 - RNA, 22 nt, Human
cugucuguuaucucaccagucc

SEQ ID NO: 110538 - RNA, 22 nt, Human
cugucuguucagauucauuacu

SEQ ID NO: 110539 - RNA, 22 nt, Human
cugucuguugaccauaguuugc

SEQ ID NO: 110540 - RNA, 22 nt, Human
cugucuguuucugauucaaccu

SEQ ID NO: 110541 - RNA, 22 nt, Human
cugucuguuuuguauacaggcc

SEQ ID NO: 110542 - RNA, 22 nt, Human
cugucuucuaccuucaaccucc

SEQ ID NO: 110543 - RNA, 18 nt, Human
cugucuuuuuucucucca

SEQ ID NO: 110544 - RNA, 22 nt, Human
cugugaaacuggacagcacuug

SEQ ID NO: 110545 - RNA, 22 nt, Human
cugugacaguuucucagacuuu

SEQ ID NO: 110546 - RNA, 20 nt, Human
cugugaccagagacccagga

SEQ ID NO: 110547 - RNA, 21 nt, Human
cugugaccuuucuuuccuccu

SEQ ID NO: 110548 - RNA, 21 nt, Human
cugugacucccugggcaaucc

SEQ ID NO: 110549 - RNA, 22 nt, Human
cugugagaugaccaacugacug

SEQ ID NO: 110550 - RNA, 22 nt, Human
cugugagauuuuuaaauaacuu

SEQ ID NO: 110551 - RNA, 22 nt, Human
cugugaggcggguggaguggag

SEQ ID NO: 110552 - RNA, 22 nt, Human
cugugaguaaugaccugucuug

SEQ ID NO: 110553 - RNA, 22 nt, Human
cugugagucuucagcaaguguu

SEQ ID NO: 110554 - RNA, 19 nt, Human
cugugagucuuguggccuc

SEQ ID NO: 110555 - RNA, 22 nt, Human
cugugagugacccuggucagca

SEQ ID NO: 110556 - RNA, 22 nt, Human
cugugaguucauugugccaccu

SEQ ID NO: 110557 - RNA, 22 nt, Human
cugugaucauucuugauuuaag

SEQ ID NO: 110558 - RNA, 22 nt, Human
cugugaugauggaaacuuucuu

SEQ ID NO: 110559 - RNA, 22 nt, Human
cugugauggucaggcccuaucu

SEQ ID NO: 110560 - RNA, 22 nt, Human
cugugcaaauaaagagcaacau

SEQ ID NO: 110561 - RNA, 22 nt, Human
cugugcaagacuuacuuuaaua

SEQ ID NO: 110562 - RNA, 22 nt, Human
cugugcaaugccuaaucacaaa

SEQ ID NO: 110563 - RNA, 22 nt, Human
cugugcaguaggucagggcugg

SEQ ID NO: 110564 - RNA, 22 nt, Human
cugugcaguccagcccuggaca

SEQ ID NO: 110565 - RNA, 22 nt, Human
cugugcauggccaucagugccc

SEQ ID NO: 110566 - RNA, 22 nt, Human
cugugccacugccccaggccuc

SEQ ID NO: 110567 - RNA, 22 nt, Human
cugugccacugggggccggcaa

SEQ ID NO: 110568 - RNA, 22 nt, Human
cugugccagccugucccaggag

SEQ ID NO: 110569 - RNA, 22 nt, Human
cugugccaguguauuccuguga

SEQ ID NO: 110570 - RNA, 22 nt, Human
cugugccauccgcuugaccugg

SEQ ID NO: 110571 - RNA, 22 nt, Human
cugugccaucugcacucucguc

SEQ ID NO: 110572 - RNA, 22 nt, Human
cugugccauucuuuguagcaug

SEQ ID NO: 110573 - RNA, 22 nt, Human
cugugcccaggccccuggggau

SEQ ID NO: 110574 - RNA, 22 nt, Human
cugugccucaguguccucgagu

SEQ ID NO: 110575 - RNA, 22 nt, Human
cugugccucccuuuacuuugag

SEQ ID NO: 110576 - RNA, 22 nt, Human
cugugccugccuuguucacuga

SEQ ID NO: 110577 - RNA, 22 nt, Human
cugugccuucugccuggaacau

SEQ ID NO: 110578 - RNA, 23 nt, Human
cugugcucagagggagggagagc

SEQ ID NO: 110579 - RNA, 22 nt, Human
cugugcugagugaugugacuua

SEQ ID NO: 110580 - RNA, 22 nt, Human
cugugcuggagaugggccagag

SEQ ID NO: 110581 - RNA, 22 nt, Human
cugugcuggcagaccuggaguu

SEQ ID NO: 110582 - RNA, 22 nt, Human
cugugcuggugaaacccacaga

SEQ ID NO: 110583 - RNA, 22 nt, Human
cugugcuuaccugcccagguga

SEQ ID NO: 110584 - RNA, 21 nt, Human
cugugcuucuuccuaagccag

SEQ ID NO: 110585 - RNA, 22 nt, Human
cugugcuuucaaaagaaggguu

SEQ ID NO: 110586 - RNA, 22 nt, Human
cugugcuuucgagaugugaucu

SEQ ID NO: 110587 - RNA, 21 nt, Human
cugugcuuuuuaagugugaug

SEQ ID NO: 110588 - RNA, 22 nt, Human
cuguggaauugaugcuuagugu

SEQ ID NO: 110589 - RNA, 22 nt, Human
ccauguguaaauuagauaacuc

SEQ ID NO: 110590 - RNA, 22 nt, Human
ccaugugucgggccugcagugg

SEQ ID NO: 110591 - RNA, 18 nt, Human
ccauguguuccuuuuggg

SEQ ID NO: 110592 - RNA, 22 nt, Human
ccauguguugauucucugcaga

SEQ ID NO: 110593 - RNA, 22 nt, Human
ccauguuguaucucuuaucggc

SEQ ID NO: 110594 - RNA, 22 nt, Human
ccauuaaagcaccacuguaaua

SEQ ID NO: 110595 - RNA, 22 nt, Human
cuuucaaaacgcucuguaugca

SEQ ID NO: 110596 - RNA, 22 nt, Human
cuuucacagcuugaaaaguauu

SEQ ID NO: 110597 - RNA, 22 nt, Human
cuuucacauaauugaccuugaa

SEQ ID NO: 110598 - RNA, 22 nt, Human
cuuucacuuuaaucugacaccu

SEQ ID NO: 110599 - RNA, 22 nt, Human
cuuucagguucuauaggaagcc

SEQ ID NO: 110600 - RNA, 22 nt, Human
cuuucagucuuuacaagguugc

SEQ ID NO: 110601 - RNA, 22 nt, Human
cuuucaguuacaguuacacaca

SEQ ID NO: 110602 - RNA, 22 nt, Human
cuuucauaaaggaaaugaugag

SEQ ID NO: 110603 - RNA, 22 nt, Human
cuuucauaauucagcacauuga

SEQ ID NO: 110604 - RNA, 22 nt, Human
cuuucaugaacagacaaggaac

SEQ ID NO: 110605 - RNA, 19 nt, Human
cuuucaugugguucuucuu

SEQ ID NO: 110606 - RNA, 22 nt, Human
cuuuccaaugucacuaugaauc

SEQ ID NO: 110607 - RNA, 22 nt, Human
cuuuccccaguauaucauugcc

SEQ ID NO: 110608 - RNA, 22 nt, Human
cuuucccugcuuagaaggauuu

SEQ ID NO: 110609 - RNA, 22 nt, Human
cuuuccuagauggccaucuuuc

SEQ ID NO: 110610 - RNA, 22 nt, Human
cuuuccugagaaaggagaagga

SEQ ID NO: 110611 - RNA, 19 nt, Human
ccaggccucuggggccugu

SEQ ID NO: 110612 - RNA, 22 nt, Human
ccaggccugcauucccucucag

SEQ ID NO: 110613 - RNA, 19 nt, Human
ccaggccugcgggcguugg

SEQ ID NO: 110614 - RNA, 22 nt, Human
ccaggccuggaccaugccaggg

SEQ ID NO: 110615 - RNA, 22 nt, Human
ccaggccuuucuucuuggucug

SEQ ID NO: 110616 - RNA, 22 nt, Human
ccaggcuagagugcaauggcau

SEQ ID NO: 110617 - RNA, 22 nt, Human
ccaggcucacagcaucccagga

SEQ ID NO: 110618 - RNA, 22 nt, Human
ccaggcucugagccucacucuu

SEQ ID NO: 110619 - RNA, 22 nt, Human
ccaggcucugcgcuggacaugg

SEQ ID NO: 110620 - RNA, 22 nt, Human
ccaggcugaauauguuccaggg

SEQ ID NO: 110621 - RNA, 22 nt, Human
ccaggcugcuguugguguccgc

SEQ ID NO: 110622 - RNA, 22 nt, Human
ccaggcugggcggggaaccugg

SEQ ID NO: 110623 - RNA, 22 nt, Human
ccaggcuucccugagaggcugc

SEQ ID NO: 110624 - RNA, 22 nt, Human
ccaggcuugguguguggucagg

SEQ ID NO: 110625 - RNA, 22 nt, Human
ccagggaaaggagguugacuug

SEQ ID NO: 110626 - RNA, 21 nt, Human
ccagggaagaaaugagggcag

SEQ ID NO: 110627 - RNA, 22 nt, Human
ccagggaaguaguugugagagc

SEQ ID NO: 110628 - RNA, 22 nt, Human
ccagggacuuugcauuguuuau

SEQ ID NO: 110629 - RNA, 22 nt, Human
ccagggagccuggugugucagc

SEQ ID NO: 110630 - RNA, 22 nt, Human
ccagggaguuuccaaucugaga

SEQ ID NO: 110631 - RNA, 22 nt, Human
ccagggaugccaagcuuuacca

SEQ ID NO: 110632 - RNA, 22 nt, Human
ccagggaugcuuucccaggacu

SEQ ID NO: 110633 - RNA, 22 nt, Human
ccagggcaacgcugucucagag

SEQ ID NO: 110634 - RNA, 22 nt, Human
ccagggcagcgccccuccacgc

SEQ ID NO: 110635 - RNA, 22 nt, Human
ccagggcagggaccacgugucu

SEQ ID NO: 110636 - RNA, 22 nt, Human
ccagggccugccacuuagcaag

SEQ ID NO: 110637 - RNA, 22 nt, Human
ccagggcucaggcucccagugg

SEQ ID NO: 110638 - RNA, 22 nt, Human
ccagggcugagcugugaccaug

SEQ ID NO: 110639 - RNA, 22 nt, Human
ccagggcugcucauuggcuggu

SEQ ID NO: 110640 - RNA, 20 nt, Human
ccagggcuggcuccugggau

SEQ ID NO: 110641 - RNA, 22 nt, Human
ccagggcuuaacuuuucaggag

SEQ ID NO: 110642 - RNA, 22 nt, Human
ccaggggaaacagggagcacuc

SEQ ID NO: 110643 - RNA, 22 nt, Human
ccaggggcugcagauccauggu

SEQ ID NO: 110644 - RNA, 22 nt, Human
ccaggggcuggugcugagcugg

SEQ ID NO: 110645 - RNA, 22 nt, Human
ccaggguggcguagaugcuggg

SEQ ID NO: 110646 - RNA, 22 nt, Human
ccagggugggaggcugaaggcg

SEQ ID NO: 110647 - RNA, 22 nt, Human
ccagggugggguccaggaacca

SEQ ID NO: 110648 - RNA, 22 nt, Human
ccaggguguagggauuccagau

SEQ ID NO: 110649 - RNA, 22 nt, Human
ccaggguugcuuuagauucuga

SEQ ID NO: 110650 - RNA, 22 nt, Human
ccaggguuuaaauucugacuau

SEQ ID NO: 110651 - RNA, 22 nt, Human
ccagguaccagucaaaucugua

SEQ ID NO: 110652 - RNA, 22 nt, Human
ccagguaggagagagggauccu

SEQ ID NO: 110653 - RNA, 22 nt, Human
ccagguaggagagucaacaugu

SEQ ID NO: 110654 - RNA, 22 nt, Human
ccaggucccuggaauuuaugag

SEQ ID NO: 110655 - RNA, 22 nt, Human
ccaggucugcgggcggcaggca

SEQ ID NO: 110656 - RNA, 22 nt, Human
ccaggucuggcacuggccaguc

SEQ ID NO: 110657 - RNA, 19 nt, Human
ccaggucuggggccagauu

SEQ ID NO: 110658 - RNA, 22 nt, Human
ccaggucuucacuuuacugaag

SEQ ID NO: 110659 - RNA, 21 nt, Human
ccaggucuugguccuuggacu

SEQ ID NO: 110660 - RNA, 22 nt, Human
ccaggucuuuggccuuggcacu

SEQ ID NO: 110661 - RNA, 22 nt, Human
ccaggugcaaacucccagcagg

SEQ ID NO: 110662 - RNA, 22 nt, Human
ccaggugcuagcaaucacuguc

SEQ ID NO: 110663 - RNA, 22 nt, Human
ccaggugcugaccggucagauu

SEQ ID NO: 110664 - RNA, 19 nt, Human
ccagguggaacugagguag

SEQ ID NO: 110665 - RNA, 22 nt, Human
ccagguggauaagguuucugga

SEQ ID NO: 110666 - RNA, 22 nt, Human
ccagguggcuucugcccgaugu

SEQ ID NO: 110667 - RNA, 22 nt, Human
ccaggugggaggaaagcagaga

SEQ ID NO: 110668 - RNA, 22 nt, Human
ccagguggugaaagugggcccu

SEQ ID NO: 110669 - RNA, 22 nt, Human
ccaggugguucaggucaccaua

SEQ ID NO: 110670 - RNA, 22 nt, Human
ccagguguaggacaccaaggga

SEQ ID NO: 110671 - RNA, 22 nt, Human
ccaggugugccagcagggacug

SEQ ID NO: 110672 - RNA, 22 nt, Human
ccagguguggggaggacucaca

SEQ ID NO: 110673 - RNA, 22 nt, Human
ccaggugugguggcauacaccu

SEQ ID NO: 110674 - RNA, 22 nt, Human
ccaggugugucaccauugccca

SEQ ID NO: 110675 - RNA, 22 nt, Human
ccaggugugucuggccccgaag

SEQ ID NO: 110676 - RNA, 22 nt, Human
ccagguucaaauagcuguguga

SEQ ID NO: 110677 - RNA, 22 nt, Human
ccaguaauuagacuuucaggca

SEQ ID NO: 110678 - RNA, 22 nt, Human
ccaguacaucgcauggugacca

SEQ ID NO: 110679 - RNA, 22 nt, Human
ccaguacugucuccaauauucc

SEQ ID NO: 110680 - RNA, 22 nt, Human
ccaguacuuugugcaacaaaug

SEQ ID NO: 110681 - RNA, 19 nt, Human
ccaguagagacagcugcag

SEQ ID NO: 110682 - RNA, 23 nt, Human
ccaguagcacaguuacccagugg

SEQ ID NO: 110683 - RNA, 19 nt, Human
ccaguaguauagcacaguc

SEQ ID NO: 110684 - RNA, 22 nt, Human
ccagucaaaaggaagucaaugu

SEQ ID NO: 110685 - RNA, 22 nt, Human
ccagucagagcagcgcucgcau

SEQ ID NO: 110686 - RNA, 22 nt, Human
ccagucagucaguugcuggcau

SEQ ID NO: 110687 - RNA, 20 nt, Human
ccaguccaccugagacaugu

SEQ ID NO: 110688 - RNA, 22 nt, Human
ccaguccaggccauggauuuug

SEQ ID NO: 110689 - RNA, 22 nt, Human
ccagucccgcaugguccagaau

SEQ ID NO: 110690 - RNA, 20 nt, Human
ccagucccugagcaccaggg

SEQ ID NO: 110691 - RNA, 22 nt, Human
ccaguccuagaagaggagucga

SEQ ID NO: 110692 - RNA, 22 nt, Human
ccaguccucagauggucugugc

SEQ ID NO: 110693 - RNA, 22 nt, Human
ccaguccugccacccugucuau

SEQ ID NO: 110694 - RNA, 22 nt, Human
ccaguccugcucccugaccacc

SEQ ID NO: 110695 - RNA, 22 nt, Human
ccaguccuuugagccaguucug

SEQ ID NO: 110696 - RNA, 23 nt, Human
ccagucucuuuccaaaaucacau

SEQ ID NO: 110697 - RNA, 22 nt, Human
ccagucuguacuuugcucuguu

SEQ ID NO: 110698 - RNA, 22 nt, Human
ccagucuguucucaccucugag

SEQ ID NO: 110699 - RNA, 22 nt, Human
ccagugauggugaucagauguu

SEQ ID NO: 110700 - RNA, 22 nt, Human
ccagugcacagccaggcaggug

SEQ ID NO: 110701 - RNA, 22 nt, Human
ccagugcauaaucaauacagcc

SEQ ID NO: 110702 - RNA, 22 nt, Human
ccagugcauugccgugucuagg

SEQ ID NO: 110703 - RNA, 18 nt, Human
ccagugccaagaguggca

SEQ ID NO: 110704 - RNA, 22 nt, Human
ccucucucugcaucuggagggc

SEQ ID NO: 110705 - RNA, 20 nt, Human
ccucucugaagaggucaucu

SEQ ID NO: 110706 - RNA, 20 nt, Human
ccucucugcaugcucccuga

SEQ ID NO: 110707 - RNA, 20 nt, Human
ccucucugcccugcaaggcc

SEQ ID NO: 110708 - RNA, 22 nt, Human
ccucucugucacaccaguggcc

SEQ ID NO: 110709 - RNA, 22 nt, Human
ccucucuuggauguggaugggu

SEQ ID NO: 110710 - RNA, 22 nt, Human
ccucugaguacagugauggauu

SEQ ID NO: 110711 - RNA, 22 nt, Human
ccucugcaaagaauuugucucc

SEQ ID NO: 110712 - RNA, 22 nt, Human
ccucugcacuucaccuuagcuc

SEQ ID NO: 110713 - RNA, 18 nt, Human
ccucugccauagccagca

SEQ ID NO: 110714 - RNA, 19 nt, Human
ccucugcuccaguuuccuu

SEQ ID NO: 110715 - RNA, 22 nt, Human
ccucugcugcuguugagcaccg

SEQ ID NO: 110716 - RNA, 22 nt, Human
ccucuggacuugggacagugag

SEQ ID NO: 110717 - RNA, 22 nt, Human
ccucuggcaacuucacagccca

SEQ ID NO: 110718 - RNA, 16 nt, Human
ccucuggcaauuagau

SEQ ID NO: 110719 - RNA, 22 nt, Human
ccucuggcagccagccaguugu

SEQ ID NO: 110720 - RNA, 22 nt, Human
ccucuggcauagcaaguggccu

SEQ ID NO: 110721 - RNA, 22 nt, Human
ccucuggccagagaaaggccag

SEQ ID NO: 110722 - RNA, 22 nt, Human
ccucuggccauucuuugaugga

SEQ ID NO: 110723 - RNA, 22 nt, Human
ccucuggccuaggccgggagag

SEQ ID NO: 110724 - RNA, 22 nt, Human
ccucuggcucacagcaccaacu

SEQ ID NO: 110725 - RNA, 22 nt, Human
ccucugggagacugcuacugag

SEQ ID NO: 110726 - RNA, 22 nt, Human
ccucugggcugccugcacgggu

SEQ ID NO: 110727 - RNA, 22 nt, Human
ccucuggguaucuguggaagua

SEQ ID NO: 110728 - RNA, 22 nt, Human
ccaguguucauaauuuuacacu

SEQ ID NO: 110729 - RNA, 22 nt, Human
ccaguguuccagagagcugaug

SEQ ID NO: 110730 - RNA, 22 nt, Human
ccaguguucugguguucauuuc

SEQ ID NO: 110731 - RNA, 22 nt, Human
ccaguguuuaggaauaaaaugu

SEQ ID NO: 110732 - RNA, 22 nt, Human
ccaguguuugaugggauuuuca

SEQ ID NO: 110733 - RNA, 22 nt, Human
ccaguuacaagugauucuuggu

SEQ ID NO: 110734 - RNA, 22 nt, Human
ccaguucuaaacauaaagcuaa

SEQ ID NO: 110735 - RNA, 23 nt, Human
ccaguucuccuuugaacagugac

SEQ ID NO: 110736 - RNA, 22 nt, Human
ccaguucugacacaagcacagu

SEQ ID NO: 110737 - RNA, 22 nt, Human
ccaguucugagaugaauaucca

SEQ ID NO: 110738 - RNA, 22 nt, Human
ccaguuuaggacacaugcccac

SEQ ID NO: 110739 - RNA, 22 nt, Human
ccaguuuauaagaaagaaaacc

SEQ ID NO: 110740 - RNA, 22 nt, Human
ccaguuucuuaaguaggaagaa

SEQ ID NO: 110741 - RNA, 22 nt, Human
ccaguuugaggaagaaguagau

SEQ ID NO: 110742 - RNA, 22 nt, Human
ccauaaaguaggaaacacuaca

SEQ ID NO: 110743 - RNA, 22 nt, Human
ccauaauauuaaaugcuuuugu

SEQ ID NO: 110744 - RNA, 22 nt, Human
ccauaaucuggcuuugagagag

SEQ ID NO: 110745 - RNA, 22 nt, Human
ccauacacacaccaaauuugua

SEQ ID NO: 110746 - RNA, 21 nt, Human
ccauaccuaccucaccugguu

SEQ ID NO: 110747 - RNA, 22 nt, Human
ccaucacaguccccaucgugau

SEQ ID NO: 110748 - RNA, 22 nt, Human
ccaucagacaauucuuucucuu

SEQ ID NO: 110749 - RNA, 22 nt, Human
ccaucagcaugggagcaugggc

SEQ ID NO: 110750 - RNA, 22 nt, Human
ccaucagcuccaguaucuucug

SEQ ID NO: 110751 - RNA, 23 nt, Human
ccaucaggccuccguguccagcc

SEQ ID NO: 110752 - RNA, 22 nt, Human
ccaucagugaaggagacagauu

SEQ ID NO: 110753 - RNA, 22 nt, Human
ccauccagaaacuuccaucccc

SEQ ID NO: 110754 - RNA, 21 nt, Human
ccauccaucucccuuugcugg

SEQ ID NO: 110755 - RNA, 22 nt, Human
ccauccauguggcagggcuggc

SEQ ID NO: 110756 - RNA, 22 nt, Human
ccauccauuuucuugcuugccu

SEQ ID NO: 110757 - RNA, 22 nt, Human
ccaucccugggccauguccccu

SEQ ID NO: 110758 - RNA, 22 nt, Human
ccaucccuucaccacagcagua

SEQ ID NO: 110759 - RNA, 22 nt, Human
ccauccuggccucgcuguccac

SEQ ID NO: 110760 - RNA, 22 nt, Human
ccaucgcuucaaaucucagacu

SEQ ID NO: 110761 - RNA, 22 nt, Human
ccaucucacucauguuucuaga

SEQ ID NO: 110762 - RNA, 22 nt, Human
ccaucuccacugucccugucaa

SEQ ID NO: 110763 - RNA, 22 nt, Human
ccaucugacugccacccaggcc

SEQ ID NO: 110764 - RNA, 22 nt, Human
ccaucuucucuugaaccuccuu

SEQ ID NO: 110765 - RNA, 22 nt, Human
ccaugagacagcaacugaaagu

SEQ ID NO: 110766 - RNA, 22 nt, Human
ccaugagcuucaacugacacag

SEQ ID NO: 110767 - RNA, 22 nt, Human
ccaugagcuuccuauauagggu

SEQ ID NO: 110768 - RNA, 22 nt, Human
ccaugcaaggagaacucucacu

SEQ ID NO: 110769 - RNA, 22 nt, Human
ccaugcaagggucugguccugc

SEQ ID NO: 110770 - RNA, 22 nt, Human
ccaugcaauauauauccucaag

SEQ ID NO: 110771 - RNA, 22 nt, Human
ccaugcauauaauagugccugg

SEQ ID NO: 110772 - RNA, 22 nt, Human
ccaugcaugccugaaauugcug

SEQ ID NO: 110773 - RNA, 22 nt, Human
ccaugccccaauacaggacacc

SEQ ID NO: 110774 - RNA, 22 nt, Human
ccaugcuaggaacucucaggga

SEQ ID NO: 110775 - RNA, 22 nt, Human
ccaugcucuggggaggucaagc

SEQ ID NO: 110776 - RNA, 19 nt, Human
ccauggagagagaugcauu

SEQ ID NO: 110777 - RNA, 22 nt, Human
ccauggagcaccucacagaggc

SEQ ID NO: 110778 - RNA, 19 nt, Human
ccauggcaaugaucugaug

SEQ ID NO: 110779 - RNA, 22 nt, Human
ccauggcauuuuaugugucuua

SEQ ID NO: 110780 - RNA, 20 nt, Human
ccauggccacaucugugcug

SEQ ID NO: 110781 - RNA, 22 nt, Human
ccauggccaggaaagccaaggu

SEQ ID NO: 110782 - RNA, 22 nt, Human
ccauggccgccgcugcucagga

SEQ ID NO: 110783 - RNA, 22 nt, Human
ccauggcuaaguaucuguagaa

SEQ ID NO: 110784 - RNA, 22 nt, Human
ccaugugucuccccuggaagua

SEQ ID NO: 110785 - RNA, 22 nt, Human
ccauuaaaauggaauguaguga

SEQ ID NO: 110786 - RNA, 22 nt, Human
ccauuaaguauuauuaaugauu

SEQ ID NO: 110787 - RNA, 22 nt, Human
ccauuacuuagaaaggaacuga

SEQ ID NO: 110788 - RNA, 22 nt, Human
ccauuacuuuccaauauaucag

SEQ ID NO: 110789 - RNA, 22 nt, Human
ccauucauagcaagcuacaucu

SEQ ID NO: 110790 - RNA, 22 nt, Human
ccauucugccaugcuucaucua

SEQ ID NO: 110791 - RNA, 19 nt, Human
ccauucugucucugccaca

SEQ ID NO: 110792 - RNA, 22 nt, Human
ccauugaaccccucuaggccac

SEQ ID NO: 110793 - RNA, 22 nt, Human
ccauugaaggcacuugagcaga

SEQ ID NO: 110794 - RNA, 22 nt, Human
ccauuggagaguuuuaagaagg

SEQ ID NO: 110795 - RNA, 22 nt, Human
ccauuuauagauguauuuggcu

SEQ ID NO: 110796 - RNA, 22 nt, Human
ccauuucacccacugcuuuagg

SEQ ID NO: 110797 - RNA, 22 nt, Human
ccauuucacuggguaguugugg

SEQ ID NO: 110798 - RNA, 19 nt, Human
ccauuucauauguauugug

SEQ ID NO: 110799 - RNA, 22 nt, Human
ccauuuggcaaacauuuuacag

SEQ ID NO: 110800 - RNA, 22 nt, Human
ccauuugguauagugaaaagga

SEQ ID NO: 110801 - RNA, 22 nt, Human
ccauuuguucgcccagcuccaa

SEQ ID NO: 110802 - RNA, 22 nt, Human
ccauuuguuuucgcuaccaugg

SEQ ID NO: 110803 - RNA, 22 nt, Human
ccauuuuauuagugacauuuag

SEQ ID NO: 110804 - RNA, 22 nt, Human
ccauuuugucugacuucuugcu

SEQ ID NO: 110805 - RNA, 22 nt, Human
ccauuuuuaaagagcuuaagua

SEQ ID NO: 110806 - RNA, 22 nt, Human
cccaaacaguuccugugguacu

SEQ ID NO: 110807 - RNA, 22 nt, Human
cccaaagggugucagcagcaag

SEQ ID NO: 110808 - RNA, 22 nt, Human
cccaacaacaugaaacuaccua

SEQ ID NO: 110809 - RNA, 21 nt, Human
cccaacccauuuccaguucau

SEQ ID NO: 110810 - RNA, 19 nt, Human
cccaacuggauccaucaua

SEQ ID NO: 110811 - RNA, 19 nt, Human
cccaacuugacuauuuucu

SEQ ID NO: 110812 - RNA, 22 nt, Human
cccaagagaucgcauguaguug

SEQ ID NO: 110813 - RNA, 22 nt, Human
ugugaggcuggcaggggccagg

SEQ ID NO: 110814 - RNA, 21 nt, Human
ugugaguccaucugagcagaa

SEQ ID NO: 110815 - RNA, 22 nt, Human
ugugagucuaggucaggguguu

SEQ ID NO: 110816 - RNA, 22 nt, Human
ugugagugaaugggucugaagu

SEQ ID NO: 110817 - RNA, 22 nt, Human
ugugaguucuuagaaagucagu

SEQ ID NO: 110818 - RNA, 22 nt, Human
ugugaguugcucuuuugcuacu

SEQ ID NO: 110819 - RNA, 22 nt, Human
ugugauaacuuuuacauuuucg

SEQ ID NO: 110820 - RNA, 22 nt, Human
ugugauauuugaguauugucaa

SEQ ID NO: 110821 - RNA, 22 nt, Human
ugugaucuuagacaacucacug

SEQ ID NO: 110822 - RNA, 22 nt, Human
ugugauuagcugaauacacugg

SEQ ID NO: 110823 - RNA, 22 nt, Human
ugugauuuauugaaaagagcuu

SEQ ID NO: 110824 - RNA, 22 nt, Human
ugugauuuccagccauuaaaaa

SEQ ID NO: 110825 - RNA, 18 nt, Human
ugugcaauauuaaccacc

SEQ ID NO: 110826 - RNA, 22 nt, Human
ugugcacaaugugcagguuugu

SEQ ID NO: 110827 - RNA, 23 nt, Human
ugugcacaucugacgggugaagg

SEQ ID NO: 110828 - RNA, 22 nt, Human
ugugcagaguugaagacaggag

SEQ ID NO: 110829 - RNA, 22 nt, Human
ugugcagcagcagcuguggaga

SEQ ID NO: 110830 - RNA, 22 nt, Human
ugugcaggugcaggaagggggc

SEQ ID NO: 110831 - RNA, 21 nt, Human
ugugcaguccaaugugcuagc

SEQ ID NO: 110832 - RNA, 22 nt, Human
ugugcaucaagagaaaacagug

SEQ ID NO: 110833 - RNA, 22 nt, Human
ugugcauggcaucauugcagcc

SEQ ID NO: 110834 - RNA, 22 nt, Human
ugugccaagaucaaacuuuucu

SEQ ID NO: 110835 - RNA, 22 nt, Human
ugugccaggcccuggggaccaa

SEQ ID NO: 110836 - RNA, 22 nt, Human
ugugccaucugauauaagagcc

SEQ ID NO: 110837 - RNA, 20 nt, Human
ugugcccagcagaggcugcc

SEQ ID NO: 110838 - RNA, 22 nt, Human
ugugcccauuccacuugaguac

SEQ ID NO: 110839 - RNA, 22 nt, Human
ugugcccuccugccaggggcug

SEQ ID NO: 110840 - RNA, 22 nt, Human
ugugcccuuuccugcuccucca

SEQ ID NO: 110841 - RNA, 22 nt, Human
ugugccugcuagaugguugucg

SEQ ID NO: 110842 - RNA, 22 nt, Human
ugugccuggcauucugggcuuc

SEQ ID NO: 110843 - RNA, 22 nt, Human
ugugccugugacagcgaccugg

SEQ ID NO: 110844 - RNA, 22 nt, Human
ugugccuuaugaauucuuucug

SEQ ID NO: 110845 - RNA, 22 nt, Human
ugugccuuucaucaugcuuuug

SEQ ID NO: 110846 - RNA, 22 nt, Human
ugugcgcgugcagcggaguguu

SEQ ID NO: 110847 - RNA, 22 nt, Human
ugugcuaaggcagucuaucaca

SEQ ID NO: 110848 - RNA, 22 nt, Human
ugugcuaaguauuuucuuauuu

SEQ ID NO: 110849 - RNA, 22 nt, Human
ugugcuauuuuugcauaugugu

SEQ ID NO: 110850 - RNA, 17 nt, Human
ugugcucucucacucag

SEQ ID NO: 110851 - RNA, 22 nt, Human
ugugcucuggaguugccuucac

SEQ ID NO: 110852 - RNA, 22 nt, Human
ugugcugcucucagugacagcc

SEQ ID NO: 110853 - RNA, 22 nt, Human
uguggaaaauuggaacguuccu

SEQ ID NO: 110854 - RNA, 22 nt, Human
uguggaacaaaauguugggaga

SEQ ID NO: 110855 - RNA, 22 nt, Human
uguggaagaaacaagacacuuu

SEQ ID NO: 110856 - RNA, 22 nt, Human
uguggaagccggugggaagcag

SEQ ID NO: 110857 - RNA, 22 nt, Human
uguggaaggggccccaugacca

SEQ ID NO: 110858 - RNA, 20 nt, Human
uguggacucaguuucuugcu

SEQ ID NO: 110859 - RNA, 22 nt, Human
uguggacuuuauuuuagggagg

SEQ ID NO: 110860 - RNA, 22 nt, Human
uguggagguuuaaguaauggga

SEQ ID NO: 110861 - RNA, 22 nt, Human
uguggaugaauaaagugcagac

SEQ ID NO: 110862 - RNA, 22 nt, Human
uguggcaaagaccauuucuuuc

SEQ ID NO: 110863 - RNA, 22 nt, Human
uguggcagaaagcauguggaca

SEQ ID NO: 110864 - RNA, 22 nt, Human
uguggcagaaccagaauucaaa

SEQ ID NO: 110865 - RNA, 22 nt, Human
uguggcagaaggcuaagguguc

SEQ ID NO: 110866 - RNA, 22 nt, Human
uguggcagaggaggcagcgucc

SEQ ID NO: 110867 - RNA, 22 nt, Human
uguggcagcugcugcaggagcu

SEQ ID NO: 110868 - RNA, 22 nt, Human
uguggcaggcuaggcuuuuugg

SEQ ID NO: 110869 - RNA, 22 nt, Human
uguggcaguaaaauugggcaac

SEQ ID NO: 110870 - RNA, 22 nt, Human
uggcuggcugucaguaggcugu

SEQ ID NO: 110871 - RNA, 20 nt, Human
uggcuggcuuguauuuccuu

SEQ ID NO: 110872 - RNA, 22 nt, Human
uggcugggccgggccuugugcc

SEQ ID NO: 110873 - RNA, 22 nt, Human
uggcugggggugcuauagcugc

SEQ ID NO: 110874 - RNA, 22 nt, Human
uggcugggugcuauccaguacu

SEQ ID NO: 110875 - RNA, 22 nt, Human
uggcuguagaacaguggauauu

SEQ ID NO: 110876 - RNA, 22 nt, Human
uggcugugaacaaagagaauaa

SEQ ID NO: 110877 - RNA, 22 nt, Human
uggcugugccucuuuccaggcc

SEQ ID NO: 110878 - RNA, 19 nt, Human
uggcuguggggaaaugcuu

SEQ ID NO: 110879 - RNA, 22 nt, Human
uggcugugguuuaucccaguuc

SEQ ID NO: 110880 - RNA, 22 nt, Human
uggcuuaagcgcaacucugucu

SEQ ID NO: 110881 - RNA, 22 nt, Human
uggcuuaauauuucauauuuaa

SEQ ID NO: 110882 - RNA, 22 nt, Human
uggcuucacaauuucauaacua

SEQ ID NO: 110883 - RNA, 22 nt, Human
uggcuucacacaggcacuuccg

SEQ ID NO: 110884 - RNA, 22 nt, Human
uggcuucacccguccuccccac

SEQ ID NO: 110885 - RNA, 22 nt, Human
uggcuucaccucagcaugaagg

SEQ ID NO: 110886 - RNA, 22 nt, Human
uggcuucaggcagaauuuagac

SEQ ID NO: 110887 - RNA, 22 nt, Human
uggcuucaggguugucuucagc

SEQ ID NO: 110888 - RNA, 22 nt, Human
uggcuucaucugcagcacugcc

SEQ ID NO: 110889 - RNA, 22 nt, Human
uggcuuccacugugugcccccu

SEQ ID NO: 110890 - RNA, 19 nt, Human
uggcuuccaucucucucau

SEQ ID NO: 110891 - RNA, 16 nt, Human
uggcuucccagagaua

SEQ ID NO: 110892 - RNA, 19 nt, Human
uggcuuccugacucucauc

SEQ ID NO: 110893 - RNA, 18 nt, Human
uggcuuccugcgggcugc

SEQ ID NO: 110894 - RNA, 22 nt, Human
uggcuucuaguuugaggaaaaa

SEQ ID NO: 110895 - RNA, 22 nt, Human
uggcuucucccuccccaucuag

SEQ ID NO: 110896 - RNA, 22 nt, Human
uggcuucucugugguggcuccc

SEQ ID NO: 110897 - RNA, 22 nt, Human
uggcuucucuguuuuaguauuu

SEQ ID NO: 110898 - RNA, 20 nt, Human
uggcuucucuucacuccugu

SEQ ID NO: 110899 - RNA, 22 nt, Human
uggcuucugagucuccugacau

SEQ ID NO: 110900 - RNA, 22 nt, Human
uggcuucugcauauuuuuagag

SEQ ID NO: 110901 - RNA, 21 nt, Human
uggcuucugccaauguuaaga

SEQ ID NO: 110902 - RNA, 22 nt, Human
uggcuucugcuuucaguggagg

SEQ ID NO: 110903 - RNA, 22 nt, Human
uggcuucuggccaggcacagga

SEQ ID NO: 110904 - RNA, 22 nt, Human
uggcuucugggacuugugagca

SEQ ID NO: 110905 - RNA, 22 nt, Human
uggcuucugggguggccugcau

SEQ ID NO: 110906 - RNA, 22 nt, Human
uggcuucuuacuagggcucagu

SEQ ID NO: 110907 - RNA, 22 nt, Human
uggcuucuuagaccaguggccu

SEQ ID NO: 110908 - RNA, 22 nt, Human
uggcuucuuguuugguuuaaga

SEQ ID NO: 110909 - RNA, 22 nt, Human
uggcuucuuugugacagcucuu

SEQ ID NO: 110910 - RNA, 22 nt, Human
uggcuuggacuaaauggaccgu

SEQ ID NO: 110911 - RNA, 22 nt, Human
uggcuuggcuaagaucuaagcu

SEQ ID NO: 110912 - RNA, 22 nt, Human
uggcuugggugucucagcucuu

SEQ ID NO: 110913 - RNA, 16 nt, Human
uggcuuggguuucaug

SEQ ID NO: 110914 - RNA, 22 nt, Human
uggcuugguaaggaccagcagg

SEQ ID NO: 110915 - RNA, 22 nt, Human
uggcuuuaaaucuguauucaua

SEQ ID NO: 110916 - RNA, 22 nt, Human
uggcuuuacugucauucuuaug

SEQ ID NO: 110917 - RNA, 23 nt, Human
uggcuuuauucacauaucugacc

SEQ ID NO: 110918 - RNA, 22 nt, Human
uggcuuucccccagcccaguug

SEQ ID NO: 110919 - RNA, 17 nt, Human
uggcuuuccugacacag

SEQ ID NO: 110920 - RNA, 22 nt, Human
uggcuuucucccccagcuucuc

SEQ ID NO: 110921 - RNA, 21 nt, Human
uggcuuugcccugcuugcccc

SEQ ID NO: 110922 - RNA, 22 nt, Human
ugggaaagacucaggacaggag

SEQ ID NO: 110923 - RNA, 22 nt, Human
gugggacucuucuuuggcagug

SEQ ID NO: 110924 - RNA, 22 nt, Human
gugggagaauggccuugcaaac

SEQ ID NO: 110925 - RNA, 22 nt, Human
gugggagcauggucccagugcc

SEQ ID NO: 110926 - RNA, 22 nt, Human
gugggagcugcggaggccuggg

SEQ ID NO: 110927 - RNA, 22 nt, Human
gugggagcugcuaccuccuucc

SEQ ID NO: 110928 - RNA, 22 nt, Human
gugggaugguagguagguaaua

SEQ ID NO: 110929 - RNA, 22 nt, Human
gugggcagagcaagggaacuca

SEQ ID NO: 110930 - RNA, 20 nt, Human
gugggcagagcaccaccugg

SEQ ID NO: 110931 - RNA, 22 nt, Human
gugggcagauuaauuucucaau

SEQ ID NO: 110932 - RNA, 22 nt, Human
gugggcagcaccagggaagugu

SEQ ID NO: 110933 - RNA, 20 nt, Human
gugggcagcaggcauacugg

SEQ ID NO: 110934 - RNA, 22 nt, Human
gugggcagccccuucaaggcca

SEQ ID NO: 110935 - RNA, 22 nt, Human
gugggcagccuccuuuauuuuc

SEQ ID NO: 110936 - RNA, 22 nt, Human
gugggcagguaggcaccagcua

SEQ ID NO: 110937 - RNA, 22 nt, Human
gugggcagucaugaaaucuaga

SEQ ID NO: 110938 - RNA, 22 nt, Human
gugggcagugugucaguaucuu

SEQ ID NO: 110939 - RNA, 22 nt, Human
gugggccuucaacccugucugg

SEQ ID NO: 110940 - RNA, 22 nt, Human
gugggccuugcagggugcaggg

SEQ ID NO: 110941 - RNA, 22 nt, Human
gugggcuggauuugcuugcaga

SEQ ID NO: 110942 - RNA, 22 nt, Human
gugggcuguuguucccuguucu

SEQ ID NO: 110943 - RNA, 22 nt, Human
gugggcuucccuuaagccagag

SEQ ID NO: 110944 - RNA, 22 nt, Human
gugggcuucuguuagggaggcu

SEQ ID NO: 110945 - RNA, 22 nt, Human
guggccaaggugcagagcagcu

SEQ ID NO: 110946 - RNA, 22 nt, Human
guggccaauuuccaucuguaag

SEQ ID NO: 110947 - RNA, 22 nt, Human
guggccagcugucagcacccuu

SEQ ID NO: 110948 - RNA, 22 nt, Human
guggccaggagagggugggaca

SEQ ID NO: 110949 - RNA, 22 nt, Human
guggccaggcguccgcgcggcu

SEQ ID NO: 110950 - RNA, 22 nt, Human
guggccaugugcuugcagggua

SEQ ID NO: 110951 - RNA, 22 nt, Human
guggccauuuggaaggcaagua

SEQ ID NO: 110952 - RNA, 22 nt, Human
guggcccagcccuacagaggac

SEQ ID NO: 110953 - RNA, 21 nt, Human
guggcccugguguggcugcac

SEQ ID NO: 110954 - RNA, 22 nt, Human
guggccuagaggugcaaggaac

SEQ ID NO: 110955 - RNA, 20 nt, Human
guggccucucacauucugag

SEQ ID NO: 110956 - RNA, 22 nt, Human
guggccugaugccagcccugug

SEQ ID NO: 110957 - RNA, 22 nt, Human
guggccugccgcaccccaauau

SEQ ID NO: 110958 - RNA, 22 nt, Human
guggccuggaguuugauguagg

SEQ ID NO: 110959 - RNA, 20 nt, Human
guggccuguccuguuguggg

SEQ ID NO: 110960 - RNA, 22 nt, Human
guggccugugcugucuccccaa

SEQ ID NO: 110961 - RNA, 22 nt, Human
guggccuuuuagaauaaacucu

SEQ ID NO: 110962 - RNA, 22 nt, Human
guggccuuuucaaguaggguau

SEQ ID NO: 110963 - RNA, 22 nt, Human
guggcuaggcccaacggcagga

SEQ ID NO: 110964 - RNA, 22 nt, Human
guggcuaguuggcagagaacag

SEQ ID NO: 110965 - RNA, 22 nt, Human
guggcucaguuaacuuccaugu

SEQ ID NO: 110966 - RNA, 21 nt, Human
guggcucugccaggacugaaa

SEQ ID NO: 110967 - RNA, 22 nt, Human
guggcucuggcuuuccaggcgg

SEQ ID NO: 110968 - RNA, 22 nt, Human
guggcugaguggucgagucaga

SEQ ID NO: 110969 - RNA, 22 nt, Human
guggcugcagagggcacagcau

SEQ ID NO: 110970 - RNA, 22 nt, Human
guggcugcagcccagcggcacg

SEQ ID NO: 110971 - RNA, 22 nt, Human
guggcugcagcucugaacggac

SEQ ID NO: 110972 - RNA, 22 nt, Human
guggcugcaucggggugaccag

SEQ ID NO: 110973 - RNA, 22 nt, Human
guggcugggcuccgagcggcuu

SEQ ID NO: 110974 - RNA, 22 nt, Human
guggcuucugcggugugcgcag

SEQ ID NO: 110975 - RNA, 22 nt, Human
guggcuugagcaggggcagagg

SEQ ID NO: 110976 - RNA, 22 nt, Human
guggcuuggaccagucacagug

SEQ ID NO: 110977 - RNA, 22 nt, Human
guggcuuuauaggaagaggaac

SEQ ID NO: 110978 - RNA, 22 nt, Human
gugggaagaacuucaaguggcu

SEQ ID NO: 110979 - RNA, 22 nt, Human
gugggaagagccaauuggggua

SEQ ID NO: 110980 - RNA, 22 nt, Human
gugggaagucucucggaggaag

SEQ ID NO: 110981 - RNA, 22 nt, Human
gugggacaaggaugaagauauu

SEQ ID NO: 110982 - RNA, 22 nt, Human
gugggagaaauuagcucuaguu

SEQ ID NO: 110983 - RNA, 22 nt, Human
gugggagccauuuccaguaugc

SEQ ID NO: 110984 - RNA, 22 nt, Human
gugggcagaacauuuguaggcu

SEQ ID NO: 110985 - RNA, 20 nt, Human
gugggcagaugugugcaugg

SEQ ID NO: 110986 - RNA, 22 nt, Human
gugggcaggaggcccugcccug

SEQ ID NO: 110987 - RNA, 22 nt, Human
gugggcagugccugacggauga

SEQ ID NO: 110988 - RNA, 22 nt, Human
gugggcagugguuugcgcgguc

SEQ ID NO: 110989 - RNA, 22 nt, Human
gugggcaguucaauucugggag

SEQ ID NO: 110990 - RNA, 22 nt, Human
gugggccacugggaggcaaggg

SEQ ID NO: 110991 - RNA, 22 nt, Human
gugggccagcauuuugaagagu

SEQ ID NO: 110992 - RNA, 22 nt, Human
gugggccaggacccgcuguccg

SEQ ID NO: 110993 - RNA, 22 nt, Human
gugggccaggccggagugcaga

SEQ ID NO: 110994 - RNA, 22 nt, Human
gugggccaggcgucuaggcccu

SEQ ID NO: 110995 - RNA, 22 nt, Human
gugggccuccccuuuacgagcc

SEQ ID NO: 110996 - RNA, 22 nt, Human
gugggcucaggccucugugggg

SEQ ID NO: 110997 - RNA, 22 nt, Human
gugggcuccccuggcaugucca

SEQ ID NO: 110998 - RNA, 22 nt, Human
gugggcugcccuugaggucagc

SEQ ID NO: 110999 - RNA, 22 nt, Human
gugggcuggacccuccugcucc

SEQ ID NO: 111000 - RNA, 22 nt, Human
gugggcuuugcuggauccuucc

SEQ ID NO: 111001 - RNA, 22 nt, Human
guggggaaaggaguggggcuca

SEQ ID NO: 111002 - RNA, 22 nt, Human
guggggaggcauucuucucccu

SEQ ID NO: 111003 - RNA, 22 nt, Human
guggggaguguucugugauugg

SEQ ID NO: 111004 - RNA, 22 nt, Human
guggggcaugcacgcugcuccu

SEQ ID NO: 111005 - RNA, 22 nt, Human
guggggcuaaaaacugugcagu

SEQ ID NO: 111006 - RNA, 22 nt, Human
guggggcucccaucuccuggcu

SEQ ID NO: 111007 - RNA, 22 nt, Human
guggggcugaguggagccagaa

SEQ ID NO: 111008 - RNA, 22 nt, Human
guggggcuggaagauggguacu

SEQ ID NO: 111009 - RNA, 22 nt, Human
gugggggaugcugaguuggaaa

SEQ ID NO: 111010 - RNA, 22 nt, Human
guggggggagcugcaagcugga

SEQ ID NO: 111011 - RNA, 22 nt, Human
gugggguagaucuuucucagga

SEQ ID NO: 111012 - RNA, 22 nt, Human
guggggugggcugaguuaggcc

SEQ ID NO: 111013 - RNA, 22 nt, Human
gugggugcugucaggcagggaa

SEQ ID NO: 111014 - RNA, 22 nt, Human
guggguggaggcgucgagggca

SEQ ID NO: 111015 - RNA, 22 nt, Human
guggguggaucaugaggucagg

SEQ ID NO: 111016 - RNA, 22 nt, Human
gugggugucaguaucuuuaacg

SEQ ID NO: 111017 - RNA, 22 nt, Human
gugggugucucaagaauggggg

SEQ ID NO: 111018 - RNA, 22 nt, Human
gugggugugauaagaccaaggg

SEQ ID NO: 111019 - RNA, 22 nt, Human
gugguaaucggauucuuaccgg

SEQ ID NO: 111020 - RNA, 22 nt, Human
gugguaccaguaggucagccau

SEQ ID NO: 111021 - RNA, 20 nt, Human
gugguauucaguaacaguga

SEQ ID NO: 111022 - RNA, 22 nt, Human
guggucagaauggagcccagga

SEQ ID NO: 111023 - RNA, 22 nt, Human
guggucagcagcagugggagug

SEQ ID NO: 111024 - RNA, 22 nt, Human
guggucaggcagugggagagaa

SEQ ID NO: 111025 - RNA, 22 nt, Human
guggucaggggcuguggcuaug

SEQ ID NO: 111026 - RNA, 22 nt, Human
guggucauggaagguccuaccu

SEQ ID NO: 111027 - RNA, 22 nt, Human
gugguccccagagcuguguaca

SEQ ID NO: 111028 - RNA, 22 nt, Human
guggucccuucuggcccugguc

SEQ ID NO: 111029 - RNA, 22 nt, Human
gugguccugcacccgcuuggcc

SEQ ID NO: 111030 - RNA, 22 nt, Human
gugguccugccagccaggucca

SEQ ID NO: 111031 - RNA, 22 nt, Human
guggugcaggccagcaggggcg

SEQ ID NO: 111032 - RNA, 22 nt, Human
ucuguucagcugccucagggua

SEQ ID NO: 111033 - RNA, 22 nt, Human
ucuguucagguuucagagaacu

SEQ ID NO: 111034 - RNA, 22 nt, Human
ucuguucauacagaguauagua

SEQ ID NO: 111035 - RNA, 22 nt, Human
ucuguucaugucuuuuuaagug

SEQ ID NO: 111036 - RNA, 22 nt, Human
ucuguuccuggucucuggagcu

SEQ ID NO: 111037 - RNA, 18 nt, Human
ucuguugagcagagaggc

SEQ ID NO: 111038 - RNA, 22 nt, Human
ucuguugcauaugcugcugggu

SEQ ID NO: 111039 - RNA, 21 nt, Human
ucuguuggaggccucucuucc

SEQ ID NO: 111040 - RNA, 22 nt, Human
ucuguuggcuugagauuuaauu

SEQ ID NO: 111041 - RNA, 22 nt, Human
ucuguuggcuuuuuaaaguugu

SEQ ID NO: 111042 - RNA, 22 nt, Human
ucuguuuagaugcuuuaucugu

SEQ ID NO: 111043 - RNA, 22 nt, Human
ucuguuuauauuucaaaccuuc

SEQ ID NO: 111044 - RNA, 22 nt, Human
ucuguuuccucuuguguaaagu

SEQ ID NO: 111045 - RNA, 22 nt, Human
ucuguuucuucuucuguuauau

SEQ ID NO: 111046 - RNA, 22 nt, Human
ucuguuuucauuugucuugaga

SEQ ID NO: 111047 - RNA, 22 nt, Human
ucuguuuuggucaccuuuauau

SEQ ID NO: 111048 - RNA, 22 nt, Human
ucuguuuuguaccagauacagc

SEQ ID NO: 111049 - RNA, 22 nt, Human
ucuguuuugugucucucuggug

SEQ ID NO: 111050 - RNA, 22 nt, Human
ucuuaaaccacacaugugcucu

SEQ ID NO: 111051 - RNA, 22 nt, Human
ucuuaaaggcacauagugucua

SEQ ID NO: 111052 - RNA, 22 nt, Human
ucuuaacuaucauuugaacacc

SEQ ID NO: 111053 - RNA, 22 nt, Human
ucuuaaugcuagccaauagaga

SEQ ID NO: 111054 - RNA, 22 nt, Human
ucuuacaagaaauaagccaaug

SEQ ID NO: 111055 - RNA, 22 nt, Human
ucuuacaagucacccgcuuucu

SEQ ID NO: 111056 - RNA, 22 nt, Human
ucuuacauauagcaugaguaca

SEQ ID NO: 111057 - RNA, 22 nt, Human
ucuuagaaaaaugguauguuuu

SEQ ID NO: 111058 - RNA, 22 nt, Human
ucuuagaaacuguaucgauuag

SEQ ID NO: 111059 - RNA, 22 nt, Human
ucuuagauguuagcucugugug

SEQ ID NO: 111060 - RNA, 22 nt, Human
ucuuagcaaauuuucuuugccu

SEQ ID NO: 111061 - RNA, 20 nt, Human
ucuuagcaucacuugcuuaa

SEQ ID NO: 111062 - RNA, 22 nt, Human
ucuuagucacagaggugagaaa

SEQ ID NO: 111063 - RNA, 22 nt, Human
guguccacggcugagaaugauu

SEQ ID NO: 111064 - RNA, 22 nt, Human
guguccaguuuuuucucugcug

SEQ ID NO: 111065 - RNA, 22 nt, Human
guguccaucagcagccacugug

SEQ ID NO: 111066 - RNA, 22 nt, Human
guguccauguuguucaggguga

SEQ ID NO: 111067 - RNA, 22 nt, Human
gugucccaggccucuggaauua

SEQ ID NO: 111068 - RNA, 22 nt, Human
guguccugaucaauugagcugg

SEQ ID NO: 111069 - RNA, 22 nt, Human
guguccugggcugguagagcug

SEQ ID NO: 111070 - RNA, 22 nt, Human
guguccuuauaagaagagaugc

SEQ ID NO: 111071 - RNA, 18 nt, Human
guguccuuugcaagaaac

SEQ ID NO: 111072 - RNA, 22 nt, Human
guguccuuuugaggguccacag

SEQ ID NO: 111073 - RNA, 22 nt, Human
gugucuauaaugaaaugcacuu

SEQ ID NO: 111074 - RNA, 22 nt, Human
gugucucuaucuaugccugaag

SEQ ID NO: 111075 - RNA, 22 nt, Human
gugucugcucagcuugcuagaa

SEQ ID NO: 111076 - RNA, 22 nt, Human
gugucugcuugcugagcauuua

SEQ ID NO: 111077 - RNA, 18 nt, Human
gugucuuauuacaguggg

SEQ ID NO: 111078 - RNA, 22 nt, Human
gugucuuuugaggcugaccagu

SEQ ID NO: 111079 - RNA, 22 nt, Human
gugugaaaaugugcacaauaug

SEQ ID NO: 111080 - RNA, 22 nt, Human
gugugaaaguaauugcgguuuu

SEQ ID NO: 111081 - RNA, 22 nt, Human
gugugaaaugguucucuuuguu

SEQ ID NO: 111082 - RNA, 20 nt, Human
gugugaccuccuguggaugc

SEQ ID NO: 111083 - RNA, 22 nt, Human
gugugagaagggaauguaaagc

SEQ ID NO: 111084 - RNA, 22 nt, Human
gugugagagaagcugccaugga

SEQ ID NO: 111085 - RNA, 22 nt, Human
gugugagggacagagaaagggg

SEQ ID NO: 111086 - RNA, 21 nt, Human
gugugaguagcaugugucuca

SEQ ID NO: 111087 - RNA, 23 nt, Human
gugugcaggauuauuugcagaca

SEQ ID NO: 111088 - RNA, 22 nt, Human
gugugcaggcuugaggauuagg

SEQ ID NO: 111089 - RNA, 18 nt, Human
gugugcaguugcaggggu

SEQ ID NO: 111090 - RNA, 22 nt, Human
gugugcauauguguggcucucc

SEQ ID NO: 111091 - RNA, 22 nt, Human
gugugcaucuugguaauggagc

SEQ ID NO: 111092 - RNA, 22 nt, Human
gugugccaacaaaagacagugc

SEQ ID NO: 111093 - RNA, 23 nt, Human
gugugccaagcacugugccagga

SEQ ID NO: 111094 - RNA, 22 nt, Human
gugugcgcgcgcgucccgggug

SEQ ID NO: 111095 - RNA, 22 nt, Human
gugugcgcgcucauaggugugu

SEQ ID NO: 111096 - RNA, 22 nt, Human
gugugcguuccuaguaaacgug

SEQ ID NO: 111097 - RNA, 22 nt, Human
gugugcucaagggcaggaaccu

SEQ ID NO: 111098 - RNA, 22 nt, Human
gugugcucuggaggcuagauuu

SEQ ID NO: 111099 - RNA, 21 nt, Human
gugugcugauacauuggagaa

SEQ ID NO: 111100 - RNA, 22 nt, Human
guguggaaagaguggccucuca

SEQ ID NO: 111101 - RNA, 21 nt, Human
guguggauaugugacaggugg

SEQ ID NO: 111102 - RNA, 22 nt, Human
guguggcaaggugagaaguggg

SEQ ID NO: 111103 - RNA, 19 nt, Human
guguggcagagagugacca

SEQ ID NO: 111104 - RNA, 23 nt, Human
guguggccccagggccuccucgc

SEQ ID NO: 111105 - RNA, 22 nt, Human
guguggcuaccucagaggagca

SEQ ID NO: 111106 - RNA, 22 nt, Human
guguggcugauugacaugguca

SEQ ID NO: 111107 - RNA, 22 nt, Human
gugugggaaggcuaggaugcug

SEQ ID NO: 111108 - RNA, 22 nt, Human
gugugggcugcagaggcacagc

SEQ ID NO: 111109 - RNA, 22 nt, Human
gugugggggcagcucugauaug

SEQ ID NO: 111110 - RNA, 22 nt, Human
guguggggucuucucuuggccu

SEQ ID NO: 111111 - RNA, 22 nt, Human
guguggguguacuguucuagau

SEQ ID NO: 111112 - RNA, 22 nt, Human
guguguaaugcuuauugugcuu

SEQ ID NO: 111113 - RNA, 22 nt, Human
guguguacaaauuucauguaaa

SEQ ID NO: 111114 - RNA, 22 nt, Human
guguguauguagaacuauguau

SEQ ID NO: 111115 - RNA, 22 nt, Human
guguguauuauugcauacacau

SEQ ID NO: 111116 - RNA, 22 nt, Human
gugugucagagcucagagaagu

SEQ ID NO: 111117 - RNA, 22 nt, Human
guguguccaaggcacggaugac

SEQ ID NO: 111118 - RNA, 22 nt, Human
gugugucccuccucuccugagu

SEQ ID NO: 111119 - RNA, 22 nt, Human
guguguccucaguaguggcaug

SEQ ID NO: 111120 - RNA, 22 nt, Human
guguguccuguuuuaaaauagu

SEQ ID NO: 111121 - RNA, 22 nt, Human
gugugucuuucauuucaugagg

SEQ ID NO: 111122 - RNA, 22 nt, Human
guguguggaaugcucauuuauu

SEQ ID NO: 111123 - RNA, 22 nt, Human
guguguggcaaacugggccugc

SEQ ID NO: 111124 - RNA, 22 nt, Human
gugugugugccugcacacacac

SEQ ID NO: 111125 - RNA, 22 nt, Human
guguguguucaauaaauuuaag

SEQ ID NO: 111126 - RNA, 22 nt, Human
guguuaaaaaucccaugauaug

SEQ ID NO: 111127 - RNA, 22 nt, Human
guguuaaaaugcuuuauaguag

SEQ ID NO: 111128 - RNA, 22 nt, Human
guguuaaacauguucacagcau

SEQ ID NO: 111129 - RNA, 22 nt, Human
guguuaauggcuaugaacugau

SEQ ID NO: 111130 - RNA, 22 nt, Human
guguuacauauucuaaaaugcu

SEQ ID NO: 111131 - RNA, 22 nt, Human
guguuacucaagagauagcuuu

SEQ ID NO: 111132 - RNA, 22 nt, Human
guguuacugacacauuuuuguc

SEQ ID NO: 111133 - RNA, 23 nt, Human
guguucaucccagucugugcaau

SEQ ID NO: 111134 - RNA, 22 nt, Human
guguuccuggacagcaagugag

SEQ ID NO: 111135 - RNA, 22 nt, Human
guguucucuagagcuguacaaa

SEQ ID NO: 111136 - RNA, 22 nt, Human
guguucucucuacaggaauuua

SEQ ID NO: 111137 - RNA, 22 nt, Human
guguugacacagccaucuuguc

SEQ ID NO: 111138 - RNA, 22 nt, Human
guguugcucuguuuggggguug

SEQ ID NO: 111139 - RNA, 22 nt, Human
guguuuacagauaaagugagcu

SEQ ID NO: 111140 - RNA, 19 nt, Human
guguuuacugugugcagaa

SEQ ID NO: 111141 - RNA, 22 nt, Human
guuccauaucacagcagacgaa

SEQ ID NO: 111142 - RNA, 22 nt, Human
guucccaugccuccaagcuuca

SEQ ID NO: 111143 - RNA, 22 nt, Human
guucccauuggggaucuugggc

SEQ ID NO: 111144 - RNA, 22 nt, Human
guuccccuuguguuguugccca

SEQ ID NO: 111145 - RNA, 22 nt, Human
guucccuuucguauggacuggg

SEQ ID NO: 111146 - RNA, 22 nt, Human
guuccuaaccagcagagaaaca

SEQ ID NO: 111147 - RNA, 22 nt, Human
guuccuaagcuguggcccugga

SEQ ID NO: 111148 - RNA, 22 nt, Human
guuccucaguuguaaaaaaugu

SEQ ID NO: 111149 - RNA, 22 nt, Human
guuccucaugaguaccccuuaa

SEQ ID NO: 111150 - RNA, 22 nt, Human
guuccugaagggacuggugcag

SEQ ID NO: 111151 - RNA, 22 nt, Human
guuccugacuguggaguuuggu

SEQ ID NO: 111152 - RNA, 22 nt, Human
guuccuuggaagaacuugaggu

SEQ ID NO: 111153 - RNA, 22 nt, Human
guucguugcuugguuuccucua

SEQ ID NO: 111154 - RNA, 22 nt, Human
guucuaagggcuugaaauguau

SEQ ID NO: 111155 - RNA, 22 nt, Human
guucuaauuuggggcuccuuag

SEQ ID NO: 111156 - RNA, 21 nt, Human
guucuacaguuuuagaauucc

SEQ ID NO: 111157 - RNA, 22 nt, Human
guucuagaugacugagcagcug

SEQ ID NO: 111158 - RNA, 22 nt, Human
guucuauucauugcuccacgag

SEQ ID NO: 111159 - RNA, 22 nt, Human
guucuauuucaguaagcaggca

SEQ ID NO: 111160 - RNA, 21 nt, Human
guucuauuuugcaaacuucug

SEQ ID NO: 111161 - RNA, 20 nt, Human
guucucacugaucugcaggg

SEQ ID NO: 111162 - RNA, 22 nt, Human
guucucauaguggaaaauaggu

SEQ ID NO: 111163 - RNA, 22 nt, Human
guucucucucuugccugggugg

SEQ ID NO: 111164 - RNA, 22 nt, Human
guucucucugcuuccaagaugg

SEQ ID NO: 111165 - RNA, 22 nt, Human
guucugaaugugccuguacucu

SEQ ID NO: 111166 - RNA, 22 nt, Human
guucugcacaucacacaggugc

SEQ ID NO: 111167 - RNA, 22 nt, Human
guucugcagacuuggaaggugg

SEQ ID NO: 111168 - RNA, 22 nt, Human
guucuggaaagcaagaaagagu

SEQ ID NO: 111169 - RNA, 22 nt, Human
guucuggaggagagccuggugu

SEQ ID NO: 111170 - RNA, 21 nt, Human
guucuggaggcugcaagucca

SEQ ID NO: 111171 - RNA, 22 nt, Human
guucuggaguggugccaggccu

SEQ ID NO: 111172 - RNA, 22 nt, Human
guucugggagaucuugagcuuc

SEQ ID NO: 111173 - RNA, 22 nt, Human
guucugucugagcaccacagga

SEQ ID NO: 111174 - RNA, 22 nt, Human
guucuuaaagauucaucaagca

SEQ ID NO: 111175 - RNA, 21 nt, Human
guucuuaguuauauucucaau

SEQ ID NO: 111176 - RNA, 22 nt, Human
guucuucacauuucauugagga

SEQ ID NO: 111177 - RNA, 22 nt, Human
guucuucagauuccauuucagu

SEQ ID NO: 111178 - RNA, 22 nt, Human
guucuucagcauuagaagucau

SEQ ID NO: 111179 - RNA, 22 nt, Human
guucuucaggccauccucccag

SEQ ID NO: 111180 - RNA, 22 nt, Human
guucuccaggggcuguucaucu

SEQ ID NO: 111181 - RNA, 22 nt, Human
guucuccauucagcuuccugug

SEQ ID NO: 111182 - RNA, 22 nt, Human
guucuccuggcucccacccugc

SEQ ID NO: 111183 - RNA, 22 nt, Human
guucucguuucugaagaaaagu

SEQ ID NO: 111184 - RNA, 22 nt, Human
guucucucaaacuuuguguuug

SEQ ID NO: 111185 - RNA, 16 nt, Human
guucucucacuguacc

SEQ ID NO: 111186 - RNA, 22 nt, Human
guucucucagccuuuguuauua

SEQ ID NO: 111187 - RNA, 22 nt, Human
guucucugaguccuggcaaaau

SEQ ID NO: 111188 - RNA, 22 nt, Human
guucucugccggcaccuacccg

SEQ ID NO: 111189 - RNA, 22 nt, Human
guucugccuguggcuucugugg

SEQ ID NO: 111190 - RNA, 22 nt, Human
guucugcuguaauaucucugcu

SEQ ID NO: 111191 - RNA, 22 nt, Human
guucugcugugucucagcaggu

SEQ ID NO: 111192 - RNA, 22 nt, Human
guucugcuuaaauuauugaucc

SEQ ID NO: 111193 - RNA, 22 nt, Human
guucugcuuccuugcuugcgca

SEQ ID NO: 111194 - RNA, 22 nt, Human
guucuggaagcuuuugagcaac

SEQ ID NO: 111195 - RNA, 22 nt, Human
guucugggugaugagguuggcu

SEQ ID NO: 111196 - RNA, 22 nt, Human
guucuggguucuggguuauugg

SEQ ID NO: 111197 - RNA, 22 nt, Human
guucuguccuccuaccaggcau

SEQ ID NO: 111198 - RNA, 22 nt, Human
guucuuaagaccacaauaaaaa

SEQ ID NO: 111199 - RNA, 22 nt, Human
guucuucagaggggaaagaacc

SEQ ID NO: 111200 - RNA, 22 nt, Human
guucuucagcccucagguccua

SEQ ID NO: 111201 - RNA, 22 nt, Human
guucuucagucacaucacagaa

SEQ ID NO: 111202 - RNA, 22 nt, Human
guucuucauuacaagggaacca

SEQ ID NO: 111203 - RNA, 22 nt, Human
guucuuccucauugcuuugaag

SEQ ID NO: 111204 - RNA, 22 nt, Human
guucuuggaccagcagcauuga

SEQ ID NO: 111205 - RNA, 22 nt, Human
guugaaagagcauggacuugaa

SEQ ID NO: 111206 - RNA, 22 nt, Human
guugaauauaccugcauuugug

SEQ ID NO: 111207 - RNA, 22 nt, Human
guugaauaucguguucuuguuu

SEQ ID NO: 111208 - RNA, 22 nt, Human
guugaauauuuuaagaguuuug

SEQ ID NO: 111209 - RNA, 22 nt, Human
guugaggaggcacucacuguca

SEQ ID NO: 111210 - RNA, 22 nt, Human
guugaggagguucagggugguu

SEQ ID NO: 111211 - RNA, 22 nt, Human
guugaguggguuaggaugcuga

SEQ ID NO: 111212 - RNA, 22 nt, Human
guugauuugaagagcagaaagu

SEQ ID NO: 111213 - RNA, 22 nt, Human
guugcaaacuccuacuucucau

SEQ ID NO: 111214 - RNA, 22 nt, Human
guugcaaaugggaagaugguua

SEQ ID NO: 111215 - RNA, 22 nt, Human
guugcaggaggauggcugcaua

SEQ ID NO: 111216 - RNA, 22 nt, Human
guugcauuaaucugcucaggcu

SEQ ID NO: 111217 - RNA, 22 nt, Human
guugcucaaugggaauaagaau

SEQ ID NO: 111218 - RNA, 22 nt, Human
guugcugauuaacacuuugagu

SEQ ID NO: 111219 - RNA, 22 nt, Human
guugcuuguuaguggugagguu

SEQ ID NO: 111220 - RNA, 22 nt, Human
guuggaagaagacuguaaauua

SEQ ID NO: 111221 - RNA, 22 nt, Human
guuggcaaguguuccuuccucu

SEQ ID NO: 111222 - RNA, 19 nt, Human
guuggcacugaaaauggcu

SEQ ID NO: 111223 - RNA, 22 nt, Human
guuggcuauagggagauggggc

SEQ ID NO: 111224 - RNA, 22 nt, Human
guuggcuaugagagcuuuagug

SEQ ID NO: 111225 - RNA, 18 nt, Human
guuggcugcuguggcugg

SEQ ID NO: 111226 - RNA, 22 nt, Human
guugggccccagagguccaggc

SEQ ID NO: 111227 - RNA, 22 nt, Human
guugggcucauuacagccugcu

SEQ ID NO: 111228 - RNA, 22 nt, Human
guugggguaccuugaggcuggg

SEQ ID NO: 111229 - RNA, 22 nt, Human
guuggugaguuucugaucacaa

SEQ ID NO: 111230 - RNA, 22 nt, Human
guuguacaauuguuucacaugc

SEQ ID NO: 111231 - RNA, 22 nt, Human
guuguacaggcagggaaacuga

SEQ ID NO: 111232 - RNA, 22 nt, Human
guuguauagagggcaugaaucu

SEQ ID NO: 111233 - RNA, 22 nt, Human
guuguauauguagagaaugguc

SEQ ID NO: 111234 - RNA, 22 nt, Human
guuguauuugccugaaugcagu

SEQ ID NO: 111235 - RNA, 22 nt, Human
guugucagguaaaacaguaugg

SEQ ID NO: 111236 - RNA, 22 nt, Human
guugucaucaccguuguuauca

SEQ ID NO: 111237 - RNA, 22 nt, Human
guugugauuguagcuaaacuag

SEQ ID NO: 111238 - RNA, 22 nt, Human
guugugcaaacacuggggucug

SEQ ID NO: 111239 - RNA, 22 nt, Human
guugugcauuuaugaagaaguu

SEQ ID NO: 111240 - RNA, 21 nt, Human
guugugguuggggcugcagcu

SEQ ID NO: 111241 - RNA, 22 nt, Human
guuguuuuauaauugauugcaa

SEQ ID NO: 111242 - RNA, 22 nt, Human
guuguuuuauugugagucccau

SEQ ID NO: 111243 - RNA, 22 nt, Human
guuguuuucagcaguuuaugac

SEQ ID NO: 111244 - RNA, 22 nt, Human
guuguuuugcaggauccuuaca

SEQ ID NO: 111245 - RNA, 22 nt, Human
guuguuuugcugucugucuuag

SEQ ID NO: 111246 - RNA, 22 nt, Human
guuuaaaguagcuuccuuuugg

SEQ ID NO: 111247 - RNA, 22 nt, Human
guuuaacugggagugugggaaa

SEQ ID NO: 111248 - RNA, 22 nt, Human
guuuaagaaaauucauguuguu

SEQ ID NO: 111249 - RNA, 22 nt, Human
guuuaauucccacaccugcccu

SEQ ID NO: 111250 - RNA, 22 nt, Human
uacagcugaguuuagguacagg

SEQ ID NO: 111251 - RNA, 22 nt, Human
uacagcuuaaaagaugcauuua

SEQ ID NO: 111252 - RNA, 22 nt, Human
uacagcuuauccagcuugauag

SEQ ID NO: 111253 - RNA, 22 nt, Human
uacagcuucagugugccccagu

SEQ ID NO: 111254 - RNA, 22 nt, Human
uacagcuugacccauaaugucu

SEQ ID NO: 111255 - RNA, 22 nt, Human
uacagcuuuauacccaucaaaa

SEQ ID NO: 111256 - RNA, 22 nt, Human
uacagcuuuugcagcuguuuug

SEQ ID NO: 111257 - RNA, 22 nt, Human
uacaggaacugggcaggacauu

SEQ ID NO: 111258 - RNA, 22 nt, Human
uacaggaaggagcacaucggga

SEQ ID NO: 111259 - RNA, 22 nt, Human
uacaggaaguuacagacuauga

SEQ ID NO: 111260 - RNA, 22 nt, Human
uacaggacagauguuuacagga

SEQ ID NO: 111261 - RNA, 22 nt, Human
uacaggacauugugcauuuguc

SEQ ID NO: 111262 - RNA, 20 nt, Human
uacaggagugaguggguggg

SEQ ID NO: 111263 - RNA, 22 nt, Human
uacaggauaucacuucauuucu

SEQ ID NO: 111264 - RNA, 19 nt, Human
uacaggauccucauacagu

SEQ ID NO: 111265 - RNA, 22 nt, Human
uacaggcauguagcauggugau

SEQ ID NO: 111266 - RNA, 22 nt, Human
uacaggcuagggagagugacug

SEQ ID NO: 111267 - RNA, 20 nt, Human
uacaggcucugagagaugau

SEQ ID NO: 111268 - RNA, 22 nt, Human
uacaggcugcagggcuagaggg

SEQ ID NO: 111269 - RNA, 22 nt, Human
uacagggaaugggacauaaauc

SEQ ID NO: 111270 - RNA, 22 nt, Human
uacagggacucccgcagagaua

SEQ ID NO: 111271 - RNA, 22 nt, Human
uacaggguauagguacagauga

SEQ ID NO: 111272 - RNA, 22 nt, Human
uacaggugguaaaaauauuguu

SEQ ID NO: 111273 - RNA, 22 nt, Human
uacagguuccaggaauuaggac

SEQ ID NO: 111274 - RNA, 22 nt, Human
uacaguaacauguuguacaagc

SEQ ID NO: 111275 - RNA, 22 nt, Human
uacaguaagaugaaauagcaau

SEQ ID NO: 111276 - RNA, 22 nt, Human
uacaguaauaaaaugagcuaca

SEQ ID NO: 111277 - RNA, 22 nt, Human
uacaguaccagaaaugcuaaga

SEQ ID NO: 111278 - RNA, 22 nt, Human
uacaguacccugaugaacuaaa

SEQ ID NO: 111279 - RNA, 22 nt, Human
uacaguagaaugcggugccagu

SEQ ID NO: 111280 - RNA, 22 nt, Human
uacaguagacaauguuaguaug

SEQ ID NO: 111281 - RNA, 22 nt, Human
uacaguauagaauguguauuaa

SEQ ID NO: 111282 - RNA, 22 nt, Human
uacaguauauacuguguguaga

SEQ ID NO: 111283 - RNA, 22 nt, Human
uacaguauuacuguguuguuuu

SEQ ID NO: 111284 - RNA, 22 nt, Human
uacagucaauacuaggaccaua

SEQ ID NO: 111285 - RNA, 22 nt, Human
uacagucacauucugaggucuu

SEQ ID NO: 111286 - RNA, 22 nt, Human
uacagucagagugccuuucuaa

SEQ ID NO: 111287 - RNA, 22 nt, Human
uacagucucugauaacugucag

SEQ ID NO: 111288 - RNA, 22 nt, Human
uacagugacagauagggauaga

SEQ ID NO: 111289 - RNA, 21 nt, Human
uacagugagguguuaggaugu

SEQ ID NO: 111290 - RNA, 22 nt, Human
uacagugaguggcagagccaga

SEQ ID NO: 111291 - RNA, 22 nt, Human
uacagugauagagaguagcuau

SEQ ID NO: 111292 - RNA, 22 nt, Human
uacagugcaaugugauguagau

SEQ ID NO: 111293 - RNA, 22 nt, Human
uacagugcacauuucuuaggaa

SEQ ID NO: 111294 - RNA, 22 nt, Human
uacagugcuagaaccugcugua

SEQ ID NO: 111295 - RNA, 22 nt, Human
uacagugcuuuuugguggagaa

SEQ ID NO: 111296 - RNA, 22 nt, Human
uacaguuacuguuauaugugcu

SEQ ID NO: 111297 - RNA, 20 nt, Human
uacaguucuguagaaguaga

SEQ ID NO: 111298 - RNA, 22 nt, Human
uacaguuuaacacuuuggagaa

SEQ ID NO: 111299 - RNA, 22 nt, Human
uacaguuucccagcagaugcaa

SEQ ID NO: 111300 - RNA, 22 nt, Human
uacaguuucucauuaugcucuc

SEQ ID NO: 111301 - RNA, 22 nt, Human
uacaguuuguauggucaggaau

SEQ ID NO: 111302 - RNA, 22 nt, Human
uacaguuuguuacauuguuagu

SEQ ID NO: 111303 - RNA, 22 nt, Human
uacauaauuaaucuuuaaguuc

SEQ ID NO: 111304 - RNA, 22 nt, Human
uacauaauugucuuuguccuca

SEQ ID NO: 111305 - RNA, 22 nt, Human
uacauagagaaguuacagugga

SEQ ID NO: 111306 - RNA, 21 nt, Human
uacauagaggugauaucuguu

SEQ ID NO: 111307 - RNA, 22 nt, Human
uacauagugaacauuuacagag

SEQ ID NO: 111308 - RNA, 22 nt, Human
uacauaguguuuugaagaauua

SEQ ID NO: 111309 - RNA, 22 nt, Human
uacauauuugucuuuguacugu

SEQ ID NO: 111310 - RNA, 22 nt, Human
uacaucauggcuucaugcugca

SEQ ID NO: 111311 - RNA, 22 nt, Human
uacaucauuuuggagaugagca

SEQ ID NO: 111312 - RNA, 22 nt, Human
uacauccaaaguugaggugccu

SEQ ID NO: 111313 - RNA, 19 nt, Human
uacauccggguuacuuaag

SEQ ID NO: 111314 - RNA, 22 nt, Human
uacaucuauacugaucuacauu

SEQ ID NO: 111315 - RNA, 22 nt, Human
uacaucuauuugacagauacag

SEQ ID NO: 111316 - RNA, 22 nt, Human
uacaucucaucugugcucuccg

SEQ ID NO: 111317 - RNA, 22 nt, Human
uacaugaaccuuuaugugugau

SEQ ID NO: 111318 - RNA, 22 nt, Human
uacaugaauguuucaauauugu

SEQ ID NO: 111319 - RNA, 22 nt, Human
uacaugacauuucuuucuguuc

SEQ ID NO: 111320 - RNA, 22 nt, Human
uacaugaccuagacuugcuaaa

SEQ ID NO: 111321 - RNA, 22 nt, Human
uacaugagggcacucugcaucu

SEQ ID NO: 111322 - RNA, 22 nt, Human
uacaugcaauuaagagggugaa

SEQ ID NO: 111323 - RNA, 22 nt, Human
uacaugcuccuuaugagaaucu

SEQ ID NO: 111324 - RNA, 22 nt, Human
uacaugcuggugacuguagaca

SEQ ID NO: 111325 - RNA, 22 nt, Human
uacaugcuuaaaaugcaauguu

SEQ ID NO: 111326 - RNA, 22 nt, Human
uacauguaggugacauuuuaau

SEQ ID NO: 111327 - RNA, 22 nt, Human
uacauguaguucacugguggca

SEQ ID NO: 111328 - RNA, 22 nt, Human
uacauguauguguacgugcaug

SEQ ID NO: 111329 - RNA, 22 nt, Human
uacaugugauaaauugauuaaa

SEQ ID NO: 111330 - RNA, 22 nt, Human
uacaugugcacgugugacuuug

SEQ ID NO: 111331 - RNA, 22 nt, Human
uacauguggagauaacugaagc

SEQ ID NO: 111332 - RNA, 22 nt, Human
uacauguggaguuuucuaguca

SEQ ID NO: 111333 - RNA, 22 nt, Human
uacauguuauuucacuauuggu

SEQ ID NO: 111334 - RNA, 22 nt, Human
uacauguuugguaaaugauggc

SEQ ID NO: 111335 - RNA, 22 nt, Human
uacauuaucuuguuaucuuuca

SEQ ID NO: 111336 - RNA, 22 nt, Human
uacauucacuuguugaaggugg

SEQ ID NO: 111337 - RNA, 22 nt, Human
uacauucagaagaauggacacg

SEQ ID NO: 111338 - RNA, 22 nt, Human
uacauucauaugugugcauaca

SEQ ID NO: 111339 - RNA, 23 nt, Human
uacauucauuugcacagccagua

SEQ ID NO: 111340 - RNA, 22 nt, Human
uacauuccugggcuccacccua

SEQ ID NO: 111341 - RNA, 22 nt, Human
uacauucuacuuuuucacuccc

SEQ ID NO: 111342 - RNA, 23 nt, Human
uacauucuguauuuuuauagagu

SEQ ID NO: 111343 - RNA, 22 nt, Human
uacauugaacuaugaguucagu

SEQ ID NO: 111344 - RNA, 22 nt, Human
uacauugaauuuuuuagcaugu

SEQ ID NO: 111345 - RNA, 22 nt, Human
uacauugacugugugcaucaca

SEQ ID NO: 111346 - RNA, 22 nt, Human
uacauugacuuggauuguuaga

SEQ ID NO: 111347 - RNA, 22 nt, Human
uacauugagaaccacugcuuag

SEQ ID NO: 111348 - RNA, 22 nt, Human
uacauugaggcaguagcuggag

SEQ ID NO: 111349 - RNA, 22 nt, Human
uacauugauggaguaccuagcu

SEQ ID NO: 111350 - RNA, 20 nt, Human
uacauuguagaaauauucaa

SEQ ID NO: 111351 - RNA, 23 nt, Human
uacauuguggauggaguccuggg

SEQ ID NO: 111352 - RNA, 22 nt, Human
uacauugugucucuaucuaguc

SEQ ID NO: 111353 - RNA, 22 nt, Human
uacauuuacagagccuucucug

SEQ ID NO: 111354 - RNA, 22 nt, Human
uacauuucagagcuccucucug

SEQ ID NO: 111355 - RNA, 22 nt, Human
uacauuuggaugugcuuaagug

SEQ ID NO: 111356 - RNA, 19 nt, Human
uacauuuguguacacuugu

SEQ ID NO: 111357 - RNA, 22 nt, Human
uacauuuguuauagaaaugaag

SEQ ID NO: 111358 - RNA, 22 nt, Human
uacauuuucuaggggaccaaga

SEQ ID NO: 111359 - RNA, 22 nt, Human
uagcaucagccacaccuuguac

SEQ ID NO: 111360 - RNA, 22 nt, Human
uagcaucuaacaucuuaggacu

SEQ ID NO: 111361 - RNA, 22 nt, Human
uagcaucuggagaaacaagucc

SEQ ID NO: 111362 - RNA, 22 nt, Human
uagcaucuguacugacauaauc

SEQ ID NO: 111363 - RNA, 22 nt, Human
uagcauuucccaaaugcauuug

SEQ ID NO: 111364 - RNA, 22 nt, Human
uagccaggcgaggucagugucg

SEQ ID NO: 111365 - RNA, 22 nt, Human
uagccagggagacacuguggag

SEQ ID NO: 111366 - RNA, 22 nt, Human
uagccaggucacacuguguguu

SEQ ID NO: 111367 - RNA, 22 nt, Human
uagccauuuuuauuaaugcugg

SEQ ID NO: 111368 - RNA, 22 nt, Human
uagcccagaaagcaaaugucuc

SEQ ID NO: 111369 - RNA, 22 nt, Human
uagcccagagagccaggggcuu

SEQ ID NO: 111370 - RNA, 22 nt, Human
uagcccagaugauugaaccaug

SEQ ID NO: 111371 - RNA, 22 nt, Human
uagcccaggcuguagugcagug

SEQ ID NO: 111372 - RNA, 22 nt, Human
uagcccaugaugguggaaggca

SEQ ID NO: 111373 - RNA, 22 nt, Human
uagccccagcuacucggaagcu

SEQ ID NO: 111374 - RNA, 22 nt, Human
uagccgggugugguggaacucc

SEQ ID NO: 111375 - RNA, 22 nt, Human
uagccuucucaagacaaaguug

SEQ ID NO: 111376 - RNA, 22 nt, Human
uagcuacaaaucugauaagugg

SEQ ID NO: 111377 - RNA, 22 nt, Human
uagcuacacaucuaaacagcaa

SEQ ID NO: 111378 - RNA, 22 nt, Human
uagcuacacugaggcugcuuaa

SEQ ID NO: 111379 - RNA, 22 nt, Human
uagcuacauacuuggccauucu

SEQ ID NO: 111380 - RNA, 22 nt, Human
uagcuagaagguugaaagcagg

SEQ ID NO: 111381 - RNA, 22 nt, Human
uagcuagagguagauggguuag

SEQ ID NO: 111382 - RNA, 22 nt, Human
uagcuagcugcacaggcccugg

SEQ ID NO: 111383 - RNA, 22 nt, Human
uagcuaguguuuggagauggau

SEQ ID NO: 111384 - RNA, 22 nt, Human
uagcuauuuggaaaauuccaau

SEQ ID NO: 111385 - RNA, 22 nt, Human
uagcuccuccccauccagguuc

SEQ ID NO: 111386 - RNA, 22 nt, Human
uagcucugaggccaucuccggu

SEQ ID NO: 111387 - RNA, 19 nt, Human
uagcucugucuuauuccaa

SEQ ID NO: 111388 - RNA, 22 nt, Human
uagcucugugcucuggaucugu

SEQ ID NO: 111389 - RNA, 22 nt, Human
uagcucuucauuucaucugauu

SEQ ID NO: 111390 - RNA, 22 nt, Human
uagcugaagaggguauuguagg

SEQ ID NO: 111391 - RNA, 22 nt, Human
uagcugaagggcauuuaauaaa

SEQ ID NO: 111392 - RNA, 22 nt, Human
uagcugaauaaugcgucugcag

SEQ ID NO: 111393 - RNA, 22 nt, Human
uagcugacgcuaaauaaauguu

SEQ ID NO: 111394 - RNA, 19 nt, Human
uagcugccuguuaccucca

SEQ ID NO: 111395 - RNA, 22 nt, Human
uagcugcugcagcacagggagg

SEQ ID NO: 111396 - RNA, 22 nt, Human
uagcugggaauuaucugguugc

SEQ ID NO: 111397 - RNA, 22 nt, Human
uagcugguccucagcuccagcc

SEQ ID NO: 111398 - RNA, 22 nt, Human
uagcuggucuuuaagcauguaa

SEQ ID NO: 111399 - RNA, 22 nt, Human
uagcugguuaaugcagaaggag

SEQ ID NO: 111400 - RNA, 22 nt, Human
uagcugugaaacagcagaagag

SEQ ID NO: 111401 - RNA, 22 nt, Human
uagcuguggccuugcuggucug

SEQ ID NO: 111402 - RNA, 22 nt, Human
uagcuguguaagcuugguaaga

SEQ ID NO: 111403 - RNA, 22 nt, Human
uagcuguguagacacucagagc

SEQ ID NO: 111404 - RNA, 22 nt, Human
uagcuguuaauauacaaauggu

SEQ ID NO: 111405 - RNA, 22 nt, Human
uagcuguuugaaguauuuuucu

SEQ ID NO: 111406 - RNA, 22 nt, Human
uagcuuaauaugaaacacauaa

SEQ ID NO: 111407 - RNA, 19 nt, Human
uagcuucacguggucuaga

SEQ ID NO: 111408 - RNA, 22 nt, Human
uagcuucccuagcuaaagaggu

SEQ ID NO: 111409 - RNA, 22 nt, Human
uagcuucccugcuggaucauaa

SEQ ID NO: 111410 - RNA, 22 nt, Human
uagcuucuaauacuuaccaauu

SEQ ID NO: 111411 - RNA, 21 nt, Human
uagcuucuugaggcuuggccg

SEQ ID NO: 111412 - RNA, 22 nt, Human
uagcuugacuauucuaugaugu

SEQ ID NO: 111413 - RNA, 22 nt, Human
uagcuuuaggaugguucucuug

SEQ ID NO: 111414 - RNA, 22 nt, Human
uagcuuugccuguuaaucacaa

SEQ ID NO: 111415 - RNA, 22 nt, Human
uagcuuuggauucuuuggggaa

SEQ ID NO: 111416 - RNA, 22 nt, Human
uagcuuuguguccugauuuagc

SEQ ID NO: 111417 - RNA, 16 nt, Human
uagcuuuguguugugg

SEQ ID NO: 111418 - RNA, 22 nt, Human
uaggaaaaagaggcuggcaagg

SEQ ID NO: 111419 - RNA, 22 nt, Human
uaggaaaagcacaggauguucu

SEQ ID NO: 111420 - RNA, 22 nt, Human
uaggaaacauuugaagaggauu

SEQ ID NO: 111421 - RNA, 22 nt, Human
uaggaaaccaaucuuuugggag

SEQ ID NO: 111422 - RNA, 22 nt, Human
uaggaaacucaaagggaagugg

SEQ ID NO: 111423 - RNA, 22 nt, Human
uaggaaauaauucacucuggcu

SEQ ID NO: 111424 - RNA, 22 nt, Human
uaggaaaugcugucuuauugua

SEQ ID NO: 111425 - RNA, 22 nt, Human
uaggaaauugccaauauaugac

SEQ ID NO: 111426 - RNA, 22 nt, Human
uaggaacaaagagccucacauu

SEQ ID NO: 111427 - RNA, 22 nt, Human
uaggaacacagggacuugauga

SEQ ID NO: 111428 - RNA, 18 nt, Human
uaggaaccacuugcagag

SEQ ID NO: 111429 - RNA, 22 nt, Human
uaagaacauuuucggaaagaua

SEQ ID NO: 111430 - RNA, 22 nt, Human
uaagaacuuuguagccuguucu

SEQ ID NO: 111431 - RNA, 22 nt, Human
uaagaaguacaaaaauuuucug

SEQ ID NO: 111432 - RNA, 22 nt, Human
uaagaagugagugcaccuucuu

SEQ ID NO: 111433 - RNA, 22 nt, Human
uaagaagugcugaauugaauau

SEQ ID NO: 111434 - RNA, 22 nt, Human
uaagaaucaguagauauagauu

SEQ ID NO: 111435 - RNA, 22 nt, Human
uaagaaucgauguuuauuuaga

SEQ ID NO: 111436 - RNA, 22 nt, Human
uaagaaucggucgcaacagagg

SEQ ID NO: 111437 - RNA, 22 nt, Human
uaagaauuaucucauggauaau

SEQ ID NO: 111438 - RNA, 22 nt, Human
uaagaauuccaucgcagaguau

SEQ ID NO: 111439 - RNA, 19 nt, Human
uaagacacaaaugcaagcc

SEQ ID NO: 111440 - RNA, 22 nt, Human
uaagacacaguccgcacucucu

SEQ ID NO: 111441 - RNA, 22 nt, Human
uaagacacgggcugaucuaaag

SEQ ID NO: 111442 - RNA, 22 nt, Human
uaagacagggucuauucuuagu

SEQ ID NO: 111443 - RNA, 22 nt, Human
uaagacagguaguaagaacauu

SEQ ID NO: 111444 - RNA, 22 nt, Human
uaagacauaaauaggcuuuuua

SEQ ID NO: 111445 - RNA, 22 nt, Human
uaagacauagccaagagcaucc

SEQ ID NO: 111446 - RNA, 22 nt, Human
uaagaccaauccuguguaccuc

SEQ ID NO: 111447 - RNA, 22 nt, Human
uaagaccaguaugcauuuucac

SEQ ID NO: 111448 - RNA, 22 nt, Human
uaagaccauacauuuccacaga

SEQ ID NO: 111449 - RNA, 22 nt, Human
uaagacuuaggucgaguuuggc

SEQ ID NO: 111450 - RNA, 22 nt, Human
uaagacuugauccaaagaacua

SEQ ID NO: 111451 - RNA, 22 nt, Human
uaagagaaugucaggaguggau

SEQ ID NO: 111452 - RNA, 22 nt, Human
uaagagacuuaagaauaauuga

SEQ ID NO: 111453 - RNA, 22 nt, Human
uaagagcauuguaaaauaaucu

SEQ ID NO: 111454 - RNA, 22 nt, Human
uaagaggcauuagagacauagc

SEQ ID NO: 111455 - RNA, 22 nt, Human
uaagauaauaccaugggccagg

SEQ ID NO: 111456 - RNA, 22 nt, Human
uaagaucaguucaaacaugugu

SEQ ID NO: 111457 - RNA, 22 nt, Human
uaagaugaaggcucaccuagaa

SEQ ID NO: 111458 - RNA, 22 nt, Human
uaagaugaccuuauaaagagca

SEQ ID NO: 111459 - RNA, 22 nt, Human
uaagaugacuacuuaccacuga

SEQ ID NO: 111460 - RNA, 22 nt, Human
uaagauguaagaucagagcuug

SEQ ID NO: 111461 - RNA, 22 nt, Human
uaagauguacaaccacuucucu

SEQ ID NO: 111462 - RNA, 22 nt, Human
uaagauguuuugguuugauaag

SEQ ID NO: 111463 - RNA, 22 nt, Human
uaagauuuuuaaaauguccuca

SEQ ID NO: 111464 - RNA, 22 nt, Human
uaagcaaauaaugcaucaaggg

SEQ ID NO: 111465 - RNA, 21 nt, Human
uaagcaaggaaagggcagccc

SEQ ID NO: 111466 - RNA, 22 nt, Human
uaagcacacaauaucuggagag

SEQ ID NO: 111467 - RNA, 20 nt, Human
uaagcacaugaacaguccuc

SEQ ID NO: 111468 - RNA, 22 nt, Human
uaggauuucucuuuuugcaacu

SEQ ID NO: 111469 - RNA, 21 nt, Human
uaggcaauuuguugucauagc

SEQ ID NO: 111470 - RNA, 22 nt, Human
uaggcaccaccuagggugaccc

SEQ ID NO: 111471 - RNA, 22 nt, Human
uaggcacugaguacauauuggu

SEQ ID NO: 111472 - RNA, 22 nt, Human
uaggcacugggcuaggacaggu

SEQ ID NO: 111473 - RNA, 22 nt, Human
uaggcacuuggcguguuggaga

SEQ ID NO: 111474 - RNA, 22 nt, Human
uaggcagaaaggaaggcaaguu

SEQ ID NO: 111475 - RNA, 22 nt, Human
uaggcagcauggauucugaaua

SEQ ID NO: 111476 - RNA, 22 nt, Human
uaggcagcugcaaacuucgguc

SEQ ID NO: 111477 - RNA, 23 nt, Human
uaggcaggacucagauaugacag

SEQ ID NO: 111478 - RNA, 22 nt, Human
uaggcauuauuuuaccacgguc

SEQ ID NO: 111479 - RNA, 22 nt, Human
uaggccaacguggaagggucca

SEQ ID NO: 111480 - RNA, 22 nt, Human
uaggccacagagaggagauuuc

SEQ ID NO: 111481 - RNA, 22 nt, Human
uaggccaccaggguuccauuua

SEQ ID NO: 111482 - RNA, 19 nt, Human
uaggccagaaguuuuccac

SEQ ID NO: 111483 - RNA, 22 nt, Human
uaggccagauuacuagaguagg

SEQ ID NO: 111484 - RNA, 22 nt, Human
uaggccagcccuuaguccuguc

SEQ ID NO: 111485 - RNA, 22 nt, Human
uaggccaggaaucagcaagcuu

SEQ ID NO: 111486 - RNA, 22 nt, Human
uaggccauuccuucucuugauc

SEQ ID NO: 111487 - RNA, 22 nt, Human
uaggccuaguuacugcuuacuu

SEQ ID NO: 111488 - RNA, 22 nt, Human
uaggccuaugcagaaggugguu

SEQ ID NO: 111489 - RNA, 22 nt, Human
uaggccuauuguauucuuaucu

SEQ ID NO: 111490 - RNA, 22 nt, Human
uaggccuucggugugugcuugg

SEQ ID NO: 111491 - RNA, 22 nt, Human
uaggcgaaggucugggugggca

SEQ ID NO: 111492 - RNA, 22 nt, Human
uaggcgacagcuugauggugcg

SEQ ID NO: 111493 - RNA, 22 nt, Human
uaggcuaggcugaagguuuugg

SEQ ID NO: 111494 - RNA, 22 nt, Human
uaggcucagggcugggugacgg

SEQ ID NO: 111495 - RNA, 22 nt, Human
uaggcugacuuguuucauaaag

SEQ ID NO: 111496 - RNA, 22 nt, Human
uaggcugagcuuguagaucgua

SEQ ID NO: 111497 - RNA, 22 nt, Human
uaggcugggcauucuggccagg

SEQ ID NO: 111498 - RNA, 22 nt, Human
uaggcuucacuuccaguuauuc

SEQ ID NO: 111499 - RNA, 22 nt, Human
uaggcuugcaauuaggauggaa

SEQ ID NO: 111500 - RNA, 22 nt, Human
uaggcuuguuacaaaacaguca

SEQ ID NO: 111501 - RNA, 22 nt, Human
uagggacaaagagcugaggccu

SEQ ID NO: 111502 - RNA, 20 nt, Human
uagggagauaugcucuuuuc

SEQ ID NO: 111503 - RNA, 22 nt, Human
uagggaugaggauagauuuuuc

SEQ ID NO: 111504 - RNA, 22 nt, Human
uagggaugcuuaguaggaccca

SEQ ID NO: 111505 - RNA, 22 nt, Human
uagggauggaugaugccuggca

SEQ ID NO: 111506 - RNA, 22 nt, Human
uagggcacagcuuagauaaaug

SEQ ID NO: 111507 - RNA, 22 nt, Human
uagggcagaguccaggaugggc

SEQ ID NO: 111508 - RNA, 22 nt, Human
uagggcaggggaggaaucugaa

SEQ ID NO: 111509 - RNA, 22 nt, Human
uagggcuauaagagaauaagac

SEQ ID NO: 111510 - RNA, 22 nt, Human
uagggcucacugagaugaauau

SEQ ID NO: 111511 - RNA, 20 nt, Human
uagggcucauuaugaucucc

SEQ ID NO: 111512 - RNA, 19 nt, Human
uagggcuggccgggcggug

SEQ ID NO: 111513 - RNA, 22 nt, Human
uagggcuggcgugcucagggaa

SEQ ID NO: 111514 - RNA, 16 nt, Human
uagggcugggaaggag

SEQ ID NO: 111515 - RNA, 22 nt, Human
uagggcuggguacacucuugcc

SEQ ID NO: 111516 - RNA, 22 nt, Human
uagggcuuagaaaagaauuuac

SEQ ID NO: 111517 - RNA, 22 nt, Human
uaggggcucagaacauguccuu

SEQ ID NO: 111518 - RNA, 23 nt, Human
uaggggcuggcguggagccugcg

SEQ ID NO: 111519 - RNA, 21 nt, Human
uagggggcagugggaugcuua

SEQ ID NO: 111520 - RNA, 22 nt, Human
uaggguccucaucuguaaauga

SEQ ID NO: 111521 - RNA, 22 nt, Human
uagguagauacauguguuggcu

SEQ ID NO: 111522 - RNA, 22 nt, Human
uagguauacagagauuucuggg

SEQ ID NO: 111523 - RNA, 20 nt, Human
uagguccaaugcucgucuuc

SEQ ID NO: 111524 - RNA, 22 nt, Human
uagguccacaagaucaaugcag

SEQ ID NO: 111525 - RNA, 22 nt, Human
uaggucccuucuguccuggucu

SEQ ID NO: 111526 - RNA, 20 nt, Human
uaggugagggcagauagagg

SEQ ID NO: 111527 - RNA, 22 nt, Human
uaggugcaggucacaagggaug

SEQ ID NO: 111528 - RNA, 21 nt, Human
uaggugggagccccaguaugc

SEQ ID NO: 111529 - RNA, 22 nt, Human
uagguggugugcgaagagcgug

SEQ ID NO: 111530 - RNA, 22 nt, Human
uaggugucuggacaacuuugua

SEQ ID NO: 111531 - RNA, 22 nt, Human
uaggugucuuucuguccuuguu

SEQ ID NO: 111532 - RNA, 22 nt, Human
uagguucaaguucaggcucuau

SEQ ID NO: 111533 - RNA, 22 nt, Human
uagguucauauucuagaaucau

SEQ ID NO: 111534 - RNA, 22 nt, Human
uagguuuaggagugaaggugaa

SEQ ID NO: 111535 - RNA, 22 nt, Human
uagguuucagaggugccgggaa

SEQ ID NO: 111536 - RNA, 22 nt, Human
uaguaaaaguuuaguugaaagu

SEQ ID NO: 111537 - RNA, 22 nt, Human
uaguaacaacaacuagcauuuu

SEQ ID NO: 111538 - RNA, 22 nt, Human
uaguaacacacugguauuugga

SEQ ID NO: 111539 - RNA, 22 nt, Human
uaguaacacauugaacgaucgc

SEQ ID NO: 111540 - RNA, 22 nt, Human
uaguaacagauuuauacagucu

SEQ ID NO: 111541 - RNA, 22 nt, Human
uaguaacucuacacacgacacu

SEQ ID NO: 111542 - RNA, 22 nt, Human
uaguaacugguugaacaacugu

SEQ ID NO: 111543 - RNA, 22 nt, Human
uaguaaguucucgcauuguuau

SEQ ID NO: 111544 - RNA, 22 nt, Human
uaguacacuaccaucagguuuu

SEQ ID NO: 111545 - RNA, 22 nt, Human
uaguacagugcucuguaaguuu

SEQ ID NO: 111546 - RNA, 22 nt, Human
uaguacaguggagagcaaagaa

SEQ ID NO: 111547 - RNA, 22 nt, Human
uaagugguaccaagcucaguga

SEQ ID NO: 111548 - RNA, 18 nt, Human
uaaguguaauugacaauu

SEQ ID NO: 111549 - RNA, 22 nt, Human
uaaguuagagcacaauucuuac

SEQ ID NO: 111550 - RNA, 22 nt, Human
uaaguuagcccuauuaaauuaa

SEQ ID NO: 111551 - RNA, 22 nt, Human
uaaguuaguccuuuuuaaaagu

SEQ ID NO: 111552 - RNA, 22 nt, Human
uaaguucaagucuuggauauaa

SEQ ID NO: 111553 - RNA, 22 nt, Human
uaaguucauaagcuuauucuua

SEQ ID NO: 111554 - RNA, 22 nt, Human
uaaguucauuagacuacagaua

SEQ ID NO: 111555 - RNA, 22 nt, Human
uaaguucugaagaggcgaggua

SEQ ID NO: 111556 - RNA, 22 nt, Human
uaaguucugcugacggccagcc

SEQ ID NO: 111557 - RNA, 22 nt, Human
uaaguucuuuucuauguaauau

SEQ ID NO: 111558 - RNA, 22 nt, Human
uaaguuuaacccucugggacua

SEQ ID NO: 111559 - RNA, 22 nt, Human
uaaguuucuccaaagcacagaa

SEQ ID NO: 111560 - RNA, 22 nt, Human
uaaguuugugucucuguuacuu

SEQ ID NO: 111561 - RNA, 22 nt, Human
uaaguuuucuggaauaacuugg

SEQ ID NO: 111562 - RNA, 22 nt, Human
uaauaacaauuguaggacauga

SEQ ID NO: 111563 - RNA, 19 nt, Human
uaauaagcaauauggaagu

SEQ ID NO: 111564 - RNA, 22 nt, Human
uaauaauuggcuaacccuggga

SEQ ID NO: 111565 - RNA, 22 nt, Human
uaauaauuuuaaagaaggcuag

SEQ ID NO: 111566 - RNA, 22 nt, Human
uaauacaauggaguugggcccc

SEQ ID NO: 111567 - RNA, 22 nt, Human
uaauacacugcuuuuuguaacu

SEQ ID NO: 111568 - RNA, 22 nt, Human
uaauacagaaguguauuaaaau

SEQ ID NO: 111569 - RNA, 22 nt, Human
uaauaccuacuggucauugcaa

SEQ ID NO: 111570 - RNA, 22 nt, Human
uaauaccuggccuugauacagu

SEQ ID NO: 111571 - RNA, 22 nt, Human
uaauacugaaaggaguaucagc

SEQ ID NO: 111572 - RNA, 22 nt, Human
uaauacugacuaaagauaucaa

SEQ ID NO: 111573 - RNA, 22 nt, Human
uaauacuguauacugcaaauuu

SEQ ID NO: 111574 - RNA, 22 nt, Human
uaauacuugcuuuggauguaug

SEQ ID NO: 111575 - RNA, 22 nt, Human
uaauacuugucauaaaggcauu

SEQ ID NO: 111576 - RNA, 22 nt, Human
uaauaguuucauaaugugcuuc

SEQ ID NO: 111577 - RNA, 22 nt, Human
uagugcuuauuacugugcuguc

SEQ ID NO: 111578 - RNA, 22 nt, Human
uagugcuuuaggccugaguguc

SEQ ID NO: 111579 - RNA, 22 nt, Human
uagugcuuuggagcuuucuccu

SEQ ID NO: 111580 - RNA, 22 nt, Human
uaguggagaaguggagucugug

SEQ ID NO: 111581 - RNA, 22 nt, Human
uaguggaggccuguugugugca

SEQ ID NO: 111582 - RNA, 19 nt, Human
uaguggagugacaaguucu

SEQ ID NO: 111583 - RNA, 22 nt, Human
uaguggauggguaaaguauuuu

SEQ ID NO: 111584 - RNA, 22 nt, Human
uaguggcauuguugugaggauu

SEQ ID NO: 111585 - RNA, 23 nt, Human
uaguguauaucaacauuuguccc

SEQ ID NO: 111586 - RNA, 22 nt, Human
uagugucaugaaaaguacacua

SEQ ID NO: 111587 - RNA, 22 nt, Human
uagugucauuucaguggaguuu

SEQ ID NO: 111588 - RNA, 22 nt, Human
uagugucuauugaccggaaaga

SEQ ID NO: 111589 - RNA, 22 nt, Human
uagugucugacauuuaagagca

SEQ ID NO: 111590 - RNA, 21 nt, Human
uagugucuuaagagccuugca

SEQ ID NO: 111591 - RNA, 22 nt, Human
uagugucuucaggagauaugag

SEQ ID NO: 111592 - RNA, 22 nt, Human
uagugucuuccaggacauggua

SEQ ID NO: 111593 - RNA, 22 nt, Human
uaguguguggucucucccuugu

SEQ ID NO: 111594 - RNA, 22 nt, Human
uaguuaaaauaauggagauguu

SEQ ID NO: 111595 - RNA, 22 nt, Human
uaguuaaagauucuguuaagag

SEQ ID NO: 111596 - RNA, 22 nt, Human
uaguuaacucuugguaauaggu

SEQ ID NO: 111597 - RNA, 22 nt, Human
uaguuacaauggguucugugac

SEQ ID NO: 111598 - RNA, 22 nt, Human
uaguuacacauggguagggaau

SEQ ID NO: 111599 - RNA, 22 nt, Human
uaguuacagugcauagcaagau

SEQ ID NO: 111600 - RNA, 23 nt, Human
uaguuacauuauugucagagcug

SEQ ID NO: 111601 - RNA, 22 nt, Human
uaguuacuuuugcucuucauua

SEQ ID NO: 111602 - RNA, 22 nt, Human
uaguuauuauuguuacuaucag

SEQ ID NO: 111603 - RNA, 22 nt, Human
uaguucaaagucugucaaagga

SEQ ID NO: 111604 - RNA, 22 nt, Human
uaguucuauaagcagauagagu

SEQ ID NO: 111605 - RNA, 22 nt, Human
uaguucucuauucaaggaucaa

SEQ ID NO: 111606 - RNA, 22 nt, Human
uaguucuucaugaauucagcuu

SEQ ID NO: 111607 - RNA, 22 nt, Human
uaguucuugguucuuaguucuu

SEQ ID NO: 111608 - RNA, 22 nt, Human
uaguugaagagaugaaugacca

SEQ ID NO: 111609 - RNA, 22 nt, Human
uaguugcuaaaaagugccuaac

SEQ ID NO: 111610 - RNA, 22 nt, Human
uaguuuagaauguugcaauaca

SEQ ID NO: 111611 - RNA, 22 nt, Human
uaguuuagccauuuaggaauug

SEQ ID NO: 111612 - RNA, 22 nt, Human
uaguuuaggauccaaucuaaga

SEQ ID NO: 111613 - RNA, 22 nt, Human
uaguuuaggaucuuuuuugugc

SEQ ID NO: 111614 - RNA, 22 nt, Human
uaguuuaggucguacaagcaaa

SEQ ID NO: 111615 - RNA, 22 nt, Human
uaguuuaugauuuuuuggaagg

SEQ ID NO: 111616 - RNA, 18 nt, Human
uaguuucuaauggccuuu

SEQ ID NO: 111617 - RNA, 22 nt, Human
uaguuucuggguuggcuucuac

SEQ ID NO: 111618 - RNA, 22 nt, Human
uaguuucuugauuagccacuuu

SEQ ID NO: 111619 - RNA, 22 nt, Human
uaguuugcgaaauuccugccuc

SEQ ID NO: 111620 - RNA, 22 nt, Human
uaguuuugaggauuauauguga

SEQ ID NO: 111621 - RNA, 22 nt, Human
uauaaagaaggcacagcaagac

SEQ ID NO: 111622 - RNA, 22 nt, Human
uauaaagagucucaaagaaguu

SEQ ID NO: 111623 - RNA, 22 nt, Human
uauaaaguuggggcugaaguaa

SEQ ID NO: 111624 - RNA, 22 nt, Human
uauaaaguuucgaaagauguau

SEQ ID NO: 111625 - RNA, 20 nt, Human
uauaaauucagagcuuuggu

SEQ ID NO: 111626 - RNA, 22 nt, Human
uauaacaccauguucuacagau

SEQ ID NO: 111627 - RNA, 22 nt, Human
uauaacaggaaguauucaaaca

SEQ ID NO: 111628 - RNA, 22 nt, Human
uauaagaaauugccaaccuguu

SEQ ID NO: 111629 - RNA, 22 nt, Human
uauaagcaugcuucauauggau

SEQ ID NO: 111630 - RNA, 22 nt, Human
uauaaguaguuguugaagacuu

SEQ ID NO: 111631 - RNA, 22 nt, Human
uauaagucuggcauauguaugc

SEQ ID NO: 111632 - RNA, 22 nt, Human
uauaaguguaguuucaaauguu

SEQ ID NO: 111633 - RNA, 22 nt, Human
uauaauccauucauugauuucu

SEQ ID NO: 111634 - RNA, 22 nt, Human
uauaauuaguaaauggcagauu

SEQ ID NO: 111635 - RNA, 22 nt, Human
uauacaagaggugagaugagca

SEQ ID NO: 111636 - RNA, 22 nt, Human
uauacaagugagaagaagaguu

SEQ ID NO: 111637 - RNA, 22 nt, Human
uauacaauggcugaaucaucca

SEQ ID NO: 111638 - RNA, 22 nt, Human
uauacacaaacaagggguuaag

SEQ ID NO: 111639 - RNA, 22 nt, Human
uauacacauaucuucuaggccu

SEQ ID NO: 111640 - RNA, 22 nt, Human
uauacacugauauaaggaguaa

SEQ ID NO: 111641 - RNA, 22 nt, Human
uauacagaacauuaagaacugu

SEQ ID NO: 111642 - RNA, 22 nt, Human
uauacagaaccgccugaagucu

SEQ ID NO: 111643 - RNA, 22 nt, Human
uauacagaacugcacgugcacg

SEQ ID NO: 111644 - RNA, 22 nt, Human
uauacagauggaaagauacaca

SEQ ID NO: 111645 - RNA, 22 nt, Human
uauacaggaacuguuggcuccc

SEQ ID NO: 111646 - RNA, 22 nt, Human
uauacaguaucuuuugaaggca

SEQ ID NO: 111647 - RNA, 22 nt, Human
uauacagugccucuuccauuag

SEQ ID NO: 111648 - RNA, 22 nt, Human
uauacaguuaaguuucuucagu

SEQ ID NO: 111649 - RNA, 22 nt, Human
uauaccaaaaaaauucuugucu

SEQ ID NO: 111650 - RNA, 22 nt, Human
uauaccaaaauaucagaaaggg

SEQ ID NO: 111651 - RNA, 22 nt, Human
uauacuacgcaccaaacaaagg

SEQ ID NO: 111652 - RNA, 22 nt, Human
uauacuauuauugucaguuuau

SEQ ID NO: 111653 - RNA, 22 nt, Human
uauacucugagaaacgugucac

SEQ ID NO: 111654 - RNA, 22 nt, Human
uauacucuggaauuuuauucuu

SEQ ID NO: 111655 - RNA, 22 nt, Human
uauacugagagcaaauacauuc

SEQ ID NO: 111656 - RNA, 22 nt, Human
uauacugaguguguuaaugaug

SEQ ID NO: 111657 - RNA, 22 nt, Human
uauacugaucacugaggucauc

SEQ ID NO: 111658 - RNA, 22 nt, Human
uauagaagagacaugugcauag

SEQ ID NO: 111659 - RNA, 22 nt, Human
uauagacaagcguaacaagaag

SEQ ID NO: 111660 - RNA, 22 nt, Human
ugagcucauagcucuuauuaug

SEQ ID NO: 111661 - RNA, 22 nt, Human
ugagcuccggcauauggaauua

SEQ ID NO: 111662 - RNA, 23 nt, Human
ugagcucuauggaggacugaacc

SEQ ID NO: 111663 - RNA, 22 nt, Human
ugagcucuguuagggcuggaac

SEQ ID NO: 111664 - RNA, 22 nt, Human
ugagcucuucuaacuaauugug

SEQ ID NO: 111665 - RNA, 22 nt, Human
ugagcugagaacacuugggcua

SEQ ID NO: 111666 - RNA, 22 nt, Human
ugagcugauaggcugugagccu

SEQ ID NO: 111667 - RNA, 22 nt, Human
ugagcugcuucuuauaaugugu

SEQ ID NO: 111668 - RNA, 22 nt, Human
ugagcuggaaucuucuugacug

SEQ ID NO: 111669 - RNA, 22 nt, Human
ugagcuggcaggggcucaggga

SEQ ID NO: 111670 - RNA, 22 nt, Human
ugagcuggucuugaguguagcu

SEQ ID NO: 111671 - RNA, 22 nt, Human
ugagcugucuaugguccugucu

SEQ ID NO: 111672 - RNA, 22 nt, Human
ugagcugucugaauggugagga

SEQ ID NO: 111673 - RNA, 22 nt, Human
ugagcugugauuaacucugaga

SEQ ID NO: 111674 - RNA, 22 nt, Human
ugagcuguuucucugguggcuu

SEQ ID NO: 111675 - RNA, 22 nt, Human
ugagcuucaaaauaugugaauc

SEQ ID NO: 111676 - RNA, 22 nt, Human
ugagcuucuuuauuuggccaga

SEQ ID NO: 111677 - RNA, 22 nt, Human
ugagcuuuuaauauacaggugu

SEQ ID NO: 111678 - RNA, 22 nt, Human
ugaggaaacugaggcacagaug

SEQ ID NO: 111679 - RNA, 22 nt, Human
ugaggaaacuuacaaggcagaa

SEQ ID NO: 111680 - RNA, 18 nt, Human
ugaggaaggggaaguauu

SEQ ID NO: 111681 - RNA, 22 nt, Human
ugaggaauggcuuaauguggga

SEQ ID NO: 111682 - RNA, 22 nt, Human
ugaggacauuaggaagugaagg

SEQ ID NO: 111683 - RNA, 23 nt, Human
ugaggaccucucaggggccaggc

SEQ ID NO: 111684 - RNA, 22 nt, Human
ugaggagaaaugcucagagcca

SEQ ID NO: 111685 - RNA, 23 nt, Human
ugaggagcauagcugacugacag

SEQ ID NO: 111686 - RNA, 22 nt, Human
uaagaacauaaauucauacggg

SEQ ID NO: 111687 - RNA, 21 nt, Human
uaagaacauuaucuucuuccu

SEQ ID NO: 111688 - RNA, 22 nt, Human
uaagaacuuggcagcaagaaau

SEQ ID NO: 111689 - RNA, 22 nt, Human
uaagaagcuucugcuaaugccu

SEQ ID NO: 111690 - RNA, 22 nt, Human
uaagaagguaauacauuuuugc

SEQ ID NO: 111691 - RNA, 22 nt, Human
uaagaauagucccuagaugugu

SEQ ID NO: 111692 - RNA, 22 nt, Human
uaagaaucuauuaggaauaugu

SEQ ID NO: 111693 - RNA, 22 nt, Human
uaagaaugacuaccaaacugga

SEQ ID NO: 111694 - RNA, 22 nt, Human
uaagacacaaauaucuuuuaca

SEQ ID NO: 111695 - RNA, 22 nt, Human
uaagacacauuggaguagauga

SEQ ID NO: 111696 - RNA, 23 nt, Human
uaagacacccgacuccagagaug

SEQ ID NO: 111697 - RNA, 22 nt, Human
uaagacaccucucugcccuuca

SEQ ID NO: 111698 - RNA, 22 nt, Human
uaagacaucauuaaacagcaau

SEQ ID NO: 111699 - RNA, 22 nt, Human
uaagacauccuggauguucaaa

SEQ ID NO: 111700 - RNA, 22 nt, Human
uaagacaugagacucagccagu

SEQ ID NO: 111701 - RNA, 22 nt, Human
uaagacuucauuaguaauaugg

SEQ ID NO: 111702 - RNA, 22 nt, Human
uaagagacuauugagcaucuug

SEQ ID NO: 111703 - RNA, 22 nt, Human
uaagagaugguuaucaaaagca

SEQ ID NO: 111704 - RNA, 22 nt, Human
uaagagcacugaagucuucuua

SEQ ID NO: 111705 - RNA, 22 nt, Human
uaagagcucccuucuccuugca

SEQ ID NO: 111706 - RNA, 22 nt, Human
uaagaggcaaaagauacucaga

SEQ ID NO: 111707 - RNA, 22 nt, Human
uaagaggcagcauuccucgccu

SEQ ID NO: 111708 - RNA, 22 nt, Human
uaagaguaucuauuaaguacuu

SEQ ID NO: 111709 - RNA, 22 nt, Human
uaagaguuagggcuagcaauau

SEQ ID NO: 111710 - RNA, 22 nt, Human
uaagauaaguggguugagaugg

SEQ ID NO: 111711 - RNA, 22 nt, Human
uaagaugguuguagauggacug

SEQ ID NO: 111712 - RNA, 22 nt, Human
uaagaugucauccacauagagu

SEQ ID NO: 111713 - RNA, 22 nt, Human
uaagcaaaggauuuugaucuuu

SEQ ID NO: 111714 - RNA, 18 nt, Human
uaagcaaugacauugcaa

SEQ ID NO: 111715 - RNA, 22 nt, Human
uaagcaaugagauaaucauggg

SEQ ID NO: 111716 - RNA, 22 nt, Human
uaagcaggggucaaguguacaa

SEQ ID NO: 111717 - RNA, 22 nt, Human
uaagcauaacuaaaaaugauuu

SEQ ID NO: 111718 - RNA, 22 nt, Human
uaagcauacauucucuccuuuc

SEQ ID NO: 111719 - RNA, 22 nt, Human
uaagcauuaacucugcugcaag

SEQ ID NO: 111720 - RNA, 22 nt, Human
uaagcauuaugguaaagaagua

SEQ ID NO: 111721 - RNA, 22 nt, Human
uaagcucacuguaagaacugau

SEQ ID NO: 111722 - RNA, 22 nt, Human
uaagcucuccaggugaucauga

SEQ ID NO: 111723 - RNA, 22 nt, Human
uaagcuggagcuucccccgucc

SEQ ID NO: 111724 - RNA, 22 nt, Human
uaaggaagucacaagaaucgcu

SEQ ID NO: 111725 - RNA, 22 nt, Human
uaaggaaugcuugaauguuccu

SEQ ID NO: 111726 - RNA, 22 nt, Human
uaaggagagaauuuagagguuu

SEQ ID NO: 111727 - RNA, 22 nt, Human
uaaggagguugguggguuggau

SEQ ID NO: 111728 - RNA, 22 nt, Human
uaaggcaaagaaccauaguaau

SEQ ID NO: 111729 - RNA, 22 nt, Human
uaaggcacacaguugcugcaug

SEQ ID NO: 111730 - RNA, 22 nt, Human
uaaggcacccgugagcugccag

SEQ ID NO: 111731 - RNA, 22 nt, Human
uaaggcacuucaauguuuagaa

SEQ ID NO: 111732 - RNA, 22 nt, Human
uaaggcagcauaauuaggccac

SEQ ID NO: 111733 - RNA, 22 nt, Human
uaaggcaguuuugccugagaua

SEQ ID NO: 111734 - RNA, 22 nt, Human
uaaggcauuagagugaaagcaa

SEQ ID NO: 111735 - RNA, 21 nt, Human
uaaggccaagucuauuucugu

SEQ ID NO: 111736 - RNA, 22 nt, Human
uaaggccaauuaacaaccaggg

SEQ ID NO: 111737 - RNA, 22 nt, Human
uaaggccaccguuauagaacca

SEQ ID NO: 111738 - RNA, 22 nt, Human
uaaggccagccagcaaaucugu

SEQ ID NO: 111739 - RNA, 22 nt, Human
uaaggccaggcuguggucggca

SEQ ID NO: 111740 - RNA, 22 nt, Human
uaaggcccgugaguuucauauc

SEQ ID NO: 111741 - RNA, 22 nt, Human
uaaggcuagcaagaugagaaua

SEQ ID NO: 111742 - RNA, 22 nt, Human
uaaggcuagugccugacugggu

SEQ ID NO: 111743 - RNA, 22 nt, Human
uaaggcuuagaagcuaucugcu

SEQ ID NO: 111744 - RNA, 22 nt, Human
uaaggcuuaugaucagaagguu

SEQ ID NO: 111745 - RNA, 22 nt, Human
uaaggcuuggacuucuccaacc

SEQ ID NO: 111746 - RNA, 22 nt, Human
uaaggcuuggggaaaagugagg

SEQ ID NO: 111747 - RNA, 22 nt, Human
uaaggcuuuggucaccauggag

SEQ ID NO: 111748 - RNA, 22 nt, Human
uaaggcuuuguagugauugcuu

SEQ ID NO: 111749 - RNA, 22 nt, Human
uaaggucuuuaacaggucuuuu

SEQ ID NO: 111750 - RNA, 22 nt, Human
uaaggugugguaguuuaguucu

SEQ ID NO: 111751 - RNA, 22 nt, Human
uaagguuuaacgcccugucucg

SEQ ID NO: 111752 - RNA, 19 nt, Human
uaagguuuaccagcaaaau

SEQ ID NO: 111753 - RNA, 22 nt, Human
uaaguaaaacauucaagaaguc

SEQ ID NO: 111754 - RNA, 22 nt, Human
uaagucauaagucaugauguua

SEQ ID NO: 111755 - RNA, 22 nt, Human
uaaguccauaauggcaguaaau

SEQ ID NO: 111756 - RNA, 22 nt, Human
uaaguccuaacagacugggggc

SEQ ID NO: 111757 - RNA, 17 nt, Human
uaaguccuaguuauuuu

SEQ ID NO: 111758 - RNA, 22 nt, Human
uaaguccuggcugguuugaagc

SEQ ID NO: 111759 - RNA, 22 nt, Human
uaagucuucauagucuaauguc

SEQ ID NO: 111760 - RNA, 22 nt, Human
uaagugagaacuaaaccuucug

SEQ ID NO: 111761 - RNA, 22 nt, Human
uaagugagaucugaaaugaaau

SEQ ID NO: 111762 - RNA, 23 nt, Human
uaagugauuagaauuugcuguca

SEQ ID NO: 111763 - RNA, 17 nt, Human
uaagugauuaucucaua

SEQ ID NO: 111764 - RNA, 22 nt, Human
uaagugcaauguuuuacuuaaa

SEQ ID NO: 111765 - RNA, 22 nt, Human
uaaguuaacccuguuaauagau

SEQ ID NO: 111766 - RNA, 17 nt, Human
uaaguuauagcagaaga

SEQ ID NO: 111767 - RNA, 22 nt, Human
uaaguuaucggaguguguuuca

SEQ ID NO: 111768 - RNA, 22 nt, Human
uaaguucaaugaacucaguucu

SEQ ID NO: 111769 - RNA, 22 nt, Human
uaaguucaccaguuguaauaag

SEQ ID NO: 111770 - RNA, 22 nt, Human
uaaguucaguuggucgaaguag

SEQ ID NO: 111771 - RNA, 23 nt, Human
uaaguucuaugagaagagaaauc

SEQ ID NO: 111772 - RNA, 22 nt, Human
uaaguucucaauacauuguagc

SEQ ID NO: 111773 - RNA, 22 nt, Human
uacaaauggguuaaaauauagu

SEQ ID NO: 111774 - RNA, 22 nt, Human
uacaaaugguugaauggaugaa

SEQ ID NO: 111775 - RNA, 22 nt, Human
uacaaauguauuuuauuuuggu

SEQ ID NO: 111776 - RNA, 20 nt, Human
uacaacaaguagagacauac

SEQ ID NO: 111777 - RNA, 22 nt, Human
uacaacacugguucgacaugug

SEQ ID NO: 111778 - RNA, 22 nt, Human
uacaacacuguucagccucuuc

SEQ ID NO: 111779 - RNA, 21 nt, Human
uacaacagguuuuauuucgau

SEQ ID NO: 111780 - RNA, 22 nt, Human
uacaacaguaaucaagguuuuu

SEQ ID NO: 111781 - RNA, 22 nt, Human
uacaacauuuacguuaggcugu

SEQ ID NO: 111782 - RNA, 22 nt, Human
uacaaccauagacauauacuag

SEQ ID NO: 111783 - RNA, 22 nt, Human
uacaacuuacuugaauggcuuu

SEQ ID NO: 111784 - RNA, 21 nt, Human
uacaagaccggauucgggccc

SEQ ID NO: 111785 - RNA, 22 nt, Human
uacaagaggauguggacaugga

SEQ ID NO: 111786 - RNA, 22 nt, Human
uacaagaugacaggugcaugau

SEQ ID NO: 111787 - RNA, 22 nt, Human
uacaagauguacuaaaaauuau

SEQ ID NO: 111788 - RNA, 22 nt, Human
uacaagcuggcgcaguuaagau

SEQ ID NO: 111789 - RNA, 19 nt, Human
uacaagcuuaaaguaaugu

SEQ ID NO: 111790 - RNA, 22 nt, Human
uacaaggcuucagcucagcuau

SEQ ID NO: 111791 - RNA, 22 nt, Human
uacaaguacuguggcuuugaau

SEQ ID NO: 111792 - RNA, 22 nt, Human
uacaaguagcucagguuuucug

SEQ ID NO: 111793 - RNA, 22 nt, Human
uacaaguccguaaagggcagau

SEQ ID NO: 111794 - RNA, 22 nt, Human
uacaagugcuagcagauauugu

SEQ ID NO: 111795 - RNA, 22 nt, Human
uauauaugagcaugugaggaca

SEQ ID NO: 111796 - RNA, 22 nt, Human
uauauauucuuaaguaguguag

SEQ ID NO: 111797 - RNA, 19 nt, Human
uauauauuuugggguugug

SEQ ID NO: 111798 - RNA, 22 nt, Human
uauaucagaguuaaaagaaugu

SEQ ID NO: 111799 - RNA, 22 nt, Human
uauaucugggaaccaaaggggg

SEQ ID NO: 111800 - RNA, 22 nt, Human
uauaugacaguaucauuuuaaa

SEQ ID NO: 111801 - RNA, 22 nt, Human
uauaugcaauuuuuuagugcaa

SEQ ID NO: 111802 - RNA, 22 nt, Human
uauaugcucugggauccugaaa

SEQ ID NO: 111803 - RNA, 22 nt, Human
uauauguagauuguaccaaugu

SEQ ID NO: 111804 - RNA, 22 nt, Human
uauaugucugcuacuguauaaa

SEQ ID NO: 111805 - RNA, 22 nt, Human
uauauuaccugccugaucuaua

SEQ ID NO: 111806 - RNA, 22 nt, Human
uauauucuuaccaguguaugua

SEQ ID NO: 111807 - RNA, 22 nt, Human
uauauugcuagugguacuguaa

SEQ ID NO: 111808 - RNA, 22 nt, Human
uauauugggacuucaggacuuu

SEQ ID NO: 111809 - RNA, 22 nt, Human
uauauuuaauuaguugcuggau

SEQ ID NO: 111810 - RNA, 22 nt, Human
uauauuugugugugauuuauga

SEQ ID NO: 111811 - RNA, 19 nt, Human
uauauuuguugaauaaaaa

SEQ ID NO: 111812 - RNA, 22 nt, Human
uaucaaaggcuaugugauuuuu

SEQ ID NO: 111813 - RNA, 21 nt, Human
uaucaaggcacuuuuuaaaga

SEQ ID NO: 111814 - RNA, 22 nt, Human
uaucaaggcauggaaaaugcua

SEQ ID NO: 111815 - RNA, 19 nt, Human
uaucaaucacggcaucuuu

SEQ ID NO: 111816 - RNA, 20 nt, Human
uaucaaucagaaagaagacu

SEQ ID NO: 111817 - RNA, 22 nt, Human
uaucacaauuccuauaguuugu

SEQ ID NO: 111818 - RNA, 22 nt, Human
uaucacaggugugauuuacauu

SEQ ID NO: 111819 - RNA, 22 nt, Human
uaucacauuuggagauuuauga

SEQ ID NO: 111820 - RNA, 22 nt, Human
uaucacccuacauaagaaauaa

SEQ ID NO: 111821 - RNA, 22 nt, Human
uaucacuacaccuggcuaauua

SEQ ID NO: 111822 - RNA, 22 nt, Human
uaucacuacacuucagcuuuaa

SEQ ID NO: 111823 - RNA, 22 nt, Human
uaucacuugcguuuuggcagag

SEQ ID NO: 111824 - RNA, 22 nt, Human
uaucagaaaugccuuaaauugg

SEQ ID NO: 111825 - RNA, 22 nt, Human
uaucagaacacauguuuugcag

SEQ ID NO: 111826 - RNA, 21 nt, Human
uaucagaagagaaagaaugau

SEQ ID NO: 111827 - RNA, 22 nt, Human
uaucagauuuagaggagucaua

SEQ ID NO: 111828 - RNA, 22 nt, Human
uaucagcauauuuacuuucuug

SEQ ID NO: 111829 - RNA, 22 nt, Human
uaucaggaagaacacgugaaau

SEQ ID NO: 111830 - RNA, 22 nt, Human
uaucaggaauugaauggcuuca

SEQ ID NO: 111831 - RNA, 22 nt, Human
uaucaggaguugacaguugcua

SEQ ID NO: 111832 - RNA, 22 nt, Human
uaucaguagaacaauggacauu

SEQ ID NO: 111833 - RNA, 22 nt, Human
uaucaguagauaaacggauugc

SEQ ID NO: 111834 - RNA, 22 nt, Human
uaucaguauggauucauggauu

SEQ ID NO: 111835 - RNA, 22 nt, Human
uaucaguccaggguuuugugac

SEQ ID NO: 111836 - RNA, 22 nt, Human
uaucagugcucccagcuuagca

SEQ ID NO: 111837 - RNA, 22 nt, Human
uaucagugugguuucuggacug

SEQ ID NO: 111838 - RNA, 22 nt, Human
uaucauuauacagacguauaca

SEQ ID NO: 111839 - RNA, 22 nt, Human
uaucauucuaauucuccucgua

SEQ ID NO: 111840 - RNA, 22 nt, Human
uaucauugcugaugugcugaga

SEQ ID NO: 111841 - RNA, 22 nt, Human
uaucauuuaacagaaucauugc

SEQ ID NO: 111842 - RNA, 22 nt, Human
uaucauuuagaguauuucuuca

SEQ ID NO: 111843 - RNA, 22 nt, Human
uauccaaaggaacaaucacagc

SEQ ID NO: 111844 - RNA, 22 nt, Human
uauccaaaguggcauauuauag

SEQ ID NO: 111845 - RNA, 22 nt, Human
uauccauauuaagaugccucug

SEQ ID NO: 111846 - RNA, 22 nt, Human
uauccaugccuuugugccuuag

SEQ ID NO: 111847 - RNA, 22 nt, Human
uauccauuaggucuauggucaa

SEQ ID NO: 111848 - RNA, 22 nt, Human
uauccguuagaaucaugcuggg

SEQ ID NO: 111849 - RNA, 22 nt, Human
uauccuguuuugcacaauuaua

SEQ ID NO: 111850 - RNA, 21 nt, Human
uaucuacaguguccauucagu

SEQ ID NO: 111851 - RNA, 22 nt, Human
uaucuacaguuaauaugucauc

SEQ ID NO: 111852 - RNA, 23 nt, Human
uaucuacuuugcaauucaguacc

SEQ ID NO: 111853 - RNA, 22 nt, Human
uaucuagaaacagaguuuuacu

SEQ ID NO: 111854 - RNA, 22 nt, Human
uaucuagaacuccagaauguag

SEQ ID NO: 111855 - RNA, 22 nt, Human
uaucuagauaguuuagccaucu

SEQ ID NO: 111856 - RNA, 22 nt, Human
uaucuagauauuuggauaaaug

SEQ ID NO: 111857 - RNA, 22 nt, Human
uaucuauaaguacuaacauggu

SEQ ID NO: 111858 - RNA, 22 nt, Human
uaucuauaauguuuuacuuccu

SEQ ID NO: 111859 - RNA, 22 nt, Human
uaucuauuauguucuauguguc

SEQ ID NO: 111860 - RNA, 17 nt, Human
uaucucugcuucauggu

SEQ ID NO: 111861 - RNA, 22 nt, Human
uaucucuguaaaagaaaucaca

SEQ ID NO: 111862 - RNA, 22 nt, Human
uaucucuuuauugacaauaaaa

SEQ ID NO: 111863 - RNA, 22 nt, Human
uaucugauacaacagaauaaca

SEQ ID NO: 111864 - RNA, 20 nt, Human
uaucugcucuaguagcaguu

SEQ ID NO: 111865 - RNA, 21 nt, Human
uaucugcuuuuuaaggcucac

SEQ ID NO: 111866 - RNA, 17 nt, Human
uaucuguaugauggaua

SEQ ID NO: 111867 - RNA, 22 nt, Human
uaucuguauucugacagucacu

SEQ ID NO: 111868 - RNA, 23 nt, Human
uaucuguauuuguucacugcugu

SEQ ID NO: 111869 - RNA, 22 nt, Human
uaucuguuaaaacaagcuuuaa

SEQ ID NO: 111870 - RNA, 22 nt, Human
uaucuguuagcuaaugaaugag

SEQ ID NO: 111871 - RNA, 22 nt, Human
uaucuguuaugggcugaauugc

SEQ ID NO: 111872 - RNA, 22 nt, Human
uaucuguuuauuguuacuguca

SEQ ID NO: 111873 - RNA, 22 nt, Human
uaucuucauagauuuuuacacc

SEQ ID NO: 111874 - RNA, 22 nt, Human
uaucuucuugccaggcuggugu

SEQ ID NO: 111875 - RNA, 19 nt, Human
uaucuuuaugcaguggugg

SEQ ID NO: 111876 - RNA, 22 nt, Human
uaucuuucuguccuagauucug

SEQ ID NO: 111877 - RNA, 22 nt, Human
uaugaaacauucauacaaauaa

SEQ ID NO: 111878 - RNA, 22 nt, Human
uaugaaagaaucucagagcaca

SEQ ID NO: 111879 - RNA, 22 nt, Human
uaugaaauuucuaguucugcuu

SEQ ID NO: 111880 - RNA, 22 nt, Human
uaugaacauguucauugacuua

SEQ ID NO: 111881 - RNA, 22 nt, Human
uaugaacauugaagaggagccc

SEQ ID NO: 111882 - RNA, 22 nt, Human
uaugaacuagcugauuuaguuu

SEQ ID NO: 111883 - RNA, 22 nt, Human
uaugaacugcucuuguguuuug

SEQ ID NO: 111884 - RNA, 22 nt, Human
uaugaacuuuugaugugacaug

SEQ ID NO: 111885 - RNA, 22 nt, Human
uaugaagaaaccuauccucuag

SEQ ID NO: 111886 - RNA, 22 nt, Human
uaugaagaagacaaaugacacu

SEQ ID NO: 111887 - RNA, 22 nt, Human
uaugaagaaguucugugaaaug

SEQ ID NO: 111888 - RNA, 22 nt, Human
uaugaagauugcggucuggaau

SEQ ID NO: 111889 - RNA, 22 nt, Human
uaugaagcugauaaucacugau

SEQ ID NO: 111890 - RNA, 22 nt, Human
ugcaaaagaauauagauauugu

SEQ ID NO: 111891 - RNA, 23 nt, Human
ugcaaaauuugcagaguucgaug

SEQ ID NO: 111892 - RNA, 22 nt, Human
ugcaaacagccuugaaagaggg

SEQ ID NO: 111893 - RNA, 22 nt, Human
ugcaaacaggagaguaaguaua

SEQ ID NO: 111894 - RNA, 22 nt, Human
ugcaaacaucaauggccugagc

SEQ ID NO: 111895 - RNA, 18 nt, Human
ugcaaaggacacugagau

SEQ ID NO: 111896 - RNA, 22 nt, Human
ugcaaaggaggaugggaaagaa

SEQ ID NO: 111897 - RNA, 22 nt, Human
ugcaaaggggacagaguccacu

SEQ ID NO: 111898 - RNA, 22 nt, Human
ugcaaauacaaaaugguacagc

SEQ ID NO: 111899 - RNA, 22 nt, Human
ugcaaauaggggacaacucuuu

SEQ ID NO: 111900 - RNA, 22 nt, Human
ugcaaauauuagcauucgauau

SEQ ID NO: 111901 - RNA, 22 nt, Human
ugcaaauggagcauguauaaga

SEQ ID NO: 111902 - RNA, 22 nt, Human
ugcaaaugggugaggguuagga

SEQ ID NO: 111903 - RNA, 22 nt, Human
ugcaaauguguagguuuacaua

SEQ ID NO: 111904 - RNA, 22 nt, Human
uagcgggucacccugcugugaa

SEQ ID NO: 111905 - RNA, 22 nt, Human
uagcuaauggugaagauucaga

SEQ ID NO: 111906 - RNA, 22 nt, Human
uagcuacaaucacuguccuuug

SEQ ID NO: 111907 - RNA, 22 nt, Human
uagcuagaaagugaagaucaca

SEQ ID NO: 111908 - RNA, 22 nt, Human
uagcuagaaugcuucgugauau

SEQ ID NO: 111909 - RNA, 22 nt, Human
uagcuauuugagcauauuccag

SEQ ID NO: 111910 - RNA, 22 nt, Human
uauuucccagggagcaacaagc

SEQ ID NO: 111911 - RNA, 22 nt, Human
uauuucuggcuuugagggugau

SEQ ID NO: 111912 - RNA, 20 nt, Human
uauuucugggcaaccauuua

SEQ ID NO: 111913 - RNA, 22 nt, Human
uauuucuguaacucagggucug

SEQ ID NO: 111914 - RNA, 22 nt, Human
uauuucuguuuauuuguacauc

SEQ ID NO: 111915 - RNA, 22 nt, Human
uauuucuugagacucgucuucc

SEQ ID NO: 111916 - RNA, 22 nt, Human
uauuucuuuucgugacuuauug

SEQ ID NO: 111917 - RNA, 22 nt, Human
uauuugaagggagaaagugcca

SEQ ID NO: 111918 - RNA, 22 nt, Human
uauuugaauccugguucuucag

SEQ ID NO: 111919 - RNA, 22 nt, Human
uauuugaugaagguaaagucuu

SEQ ID NO: 111920 - RNA, 22 nt, Human
uauuugcaggcuuuugucaugg

SEQ ID NO: 111921 - RNA, 23 nt, Human
uauuugcuacugguaauucugga

SEQ ID NO: 111922 - RNA, 22 nt, Human
uauuugcugaaucugauucaga

SEQ ID NO: 111923 - RNA, 22 nt, Human
uauuugcuuugguccuccaagc

SEQ ID NO: 111924 - RNA, 22 nt, Human
uauuugcuuuugugccacagau

SEQ ID NO: 111925 - RNA, 22 nt, Human
uauuuggaaaugauaaaguacu

SEQ ID NO: 111926 - RNA, 22 nt, Human
uauuuggaaucugccuuaggac

SEQ ID NO: 111927 - RNA, 22 nt, Human
uauuuggagaugggaucuucaa

SEQ ID NO: 111928 - RNA, 22 nt, Human
uauuuggagcugugugagcuca

SEQ ID NO: 111929 - RNA, 22 nt, Human
uauuuggauacaaucauuugcu

SEQ ID NO: 111930 - RNA, 22 nt, Human
uauuuggugaaucuauggucag

SEQ ID NO: 111931 - RNA, 22 nt, Human
uauuuguccuuauuaagaucug

SEQ ID NO: 111932 - RNA, 22 nt, Human
uauuugucuuucuuauaagaau

SEQ ID NO: 111933 - RNA, 22 nt, Human
uauuuguguggguaucuauaua

SEQ ID NO: 111934 - RNA, 22 nt, Human
uauuuguugaguuguuaugucu

SEQ ID NO: 111935 - RNA, 22 nt, Human
uauuuuaaagacugccagccua

SEQ ID NO: 111936 - RNA, 22 nt, Human
uauuuuacaaaugggaaugcug

SEQ ID NO: 111937 - RNA, 22 nt, Human
uauuuuacagacuacuuuagau

SEQ ID NO: 111938 - RNA, 22 nt, Human
uauuuuacaugacagguguuua

SEQ ID NO: 111939 - RNA, 22 nt, Human
uauuuuacaugauccagaguug

SEQ ID NO: 111940 - RNA, 22 nt, Human
uauuuuacuuuaaagcgagaga

SEQ ID NO: 111941 - RNA, 22 nt, Human
uauuuucaccuucucuggauau

SEQ ID NO: 111942 - RNA, 22 nt, Human
uauuuucauucugugugacugu

SEQ ID NO: 111943 - RNA, 23 nt, Human
uauuuuccaaaugaugacuacau

SEQ ID NO: 111944 - RNA, 22 nt, Human
uauuuugagguauuuuugagcu

SEQ ID NO: 111945 - RNA, 20 nt, Human
uauuuugcaauuaugguuca

SEQ ID NO: 111946 - RNA, 22 nt, Human
uauuuugucuucugcucaucac

SEQ ID NO: 111947 - RNA, 22 nt, Human
uauuuuguuuuguauccacugu

SEQ ID NO: 111948 - RNA, 22 nt, Human
ucaaaaauggucuuugagcugc

SEQ ID NO: 111949 - RNA, 22 nt, Human
ucaaaacccagccaucaggacu

SEQ ID NO: 111950 - RNA, 22 nt, Human
ucaaaaccuaggcucucugcuu

SEQ ID NO: 111951 - RNA, 22 nt, Human
ucaaaacucauuuuggaaguaa

SEQ ID NO: 111952 - RNA, 22 nt, Human
ucaaaagaaacaccauguuccu

SEQ ID NO: 111953 - RNA, 20 nt, Human
ucaaaauaggugugggcgga

SEQ ID NO: 111954 - RNA, 22 nt, Human
ucaaaauuucagcacuagcccu

SEQ ID NO: 111955 - RNA, 22 nt, Human
ucaaacagaaauuguucaugcu

SEQ ID NO: 111956 - RNA, 22 nt, Human
ucaaacauaaaacuaaaucgag

SEQ ID NO: 111957 - RNA, 23 nt, Human
ucaaacauauugugagacacagg

SEQ ID NO: 111958 - RNA, 22 nt, Human
ucaaacuguuagauuucagcuc

SEQ ID NO: 111959 - RNA, 22 nt, Human
ucaaacuucuauucucuguuuu

SEQ ID NO: 111960 - RNA, 22 nt, Human
ucaaagaacaucaucugaaaug

SEQ ID NO: 111961 - RNA, 17 nt, Human
ucaaagaaugcaugcag

SEQ ID NO: 111962 - RNA, 22 nt, Human
ucaaagagcucuaucuucaaaa

SEQ ID NO: 111963 - RNA, 22 nt, Human
ucaaagauagauguugagaaau

SEQ ID NO: 111964 - RNA, 22 nt, Human
ucaaagaugauaggaaaucaua

SEQ ID NO: 111965 - RNA, 22 nt, Human
ucaaagauggguuuuguuugau

SEQ ID NO: 111966 - RNA, 22 nt, Human
ucaaagauugaaacuaaggaga

SEQ ID NO: 111967 - RNA, 22 nt, Human
ucaaagcaauuucaccagugcc

SEQ ID NO: 111968 - RNA, 22 nt, Human
ucaaagcacacuuagugguaga

SEQ ID NO: 111969 - RNA, 22 nt, Human
ucaaaggagacacaaggagaaa

SEQ ID NO: 111970 - RNA, 23 nt, Human
ucaaaggaggcaucguucugcag

SEQ ID NO: 111971 - RNA, 22 nt, Human
ucaaaggcaccaaggucacugc

SEQ ID NO: 111972 - RNA, 22 nt, Human
ucaaaggcccauugucccguug

SEQ ID NO: 111973 - RNA, 19 nt, Human
ucaaaggcuuuuaggagac

SEQ ID NO: 111974 - RNA, 22 nt, Human
ucaaaguaagaauuuauuacaa

SEQ ID NO: 111975 - RNA, 22 nt, Human
ucaaaguagccggauggaauuu

SEQ ID NO: 111976 - RNA, 22 nt, Human
ucaaagucauggcaggcucaga

SEQ ID NO: 111977 - RNA, 22 nt, Human
ucaaaguccuugcuuuuucugu

SEQ ID NO: 111978 - RNA, 22 nt, Human
ucaaauaaggagucaugaccau

SEQ ID NO: 111979 - RNA, 22 nt, Human
ucaaauaccagcaauuucaugu

SEQ ID NO: 111980 - RNA, 22 nt, Human
ucaaaucccagcucagccucuc

SEQ ID NO: 111981 - RNA, 22 nt, Human
ucaaaugcaccucucauuuguu

SEQ ID NO: 111982 - RNA, 17 nt, Human
ucaaauguacagaacua

SEQ ID NO: 111983 - RNA, 22 nt, Human
ucaaauguucccuguacuggcc

SEQ ID NO: 111984 - RNA, 22 nt, Human
ucaaauucagugugacaacauu

SEQ ID NO: 111985 - RNA, 22 nt, Human
ucaaauucuauucuauacucag

SEQ ID NO: 111986 - RNA, 22 nt, Human
ucaacaauugcauguugauguu

SEQ ID NO: 111987 - RNA, 19 nt, Human
ucaacaguggugcugugga

SEQ ID NO: 111988 - RNA, 22 nt, Human
ucaacauauaggcaaccuguaa

SEQ ID NO: 111989 - RNA, 22 nt, Human
ucaacucacaagaaugagcaag

SEQ ID NO: 111990 - RNA, 22 nt, Human
ucaagaaaaugacgccaaccuu

SEQ ID NO: 111991 - RNA, 22 nt, Human
ucaagaacuggaaauugauaug

SEQ ID NO: 111992 - RNA, 22 nt, Human
ucaagaacugugaagagucuga

SEQ ID NO: 111993 - RNA, 22 nt, Human
ucaagaacuuaggagcaagcca

SEQ ID NO: 111994 - RNA, 22 nt, Human
ucaagaauagcugcaaacaggg

SEQ ID NO: 111995 - RNA, 22 nt, Human
ucaagaauuuggauaagaaaug

SEQ ID NO: 111996 - RNA, 22 nt, Human
ucaagacagauggguaacuugg

SEQ ID NO: 111997 - RNA, 22 nt, Human
ucaagacaggguuuaagguuga

SEQ ID NO: 111998 - RNA, 22 nt, Human
ucaagacauauuaaaugugcga

SEQ ID NO: 111999 - RNA, 22 nt, Human
ucaagagaagugcuccacagua

SEQ ID NO: 112000 - RNA, 22 nt, Human
ucaagagcauguaucucccuaa

SEQ ID NO: 112001 - RNA, 22 nt, Human
ucaagauaagucaguauaucaa

SEQ ID NO: 112002 - RNA, 22 nt, Human
ucaagcaaagauacaaauggaa

SEQ ID NO: 112003 - RNA, 22 nt, Human
ucaagcaaucucugugucccug

SEQ ID NO: 112004 - RNA, 22 nt, Human
ucaagcagcagaucaagagcua

SEQ ID NO: 112005 - RNA, 22 nt, Human
ucaagcaggguagcaagcuggu

SEQ ID NO: 112006 - RNA, 22 nt, Human
ucaagcuacaaccauauucauu

SEQ ID NO: 112007 - RNA, 22 nt, Human
ucaagcucauuccucuaaccuc

SEQ ID NO: 112008 - RNA, 22 nt, Human
ucaaggaagggauauucuugaa

SEQ ID NO: 112009 - RNA, 22 nt, Human
ucaaggaaugacuauaugagga

SEQ ID NO: 112010 - RNA, 22 nt, Human
ucaaggagacagaaagcaaugg

SEQ ID NO: 112011 - RNA, 19 nt, Human
ucaaggcucccugagggau

SEQ ID NO: 112012 - RNA, 22 nt, Human
ucaaggugcugugcugugcuag

SEQ ID NO: 112013 - RNA, 22 nt, Human
ugccagcuagucacauauuaga

SEQ ID NO: 112014 - RNA, 22 nt, Human
ugccagcucagaguuaggacug

SEQ ID NO: 112015 - RNA, 22 nt, Human
ugccagcuccgaggagcugcag

SEQ ID NO: 112016 - RNA, 22 nt, Human
ugccagcugacagcagagacaa

SEQ ID NO: 112017 - RNA, 22 nt, Human
ugccagcuuuugacuaucuuag

SEQ ID NO: 112018 - RNA, 22 nt, Human
ugccaggacaaggaccacaugg

SEQ ID NO: 112019 - RNA, 22 nt, Human
ugccaggaguguagagugguuu

SEQ ID NO: 112020 - RNA, 22 nt, Human
ugccaggcauuugacagacacu

SEQ ID NO: 112021 - RNA, 22 nt, Human
ugccaggcccagcuccagagcu

SEQ ID NO: 112022 - RNA, 22 nt, Human
ugccaggcccucccacagauua

SEQ ID NO: 112023 - RNA, 22 nt, Human
ugccaggcccugcgggguccca

SEQ ID NO: 112024 - RNA, 22 nt, Human
ugccaggcgugguggugcgcac

SEQ ID NO: 112025 - RNA, 22 nt, Human
uagcuauuuugcuuggaaauac

SEQ ID NO: 112026 - RNA, 22 nt, Human
uagcucaucuaggcuaccacag

SEQ ID NO: 112027 - RNA, 22 nt, Human
uagcucauguaauccgaacaua

SEQ ID NO: 112028 - RNA, 22 nt, Human
uagcucuggcauucuuuccaaa

SEQ ID NO: 112029 - RNA, 22 nt, Human
uagcucuucaaucacugucucc

SEQ ID NO: 112030 - RNA, 22 nt, Human
uagcugaaggcuacagcagaac

SEQ ID NO: 112031 - RNA, 22 nt, Human
uagcugaaugccuuggauuuuu

SEQ ID NO: 112032 - RNA, 22 nt, Human
uagcugccaaaagggugggcua

SEQ ID NO: 112033 - RNA, 22 nt, Human
uagcugccuagacagcuauagc

SEQ ID NO: 112034 - RNA, 22 nt, Human
uagcugccuuugggcuccugcu

SEQ ID NO: 112035 - RNA, 22 nt, Human
uagcugcuuagaaaucacugag

SEQ ID NO: 112036 - RNA, 22 nt, Human
uagcugcuucagucuaggucuc

SEQ ID NO: 112037 - RNA, 22 nt, Human
uagcugggagugucugaugggu

SEQ ID NO: 112038 - RNA, 22 nt, Human
uagcuggggcuuucauucuugc

SEQ ID NO: 112039 - RNA, 22 nt, Human
uagcugggucucuguuuucuca

SEQ ID NO: 112040 - RNA, 22 nt, Human
uagcuggguugaggucaucuac

SEQ ID NO: 112041 - RNA, 22 nt, Human
uagcugugacguaucucuaugg

SEQ ID NO: 112042 - RNA, 22 nt, Human
uagcugugagcacccaggcugu

SEQ ID NO: 112043 - RNA, 22 nt, Human
uagcugugcccagggaaguugu

SEQ ID NO: 112044 - RNA, 22 nt, Human
uagcugugcccgccacccaacg

SEQ ID NO: 112045 - RNA, 22 nt, Human
uagcuguucucuguaaauugga

SEQ ID NO: 112046 - RNA, 22 nt, Human
uagcuguuggcuuacaucuguu

SEQ ID NO: 112047 - RNA, 22 nt, Human
uagcuguugggagagggcuaga

SEQ ID NO: 112048 - RNA, 22 nt, Human
uagcuguuuaucaaguucuuga

SEQ ID NO: 112049 - RNA, 22 nt, Human
uagcuguuucagugcagcagaa

SEQ ID NO: 112050 - RNA, 22 nt, Human
uagcuguuuugccauaagcgcu

SEQ ID NO: 112051 - RNA, 22 nt, Human
uagcuuaaaccaaucugaauaa

SEQ ID NO: 112052 - RNA, 22 nt, Human
uagcuuaacagcaaaacuguug

SEQ ID NO: 112053 - RNA, 22 nt, Human
uagcuuaaggaguaccagauca

SEQ ID NO: 112054 - RNA, 22 nt, Human
uagcuuaaggcaggcccuuguc

SEQ ID NO: 112055 - RNA, 22 nt, Human
uagcuucagggaaaccacugcu

SEQ ID NO: 112056 - RNA, 22 nt, Human
uagcuucuggaguguuugaaaa

SEQ ID NO: 112057 - RNA, 22 nt, Human
uagcuucugggaguguuuacua

SEQ ID NO: 112058 - RNA, 22 nt, Human
uagcuuguuacacagcaauguu

SEQ ID NO: 112059 - RNA, 22 nt, Human
uagcuuuaaaaaucaucaaagc

SEQ ID NO: 112060 - RNA, 22 nt, Human
uagcuuuaauaagcugcugaau

SEQ ID NO: 112061 - RNA, 22 nt, Human
uagcuuuagugaaaaauaucag

SEQ ID NO: 112062 - RNA, 22 nt, Human
uagcuuugcaaaggaaguuuua

SEQ ID NO: 112063 - RNA, 22 nt, Human
uagcuuugccacacauguagau

SEQ ID NO: 112064 - RNA, 22 nt, Human
uagcuuugccaucugucacaua

SEQ ID NO: 112065 - RNA, 22 nt, Human
uagcuuugcccgugcuggauuu

SEQ ID NO: 112066 - RNA, 22 nt, Human
uagcuuuguuagaaugucuuca

SEQ ID NO: 112067 - RNA, 22 nt, Human
uagcuuuuaguacuuaauggcu

SEQ ID NO: 112068 - RNA, 16 nt, Human
uagcuuuuuccuaugu

SEQ ID NO: 112069 - RNA, 22 nt, Human
uaggaaaacgugauuuucucac

SEQ ID NO: 112070 - RNA, 22 nt, Human
uaggaaaagucuagauugauga

SEQ ID NO: 112071 - RNA, 22 nt, Human
uaggaaacagugcauauauagu

SEQ ID NO: 112072 - RNA, 22 nt, Human
uaggaaagcaguagagccagga

SEQ ID NO: 112073 - RNA, 22 nt, Human
uaggaaauacuguaaguuuggg

SEQ ID NO: 112074 - RNA, 20 nt, Human
uaggaaaucgaggcagggug

SEQ ID NO: 112075 - RNA, 22 nt, Human
uaggaaaugcuccauugcauaa

SEQ ID NO: 112076 - RNA, 22 nt, Human
uaggaaauuugaaauauguggg

SEQ ID NO: 112077 - RNA, 22 nt, Human
uaggaacaacugcagguacaag

SEQ ID NO: 112078 - RNA, 22 nt, Human
uaggaacaaguuuccuugcugu

SEQ ID NO: 112079 - RNA, 22 nt, Human
uaggaacacauccuccucuagc

SEQ ID NO: 112080 - RNA, 22 nt, Human
uaggaacaguuucaggauguuu

SEQ ID NO: 112081 - RNA, 22 nt, Human
uaggaacauaugcagugcuuuu

SEQ ID NO: 112082 - RNA, 22 nt, Human
uaggaacaugcccuuaccuucc

SEQ ID NO: 112083 - RNA, 18 nt, Human
uaggaacauugauuggag

SEQ ID NO: 112084 - RNA, 22 nt, Human
uaggaaccagagcacucugggc

SEQ ID NO: 112085 - RNA, 22 nt, Human
uaggaaccuacugugguuuuaa

SEQ ID NO: 112086 - RNA, 22 nt, Human
uaggaacuaguagauguguaaa

SEQ ID NO: 112087 - RNA, 22 nt, Human
uaggaagauaaacauuuguaug

SEQ ID NO: 112088 - RNA, 22 nt, Human
uaggaagaucaaguuuaucuca

SEQ ID NO: 112089 - RNA, 22 nt, Human
uaggaagcuuccagaacuuaag

SEQ ID NO: 112090 - RNA, 22 nt, Human
uaggaagggaaaggcuucaacu

SEQ ID NO: 112091 - RNA, 22 nt, Human
uaggaaugauaauaguaaagag

SEQ ID NO: 112092 - RNA, 22 nt, Human
uaggaauugaaaaguggucuga

SEQ ID NO: 112093 - RNA, 22 nt, Human
uaggaauuuugcaugggaauuu

SEQ ID NO: 112094 - RNA, 23 nt, Human
uaggacagaaugcagaaaaauac

SEQ ID NO: 112095 - RNA, 22 nt, Human
uaggacagagcugguuacaaug

SEQ ID NO: 112096 - RNA, 22 nt, Human
uaggacaggaucaugaugcugg

SEQ ID NO: 112097 - RNA, 22 nt, Human
uaggacagggacaucuuuuuga

SEQ ID NO: 112098 - RNA, 22 nt, Human
uaggacaggugaggggcugugg

SEQ ID NO: 112099 - RNA, 22 nt, Human
uaggacaguagcuggugcacag

SEQ ID NO: 112100 - RNA, 22 nt, Human
uaggacugauaaggggccagag

SEQ ID NO: 112101 - RNA, 21 nt, Human
uaggacuuuacaauuuaggaa

SEQ ID NO: 112102 - RNA, 22 nt, Human
uaggagagcugaacuauugucu

SEQ ID NO: 112103 - RNA, 22 nt, Human
uaggagcuauaaugugaagucu

SEQ ID NO: 112104 - RNA, 21 nt, Human
uaggagcugauggggaaguag

SEQ ID NO: 112105 - RNA, 22 nt, Human
uaggaguaacucucgucaucau

SEQ ID NO: 112106 - RNA, 22 nt, Human
uaggagugcauaaaacuauauu

SEQ ID NO: 112107 - RNA, 22 nt, Human
uaggauuuuuuggauucuggau

SEQ ID NO: 112108 - RNA, 22 nt, Human
uaggcaacaugucgaauacugu

SEQ ID NO: 112109 - RNA, 22 nt, Human
uaggcaaguugcccaaucucuc

SEQ ID NO: 112110 - RNA, 22 nt, Human
uaggcaauguucuaaggaauga

SEQ ID NO: 112111 - RNA, 22 nt, Human
uaggcacaaaaugaaaauggca

SEQ ID NO: 112112 - RNA, 22 nt, Human
uaggcacuggggaggcagcaug

SEQ ID NO: 112113 - RNA, 22 nt, Human
uaggcacuguguuuguaggagu

SEQ ID NO: 112114 - RNA, 21 nt, Human
uaggcagaggagcagguaucu

SEQ ID NO: 112115 - RNA, 22 nt, Human
uaggcagauuccauauuuuggc

SEQ ID NO: 112116 - RNA, 22 nt, Human
uaggcagccagcaucaguuggg

SEQ ID NO: 112117 - RNA, 22 nt, Human
uaggcagcgcuuggcugugcuu

SEQ ID NO: 112118 - RNA, 22 nt, Human
uaggcagggauuaggguugauu

SEQ ID NO: 112119 - RNA, 22 nt, Human
uaggcagugcucugugcuucag

SEQ ID NO: 112120 - RNA, 22 nt, Human
uaggccacgaaggagaugauag

SEQ ID NO: 112121 - RNA, 22 nt, Human
uaggccacggaaagcagguugc

SEQ ID NO: 112122 - RNA, 22 nt, Human
ugccugcuccaguccuguccac

SEQ ID NO: 112123 - RNA, 19 nt, Human
ugccugcuccuggcuucca

SEQ ID NO: 112124 - RNA, 16 nt, Human
ugccugcucugaucuc

SEQ ID NO: 112125 - RNA, 22 nt, Human
ugccugcucuuaccacucuccc

SEQ ID NO: 112126 - RNA, 22 nt, Human
ugccugcuuguuuaccuacucc

SEQ ID NO: 112127 - RNA, 22 nt, Human
ugccuggaucugaggacccauu

SEQ ID NO: 112128 - RNA, 22 nt, Human
ugccuggcaagaggggcuggcu

SEQ ID NO: 112129 - RNA, 22 nt, Human
ugccuggcaaugccagaagcca

SEQ ID NO: 112130 - RNA, 22 nt, Human
ugccuggcacagagcagguggc

SEQ ID NO: 112131 - RNA, 19 nt, Human
ugccuggcaccagcuccac

SEQ ID NO: 112132 - RNA, 22 nt, Human
ugccuggcacuccuggagcuca

SEQ ID NO: 112133 - RNA, 22 nt, Human
ugccuggcauguuauagacaca

SEQ ID NO: 112134 - RNA, 20 nt, Human
ugccuggccuuucucugccc

SEQ ID NO: 112135 - RNA, 22 nt, Human
ugccuggcugaggugacagguu

SEQ ID NO: 112136 - RNA, 22 nt, Human
ugccugggaaccaauccuggcu

SEQ ID NO: 112137 - RNA, 22 nt, Human
ugccugggacucuguuaucuug

SEQ ID NO: 112138 - RNA, 22 nt, Human
ugccugggccuucccaccucug

SEQ ID NO: 112139 - RNA, 22 nt, Human
ugccugggcucaccgccucuuu

SEQ ID NO: 112140 - RNA, 22 nt, Human
ugccuggggauugcucugggcc

SEQ ID NO: 112141 - RNA, 22 nt, Human
ugccugggugcuggcuggucac

SEQ ID NO: 112142 - RNA, 22 nt, Human
ugccuguccugaggaugagggu

SEQ ID NO: 112143 - RNA, 22 nt, Human
uagauucuaagauucuaagaau

SEQ ID NO: 112144 - RNA, 22 nt, Human
uagauucuacagcucagcuguc

SEQ ID NO: 112145 - RNA, 22 nt, Human
uagauucucccaccugccaggc

SEQ ID NO: 112146 - RNA, 22 nt, Human
uagauucuucuuuugagucucu

SEQ ID NO: 112147 - RNA, 22 nt, Human
uagauuuaagacccugaauuug

SEQ ID NO: 112148 - RNA, 22 nt, Human
uagauuucaggagacaaaaugg

SEQ ID NO: 112149 - RNA, 22 nt, Human
uagauuucaggcuggcuugcgg

SEQ ID NO: 112150 - RNA, 22 nt, Human
uagauuucuaacagugugcuug

SEQ ID NO: 112151 - RNA, 22 nt, Human
uagauuugauguaagcauaguc

SEQ ID NO: 112152 - RNA, 22 nt, Human
uagauuugccugggaaagcuca

SEQ ID NO: 112153 - RNA, 22 nt, Human
uagauuuguuuccuucucucca

SEQ ID NO: 112154 - RNA, 22 nt, Human
uagcaaaagccacgauuacuuu

SEQ ID NO: 112155 - RNA, 22 nt, Human
uagcaaacucauacaugugggu

SEQ ID NO: 112156 - RNA, 22 nt, Human
uagcaaagaagauauuauugca

SEQ ID NO: 112157 - RNA, 22 nt, Human
uagcaaagaccaaagcuaguug

SEQ ID NO: 112158 - RNA, 22 nt, Human
uagcaaagagaaaaauuaugcu

SEQ ID NO: 112159 - RNA, 22 nt, Human
uagcaaagggaaagaagggccu

SEQ ID NO: 112160 - RNA, 23 nt, Human
uagcaaaguuguuugggaaauuu

SEQ ID NO: 112161 - RNA, 22 nt, Human
uagcaaauacaugauguaauuu

SEQ ID NO: 112162 - RNA, 22 nt, Human
uagcaaauguaaaaugccuaca

SEQ ID NO: 112163 - RNA, 22 nt, Human
uagcaaauguguuaugcuaugc

SEQ ID NO: 112164 - RNA, 22 nt, Human
uagcaacaauggaaguaacuuc

SEQ ID NO: 112165 - RNA, 22 nt, Human
uagcaacaugguuaucacauua

SEQ ID NO: 112166 - RNA, 22 nt, Human
uagcaacugccuuuacuauauu

SEQ ID NO: 112167 - RNA, 22 nt, Human
uagcaagaccaauauguagaua

SEQ ID NO: 112168 - RNA, 22 nt, Human
uagcaagaggaaacaaggggcc

SEQ ID NO: 112169 - RNA, 22 nt, Human
uagcaagauccuucccuggcgu

SEQ ID NO: 112170 - RNA, 20 nt, Human
uagcaagcaggaggugcaga

SEQ ID NO: 112171 - RNA, 22 nt, Human
uagcaaggcguggcacucaaau

SEQ ID NO: 112172 - RNA, 22 nt, Human
uagcaaggugaaguauggguga

SEQ ID NO: 112173 - RNA, 22 nt, Human
uagcaaguagauacucauuuag

SEQ ID NO: 112174 - RNA, 22 nt, Human
uagcaauagaaacauauaaagu

SEQ ID NO: 112175 - RNA, 22 nt, Human
uagcaaugcuucauuauuuaaa

SEQ ID NO: 112176 - RNA, 22 nt, Human
uagcacaaagagucuuucagag

SEQ ID NO: 112177 - RNA, 22 nt, Human
uagcacaaagucuugcccuuuu

SEQ ID NO: 112178 - RNA, 22 nt, Human
uagcacaagcaacuacugaagu

SEQ ID NO: 112179 - RNA, 22 nt, Human
uagcacaauaucaugucuguga

SEQ ID NO: 112180 - RNA, 22 nt, Human
uagcacacuaaagauauuaaca

SEQ ID NO: 112181 - RNA, 18 nt, Human
uagcacagagcaggaugu

SEQ ID NO: 112182 - RNA, 21 nt, Human
uagcacagcuguagacaguuu

SEQ ID NO: 112183 - RNA, 22 nt, Human
uagcacaggucuuguugccauu

SEQ ID NO: 112184 - RNA, 17 nt, Human
uagcacagugccuggua

SEQ ID NO: 112185 - RNA, 22 nt, Human
uagcacaguucacuaugauaca

SEQ ID NO: 112186 - RNA, 22 nt, Human
uagcacauaacuuagaauaguu

SEQ ID NO: 112187 - RNA, 22 nt, Human
uagcacaucuggcgcuuauagg

SEQ ID NO: 112188 - RNA, 22 nt, Human
uagcacaucuucuuggccugca

SEQ ID NO: 112189 - RNA, 22 nt, Human
uagcaccaaaacugaagaacau

SEQ ID NO: 112190 - RNA, 22 nt, Human
uagcaccuuagcauuucuagug

SEQ ID NO: 112191 - RNA, 22 nt, Human
uagcacuauauguuagcuauua

SEQ ID NO: 112192 - RNA, 22 nt, Human
uagcagaaacuguuacagaagg

SEQ ID NO: 112193 - RNA, 22 nt, Human
uagcagaacaauagucaaugau

SEQ ID NO: 112194 - RNA, 22 nt, Human
uagcagaagaacaacaugaucu

SEQ ID NO: 112195 - RNA, 22 nt, Human
uagcagagauaugggcauagau

SEQ ID NO: 112196 - RNA, 19 nt, Human
uagcagagaugacuccagc

SEQ ID NO: 112197 - RNA, 22 nt, Human
uagcagagcacaucuucauucu

SEQ ID NO: 112198 - RNA, 22 nt, Human
uagcagagguaaguguggcaau

SEQ ID NO: 112199 - RNA, 22 nt, Human
uagcagcaaaaugaccuucuaa

SEQ ID NO: 112200 - RNA, 22 nt, Human
uagcagcaagaaugggaugugu

SEQ ID NO: 112201 - RNA, 22 nt, Human
uagcagcaauuacacaguccgu

SEQ ID NO: 112202 - RNA, 22 nt, Human
uagcagcaauuucagaaguuug

SEQ ID NO: 112203 - RNA, 22 nt, Human
uagcagcacauggugguuuuau

SEQ ID NO: 112204 - RNA, 22 nt, Human
uagcagcaccuacacgucagag

SEQ ID NO: 112205 - RNA, 22 nt, Human
uagcagcauccuguggugaugg

SEQ ID NO: 112206 - RNA, 23 nt, Human
uagcagcauuuuuagccucuguc

SEQ ID NO: 112207 - RNA, 22 nt, Human
uagcagcgacuaaugaauaagu

SEQ ID NO: 112208 - RNA, 22 nt, Human
uagcagcucacagccucccauu

SEQ ID NO: 112209 - RNA, 22 nt, Human
uagcagcuccauuucucuggca

SEQ ID NO: 112210 - RNA, 22 nt, Human
uagcagcuccuaaacaguggug

SEQ ID NO: 112211 - RNA, 22 nt, Human
uagcagcucuuuacuaaccagu

SEQ ID NO: 112212 - RNA, 19 nt, Human
uagcagcugccaaaggaga

SEQ ID NO: 112213 - RNA, 22 nt, Human
uagcagcugugaguaaaagcca

SEQ ID NO: 112214 - RNA, 22 nt, Human
uagcagcuguggaggggcugug

SEQ ID NO: 112215 - RNA, 22 nt, Human
uagcaggaaaccuguguugagg

SEQ ID NO: 112216 - RNA, 22 nt, Human
uagcaggagagaaguuuuaagu

SEQ ID NO: 112217 - RNA, 22 nt, Human
uagcagggccaggcugggaacc

SEQ ID NO: 112218 - RNA, 22 nt, Human
uagcaggguaaauguagaugga

SEQ ID NO: 112219 - RNA, 22 nt, Human
uagcagugguuccuacguguug

SEQ ID NO: 112220 - RNA, 22 nt, Human
uagcauaauuuguagaaaauca

SEQ ID NO: 112221 - RNA, 22 nt, Human
uagcaucugaacuguugaaaag

SEQ ID NO: 112222 - RNA, 22 nt, Human
uagcaucugcguuggguuggac

SEQ ID NO: 112223 - RNA, 22 nt, Human
uagcaucuguucuuucauuaaa

SEQ ID NO: 112224 - RNA, 22 nt, Human
uagcaucuuuuucugucuucua

SEQ ID NO: 112225 - RNA, 22 nt, Human
uagcauggggagcagaaaguca

SEQ ID NO: 112226 - RNA, 22 nt, Human
uagcaugggucgcgucucugga

SEQ ID NO: 112227 - RNA, 22 nt, Human
uagcauuaaagguaagacauua

SEQ ID NO: 112228 - RNA, 22 nt, Human
uagcauuagagauagaaauagu

SEQ ID NO: 112229 - RNA, 22 nt, Human
uagcauuagucagauauguuuu

SEQ ID NO: 112230 - RNA, 22 nt, Human
uagcauuaucugucuuaucauu

SEQ ID NO: 112231 - RNA, 22 nt, Human
uaggacuugguuugaagauuuu

SEQ ID NO: 112232 - RNA, 22 nt, Human
uaggagaagagucagggccuaa

SEQ ID NO: 112233 - RNA, 22 nt, Human
uaggagacauugaucccaagaa

SEQ ID NO: 112234 - RNA, 18 nt, Human
uaggagagaauuuauuua

SEQ ID NO: 112235 - RNA, 22 nt, Human
uaggagccugcucugcagggac

SEQ ID NO: 112236 - RNA, 22 nt, Human
uaggagcuuuuggaguccugug

SEQ ID NO: 112237 - RNA, 22 nt, Human
uaggaggccauccagccugccu

SEQ ID NO: 112238 - RNA, 22 nt, Human
uaggagggggaacaaggcauac

SEQ ID NO: 112239 - RNA, 22 nt, Human
uaggaggguuagagggaaauau

SEQ ID NO: 112240 - RNA, 22 nt, Human
uaggauacaaauucuguaauuu

SEQ ID NO: 112241 - RNA, 22 nt, Human
uaggaugaaaauccagcuuaua

SEQ ID NO: 112242 - RNA, 22 nt, Human
uaggaugacugauagugauucc

SEQ ID NO: 112243 - RNA, 22 nt, Human
uaggaugagggguggccaagua

SEQ ID NO: 112244 - RNA, 22 nt, Human
uaggauguagcuaugucaucau

SEQ ID NO: 112245 - RNA, 22 nt, Human
uaggauuuauucuacaauauug

SEQ ID NO: 112246 - RNA, 22 nt, Human
uaggcaauauuagacuuugucu

SEQ ID NO: 112247 - RNA, 22 nt, Human
uaggcacaagaccaugcaaagg

SEQ ID NO: 112248 - RNA, 22 nt, Human
uaggcacugguuguggauaguu

SEQ ID NO: 112249 - RNA, 22 nt, Human
uaggcagaauuguugaaugaag

SEQ ID NO: 112250 - RNA, 20 nt, Human
uaggcagcuugacccuuggu

SEQ ID NO: 112251 - RNA, 22 nt, Human
uaggcaugcaaauaaaugugca

SEQ ID NO: 112252 - RNA, 22 nt, Human
uaggccaaaugacuugauguuu

SEQ ID NO: 112253 - RNA, 22 nt, Human
uaggccaaggacaguaaggaca

SEQ ID NO: 112254 - RNA, 22 nt, Human
uaggccaaguugaucagacauc

SEQ ID NO: 112255 - RNA, 22 nt, Human
uaggccacaaauaagauccugu

SEQ ID NO: 112256 - RNA, 22 nt, Human
uaggccacagaugagacauaag

SEQ ID NO: 112257 - RNA, 21 nt, Human
uaggccacauggguuggagau

SEQ ID NO: 112258 - RNA, 22 nt, Human
uaggccacucuccuuugucuca

SEQ ID NO: 112259 - RNA, 22 nt, Human
uaggccaggagucagacagauu

SEQ ID NO: 112260 - RNA, 23 nt, Human
ucagaaggugccacugacgcuuu

SEQ ID NO: 112261 - RNA, 22 nt, Human
ucagaaguaagguucucccaag

SEQ ID NO: 112262 - RNA, 22 nt, Human
ucagaaguacugugcuacaaua

SEQ ID NO: 112263 - RNA, 22 nt, Human
ucagaaguaggagacauucuug

SEQ ID NO: 112264 - RNA, 22 nt, Human
ucagaaguauuaugcuaaagga

SEQ ID NO: 112265 - RNA, 22 nt, Human
ucagaagucuggacugcuucuc

SEQ ID NO: 112266 - RNA, 22 nt, Human
ucagaaguuaauacgaggagaa

SEQ ID NO: 112267 - RNA, 22 nt, Human
ucagaaguuucaaucccagcug

SEQ ID NO: 112268 - RNA, 22 nt, Human
ucagaaucugaaaagcgcuugg

SEQ ID NO: 112269 - RNA, 22 nt, Human
ucagaaugaaauuucuuucaga

SEQ ID NO: 112270 - RNA, 21 nt, Human
ucagaauuaccccuggaucug

SEQ ID NO: 112271 - RNA, 22 nt, Human
ucagaauucuacaauagaucag

SEQ ID NO: 112272 - RNA, 22 nt, Human
ucagaauucuagcucuucccuu

SEQ ID NO: 112273 - RNA, 22 nt, Human
ucagaauuggaacgugaagauu

SEQ ID NO: 112274 - RNA, 22 nt, Human
ucagaauuguggagaaagggga

SEQ ID NO: 112275 - RNA, 22 nt, Human
ucagacagagaaguacaaugag

SEQ ID NO: 112276 - RNA, 22 nt, Human
ucagacagauuuugacacuugc

SEQ ID NO: 112277 - RNA, 22 nt, Human
ucagacagcuugcagggaggug

SEQ ID NO: 112278 - RNA, 22 nt, Human
ucagacauauuuuuaacaaagu

SEQ ID NO: 112279 - RNA, 22 nt, Human
ucagacaugggauaugaagcuc

SEQ ID NO: 112280 - RNA, 22 nt, Human
ucagaccauccugcuguuagug

SEQ ID NO: 112281 - RNA, 20 nt, Human
ucagacccuacauuccucag

SEQ ID NO: 112282 - RNA, 22 nt, Human
ucagacccugcgguguuuggau

SEQ ID NO: 112283 - RNA, 22 nt, Human
ucagaccucugaccuugccaaa

SEQ ID NO: 112284 - RNA, 22 nt, Human
ucagacugaucaucuaucagau

SEQ ID NO: 112285 - RNA, 22 nt, Human
ucagacuuccacuuugugcacu

SEQ ID NO: 112286 - RNA, 22 nt, Human
ucagacuugacuuuguaaguuu

SEQ ID NO: 112287 - RNA, 22 nt, Human
ucagacuuuuaaagacugaaug

SEQ ID NO: 112288 - RNA, 22 nt, Human
ucagagaaaggccaaaauauca

SEQ ID NO: 112289 - RNA, 22 nt, Human
ucagagaaaugacaauauauag

SEQ ID NO: 112290 - RNA, 22 nt, Human
ucagagaaaugcugagcucaug

SEQ ID NO: 112291 - RNA, 22 nt, Human
ucagagaacacagaggugaugu

SEQ ID NO: 112292 - RNA, 21 nt, Human
ucagagaacccggcaggcaag

SEQ ID NO: 112293 - RNA, 22 nt, Human
ucagagaaggcugagucacggc

SEQ ID NO: 112294 - RNA, 21 nt, Human
ucagagaauggccuacucuca

SEQ ID NO: 112295 - RNA, 22 nt, Human
ucagagacaguucuggggcagg

SEQ ID NO: 112296 - RNA, 22 nt, Human
ucagagaccuagcaagaaauug

SEQ ID NO: 112297 - RNA, 22 nt, Human
ucagagagcagaacuuuuuuac

SEQ ID NO: 112298 - RNA, 22 nt, Human
ucagagaggauuuuaauaagug

SEQ ID NO: 112299 - RNA, 21 nt, Human
ucagagagucacagugaacug

SEQ ID NO: 112300 - RNA, 22 nt, Human
ucagagaguuggaaagaauuaa

SEQ ID NO: 112301 - RNA, 22 nt, Human
ucagagaguuuucacuagggug

SEQ ID NO: 112302 - RNA, 22 nt, Human
ucagagaugcagugccaccuac

SEQ ID NO: 112303 - RNA, 22 nt, Human
ucagagcaugugggcugcaguu

SEQ ID NO: 112304 - RNA, 22 nt, Human
ucagaggacaagcucccuggug

SEQ ID NO: 112305 - RNA, 22 nt, Human
ucagaggaccuuacugagaacc

SEQ ID NO: 112306 - RNA, 22 nt, Human
ucagaggacuaccuucuccagu

SEQ ID NO: 112307 - RNA, 22 nt, Human
ucagaggagaccaaggggaaua

SEQ ID NO: 112308 - RNA, 23 nt, Human
ucagaggaucaucaaacguuuuc

SEQ ID NO: 112309 - RNA, 22 nt, Human
ucagaggauuggacuuuuaugu

SEQ ID NO: 112310 - RNA, 22 nt, Human
ucagaggcuacagucugggagu

SEQ ID NO: 112311 - RNA, 22 nt, Human
ucagaggcucaucugccuugca

SEQ ID NO: 112312 - RNA, 21 nt, Human
ucagaggcugggggaaugccc

SEQ ID NO: 112313 - RNA, 22 nt, Human
ucagaggcuuccuuccucggag

SEQ ID NO: 112314 - RNA, 22 nt, Human
ucagaggcuucuggccagucug

SEQ ID NO: 112315 - RNA, 22 nt, Human
ucagaggguggcugggagcauc

SEQ ID NO: 112316 - RNA, 18 nt, Human
ucagagguacagaaaagu

SEQ ID NO: 112317 - RNA, 22 nt, Human
ucagaggugagcuucuugcuaa

SEQ ID NO: 112318 - RNA, 22 nt, Human
ucagaggugguaaaggacagca

SEQ ID NO: 112319 - RNA, 22 nt, Human
ucagagguuccggccauaacca

SEQ ID NO: 112320 - RNA, 22 nt, Human
ucagaguaacuacaguauagac

SEQ ID NO: 112321 - RNA, 22 nt, Human
ucagagucauugcaaguagaag

SEQ ID NO: 112322 - RNA, 22 nt, Human
ucagaguccaugguacuuaauu

SEQ ID NO: 112323 - RNA, 22 nt, Human
ucagaguccucacccugaggau

SEQ ID NO: 112324 - RNA, 22 nt, Human
ucagagucuuaacuauucagag

SEQ ID NO: 112325 - RNA, 22 nt, Human
ucagagugaccuuacauggucu

SEQ ID NO: 112326 - RNA, 22 nt, Human
ucagagugcagcgggaggcugg

SEQ ID NO: 112327 - RNA, 22 nt, Human
ucagagugcagggaguagcagc

SEQ ID NO: 112328 - RNA, 22 nt, Human
ucagaguguuuuacuaaacaag

SEQ ID NO: 112329 - RNA, 22 nt, Human
ucagauaagugaagcaaaguuu

SEQ ID NO: 112330 - RNA, 22 nt, Human
ucagauacuguggcuuaugggc

SEQ ID NO: 112331 - RNA, 22 nt, Human
ucagauagugauaauagcaugu

SEQ ID NO: 112332 - RNA, 22 nt, Human
ucagauauggagucuaaaacca

SEQ ID NO: 112333 - RNA, 22 nt, Human
ucagauauucaauuaaguuaaa

SEQ ID NO: 112334 - RNA, 22 nt, Human
ucagauauucucuaagaacaau

SEQ ID NO: 112335 - RNA, 22 nt, Human
ucagauggaaagguuacugucc

SEQ ID NO: 112336 - RNA, 22 nt, Human
ucagauggauucauuacaugac

SEQ ID NO: 112337 - RNA, 22 nt, Human
ucagauggauuuauacuauuuc

SEQ ID NO: 112338 - RNA, 20 nt, Human
ucagaugggagugagccauc

SEQ ID NO: 112339 - RNA, 22 nt, Human
ucagauggguuuugaaggaugu

SEQ ID NO: 112340 - RNA, 22 nt, Human
uaucuguucaauggaagaugac

SEQ ID NO: 112341 - RNA, 22 nt, Human
uaucuguuggcuccuaguugua

SEQ ID NO: 112342 - RNA, 22 nt, Human
uaucuguugucuuuuacaugua

SEQ ID NO: 112343 - RNA, 22 nt, Human
uaucuguuuccuaugcauguga

SEQ ID NO: 112344 - RNA, 19 nt, Human
uaucuguuuccugcuuguc

SEQ ID NO: 112345 - RNA, 22 nt, Human
uaucuguuuuuacagugucuuu

SEQ ID NO: 112346 - RNA, 22 nt, Human
uaucuuaaaaaucgaagcagau

SEQ ID NO: 112347 - RNA, 22 nt, Human
uaucuuaaaugcaugauagaca

SEQ ID NO: 112348 - RNA, 23 nt, Human
uaucuuaccucccuucuuuccug

SEQ ID NO: 112349 - RNA, 22 nt, Human
uaucuucacuuauaucuuucuu

SEQ ID NO: 112350 - RNA, 22 nt, Human
uaucuucagcugaagcagaguc

SEQ ID NO: 112351 - RNA, 22 nt, Human
uaucuugccuuuaacugcucau

SEQ ID NO: 112352 - RNA, 22 nt, Human
uaucuuguaauagguccacuug

SEQ ID NO: 112353 - RNA, 22 nt, Human
uaucuugugcagaugaaagaau

SEQ ID NO: 112354 - RNA, 22 nt, Human
uaucuuuaacuugcaguauuua

SEQ ID NO: 112355 - RNA, 22 nt, Human
uaucuuuguaucaaucuccauu

SEQ ID NO: 112356 - RNA, 18 nt, Human
uaucuuuuccagugguau

SEQ ID NO: 112357 - RNA, 23 nt, Human
uaucuuuuucaauguuggaaaua

SEQ ID NO: 112358 - RNA, 22 nt, Human
uaugaaaauuuagcugaagcau

SEQ ID NO: 112359 - RNA, 22 nt, Human
uaugaaaugguaguaggaaggg

SEQ ID NO: 112360 - RNA, 22 nt, Human
uaugaaauuuaaacacagauca

SEQ ID NO: 112361 - RNA, 22 nt, Human
uaugaacacuuauuggggaagg

SEQ ID NO: 112362 - RNA, 21 nt, Human
uaugaacaugaccaauagucc

SEQ ID NO: 112363 - RNA, 22 nt, Human
uaugaacaugcugugguuauaa

SEQ ID NO: 112364 - RNA, 22 nt, Human
uaugaacauuauuuuugucuag

SEQ ID NO: 112365 - RNA, 22 nt, Human
uaugaacucuggagucugagug

SEQ ID NO: 112366 - RNA, 23 nt, Human
uaugaacugcauugcuggugugu

SEQ ID NO: 112367 - RNA, 22 nt, Human
uaugaacuuuaagcucuguguc

SEQ ID NO: 112368 - RNA, 22 nt, Human
uaugaagauauaucugaucucu

SEQ ID NO: 112369 - RNA, 20 nt, Human
uaugaaguguucuucuggua

SEQ ID NO: 112370 - RNA, 19 nt, Human
uaugaaguugauaaaaguu

SEQ ID NO: 112371 - RNA, 22 nt, Human
uaugaauucucuuguguauagu

SEQ ID NO: 112372 - RNA, 20 nt, Human
uaugaauucuggucccuggg

SEQ ID NO: 112373 - RNA, 22 nt, Human
uaugacaggcaugagauccuaa

SEQ ID NO: 112374 - RNA, 22 nt, Human
uaugacauuauaaaggauuauu

SEQ ID NO: 112375 - RNA, 22 nt, Human
uaugacauuucucugauuugug

SEQ ID NO: 112376 - RNA, 22 nt, Human
uaugaccauaagauuacuguua

SEQ ID NO: 112377 - RNA, 22 nt, Human
uaugacuauagggcuuaguguu

SEQ ID NO: 112378 - RNA, 22 nt, Human
uaugacuuauuucaucaguucu

SEQ ID NO: 112379 - RNA, 21 nt, Human
uaugagaaaacugaggugcau

SEQ ID NO: 112380 - RNA, 22 nt, Human
uaugagaaagucguaugucucc

SEQ ID NO: 112381 - RNA, 22 nt, Human
uaugagauauucccagcgucua

SEQ ID NO: 112382 - RNA, 22 nt, Human
uaugaggcacuucauuagcugg

SEQ ID NO: 112383 - RNA, 22 nt, Human
uaugaguacaaggaaggaugga

SEQ ID NO: 112384 - RNA, 22 nt, Human
uaugaguacaaggaaucuucca

SEQ ID NO: 112385 - RNA, 22 nt, Human
uaugaguacaaggacucugucu

SEQ ID NO: 112386 - RNA, 23 nt, Human
uaugagucaucugcuacaaccca

SEQ ID NO: 112387 - RNA, 22 nt, Human
uaugaguucaguuaucuuaagu

SEQ ID NO: 112388 - RNA, 22 nt, Human
uaugaguuuaaggcuaaaauag

SEQ ID NO: 112389 - RNA, 20 nt, Human
uaugauaauuacaaaauagu

SEQ ID NO: 112390 - RNA, 22 nt, Human
uaugauauucuaaauugacacc

SEQ ID NO: 112391 - RNA, 22 nt, Human
uaugaucucugggucuggagcu

SEQ ID NO: 112392 - RNA, 22 nt, Human
uaugaucuuuauaaccuaucuu

SEQ ID NO: 112393 - RNA, 19 nt, Human
ucaguggaugaacauguuu

SEQ ID NO: 112394 - RNA, 22 nt, Human
ucaguggauuggaugagaucug

SEQ ID NO: 112395 - RNA, 20 nt, Human
ucagugggaaagugagagug

SEQ ID NO: 112396 - RNA, 22 nt, Human
ucaguguaaguuauguagaugu

SEQ ID NO: 112397 - RNA, 18 nt, Human
ucaguguagaucugugua

SEQ ID NO: 112398 - RNA, 22 nt, Human
ucaguguagcagacuuguagcc

SEQ ID NO: 112399 - RNA, 22 nt, Human
ucaguguagggcagaccccugg

SEQ ID NO: 112400 - RNA, 16 nt, Human
ucagugucagcuccug

SEQ ID NO: 112401 - RNA, 20 nt, Human
ucagugucaguagccacuac

SEQ ID NO: 112402 - RNA, 22 nt, Human
ucaguguccauaaauaaaguuu

SEQ ID NO: 112403 - RNA, 22 nt, Human
ucagugucucauaugagguuuc

SEQ ID NO: 112404 - RNA, 22 nt, Human
ucagugucuugaccugggugug

SEQ ID NO: 112405 - RNA, 22 nt, Human
ucagugucuugggcuugaaugc

SEQ ID NO: 112406 - RNA, 22 nt, Human
ucagugugaauucaggagccua

SEQ ID NO: 112407 - RNA, 22 nt, Human
ucagugugaggggcuggguccu

SEQ ID NO: 112408 - RNA, 22 nt, Human
ucagugugcacucugugaccca

SEQ ID NO: 112409 - RNA, 22 nt, Human
ucaguguuacauuauauagaac

SEQ ID NO: 112410 - RNA, 22 nt, Human
ucaguguuauuagaugagguuu

SEQ ID NO: 112411 - RNA, 22 nt, Human
ucaguguucagcggugugugca

SEQ ID NO: 112412 - RNA, 22 nt, Human
ucaguguucgcucagggacucc

SEQ ID NO: 112413 - RNA, 22 nt, Human
ucaguguuggcauucagaaaug

SEQ ID NO: 112414 - RNA, 22 nt, Human
ucaguguuuaccguauguuguu

SEQ ID NO: 112415 - RNA, 22 nt, Human
ucaguuaagacugcacuggacu

SEQ ID NO: 112416 - RNA, 22 nt, Human
ucaguuaagcacuauacccuaa

SEQ ID NO: 112417 - RNA, 22 nt, Human
ucaguuaaucaauguggucuaa

SEQ ID NO: 112418 - RNA, 22 nt, Human
ucaguuacuccuuuccuuaggu

SEQ ID NO: 112419 - RNA, 22 nt, Human
ucaguuagcguaaucacugggg

SEQ ID NO: 112420 - RNA, 20 nt, Human
ucaguuaggaagaggcacuc

SEQ ID NO: 112421 - RNA, 22 nt, Human
ucaguuccucugcccaaggcag

SEQ ID NO: 112422 - RNA, 22 nt, Human
ucaguuccuguugcacagcauc

SEQ ID NO: 112423 - RNA, 22 nt, Human
ucaguucucucaugccugcccu

SEQ ID NO: 112424 - RNA, 21 nt, Human
ucaguucucugccugugcuug

SEQ ID NO: 112425 - RNA, 22 nt, Human
ucaguucuuauuuucaugaaua

SEQ ID NO: 112426 - RNA, 22 nt, Human
ucaguucuugggcugcuaggac

SEQ ID NO: 112427 - RNA, 22 nt, Human
ucaguugcaccugcaugguacu

SEQ ID NO: 112428 - RNA, 21 nt, Human
ucaguugccaaagugauguca

SEQ ID NO: 112429 - RNA, 22 nt, Human
ucaguuucacagucugugcaga

SEQ ID NO: 112430 - RNA, 22 nt, Human
ucaguuuccucaucuacaaaag

SEQ ID NO: 112431 - RNA, 22 nt, Human
ucaguuuccugguuuuaauauu

SEQ ID NO: 112432 - RNA, 22 nt, Human
ucaguuucuaaaucuuaccaau

SEQ ID NO: 112433 - RNA, 22 nt, Human
ucaguuucuucaucucccuaac

SEQ ID NO: 112434 - RNA, 22 nt, Human
ucaguuucuucuuuagauaaaa

SEQ ID NO: 112435 - RNA, 22 nt, Human
ucaguuuuaagguuugagaauu

SEQ ID NO: 112436 - RNA, 22 nt, Human
ucaguuuucucaucuguaauuu

SEQ ID NO: 112437 - RNA, 22 nt, Human
ucaguuuugauuccugguucuc

SEQ ID NO: 112438 - RNA, 22 nt, Human
ucaguuuuguauguuguaaguc

SEQ ID NO: 112439 - RNA, 22 nt, Human
ucaguuuuuacggucacaggga

SEQ ID NO: 112440 - RNA, 22 nt, Human
ucauaaaacacaccagguaguu

SEQ ID NO: 112441 - RNA, 22 nt, Human
ucauaaaaugcuccugauauug

SEQ ID NO: 112442 - RNA, 21 nt, Human
ucauaaacuaguaucaaaguu

SEQ ID NO: 112443 - RNA, 22 nt, Human
ucauaaagagugcuguuguuuu

SEQ ID NO: 112444 - RNA, 22 nt, Human
ucauaaaucauacuccauuugc

SEQ ID NO: 112445 - RNA, 22 nt, Human
ucauaaauuagcugucuuugaa

SEQ ID NO: 112446 - RNA, 22 nt, Human
ucauaacagcuaagucccuuuc

SEQ ID NO: 112447 - RNA, 22 nt, Human
ucauaaugaccccagaguccgc

SEQ ID NO: 112448 - RNA, 22 nt, Human
ucauacauaaauaagaguuuag

SEQ ID NO: 112449 - RNA, 22 nt, Human
ucauucaucaguugguagagau

SEQ ID NO: 112450 - RNA, 22 nt, Human
ucauucaugaggugcuagugcu

SEQ ID NO: 112451 - RNA, 22 nt, Human
ucauuccauuuccagcucugaa

SEQ ID NO: 112452 - RNA, 22 nt, Human
ucauucuugaucacuaguuagu

SEQ ID NO: 112453 - RNA, 22 nt, Human
ucauucuuuaccaaguugucac

SEQ ID NO: 112454 - RNA, 22 nt, Human
ucauugaaagugccuccucgga

SEQ ID NO: 112455 - RNA, 22 nt, Human
ucauugaacgaagagcuccauu

SEQ ID NO: 112456 - RNA, 16 nt, Human
ucauugaagacaguac

SEQ ID NO: 112457 - RNA, 22 nt, Human
ucauugaauacauauuugggau

SEQ ID NO: 112458 - RNA, 22 nt, Human
ucauugaauuugguucaauaug

SEQ ID NO: 112459 - RNA, 22 nt, Human
ucauugaguugcacuuuuacua

SEQ ID NO: 112460 - RNA, 22 nt, Human
ucauugauaaaguacugcuuuu

SEQ ID NO: 112461 - RNA, 20 nt, Human
ucauugcacauaauggaagc

SEQ ID NO: 112462 - RNA, 22 nt, Human
ucauugcagaaauaaaggugaa

SEQ ID NO: 112463 - RNA, 22 nt, Human
ucauugcagugauguuguaugu

SEQ ID NO: 112464 - RNA, 22 nt, Human
ucauugcaguugaguuguguua

SEQ ID NO: 112465 - RNA, 21 nt, Human
ucauuggucauuaagcucugu

SEQ ID NO: 112466 - RNA, 22 nt, Human
ucauuguauuaaaauauugguu

SEQ ID NO: 112467 - RNA, 22 nt, Human
ucauugucagcucuugacuucu

SEQ ID NO: 112468 - RNA, 22 nt, Human
ucauugucuugauaugauuguc

SEQ ID NO: 112469 - RNA, 23 nt, Human
ucauugugacugugccacauaac

SEQ ID NO: 112470 - RNA, 22 nt, Human
ucauuguuaauuguaugaucug

SEQ ID NO: 112471 - RNA, 22 nt, Human
ucauuguuacuguuuaguugcc

SEQ ID NO: 112472 - RNA, 22 nt, Human
ucauuuaaaauguaccaggauu

SEQ ID NO: 112473 - RNA, 22 nt, Human
ucauuuaauaauuuuugaguag

SEQ ID NO: 112474 - RNA, 22 nt, Human
ucauuuacauagaaacaauaua

SEQ ID NO: 112475 - RNA, 22 nt, Human
ucauuuacuugguuuuaaucuu

SEQ ID NO: 112476 - RNA, 22 nt, Human
ucauuuauagaagugggcagua

SEQ ID NO: 112477 - RNA, 22 nt, Human
ucauuuauagcuaaccuugaau

SEQ ID NO: 112478 - RNA, 22 nt, Human
ucauuuauauuguauucuguag

SEQ ID NO: 112479 - RNA, 22 nt, Human
ucauuuaugcaggaauggcaua

SEQ ID NO: 112480 - RNA, 21 nt, Human
ucauuuauugagaaaugacug

SEQ ID NO: 112481 - RNA, 22 nt, Human
ucauuucagaugcauuuagaau

SEQ ID NO: 112482 - RNA, 22 nt, Human
ucauuucagccauuuuuaaaug

SEQ ID NO: 112483 - RNA, 22 nt, Human
ucauuucaguuguucccugguu

SEQ ID NO: 112484 - RNA, 22 nt, Human
ucauuucccuccuacaaagagg

SEQ ID NO: 112485 - RNA, 22 nt, Human
ucauuucuccgaccugcugucc

SEQ ID NO: 112486 - RNA, 22 nt, Human
ucauuucuccuaagugaaauau

SEQ ID NO: 112487 - RNA, 22 nt, Human
ucauuucuguugugcaucacug

SEQ ID NO: 112488 - RNA, 22 nt, Human
ucauuuggaagccugagagugu

SEQ ID NO: 112489 - RNA, 22 nt, Human
ucauuuggagccuuccuguuuu

SEQ ID NO: 112490 - RNA, 22 nt, Human
ucauuugggucaguuuuccaua

SEQ ID NO: 112491 - RNA, 22 nt, Human
ucauuuguaccauuuuuuaaga

SEQ ID NO: 112492 - RNA, 22 nt, Human
ucauuugugugagugauuugac

SEQ ID NO: 112493 - RNA, 22 nt, Human
ucauuuguugcuguuaccugag

SEQ ID NO: 112494 - RNA, 18 nt, Human
ucauuuguuuugcaugaa

SEQ ID NO: 112495 - RNA, 16 nt, Human
ucauuuugagugacag

SEQ ID NO: 112496 - RNA, 22 nt, Human
ucauuuugggguuugucaucuu

SEQ ID NO: 112497 - RNA, 22 nt, Human
ucauuuuugucuccgguuugug

SEQ ID NO: 112498 - RNA, 22 nt, Human
ucauuuuuugcauaccuguguc

SEQ ID NO: 112499 - RNA, 21 nt, Human
uccaaaaaggagcguccuucu

SEQ ID NO: 112500 - RNA, 22 nt, Human
uccaaaacagaacucugugaau

SEQ ID NO: 112501 - RNA, 22 nt, Human
uccaaagaagucacaaacgaag

SEQ ID NO: 112502 - RNA, 20 nt, Human
uccaaagaaguucacauuua

SEQ ID NO: 112503 - RNA, 22 nt, Human
uccaaagagguuaagaacgaga

SEQ ID NO: 112504 - RNA, 22 nt, Human
uccaaagcaucugagugugcau

SEQ ID NO: 112505 - RNA, 22 nt, Human
uccaaaggcccugaguucacuu

SEQ ID NO: 112506 - RNA, 22 nt, Human
uccaaaggggcaguguccagcc

SEQ ID NO: 112507 - RNA, 22 nt, Human
uccaaauauauucacguccuag

SEQ ID NO: 112508 - RNA, 22 nt, Human
uccaaauauuaugauuauagga

SEQ ID NO: 112509 - RNA, 22 nt, Human
uccaaauucuagggccuugguu

SEQ ID NO: 112510 - RNA, 22 nt, Human
uccaaauuuaccuuacagauau

SEQ ID NO: 112511 - RNA, 22 nt, Human
uccaacauuuaucaagguuguu

SEQ ID NO: 112512 - RNA, 22 nt, Human
uccaacuccaccuuugucuccc

SEQ ID NO: 112513 - RNA, 22 nt, Human
uauuagcuuguuuggcaggaug

SEQ ID NO: 112514 - RNA, 22 nt, Human
uauuagggaacugcaagacuaa

SEQ ID NO: 112515 - RNA, 22 nt, Human
uauuagguaaaggacuugcagg

SEQ ID NO: 112516 - RNA, 22 nt, Human
uauuagguuggugcaaaauuaa

SEQ ID NO: 112517 - RNA, 22 nt, Human
uauuagguuggugcaacaguaa

SEQ ID NO: 112518 - RNA, 22 nt, Human
uauuagguuguugcaaaaguaa

SEQ ID NO: 112519 - RNA, 22 nt, Human
uauuagucuguaaauugaugcu

SEQ ID NO: 112520 - RNA, 22 nt, Human
uauuauauuuaguaauguggag

SEQ ID NO: 112521 - RNA, 22 nt, Human
uauuauccaaagagcugggagc

SEQ ID NO: 112522 - RNA, 22 nt, Human
uauuaugagccaggugcugucu

SEQ ID NO: 112523 - RNA, 22 nt, Human
uauuaugaggcuuagggaugac

SEQ ID NO: 112524 - RNA, 22 nt, Human
uauuaugaggggcagagggcau

SEQ ID NO: 112525 - RNA, 22 nt, Human
uauuaugcaaauauuccuaccu

SEQ ID NO: 112526 - RNA, 22 nt, Human
uauuaugcauaggcaauaaugg

SEQ ID NO: 112527 - RNA, 22 nt, Human
uauuauguagaguaaggguuaa

SEQ ID NO: 112528 - RNA, 22 nt, Human
uauuauuauauuggaugagacu

SEQ ID NO: 112529 - RNA, 22 nt, Human
uauuauuaugcauagcaugaaa

SEQ ID NO: 112530 - RNA, 22 nt, Human
uauuauugaaucaguucuuuga

SEQ ID NO: 112531 - RNA, 22 nt, Human
uauuauuuuuauucgagggaaa

SEQ ID NO: 112532 - RNA, 22 nt, Human
uauucaaagugcgaggucaggg

SEQ ID NO: 112533 - RNA, 22 nt, Human
uauucacaaaaugagguccuca

SEQ ID NO: 112534 - RNA, 22 nt, Human
uauucacaggcuggagugaugu

SEQ ID NO: 112535 - RNA, 22 nt, Human
uauucacagguuccggagauua

SEQ ID NO: 112536 - RNA, 22 nt, Human
uauucacaugaaaacaaauuuu

SEQ ID NO: 112537 - RNA, 22 nt, Human
uauucacauguacauaugcuca

SEQ ID NO: 112538 - RNA, 22 nt, Human
uauucacuguaacucagcaaua

SEQ ID NO: 112539 - RNA, 22 nt, Human
uauucagaggguugaauuuuua

SEQ ID NO: 112540 - RNA, 23 nt, Human
uauucagcagugggauuuguugu

SEQ ID NO: 112541 - RNA, 22 nt, Human
uauucaggucgagcuaacugcu

SEQ ID NO: 112542 - RNA, 21 nt, Human
uauucaguccauugauguuua

SEQ ID NO: 112543 - RNA, 22 nt, Human
uauucagugcgggaacucagcc

SEQ ID NO: 112544 - RNA, 22 nt, Human
uauucauaguaaacaaaagugg

SEQ ID NO: 112545 - RNA, 22 nt, Human
uauucaugucggcugaaaaagc

SEQ ID NO: 112546 - RNA, 22 nt, Human
uauuccaagugccuagaagagu

SEQ ID NO: 112547 - RNA, 22 nt, Human
uauuccagaugaaaucauucag

SEQ ID NO: 112548 - RNA, 22 nt, Human
uauuccaugccagaguuuauug

SEQ ID NO: 112549 - RNA, 22 nt, Human
uauucccagccucuuucuaucu

SEQ ID NO: 112550 - RNA, 22 nt, Human
uauucccauuccacuuaucaag

SEQ ID NO: 112551 - RNA, 22 nt, Human
uauuccugguguuggcuggguc

SEQ ID NO: 112552 - RNA, 22 nt, Human
uauucucauuagucuguauucc

SEQ ID NO: 112553 - RNA, 22 nt, Human
uauucuccccggaucagggcaa

SEQ ID NO: 112554 - RNA, 22 nt, Human
uauucucuccccaaucuugcuu

SEQ ID NO: 112555 - RNA, 22 nt, Human
uauucugcaugaaaauaaacag

SEQ ID NO: 112556 - RNA, 22 nt, Human
uauucugguuuccggaucucua

SEQ ID NO: 112557 - RNA, 18 nt, Human
uauucuguccuaugaagc

SEQ ID NO: 112558 - RNA, 22 nt, Human
ucaaagguuaacucuguuguuc

SEQ ID NO: 112559 - RNA, 22 nt, Human
ucaaaguaaaaguauagaguuu

SEQ ID NO: 112560 - RNA, 22 nt, Human
ucaaaguacuacucaguucagc

SEQ ID NO: 112561 - RNA, 22 nt, Human
ucaaaguagaguucagugcagc

SEQ ID NO: 112562 - RNA, 22 nt, Human
ucaaaguauuuuaacuguaucc

SEQ ID NO: 112563 - RNA, 22 nt, Human
ucaaagucuaucuguaauuacu

SEQ ID NO: 112564 - RNA, 22 nt, Human
ucaaaguuacuugugguuuucu

SEQ ID NO: 112565 - RNA, 22 nt, Human
ucaaauaccagcuuuuccagaa

SEQ ID NO: 112566 - RNA, 22 nt, Human
ucaaaucaccaaacucacuggc

SEQ ID NO: 112567 - RNA, 21 nt, Human
ucaaaucagguaucacuauug

SEQ ID NO: 112568 - RNA, 21 nt, Human
ucaaauccugcuguuaccacu

SEQ ID NO: 112569 - RNA, 19 nt, Human
ucaaaugccaaugucacag

SEQ ID NO: 112570 - RNA, 22 nt, Human
ucaaaugcggucauggcuuuua

SEQ ID NO: 112571 - RNA, 22 nt, Human
ucaaaugcuguauuguaguaau

SEQ ID NO: 112572 - RNA, 22 nt, Human
ucaaauuaguggaauaauaaug

SEQ ID NO: 112573 - RNA, 22 nt, Human
ucaacaaauacuuaaagcagag

SEQ ID NO: 112574 - RNA, 22 nt, Human
ucaacaagagcccaugcuuuuu

SEQ ID NO: 112575 - RNA, 22 nt, Human
ucaacaauuuugagaugagaca

SEQ ID NO: 112576 - RNA, 22 nt, Human
ucaacacaacagagaaaugcug

SEQ ID NO: 112577 - RNA, 22 nt, Human
ucaacacuaaagaauaaucuuu

SEQ ID NO: 112578 - RNA, 22 nt, Human
ucaacacucuuuggcacaguua

SEQ ID NO: 112579 - RNA, 22 nt, Human
ucaacauuuaugaagcuguggc

SEQ ID NO: 112580 - RNA, 22 nt, Human
ucaaccauccggcuuauccugc

SEQ ID NO: 112581 - RNA, 22 nt, Human
ucaacccuuccuccauauuucc

SEQ ID NO: 112582 - RNA, 21 nt, Human
ucaacccuugcgucaccaagc

SEQ ID NO: 112583 - RNA, 22 nt, Human
ucaacgcaugcuccaagaaaga

SEQ ID NO: 112584 - RNA, 22 nt, Human
ucaacuaaggcacaaucucuaa

SEQ ID NO: 112585 - RNA, 22 nt, Human
ucaacugauuuagucugugcca

SEQ ID NO: 112586 - RNA, 22 nt, Human
ucaacugcaaguuugcuuaguu

SEQ ID NO: 112587 - RNA, 22 nt, Human
ucaacuuggagcacauuuggcu

SEQ ID NO: 112588 - RNA, 22 nt, Human
ucaacuuggcuuuuuaaagucc

SEQ ID NO: 112589 - RNA, 22 nt, Human
ucaacuuuaguguagcuauuua

SEQ ID NO: 112590 - RNA, 22 nt, Human
ucaagaaacuguagcaaugggu

SEQ ID NO: 112591 - RNA, 22 nt, Human
ucaagaaacugugcuacagagu

SEQ ID NO: 112592 - RNA, 22 nt, Human
ucaagaaaugugcuuggauaua

SEQ ID NO: 112593 - RNA, 22 nt, Human
ucaagaaggaguuauuuauuca

SEQ ID NO: 112594 - RNA, 22 nt, Human
ucaagaauuuuuaaugugacug

SEQ ID NO: 112595 - RNA, 21 nt, Human
ucaagacagcauauuuaagaa

SEQ ID NO: 112596 - RNA, 22 nt, Human
ucaagagauugaauaauaacug

SEQ ID NO: 112597 - RNA, 19 nt, Human
ucaagauggauggcuccca

SEQ ID NO: 112598 - RNA, 22 nt, Human
ucaagauguccagugccuauaa

SEQ ID NO: 112599 - RNA, 22 nt, Human
ucaagcaaacucugagaaauaa

SEQ ID NO: 112600 - RNA, 19 nt, Human
ucaagcagucugauuuagg

SEQ ID NO: 112601 - RNA, 22 nt, Human
ucaagcaucuuggucuacgauc

SEQ ID NO: 112602 - RNA, 22 nt, Human
ucaagccacuggcagaagauua

SEQ ID NO: 112603 - RNA, 22 nt, Human
ucaagcggacugagauacucug

SEQ ID NO: 112604 - RNA, 22 nt, Human
ucaagcuuucugucucuuaugg

SEQ ID NO: 112605 - RNA, 22 nt, Human
ucaaggaaaagauaacuugaug

SEQ ID NO: 112606 - RNA, 22 nt, Human
ucaaggaagucuuauugcacag

SEQ ID NO: 112607 - RNA, 22 nt, Human
ucaaggaauggguccuucccuu

SEQ ID NO: 112608 - RNA, 22 nt, Human
ucaaggacuauugcaugacucc

SEQ ID NO: 112609 - RNA, 22 nt, Human
ucaaggaggugcuuggcuucac

SEQ ID NO: 112610 - RNA, 22 nt, Human
ucaaggcauacauuuagaagag

SEQ ID NO: 112611 - RNA, 22 nt, Human
ucaaggcuauuaauucugugag

SEQ ID NO: 112612 - RNA, 22 nt, Human
ucaaguaacaugaacacacaga

SEQ ID NO: 112613 - RNA, 22 nt, Human
ucaaguaguacccaaugcgugg

SEQ ID NO: 112614 - RNA, 22 nt, Human
ucaaguauuauuacagauguag

SEQ ID NO: 112615 - RNA, 22 nt, Human
ucaagucccagcucuucacuua

SEQ ID NO: 112616 - RNA, 22 nt, Human
ucaagucuugaugagacaaacc

SEQ ID NO: 112617 - RNA, 22 nt, Human
ucaagugcuugugagguauuug

SEQ ID NO: 112618 - RNA, 22 nt, Human
ucaaguuuaauugagauguuua

SEQ ID NO: 112619 - RNA, 22 nt, Human
ucaauacagaaaggauauuuug

SEQ ID NO: 112620 - RNA, 22 nt, Human
ucaauagaaaugcagagucuca

SEQ ID NO: 112621 - RNA, 22 nt, Human
ucaauagauuagguauuagauu

SEQ ID NO: 112622 - RNA, 22 nt, Human
ucaauagcaaucaagccuucca

SEQ ID NO: 112623 - RNA, 22 nt, Human
ucaaucaaagccagauguccuu

SEQ ID NO: 112624 - RNA, 22 nt, Human
ucaaucaaugguuuccaaauuu

SEQ ID NO: 112625 - RNA, 22 nt, Human
ucaaucacguguuccauguucu

SEQ ID NO: 112626 - RNA, 22 nt, Human
ucaaucauaaugaagugaagaa

SEQ ID NO: 112627 - RNA, 22 nt, Human
ucaaucuagagauuaaaauagg

SEQ ID NO: 112628 - RNA, 22 nt, Human
uccaacuuucuccuccggcuug

SEQ ID NO: 112629 - RNA, 22 nt, Human
uccaagaagucaucuaaacugu

SEQ ID NO: 112630 - RNA, 22 nt, Human
uccaagagaauacuggagagua

SEQ ID NO: 112631 - RNA, 22 nt, Human
uccaagaggagacacugggaug

SEQ ID NO: 112632 - RNA, 22 nt, Human
uccaagaucuacagcaguuuag

SEQ ID NO: 112633 - RNA, 17 nt, Human
uccaagccagcuugccu

SEQ ID NO: 112634 - RNA, 22 nt, Human
uccaagcuacugaagguuuggg

SEQ ID NO: 112635 - RNA, 22 nt, Human
uccaagcuugcuuuagccacag

SEQ ID NO: 112636 - RNA, 22 nt, Human
uccaagcuuuccaugcccucac

SEQ ID NO: 112637 - RNA, 22 nt, Human
uccaaggacgcuggaccccugc

SEQ ID NO: 112638 - RNA, 22 nt, Human
uccaaggagcagucuucaaccu

SEQ ID NO: 112639 - RNA, 22 nt, Human
uccaaggaggagcuggagauug

SEQ ID NO: 112640 - RNA, 20 nt, Human
uccaagggcagcagaaucag

SEQ ID NO: 112641 - RNA, 22 nt, Human
uccaagggcagccauagaacuu

SEQ ID NO: 112642 - RNA, 22 nt, Human
uccaaguccauuaugguggucu

SEQ ID NO: 112643 - RNA, 22 nt, Human
uccaauaaccacaaucagauag

SEQ ID NO: 112644 - RNA, 22 nt, Human
uccaauggggccucucugucag

SEQ ID NO: 112645 - RNA, 20 nt, Human
uccaauguaggauaaaugug

SEQ ID NO: 112646 - RNA, 22 nt, Human
uccaaugugacuaucagggagc

SEQ ID NO: 112647 - RNA, 22 nt, Human
uccaauguuauuaucuagaggc

SEQ ID NO: 112648 - RNA, 22 nt, Human
uccaauguuccaggguaaaugu

SEQ ID NO: 112649 - RNA, 20 nt, Human
uccaauuaaaaauuguaugc

SEQ ID NO: 112650 - RNA, 22 nt, Human
uccaauuugaaaugguauaugu

SEQ ID NO: 112651 - RNA, 22 nt, Human
uccacacacauuucuaugugca

SEQ ID NO: 112652 - RNA, 22 nt, Human
uccacagaauggaauucuccgc

SEQ ID NO: 112653 - RNA, 22 nt, Human
uccacagacuauuaagugaucu

SEQ ID NO: 112654 - RNA, 22 nt, Human
uccacagcuuuuaaaugucuag

SEQ ID NO: 112655 - RNA, 22 nt, Human
uccacagggccuuucuggugug

SEQ ID NO: 112656 - RNA, 22 nt, Human
uccacaggucagggagauaggc

SEQ ID NO: 112657 - RNA, 22 nt, Human
uccacagguccucuuugcaaag

SEQ ID NO: 112658 - RNA, 22 nt, Human
uccacaucuagguuugucaaca

SEQ ID NO: 112659 - RNA, 20 nt, Human
uccacaucuuuugagaugug

SEQ ID NO: 112660 - RNA, 22 nt, Human
uccacaugaccauugugcuccu

SEQ ID NO: 112661 - RNA, 22 nt, Human
uccaccagagccuucccaugcu

SEQ ID NO: 112662 - RNA, 20 nt, Human
uccaccaggaaggguaggga

SEQ ID NO: 112663 - RNA, 18 nt, Human
uccaccagucaaucuguc

SEQ ID NO: 112664 - RNA, 22 nt, Human
uccaccuccaugcugggcagag

SEQ ID NO: 112665 - RNA, 22 nt, Human
uccaccugaguuucaguuauuu

SEQ ID NO: 112666 - RNA, 22 nt, Human
uccacugcucauuccacaggca

SEQ ID NO: 112667 - RNA, 17 nt, Human
ucaaaguauucugaugc

SEQ ID NO: 112668 - RNA, 22 nt, Human
ucaaagucauggcuaguaauga

SEQ ID NO: 112669 - RNA, 22 nt, Human
ucaaagucucugcuucuguaac

SEQ ID NO: 112670 - RNA, 19 nt, Human
ucaaagucugagucacuuu

SEQ ID NO: 112671 - RNA, 22 nt, Human
ucaaaguuuuugagaauuacau

SEQ ID NO: 112672 - RNA, 22 nt, Human
ucaaauacauggucaaucaacu

SEQ ID NO: 112673 - RNA, 22 nt, Human
ucaaauaggcuuguagugacug

SEQ ID NO: 112674 - RNA, 22 nt, Human
ucaaauaugugauagaagcuaa

SEQ ID NO: 112675 - RNA, 17 nt, Human
ucaaauccucugucugg

SEQ ID NO: 112676 - RNA, 22 nt, Human
ucaaaucucacucugcauuucu

SEQ ID NO: 112677 - RNA, 22 nt, Human
ucaaaucucaucuugaauugua

SEQ ID NO: 112678 - RNA, 22 nt, Human
ucaaaucucauugccuaaaacu

SEQ ID NO: 112679 - RNA, 22 nt, Human
ucaaaucuuuaacaugugcaaa

SEQ ID NO: 112680 - RNA, 22 nt, Human
ucaaaucuuugaccacuuaugu

SEQ ID NO: 112681 - RNA, 22 nt, Human
ucaaaugcaggucuggucuugg

SEQ ID NO: 112682 - RNA, 22 nt, Human
ucaaaugccagugguguggauc

SEQ ID NO: 112683 - RNA, 22 nt, Human
ucaaaugcucuuugcagagagg

SEQ ID NO: 112684 - RNA, 22 nt, Human
ucaaaugcugccuuugugugcc

SEQ ID NO: 112685 - RNA, 22 nt, Human
ucaaaugcuucuacuccuaaga

SEQ ID NO: 112686 - RNA, 22 nt, Human
ucaaauggguaugcuuuauaau

SEQ ID NO: 112687 - RNA, 22 nt, Human
ucaaauguaauuuauuguuuua

SEQ ID NO: 112688 - RNA, 22 nt, Human
ucaaauugucaucuugauaaug

SEQ ID NO: 112689 - RNA, 22 nt, Human
ucaacaauaggauauagcaggu

SEQ ID NO: 112690 - RNA, 22 nt, Human
ucaacaaugggucuguaaugga

SEQ ID NO: 112691 - RNA, 22 nt, Human
ucaacacuuuugucuuuguccc

SEQ ID NO: 112692 - RNA, 22 nt, Human
ucaacagccagaaauauuagcc

SEQ ID NO: 112693 - RNA, 22 nt, Human
ucaacaguucuguccaauuaau

SEQ ID NO: 112694 - RNA, 22 nt, Human
ucaacaguugcacuggagaggu

SEQ ID NO: 112695 - RNA, 22 nt, Human
ucaacauugagucccugggucu

SEQ ID NO: 112696 - RNA, 22 nt, Human
ucaacauuggaggcaacauuca

SEQ ID NO: 112697 - RNA, 22 nt, Human
ucaaccagaguuuuucuuaaua

SEQ ID NO: 112698 - RNA, 19 nt, Human
ucaacccucuuugccuagc

SEQ ID NO: 112699 - RNA, 22 nt, Human
ucaacccuggugggaauauuug

SEQ ID NO: 112700 - RNA, 22 nt, Human
ucaacccuugugcaacagugau

SEQ ID NO: 112701 - RNA, 20 nt, Human
ucaaccuacugugcucaagu

SEQ ID NO: 112702 - RNA, 22 nt, Human
ucaaccucuggagaaaucagga

SEQ ID NO: 112703 - RNA, 22 nt, Human
ucaaccuugugagaacugaguc

SEQ ID NO: 112704 - RNA, 22 nt, Human
ucaacuaacucuauuauuugaa

SEQ ID NO: 112705 - RNA, 22 nt, Human
ucaacugguucuugaauguaua

SEQ ID NO: 112706 - RNA, 22 nt, Human
ucaacuuugaaaccauagugaa

SEQ ID NO: 112707 - RNA, 22 nt, Human
ucaagaaaaugccugcuggugu

SEQ ID NO: 112708 - RNA, 20 nt, Human
ucaagacagacauggaguuu

SEQ ID NO: 112709 - RNA, 22 nt, Human
ucaagacagugugauacuggcc

SEQ ID NO: 112710 - RNA, 22 nt, Human
ucaagacaucacugugcauuuu

SEQ ID NO: 112711 - RNA, 18 nt, Human
ucaagacaucaugaaaua

SEQ ID NO: 112712 - RNA, 22 nt, Human
ucaagagaaggggaaauagacu

SEQ ID NO: 112713 - RNA, 22 nt, Human
ucaagauaccaccauuauaugu

SEQ ID NO: 112714 - RNA, 22 nt, Human
ucaagauauagaggguucuaga

SEQ ID NO: 112715 - RNA, 22 nt, Human
ucaagaugaaagauguagccau

SEQ ID NO: 112716 - RNA, 22 nt, Human
ucaagcaaauguccuuuuguuc

SEQ ID NO: 112717 - RNA, 22 nt, Human
ucaagcaaguguuugguguaaa

SEQ ID NO: 112718 - RNA, 23 nt, Human
ucaagcaauaauugguaauagug

SEQ ID NO: 112719 - RNA, 22 nt, Human
ucaagcagcuuuuacagaagag

SEQ ID NO: 112720 - RNA, 22 nt, Human
ucaagcuggcuguugcuauuuc

SEQ ID NO: 112721 - RNA, 20 nt, Human
ucaaggaaugucauuuuguu

SEQ ID NO: 112722 - RNA, 21 nt, Human
ucaaggaguuucucuuuucca

SEQ ID NO: 112723 - RNA, 22 nt, Human
ucaaggcaaaguaaauauucaa

SEQ ID NO: 112724 - RNA, 22 nt, Human
ucaaguauuauauucucauuuu

SEQ ID NO: 112725 - RNA, 22 nt, Human
ucaaguauuuauuucugcuggc

SEQ ID NO: 112726 - RNA, 22 nt, Human
ucaagucacuggcagggaugcu

SEQ ID NO: 112727 - RNA, 19 nt, Human
ucaaguccuaggcccacaa

SEQ ID NO: 112728 - RNA, 22 nt, Human
ucaaguguaguggugucagguc

SEQ ID NO: 112729 - RNA, 22 nt, Human
ucaaguuaggugguuguuagga

SEQ ID NO: 112730 - RNA, 20 nt, Human
ucaaguuuugcuugacaaga

SEQ ID NO: 112731 - RNA, 22 nt, Human
ucaauaacuuuguuuagcauug

SEQ ID NO: 112732 - RNA, 22 nt, Human
ucaauaauggcaggauaaauuu

SEQ ID NO: 112733 - RNA, 22 nt, Human
ucaauagagccuucuuucaggu

SEQ ID NO: 112734 - RNA, 22 nt, Human
ucaauagauaaagcuacauaaa

SEQ ID NO: 112735 - RNA, 22 nt, Human
ucaauagcucaguguggaagcu

SEQ ID NO: 112736 - RNA, 22 nt, Human
ucaauauauuccauguuuucuc

SEQ ID NO: 112737 - RNA, 22 nt, Human
ucaauauucuucuuuaguagga

SEQ ID NO: 112738 - RNA, 22 nt, Human
ucaaucaaagcacugggcuuug

SEQ ID NO: 112739 - RNA, 22 nt, Human
ucaaucaaugugucaguuccca

SEQ ID NO: 112740 - RNA, 22 nt, Human
ucaaucauucuugccauuuauu

SEQ ID NO: 112741 - RNA, 22 nt, Human
ucaaugacugguccaagguggc

SEQ ID NO: 112742 - RNA, 22 nt, Human
ucaaugauagacaagaucuaag

SEQ ID NO: 112743 - RNA, 22 nt, Human
ucaaugauaguacaaucagccu

SEQ ID NO: 112744 - RNA, 22 nt, Human
ucaaugcaaucauuggacaagu

SEQ ID NO: 112745 - RNA, 22 nt, Human
ucaaugcacacaggacuuggug

SEQ ID NO: 112746 - RNA, 22 nt, Human
ucaauuaagaggcuaaguuacu

SEQ ID NO: 112747 - RNA, 22 nt, Human
ucaauuacagcacaguacucca

SEQ ID NO: 112748 - RNA, 23 nt, Human
ucaauuaucaauggaaagaaguu

SEQ ID NO: 112749 - RNA, 22 nt, Human
ucaauuucucagaaauggucuu

SEQ ID NO: 112750 - RNA, 22 nt, Human
ucacaaaagcuuuugaauuugg

SEQ ID NO: 112751 - RNA, 22 nt, Human
ucacaaacaaugcuuuggaauu

SEQ ID NO: 112752 - RNA, 22 nt, Human
ucacaaauauagugagaaccag

SEQ ID NO: 112753 - RNA, 22 nt, Human
ucacaaaucauuuuaucugugu

SEQ ID NO: 112754 - RNA, 22 nt, Human
ucacaaaucgaagccuuauaau

SEQ ID NO: 112755 - RNA, 20 nt, Human
ucacaacuccaucauuuccc

SEQ ID NO: 112756 - RNA, 22 nt, Human
ucacaacucuuuccauuuaaua

SEQ ID NO: 112757 - RNA, 22 nt, Human
ucacaagauaaacauagcucca

SEQ ID NO: 112758 - RNA, 22 nt, Human
ucacaaugaaaaacacuacaua

SEQ ID NO: 112759 - RNA, 22 nt, Human
ucacaauuuggauacagcuaug

SEQ ID NO: 112760 - RNA, 22 nt, Human
ucacacagcuccuuuccuuagu

SEQ ID NO: 112761 - RNA, 22 nt, Human
ucacacagggucggaaagagug

SEQ ID NO: 112762 - RNA, 22 nt, Human
ucacacagugagaaagugcgga

SEQ ID NO: 112763 - RNA, 22 nt, Human
ucacacagugguaaaacccuga

SEQ ID NO: 112764 - RNA, 22 nt, Human
ucacacaugaguaaauacaggg

SEQ ID NO: 112765 - RNA, 22 nt, Human
ucacacaugcuaagccagagau

SEQ ID NO: 112766 - RNA, 22 nt, Human
ucacacauuucucaaguguagg

SEQ ID NO: 112767 - RNA, 22 nt, Human
ucacaccuuuuagaauuacuau

SEQ ID NO: 112768 - RNA, 22 nt, Human
ucacacguccuugcuacuccuc

SEQ ID NO: 112769 - RNA, 22 nt, Human
ucacacuaagacaaaauaauuu

SEQ ID NO: 112770 - RNA, 22 nt, Human
ucacacuuagagcgaauuguuu

SEQ ID NO: 112771 - RNA, 21 nt, Human
ucacacuugauuggcuuagac

SEQ ID NO: 112772 - RNA, 22 nt, Human
ucacacuuuauuuauuucaugc

SEQ ID NO: 112773 - RNA, 22 nt, Human
ucacacuuuccauggcuguuaa

SEQ ID NO: 112774 - RNA, 22 nt, Human
ucacagaaaagcugagcaucag

SEQ ID NO: 112775 - RNA, 22 nt, Human
ucacagaaaaguggagagccua

SEQ ID NO: 112776 - RNA, 22 nt, Human
ucacagaacaauguuuaguucu

SEQ ID NO: 112777 - RNA, 22 nt, Human
ucacagaagcaucauacccgga

SEQ ID NO: 112778 - RNA, 22 nt, Human
ucacagaagcuugaagauuuuc

SEQ ID NO: 112779 - RNA, 22 nt, Human
ucacagaauaaauguacuggcc

SEQ ID NO: 112780 - RNA, 22 nt, Human
ucacagaaugucagaguugggg

SEQ ID NO: 112781 - RNA, 22 nt, Human
ucacagacaccuuggccacagu

SEQ ID NO: 112782 - RNA, 18 nt, Human
ucacagacagcugucuuu

SEQ ID NO: 112783 - RNA, 22 nt, Human
ucacagacgccuccccucgccu

SEQ ID NO: 112784 - RNA, 21 nt, Human
ucacagacuggucagugaggc

SEQ ID NO: 112785 - RNA, 22 nt, Human
ucacagacuguguugcuacuca

SEQ ID NO: 112786 - RNA, 22 nt, Human
ucacagagagugacuuguugcu

SEQ ID NO: 112787 - RNA, 20 nt, Human
ucacagaguagccuugucug

SEQ ID NO: 112788 - RNA, 20 nt, Human
ucacagaugaaaguucaaga

SEQ ID NO: 112789 - RNA, 22 nt, Human
ucacagcaacacuggggcagac

SEQ ID NO: 112790 - RNA, 22 nt, Human
ucacagcaccaggaucucucca

SEQ ID NO: 112791 - RNA, 19 nt, Human
ucacagcaucugucugaac

SEQ ID NO: 112792 - RNA, 22 nt, Human
ucacagcucacuguagccucga

SEQ ID NO: 112793 - RNA, 22 nt, Human
ucacagcuccagacugcaacuc

SEQ ID NO: 112794 - RNA, 22 nt, Human
ucacagcugaguuuccauuucu

SEQ ID NO: 112795 - RNA, 22 nt, Human
ucacagcuguuuuguccauuaa

SEQ ID NO: 112796 - RNA, 22 nt, Human
ucacaggaaggguaaauauuua

SEQ ID NO: 112797 - RNA, 22 nt, Human
ucacaggagaauguacuuacca

SEQ ID NO: 112798 - RNA, 22 nt, Human
ucacaggagggagagacaccca

SEQ ID NO: 112799 - RNA, 22 nt, Human
ucacaggcuaaauuuaugcagg

SEQ ID NO: 112800 - RNA, 21 nt, Human
ucacaggcucagggagagagu

SEQ ID NO: 112801 - RNA, 22 nt, Human
ucacaggcucuccaccaugagg

SEQ ID NO: 112802 - RNA, 23 nt, Human
ucacagggcacuggcugggguug

SEQ ID NO: 112803 - RNA, 22 nt, Human
ucacaguacaugauucaguggu

SEQ ID NO: 112804 - RNA, 22 nt, Human
ucacaguaguuguucucuguuu

SEQ ID NO: 112805 - RNA, 23 nt, Human
ucacaguaucucuggagccauag

SEQ ID NO: 112806 - RNA, 22 nt, Human
ucacaguauucaugaacaugga

SEQ ID NO: 112807 - RNA, 22 nt, Human
ucacagugaugacgugggagca

SEQ ID NO: 112808 - RNA, 22 nt, Human
ucacagugucguccuugggugu

SEQ ID NO: 112809 - RNA, 22 nt, Human
ucacaguuaauuguuggaaugu

SEQ ID NO: 112810 - RNA, 22 nt, Human
ucacaguuacuccuucagauga

SEQ ID NO: 112811 - RNA, 21 nt, Human
ucacaguucaagaugaacccc

SEQ ID NO: 112812 - RNA, 21 nt, Human
ucacaguuggccaggcauuua

SEQ ID NO: 112813 - RNA, 22 nt, Human
ucacauaaauuuaccagaugau

SEQ ID NO: 112814 - RNA, 22 nt, Human
ucacauaguggggcauuggaau

SEQ ID NO: 112815 - RNA, 22 nt, Human
ucacaucacccugcucuuaauu

SEQ ID NO: 112816 - RNA, 22 nt, Human
ucacaucacuagcugguaauga

SEQ ID NO: 112817 - RNA, 18 nt, Human
ucacaucaucccaugcuu

SEQ ID NO: 112818 - RNA, 22 nt, Human
ucacaucauuaagacuucuccu

SEQ ID NO: 112819 - RNA, 22 nt, Human
ucacaucucccuggaggacaca

SEQ ID NO: 112820 - RNA, 22 nt, Human
ucacaucucucauugccucugc

SEQ ID NO: 112821 - RNA, 22 nt, Human
ucacaucugauuagugacugau

SEQ ID NO: 112822 - RNA, 22 nt, Human
ucacaugaagaucccucaauuu

SEQ ID NO: 112823 - RNA, 22 nt, Human
ucacaugacuuuuugguggccu

SEQ ID NO: 112824 - RNA, 22 nt, Human
ucacaugaggcauccccgggca

SEQ ID NO: 112825 - RNA, 22 nt, Human
ucacaugauguuuccucugugc

SEQ ID NO: 112826 - RNA, 22 nt, Human
ucacaugcacauacuuccugug

SEQ ID NO: 112827 - RNA, 22 nt, Human
ucacaugcucaccuaagccaca

SEQ ID NO: 112828 - RNA, 22 nt, Human
ucacaugcuguguguggagauc

SEQ ID NO: 112829 - RNA, 22 nt, Human
ucacaugcuugaggaaagaaaa

SEQ ID NO: 112830 - RNA, 22 nt, Human
ucacauguguuuucucaccaac

SEQ ID NO: 112831 - RNA, 19 nt, Human
ucacauucagccuugcuga

SEQ ID NO: 112832 - RNA, 22 nt, Human
ucacauucauggugcuaauaaa

SEQ ID NO: 112833 - RNA, 22 nt, Human
ucacauucuucccugacuucuu

SEQ ID NO: 112834 - RNA, 22 nt, Human
ucacauucuuuauuugccaucc

SEQ ID NO: 112835 - RNA, 22 nt, Human
ucacauugaagaaauuuuaagu

SEQ ID NO: 112836 - RNA, 22 nt, Human
ucacauugaauggaagaauaga

SEQ ID NO: 112837 - RNA, 22 nt, Human
ucacauuucaagugcucaaaag

SEQ ID NO: 112838 - RNA, 22 nt, Human
ucacauuucucagcacugauga

SEQ ID NO: 112839 - RNA, 22 nt, Human
ucacauuucugauuauaccaaa

SEQ ID NO: 112840 - RNA, 22 nt, Human
ucacauuugauaaugcccauug

SEQ ID NO: 112841 - RNA, 22 nt, Human
ucacauuuuaguaccaugauuu

SEQ ID NO: 112842 - RNA, 22 nt, Human
ucacauuuuauaucucugguuu

SEQ ID NO: 112843 - RNA, 22 nt, Human
ucacauuuuaucugagauugac

SEQ ID NO: 112844 - RNA, 22 nt, Human
ucacauuuucauauucucugag

SEQ ID NO: 112845 - RNA, 22 nt, Human
ucaccaaguccauaugcaucau

SEQ ID NO: 112846 - RNA, 22 nt, Human
ucaccaauaauaacuugagaau

SEQ ID NO: 112847 - RNA, 22 nt, Human
ucaccacugaggccacguggcu

SEQ ID NO: 112848 - RNA, 22 nt, Human
ucaccagaugauuuuucuucag

SEQ ID NO: 112849 - RNA, 22 nt, Human
ucaccaggauugggcuguaggc

SEQ ID NO: 112850 - RNA, 22 nt, Human
ucaccagucuuucuuaccauug

SEQ ID NO: 112851 - RNA, 22 nt, Human
ucaccauuaaggacuuucagcu

SEQ ID NO: 112852 - RNA, 22 nt, Human
ucacccagaaaagacagcagau

SEQ ID NO: 112853 - RNA, 22 nt, Human
ucaaucuguguaugcugggagu

SEQ ID NO: 112854 - RNA, 22 nt, Human
ucaaugaaagagcaugcauuuu

SEQ ID NO: 112855 - RNA, 22 nt, Human
ucaaugacauuguaucagaguu

SEQ ID NO: 112856 - RNA, 22 nt, Human
ucaaugagaaagacacagucuu

SEQ ID NO: 112857 - RNA, 22 nt, Human
ucaaugagcuggggacguguac

SEQ ID NO: 112858 - RNA, 22 nt, Human
ucaaugagguaaucagucaccc

SEQ ID NO: 112859 - RNA, 22 nt, Human
ucaaugaggugauugcuguccu

SEQ ID NO: 112860 - RNA, 22 nt, Human
ucaaugcaaccuccaccucccg

SEQ ID NO: 112861 - RNA, 19 nt, Human
ucaaugcaugaaaucagcc

SEQ ID NO: 112862 - RNA, 22 nt, Human
ucaaugcaugugacaaagagua

SEQ ID NO: 112863 - RNA, 20 nt, Human
ucaauguaaucauaucauca

SEQ ID NO: 112864 - RNA, 22 nt, Human
ucaaugucugcggcuagcugga

SEQ ID NO: 112865 - RNA, 22 nt, Human
ucaauuacagugucaccuuaag

SEQ ID NO: 112866 - RNA, 21 nt, Human
ucaauuauggaugugugcaaa

SEQ ID NO: 112867 - RNA, 22 nt, Human
ucaauucuuauugguguucugc

SEQ ID NO: 112868 - RNA, 23 nt, Human
ucaauugaugauguucucuuuug

SEQ ID NO: 112869 - RNA, 22 nt, Human
ucaauuuaagguacuacuuugg

SEQ ID NO: 112870 - RNA, 22 nt, Human
ucaauuuauguggcuauucauu

SEQ ID NO: 112871 - RNA, 22 nt, Human
ucaauuucaacagcugauaaga

SEQ ID NO: 112872 - RNA, 22 nt, Human
ucaauuuccccuauugauagac

SEQ ID NO: 112873 - RNA, 22 nt, Human
ucaauuucuugguuugauaaua

SEQ ID NO: 112874 - RNA, 22 nt, Human
ucacaaagcuuugauaagcaga

SEQ ID NO: 112875 - RNA, 22 nt, Human
ucacaaaggaugaugaauucug

SEQ ID NO: 112876 - RNA, 22 nt, Human
ucacaaauagcuauauuaagga

SEQ ID NO: 112877 - RNA, 22 nt, Human
ucacaaaugaccaugguuacua

SEQ ID NO: 112878 - RNA, 22 nt, Human
ucacaaaugaggaaaucgagca

SEQ ID NO: 112879 - RNA, 22 nt, Human
ucacaaaugucuccuguccugu

SEQ ID NO: 112880 - RNA, 22 nt, Human
ucacaaauuucagcucccugaa

SEQ ID NO: 112881 - RNA, 22 nt, Human
ucacaacuugaagcugauuuaa

SEQ ID NO: 112882 - RNA, 22 nt, Human
ucacaagaauuuguagaugaaa

SEQ ID NO: 112883 - RNA, 22 nt, Human
ucacaagacugagcuugcuuga

SEQ ID NO: 112884 - RNA, 19 nt, Human
ucacaagagagauaaagug

SEQ ID NO: 112885 - RNA, 22 nt, Human
ucacucugcugcccgagggcug

SEQ ID NO: 112886 - RNA, 22 nt, Human
ucacucuggaguccgcuaccag

SEQ ID NO: 112887 - RNA, 22 nt, Human
ucacucuguggcccaggcagug

SEQ ID NO: 112888 - RNA, 22 nt, Human
ucacucuguguuugaacucaag

SEQ ID NO: 112889 - RNA, 22 nt, Human
ucacucuguuuuacucacuguu

SEQ ID NO: 112890 - RNA, 22 nt, Human
ucacucuuuaucuuuuaugucu

SEQ ID NO: 112891 - RNA, 22 nt, Human
ucacugaaagaaugacauuaug

SEQ ID NO: 112892 - RNA, 22 nt, Human
ucacugcaaccucugccuuccg

SEQ ID NO: 112893 - RNA, 22 nt, Human
ucacugcagacaaccucaguca

SEQ ID NO: 112894 - RNA, 22 nt, Human
ucacugcagagaccucuaguca

SEQ ID NO: 112895 - RNA, 23 nt, Human
ucacugcuacucagccugagauu

SEQ ID NO: 112896 - RNA, 22 nt, Human
ucacugcucuccaauguggagu

SEQ ID NO: 112897 - RNA, 22 nt, Human
ucacugcuuucaaaaauuauug

SEQ ID NO: 112898 - RNA, 20 nt, Human
ucacuggccagaguagcccu

SEQ ID NO: 112899 - RNA, 22 nt, Human
ucacugggagagcugacaagga

SEQ ID NO: 112900 - RNA, 17 nt, Human
ucacugggccugcuccc

SEQ ID NO: 112901 - RNA, 22 nt, Human
ucacuggggagcacugacaugu

SEQ ID NO: 112902 - RNA, 22 nt, Human
ucacuggggccaugugagggac

SEQ ID NO: 112903 - RNA, 22 nt, Human
ucacuggggcccacaucaacau

SEQ ID NO: 112904 - RNA, 18 nt, Human
ucacuggguguauguggc

SEQ ID NO: 112905 - RNA, 22 nt, Human
ucacugguuagaagaaguaagc

SEQ ID NO: 112906 - RNA, 20 nt, Human
ucacuguaacauuugggggg

SEQ ID NO: 112907 - RNA, 20 nt, Human
ucacuguaauugccuacauu

SEQ ID NO: 112908 - RNA, 22 nt, Human
ucacuguagagucuguuuccac

SEQ ID NO: 112909 - RNA, 22 nt, Human
ucacugucccuguccucuuauc

SEQ ID NO: 112910 - RNA, 22 nt, Human
ucacugugauucuguauggauu

SEQ ID NO: 112911 - RNA, 22 nt, Human
ucacugugcucucuagauaggc

SEQ ID NO: 112912 - RNA, 22 nt, Human
ucacuguuucaucccuagcacu

SEQ ID NO: 112913 - RNA, 22 nt, Human
ucacuguuuugccugcacuucc

SEQ ID NO: 112914 - RNA, 22 nt, Human
ucacuuauugcucaucucaugc

SEQ ID NO: 112915 - RNA, 22 nt, Human
ucacuucccucuucagcuccca

SEQ ID NO: 112916 - RNA, 22 nt, Human
ucacuucguaaaccccucccau

SEQ ID NO: 112917 - RNA, 22 nt, Human
ucacuucuucagcuuuccuuga

SEQ ID NO: 112918 - RNA, 23 nt, Human
ucacuugaagcuagaaucugccc

SEQ ID NO: 112919 - RNA, 22 nt, Human
ucacuugagauguaccacaaac

SEQ ID NO: 112920 - RNA, 22 nt, Human
ucacuugauccuucccugaaau

SEQ ID NO: 112921 - RNA, 22 nt, Human
ucacuuuaccaaaguacaggag

SEQ ID NO: 112922 - RNA, 22 nt, Human
ucacuuuagaucuucaucucuu

SEQ ID NO: 112923 - RNA, 22 nt, Human
ucacuuuccucaucacgacuag

SEQ ID NO: 112924 - RNA, 22 nt, Human
ucacuuugaauuccuugauuuu

SEQ ID NO: 112925 - RNA, 22 nt, Human
ucacuuugacggccaacuucua

SEQ ID NO: 112926 - RNA, 22 nt, Human
ucacuuugaugacauuguagcu

SEQ ID NO: 112927 - RNA, 23 nt, Human
ucacuuugauguaauugaaaagc

SEQ ID NO: 112928 - RNA, 22 nt, Human
ucacuuugcaaauggcacggga

SEQ ID NO: 112929 - RNA, 22 nt, Human
ucagaaaagacucaggggcuga

SEQ ID NO: 112930 - RNA, 22 nt, Human
ucagaaaaugaaauggacucuc

SEQ ID NO: 112931 - RNA, 22 nt, Human
ucagaaagcuuagugucuugca

SEQ ID NO: 112932 - RNA, 22 nt, Human
ucagaaaggaguuagaggucuc

SEQ ID NO: 112933 - RNA, 22 nt, Human
ucagaaagguugagucaugugc

SEQ ID NO: 112934 - RNA, 22 nt, Human
ucagaaaugaucguuauucauu

SEQ ID NO: 112935 - RNA, 22 nt, Human
ucagaaauuuucucaguaguuc

SEQ ID NO: 112936 - RNA, 22 nt, Human
ucagaacagaagaaggaacacg

SEQ ID NO: 112937 - RNA, 22 nt, Human
ucagaacagcacagggugauuu

SEQ ID NO: 112938 - RNA, 22 nt, Human
ucagaacaggacuggcugccau

SEQ ID NO: 112939 - RNA, 23 nt, Human
ucagaacaguucuuggugcauag

SEQ ID NO: 112940 - RNA, 22 nt, Human
ucagaacaucccagauaguaga

SEQ ID NO: 112941 - RNA, 22 nt, Human
ucagaacaugaagguuaauuug

SEQ ID NO: 112942 - RNA, 22 nt, Human
ucagaacuauaguaguuucaug

SEQ ID NO: 112943 - RNA, 19 nt, Human
ucagaacucagaaugugua

SEQ ID NO: 112944 - RNA, 22 nt, Human
ucagaacugguauuuaucaagg

SEQ ID NO: 112945 - RNA, 21 nt, Human
ucagaacuggugcagaugaau

SEQ ID NO: 112946 - RNA, 22 nt, Human
ucagaacuuaaagccgauuggg

SEQ ID NO: 112947 - RNA, 19 nt, Human
ucagaaggcaggagaggcc

SEQ ID NO: 112948 - RNA, 22 nt, Human
ucagaagggaaacacaagugac

SEQ ID NO: 112949 - RNA, 22 nt, Human
ucagaagucacuuaggaaaggg

SEQ ID NO: 112950 - RNA, 22 nt, Human
ucagaagucaugcucagucugu

SEQ ID NO: 112951 - RNA, 22 nt, Human
ucagaaguccaauuuucgcacc

SEQ ID NO: 112952 - RNA, 22 nt, Human
ucagaaguccccagucaaggag

SEQ ID NO: 112953 - RNA, 21 nt, Human
ucagaagugcagcccaggaau

SEQ ID NO: 112954 - RNA, 22 nt, Human
ucagaagugcuguccuuauccc

SEQ ID NO: 112955 - RNA, 23 nt, Human
ucagaauaauaaccuaguaacug

SEQ ID NO: 112956 - RNA, 22 nt, Human
ucagaauaugcuaaugacauuu

SEQ ID NO: 112957 - RNA, 22 nt, Human
ucagaaucugcauuuaacaaaa

SEQ ID NO: 112958 - RNA, 23 nt, Human
ucagaaugcacugaauuuacccu

SEQ ID NO: 112959 - RNA, 22 nt, Human
ucagaauuagagcucuucuuga

SEQ ID NO: 112960 - RNA, 22 nt, Human
ucagaauuauguaggccugguu

SEQ ID NO: 112961 - RNA, 22 nt, Human
ucagaauuggacaauagaagca

SEQ ID NO: 112962 - RNA, 22 nt, Human
ucagaauuuaaaauguguagau

SEQ ID NO: 112963 - RNA, 22 nt, Human
ucagacaaguaaaauaauguaa

SEQ ID NO: 112964 - RNA, 22 nt, Human
ucagacagaaagaugaguaugg

SEQ ID NO: 112965 - RNA, 22 nt, Human
ucagacagaaggacuauuugaa

SEQ ID NO: 112966 - RNA, 22 nt, Human
ucagacagcuugggauaacuga

SEQ ID NO: 112967 - RNA, 22 nt, Human
ucagacaggcuucuuucucccu

SEQ ID NO: 112968 - RNA, 22 nt, Human
ucagacagggagucagaaaaua

SEQ ID NO: 112969 - RNA, 20 nt, Human
ucagacccagauuagcaggu

SEQ ID NO: 112970 - RNA, 22 nt, Human
ucacaucuccauguguuguuca

SEQ ID NO: 112971 - RNA, 23 nt, Human
ucacaucugccguaguguauucu

SEQ ID NO: 112972 - RNA, 20 nt, Human
ucacaucuggcagcugauga

SEQ ID NO: 112973 - RNA, 19 nt, Human
ucacaugaagccuagagaa

SEQ ID NO: 112974 - RNA, 18 nt, Human
ucacaugacagcuguugc

SEQ ID NO: 112975 - RNA, 22 nt, Human
ucacaugagguuaugacaaagc

SEQ ID NO: 112976 - RNA, 22 nt, Human
ucacaugagucacuaucuuaau

SEQ ID NO: 112977 - RNA, 18 nt, Human
ucacaugauuacccuggg

SEQ ID NO: 112978 - RNA, 22 nt, Human
ucacaugcacaucucuggaacc

SEQ ID NO: 112979 - RNA, 22 nt, Human
ucacaugcagucacugagcagg

SEQ ID NO: 112980 - RNA, 21 nt, Human
ucacaugcccauuacuggagc

SEQ ID NO: 112981 - RNA, 22 nt, Human
ucacaugcccuaccuaaucuua

SEQ ID NO: 112982 - RNA, 22 nt, Human
ucacaugccuuuuacucugcac

SEQ ID NO: 112983 - RNA, 22 nt, Human
ucacaugcuacugagccagacc

SEQ ID NO: 112984 - RNA, 22 nt, Human
ucacauguauaugcagcacagc

SEQ ID NO: 112985 - RNA, 22 nt, Human
ucacauguuaggucgggcaagg

SEQ ID NO: 112986 - RNA, 22 nt, Human
ucacauucucagcaucuauaca

SEQ ID NO: 112987 - RNA, 22 nt, Human
ucacauuuaaacaggaggauua

SEQ ID NO: 112988 - RNA, 23 nt, Human
ucacauuuaaccccucagaccuc

SEQ ID NO: 112989 - RNA, 22 nt, Human
ucacauuucacaugggaggagg

SEQ ID NO: 112990 - RNA, 22 nt, Human
ucacauuucgcaucaguccgau

SEQ ID NO: 112991 - RNA, 22 nt, Human
ucacauuucuuuauguagucuu

SEQ ID NO: 112992 - RNA, 22 nt, Human
ucacauuuggagaaagccugcc

SEQ ID NO: 112993 - RNA, 22 nt, Human
ucacauuuuaucuauuuuaagu

SEQ ID NO: 112994 - RNA, 22 nt, Human
ucagucucagcaccuagucaca

SEQ ID NO: 112995 - RNA, 22 nt, Human
ucagucucaucaacucuauucc

SEQ ID NO: 112996 - RNA, 22 nt, Human
ucagucuccuuuccucuagaca

SEQ ID NO: 112997 - RNA, 22 nt, Human
ucagucuuuaaaagcucaggaa

SEQ ID NO: 112998 - RNA, 22 nt, Human
ucagucuuucgaauucagccag

SEQ ID NO: 112999 - RNA, 22 nt, Human
ucagucuuuugcccugaggagu

SEQ ID NO: 113000 - RNA, 22 nt, Human
ucagugaaguaauggugagaga

SEQ ID NO: 113001 - RNA, 22 nt, Human
ucagugacuggguauuaaauca

SEQ ID NO: 113002 - RNA, 22 nt, Human
ucagugaugagguggcuuucaa

SEQ ID NO: 113003 - RNA, 22 nt, Human
ucagugauugguggacugccua

SEQ ID NO: 113004 - RNA, 22 nt, Human
ucagugcaaucaagguauguuu

SEQ ID NO: 113005 - RNA, 22 nt, Human
ucagugcacagagauuuuuguu

SEQ ID NO: 113006 - RNA, 22 nt, Human
ucagugcaggaaucucuagcca

SEQ ID NO: 113007 - RNA, 22 nt, Human
ucagugcaggaauuuccuuaga

SEQ ID NO: 113008 - RNA, 22 nt, Human
ucagugcagugaaagguuuacu

SEQ ID NO: 113009 - RNA, 22 nt, Human
ucagugcauggacagauuuaga

SEQ ID NO: 113010 - RNA, 22 nt, Human
ucagugcauucuaccaaaaggc

SEQ ID NO: 113011 - RNA, 22 nt, Human
ucagugcauuguucauuguagg

SEQ ID NO: 113012 - RNA, 22 nt, Human
ucagugccaugggcagacaggc

SEQ ID NO: 113013 - RNA, 22 nt, Human
ucagugcuaaaagagcuggugu

SEQ ID NO: 113014 - RNA, 20 nt, Human
ucagugcucaggcaccaggu

SEQ ID NO: 113015 - RNA, 19 nt, Human
ucagugcuccuauguccuu

SEQ ID NO: 113016 - RNA, 22 nt, Human
ucagugcugaguagcgugcacc

SEQ ID NO: 113017 - RNA, 22 nt, Human
ucagugcugcuuuaugacaguu

SEQ ID NO: 113018 - RNA, 22 nt, Human
ucagugcuuccuggaggaagcc

SEQ ID NO: 113019 - RNA, 22 nt, Human
ucagugcuugacagcucuggga

SEQ ID NO: 113020 - RNA, 22 nt, Human
ucaguggagagcuuccaggauu

SEQ ID NO: 113021 - RNA, 22 nt, Human
ucaguggauugacaugaaaaag

SEQ ID NO: 113022 - RNA, 22 nt, Human
ucaguggauuguagaaggcuua

SEQ ID NO: 113023 - RNA, 22 nt, Human
ucaguggggucgaugugaggga

SEQ ID NO: 113024 - RNA, 22 nt, Human
ucagugguaugcgugggagcug

SEQ ID NO: 113025 - RNA, 22 nt, Human
ucagugguuggaugauggucgc

SEQ ID NO: 113026 - RNA, 20 nt, Human
ucaguguauccucaguggcu

SEQ ID NO: 113027 - RNA, 22 nt, Human
ucagugucaucacuuaauauaa

SEQ ID NO: 113028 - RNA, 19 nt, Human
ucagugucccuguuaauau

SEQ ID NO: 113029 - RNA, 22 nt, Human
ucaguguccugugcggugcagc

SEQ ID NO: 113030 - RNA, 22 nt, Human
ucaguguccuucguucuuguug

SEQ ID NO: 113031 - RNA, 19 nt, Human
ucagugugacuuggucagu

SEQ ID NO: 113032 - RNA, 22 nt, Human
ucagugugauuaggcuaucuga

SEQ ID NO: 113033 - RNA, 22 nt, Human
ucagugugcacaugguagcagu

SEQ ID NO: 113034 - RNA, 22 nt, Human
ucaguguguaauucuuuguuuc

SEQ ID NO: 113035 - RNA, 22 nt, Human
ucaguguguacacugagcauuu

SEQ ID NO: 113036 - RNA, 19 nt, Human
ucagugugugggagguggu

SEQ ID NO: 113037 - RNA, 22 nt, Human
ucaguguguuacuuucuccuau

SEQ ID NO: 113038 - RNA, 22 nt, Human
ucaguguuggcuacaucugccu

SEQ ID NO: 113039 - RNA, 22 nt, Human
ucaguguugugcacauacaaaa

SEQ ID NO: 113040 - RNA, 22 nt, Human
ucaguguuugaacccaggguua

SEQ ID NO: 113041 - RNA, 22 nt, Human
ucaguguuugguuucagaauug

SEQ ID NO: 113042 - RNA, 22 nt, Human
ucaguguuuuccagggucuacu

SEQ ID NO: 113043 - RNA, 22 nt, Human
ucaguuaacggaaaggggugug

SEQ ID NO: 113044 - RNA, 23 nt, Human
ucaguuaacuguguuaccugugc

SEQ ID NO: 113045 - RNA, 22 nt, Human
ucaguuaagaggccacggcagu

SEQ ID NO: 113046 - RNA, 22 nt, Human
ucaguuaaugguaagggugaaa

SEQ ID NO: 113047 - RNA, 22 nt, Human
ucaguugcuaaaugguguagug

SEQ ID NO: 113048 - RNA, 22 nt, Human
ucaguuuaauacccagaugccu

SEQ ID NO: 113049 - RNA, 22 nt, Human
ucaguuuccugguugugauauu

SEQ ID NO: 113050 - RNA, 22 nt, Human
ucaguuuucucaucugugaaau

SEQ ID NO: 113051 - RNA, 22 nt, Human
ucaguuuucucauuuaugagau

SEQ ID NO: 113052 - RNA, 23 nt, Human
ucaguuuuggcuguucaguguug

SEQ ID NO: 113053 - RNA, 22 nt, Human
ucauaaaaauagacucuaaagu

SEQ ID NO: 113054 - RNA, 22 nt, Human
ucauaaacacacuaguaugauu

SEQ ID NO: 113055 - RNA, 20 nt, Human
ucauaaagaggaaauaaaua

SEQ ID NO: 113056 - RNA, 22 nt, Human
ucauaaagcuugccugcagugu

SEQ ID NO: 113057 - RNA, 22 nt, Human
ucauaaaguuaucaccaaaucc

SEQ ID NO: 113058 - RNA, 22 nt, Human
ucauaaaguuguuuuaauggga

SEQ ID NO: 113059 - RNA, 22 nt, Human
ucauaaauucuggugcugugag

SEQ ID NO: 113060 - RNA, 22 nt, Human
ucauaaauuggguuggcugggu

SEQ ID NO: 113061 - RNA, 22 nt, Human
ucauaagcuagcugcaccauau

SEQ ID NO: 113062 - RNA, 19 nt, Human
ucauaaggagagaggaaau

SEQ ID NO: 113063 - RNA, 22 nt, Human
ucauaaguaauuuaaacauucc

SEQ ID NO: 113064 - RNA, 22 nt, Human
ucauaagugguuuauaugcuug

SEQ ID NO: 113065 - RNA, 22 nt, Human
ucauaaugacaaacauacucag

SEQ ID NO: 113066 - RNA, 22 nt, Human
ucauacaaggaggguguucaaa

SEQ ID NO: 113067 - RNA, 22 nt, Human
ucauacaauucaaucucugauu

SEQ ID NO: 113068 - RNA, 22 nt, Human
ucauacaggcucaagcuauacg

SEQ ID NO: 113069 - RNA, 22 nt, Human
ucauacauaacuuguacaguga

SEQ ID NO: 113070 - RNA, 22 nt, Human
ucauacaucuuguauaucuauc

SEQ ID NO: 113071 - RNA, 22 nt, Human
ucauagaaauguggccagaaac

SEQ ID NO: 113072 - RNA, 22 nt, Human
ucauauaacuggauauuuucaa

SEQ ID NO: 113073 - RNA, 22 nt, Human
ucauauaucugcaaagcaguau

SEQ ID NO: 113074 - RNA, 22 nt, Human
ucauauauuuuggcagugauca

SEQ ID NO: 113075 - RNA, 21 nt, Human
ucauaucugcuuugcugucug

SEQ ID NO: 113076 - RNA, 22 nt, Human
ucauauuaggguaaugauaaga

SEQ ID NO: 113077 - RNA, 21 nt, Human
ucauauuucucuugcuauugu

SEQ ID NO: 113078 - RNA, 20 nt, Human
ucauauuuuugcccugggcc

SEQ ID NO: 113079 - RNA, 22 nt, Human
ucaucacauaugucaugauuug

SEQ ID NO: 113080 - RNA, 22 nt, Human
ucaucacucauuggacaacaga

SEQ ID NO: 113081 - RNA, 20 nt, Human
ucaucagauagguuaguaca

SEQ ID NO: 113082 - RNA, 22 nt, Human
ucaucagcucaucugcuccuag

SEQ ID NO: 113083 - RNA, 22 nt, Human
ucaucaucugggcuugggggug

SEQ ID NO: 113084 - RNA, 22 nt, Human
ucaucauguuugauuuccacag

SEQ ID NO: 113085 - RNA, 22 nt, Human
ucauccagaaaaaugucuuagc

SEQ ID NO: 113086 - RNA, 22 nt, Human
ucauccauaguuugguuggacu

SEQ ID NO: 113087 - RNA, 16 nt, Human
ucauccaugacagcuc

SEQ ID NO: 113088 - RNA, 22 nt, Human
ucauccugcacuggcuccuccu

SEQ ID NO: 113089 - RNA, 22 nt, Human
ucauccuggagaagcuccuucg

SEQ ID NO: 113090 - RNA, 22 nt, Human
ucaucgccucgugcaucuuggc

SEQ ID NO: 113091 - RNA, 22 nt, Human
ucaucuaagagucuuacauuua

SEQ ID NO: 113092 - RNA, 22 nt, Human
ucaucuaauuuuggaacagaga

SEQ ID NO: 113093 - RNA, 22 nt, Human
ucaucucagagagguauguuag

SEQ ID NO: 113094 - RNA, 22 nt, Human
ucaucuccauacggucucgcag

SEQ ID NO: 113095 - RNA, 22 nt, Human
ucaucucuccccagugucuuua

SEQ ID NO: 113096 - RNA, 22 nt, Human
ucaucugaacaugcagccugug

SEQ ID NO: 113097 - RNA, 22 nt, Human
ucaucugaccccaucuauucuc

SEQ ID NO: 113098 - RNA, 20 nt, Human
ucaucugauuaaccucgaag

SEQ ID NO: 113099 - RNA, 21 nt, Human
ucaucuggucuggggccugcu

SEQ ID NO: 113100 - RNA, 22 nt, Human
ucaucugucaaauugcaauaag

SEQ ID NO: 113101 - RNA, 22 nt, Human
ucaucugucauccacaaagcug

SEQ ID NO: 113102 - RNA, 22 nt, Human
ucaguuuauuucuuguuccaca

SEQ ID NO: 113103 - RNA, 22 nt, Human
ugggagucacuguuguugaggg

SEQ ID NO: 113104 - RNA, 22 nt, Human
ugggagucagacagccugagau

SEQ ID NO: 113105 - RNA, 22 nt, Human
ugggagucugaggcgggucgau

SEQ ID NO: 113106 - RNA, 23 nt, Human
ugggaguguugggaucucugcuc

SEQ ID NO: 113107 - RNA, 22 nt, Human
uccugaggacccugucaggggc

SEQ ID NO: 113108 - RNA, 22 nt, Human
uccugaggcccuguuagggucu

SEQ ID NO: 113109 - RNA, 22 nt, Human
uccugagggcauuuuggugacu

SEQ ID NO: 113110 - RNA, 22 nt, Human
uccugaggucugaaaaaggagc

SEQ ID NO: 113111 - RNA, 22 nt, Human
uccugaggugcucagccaggaa

SEQ ID NO: 113112 - RNA, 21 nt, Human
uccugagugugcccaggcucu

SEQ ID NO: 113113 - RNA, 22 nt, Human
uccugauggaggggucaucuuu

SEQ ID NO: 113114 - RNA, 22 nt, Human
uccugcagacauuuacaccuuu

SEQ ID NO: 113115 - RNA, 22 nt, Human
uccugcagagucccacugauuu

SEQ ID NO: 113116 - RNA, 23 nt, Human
uccugcagauaagcugguugaca

SEQ ID NO: 113117 - RNA, 22 nt, Human
uccugcaggccuguucccagua

SEQ ID NO: 113118 - RNA, 22 nt, Human
uccugcaggcuugaguccucag

SEQ ID NO: 113119 - RNA, 21 nt, Human
uccugcagggcagcagagugg

SEQ ID NO: 113120 - RNA, 22 nt, Human
uccugcagucugcacucugccu

SEQ ID NO: 113121 - RNA, 22 nt, Human
uccugccacugcacauauacuu

SEQ ID NO: 113122 - RNA, 23 nt, Human
uccugccagaugacuccuuucuu

SEQ ID NO: 113123 - RNA, 22 nt, Human
uccugccaucugcuguugaucu

SEQ ID NO: 113124 - RNA, 22 nt, Human
uccugccuaccuugcggaggug

SEQ ID NO: 113125 - RNA, 22 nt, Human
uccugccucaggcucuggagua

SEQ ID NO: 113126 - RNA, 22 nt, Human
uccugccucuccaugcuaacua

SEQ ID NO: 113127 - RNA, 22 nt, Human
uccugccucuuuucuuauucca

SEQ ID NO: 113128 - RNA, 22 nt, Human
uccugccuguuuaccuguacuu

SEQ ID NO: 113129 - RNA, 21 nt, Human
uccugccuuaguccagagcag

SEQ ID NO: 113130 - RNA, 22 nt, Human
uccugcuccaccgugggcugga

SEQ ID NO: 113131 - RNA, 22 nt, Human
uccugcugaccaguaaaugaau

SEQ ID NO: 113132 - RNA, 21 nt, Human
uccugcugagaaacagauggu

SEQ ID NO: 113133 - RNA, 20 nt, Human
uccugcugccaccucuucuu

SEQ ID NO: 113134 - RNA, 21 nt, Human
uccugcugcuccugucguguu

SEQ ID NO: 113135 - RNA, 22 nt, Human
uccugcugggucuaacucuggu

SEQ ID NO: 113136 - RNA, 22 nt, Human
uccugcugugcuuauuauccug

SEQ ID NO: 113137 - RNA, 19 nt, Human
uccugcugugugaagggga

SEQ ID NO: 113138 - RNA, 22 nt, Human
uccuggaacauggauaaagaau

SEQ ID NO: 113139 - RNA, 22 nt, Human
uccuggaagugcuuggugaggg

SEQ ID NO: 113140 - RNA, 22 nt, Human
uccuggagaagaggggcuugga

SEQ ID NO: 113141 - RNA, 22 nt, Human
uccuggagaauccugccaccug

SEQ ID NO: 113142 - RNA, 22 nt, Human
uccuggagauaauugcagugaa

SEQ ID NO: 113143 - RNA, 22 nt, Human
uccuggagccucauucaaacac

SEQ ID NO: 113144 - RNA, 22 nt, Human
uccuggagcugacuccguuuga

SEQ ID NO: 113145 - RNA, 20 nt, Human
uccuggagcugcuugaauuc

SEQ ID NO: 113146 - RNA, 22 nt, Human
uccuggaggggacagcaugggc

SEQ ID NO: 113147 - RNA, 20 nt, Human
uccuggaguauuccaugcuu

SEQ ID NO: 113148 - RNA, 22 nt, Human
uccuggaguauuucuguggugu

SEQ ID NO: 113149 - RNA, 22 nt, Human
uccuggagugucuuccccaagg

SEQ ID NO: 113150 - RNA, 22 nt, Human
uccuggauuaauagggagcugu

SEQ ID NO: 113151 - RNA, 22 nt, Human
uccuggauucugcccugaaggc

SEQ ID NO: 113152 - RNA, 22 nt, Human
uccuggcagaaauggggcugug

SEQ ID NO: 113153 - RNA, 22 nt, Human
uccuggcagcccgcaggugcug

SEQ ID NO: 113154 - RNA, 22 nt, Human
uccuggcagggucuaggucuag

SEQ ID NO: 113155 - RNA, 22 nt, Human
uccuggcaggguggcagcgggu

SEQ ID NO: 113156 - RNA, 22 nt, Human
uccuggcaggucagcaggagca

SEQ ID NO: 113157 - RNA, 22 nt, Human
uccuggcagguguauuggcugu

SEQ ID NO: 113158 - RNA, 22 nt, Human
uccuggcauccgugggucugug

SEQ ID NO: 113159 - RNA, 19 nt, Human
uccuggcaucuuccucccu

SEQ ID NO: 113160 - RNA, 22 nt, Human
uccuggcauugugcagggugug

SEQ ID NO: 113161 - RNA, 19 nt, Human
uccuggcauuuguaggaaa

SEQ ID NO: 113162 - RNA, 21 nt, Human
uccuggccagggcacuaggca

SEQ ID NO: 113163 - RNA, 22 nt, Human
uccuggcccaaucugcccauga

SEQ ID NO: 113164 - RNA, 22 nt, Human
uccuggcccacuccuagcuucu

SEQ ID NO: 113165 - RNA, 22 nt, Human
uccuggcccucugcaaacgcca

SEQ ID NO: 113166 - RNA, 22 nt, Human
uccuggccgccgcguggggccg

SEQ ID NO: 113167 - RNA, 22 nt, Human
uccuggccuagaguuuguguuc

SEQ ID NO: 113168 - RNA, 22 nt, Human
uccuggccuagcucacccugga

SEQ ID NO: 113169 - RNA, 20 nt, Human
uccuggccucccuggggcuc

SEQ ID NO: 113170 - RNA, 22 nt, Human
uccuggccucugagucaagaac

SEQ ID NO: 113171 - RNA, 22 nt, Human
uccuggccugucuggaguagcu

SEQ ID NO: 113172 - RNA, 16 nt, Human
uccuggccuuuggaag

SEQ ID NO: 113173 - RNA, 22 nt, Human
uccuggcuccugaucugucacu

SEQ ID NO: 113174 - RNA, 22 nt, Human
uccuggcuucugucuccuuauu

SEQ ID NO: 113175 - RNA, 22 nt, Human
uccugggaagacugugaggaca

SEQ ID NO: 113176 - RNA, 22 nt, Human
uccugggaaguugcaucaccgu

SEQ ID NO: 113177 - RNA, 22 nt, Human
uccugggaccaggcaccuacug

SEQ ID NO: 113178 - RNA, 22 nt, Human
uccugggagaguuugauucauu

SEQ ID NO: 113179 - RNA, 22 nt, Human
uccugggaggcugugccuggcu

SEQ ID NO: 113180 - RNA, 22 nt, Human
uccugggaguaaaagcugcccu

SEQ ID NO: 113181 - RNA, 22 nt, Human
uccugggaugaggaaacaagga

SEQ ID NO: 113182 - RNA, 22 nt, Human
uccugggaugcauaaaauaugu

SEQ ID NO: 113183 - RNA, 22 nt, Human
uccugggcagccucucuggaag

SEQ ID NO: 113184 - RNA, 22 nt, Human
uccugggcccuccggaucaggu

SEQ ID NO: 113185 - RNA, 22 nt, Human
uccugggcgagguacuggggcu

SEQ ID NO: 113186 - RNA, 22 nt, Human
uccugggcgaguggugguacac

SEQ ID NO: 113187 - RNA, 20 nt, Human
uccugggguaagccaugguc

SEQ ID NO: 113188 - RNA, 22 nt, Human
uccugggguuuagagggaagug

SEQ ID NO: 113189 - RNA, 22 nt, Human
uccugggucucuuccuuaguuc

SEQ ID NO: 113190 - RNA, 22 nt, Human
uccugggugugauauucauaga

SEQ ID NO: 113191 - RNA, 18 nt, Human
uccugguauugcaagcac

SEQ ID NO: 113192 - RNA, 22 nt, Human
uccuggucagcuuugagguugu

SEQ ID NO: 113193 - RNA, 22 nt, Human
uccugguggauagaagccaagg

SEQ ID NO: 113194 - RNA, 22 nt, Human
uccugguggcagauuuuagguc

SEQ ID NO: 113195 - RNA, 22 nt, Human
uccuggugguuugaaaacugaa

SEQ ID NO: 113196 - RNA, 22 nt, Human
uccugguguccuggucugcuag

SEQ ID NO: 113197 - RNA, 22 nt, Human
uccuggugucgccuggucaguu

SEQ ID NO: 113198 - RNA, 22 nt, Human
uccugguuagagcucucugggg

SEQ ID NO: 113199 - RNA, 22 nt, Human
uccugguuuauagacugauggc

SEQ ID NO: 113200 - RNA, 21 nt, Human
uccuguaagcuuggguggcuc

SEQ ID NO: 113201 - RNA, 22 nt, Human
uccuguagcugucacugggggc

SEQ ID NO: 113202 - RNA, 22 nt, Human
uccuguaguugcuaaguuuguu

SEQ ID NO: 113203 - RNA, 22 nt, Human
uccuguccucugggugccccau

SEQ ID NO: 113204 - RNA, 22 nt, Human
uccuguccugaggcuccaggcc

SEQ ID NO: 113205 - RNA, 22 nt, Human
uccugucugcucacagagcugg

SEQ ID NO: 113206 - RNA, 22 nt, Human
uccugucuuaaugaucucgugc

SEQ ID NO: 113207 - RNA, 22 nt, Human
uccugugagacuuguccauuau

SEQ ID NO: 113208 - RNA, 22 nt, Human
uccugugauggcuugcgaugug

SEQ ID NO: 113209 - RNA, 22 nt, Human
uccuguggucauucuucugccc

SEQ ID NO: 113210 - RNA, 22 nt, Human
uccugugucucagcgugaagca

SEQ ID NO: 113211 - RNA, 22 nt, Human
uccugugugcuuucuuuagguu

SEQ ID NO: 113212 - RNA, 22 nt, Human
uccagccugaacuuuguccaga

SEQ ID NO: 113213 - RNA, 22 nt, Human
uccagccugguugcgggcaucc

SEQ ID NO: 113214 - RNA, 18 nt, Human
uccagcgugcuccagggc

SEQ ID NO: 113215 - RNA, 18 nt, Human
uccagcucacagaugggc

SEQ ID NO: 113216 - RNA, 22 nt, Human
uccagcucagaugcagggauca

SEQ ID NO: 113217 - RNA, 22 nt, Human
uccagcucccacucucacugcu

SEQ ID NO: 113218 - RNA, 22 nt, Human
uccagcuccugaguucacugcu

SEQ ID NO: 113219 - RNA, 22 nt, Human
uccagcucuaacaugcugggcc

SEQ ID NO: 113220 - RNA, 21 nt, Human
uccagcucucauaguguucca

SEQ ID NO: 113221 - RNA, 22 nt, Human
uccagcucugcuucacagucuc

SEQ ID NO: 113222 - RNA, 22 nt, Human
uccagcucuuguugcccacugc

SEQ ID NO: 113223 - RNA, 22 nt, Human
uccagcugacaguucaaaauga

SEQ ID NO: 113224 - RNA, 19 nt, Human
uccuuaaaaaagcaguucu

SEQ ID NO: 113225 - RNA, 22 nt, Human
uccuuaaauccuucagagauua

SEQ ID NO: 113226 - RNA, 22 nt, Human
uccuuacaguuaaaaugggagu

SEQ ID NO: 113227 - RNA, 22 nt, Human
uccuuacaugcuuccuuauaca

SEQ ID NO: 113228 - RNA, 22 nt, Human
uccuuaccucaagcuugugguc

SEQ ID NO: 113229 - RNA, 22 nt, Human
uccuuagacaaagagugggcuu

SEQ ID NO: 113230 - RNA, 22 nt, Human
uccuuagaccuggcaaaugggg

SEQ ID NO: 113231 - RNA, 22 nt, Human
uccuuagcaggcauucaggacc

SEQ ID NO: 113232 - RNA, 22 nt, Human
uccuuagcccacuaauacuuau

SEQ ID NO: 113233 - RNA, 22 nt, Human
uccuuagcugugaaaugagaau

SEQ ID NO: 113234 - RNA, 22 nt, Human
uccuuaggcaauuugggagagu

SEQ ID NO: 113235 - RNA, 22 nt, Human
uccuuauaccuuugcuccgcuu

SEQ ID NO: 113236 - RNA, 22 nt, Human
uccuuauaguugucuuugaacc

SEQ ID NO: 113237 - RNA, 21 nt, Human
uccuuauauuugaauacuuua

SEQ ID NO: 113238 - RNA, 22 nt, Human
uccuucaaaaguugagagagcc

SEQ ID NO: 113239 - RNA, 22 nt, Human
uccuucaagugcaguaccugag

SEQ ID NO: 113240 - RNA, 23 nt, Human
uccuucaaguuaggaagugaaca

SEQ ID NO: 113241 - RNA, 18 nt, Human
uccuucacagcaggaagg

SEQ ID NO: 113242 - RNA, 22 nt, Human
uccuucaccucaagcuuuugaa

SEQ ID NO: 113243 - RNA, 22 nt, Human
uccuucagaaaaccucagucuu

SEQ ID NO: 113244 - RNA, 20 nt, Human
uccuucagacuuuggaguug

SEQ ID NO: 113245 - RNA, 22 nt, Human
uccuucagaggauaaggaagaa

SEQ ID NO: 113246 - RNA, 22 nt, Human
uccuucagcuuguuagagugac

SEQ ID NO: 113247 - RNA, 23 nt, Human
uccuucaggcucuuccccuggac

SEQ ID NO: 113248 - RNA, 17 nt, Human
uccuucagggccucaca

SEQ ID NO: 113249 - RNA, 21 nt, Human
uccuucagucuagaugauugu

SEQ ID NO: 113250 - RNA, 22 nt, Human
uccuucagucuucugagccaua

SEQ ID NO: 113251 - RNA, 22 nt, Human
uccuucaguuaaagaucucaca

SEQ ID NO: 113252 - RNA, 22 nt, Human
uccuucaugaugcuuagcagag

SEQ ID NO: 113253 - RNA, 22 nt, Human
uccuuccagguccagggaugug

SEQ ID NO: 113254 - RNA, 19 nt, Human
uccuuccaguuccuggggu

SEQ ID NO: 113255 - RNA, 21 nt, Human
uccuucccccuuggccuggga

SEQ ID NO: 113256 - RNA, 22 nt, Human
uccuuccuggggucucugcugc

SEQ ID NO: 113257 - RNA, 21 nt, Human
uccuuccuugagguccuuucc

SEQ ID NO: 113258 - RNA, 22 nt, Human
uccuucuacacugccucugaga

SEQ ID NO: 113259 - RNA, 22 nt, Human
uccuucucuacaaauccaggca

SEQ ID NO: 113260 - RNA, 21 nt, Human
uccuucucuaugauugucuga

SEQ ID NO: 113261 - RNA, 20 nt, Human
uccuucugaggugaggagga

SEQ ID NO: 113262 - RNA, 22 nt, Human
uccuucuguagucccugucccu

SEQ ID NO: 113263 - RNA, 22 nt, Human
uccuucuucaugaagauauaug

SEQ ID NO: 113264 - RNA, 22 nt, Human
uccuugaaaaucuugguuuaga

SEQ ID NO: 113265 - RNA, 22 nt, Human
uccuugaagcuuguaucuaaua

SEQ ID NO: 113266 - RNA, 22 nt, Human
uccuugaauauaauaacaguag

SEQ ID NO: 113267 - RNA, 22 nt, Human
uccuugaauccuagcauccuau

SEQ ID NO: 113268 - RNA, 22 nt, Human
uccuugaauggacauuacacug

SEQ ID NO: 113269 - RNA, 22 nt, Human
uccuugaggaggugacacugga

SEQ ID NO: 113270 - RNA, 22 nt, Human
uccuuggaaauuucaucagaca

SEQ ID NO: 113271 - RNA, 22 nt, Human
uccuuggaacauugauccaaac

SEQ ID NO: 113272 - RNA, 22 nt, Human
uccuuggaagagcauucccagg

SEQ ID NO: 113273 - RNA, 22 nt, Human
uccuuggagaaucuuguuuuac

SEQ ID NO: 113274 - RNA, 22 nt, Human
uccuuggaggucaacgggacgg

SEQ ID NO: 113275 - RNA, 22 nt, Human
uccuuggaucuuuccuaugauu

SEQ ID NO: 113276 - RNA, 22 nt, Human
uccuuggcuaguacuggccagc

SEQ ID NO: 113277 - RNA, 22 nt, Human
uccuuggcucuuugauaaauac

SEQ ID NO: 113278 - RNA, 22 nt, Human
uccuugggguaacuccagccug

SEQ ID NO: 113279 - RNA, 22 nt, Human
uccuuggugcaaaugauuuaau

SEQ ID NO: 113280 - RNA, 22 nt, Human
uccuuggugcuggagcucagac

SEQ ID NO: 113281 - RNA, 22 nt, Human
uccuuguaacguugggcugggg

SEQ ID NO: 113282 - RNA, 22 nt, Human
uccuuuaacuugauuauuuuca

SEQ ID NO: 113283 - RNA, 22 nt, Human
uccuuuaucaaggagccuuaga

SEQ ID NO: 113284 - RNA, 22 nt, Human
uccuuucaccaaaaaguguugu

SEQ ID NO: 113285 - RNA, 22 nt, Human
uccuuucuccagcuggcauugu

SEQ ID NO: 113286 - RNA, 22 nt, Human
uccuuucugucuuuacucugga

SEQ ID NO: 113287 - RNA, 17 nt, Human
uccuuucuuuaccuguu

SEQ ID NO: 113288 - RNA, 22 nt, Human
uccuuuggcaagcucugcucuu

SEQ ID NO: 113289 - RNA, 20 nt, Human
uccuuuggccuuagagcugu

SEQ ID NO: 113290 - RNA, 22 nt, Human
uccuuugguucucuaagaugcu

SEQ ID NO: 113291 - RNA, 22 nt, Human
uccuuuguugagauaaauuggg

SEQ ID NO: 113292 - RNA, 22 nt, Human
uccuuuguuguacaauuauuuu

SEQ ID NO: 113293 - RNA, 18 nt, Human
uccuuuucucccacccac

SEQ ID NO: 113294 - RNA, 22 nt, Human
ucgaaaaugaagagucaauuaa

SEQ ID NO: 113295 - RNA, 22 nt, Human
ucgaaggaaccucaauuuucgu

SEQ ID NO: 113296 - RNA, 22 nt, Human
ucgagcugcacgcccccgagcu

SEQ ID NO: 113297 - RNA, 22 nt, Human
ucgagucauguucucccauuaa

SEQ ID NO: 113298 - RNA, 22 nt, Human
ucgauguggugacaagguacgu

SEQ ID NO: 113299 - RNA, 22 nt, Human
ucgcagaccgcggugcacgugg

SEQ ID NO: 113300 - RNA, 22 nt, Human
ucgcagcacuagcccugcauug

SEQ ID NO: 113301 - RNA, 22 nt, Human
ucgccauggaaguccuugcgga

SEQ ID NO: 113302 - RNA, 22 nt, Human
ucgccccgaggcagcccuaugc

SEQ ID NO: 113303 - RNA, 22 nt, Human
ucgcugaggcugcacggcugcc

SEQ ID NO: 113304 - RNA, 22 nt, Human
ucgcuggccuggaggggagcca

SEQ ID NO: 113305 - RNA, 22 nt, Human
ucgcugugaaaaccuuggacaa

SEQ ID NO: 113306 - RNA, 22 nt, Human
ucgcugugguuucuguacaugg

SEQ ID NO: 113307 - RNA, 22 nt, Human
ucggaaggggccgcgcucggac

SEQ ID NO: 113308 - RNA, 22 nt, Human
ucggccacgggguuuccuccaa

SEQ ID NO: 113309 - RNA, 22 nt, Human
ucgggcugcucgcugcggaacu

SEQ ID NO: 113310 - RNA, 17 nt, Human
ucgguuugccaggcuuc

SEQ ID NO: 113311 - RNA, 22 nt, Human
ucguacagcagacugaaguccu

SEQ ID NO: 113312 - RNA, 22 nt, Human
ucguauccugcuucaugcccag

SEQ ID NO: 113313 - RNA, 22 nt, Human
ucguaugcucucuguguccugu

SEQ ID NO: 113314 - RNA, 22 nt, Human
ucgugcaaaccugacacagcca

SEQ ID NO: 113315 - RNA, 22 nt, Human
ucgugcaaaggcccaugugggu

SEQ ID NO: 113316 - RNA, 19 nt, Human
ucguggggaggugggcagc

SEQ ID NO: 113317 - RNA, 23 nt, Human
ucguugaauagcaauagcacaac

SEQ ID NO: 113318 - RNA, 22 nt, Human
ucuaaaaugcagaucuacuggu

SEQ ID NO: 113319 - RNA, 22 nt, Human
ucuaaacagccucuuaccaacu

SEQ ID NO: 113320 - RNA, 20 nt, Human
ucuaaacaguuggcaugggg

SEQ ID NO: 113321 - RNA, 22 nt, Human
ucuaaacugcgagcaugccccc

SEQ ID NO: 113322 - RNA, 22 nt, Human
uccaggcaggguuaaggguccu

SEQ ID NO: 113323 - RNA, 17 nt, Human
uccaggcauaucuccua

SEQ ID NO: 113324 - RNA, 23 nt, Human
uccaggcaugagcucuggaugga

SEQ ID NO: 113325 - RNA, 22 nt, Human
uccaggccauugacugcauccu

SEQ ID NO: 113326 - RNA, 22 nt, Human
uccaggcccgagaugggcugga

SEQ ID NO: 113327 - RNA, 22 nt, Human
uccaggccgcauaguuacucug

SEQ ID NO: 113328 - RNA, 21 nt, Human
uccaggccucaggaagggaug

SEQ ID NO: 113329 - RNA, 22 nt, Human
uccaggccucuagcccucucuu

SEQ ID NO: 113330 - RNA, 22 nt, Human
uccaggccugcaaugacaaagc

SEQ ID NO: 113331 - RNA, 22 nt, Human
uccaggccugccugguguuugc

SEQ ID NO: 113332 - RNA, 22 nt, Human
uccaggcucagucaagcacuuc

SEQ ID NO: 113333 - RNA, 18 nt, Human
uccaggcuccaggcuaac

SEQ ID NO: 113334 - RNA, 22 nt, Human
uccaggcucuaggcugcucucc

SEQ ID NO: 113335 - RNA, 22 nt, Human
uccaggcucucaggugucagca

SEQ ID NO: 113336 - RNA, 21 nt, Human
uccaggcugaugaugucaacu

SEQ ID NO: 113337 - RNA, 22 nt, Human
uccaggcugcagucuugcccuc

SEQ ID NO: 113338 - RNA, 22 nt, Human
uccaggcuggagugcaguggcg

SEQ ID NO: 113339 - RNA, 22 nt, Human
uccaggcuggcucuucaaaauu

SEQ ID NO: 113340 - RNA, 22 nt, Human
uccaggcugugcaugaguuuag

SEQ ID NO: 113341 - RNA, 22 nt, Human
uccaggcuucacgucugcccuc

SEQ ID NO: 113342 - RNA, 21 nt, Human
uccagcugcacaagcaugggg

SEQ ID NO: 113343 - RNA, 23 nt, Human
uccagcugcagugggauggggaa

SEQ ID NO: 113344 - RNA, 22 nt, Human
uccagcugcuagcuagaugcaa

SEQ ID NO: 113345 - RNA, 22 nt, Human
uccagcugcugacccaguagcc

SEQ ID NO: 113346 - RNA, 22 nt, Human
uccagcugcugccagccaagcu

SEQ ID NO: 113347 - RNA, 22 nt, Human
uccagcuguacuuuguccuggc

SEQ ID NO: 113348 - RNA, 22 nt, Human
uccagcuguaguggauuugaga

SEQ ID NO: 113349 - RNA, 22 nt, Human
uccagcuguugauauucuaggu

SEQ ID NO: 113350 - RNA, 22 nt, Human
uccagcuuucacgcuccugccu

SEQ ID NO: 113351 - RNA, 22 nt, Human
uccagcuuugagauuuuaugga

SEQ ID NO: 113352 - RNA, 22 nt, Human
uccagcuuuuaccaaaugagca

SEQ ID NO: 113353 - RNA, 22 nt, Human
uccagcuuuuauuggaugagga

SEQ ID NO: 113354 - RNA, 22 nt, Human
uccaggaaacaucuccgccuaa

SEQ ID NO: 113355 - RNA, 22 nt, Human
uccaggaacagaauguuagugc

SEQ ID NO: 113356 - RNA, 22 nt, Human
uccaggaaugugugugggcuag

SEQ ID NO: 113357 - RNA, 22 nt, Human
uccaggaccaaagacacaugua

SEQ ID NO: 113358 - RNA, 17 nt, Human
uccaggagaggcaaugg

SEQ ID NO: 113359 - RNA, 22 nt, Human
uccaggagagguguggggacug

SEQ ID NO: 113360 - RNA, 22 nt, Human
uccaggagauucauuaggucau

SEQ ID NO: 113361 - RNA, 21 nt, Human
uccaggagcacgggacuagga

SEQ ID NO: 113362 - RNA, 22 nt, Human
uccaggaggacugagggggcug

SEQ ID NO: 113363 - RNA, 19 nt, Human
uccaggaggcugccauuga

SEQ ID NO: 113364 - RNA, 20 nt, Human
uccaggagguuaguguggcu

SEQ ID NO: 113365 - RNA, 22 nt, Human
uccaggaguccugggagugauu

SEQ ID NO: 113366 - RNA, 22 nt, Human
uccaggagucuagccucaggcc

SEQ ID NO: 113367 - RNA, 22 nt, Human
uccaggaguggggcagaggucu

SEQ ID NO: 113368 - RNA, 22 nt, Human
uccaggauugcaggugcacaac

SEQ ID NO: 113369 - RNA, 22 nt, Human
uccaggcaaagggacuagcagg

SEQ ID NO: 113370 - RNA, 22 nt, Human
uccaggcaaagugcugggcugc

SEQ ID NO: 113371 - RNA, 22 nt, Human
uccaggcacagaguuggucagu

SEQ ID NO: 113372 - RNA, 20 nt, Human
uccaggcagacagcuauggg

SEQ ID NO: 113373 - RNA, 22 nt, Human
uccaggcagcccuuccugacuc

SEQ ID NO: 113374 - RNA, 22 nt, Human
uccaggcagucauuaaucucua

SEQ ID NO: 113375 - RNA, 22 nt, Human
uccaggcaguuuuccagguugu

SEQ ID NO: 113376 - RNA, 22 nt, Human
uccaggcauaaugcccaguggu

SEQ ID NO: 113377 - RNA, 22 nt, Human
uccaggcauagaaggcacgcac

SEQ ID NO: 113378 - RNA, 22 nt, Human
uccaggccaggguaagaggaga

SEQ ID NO: 113379 - RNA, 21 nt, Human
uccaggccaugguggggaggc

SEQ ID NO: 113380 - RNA, 20 nt, Human
uccaggcccacucagcugaa

SEQ ID NO: 113381 - RNA, 22 nt, Human
uccaggcccagacggggugagg

SEQ ID NO: 113382 - RNA, 22 nt, Human
uccaggcccauggagcagagcu

SEQ ID NO: 113383 - RNA, 22 nt, Human
uccaggccccacugaagccccu

SEQ ID NO: 113384 - RNA, 22 nt, Human
uccaggccccagaccguacugc

SEQ ID NO: 113385 - RNA, 22 nt, Human
uccaggccccccacgcuaaugg

SEQ ID NO: 113386 - RNA, 22 nt, Human
uccaggccccugccugggccug

SEQ ID NO: 113387 - RNA, 22 nt, Human
uccaggccuaggccaagugauu

SEQ ID NO: 113388 - RNA, 18 nt, Human
uccaggccugaagugucc

SEQ ID NO: 113389 - RNA, 22 nt, Human
uccaggccugacuauaaaugua

SEQ ID NO: 113390 - RNA, 22 nt, Human
uccaggccuggcuccauucagu

SEQ ID NO: 113391 - RNA, 22 nt, Human
uccaggccuuugcacauguugu

SEQ ID NO: 113392 - RNA, 22 nt, Human
uccaggcucagcacuugcuacu

SEQ ID NO: 113393 - RNA, 19 nt, Human
uccaggcuccauuggcaga

SEQ ID NO: 113394 - RNA, 22 nt, Human
uccaggcucccucaggaugcac

SEQ ID NO: 113395 - RNA, 23 nt, Human
uccaggcugaaggagcagauuuu

SEQ ID NO: 113396 - RNA, 22 nt, Human
uccaggcugacgcagcuauuua

SEQ ID NO: 113397 - RNA, 22 nt, Human
uccaggcuuuggggcaggagcg

SEQ ID NO: 113398 - RNA, 22 nt, Human
uccagggaagagcagaggcuac

SEQ ID NO: 113399 - RNA, 22 nt, Human
uccagggacacagaguccuucu

SEQ ID NO: 113400 - RNA, 22 nt, Human
uccagggacagcgcuggagcua

SEQ ID NO: 113401 - RNA, 22 nt, Human
uccagggacaguauagaggauc

SEQ ID NO: 113402 - RNA, 22 nt, Human
uccagggauguccuguagcacu

SEQ ID NO: 113403 - RNA, 22 nt, Human
uccagggcaccagcgucccccu

SEQ ID NO: 113404 - RNA, 22 nt, Human
uccagggcaggugcugggcucu

SEQ ID NO: 113405 - RNA, 22 nt, Human
uccagggccaguccuugucugu

SEQ ID NO: 113406 - RNA, 22 nt, Human
uccagggccuuaccucuucaga

SEQ ID NO: 113407 - RNA, 22 nt, Human
uccagggcugacuugggagagg

SEQ ID NO: 113408 - RNA, 23 nt, Human
uccagggcuggccagaccucggu

SEQ ID NO: 113409 - RNA, 18 nt, Human
uccagggcuuccuccucu

SEQ ID NO: 113410 - RNA, 22 nt, Human
uccaggggugauuuuugacuug

SEQ ID NO: 113411 - RNA, 22 nt, Human
uccaggguguguuuacuggggu

SEQ ID NO: 113412 - RNA, 22 nt, Human
uccagguaauuuggaugcuagu

SEQ ID NO: 113413 - RNA, 22 nt, Human
uccagguguauuuacugaagua

SEQ ID NO: 113414 - RNA, 22 nt, Human
uccagguuucgcuacaggagag

SEQ ID NO: 113415 - RNA, 22 nt, Human
uccaguaugacugauguccuuc

SEQ ID NO: 113416 - RNA, 22 nt, Human
uccagucaacuuaaucucuuua

SEQ ID NO: 113417 - RNA, 22 nt, Human
uccagucaagcuugagaauuuc

SEQ ID NO: 113418 - RNA, 22 nt, Human
uccagucauuuccauuguuccc

SEQ ID NO: 113419 - RNA, 22 nt, Human
uccaguccuaucugcccuugga

SEQ ID NO: 113420 - RNA, 18 nt, Human
uccagucuuauuaccauu

SEQ ID NO: 113421 - RNA, 22 nt, Human
uccagucuucuugcagcuacau

SEQ ID NO: 113422 - RNA, 22 nt, Human
uccagugccucacugaggauuc

SEQ ID NO: 113423 - RNA, 20 nt, Human
uccaguggccugaaucugga

SEQ ID NO: 113424 - RNA, 22 nt, Human
uccaguggguugcugagggagg

SEQ ID NO: 113425 - RNA, 23 nt, Human
uccagugugugcagauuaagugc

SEQ ID NO: 113426 - RNA, 22 nt, Human
uccaguugcccaucucucuucu

SEQ ID NO: 113427 - RNA, 22 nt, Human
uccaguuguuuguauuaacucu

SEQ ID NO: 113428 - RNA, 22 nt, Human
uccaguuuacaggguugcuuuu

SEQ ID NO: 113429 - RNA, 22 nt, Human
uccaguuuauuaugcauuuaca

SEQ ID NO: 113430 - RNA, 22 nt, Human
uccaguuucauagcuaaggaac

SEQ ID NO: 113431 - RNA, 22 nt, Human
uccuaggguuggagacagugac

SEQ ID NO: 113432 - RNA, 22 nt, Human
uccucaaaguuguauaaauauu

SEQ ID NO: 113433 - RNA, 22 nt, Human
uccucaaauauuuacuuacuga

SEQ ID NO: 113434 - RNA, 22 nt, Human
uccucacaagcaagcacaggua

SEQ ID NO: 113435 - RNA, 22 nt, Human
uccucacagucaacacuuugag

SEQ ID NO: 113436 - RNA, 22 nt, Human
uccucacauggugagccacaca

SEQ ID NO: 113437 - RNA, 22 nt, Human
uccucacugcagugcuccgagc

SEQ ID NO: 113438 - RNA, 22 nt, Human
uccucagaaaccccugugaggu

SEQ ID NO: 113439 - RNA, 20 nt, Human
uccucagaagacauuugggg

SEQ ID NO: 113440 - RNA, 22 nt, Human
uccucagcuuuuauuucacuug

SEQ ID NO: 113441 - RNA, 22 nt, Human
uccucaggauguggaguagaau

SEQ ID NO: 113442 - RNA, 22 nt, Human
uccucaggaugugggguagaau

SEQ ID NO: 113443 - RNA, 22 nt, Human
uccucaggcggugaggaggggc

SEQ ID NO: 113444 - RNA, 22 nt, Human
uccucaggugacuagguaucuu

SEQ ID NO: 113445 - RNA, 22 nt, Human
uccucaguaaggaucgucagcu

SEQ ID NO: 113446 - RNA, 22 nt, Human
uccucagucacgguagcacauu

SEQ ID NO: 113447 - RNA, 22 nt, Human
uccucagucguuugagccaaaa

SEQ ID NO: 113448 - RNA, 22 nt, Human
uccucagucucuaaggccucag

SEQ ID NO: 113449 - RNA, 22 nt, Human
uccucaguggggcauucauuau

SEQ ID NO: 113450 - RNA, 22 nt, Human
uccucauacauaucucagucuu

SEQ ID NO: 113451 - RNA, 22 nt, Human
uccucauugucacuggcccgca

SEQ ID NO: 113452 - RNA, 20 nt, Human
uccuccaaccagcugcuaau

SEQ ID NO: 113453 - RNA, 22 nt, Human
uccuccaagcagaggcccugaa

SEQ ID NO: 113454 - RNA, 23 nt, Human
uccuccaaucucauggcccuuaa

SEQ ID NO: 113455 - RNA, 22 nt, Human
uccuccagaaacugaggcagaa

SEQ ID NO: 113456 - RNA, 22 nt, Human
uccuccagcuguauccugccug

SEQ ID NO: 113457 - RNA, 22 nt, Human
uccuccagcuucucuuuugggg

SEQ ID NO: 113458 - RNA, 22 nt, Human
uccuccaggauaaaauguguug

SEQ ID NO: 113459 - RNA, 22 nt, Human
uccuccaguggcccaguccuuc

SEQ ID NO: 113460 - RNA, 22 nt, Human
uccucccacauaggacaauggg

SEQ ID NO: 113461 - RNA, 22 nt, Human
uccuccccugcccaugaggagg

SEQ ID NO: 113462 - RNA, 22 nt, Human
uccucccugcacucagugaagu

SEQ ID NO: 113463 - RNA, 22 nt, Human
uccucccuugacuccugcuuuu

SEQ ID NO: 113464 - RNA, 22 nt, Human
uccucccuugggguuucguuau

SEQ ID NO: 113465 - RNA, 21 nt, Human
uccuccuccacuaggcuagcc

SEQ ID NO: 113466 - RNA, 22 nt, Human
uccuccugccuuugcuucuugu

SEQ ID NO: 113467 - RNA, 23 nt, Human
uccuccuggauacaaagggaaca

SEQ ID NO: 113468 - RNA, 21 nt, Human
uccuccuggccaggcggcccc

SEQ ID NO: 113469 - RNA, 21 nt, Human
uccuccuucaaguccuggccu

SEQ ID NO: 113470 - RNA, 22 nt, Human
uccuccuucgggacugcuugac

SEQ ID NO: 113471 - RNA, 20 nt, Human
uccuccuugcagagcccaga

SEQ ID NO: 113472 - RNA, 22 nt, Human
uccuccuuguuuugucucugcu

SEQ ID NO: 113473 - RNA, 22 nt, Human
uccucuacucgcuugcccuuug

SEQ ID NO: 113474 - RNA, 22 nt, Human
uccucucagugugguuguggga

SEQ ID NO: 113475 - RNA, 22 nt, Human
uccucuccagcaaacuggcuau

SEQ ID NO: 113476 - RNA, 22 nt, Human
uccggggcuuccccgcagugcc

SEQ ID NO: 113477 - RNA, 22 nt, Human
uccggguuuuacacucacauca

SEQ ID NO: 113478 - RNA, 22 nt, Human
uccguauuugacuauugcaccg

SEQ ID NO: 113479 - RNA, 22 nt, Human
uccguguucuccagagauaauc

SEQ ID NO: 113480 - RNA, 22 nt, Human
uccguucucuaggagaaacuuc

SEQ ID NO: 113481 - RNA, 20 nt, Human
uccuaacgaggcccauugca

SEQ ID NO: 113482 - RNA, 23 nt, Human
uccuaacucaauucagggguguc

SEQ ID NO: 113483 - RNA, 18 nt, Human
uccuaacuuagauacucc

SEQ ID NO: 113484 - RNA, 20 nt, Human
uccuaauaaccugaagaaau

SEQ ID NO: 113485 - RNA, 22 nt, Human
uccuacagauacuaaggagauc

SEQ ID NO: 113486 - RNA, 22 nt, Human
uccuagccuggugagaaacugu

SEQ ID NO: 113487 - RNA, 22 nt, Human
uccuagcuggccucucaccagc

SEQ ID NO: 113488 - RNA, 22 nt, Human
uccuagggauucaacacugaac

SEQ ID NO: 113489 - RNA, 22 nt, Human
uccuagugcaaauuggagcaug

SEQ ID NO: 113490 - RNA, 22 nt, Human
uccuaguucugguucugucacu

SEQ ID NO: 113491 - RNA, 22 nt, Human
uccuauugguagacauuucugu

SEQ ID NO: 113492 - RNA, 22 nt, Human
uccucaaauuagcagaucauag

SEQ ID NO: 113493 - RNA, 22 nt, Human
uccucacaagcauccugucuca

SEQ ID NO: 113494 - RNA, 22 nt, Human
uccucagaagaaccccuagauu

SEQ ID NO: 113495 - RNA, 22 nt, Human
uccucagauauaaaugagggug

SEQ ID NO: 113496 - RNA, 22 nt, Human
uccucagaugcucuuggacgcc

SEQ ID NO: 113497 - RNA, 18 nt, Human
uccucagccucaccuagc

SEQ ID NO: 113498 - RNA, 22 nt, Human
uccucaggagagcuccuaugcc

SEQ ID NO: 113499 - RNA, 22 nt, Human
uccucagggggccaacccagcc

SEQ ID NO: 113500 - RNA, 22 nt, Human
uccucagggguuucagguguac

SEQ ID NO: 113501 - RNA, 22 nt, Human
uccucaguauuguggagcagau

SEQ ID NO: 113502 - RNA, 22 nt, Human
uccucagucagcuccguucuug

SEQ ID NO: 113503 - RNA, 22 nt, Human
uccucagucucucaaaugaggc

SEQ ID NO: 113504 - RNA, 22 nt, Human
uccucaucucggaaccugccac

SEQ ID NO: 113505 - RNA, 22 nt, Human
uccucauucuuggugcaucaaa

SEQ ID NO: 113506 - RNA, 22 nt, Human
uccuccaagccuuugugaagug

SEQ ID NO: 113507 - RNA, 22 nt, Human
uccuccaaggcagggggagaga

SEQ ID NO: 113508 - RNA, 22 nt, Human
uccuccacgauggcacaccugg

SEQ ID NO: 113509 - RNA, 23 nt, Human
uccuccagaggcccuccuuggcc

SEQ ID NO: 113510 - RNA, 22 nt, Human
uccuccagcaggacugaggccc

SEQ ID NO: 113511 - RNA, 22 nt, Human
uccuccagugucuggggccuug

SEQ ID NO: 113512 - RNA, 22 nt, Human
uccucccaacuuuuccaucuca

SEQ ID NO: 113513 - RNA, 22 nt, Human
uccuccccucagggcaacggau

SEQ ID NO: 113514 - RNA, 22 nt, Human
uccucccuaaauccuagacugu

SEQ ID NO: 113515 - RNA, 22 nt, Human
uccucccuaacucaugaugagu

SEQ ID NO: 113516 - RNA, 23 nt, Human
uccucccugacuucuacagcaca

SEQ ID NO: 113517 - RNA, 21 nt, Human
uccucccugagcuguggggga

SEQ ID NO: 113518 - RNA, 23 nt, Human
uccuccugagugagagugccagc

SEQ ID NO: 113519 - RNA, 21 nt, Human
uccuccuguagaggguccugg

SEQ ID NO: 113520 - RNA, 22 nt, Human
uccuccuguuucucaggccugg

SEQ ID NO: 113521 - RNA, 19 nt, Human
uccuccuuacuuccucuug

SEQ ID NO: 113522 - RNA, 22 nt, Human
uccuccuuguucuuuugccuac

SEQ ID NO: 113523 - RNA, 22 nt, Human
uccuccuuguuuuccuguuuac

SEQ ID NO: 113524 - RNA, 18 nt, Human
uccuccuuuggccuuuuc

SEQ ID NO: 113525 - RNA, 22 nt, Human
uccucggcugggccccaggcuu

SEQ ID NO: 113526 - RNA, 22 nt, Human
uccucuccaggugagccgaaau

SEQ ID NO: 113527 - RNA, 22 nt, Human
uccucuccauauuuucugauuu

SEQ ID NO: 113528 - RNA, 18 nt, Human
uccucucuuuccccaggg

SEQ ID NO: 113529 - RNA, 22 nt, Human
uccucugaaaucuagauuguga

SEQ ID NO: 113530 - RNA, 22 nt, Human
uccucugaauguacuucauaau

SEQ ID NO: 113531 - RNA, 22 nt, Human
uccucugacucacagccugggg

SEQ ID NO: 113532 - RNA, 21 nt, Human
uccucugcagugagguggccu

SEQ ID NO: 113533 - RNA, 22 nt, Human
uccucugcuccaucuuuacugu

SEQ ID NO: 113534 - RNA, 22 nt, Human
uccucugcuguucugguucuuu

SEQ ID NO: 113535 - RNA, 22 nt, Human
uccucuggggcgugguccugga

SEQ ID NO: 113536 - RNA, 22 nt, Human
uccucuggggucagggcacuac

SEQ ID NO: 113537 - RNA, 22 nt, Human
uccucuggucuucgguguggac

SEQ ID NO: 113538 - RNA, 22 nt, Human
uccucuuccuucuguccaaaug

SEQ ID NO: 113539 - RNA, 22 nt, Human
uccucuucugccuauaucugcc

SEQ ID NO: 113540 - RNA, 22 nt, Human
ucuggagaaucugucagugugg

SEQ ID NO: 113541 - RNA, 22 nt, Human
ucuggagaggaggauguggaca

SEQ ID NO: 113542 - RNA, 22 nt, Human
ucuggagagucacagugccaga

SEQ ID NO: 113543 - RNA, 22 nt, Human
ucuggagauaagacagacagau

SEQ ID NO: 113544 - RNA, 22 nt, Human
ucuggagaucauguggggugga

SEQ ID NO: 113545 - RNA, 22 nt, Human
ucuggagcuggcagggcccugg

SEQ ID NO: 113546 - RNA, 22 nt, Human
ucuggagcugggggcuuaguau

SEQ ID NO: 113547 - RNA, 22 nt, Human
ucuggagcuuccucauuuacag

SEQ ID NO: 113548 - RNA, 22 nt, Human
ucuggagcuugaagcuuugguu

SEQ ID NO: 113549 - RNA, 22 nt, Human
ucuggaguaauuacagugacug

SEQ ID NO: 113550 - RNA, 20 nt, Human
ucuggaguagagcacaggca

SEQ ID NO: 113551 - RNA, 22 nt, Human
ucuggaguaugugugaacggug

SEQ ID NO: 113552 - RNA, 22 nt, Human
ucuggagucuaaagaaccaaaa

SEQ ID NO: 113553 - RNA, 22 nt, Human
ucuggagucugagaucugagga

SEQ ID NO: 113554 - RNA, 22 nt, Human
ucuggagucuggugguuauggu

SEQ ID NO: 113555 - RNA, 22 nt, Human
ucuggagugaaugaaguagugu

SEQ ID NO: 113556 - RNA, 22 nt, Human
ucuggagugcccugcucugccc

SEQ ID NO: 113557 - RNA, 22 nt, Human
ucuggaguguguguauucagcu

SEQ ID NO: 113558 - RNA, 22 nt, Human
ucuggaguguuucuaauuacug

SEQ ID NO: 113559 - RNA, 22 nt, Human
ucuggaguuaguuauaaugguu

SEQ ID NO: 113560 - RNA, 22 nt, Human
ucuggaguuugaggacaagcuu

SEQ ID NO: 113561 - RNA, 22 nt, Human
ucuggaucucccucauccuggg

SEQ ID NO: 113562 - RNA, 22 nt, Human
ucuggaugaagacccagaggcu

SEQ ID NO: 113563 - RNA, 22 nt, Human
ucuggaugauaugugaacuuga

SEQ ID NO: 113564 - RNA, 22 nt, Human
ucuggauggucagcucuuccug

SEQ ID NO: 113565 - RNA, 22 nt, Human
ucuggcagcaagauaacaaugg

SEQ ID NO: 113566 - RNA, 22 nt, Human
ucuggcagcaagucuguuucuc

SEQ ID NO: 113567 - RNA, 21 nt, Human
ucuggcagcaguuuguugagu

SEQ ID NO: 113568 - RNA, 22 nt, Human
ucuggcagcucaguucaggucu

SEQ ID NO: 113569 - RNA, 22 nt, Human
ucuggcaggacaugcugaccau

SEQ ID NO: 113570 - RNA, 22 nt, Human
ucuggcaggcaaucggcucugg

SEQ ID NO: 113571 - RNA, 22 nt, Human
ucuggcaggccuugucaaucug

SEQ ID NO: 113572 - RNA, 22 nt, Human
ucuggcaguaauaggggagaga

SEQ ID NO: 113573 - RNA, 22 nt, Human
ucuggcagugauuucugugauc

SEQ ID NO: 113574 - RNA, 22 nt, Human
ucuggcaguuugagaaaggcua

SEQ ID NO: 113575 - RNA, 22 nt, Human
ucuggcaucacucgcaagagca

SEQ ID NO: 113576 - RNA, 22 nt, Human
ucuggccaauguugugaucaca

SEQ ID NO: 113577 - RNA, 22 nt, Human
ucuggccacccgaggccccugc

SEQ ID NO: 113578 - RNA, 22 nt, Human
ucuggccacuugcuucacacug

SEQ ID NO: 113579 - RNA, 22 nt, Human
ucuggccaggauggcaagacca

SEQ ID NO: 113580 - RNA, 22 nt, Human
ucuggcccaaguuuucggugag

SEQ ID NO: 113581 - RNA, 22 nt, Human
ucuggcccagccccugauccca

SEQ ID NO: 113582 - RNA, 22 nt, Human
ucuggcccaucuucugccacca

SEQ ID NO: 113583 - RNA, 22 nt, Human
ucuggccugggccugccggugc

SEQ ID NO: 113584 - RNA, 22 nt, Human
ucuggcucagggcucugaggga

SEQ ID NO: 113585 - RNA, 23 nt, Human
ucuggcuccauccuuggggaucc

SEQ ID NO: 113586 - RNA, 22 nt, Human
ucuggcucccagccugcucuca

SEQ ID NO: 113587 - RNA, 22 nt, Human
ucuggcuccguguccgcuccca

SEQ ID NO: 113588 - RNA, 22 nt, Human
ucuggcucucucaucacccaau

SEQ ID NO: 113589 - RNA, 22 nt, Human
ucuggcucugacacuacuguua

SEQ ID NO: 113590 - RNA, 22 nt, Human
ucuggcugaaauuagaagguuc

SEQ ID NO: 113591 - RNA, 22 nt, Human
ucuggcugacauccuguaugag

SEQ ID NO: 113592 - RNA, 19 nt, Human
ucuggcugccaaggauuga

SEQ ID NO: 113593 - RNA, 22 nt, Human
uccugcugcuaccuggcccacg

SEQ ID NO: 113594 - RNA, 22 nt, Human
uccugcuggaaguagggaauga

SEQ ID NO: 113595 - RNA, 22 nt, Human
uccugcuggaauggaaaaugaa

SEQ ID NO: 113596 - RNA, 22 nt, Human
uccugcuguuuucuggcccaca

SEQ ID NO: 113597 - RNA, 22 nt, Human
uccugcuugaaacucugccuuc

SEQ ID NO: 113598 - RNA, 22 nt, Human
uccuggacuggcucagcacccu

SEQ ID NO: 113599 - RNA, 22 nt, Human
uccuggagaacugauucgcggg

SEQ ID NO: 113600 - RNA, 22 nt, Human
uccuggagaauggacaaugcac

SEQ ID NO: 113601 - RNA, 22 nt, Human
uccuggagccacggagcuuuca

SEQ ID NO: 113602 - RNA, 22 nt, Human
uccuggagcuggugucuuuccc

SEQ ID NO: 113603 - RNA, 22 nt, Human
uccuggagcuucaguuuccuuu

SEQ ID NO: 113604 - RNA, 22 nt, Human
uccuggaggacagaggcaucuc

SEQ ID NO: 113605 - RNA, 20 nt, Human
uccuggaggcuucauccaua

SEQ ID NO: 113606 - RNA, 22 nt, Human
uccuggagggaggcggugcuac

SEQ ID NO: 113607 - RNA, 22 nt, Human
uccuggaguuuguggugauaug

SEQ ID NO: 113608 - RNA, 22 nt, Human
uccuggauaucaaacaaacauu

SEQ ID NO: 113609 - RNA, 22 nt, Human
uccuggaucagcgggggcaggc

SEQ ID NO: 113610 - RNA, 22 nt, Human
uccuggcaaagauguugguguu

SEQ ID NO: 113611 - RNA, 22 nt, Human
uccuggcacccuuggguuggag

SEQ ID NO: 113612 - RNA, 22 nt, Human
uccuggcacuuugggggcucgc

SEQ ID NO: 113613 - RNA, 18 nt, Human
uccuggcagucagagagg

SEQ ID NO: 113614 - RNA, 22 nt, Human
uccuggccaaguagauguggcg

SEQ ID NO: 113615 - RNA, 22 nt, Human
uccuggccaaguuacucucugc

SEQ ID NO: 113616 - RNA, 22 nt, Human
uccuggccacacauuaauagug

SEQ ID NO: 113617 - RNA, 18 nt, Human
uccuggccacacuaccuu

SEQ ID NO: 113618 - RNA, 16 nt, Human
uccuggccccuaugga

SEQ ID NO: 113619 - RNA, 22 nt, Human
uccuggccgcuggccccugaga

SEQ ID NO: 113620 - RNA, 22 nt, Human
uccuggccucacaguccugggu

SEQ ID NO: 113621 - RNA, 22 nt, Human
uccuggccucgcuguccaccuu

SEQ ID NO: 113622 - RNA, 17 nt, Human
uccuggccuggugugug

SEQ ID NO: 113623 - RNA, 22 nt, Human
uccuggccuuagcgaggcgguc

SEQ ID NO: 113624 - RNA, 22 nt, Human
uccuggccuuauccccaaacug

SEQ ID NO: 113625 - RNA, 20 nt, Human
uccuggccuucucgggcagu

SEQ ID NO: 113626 - RNA, 22 nt, Human
uccuggccuugcgucuugggag

SEQ ID NO: 113627 - RNA, 22 nt, Human
uccuggccuugcuccugaugcc

SEQ ID NO: 113628 - RNA, 22 nt, Human
uccuggcuccuggagaccugcu

SEQ ID NO: 113629 - RNA, 22 nt, Human
uccuggcucgauugcuaccaau

SEQ ID NO: 113630 - RNA, 22 nt, Human
uccuggcucuaaguccugagug

SEQ ID NO: 113631 - RNA, 22 nt, Human
uccuggcucuucugaguuuucu

SEQ ID NO: 113632 - RNA, 22 nt, Human
uccuggcugaguucccaagucg

SEQ ID NO: 113633 - RNA, 22 nt, Human
uccuggcugucacucggguuga

SEQ ID NO: 113634 - RNA, 22 nt, Human
uccuggcuguuagagaggcaag

SEQ ID NO: 113635 - RNA, 22 nt, Human
uccuggcuuagguuuccagaac

SEQ ID NO: 113636 - RNA, 22 nt, Human
uccugggaacucggaaagcucu

SEQ ID NO: 113637 - RNA, 22 nt, Human
uccugggaagagaccugagcau

SEQ ID NO: 113638 - RNA, 21 nt, Human
uccugggaagcacuggggugg

SEQ ID NO: 113639 - RNA, 22 nt, Human
uccugggagcccuugcuccacc

SEQ ID NO: 113640 - RNA, 22 nt, Human
uccugggagguaaaccagcauc

SEQ ID NO: 113641 - RNA, 21 nt, Human
uccugggagucugagauccug

SEQ ID NO: 113642 - RNA, 22 nt, Human
uccugggauuugcccuuuucuc

SEQ ID NO: 113643 - RNA, 22 nt, Human
uccugggcaaagaggggcagug

SEQ ID NO: 113644 - RNA, 22 nt, Human
uccugggcagaaugggauggcu

SEQ ID NO: 113645 - RNA, 22 nt, Human
uccugggccaagggcugugagg

SEQ ID NO: 113646 - RNA, 22 nt, Human
uccugggccuguacuccauccg

SEQ ID NO: 113647 - RNA, 19 nt, Human
uccugggcugggccagguc

SEQ ID NO: 113648 - RNA, 22 nt, Human
uccugggcugugugccacucug

SEQ ID NO: 113649 - RNA, 22 nt, Human
ugaggaguaugguggggucauu

SEQ ID NO: 113650 - RNA, 21 nt, Human
ugaggauaaguaaagcugaag

SEQ ID NO: 113651 - RNA, 22 nt, Human
ugaggcaaagacaaagcagcau

SEQ ID NO: 113652 - RNA, 22 nt, Human
ugaggcaaaguucaagcugaaa

SEQ ID NO: 113653 - RNA, 19 nt, Human
ugaggcaagauggcucugg

SEQ ID NO: 113654 - RNA, 22 nt, Human
ugaggcaaggcugaaugaaggc

SEQ ID NO: 113655 - RNA, 21 nt, Human
ugaggcaaguccuuuuauagc

SEQ ID NO: 113656 - RNA, 22 nt, Human
ugaggcaauuggaaauuuuaac

SEQ ID NO: 113657 - RNA, 22 nt, Human
ugaggcagaaauuccuguuuuc

SEQ ID NO: 113658 - RNA, 22 nt, Human
ugaggcagaguaagauacauga

SEQ ID NO: 113659 - RNA, 22 nt, Human
ugaggcagcaauuguauuguau

SEQ ID NO: 113660 - RNA, 20 nt, Human
ugaggcaggagaauggcaug

SEQ ID NO: 113661 - RNA, 22 nt, Human
ugaggcaggaugcuugcacagg

SEQ ID NO: 113662 - RNA, 22 nt, Human
ugaggcagggaguuuaauuguc

SEQ ID NO: 113663 - RNA, 21 nt, Human
ugaggcaggggugcuuuuguc

SEQ ID NO: 113664 - RNA, 22 nt, Human
ugaggcaguucuuacuuguauu

SEQ ID NO: 113665 - RNA, 22 nt, Human
ugaggccaagaaaagcugggug

SEQ ID NO: 113666 - RNA, 21 nt, Human
ugaggccaauagccccuggac

SEQ ID NO: 113667 - RNA, 22 nt, Human
ugaggccagacugaaaccaaca

SEQ ID NO: 113668 - RNA, 18 nt, Human
ugaggccagagugggcau

SEQ ID NO: 113669 - RNA, 22 nt, Human
ugaggccagcuucagcagugga

SEQ ID NO: 113670 - RNA, 22 nt, Human
ugaggccagggauuccaucauu

SEQ ID NO: 113671 - RNA, 22 nt, Human
ugaggcccagccgcccugagag

SEQ ID NO: 113672 - RNA, 22 nt, Human
ugaggcccuagggcaugggaga

SEQ ID NO: 113673 - RNA, 22 nt, Human
ugaggccucauaaugagauuuc

SEQ ID NO: 113674 - RNA, 22 nt, Human
ugaggccugaagccugaaguga

SEQ ID NO: 113675 - RNA, 22 nt, Human
ugaggccugcauugaacuagaa

SEQ ID NO: 113676 - RNA, 22 nt, Human
ugaggccuggacucugcaugga

SEQ ID NO: 113677 - RNA, 22 nt, Human
ugaggccuuaguaacccugcac

SEQ ID NO: 113678 - RNA, 22 nt, Human
ugaggccuuuucugucuggcua

SEQ ID NO: 113679 - RNA, 22 nt, Human
ugaggcucaaggucugguggag

SEQ ID NO: 113680 - RNA, 22 nt, Human
ugaggcucacaaaucugcauuu

SEQ ID NO: 113681 - RNA, 22 nt, Human
ugaggcucagaaauguaaguuu

SEQ ID NO: 113682 - RNA, 22 nt, Human
ugaggcucagagaacagugacu

SEQ ID NO: 113683 - RNA, 21 nt, Human
ugaggcucaucuuauguggcu

SEQ ID NO: 113684 - RNA, 22 nt, Human
ugaggcuccuuguagagagugg

SEQ ID NO: 113685 - RNA, 18 nt, Human
ugaggcugaggguagagg

SEQ ID NO: 113686 - RNA, 22 nt, Human
ugaggcuggcaaggcugguauu

SEQ ID NO: 113687 - RNA, 22 nt, Human
ugaggcuugauuugcccgagag

SEQ ID NO: 113688 - RNA, 22 nt, Human
ugaggcuuggaggcuccagugg

SEQ ID NO: 113689 - RNA, 22 nt, Human
ugaggcuugucucagauggggg

SEQ ID NO: 113690 - RNA, 22 nt, Human
ugaggcuuuauguaagggugca

SEQ ID NO: 113691 - RNA, 22 nt, Human
ugagggacugcauacccagcuu

SEQ ID NO: 113692 - RNA, 22 nt, Human
ugagggacuugcuaguucucug

SEQ ID NO: 113693 - RNA, 22 nt, Human
ugagggagcacacacugaagug

SEQ ID NO: 113694 - RNA, 22 nt, Human
ugagggauccagaggcaguggu

SEQ ID NO: 113695 - RNA, 22 nt, Human
ugagggcaaaguggugcugagg

SEQ ID NO: 113696 - RNA, 22 nt, Human
ugagggcagagcacuggggagc

SEQ ID NO: 113697 - RNA, 22 nt, Human
ugagggcuaaauuguggcaggu

SEQ ID NO: 113698 - RNA, 22 nt, Human
ugagggcuguggaaggcuaacc

SEQ ID NO: 113699 - RNA, 22 nt, Human
ugaggggagaagcagcagccug

SEQ ID NO: 113700 - RNA, 22 nt, Human
ugaggggagguuggggcacauc

SEQ ID NO: 113701 - RNA, 22 nt, Human
ugaggggauacgguacacauug

SEQ ID NO: 113702 - RNA, 22 nt, Human
ugaggggcagagagguguccag

SEQ ID NO: 113703 - RNA, 22 nt, Human
ugaggggcauguguuuacacau

SEQ ID NO: 113704 - RNA, 22 nt, Human
ugccugggggacuaaggccaaa

SEQ ID NO: 113705 - RNA, 22 nt, Human
ugccugggguuggcaaacugcu

SEQ ID NO: 113706 - RNA, 22 nt, Human
ugccugggugcccucugcuccu

SEQ ID NO: 113707 - RNA, 22 nt, Human
ugccugucagggggagugggaa

SEQ ID NO: 113708 - RNA, 22 nt, Human
ugccugucuccucugcagggug

SEQ ID NO: 113709 - RNA, 22 nt, Human
ugccugucuucaggagugucac

SEQ ID NO: 113710 - RNA, 22 nt, Human
ugccugucuuuccucccucgua

SEQ ID NO: 113711 - RNA, 17 nt, Human
ugccugugauaagcaca

SEQ ID NO: 113712 - RNA, 22 nt, Human
ugccugugggugccaccacccu

SEQ ID NO: 113713 - RNA, 22 nt, Human
ugccuguguauuuccggccugc

SEQ ID NO: 113714 - RNA, 22 nt, Human
ugccuguguggggucugccgcc

SEQ ID NO: 113715 - RNA, 22 nt, Human
ugccuguguugauuacuuuguc

SEQ ID NO: 113716 - RNA, 22 nt, Human
ugccuuaaguaagacugaacag

SEQ ID NO: 113717 - RNA, 22 nt, Human
ugccuuaauuuucuaagcugug

SEQ ID NO: 113718 - RNA, 22 nt, Human
ugccuucaaucaggauggucuc

SEQ ID NO: 113719 - RNA, 22 nt, Human
ugccuucaccaggccuucagcc

SEQ ID NO: 113720 - RNA, 22 nt, Human
ugccuuccugcuuugaguucug

SEQ ID NO: 113721 - RNA, 22 nt, Human
ugccuugacaguuguaagaccu

SEQ ID NO: 113722 - RNA, 22 nt, Human
ugccuugcagguuuuaaauaca

SEQ ID NO: 113723 - RNA, 22 nt, Human
ugccuugcgggcguuucuguug

SEQ ID NO: 113724 - RNA, 22 nt, Human
ugccuugcgguguauuucuggg

SEQ ID NO: 113725 - RNA, 22 nt, Human
ugccuugcugcuuuggaguccu

SEQ ID NO: 113726 - RNA, 20 nt, Human
ugccuuggagcagccaaggu

SEQ ID NO: 113727 - RNA, 19 nt, Human
ugccuuggcugccaggaaa

SEQ ID NO: 113728 - RNA, 22 nt, Human
ugccuugguucucuacuuggag

SEQ ID NO: 113729 - RNA, 22 nt, Human
ugccuugguuuccccaucugua

SEQ ID NO: 113730 - RNA, 22 nt, Human
ugccuuuaacuuaaagcaugac

SEQ ID NO: 113731 - RNA, 22 nt, Human
ugccuuuaggggccucucccuc

SEQ ID NO: 113732 - RNA, 20 nt, Human
ugccuuuccuguuucaucuu

SEQ ID NO: 113733 - RNA, 22 nt, Human
ugccuuuuccagcuuccagagg

SEQ ID NO: 113734 - RNA, 22 nt, Human
ugccuuuuccaguuucuagggg

SEQ ID NO: 113735 - RNA, 22 nt, Human
ugccuuuucuguagcucuggaa

SEQ ID NO: 113736 - RNA, 22 nt, Human
ugcgaauugaugucaacucagg

SEQ ID NO: 113737 - RNA, 22 nt, Human
ugcgagaguggaaaggaagccu

SEQ ID NO: 113738 - RNA, 22 nt, Human
ugcgcaugcguggcucuccggc

SEQ ID NO: 113739 - RNA, 22 nt, Human
ugcgcccagccaagucuggcac

SEQ ID NO: 113740 - RNA, 22 nt, Human
ugcgcggcucagucaucuccag

SEQ ID NO: 113741 - RNA, 22 nt, Human
ugcggagggagcagucggcugu

SEQ ID NO: 113742 - RNA, 22 nt, Human
ugcggccgggcaucguauggcg

SEQ ID NO: 113743 - RNA, 22 nt, Human
ugcguacuguuuauacaugugu

SEQ ID NO: 113744 - RNA, 22 nt, Human
ugcguaguacgaauuugugccu

SEQ ID NO: 113745 - RNA, 21 nt, Human
ugcgugugcauggccuucggg

SEQ ID NO: 113746 - RNA, 20 nt, Human
ugcguguguauuuauuuucu

SEQ ID NO: 113747 - RNA, 22 nt, Human
ugcuaaacaauguacaguguau

SEQ ID NO: 113748 - RNA, 22 nt, Human
ugcuaaauaacuuacauagugg

SEQ ID NO: 113749 - RNA, 22 nt, Human
ugcuaaauaaguggaauagaca

SEQ ID NO: 113750 - RNA, 22 nt, Human
ugcuaagcucacauggcucuag

SEQ ID NO: 113751 - RNA, 22 nt, Human
ugcuaagcugaggaagaugaga

SEQ ID NO: 113752 - RNA, 19 nt, Human
ugcuaaguccuuuagaggc

SEQ ID NO: 113753 - RNA, 22 nt, Human
ugcuacacucaaucagugcuau

SEQ ID NO: 113754 - RNA, 22 nt, Human
ugcuacaggcgauccucaacua

SEQ ID NO: 113755 - RNA, 21 nt, Human
ugcuacauugcugguuauguu

SEQ ID NO: 113756 - RNA, 21 nt, Human
ugcuaggccauauugguugcu

SEQ ID NO: 113757 - RNA, 22 nt, Human
ugcuagggauauaguggcgagu

SEQ ID NO: 113758 - RNA, 22 nt, Human
ugacagacauggaagccagagu

SEQ ID NO: 113759 - RNA, 22 nt, Human
ugacagaccacugcaacucugu

SEQ ID NO: 113760 - RNA, 19 nt, Human
ugacagagagcaggguggu

SEQ ID NO: 113761 - RNA, 23 nt, Human
ugacagagcacagugggggagau

SEQ ID NO: 113762 - RNA, 22 nt, Human
ugacagagccaagaucaguacu

SEQ ID NO: 113763 - RNA, 22 nt, Human
ugacagaggagcuggaaugauu

SEQ ID NO: 113764 - RNA, 22 nt, Human
ugacagagugacacucuugucu

SEQ ID NO: 113765 - RNA, 19 nt, Human
ugacagcaugaauuaggac

SEQ ID NO: 113766 - RNA, 22 nt, Human
ugacagcaugaccacagggucu

SEQ ID NO: 113767 - RNA, 22 nt, Human
ugacagcauuacuaauacaugu

SEQ ID NO: 113768 - RNA, 22 nt, Human
ugacagccaugauccuuacugu

SEQ ID NO: 113769 - RNA, 22 nt, Human
ugacagcugagccccaggcaag

SEQ ID NO: 113770 - RNA, 22 nt, Human
ugacagcuuggacaggucccuc

SEQ ID NO: 113771 - RNA, 22 nt, Human
ugacaggaugaugagcaggggg

SEQ ID NO: 113772 - RNA, 22 nt, Human
ugacaggauugguugcuucuga

SEQ ID NO: 113773 - RNA, 22 nt, Human
ugacaggcaggacagaggugug

SEQ ID NO: 113774 - RNA, 23 nt, Human
ugacaggcugcuucuggcugagg

SEQ ID NO: 113775 - RNA, 22 nt, Human
ugacagggagguggaauaagua

SEQ ID NO: 113776 - RNA, 22 nt, Human
ugacaggugauugugaacuaag

SEQ ID NO: 113777 - RNA, 22 nt, Human
ugacaggugcugggggcagugu

SEQ ID NO: 113778 - RNA, 22 nt, Human
ugacagguucguuagucauguu

SEQ ID NO: 113779 - RNA, 22 nt, Human
ugacagguuguguagguggcca

SEQ ID NO: 113780 - RNA, 22 nt, Human
ugacaguauugauggcaggauu

SEQ ID NO: 113781 - RNA, 22 nt, Human
ugacagugacagccaaaggcuu

SEQ ID NO: 113782 - RNA, 22 nt, Human
ugacaguguuggggguaaauuu

SEQ ID NO: 113783 - RNA, 22 nt, Human
ugacaguuuaguguaauaguua

SEQ ID NO: 113784 - RNA, 22 nt, Human
ugacaguuuauuuugcagaaug

SEQ ID NO: 113785 - RNA, 22 nt, Human
ugacauaaugcuuugaaguugc

SEQ ID NO: 113786 - RNA, 19 nt, Human
ugacauagcaagacaaaac

SEQ ID NO: 113787 - RNA, 22 nt, Human
ugacaucacguccuuucagaga

SEQ ID NO: 113788 - RNA, 22 nt, Human
ugacaucauuggccauugggga

SEQ ID NO: 113789 - RNA, 22 nt, Human
ugacaucuggcuugugcccugc

SEQ ID NO: 113790 - RNA, 22 nt, Human
ugacaugcuaagauuauguuau

SEQ ID NO: 113791 - RNA, 22 nt, Human
ugacauguauaucuuacgcuau

SEQ ID NO: 113792 - RNA, 22 nt, Human
ugacaugugucuccuuccgucu

SEQ ID NO: 113793 - RNA, 22 nt, Human
ugacauguuagggaaaugugau

SEQ ID NO: 113794 - RNA, 22 nt, Human
ugacauuuaauuaacgaaugcu

SEQ ID NO: 113795 - RNA, 21 nt, Human
ugacauuuccaauauaaagcc

SEQ ID NO: 113796 - RNA, 22 nt, Human
ugacauuucgguguaugugaug

SEQ ID NO: 113797 - RNA, 22 nt, Human
ugacauuucuuguugauauaaa

SEQ ID NO: 113798 - RNA, 22 nt, Human
ugacauuuuuaaaaccacuagu

SEQ ID NO: 113799 - RNA, 22 nt, Human
ugaccaaaaaauucccugugag

SEQ ID NO: 113800 - RNA, 22 nt, Human
ugaccaaagacuuuagauguuc

SEQ ID NO: 113801 - RNA, 22 nt, Human
ugaccacacgucuggaauugug

SEQ ID NO: 113802 - RNA, 22 nt, Human
ugaccacagacccaaugacuac

SEQ ID NO: 113803 - RNA, 22 nt, Human
ugaccaggauacugcagggaug

SEQ ID NO: 113804 - RNA, 22 nt, Human
ugaccaguuaagucauccuguc

SEQ ID NO: 113805 - RNA, 22 nt, Human
ugaccauuugaucuacauucca

SEQ ID NO: 113806 - RNA, 22 nt, Human
ugacccaucaggccacaugagg

SEQ ID NO: 113807 - RNA, 22 nt, Human
ugacccauuugcuuuuccugua

SEQ ID NO: 113808 - RNA, 19 nt, Human
ugaccccacgcuccagagc

SEQ ID NO: 113809 - RNA, 22 nt, Human
ugaccccacugugcucagaggu

SEQ ID NO: 113810 - RNA, 22 nt, Human
ugacccucuuccccaugcgcuc

SEQ ID NO: 113811 - RNA, 22 nt, Human
ugacccuggccugguggcggaa

SEQ ID NO: 113812 - RNA, 22 nt, Human
ugacccuucaaauauccucaaa

SEQ ID NO: 113813 - RNA, 22 nt, Human
ugaccguuuuggcacccaugcu

SEQ ID NO: 113814 - RNA, 22 nt, Human
ugaccuccaauaccuuucuucc

SEQ ID NO: 113815 - RNA, 22 nt, Human
ugaccucuguccugcagucugg

SEQ ID NO: 113816 - RNA, 22 nt, Human
ugaccucuugucggagcuccag

SEQ ID NO: 113817 - RNA, 18 nt, Human
ugaccugcgcuucacggu

SEQ ID NO: 113818 - RNA, 22 nt, Human
ugaccuguguuugcuguugcuc

SEQ ID NO: 113819 - RNA, 22 nt, Human
ugaccuucgagcugcggguugu

SEQ ID NO: 113820 - RNA, 19 nt, Human
ugaggggcucacagucuca

SEQ ID NO: 113821 - RNA, 22 nt, Human
ugagggggguaaucacuggguu

SEQ ID NO: 113822 - RNA, 22 nt, Human
ugagggguaaguaaaggaauug

SEQ ID NO: 113823 - RNA, 22 nt, Human
ugaggguagcuggaucacggag

SEQ ID NO: 113824 - RNA, 22 nt, Human
ugagggucuggaaucugggcuu

SEQ ID NO: 113825 - RNA, 22 nt, Human
ugagggugggcccugggcaucu

SEQ ID NO: 113826 - RNA, 22 nt, Human
ugagguaauguguacguuaauu

SEQ ID NO: 113827 - RNA, 21 nt, Human
ugagguagccagugagaugga

SEQ ID NO: 113828 - RNA, 22 nt, Human
ugagguagggaguuuguuguug

SEQ ID NO: 113829 - RNA, 22 nt, Human
ugagguauacguugguucaguc

SEQ ID NO: 113830 - RNA, 20 nt, Human
ugagguaucaauucaaggca

SEQ ID NO: 113831 - RNA, 22 nt, Human
ugagguauccagugaagcagcc

SEQ ID NO: 113832 - RNA, 22 nt, Human
ugagguaugugaugucuuuuag

SEQ ID NO: 113833 - RNA, 22 nt, Human
ugaggucaagcccagagcagca

SEQ ID NO: 113834 - RNA, 22 nt, Human
ugaggucacagcuggggaugga

SEQ ID NO: 113835 - RNA, 22 nt, Human
ugaggucaccuggaggcagccu

SEQ ID NO: 113836 - RNA, 22 nt, Human
ugaggucagcccuuccuaugau

SEQ ID NO: 113837 - RNA, 22 nt, Human
ugagguccuagagagugugugg

SEQ ID NO: 113838 - RNA, 22 nt, Human
ugaggugaagaguggagcucag

SEQ ID NO: 113839 - RNA, 22 nt, Human
ugagguggcacacacuuccugc

SEQ ID NO: 113840 - RNA, 22 nt, Human
ugaggugggcuuguggauuugc

SEQ ID NO: 113841 - RNA, 22 nt, Human
ugagguggguggcuucuguuau

SEQ ID NO: 113842 - RNA, 22 nt, Human
ugagguguguccccagggaggu

SEQ ID NO: 113843 - RNA, 22 nt, Human
ugagguuagcugggauuucaug

SEQ ID NO: 113844 - RNA, 22 nt, Human
ugaguaaauacaaaaucaccuc

SEQ ID NO: 113845 - RNA, 17 nt, Human
ugaguagggaagaggag

SEQ ID NO: 113846 - RNA, 22 nt, Human
ugaguaggugguuaagcaugga

SEQ ID NO: 113847 - RNA, 22 nt, Human
ugaguauucugaauuucaaacu

SEQ ID NO: 113848 - RNA, 22 nt, Human
ugaguauuuuaaguucucaauc

SEQ ID NO: 113849 - RNA, 22 nt, Human
ugagucacuggcaaggcuuuga

SEQ ID NO: 113850 - RNA, 22 nt, Human
ugagucagccagagcugccaug

SEQ ID NO: 113851 - RNA, 22 nt, Human
ugagucagucugcccuggcuuc

SEQ ID NO: 113852 - RNA, 22 nt, Human
ugagucagugacaugaacuugu

SEQ ID NO: 113853 - RNA, 22 nt, Human
ugaguccacuuuaaaaugucag

SEQ ID NO: 113854 - RNA, 22 nt, Human
ugaguccaucgcagggaagugg

SEQ ID NO: 113855 - RNA, 22 nt, Human
ugaguccuaaagcugugcccuu

SEQ ID NO: 113856 - RNA, 22 nt, Human
ugaguccugucuuugucacuua

SEQ ID NO: 113857 - RNA, 23 nt, Human
ugagucuacucaccacaacuggg

SEQ ID NO: 113858 - RNA, 22 nt, Human
ugagucucauuaauuaugaaug

SEQ ID NO: 113859 - RNA, 22 nt, Human
ugagucucccaaguaguuggaa

SEQ ID NO: 113860 - RNA, 22 nt, Human
ugagucucccagcguuaaaccu

SEQ ID NO: 113861 - RNA, 21 nt, Human
ugagucucccuuagcccacgc

SEQ ID NO: 113862 - RNA, 22 nt, Human
ugagucugauuuuucuagcauu

SEQ ID NO: 113863 - RNA, 22 nt, Human
ugagucugggcauguucacuuu

SEQ ID NO: 113864 - RNA, 22 nt, Human
ugagucuucugccuaaagaagu

SEQ ID NO: 113865 - RNA, 22 nt, Human
ugagucuuuccaaagccgucau

SEQ ID NO: 113866 - RNA, 21 nt, Human
ugagucuuuuaauaggugcac

SEQ ID NO: 113867 - RNA, 22 nt, Human
uugauucaucuucuaauaccca

SEQ ID NO: 113868 - RNA, 22 nt, Human
uugauucuagaaucuucccucu

SEQ ID NO: 113869 - RNA, 22 nt, Human
uugauucugcugaucucggacg

SEQ ID NO: 113870 - RNA, 22 nt, Human
uugauucuucugaauuugcaga

SEQ ID NO: 113871 - RNA, 22 nt, Human
uugauugaauuuugaaaaucua

SEQ ID NO: 113872 - RNA, 21 nt, Human
uugauuuagcagaucuagcug

SEQ ID NO: 113873 - RNA, 22 nt, Human
uugauuucuauugaguuccugu

SEQ ID NO: 113874 - RNA, 22 nt, Human
uugauuucuuacucuuccaagg

SEQ ID NO: 113875 - RNA, 22 nt, Human
uugauuugcagaagguguagag

SEQ ID NO: 113876 - RNA, 22 nt, Human
uugauuuguauugcaggccccu

SEQ ID NO: 113877 - RNA, 22 nt, Human
uugcaaaaaccacaauuacuuu

SEQ ID NO: 113878 - RNA, 22 nt, Human
uugcaaaagcaauugcaguuuu

SEQ ID NO: 113879 - RNA, 22 nt, Human
uugcaaaagccgaggcacucca

SEQ ID NO: 113880 - RNA, 23 nt, Human
uugcaaaaugcaauugaguuaga

SEQ ID NO: 113881 - RNA, 22 nt, Human
uugcaaagaauuuuacauucua

SEQ ID NO: 113882 - RNA, 20 nt, Human
uugcaaagugaauagcaauu

SEQ ID NO: 113883 - RNA, 20 nt, Human
uugcaaauaucuauugauug

SEQ ID NO: 113884 - RNA, 22 nt, Human
uugcaaauauguucuccuauuc

SEQ ID NO: 113885 - RNA, 22 nt, Human
uugcaaaucacaagagcagagc

SEQ ID NO: 113886 - RNA, 22 nt, Human
uugcaaauggaggccuggcagc

SEQ ID NO: 113887 - RNA, 22 nt, Human
uugcaaaugguaccaagggucu

SEQ ID NO: 113888 - RNA, 22 nt, Human
uugcaaauguuauacugccagu

SEQ ID NO: 113889 - RNA, 22 nt, Human
uugcaaauucauggaucugaau

SEQ ID NO: 113890 - RNA, 18 nt, Human
uugcaaauucuucccugu

SEQ ID NO: 113891 - RNA, 23 nt, Human
uugcaaauuucaguuaguucaug

SEQ ID NO: 113892 - RNA, 21 nt, Human
uugcaacaaccuauauauuuu

SEQ ID NO: 113893 - RNA, 22 nt, Human
uugcaacauuguaaguuuauau

SEQ ID NO: 113894 - RNA, 22 nt, Human
uugcaacucuugaaaagcauug

SEQ ID NO: 113895 - RNA, 20 nt, Human
uugcaacuguaagaagcagg

SEQ ID NO: 113896 - RNA, 22 nt, Human
uugcaacuucucccaucacucu

SEQ ID NO: 113897 - RNA, 22 nt, Human
uugcaagagagucugaaaaaug

SEQ ID NO: 113898 - RNA, 22 nt, Human
uugcaaggagccacucugccug

SEQ ID NO: 113899 - RNA, 22 nt, Human
uugcaaggucaucaugcauugg

SEQ ID NO: 113900 - RNA, 22 nt, Human
uugcaaucagcaguguuuucac

SEQ ID NO: 113901 - RNA, 22 nt, Human
uugcaaucugcaaagcugugga

SEQ ID NO: 113902 - RNA, 22 nt, Human
uugcaauuaguuacaaaagugg

SEQ ID NO: 113903 - RNA, 22 nt, Human
uugcacaaaaaauuguugaaua

SEQ ID NO: 113904 - RNA, 22 nt, Human
uugcacagggcuggaauguccu

SEQ ID NO: 113905 - RNA, 23 nt, Human
uugcacauuggagcuggucuucu

SEQ ID NO: 113906 - RNA, 22 nt, Human
uugcacccaguaguuuaaauuc

SEQ ID NO: 113907 - RNA, 22 nt, Human
uugcagaauacuuauucuguau

SEQ ID NO: 113908 - RNA, 22 nt, Human
uugcagacauuccagagcuuuu

SEQ ID NO: 113909 - RNA, 22 nt, Human
uugcagacccuuacugcuagag

SEQ ID NO: 113910 - RNA, 22 nt, Human
uugcagagaucagcagguuuga

SEQ ID NO: 113911 - RNA, 22 nt, Human
uugcagagcaguaggaauauag

SEQ ID NO: 113912 - RNA, 22 nt, Human
uugcagcaaggucaugaaaugu

SEQ ID NO: 113913 - RNA, 22 nt, Human
uugcagcagcucuuugaauguu

SEQ ID NO: 113914 - RNA, 22 nt, Human
uugcagcuagaagauucacugu

SEQ ID NO: 113915 - RNA, 22 nt, Human
uugcagcugcuguuccucaugg

SEQ ID NO: 113916 - RNA, 22 nt, Human
uugcagcuguuacugauagaua

SEQ ID NO: 113917 - RNA, 22 nt, Human
uugcagcuucgagucuaucugu

SEQ ID NO: 113918 - RNA, 22 nt, Human
uugcagcuucuaacagcuucag

SEQ ID NO: 113919 - RNA, 22 nt, Human
uugcaggauuuuagagaugaca

SEQ ID NO: 113920 - RNA, 22 nt, Human
uugcagggaaacaguuuaggaa

SEQ ID NO: 113921 - RNA, 22 nt, Human
uugcagggauuaccuuauuuuu

SEQ ID NO: 113922 - RNA, 22 nt, Human
uugcagggcuuggggauuacag

SEQ ID NO: 113923 - RNA, 22 nt, Human
uugcaggguacauucuuagaau

SEQ ID NO: 113924 - RNA, 22 nt, Human
uugcaggguugaccaauaggcu

SEQ ID NO: 113925 - RNA, 22 nt, Human
uugcaguugcuguauuuaagga

SEQ ID NO: 113926 - RNA, 22 nt, Human
uugcaguuuauguuccugcagu

SEQ ID NO: 113927 - RNA, 22 nt, Human
uugcauaaaagaguauaucuua

SEQ ID NO: 113928 - RNA, 22 nt, Human
uugcauaaagauuuuauugcau

SEQ ID NO: 113929 - RNA, 22 nt, Human
uugcauagugcugagguucggg

SEQ ID NO: 113930 - RNA, 22 nt, Human
uugcaucacaguaucucuguaa

SEQ ID NO: 113931 - RNA, 22 nt, Human
uugcaucaguccucaauaaaau

SEQ ID NO: 113932 - RNA, 22 nt, Human
uugcaucauuuccuggccgugu

SEQ ID NO: 113933 - RNA, 22 nt, Human
ugaugagggcaguucuuguugc

SEQ ID NO: 113934 - RNA, 22 nt, Human
ugaugagggggaacagagauuu

SEQ ID NO: 113935 - RNA, 22 nt, Human
ugaugaguaaauaagguugagu

SEQ ID NO: 113936 - RNA, 22 nt, Human
ugaugauugggagacauuuggg

SEQ ID NO: 113937 - RNA, 22 nt, Human
ugaugauuugaaaccaguuucu

SEQ ID NO: 113938 - RNA, 22 nt, Human
ugaugcaauagagagauagaua

SEQ ID NO: 113939 - RNA, 22 nt, Human
ugaugcacaaagucagcauccu

SEQ ID NO: 113940 - RNA, 22 nt, Human
ugaugcaguguccucccaugca

SEQ ID NO: 113941 - RNA, 20 nt, Human
ugaugcuggucugaauugca

SEQ ID NO: 113942 - RNA, 22 nt, Human
ugauggaaaauaaaucuuauuc

SEQ ID NO: 113943 - RNA, 22 nt, Human
ugauggaaauauugacaccaca

SEQ ID NO: 113944 - RNA, 22 nt, Human
ugauggaaauuugggaagcuuu

SEQ ID NO: 113945 - RNA, 22 nt, Human
ugauggaagguuucucggugau

SEQ ID NO: 113946 - RNA, 22 nt, Human
ugauggcucccaugggcauaug

SEQ ID NO: 113947 - RNA, 22 nt, Human
ugauggcuccuucauuaugggu

SEQ ID NO: 113948 - RNA, 22 nt, Human
ugaugggaggugcugcaggacc

SEQ ID NO: 113949 - RNA, 22 nt, Human
ugauggggaauuaauuaauggg

SEQ ID NO: 113950 - RNA, 22 nt, Human
ugauggucaacaauuuugagug

SEQ ID NO: 113951 - RNA, 22 nt, Human
ugauggugggucugaucucaua

SEQ ID NO: 113952 - RNA, 20 nt, Human
ugaugguucuuuccggguug

SEQ ID NO: 113953 - RNA, 22 nt, Human
ugaugucucucuauacucuaac

SEQ ID NO: 113954 - RNA, 22 nt, Human
ugaugucugccaggguccuggg

SEQ ID NO: 113955 - RNA, 22 nt, Human
ugaugugauagaaagguagugg

SEQ ID NO: 113956 - RNA, 22 nt, Human
ugaugugugauucauucucaaa

SEQ ID NO: 113957 - RNA, 22 nt, Human
ugauuaaauuaauuaagaugag

SEQ ID NO: 113958 - RNA, 22 nt, Human
ugauuaaguugcauuuuaauau

SEQ ID NO: 113959 - RNA, 22 nt, Human
ugauuacaacagagucauccau

SEQ ID NO: 113960 - RNA, 23 nt, Human
ugauuacaagggccaaagaaagg

SEQ ID NO: 113961 - RNA, 22 nt, Human
ugauuacacuauuugggaauag

SEQ ID NO: 113962 - RNA, 23 nt, Human
ugauuacaggaaguucaaguguu

SEQ ID NO: 113963 - RNA, 22 nt, Human
ugauuacagucugacagauguu

SEQ ID NO: 113964 - RNA, 22 nt, Human
ugauuagcugaagaauaugcug

SEQ ID NO: 113965 - RNA, 22 nt, Human
ugauuauauuaacuauguuccu

SEQ ID NO: 113966 - RNA, 22 nt, Human
ugauucaagagaguugggguau

SEQ ID NO: 113967 - RNA, 22 nt, Human
ugauucaauaggaauugaguag

SEQ ID NO: 113968 - RNA, 22 nt, Human
ugauucagaccugucagacuuc

SEQ ID NO: 113969 - RNA, 22 nt, Human
ugauucagucucuucaggagaa

SEQ ID NO: 113970 - RNA, 22 nt, Human
ugauuccuaggcacucuucucc

SEQ ID NO: 113971 - RNA, 22 nt, Human
ugauucugaggacccugugacg

SEQ ID NO: 113972 - RNA, 23 nt, Human
ugauucugcuuugagaaucaugg

SEQ ID NO: 113973 - RNA, 20 nt, Human
ugauucuggucuacgcuuua

SEQ ID NO: 113974 - RNA, 22 nt, Human
ugauucuguaagucauauuguu

SEQ ID NO: 113975 - RNA, 22 nt, Human
ugauucugugaauuaguugggu

SEQ ID NO: 113976 - RNA, 22 nt, Human
uugguucagaugggaucugcga

SEQ ID NO: 113977 - RNA, 22 nt, Human
uugguucaguaggcaugccugg

SEQ ID NO: 113978 - RNA, 22 nt, Human
uugguucauuauugaaugugcu

SEQ ID NO: 113979 - RNA, 22 nt, Human
uugguuuacuaggauucaaauu

SEQ ID NO: 113980 - RNA, 22 nt, Human
uugguuuauuucuuccuaugag

SEQ ID NO: 113981 - RNA, 22 nt, Human
uugguuuuaucuuaagauucuu

SEQ ID NO: 113982 - RNA, 22 nt, Human
uugguuuucaggggcaggauaa

SEQ ID NO: 113983 - RNA, 22 nt, Human
uugguuuucauagcuccacucu

SEQ ID NO: 113984 - RNA, 22 nt, Human
uugguuuucuauccucugcaau

SEQ ID NO: 113985 - RNA, 22 nt, Human
uugguuuugggauguacaaagg

SEQ ID NO: 113986 - RNA, 22 nt, Human
uuguaaagcugauuagaaagcc

SEQ ID NO: 113987 - RNA, 22 nt, Human
uuguaaaguucuuaggaagcuc

SEQ ID NO: 113988 - RNA, 22 nt, Human
uuguaaauaguaguaagaugcc

SEQ ID NO: 113989 - RNA, 21 nt, Human
uuguaaauggcuuuuuccuuc

SEQ ID NO: 113990 - RNA, 22 nt, Human
uuguaacaaucugucauaaaug

SEQ ID NO: 113991 - RNA, 22 nt, Human
uuguaacagguacuaaauaacu

SEQ ID NO: 113992 - RNA, 22 nt, Human
uuguaacaguagcugucagcuc

SEQ ID NO: 113993 - RNA, 22 nt, Human
uuguaacaucaccaucaaaauc

SEQ ID NO: 113994 - RNA, 22 nt, Human
uuguaacucugaauacauccua

SEQ ID NO: 113995 - RNA, 22 nt, Human
uuguaacuuugcauacuccugu

SEQ ID NO: 113996 - RNA, 22 nt, Human
uuguaagauggauaggaacagc

SEQ ID NO: 113997 - RNA, 22 nt, Human
uuguacaaaggauuuggaagag

SEQ ID NO: 113998 - RNA, 22 nt, Human
uuguacaaauaggaaccucuga

SEQ ID NO: 113999 - RNA, 22 nt, Human
uuguacagaaaaaauucuuggu

SEQ ID NO: 114000 - RNA, 22 nt, Human
uuguacagacccugaaaagcuc

SEQ ID NO: 114001 - RNA, 22 nt, Human
uuguacagauuuuccucggucu

SEQ ID NO: 114002 - RNA, 23 nt, Human
uuguacagcccagauuccucuuc

SEQ ID NO: 114003 - RNA, 22 nt, Human
uuguacuagaaaggaugucaaa

SEQ ID NO: 114004 - RNA, 22 nt, Human
uuguacuuuugucagguggaca

SEQ ID NO: 114005 - RNA, 22 nt, Human
uuguagaaaauucucuuggaua

SEQ ID NO: 114006 - RNA, 22 nt, Human
uuguagacaucuguaucauuuu

SEQ ID NO: 114007 - RNA, 22 nt, Human
uuguagauggcuuauuucugug

SEQ ID NO: 114008 - RNA, 22 nt, Human
uuguagauuggagaguguguga

SEQ ID NO: 114009 - RNA, 22 nt, Human
uuguagucuaggauagauuuuu

SEQ ID NO: 114010 - RNA, 22 nt, Human
uuguauaagaaguuggcagaua

SEQ ID NO: 114011 - RNA, 22 nt, Human
uuguauacauuauccuguuuca

SEQ ID NO: 114012 - RNA, 22 nt, Human
uuguaucagugccuauaaaaug

SEQ ID NO: 114013 - RNA, 20 nt, Human
uuguaucagugucucccaaa

SEQ ID NO: 114014 - RNA, 23 nt, Human
uuguaucucuggaaauucuucaa

SEQ ID NO: 114015 - RNA, 22 nt, Human
uuguaugaauguauccuaauuu

SEQ ID NO: 114016 - RNA, 22 nt, Human
uuguaugaguaugguguauagg

SEQ ID NO: 114017 - RNA, 22 nt, Human
uuguauuaaaauguguuucugu

SEQ ID NO: 114018 - RNA, 20 nt, Human
uuguauuccuugaaucaggu

SEQ ID NO: 114019 - RNA, 22 nt, Human
uuguauuuauauugaauagcuu

SEQ ID NO: 114020 - RNA, 22 nt, Human
uuguauuucgaugcacguguag

SEQ ID NO: 114021 - RNA, 22 nt, Human
uuguauuucuccacuuucuguu

SEQ ID NO: 114022 - RNA, 23 nt, Human
uuguauuuuuaguagagacaggg

SEQ ID NO: 114023 - RNA, 22 nt, Human
uuguauuuuuuccuggcggugg

SEQ ID NO: 114024 - RNA, 22 nt, Human
uugucaaggcuuuuaauauucu

SEQ ID NO: 114025 - RNA, 22 nt, Human
uugucacauguaguucauucuc

SEQ ID NO: 114026 - RNA, 22 nt, Human
uugucaccuauacugagcuuaa

SEQ ID NO: 114027 - RNA, 22 nt, Human
uuguccaucuguauuucccaug

SEQ ID NO: 114028 - RNA, 22 nt, Human
uuguccauggacagcaccacag

SEQ ID NO: 114029 - RNA, 22 nt, Human
uuguccuaauuuauggccugga

SEQ ID NO: 114030 - RNA, 22 nt, Human
uuguccugaggacuguuaucag

SEQ ID NO: 114031 - RNA, 22 nt, Human
uuguccugauuuugcaacuucu

SEQ ID NO: 114032 - RNA, 22 nt, Human
uuguccugcagguggcugggag

SEQ ID NO: 114033 - RNA, 22 nt, Human
uuguccuggagguuaauagagu

SEQ ID NO: 114034 - RNA, 22 nt, Human
uuguccugugauuucagggccu

SEQ ID NO: 114035 - RNA, 22 nt, Human
uugucgggcuuacgcagggcca

SEQ ID NO: 114036 - RNA, 22 nt, Human
uugucuacuaagaaagacaauu

SEQ ID NO: 114037 - RNA, 22 nt, Human
uugucucugccaugcuugaggg

SEQ ID NO: 114038 - RNA, 22 nt, Human
uugucucuggaaggaaaaagca

SEQ ID NO: 114039 - RNA, 22 nt, Human
uugucugaaucuggagcucucu

SEQ ID NO: 114040 - RNA, 22 nt, Human
uugucugaauucuucuaggcag

SEQ ID NO: 114041 - RNA, 22 nt, Human
uugucugacuucuuuaguuacu

SEQ ID NO: 114042 - RNA, 22 nt, Human
uugucugugaaauggaaauagu

SEQ ID NO: 114043 - RNA, 23 nt, Human
uugucugugcuuuuccaguugcu

SEQ ID NO: 114044 - RNA, 22 nt, Human
uugucuuucccagcuucuagag

SEQ ID NO: 114045 - RNA, 22 nt, Human
uugugaaaucguguuuggaagc

SEQ ID NO: 114046 - RNA, 22 nt, Human
uugugaauagugccgcuauaaa

SEQ ID NO: 114047 - RNA, 22 nt, Human
uugugaauggugccgcaauaaa

SEQ ID NO: 114048 - RNA, 22 nt, Human
uugugagagaaaauguguauau

SEQ ID NO: 114049 - RNA, 22 nt, Human
uugugagcaggcugcacaaacc

SEQ ID NO: 114050 - RNA, 22 nt, Human
uugugagcaugugcagccucug

SEQ ID NO: 114051 - RNA, 19 nt, Human
uugugagcugaagaacagg

SEQ ID NO: 114052 - RNA, 22 nt, Human
uugugcaaggucuggacuauag

SEQ ID NO: 114053 - RNA, 22 nt, Human
uugugcaaugguguuuagguuu

SEQ ID NO: 114054 - RNA, 22 nt, Human
uugugcagagaaaucuuucuug

SEQ ID NO: 114055 - RNA, 22 nt, Human
uugugcagaguugccuuuauuu

SEQ ID NO: 114056 - RNA, 22 nt, Human
uugugccuggcuuguauucaca

SEQ ID NO: 114057 - RNA, 22 nt, Human
uugugcuaagugcuaugaaggc

SEQ ID NO: 114058 - RNA, 22 nt, Human
uugugcucccucccgucuggcc

SEQ ID NO: 114059 - RNA, 22 nt, Human
uugugcuccuaugagaaucuaa

SEQ ID NO: 114060 - RNA, 22 nt, Human
uugugcugagcuucuagcugug

SEQ ID NO: 114061 - RNA, 22 nt, Human
uuguggaagcccuaugagagac

SEQ ID NO: 114062 - RNA, 22 nt, Human
uuguggauucuauuucccagaa

SEQ ID NO: 114063 - RNA, 22 nt, Human
uuguggcaugugagaacuagaa

SEQ ID NO: 114064 - RNA, 22 nt, Human
ugauggaaauauguaaucuggu

SEQ ID NO: 114065 - RNA, 23 nt, Human
ugauggaaaugaucugggucugu

SEQ ID NO: 114066 - RNA, 22 nt, Human
ugauggaauauaccuucgggag

SEQ ID NO: 114067 - RNA, 22 nt, Human
ugauggaauggaggacaugugg

SEQ ID NO: 114068 - RNA, 22 nt, Human
ugauggaggacccagcguggga

SEQ ID NO: 114069 - RNA, 18 nt, Human
ugauggaggagggcuggu

SEQ ID NO: 114070 - RNA, 22 nt, Human
ugauggccagucgcacuggagg

SEQ ID NO: 114071 - RNA, 22 nt, Human
ugauggcuaucccuggaagggc

SEQ ID NO: 114072 - RNA, 22 nt, Human
ugauggcuuaguggcagggcga

SEQ ID NO: 114073 - RNA, 23 nt, Human
ugaugggaaggaacgacuaccac

SEQ ID NO: 114074 - RNA, 22 nt, Human
ugauggucaggaugcauggaga

SEQ ID NO: 114075 - RNA, 22 nt, Human
ugaugugugggcaugcagacag

SEQ ID NO: 114076 - RNA, 22 nt, Human
ugauguucaacaaguacauauu

SEQ ID NO: 114077 - RNA, 22 nt, Human
ugauguucuguauaucauauag

SEQ ID NO: 114078 - RNA, 22 nt, Human
ugauguuuaauacuaugcuuuu

SEQ ID NO: 114079 - RNA, 22 nt, Human
ugauuaaagguggaaggcaggu

SEQ ID NO: 114080 - RNA, 22 nt, Human
ugauuacaguauuugagaucca

SEQ ID NO: 114081 - RNA, 22 nt, Human
ugauuagcuuugaaugugcugc

SEQ ID NO: 114082 - RNA, 22 nt, Human
ugauucaacuuucauaacaaaa

SEQ ID NO: 114083 - RNA, 22 nt, Human
ugauucaagcuacuguuacugg

SEQ ID NO: 114084 - RNA, 22 nt, Human
ugauucacagacuucacaaggc

SEQ ID NO: 114085 - RNA, 22 nt, Human
ugcagggcacggugcgcguggg

SEQ ID NO: 114086 - RNA, 22 nt, Human
ugcagggccagacuggguugga

SEQ ID NO: 114087 - RNA, 22 nt, Human
ugcagggccuugggucuuucuu

SEQ ID NO: 114088 - RNA, 22 nt, Human
ugcagggcuccuggcuccaauc

SEQ ID NO: 114089 - RNA, 20 nt, Human
ugcagggcucugcuucucuc

SEQ ID NO: 114090 - RNA, 20 nt, Human
ugcagggcugccucccagcu

SEQ ID NO: 114091 - RNA, 22 nt, Human
ugcagggcuuccucuuggaguu

SEQ ID NO: 114092 - RNA, 22 nt, Human
ugcaggguagacaggugagguc

SEQ ID NO: 114093 - RNA, 22 nt, Human
ugcagggucucugcaaaugagg

SEQ ID NO: 114094 - RNA, 23 nt, Human
ugcaggguguuccugccuuugcu

SEQ ID NO: 114095 - RNA, 22 nt, Human
ugcagguaaauuuguggaggau

SEQ ID NO: 114096 - RNA, 22 nt, Human
ugcaggucuccauuggcagacu

SEQ ID NO: 114097 - RNA, 22 nt, Human
ugcaggugacaccacucuuccu

SEQ ID NO: 114098 - RNA, 23 nt, Human
ugcaggugauuaauccaguuuca

SEQ ID NO: 114099 - RNA, 22 nt, Human
ugcagguggauucaauguggga

SEQ ID NO: 114100 - RNA, 22 nt, Human
ugcagguggcagcggggcacca

SEQ ID NO: 114101 - RNA, 22 nt, Human
ugcaggugguccauuugggaac

SEQ ID NO: 114102 - RNA, 22 nt, Human
ugcagguguaaauuuucaagag

SEQ ID NO: 114103 - RNA, 22 nt, Human
ugcagguguagaguugggcucc

SEQ ID NO: 114104 - RNA, 22 nt, Human
ugcaggugucuccagggcaggu

SEQ ID NO: 114105 - RNA, 22 nt, Human
ugcaggugucucugucuagcgu

SEQ ID NO: 114106 - RNA, 22 nt, Human
ugcaggugugguuccucagcca

SEQ ID NO: 114107 - RNA, 20 nt, Human
ugcagguguguccaagcacu

SEQ ID NO: 114108 - RNA, 22 nt, Human
ugcagucccuggcccacuuuaa

SEQ ID NO: 114109 - RNA, 22 nt, Human
ugcagucuccaccuccugggug

SEQ ID NO: 114110 - RNA, 22 nt, Human
ugcagucucuaguuucugaaug

SEQ ID NO: 114111 - RNA, 22 nt, Human
ugcagucuggauguccucagau

SEQ ID NO: 114112 - RNA, 22 nt, Human
ugcagugagaagcaguuaugau

SEQ ID NO: 114113 - RNA, 22 nt, Human
ugcagugauuuguacaauuaga

SEQ ID NO: 114114 - RNA, 22 nt, Human
ugcaguggcgccaucucagcuc

SEQ ID NO: 114115 - RNA, 22 nt, Human
ugcagugguguccagguguacu

SEQ ID NO: 114116 - RNA, 22 nt, Human
ugcagugguugagagcccagac

SEQ ID NO: 114117 - RNA, 20 nt, Human
ugcaguguggaagacugaga

SEQ ID NO: 114118 - RNA, 22 nt, Human
ugcaguuagccuaggauugagc

SEQ ID NO: 114119 - RNA, 22 nt, Human
ugcauaacuagaguaauuacag

SEQ ID NO: 114120 - RNA, 22 nt, Human
ugcauacacaagcauacaugua

SEQ ID NO: 114121 - RNA, 22 nt, Human
ugcauacacacaucaaauguuu

SEQ ID NO: 114122 - RNA, 22 nt, Human
ugcauacauaaagugcuaucau

SEQ ID NO: 114123 - RNA, 19 nt, Human
ugcauacauguuaacaugu

SEQ ID NO: 114124 - RNA, 22 nt, Human
ugcauacugaacagcaugcuaa

SEQ ID NO: 114125 - RNA, 22 nt, Human
ugcauagaggauccaguguggu

SEQ ID NO: 114126 - RNA, 22 nt, Human
ugcauagggaaccucaugcauu

SEQ ID NO: 114127 - RNA, 22 nt, Human
ugcauaguucuccuuccuccuc

SEQ ID NO: 114128 - RNA, 22 nt, Human
ugcauaucuucaaugcuguugc

SEQ ID NO: 114129 - RNA, 22 nt, Human
ugcauauuauguguaucugucu

SEQ ID NO: 114130 - RNA, 21 nt, Human
ugcauauucuucugguggcug

SEQ ID NO: 114131 - RNA, 22 nt, Human
ugcauauuuguaugauguuuag

SEQ ID NO: 114132 - RNA, 22 nt, Human
ugcauauuuuauaaagauggaa

SEQ ID NO: 114133 - RNA, 22 nt, Human
ugcaucacuuagcugcacaacu

SEQ ID NO: 114134 - RNA, 22 nt, Human
ugcaucagugacugaauaugag

SEQ ID NO: 114135 - RNA, 22 nt, Human
ugcaucauauaaugucuaugga

SEQ ID NO: 114136 - RNA, 22 nt, Human
ugcaucaugcggaacuggcuuu

SEQ ID NO: 114137 - RNA, 22 nt, Human
ugcauccuagggaaggcacuga

SEQ ID NO: 114138 - RNA, 23 nt, Human
ugcauccucauuuuucacacgag

SEQ ID NO: 114139 - RNA, 22 nt, Human
ugcaucuguaguggaaaccuua

SEQ ID NO: 114140 - RNA, 22 nt, Human
ugcaucuguucauucguuccca

SEQ ID NO: 114141 - RNA, 19 nt, Human
ugcaucuugcaugggugag

SEQ ID NO: 114142 - RNA, 22 nt, Human
ugcaucuuuagucuuaugucug

SEQ ID NO: 114143 - RNA, 22 nt, Human
ugcaucuuucugcauauguaaa

SEQ ID NO: 114144 - RNA, 22 nt, Human
ugcaucuuuuuccaaguuuauu

SEQ ID NO: 114145 - RNA, 22 nt, Human
ugcaugauagagaugguauuag

SEQ ID NO: 114146 - RNA, 22 nt, Human
ugcaugaugguuuagauggggu

SEQ ID NO: 114147 - RNA, 22 nt, Human
ugcaugcaaagugucugcuuug

SEQ ID NO: 114148 - RNA, 22 nt, Human
ugcaugcaaugugaagaaagcu

SEQ ID NO: 114149 - RNA, 22 nt, Human
ugcaugcagcuggucgggcgcc

SEQ ID NO: 114150 - RNA, 22 nt, Human
ugcaugcaugugagcaugcaua

SEQ ID NO: 114151 - RNA, 22 nt, Human
ugcaugcauguuuuuacccaca

SEQ ID NO: 114152 - RNA, 17 nt, Human
ugcaugcgucugugaua

SEQ ID NO: 114153 - RNA, 22 nt, Human
ugcaugcguuaguuggcguguu

SEQ ID NO: 114154 - RNA, 22 nt, Human
ugcaugcucaaguuaguuguga

SEQ ID NO: 114155 - RNA, 22 nt, Human
ugcaugcugcacacaugcguag

SEQ ID NO: 114156 - RNA, 22 nt, Human
ugcauggaggauaauaauugag

SEQ ID NO: 114157 - RNA, 22 nt, Human
ugcauggaguaauugaugcuug

SEQ ID NO: 114158 - RNA, 20 nt, Human
ugcauggcgcacaucugugg

SEQ ID NO: 114159 - RNA, 22 nt, Human
ugcauguggaccccuggugccu

SEQ ID NO: 114160 - RNA, 22 nt, Human
ugcauguggaucauauguccua

SEQ ID NO: 114161 - RNA, 22 nt, Human
ugcauguguguguauuuauaaa

SEQ ID NO: 114162 - RNA, 22 nt, Human
ugcauguguguuaagaugcuuu

SEQ ID NO: 114163 - RNA, 22 nt, Human
ugcauguuauagaauuuuaacu

SEQ ID NO: 114164 - RNA, 22 nt, Human
ugcauguuauuguggcaagaau

SEQ ID NO: 114165 - RNA, 22 nt, Human
ugcauguuuguagguucuucua

SEQ ID NO: 114166 - RNA, 22 nt, Human
ugcauguuugugucugagaacu

SEQ ID NO: 114167 - RNA, 20 nt, Human
ugcauuaaguggcauugagc

SEQ ID NO: 114168 - RNA, 22 nt, Human
ugcauuauacuuuuagaaauuu

SEQ ID NO: 114169 - RNA, 22 nt, Human
ugcauuaucaucuggaagcuug

SEQ ID NO: 114170 - RNA, 23 nt, Human
ugcauuauccucucugaagacca

SEQ ID NO: 114171 - RNA, 22 nt, Human
ugcauuaucuuuaauguucuca

SEQ ID NO: 114172 - RNA, 22 nt, Human
ugcauuaugcuacccagaagcu

SEQ ID NO: 114173 - RNA, 22 nt, Human
ugcauuaugcuugugcuguaua

SEQ ID NO: 114174 - RNA, 22 nt, Human
ugcauuauugaaggcccugugg

SEQ ID NO: 114175 - RNA, 22 nt, Human
ugcauuauuugcaugugccugu

SEQ ID NO: 114176 - RNA, 22 nt, Human
ugcauuccacagaagggaaaac

SEQ ID NO: 114177 - RNA, 22 nt, Human
ugcauuccacauaaagcgauaa

SEQ ID NO: 114178 - RNA, 23 nt, Human
ugcauuccucacagggcagaaga

SEQ ID NO: 114179 - RNA, 22 nt, Human
uggagcaugagagucuuuagcu

SEQ ID NO: 114180 - RNA, 22 nt, Human
uggagcauucagguuucccuuu

SEQ ID NO: 114181 - RNA, 22 nt, Human
uggagccaagagucaaggggag

SEQ ID NO: 114182 - RNA, 20 nt, Human
uggagccaaggugugucugg

SEQ ID NO: 114183 - RNA, 20 nt, Human
uggagccacagucagguucc

SEQ ID NO: 114184 - RNA, 22 nt, Human
uggagccagaagagccaguuca

SEQ ID NO: 114185 - RNA, 22 nt, Human
uggagccagagcgcagccuggg

SEQ ID NO: 114186 - RNA, 22 nt, Human
uggagccagcccaggccccucu

SEQ ID NO: 114187 - RNA, 22 nt, Human
uggagcccaggagaggauaaac

SEQ ID NO: 114188 - RNA, 22 nt, Human
uggagccuuuuguucugggaca

SEQ ID NO: 114189 - RNA, 22 nt, Human
uggagcucaaaggccuguggga

SEQ ID NO: 114190 - RNA, 21 nt, Human
uggagcucccugcaucccacu

SEQ ID NO: 114191 - RNA, 23 nt, Human
uggagcuccugcccauccuggcu

SEQ ID NO: 114192 - RNA, 21 nt, Human
uggagcugaauuuuuggcauc

SEQ ID NO: 114193 - RNA, 22 nt, Human
uggagcugagagccaggcuggc

SEQ ID NO: 114194 - RNA, 22 nt, Human
uuguguuucuggccaagaugga

SEQ ID NO: 114195 - RNA, 22 nt, Human
uuguguuucugugauauguaaa

SEQ ID NO: 114196 - RNA, 22 nt, Human
uuguuaaaacuccauugguuug

SEQ ID NO: 114197 - RNA, 22 nt, Human
uuguuaaaauauuggagaaagg

SEQ ID NO: 114198 - RNA, 22 nt, Human
uuguuaaauggaugcagaauaa

SEQ ID NO: 114199 - RNA, 23 nt, Human
uuguuaacuuuccugccccuaca

SEQ ID NO: 114200 - RNA, 22 nt, Human
uuguuacaucuuauguaagugg

SEQ ID NO: 114201 - RNA, 21 nt, Human
uuguuacauucuuauggcaua

SEQ ID NO: 114202 - RNA, 22 nt, Human
uuguuacuugcauguagacuaa

SEQ ID NO: 114203 - RNA, 20 nt, Human
uuguuagaggaaugccauag

SEQ ID NO: 114204 - RNA, 22 nt, Human
uuguuagcaugcuuaauggaua

SEQ ID NO: 114205 - RNA, 22 nt, Human
uuguucaggccugggacaguuu

SEQ ID NO: 114206 - RNA, 22 nt, Human
uuguucuuacuuaagagugaau

SEQ ID NO: 114207 - RNA, 22 nt, Human
uuguucuuaguaugcauuguuu

SEQ ID NO: 114208 - RNA, 22 nt, Human
uuguugaauggauaaauaaauu

SEQ ID NO: 114209 - RNA, 22 nt, Human
uuguugaauuaguugacugugu

SEQ ID NO: 114210 - RNA, 22 nt, Human
uuguugcaaggguuaaaugaga

SEQ ID NO: 114211 - RNA, 22 nt, Human
uuguugcucuuguugccacaug

SEQ ID NO: 114212 - RNA, 22 nt, Human
uuguuggugaauaggguggaau

SEQ ID NO: 114213 - RNA, 22 nt, Human
uuguuguuauaggugguacaag

SEQ ID NO: 114214 - RNA, 22 nt, Human
uuguuguuggagccaauaugca

SEQ ID NO: 114215 - RNA, 20 nt, Human
uuguuuauuauguucugauc

SEQ ID NO: 114216 - RNA, 22 nt, Human
uuguuucagcccagaucuuuac

SEQ ID NO: 114217 - RNA, 22 nt, Human
uuguuucagcuguaugcuaugu

SEQ ID NO: 114218 - RNA, 22 nt, Human
uuguuucaggaugguuuguuac

SEQ ID NO: 114219 - RNA, 22 nt, Human
uuguuucauggggauguuuauu

SEQ ID NO: 114220 - RNA, 21 nt, Human
uuguuucccagagcucgcucc

SEQ ID NO: 114221 - RNA, 20 nt, Human
uuguuuccuggcuguucugc

SEQ ID NO: 114222 - RNA, 22 nt, Human
uuguuuccuuucuauacaggau

SEQ ID NO: 114223 - RNA, 17 nt, Human
uuguuucuucucugugg

SEQ ID NO: 114224 - RNA, 22 nt, Human
uuguuugaggucacugauauuu

SEQ ID NO: 114225 - RNA, 22 nt, Human
uuguuuguaaggcucuuagaau

SEQ ID NO: 114226 - RNA, 22 nt, Human
uuguuuguaugcugagaagaau

SEQ ID NO: 114227 - RNA, 22 nt, Human
uuguuuuaaccuaguguuuaug

SEQ ID NO: 114228 - RNA, 22 nt, Human
uuguuuuaacgacucagcuugu

SEQ ID NO: 114229 - RNA, 22 nt, Human
uuguuuucuccacugcaucuua

SEQ ID NO: 114230 - RNA, 22 nt, Human
uuguuuuggaagaacuuacucu

SEQ ID NO: 114231 - RNA, 22 nt, Human
uuguuuuugugaggcagcccau

SEQ ID NO: 114232 - RNA, 22 nt, Human
uuuaaaccuaucuaagaaauag

SEQ ID NO: 114233 - RNA, 22 nt, Human
uuuaaaccuccugauucagcua

SEQ ID NO: 114234 - RNA, 22 nt, Human
uuuaaagaaauuccucaucuuu

SEQ ID NO: 114235 - RNA, 22 nt, Human
uuuaaagugcugcuccuauccu

SEQ ID NO: 114236 - RNA, 22 nt, Human
uuuaaagugguccauuucagaa

SEQ ID NO: 114237 - RNA, 22 nt, Human
uuuaaaugcuuuaagcaagggu

SEQ ID NO: 114238 - RNA, 22 nt, Human
uuuaaauguguucuuaguagcu

SEQ ID NO: 114239 - RNA, 22 nt, Human
uuuaaauguuuaaaacucguga

SEQ ID NO: 114240 - RNA, 22 nt, Human
uuuaaauuuguguuuagagggu

SEQ ID NO: 114241 - RNA, 22 nt, Human
uuuaacagaugaggaggugagg

SEQ ID NO: 114242 - RNA, 22 nt, Human
uuuaacagguaaaguaaaugug

SEQ ID NO: 114243 - RNA, 22 nt, Human
uuuaacaugugaauuuuggaag

SEQ ID NO: 114244 - RNA, 23 nt, Human
uuuaacauuugaacauguggcca

SEQ ID NO: 114245 - RNA, 22 nt, Human
uuuaaccugucaauuugcaugc

SEQ ID NO: 114246 - RNA, 23 nt, Human
uuuaaccuuggucaagaauuucc

SEQ ID NO: 114247 - RNA, 22 nt, Human
uuuaacuuaaucugcuugauga

SEQ ID NO: 114248 - RNA, 22 nt, Human
uuuaacuugaucaguagagcau

SEQ ID NO: 114249 - RNA, 20 nt, Human
uuuaagaaguuucugaggaa

SEQ ID NO: 114250 - RNA, 22 nt, Human
uuuaagaguuaaacuuugaccu

SEQ ID NO: 114251 - RNA, 22 nt, Human
uuuaagaucuaucccauuuugu

SEQ ID NO: 114252 - RNA, 22 nt, Human
uuuaagauucaguaaggcaaac

SEQ ID NO: 114253 - RNA, 22 nt, Human
uuuaagcacagggauaaaguua

SEQ ID NO: 114254 - RNA, 19 nt, Human
uuuaagcauagaggccaga

SEQ ID NO: 114255 - RNA, 22 nt, Human
uuuaaggagcuacucaccguca

SEQ ID NO: 114256 - RNA, 22 nt, Human
uuuaaggaugaugugauauaua

SEQ ID NO: 114257 - RNA, 22 nt, Human
uuuaaggauguaaaggaagaag

SEQ ID NO: 114258 - RNA, 22 nt, Human
uuuaaggcagugaaacuauucu

SEQ ID NO: 114259 - RNA, 22 nt, Human
uuuaagguacagcuagcagcau

SEQ ID NO: 114260 - RNA, 22 nt, Human
uuuaagugaaauguaauacagu

SEQ ID NO: 114261 - RNA, 22 nt, Human
uuuaauauccaguggauacaaa

SEQ ID NO: 114262 - RNA, 22 nt, Human
uuuaauaucucacacuuccaug

SEQ ID NO: 114263 - RNA, 22 nt, Human
uuuaaucucccacucucagccu

SEQ ID NO: 114264 - RNA, 23 nt, Human
uuuaaugaccaauagaaggaaca

SEQ ID NO: 114265 - RNA, 22 nt, Human
uuuaaugaggucucucgcuggc

SEQ ID NO: 114266 - RNA, 22 nt, Human
uuuaauguauucuuuggaacca

SEQ ID NO: 114267 - RNA, 22 nt, Human
uuuaaugugagucccuuucaag

SEQ ID NO: 114268 - RNA, 22 nt, Human
uuuaauuauaucugggcaguua

SEQ ID NO: 114269 - RNA, 22 nt, Human
uuuaauucuggcauaauagcuc

SEQ ID NO: 114270 - RNA, 22 nt, Human
uuuaauuuuccugguaggccug

SEQ ID NO: 114271 - RNA, 22 nt, Human
uuuacaacauaggccccaagaa

SEQ ID NO: 114272 - RNA, 22 nt, Human
uuuacaaggaucaagggaucuc

SEQ ID NO: 114273 - RNA, 22 nt, Human
uuuacaaguuuacagaaugaug

SEQ ID NO: 114274 - RNA, 22 nt, Human
uuuacacugacagcacauaagg

SEQ ID NO: 114275 - RNA, 22 nt, Human
uuuacacugccauucugaauac

SEQ ID NO: 114276 - RNA, 22 nt, Human
uuuacacuuuccugggaacauc

SEQ ID NO: 114277 - RNA, 22 nt, Human
uuuacagaaugucaauuucuau

SEQ ID NO: 114278 - RNA, 22 nt, Human
uuuacagacaacuuaauagggg

SEQ ID NO: 114279 - RNA, 22 nt, Human
uuuacagagaauguacauaaag

SEQ ID NO: 114280 - RNA, 22 nt, Human
uuuacagagagagaacuggacu

SEQ ID NO: 114281 - RNA, 22 nt, Human
uuuacagauucuggguauuagg

SEQ ID NO: 114282 - RNA, 22 nt, Human
uuuacagcacugaagccagggg

SEQ ID NO: 114283 - RNA, 22 nt, Human
uuuacagcuagacauaccugag

SEQ ID NO: 114284 - RNA, 22 nt, Human
uuuacagcugcuggcaagcuug

SEQ ID NO: 114285 - RNA, 22 nt, Human
uuuacaggauuacccuggcugc

SEQ ID NO: 114286 - RNA, 19 nt, Human
uuuacagggaauggagacc

SEQ ID NO: 114287 - RNA, 22 nt, Human
uuuacagucuauguugaauuaa

SEQ ID NO: 114288 - RNA, 22 nt, Human
uuuacagucugucuagcaaugu

SEQ ID NO: 114289 - RNA, 22 nt, Human
uuuacagugucuuguugacugu

SEQ ID NO: 114290 - RNA, 22 nt, Human
uuuacauagugcuuucccacua

SEQ ID NO: 114291 - RNA, 22 nt, Human
uuuacaugaguagcagauguuc

SEQ ID NO: 114292 - RNA, 22 nt, Human
ugcacaguaaacaugacuggag

SEQ ID NO: 114293 - RNA, 22 nt, Human
ugcacaguucgccuucuccaag

SEQ ID NO: 114294 - RNA, 22 nt, Human
ugcacaucuuucagcaucauac

SEQ ID NO: 114295 - RNA, 22 nt, Human
ugcacauggccugagugccuga

SEQ ID NO: 114296 - RNA, 22 nt, Human
ugcacauuuguuauuuugaggu

SEQ ID NO: 114297 - RNA, 22 nt, Human
ugcaccaguuucucagagaauc

SEQ ID NO: 114298 - RNA, 22 nt, Human
ugcaccauuaauuuaugugaga

SEQ ID NO: 114299 - RNA, 22 nt, Human
ugcacccacuuagcugaaguuc

SEQ ID NO: 114300 - RNA, 22 nt, Human
ugcacccauagcacacacuccu

SEQ ID NO: 114301 - RNA, 22 nt, Human
ugcacccaugucuccacguaca

SEQ ID NO: 114302 - RNA, 22 nt, Human
ugcacccucaucagucaaaugg

SEQ ID NO: 114303 - RNA, 22 nt, Human
uuuaccuggauucuuacuuccu

SEQ ID NO: 114304 - RNA, 22 nt, Human
uuuacgacugcuaaaugccugc

SEQ ID NO: 114305 - RNA, 22 nt, Human
uuuacgagugcuaaugauauug

SEQ ID NO: 114306 - RNA, 22 nt, Human
uuuacuaacaccauacaugcug

SEQ ID NO: 114307 - RNA, 22 nt, Human
uuuacucaaguaugcauuuaug

SEQ ID NO: 114308 - RNA, 22 nt, Human
uuuacugucucagagagacaaa

SEQ ID NO: 114309 - RNA, 22 nt, Human
uuuacugugcauuagaaucacc

SEQ ID NO: 114310 - RNA, 22 nt, Human
uuuagaaauucaucuauggccu

SEQ ID NO: 114311 - RNA, 17 nt, Human
uuuagaauacaauguuu

SEQ ID NO: 114312 - RNA, 22 nt, Human
uuuagacagaugugaggugggu

SEQ ID NO: 114313 - RNA, 22 nt, Human
uuuagacagcaucuggugacuu

SEQ ID NO: 114314 - RNA, 22 nt, Human
uuuagagagcacuguagacacu

SEQ ID NO: 114315 - RNA, 22 nt, Human
uuuagagaggcucuguaaaaug

SEQ ID NO: 114316 - RNA, 22 nt, Human
uuuagagcccaugugaguguga

SEQ ID NO: 114317 - RNA, 22 nt, Human
uuuagagcugugcugccacaug

SEQ ID NO: 114318 - RNA, 22 nt, Human
uuuagaggaauugggagaacgu

SEQ ID NO: 114319 - RNA, 21 nt, Human
uuuagaggacacagggaggca

SEQ ID NO: 114320 - RNA, 22 nt, Human
uuuagaggaggaagaaauuuug

SEQ ID NO: 114321 - RNA, 22 nt, Human
uuuagaggucuguuucacauca

SEQ ID NO: 114322 - RNA, 22 nt, Human
uuuagagucauuuuauauugac

SEQ ID NO: 114323 - RNA, 22 nt, Human
uuuagauaaugcucaagcaauu

SEQ ID NO: 114324 - RNA, 22 nt, Human
uuuagcaaaaaagcucugcgua

SEQ ID NO: 114325 - RNA, 20 nt, Human
uuuagcaaaagggacugcuc

SEQ ID NO: 114326 - RNA, 22 nt, Human
uuuagcaaagguaggguucaga

SEQ ID NO: 114327 - RNA, 21 nt, Human
uuuagcaagaguauagugcau

SEQ ID NO: 114328 - RNA, 22 nt, Human
uuuagcaauaucauaaggaaga

SEQ ID NO: 114329 - RNA, 22 nt, Human
uuuagcacgguaacacauaaag

SEQ ID NO: 114330 - RNA, 22 nt, Human
uuuagcagaaacucauuaaauu

SEQ ID NO: 114331 - RNA, 22 nt, Human
uuuagcagagcauaugauaucc

SEQ ID NO: 114332 - RNA, 22 nt, Human
uuuagcagugaagugaagugaa

SEQ ID NO: 114333 - RNA, 22 nt, Human
uuuagcaucgaaguaaauuuag

SEQ ID NO: 114334 - RNA, 22 nt, Human
uuuagccaaucagcuugggagc

SEQ ID NO: 114335 - RNA, 22 nt, Human
uuuagcuaagacauagauucuu

SEQ ID NO: 114336 - RNA, 23 nt, Human
uuuagcuuauaaaugcuuuugaa

SEQ ID NO: 114337 - RNA, 22 nt, Human
uuuagcuuuaccucauagauuu

SEQ ID NO: 114338 - RNA, 22 nt, Human
uuuaggaaauacuguccuauga

SEQ ID NO: 114339 - RNA, 21 nt, Human
uuuaggaaguuuaaggcaggu

SEQ ID NO: 114340 - RNA, 22 nt, Human
uuuaggaauauuuucuuucagg

SEQ ID NO: 114341 - RNA, 19 nt, Human
uuuaggauaaagucuggac

SEQ ID NO: 114342 - RNA, 22 nt, Human
uuuaggauauuaauguucagag

SEQ ID NO: 114343 - RNA, 22 nt, Human
uuuaggaucaaugagaaagucu

SEQ ID NO: 114344 - RNA, 22 nt, Human
uuuaggaucucucuuguuacau

SEQ ID NO: 114345 - RNA, 22 nt, Human
uuuaggcaaacucauugucaga

SEQ ID NO: 114346 - RNA, 22 nt, Human
uuuaggcaaauuucagaugugc

SEQ ID NO: 114347 - RNA, 22 nt, Human
uuuaggcacaacuacucagcua

SEQ ID NO: 114348 - RNA, 22 nt, Human
uuuaggcacagggaguugguuu

SEQ ID NO: 114349 - RNA, 22 nt, Human
uuuaggcagaagcccugcugau

SEQ ID NO: 114350 - RNA, 22 nt, Human
uuuaggcagcacgggcagcccu

SEQ ID NO: 114351 - RNA, 22 nt, Human
uuuaggcaugcaguucuauuua

SEQ ID NO: 114352 - RNA, 20 nt, Human
uuuaggcauuacucuuuugu

SEQ ID NO: 114353 - RNA, 22 nt, Human
uuuagggaagaagcccauggcc

SEQ ID NO: 114354 - RNA, 21 nt, Human
uuuagggaggauauuuaacuu

SEQ ID NO: 114355 - RNA, 22 nt, Human
uuuagggaugucagaacaggga

SEQ ID NO: 114356 - RNA, 22 nt, Human
uuuagggugauguaugugcagc

SEQ ID NO: 114357 - RNA, 22 nt, Human
uuuaguagaaauauuugggccu

SEQ ID NO: 114358 - RNA, 22 nt, Human
uuuaguagugacagauucuggg

SEQ ID NO: 114359 - RNA, 22 nt, Human
uuuaguauauaaaaagagaagu

SEQ ID NO: 114360 - RNA, 22 nt, Human
uuuaguauucucuauuuccauc

SEQ ID NO: 114361 - RNA, 22 nt, Human
uuuagucagguaagaugcaggg

SEQ ID NO: 114362 - RNA, 22 nt, Human
uuuagugauucauuuagaaaaa

SEQ ID NO: 114363 - RNA, 22 nt, Human
uuuagugccugguuuccuucuu

SEQ ID NO: 114364 - RNA, 22 nt, Human
uuuaguguaauucugccuuuug

SEQ ID NO: 114365 - RNA, 22 nt, Human
uuuaguguggcacugauguuca

SEQ ID NO: 114366 - RNA, 22 nt, Human
uuuaguuauuguuacaguauga

SEQ ID NO: 114367 - RNA, 22 nt, Human
uuuaguucucccagucuugauu

SEQ ID NO: 114368 - RNA, 22 nt, Human
uuuaguuugauguucuacuccu

SEQ ID NO: 114369 - RNA, 22 nt, Human
uuuaguuuugaugaaaaugcca

SEQ ID NO: 114370 - RNA, 22 nt, Human
uuuauaaccaaguucugcuugu

SEQ ID NO: 114371 - RNA, 22 nt, Human
uuuauaccucauucuuagcaaa

SEQ ID NO: 114372 - RNA, 22 nt, Human
uuuauagcugugagaccuuggg

SEQ ID NO: 114373 - RNA, 20 nt, Human
uuuauagugaucaauuuaua

SEQ ID NO: 114374 - RNA, 22 nt, Human
uuuauauauggcuggucuggau

SEQ ID NO: 114375 - RNA, 22 nt, Human
uuuauaucuggaguugcuagga

SEQ ID NO: 114376 - RNA, 22 nt, Human
uuuauaucuuaugucauuucaa

SEQ ID NO: 114377 - RNA, 22 nt, Human
uuuauauuaccuggaauagcuu

SEQ ID NO: 114378 - RNA, 22 nt, Human
uuuauauuucccaggauuggcc

SEQ ID NO: 114379 - RNA, 22 nt, Human
uuuaucaaacaaauuauccagc

SEQ ID NO: 114380 - RNA, 22 nt, Human
uuuaucagagauauguguggac

SEQ ID NO: 114381 - RNA, 22 nt, Human
uuuauccagaaucaggauuuuu

SEQ ID NO: 114382 - RNA, 22 nt, Human
uuuauccaugcucccguugaug

SEQ ID NO: 114383 - RNA, 22 nt, Human
uuuaucucuuuugaccaagauu

SEQ ID NO: 114384 - RNA, 22 nt, Human
uuuaucugaaaaaacucuugga

SEQ ID NO: 114385 - RNA, 22 nt, Human
uuuaucugaggaaagcagacaa

SEQ ID NO: 114386 - RNA, 22 nt, Human
uuuaucugcauucugaccaucu

SEQ ID NO: 114387 - RNA, 22 nt, Human
uuuaucugggauuuugcagucu

SEQ ID NO: 114388 - RNA, 22 nt, Human
uuuaucugucauuucccauauc

SEQ ID NO: 114389 - RNA, 22 nt, Human
uuuaucuguccuuugccaguga

SEQ ID NO: 114390 - RNA, 20 nt, Human
uuuaucugugggaguggaga

SEQ ID NO: 114391 - RNA, 22 nt, Human
uuuaucugugguaaauaacauu

SEQ ID NO: 114392 - RNA, 22 nt, Human
uuuaucuguuccucuuggaggc

SEQ ID NO: 114393 - RNA, 22 nt, Human
uuuaucuucugcaguucuggcu

SEQ ID NO: 114394 - RNA, 22 nt, Human
uuuaucuuuggaucuucagaaa

SEQ ID NO: 114395 - RNA, 22 nt, Human
uuuaugaacuacagauauaacu

SEQ ID NO: 114396 - RNA, 22 nt, Human
uuuaugacaagcauuacugauu

SEQ ID NO: 114397 - RNA, 22 nt, Human
uuuaugcacaauuagucuuaua

SEQ ID NO: 114398 - RNA, 21 nt, Human
uuuaugcagauaaugcuauuu

SEQ ID NO: 114399 - RNA, 22 nt, Human
uuuauguaaguggaaugaugcc

SEQ ID NO: 114400 - RNA, 22 nt, Human
uuuauguaauuucauaggugug

SEQ ID NO: 114401 - RNA, 22 nt, Human
uuuauguuauggguaggaucaa

SEQ ID NO: 114402 - RNA, 22 nt, Human
uuuauguuccucuugagcuuuc

SEQ ID NO: 114403 - RNA, 22 nt, Human
uuuauuacaccagguuaacuca

SEQ ID NO: 114404 - RNA, 22 nt, Human
uuuauuagauuaucaaagaggu

SEQ ID NO: 114405 - RNA, 22 nt, Human
uuuauuauagugguggggacug

SEQ ID NO: 114406 - RNA, 22 nt, Human
uuuauucaagaugagguucaug

SEQ ID NO: 114407 - RNA, 22 nt, Human
ugcccuggaaaugagaggugug

SEQ ID NO: 114408 - RNA, 22 nt, Human
ugcccuggagucaguggcuauu

SEQ ID NO: 114409 - RNA, 22 nt, Human
ugcccugggaacacagaugcca

SEQ ID NO: 114410 - RNA, 22 nt, Human
ugcccugggaguuggagcugcu

SEQ ID NO: 114411 - RNA, 20 nt, Human
ugcccuguggaggggaaagg

SEQ ID NO: 114412 - RNA, 22 nt, Human
ugcagggcagauaugacuguag

SEQ ID NO: 114413 - RNA, 22 nt, Human
ugcagggcagcuagggagcuuu

SEQ ID NO: 114414 - RNA, 22 nt, Human
ugcagggcccucauuccugucc

SEQ ID NO: 114415 - RNA, 22 nt, Human
ugcagggcccuugggguugaac

SEQ ID NO: 114416 - RNA, 22 nt, Human
ugcagggccgcuggaggucaug

SEQ ID NO: 114417 - RNA, 22 nt, Human
ugcagggccuucuagaccaugg

SEQ ID NO: 114418 - RNA, 22 nt, Human
ugcagggcuaagucagagccug

SEQ ID NO: 114419 - RNA, 22 nt, Human
ugcaggggcuugucugggccug

SEQ ID NO: 114420 - RNA, 22 nt, Human
ugcaggguauccuugucucugc

SEQ ID NO: 114421 - RNA, 22 nt, Human
ugcagggucccgaagggaagac

SEQ ID NO: 114422 - RNA, 22 nt, Human
ugcaggguggagcggaagcgga

SEQ ID NO: 114423 - RNA, 22 nt, Human
ugcagguacuugacaacuuggg

SEQ ID NO: 114424 - RNA, 22 nt, Human
ugcagguaggccugacuuccag

SEQ ID NO: 114425 - RNA, 22 nt, Human
ugcaggucauguggcgggacug

SEQ ID NO: 114426 - RNA, 22 nt, Human
ugcaggucuauuuaaaugauug

SEQ ID NO: 114427 - RNA, 22 nt, Human
ugcaggugaaaauuaugaggau

SEQ ID NO: 114428 - RNA, 22 nt, Human
ugcaggugcagcgauacuguga

SEQ ID NO: 114429 - RNA, 22 nt, Human
ugcaggugccaucgcugcucau

SEQ ID NO: 114430 - RNA, 22 nt, Human
ugcaggugccucuugagcuugu

SEQ ID NO: 114431 - RNA, 22 nt, Human
ugcaggugcuacaagaacucac

SEQ ID NO: 114432 - RNA, 22 nt, Human
ugcaggugcugauaccuacucc

SEQ ID NO: 114433 - RNA, 22 nt, Human
ugcaggugcugugucaagagag

SEQ ID NO: 114434 - RNA, 22 nt, Human
ugcagguggacacgggagacgg

SEQ ID NO: 114435 - RNA, 22 nt, Human
ugcagguggccaucuucguucu

SEQ ID NO: 114436 - RNA, 22 nt, Human
ugcaggugguccuuccucugcu

SEQ ID NO: 114437 - RNA, 22 nt, Human
ugcaggugucugggggcaacag

SEQ ID NO: 114438 - RNA, 20 nt, Human
ugcagguguuggagaaggua

SEQ ID NO: 114439 - RNA, 22 nt, Human
ugcagguucugaccagccaacu

SEQ ID NO: 114440 - RNA, 23 nt, Human
ugcaguaggauggggcugggccu

SEQ ID NO: 114441 - RNA, 21 nt, Human
ugcaguauguauuuguaucca

SEQ ID NO: 114442 - RNA, 22 nt, Human
ugcagucuguacauuuuaagaa

SEQ ID NO: 114443 - RNA, 22 nt, Human
ugcagucuuccagcugcacaaa

SEQ ID NO: 114444 - RNA, 22 nt, Human
ugcagucuuuccucgaguuugu

SEQ ID NO: 114445 - RNA, 21 nt, Human
ugcagugaggggagcugucag

SEQ ID NO: 114446 - RNA, 22 nt, Human
ugcaguggugguaaagaugcuc

SEQ ID NO: 114447 - RNA, 20 nt, Human
ugcaguguccucacuuguca

SEQ ID NO: 114448 - RNA, 22 nt, Human
ugcaguguuccuguggguuuau

SEQ ID NO: 114449 - RNA, 23 nt, Human
ugcaguguuuaacaaugacuuga

SEQ ID NO: 114450 - RNA, 22 nt, Human
ugcaguguuuuucagggcauau

SEQ ID NO: 114451 - RNA, 22 nt, Human
ugcaguucaagguuguacagcu

SEQ ID NO: 114452 - RNA, 21 nt, Human
ugcaguucaagucaaucuacu

SEQ ID NO: 114453 - RNA, 22 nt, Human
ugcaguucuaaguagacaaguc

SEQ ID NO: 114454 - RNA, 22 nt, Human
ugcaguuuaaacuuggcaacuu

SEQ ID NO: 114455 - RNA, 22 nt, Human
ugcaguuuccuuucuagucuuu

SEQ ID NO: 114456 - RNA, 22 nt, Human
ugcaguuugcccuuugcucacu

SEQ ID NO: 114457 - RNA, 20 nt, Human
ugcaguuugucaagguuccu

SEQ ID NO: 114458 - RNA, 22 nt, Human
ugcaguuuucaaaaguuuacag

SEQ ID NO: 114459 - RNA, 21 nt, Human
ugcaguuuugcuugaucucug

SEQ ID NO: 114460 - RNA, 22 nt, Human
ugcauaaaaaccacauacaagg

SEQ ID NO: 114461 - RNA, 22 nt, Human
ugcauaaaacaugauuucugcu

SEQ ID NO: 114462 - RNA, 22 nt, Human
ugcauaaacagauacuucaugu

SEQ ID NO: 114463 - RNA, 21 nt, Human
ugcauaaagaaauacaaauac

SEQ ID NO: 114464 - RNA, 19 nt, Human
ugcauaaauuauauacuuu

SEQ ID NO: 114465 - RNA, 22 nt, Human
ugcauacacacauagguauggg

SEQ ID NO: 114466 - RNA, 22 nt, Human
ugcauacauguuuguguauuuu

SEQ ID NO: 114467 - RNA, 22 nt, Human
ugcauacugaaucugccaucac

SEQ ID NO: 114468 - RNA, 22 nt, Human
ugcauaggguucaaaggcugua

SEQ ID NO: 114469 - RNA, 21 nt, Human
ugcauauauaagugcauacac

SEQ ID NO: 114470 - RNA, 22 nt, Human
ugcauauaucuuauuuuucugu

SEQ ID NO: 114471 - RNA, 22 nt, Human
ugcauauauuugagauuauggc

SEQ ID NO: 114472 - RNA, 22 nt, Human
ugcauauccacaccuuaucucu

SEQ ID NO: 114473 - RNA, 22 nt, Human
ugcauauucuccuuuauuuugu

SEQ ID NO: 114474 - RNA, 22 nt, Human
ugcauauuugauugagauaccu

SEQ ID NO: 114475 - RNA, 22 nt, Human
ugcaucaagaagucuaaguuug

SEQ ID NO: 114476 - RNA, 22 nt, Human
ugcaucagaguuugcugcugcu

SEQ ID NO: 114477 - RNA, 22 nt, Human
ugcaucagcugugcuucuugac

SEQ ID NO: 114478 - RNA, 18 nt, Human
ugcaucauuuauggguca

SEQ ID NO: 114479 - RNA, 22 nt, Human
ugcauccuuaaccagcaucacu

SEQ ID NO: 114480 - RNA, 22 nt, Human
ugcauccuuccauggguuucaa

SEQ ID NO: 114481 - RNA, 22 nt, Human
ugcauccuucccauuuaaacca

SEQ ID NO: 114482 - RNA, 22 nt, Human
ugcaucuaaguggcuaacaacc

SEQ ID NO: 114483 - RNA, 22 nt, Human
ugcaugagcgaauguguccugu

SEQ ID NO: 114484 - RNA, 22 nt, Human
ugcaugauguuaaacaucaggu

SEQ ID NO: 114485 - RNA, 22 nt, Human
ugcaugcaaaaaaaucugcauu

SEQ ID NO: 114486 - RNA, 22 nt, Human
ugcaugcacgugcuauguauga

SEQ ID NO: 114487 - RNA, 22 nt, Human
ugcaugcacuaucuagaugaug

SEQ ID NO: 114488 - RNA, 22 nt, Human
ugcaugcagcuggugauaagaa

SEQ ID NO: 114489 - RNA, 22 nt, Human
ugcaugcaugcuacugggaggu

SEQ ID NO: 114490 - RNA, 21 nt, Human
ugcaugcuauguuuuuauuuc

SEQ ID NO: 114491 - RNA, 22 nt, Human
ugcaugcucuguagaaagcagg

SEQ ID NO: 114492 - RNA, 22 nt, Human
ugcauggaacggucuccugguc

SEQ ID NO: 114493 - RNA, 22 nt, Human
ugcauggacucaucagacaaga

SEQ ID NO: 114494 - RNA, 22 nt, Human
ugcauggaggaagaugaaugca

SEQ ID NO: 114495 - RNA, 22 nt, Human
ugcaugguaaccaggaugucua

SEQ ID NO: 114496 - RNA, 22 nt, Human
ugcaugguuauauacuacuagu

SEQ ID NO: 114497 - RNA, 22 nt, Human
ugcauguuuuauaccaaagcuu

SEQ ID NO: 114498 - RNA, 22 nt, Human
ugcauuaagguaauuguauaau

SEQ ID NO: 114499 - RNA, 22 nt, Human
ugcauuaauuuuugccagguuc

SEQ ID NO: 114500 - RNA, 22 nt, Human
ugcauuaguaaguaauuuuaau

SEQ ID NO: 114501 - RNA, 22 nt, Human
ugcauuauaacugaauguuguu

SEQ ID NO: 114502 - RNA, 15 nt, Human
ugcauuaucaauaga

SEQ ID NO: 114503 - RNA, 22 nt, Human
ugcauuauuacaagguaagacu

SEQ ID NO: 114504 - RNA, 22 nt, Human
ugcauucaucauuugaaagccc

SEQ ID NO: 114505 - RNA, 22 nt, Human
ugcauuccacacccauagagau

SEQ ID NO: 114506 - RNA, 22 nt, Human
ugcauuccauguguuuccugag

SEQ ID NO: 114507 - RNA, 22 nt, Human
ugcauuccuccaccuccugcac

SEQ ID NO: 114508 - RNA, 21 nt, Human
ugcauuccuccauccaacagg

SEQ ID NO: 114509 - RNA, 22 nt, Human
ugcauuccuuucuaggauagcu

SEQ ID NO: 114510 - RNA, 22 nt, Human
ugcauugaggggcucucuuccu

SEQ ID NO: 114511 - RNA, 22 nt, Human
ugcauugaucauauccuuccug

SEQ ID NO: 114512 - RNA, 22 nt, Human
ugcauugcaguuaacucaguau

SEQ ID NO: 114513 - RNA, 22 nt, Human
ugcauugguaaaauacauacac

SEQ ID NO: 114514 - RNA, 22 nt, Human
ugcauuggucuuaaucuucagg

SEQ ID NO: 114515 - RNA, 17 nt, Human
ugcauuguaggcuagcc

SEQ ID NO: 114516 - RNA, 22 nt, Human
ugcauuguugaccaguugugca

SEQ ID NO: 114517 - RNA, 22 nt, Human
ugcauuguuugauaggugaauu

SEQ ID NO: 114518 - RNA, 21 nt, Human
ugcauuuaacagaaacaggaa

SEQ ID NO: 114519 - RNA, 22 nt, Human
ugcauuuaagaaaacaugaguc

SEQ ID NO: 114520 - RNA, 22 nt, Human
ugcauuuauuugaauugaucua

SEQ ID NO: 114521 - RNA, 22 nt, Human
ugcuggaauuuuucuaggauuu

SEQ ID NO: 114522 - RNA, 22 nt, Human
ugcuggagaucauuaauguuca

SEQ ID NO: 114523 - RNA, 22 nt, Human
ugcuggagcaacauuauugugc

SEQ ID NO: 114524 - RNA, 22 nt, Human
ugcuggaggagaagguugcuca

SEQ ID NO: 114525 - RNA, 22 nt, Human
ugcuggaggccagaagucugag

SEQ ID NO: 114526 - RNA, 22 nt, Human
uuuccaauucaagcuuuuacgu

SEQ ID NO: 114527 - RNA, 22 nt, Human
uuuccaauuugguagucaucgg

SEQ ID NO: 114528 - RNA, 22 nt, Human
uuuccaauuuuuaaguggauga

SEQ ID NO: 114529 - RNA, 22 nt, Human
uuuccacaauuugagcagcaga

SEQ ID NO: 114530 - RNA, 22 nt, Human
uuuccacacugcagccagcaaa

SEQ ID NO: 114531 - RNA, 22 nt, Human
uuuccacuguagagauguugaa

SEQ ID NO: 114532 - RNA, 22 nt, Human
uuuccagagcugagaaggcuug

SEQ ID NO: 114533 - RNA, 22 nt, Human
uuuccaggcagaggaguuguga

SEQ ID NO: 114534 - RNA, 22 nt, Human
uuuccagggcucuguagaagaa

SEQ ID NO: 114535 - RNA, 22 nt, Human
uuuccagucucagcccuguaac

SEQ ID NO: 114536 - RNA, 22 nt, Human
uuuccagugaauuagucuguuu

SEQ ID NO: 114537 - RNA, 22 nt, Human
uuuccagugauugcugcucuca

SEQ ID NO: 114538 - RNA, 22 nt, Human
uuucccaaagccuggggugagu

SEQ ID NO: 114539 - RNA, 22 nt, Human
uuucccaauugagagguucugu

SEQ ID NO: 114540 - RNA, 22 nt, Human
uuuccccagguagauagauaau

SEQ ID NO: 114541 - RNA, 22 nt, Human
uuuccccucaguacuaaacaua

SEQ ID NO: 114542 - RNA, 22 nt, Human
uuucccuacuuguaacuggaaa

SEQ ID NO: 114543 - RNA, 21 nt, Human
uuucccucauuguguuggcac

SEQ ID NO: 114544 - RNA, 22 nt, Human
uuucccucugugccagcuucuc

SEQ ID NO: 114545 - RNA, 22 nt, Human
uuuccuaacucaucggauguac

SEQ ID NO: 114546 - RNA, 22 nt, Human
uuuccuaagggaugcggcucaa

SEQ ID NO: 114547 - RNA, 22 nt, Human
uuuccuaggagauugaucacau

SEQ ID NO: 114548 - RNA, 22 nt, Human
uuuccuaguucuaagaaaugua

SEQ ID NO: 114549 - RNA, 22 nt, Human
uuuccucaacugucaaaugggg

SEQ ID NO: 114550 - RNA, 22 nt, Human
uuuccucagaagugucuacuau

SEQ ID NO: 114551 - RNA, 22 nt, Human
uuuccucuccggggccuccagg

SEQ ID NO: 114552 - RNA, 22 nt, Human
uuuccucugagugagcugggag

SEQ ID NO: 114553 - RNA, 22 nt, Human
uuuccucugcugccauugcccc

SEQ ID NO: 114554 - RNA, 22 nt, Human
uuuccucuucuggcaggcaggg

SEQ ID NO: 114555 - RNA, 22 nt, Human
uuuccucuuuguaccuugacua

SEQ ID NO: 114556 - RNA, 22 nt, Human
uuuccugguuggggacgugguu

SEQ ID NO: 114557 - RNA, 22 nt, Human
uuuccugguuugaagcagcagc

SEQ ID NO: 114558 - RNA, 22 nt, Human
uuuccuguccugguacuuggca

SEQ ID NO: 114559 - RNA, 22 nt, Human
uuuccuucaucaucugagagcu

SEQ ID NO: 114560 - RNA, 22 nt, Human
uuuccuuccaaaugcccgggag

SEQ ID NO: 114561 - RNA, 22 nt, Human
uuuccuuccauguugggcaaaa

SEQ ID NO: 114562 - RNA, 22 nt, Human
uuuccuucccuggaugagaagu

SEQ ID NO: 114563 - RNA, 22 nt, Human
uuuccuugggucucuuaguggc

SEQ ID NO: 114564 - RNA, 22 nt, Human
uuuccuuguuauuauuuguccu

SEQ ID NO: 114565 - RNA, 22 nt, Human
uuuccuuucucaagagccggca

SEQ ID NO: 114566 - RNA, 22 nt, Human
uuuccuuuuauaaggcuugagg

SEQ ID NO: 114567 - RNA, 22 nt, Human
uuucgagggauuagcuaggacu

SEQ ID NO: 114568 - RNA, 22 nt, Human
uuucgggaaaaacugguaagac

SEQ ID NO: 114569 - RNA, 22 nt, Human
uuucgucaauuguaacaaaugu

SEQ ID NO: 114570 - RNA, 22 nt, Human
uuucuaaaauagauuuuauggu

SEQ ID NO: 114571 - RNA, 22 nt, Human
uuucuaaaggguagauuuggcc

SEQ ID NO: 114572 - RNA, 22 nt, Human
uuucuaacagcaaauguuuauc

SEQ ID NO: 114573 - RNA, 22 nt, Human
uuucuaagaugugguuucaagg

SEQ ID NO: 114574 - RNA, 19 nt, Human
uuucuaagcuaaaugcuuc

SEQ ID NO: 114575 - RNA, 23 nt, Human
uuucuaagguuuuuaucugcuac

SEQ ID NO: 114576 - RNA, 22 nt, Human
uuucuaaguaagauuaacuucu

SEQ ID NO: 114577 - RNA, 22 nt, Human
uuucuaauaguugagucagcua

SEQ ID NO: 114578 - RNA, 22 nt, Human
uuucuaauaucacuuccagcug

SEQ ID NO: 114579 - RNA, 22 nt, Human
uuucuacauucaaaaacuacca

SEQ ID NO: 114580 - RNA, 22 nt, Human
uuucuacucauccuuuggagaa

SEQ ID NO: 114581 - RNA, 22 nt, Human
uuucuacuucuccugaaugucu

SEQ ID NO: 114582 - RNA, 22 nt, Human
uuucuagaaacauuaucucuau

SEQ ID NO: 114583 - RNA, 22 nt, Human
uuucuagacauuucuauguaca

SEQ ID NO: 114584 - RNA, 22 nt, Human
uuucuagaggcuccaggggagu

SEQ ID NO: 114585 - RNA, 22 nt, Human
uuucuagagugggcaugucuua

SEQ ID NO: 114586 - RNA, 22 nt, Human
uuucuagaguucaucaugguaa

SEQ ID NO: 114587 - RNA, 22 nt, Human
uuucuaggacaugauaggauau

SEQ ID NO: 114588 - RNA, 22 nt, Human
uuucuagucuucccuaccuccc

SEQ ID NO: 114589 - RNA, 22 nt, Human
uuucuaguggguauucccuguu

SEQ ID NO: 114590 - RNA, 22 nt, Human
uuucuaguucuaccacaguaau

SEQ ID NO: 114591 - RNA, 19 nt, Human
uuucuaguuucagcuuguc

SEQ ID NO: 114592 - RNA, 22 nt, Human
uuucuauaaaaagugcuaggau

SEQ ID NO: 114593 - RNA, 22 nt, Human
uuucuauaacuggacuggauug

SEQ ID NO: 114594 - RNA, 22 nt, Human
uuucuauaucuuaccuauugua

SEQ ID NO: 114595 - RNA, 22 nt, Human
uuucuauaugaggagcuaaagu

SEQ ID NO: 114596 - RNA, 22 nt, Human
uuucuaucuaggguuagaguga

SEQ ID NO: 114597 - RNA, 22 nt, Human
uuucucaaaagacagaagugaa

SEQ ID NO: 114598 - RNA, 23 nt, Human
uuucucaaagaguggcagcuuca

SEQ ID NO: 114599 - RNA, 22 nt, Human
uuucucaaguacugcacaugaa

SEQ ID NO: 114600 - RNA, 20 nt, Human
uuucucagaacaguggcugc

SEQ ID NO: 114601 - RNA, 22 nt, Human
uuucucagaggagccagacggu

SEQ ID NO: 114602 - RNA, 22 nt, Human
uuucucagccuccuugcuggag

SEQ ID NO: 114603 - RNA, 22 nt, Human
uuucucagggaggagucaagcc

SEQ ID NO: 114604 - RNA, 22 nt, Human
uuucucagugcaguuucuacgu

SEQ ID NO: 114605 - RNA, 22 nt, Human
uuucucaguuacuagcuguggu

SEQ ID NO: 114606 - RNA, 22 nt, Human
uuucucaguugugcgagcagca

SEQ ID NO: 114607 - RNA, 22 nt, Human
uuucucauuuagaguggcaggg

SEQ ID NO: 114608 - RNA, 20 nt, Human
uuucucccaagugcaagggu

SEQ ID NO: 114609 - RNA, 22 nt, Human
uuucuccuugugucuccuuuga

SEQ ID NO: 114610 - RNA, 22 nt, Human
uuucucuauuaggggcuagcuu

SEQ ID NO: 114611 - RNA, 22 nt, Human
uuucucugugccauuuccauaa

SEQ ID NO: 114612 - RNA, 22 nt, Human
uuucucuguucucuaacuguaa

SEQ ID NO: 114613 - RNA, 22 nt, Human
uuucugaaaucucuuuugagga

SEQ ID NO: 114614 - RNA, 22 nt, Human
uuucugaagauacagcuuugcu

SEQ ID NO: 114615 - RNA, 23 nt, Human
uuucugaaguugagauggacuuu

SEQ ID NO: 114616 - RNA, 22 nt, Human
uuucugaauuccuaggauguug

SEQ ID NO: 114617 - RNA, 22 nt, Human
uuucugauucucacuuuggcau

SEQ ID NO: 114618 - RNA, 20 nt, Human
uuucugcagggagcugggcu

SEQ ID NO: 114619 - RNA, 22 nt, Human
uuucugcagguauugcauaagu

SEQ ID NO: 114620 - RNA, 22 nt, Human
uuucugcagucucucagaagcc

SEQ ID NO: 114621 - RNA, 22 nt, Human
uuucugcaucucuacaguuguu

SEQ ID NO: 114622 - RNA, 22 nt, Human
uuucugccaaccauuuaaacuc

SEQ ID NO: 114623 - RNA, 22 nt, Human
uuucugcuaaucuuuuacugag

SEQ ID NO: 114624 - RNA, 22 nt, Human
uuucugcugugcuuucuugcgu

SEQ ID NO: 114625 - RNA, 22 nt, Human
uuucugcuguguaaaaugaggg

SEQ ID NO: 114626 - RNA, 22 nt, Human
uuucugcuuaggacucugugga

SEQ ID NO: 114627 - RNA, 22 nt, Human
uuucuggaaacuguaaagagga

SEQ ID NO: 114628 - RNA, 22 nt, Human
uuucuggaaagcaagauacauu

SEQ ID NO: 114629 - RNA, 22 nt, Human
uuucuggaaccacaaaaguaug

SEQ ID NO: 114630 - RNA, 19 nt, Human
ugggcagguucaguaaugg

SEQ ID NO: 114631 - RNA, 19 nt, Human
ugggcagugccagggcuua

SEQ ID NO: 114632 - RNA, 22 nt, Human
ugggcaguggcugggccucucu

SEQ ID NO: 114633 - RNA, 22 nt, Human
ugggcaucucugcugccggccu

SEQ ID NO: 114634 - RNA, 22 nt, Human
ugggcaugaagaaggaaguggg

SEQ ID NO: 114635 - RNA, 22 nt, Human
ugggcauggacuguggagccgc

SEQ ID NO: 114636 - RNA, 22 nt, Human
ugggccaacaggaggucuagga

SEQ ID NO: 114637 - RNA, 22 nt, Human
ugggccacacacagaagaauca

SEQ ID NO: 114638 - RNA, 22 nt, Human
ugggccacagagugagaaaugu

SEQ ID NO: 114639 - RNA, 22 nt, Human
ugggccacggggguggagagcu

SEQ ID NO: 114640 - RNA, 22 nt, Human
ugggccacgucaucucccacaa

SEQ ID NO: 114641 - RNA, 22 nt, Human
ugggccacugaggguggucauu

SEQ ID NO: 114642 - RNA, 21 nt, Human
ugggccagaucugaguuucua

SEQ ID NO: 114643 - RNA, 22 nt, Human
ugggccagcaauugcugcucag

SEQ ID NO: 114644 - RNA, 22 nt, Human
ugggccagcacugggugcucau

SEQ ID NO: 114645 - RNA, 22 nt, Human
ugggccaggcaugugaucagca

SEQ ID NO: 114646 - RNA, 23 nt, Human
ugggccaguucuguugaaagcca

SEQ ID NO: 114647 - RNA, 22 nt, Human
ugggcccagguccugggagaag

SEQ ID NO: 114648 - RNA, 22 nt, Human
ugggcccugguggccaugccuc

SEQ ID NO: 114649 - RNA, 22 nt, Human
ugggcccuuaugaagcucaaga

SEQ ID NO: 114650 - RNA, 22 nt, Human
ugggccucaguuuccuuaggau

SEQ ID NO: 114651 - RNA, 22 nt, Human
ugggccucaugcccagccaccc

SEQ ID NO: 114652 - RNA, 22 nt, Human
ugggccucccaugucuuaggga

SEQ ID NO: 114653 - RNA, 22 nt, Human
ugggccucuggguuagucccua

SEQ ID NO: 114654 - RNA, 22 nt, Human
ugggccucuguuuccucaucug

SEQ ID NO: 114655 - RNA, 22 nt, Human
ugggccugagcucaccaggggc

SEQ ID NO: 114656 - RNA, 21 nt, Human
ugggccugauucccaggguca

SEQ ID NO: 114657 - RNA, 22 nt, Human
uggagguggugcccagcaauuu

SEQ ID NO: 114658 - RNA, 22 nt, Human
uggagguguccaacucgugggu

SEQ ID NO: 114659 - RNA, 16 nt, Human
uggagguguuucuagu

SEQ ID NO: 114660 - RNA, 22 nt, Human
uggagucacagugaccugaguc

SEQ ID NO: 114661 - RNA, 22 nt, Human
uggagucacuuucucuuccagu

SEQ ID NO: 114662 - RNA, 22 nt, Human
uggagucagaaugcgacaggcc

SEQ ID NO: 114663 - RNA, 22 nt, Human
uggaguccuaguauuggaaaca

SEQ ID NO: 114664 - RNA, 22 nt, Human
uggagugaaguaaagaggacaa

SEQ ID NO: 114665 - RNA, 22 nt, Human
uggagugcaauaguaauaaggu

SEQ ID NO: 114666 - RNA, 22 nt, Human
uggagugggcaauguaggcaag

SEQ ID NO: 114667 - RNA, 22 nt, Human
uggaguucauccaugacagcuu

SEQ ID NO: 114668 - RNA, 22 nt, Human
uggaguucucaggugagggcuu

SEQ ID NO: 114669 - RNA, 23 nt, Human
uggaguugauguccuucugugcu

SEQ ID NO: 114670 - RNA, 22 nt, Human
uggaguugcagcuaccagacau

SEQ ID NO: 114671 - RNA, 20 nt, Human
uggaguuguggcaguuugga

SEQ ID NO: 114672 - RNA, 22 nt, Human
uggauaaaacguucugaaaaac

SEQ ID NO: 114673 - RNA, 22 nt, Human
uggauaaaugugcagaugacau

SEQ ID NO: 114674 - RNA, 22 nt, Human
uggauaccugguuuuuauuuac

SEQ ID NO: 114675 - RNA, 22 nt, Human
uggauauccuuguuaacuuucu

SEQ ID NO: 114676 - RNA, 22 nt, Human
uggauaugggccauggaaaaaa

SEQ ID NO: 114677 - RNA, 23 nt, Human
uggaucaauaagccugacugugu

SEQ ID NO: 114678 - RNA, 22 nt, Human
uggaucaucuuaagaagugauu

SEQ ID NO: 114679 - RNA, 22 nt, Human
uggauccugcacugaguggagu

SEQ ID NO: 114680 - RNA, 22 nt, Human
uggaucuaucuccagggguccu

SEQ ID NO: 114681 - RNA, 18 nt, Human
uggaucuuuaugaggcug

SEQ ID NO: 114682 - RNA, 22 nt, Human
uggaugaaauauugcauuuaug

SEQ ID NO: 114683 - RNA, 22 nt, Human
uggaugcuauggaguauuuaga

SEQ ID NO: 114684 - RNA, 22 nt, Human
uggaugcugagaacacugccug

SEQ ID NO: 114685 - RNA, 22 nt, Human
uggaugcuuaaaucguuugaau

SEQ ID NO: 114686 - RNA, 22 nt, Human
uggaugucauaguuggauauac

SEQ ID NO: 114687 - RNA, 22 nt, Human
uggauucucaugggaccaguag

SEQ ID NO: 114688 - RNA, 22 nt, Human
uggauucugggagaguucuaua

SEQ ID NO: 114689 - RNA, 22 nt, Human
uggauugauaagagacaaguga

SEQ ID NO: 114690 - RNA, 22 nt, Human
uggauuuaaggcagagagggcc

SEQ ID NO: 114691 - RNA, 22 nt, Human
uggauuuaauggaugaggggca

SEQ ID NO: 114692 - RNA, 22 nt, Human
uggauuucagcaagggugggug

SEQ ID NO: 114693 - RNA, 22 nt, Human
uggauuucuccagcucuccauu

SEQ ID NO: 114694 - RNA, 22 nt, Human
uggcaaaacccacaauuauauc

SEQ ID NO: 114695 - RNA, 22 nt, Human
uggcaaacuggaggaagcccug

SEQ ID NO: 114696 - RNA, 22 nt, Human
uggcaaagaugaagcauuucgu

SEQ ID NO: 114697 - RNA, 22 nt, Human
uggcaaagcuagacauucccuc

SEQ ID NO: 114698 - RNA, 22 nt, Human
uggcaaaggcgcucacaugccu

SEQ ID NO: 114699 - RNA, 22 nt, Human
uggcaaaggggaccauguugaa

SEQ ID NO: 114700 - RNA, 22 nt, Human
uggcaaaguaauuggguuucuc

SEQ ID NO: 114701 - RNA, 22 nt, Human
uggcaaaguaucugucccagcu

SEQ ID NO: 114702 - RNA, 22 nt, Human
uggcaaagugacuccuuggggc

SEQ ID NO: 114703 - RNA, 22 nt, Human
uggcaaccgcauggccugcuuc

SEQ ID NO: 114704 - RNA, 22 nt, Human
uggcaagaaacugaggccugcu

SEQ ID NO: 114705 - RNA, 22 nt, Human
uggcaagcucguuugggucaga

SEQ ID NO: 114706 - RNA, 23 nt, Human
uggcaaggaaugggauggagacu

SEQ ID NO: 114707 - RNA, 22 nt, Human
uggcaauacauaaucuuaaugg

SEQ ID NO: 114708 - RNA, 22 nt, Human
uggcaauaugcuuucaguggcc

SEQ ID NO: 114709 - RNA, 22 nt, Human
uggcaauuucagaaaauagaau

SEQ ID NO: 114710 - RNA, 22 nt, Human
uggcaauuuguagaguaaauua

SEQ ID NO: 114711 - RNA, 22 nt, Human
uggcaauuuuaggugguuuagu

SEQ ID NO: 114712 - RNA, 22 nt, Human
uggcacagacagaucaggaguc

SEQ ID NO: 114713 - RNA, 22 nt, Human
uggcacagacugggccaaggaa

SEQ ID NO: 114714 - RNA, 22 nt, Human
uggcacagcccggauucuauga

SEQ ID NO: 114715 - RNA, 22 nt, Human
uggcacauagaaaaggaucaau

SEQ ID NO: 114716 - RNA, 22 nt, Human
uggcacauagcagguacucagu

SEQ ID NO: 114717 - RNA, 22 nt, Human
uggcacauaguaggugcucaau

SEQ ID NO: 114718 - RNA, 22 nt, Human
uggcaccagcaccuagaugggg

SEQ ID NO: 114719 - RNA, 20 nt, Human
uggcaccaggugguggcccc

SEQ ID NO: 114720 - RNA, 22 nt, Human
uggcaccauguuggcaaauguu

SEQ ID NO: 114721 - RNA, 22 nt, Human
uggcacugcacuuuaagauuua

SEQ ID NO: 114722 - RNA, 22 nt, Human
uggcacugccaaccugcuaggu

SEQ ID NO: 114723 - RNA, 22 nt, Human
uggcacuguagccacuacugcc

SEQ ID NO: 114724 - RNA, 22 nt, Human
uggcacuuccacuguggcugcu

SEQ ID NO: 114725 - RNA, 22 nt, Human
uggcacuugauauuugauuugc

SEQ ID NO: 114726 - RNA, 22 nt, Human
uggcagaaagaaccaugugcaa

SEQ ID NO: 114727 - RNA, 22 nt, Human
uggcagaccugaagguucggcg

SEQ ID NO: 114728 - RNA, 22 nt, Human
uggcagagccuugccaaacucc

SEQ ID NO: 114729 - RNA, 22 nt, Human
uggcagaggaaaaagucacugg

SEQ ID NO: 114730 - RNA, 19 nt, Human
uggcagaggacaaggacuu

SEQ ID NO: 114731 - RNA, 22 nt, Human
uggcagaggagaauuaagauua

SEQ ID NO: 114732 - RNA, 16 nt, Human
uggcagagguucagcc

SEQ ID NO: 114733 - RNA, 22 nt, Human
uggcagaguaggauggcccugu

SEQ ID NO: 114734 - RNA, 22 nt, Human
uggcagagucaucacaucugga

SEQ ID NO: 114735 - RNA, 22 nt, Human
uggcagagucucuccuuuccag

SEQ ID NO: 114736 - RNA, 22 nt, Human
uggcagagucugggcuugggca

SEQ ID NO: 114737 - RNA, 22 nt, Human
uggcagagugcggcauccccug

SEQ ID NO: 114738 - RNA, 22 nt, Human
uggcagaguggaccauacucaa

SEQ ID NO: 114739 - RNA, 22 nt, Human
ugcuuggcuagcuuggcagcuc

SEQ ID NO: 114740 - RNA, 22 nt, Human
ugcuuggcuuucugagcuucug

SEQ ID NO: 114741 - RNA, 22 nt, Human
ugcuugggcggccagcauggcg

SEQ ID NO: 114742 - RNA, 22 nt, Human
ugcuuguauucauaucacagcu

SEQ ID NO: 114743 - RNA, 22 nt, Human
ugcuuguccgaggugaguacuu

SEQ ID NO: 114744 - RNA, 22 nt, Human
ugcuuuaaccaucuuguuugga

SEQ ID NO: 114745 - RNA, 22 nt, Human
ugcuuuaagacacuaaguuuga

SEQ ID NO: 114746 - RNA, 22 nt, Human
ugcuuuaccuucccagaaacca

SEQ ID NO: 114747 - RNA, 22 nt, Human
ugcuuuaguucaacaugccaaa

SEQ ID NO: 114748 - RNA, 22 nt, Human
ugcuuuauaacuuaguuuaugg

SEQ ID NO: 114749 - RNA, 22 nt, Human
ugcuuuauagacaaggaaguag

SEQ ID NO: 114750 - RNA, 22 nt, Human
ugcuuuauaucucucuucuuag

SEQ ID NO: 114751 - RNA, 22 nt, Human
ugcuuuaucaaagcuauaguga

SEQ ID NO: 114752 - RNA, 22 nt, Human
ugcuuuaucugugagaaccuga

SEQ ID NO: 114753 - RNA, 18 nt, Human
ugcuuuaugcuuauauaa

SEQ ID NO: 114754 - RNA, 22 nt, Human
ugcuuuauguuaucagaagggu

SEQ ID NO: 114755 - RNA, 22 nt, Human
ugcuuuauucaggguuuacccc

SEQ ID NO: 114756 - RNA, 22 nt, Human
ugcuuuauucgacaucugguag

SEQ ID NO: 114757 - RNA, 22 nt, Human
ugcuuuauugcaucaguguggg

SEQ ID NO: 114758 - RNA, 22 nt, Human
ugcuuuauuuuaaauaugccau

SEQ ID NO: 114759 - RNA, 22 nt, Human
ugcuuucaccuguuugcaccca

SEQ ID NO: 114760 - RNA, 22 nt, Human
ugcuuucagcugguaaagaaac

SEQ ID NO: 114761 - RNA, 22 nt, Human
ugcuuucauugccugcgguuuu

SEQ ID NO: 114762 - RNA, 18 nt, Human
ugcuuucuagcuucagau

SEQ ID NO: 114763 - RNA, 22 nt, Human
ugcuuucugcucuggaaacagg

SEQ ID NO: 114764 - RNA, 22 nt, Human
ugcuuucuuuagcuccugaguc

SEQ ID NO: 114765 - RNA, 22 nt, Human
ugcuuugaaagauaauacuguc

SEQ ID NO: 114766 - RNA, 22 nt, Human
ugcuuugcaaauaauagaaugu

SEQ ID NO: 114767 - RNA, 22 nt, Human
ugcuuugcaggaacccuaagca

SEQ ID NO: 114768 - RNA, 21 nt, Human
ugcuuugcagguggauuuagu

SEQ ID NO: 114769 - RNA, 19 nt, Human
ugcuuugcaucugauuguu

SEQ ID NO: 114770 - RNA, 22 nt, Human
ugcuuugccagacaguucccuu

SEQ ID NO: 114771 - RNA, 21 nt, Human
ugcuuugcucguucccagagu

SEQ ID NO: 114772 - RNA, 22 nt, Human
ugcuuugcucucacuguaaggu

SEQ ID NO: 114773 - RNA, 22 nt, Human
ugggccugcuggggcauuuuca

SEQ ID NO: 114774 - RNA, 23 nt, Human
ugggccuggaaagccuuagagag

SEQ ID NO: 114775 - RNA, 22 nt, Human
ugggccuggacaucuguauuuu

SEQ ID NO: 114776 - RNA, 22 nt, Human
ugggccuggagcccuggagagu

SEQ ID NO: 114777 - RNA, 22 nt, Human
ugggccugggucuuugcugcca

SEQ ID NO: 114778 - RNA, 21 nt, Human
ugggccugucccucuuggagg

SEQ ID NO: 114779 - RNA, 20 nt, Human
ugggccuguggcagaagucu

SEQ ID NO: 114780 - RNA, 22 nt, Human
ugggccuguuucccuucagggc

SEQ ID NO: 114781 - RNA, 22 nt, Human
ugggccuugcugagcuauggag

SEQ ID NO: 114782 - RNA, 23 nt, Human
ugggcgaggcaggaguggagcac

SEQ ID NO: 114783 - RNA, 22 nt, Human
ugggcuacucugggagccuaac

SEQ ID NO: 114784 - RNA, 22 nt, Human
ugggcuagcagggaagagagac

SEQ ID NO: 114785 - RNA, 22 nt, Human
ugggcucacuggggcagggacc

SEQ ID NO: 114786 - RNA, 22 nt, Human
ugggcucagccaugaccuccac

SEQ ID NO: 114787 - RNA, 22 nt, Human
ugggcucagccuucauguggcc

SEQ ID NO: 114788 - RNA, 22 nt, Human
ugggcucaggaccccagaggcc

SEQ ID NO: 114789 - RNA, 22 nt, Human
ugggcucagggucgaggacuuu

SEQ ID NO: 114790 - RNA, 22 nt, Human
ugggcucagucugcaccugcgg

SEQ ID NO: 114791 - RNA, 22 nt, Human
ugggcucaugcuggagaugaga

SEQ ID NO: 114792 - RNA, 22 nt, Human
ugggcuccggcggccucaggcu

SEQ ID NO: 114793 - RNA, 22 nt, Human
ugggcucucuggcaggaaggcu

SEQ ID NO: 114794 - RNA, 20 nt, Human
ugggcucugcuuccuggagu

SEQ ID NO: 114795 - RNA, 22 nt, Human
ugggcucugugccagguuggug

SEQ ID NO: 114796 - RNA, 22 nt, Human
ugggcugcacccucagccucug

SEQ ID NO: 114797 - RNA, 18 nt, Human
ugggcugccuggccucug

SEQ ID NO: 114798 - RNA, 22 nt, Human
ugggcugcugucugcacaugcu

SEQ ID NO: 114799 - RNA, 22 nt, Human
ugggcuggcguggagaguuuag

SEQ ID NO: 114800 - RNA, 22 nt, Human
ugggcuuuaucaugggucuggu

SEQ ID NO: 114801 - RNA, 22 nt, Human
uggggaaaacagaggaaauuag

SEQ ID NO: 114802 - RNA, 22 nt, Human
uggggaaagacauucauacagu

SEQ ID NO: 114803 - RNA, 22 nt, Human
uggggaaagggauggcucccgc

SEQ ID NO: 114804 - RNA, 22 nt, Human
uggggaagaauaauguauguac

SEQ ID NO: 114805 - RNA, 22 nt, Human
uggggaagggcacccuggagac

SEQ ID NO: 114806 - RNA, 22 nt, Human
uggggacacagagguucguugg

SEQ ID NO: 114807 - RNA, 22 nt, Human
uggggacaggagacuuacagcu

SEQ ID NO: 114808 - RNA, 22 nt, Human
uggggacagggcucagcaauuu

SEQ ID NO: 114809 - RNA, 22 nt, Human
uggggacauagccagucuggcu

SEQ ID NO: 114810 - RNA, 22 nt, Human
uggggacauucaugcagguugu

SEQ ID NO: 114811 - RNA, 22 nt, Human
uggggaccagauuagaccaugg

SEQ ID NO: 114812 - RNA, 22 nt, Human
uggggagaaaugucuuuguucc

SEQ ID NO: 114813 - RNA, 22 nt, Human
uggggagaagcaauagacucua

SEQ ID NO: 114814 - RNA, 22 nt, Human
uggggagacuggccgagauccu

SEQ ID NO: 114815 - RNA, 22 nt, Human
uggggagagauugaggaguuuu

SEQ ID NO: 114816 - RNA, 22 nt, Human
uggggagagguaucauugagau

SEQ ID NO: 114817 - RNA, 22 nt, Human
uggggagauuguuaaauuuaga

SEQ ID NO: 114818 - RNA, 22 nt, Human
uggggagguaacaauuucaggc

SEQ ID NO: 114819 - RNA, 20 nt, Human
uggggaguugagcacgagca

SEQ ID NO: 114820 - RNA, 22 nt, Human
uggggaugaaacccaggcaucu

SEQ ID NO: 114821 - RNA, 22 nt, Human
uggggauggaugaaucuuugcu

SEQ ID NO: 114822 - RNA, 22 nt, Human
uggggcacagcugagaaagcac

SEQ ID NO: 114823 - RNA, 22 nt, Human
uggggcagaguaggauuuuggc

SEQ ID NO: 114824 - RNA, 22 nt, Human
uggggccacacugaucucccag

SEQ ID NO: 114825 - RNA, 22 nt, Human
uggggccagagauggggcgcag

SEQ ID NO: 114826 - RNA, 22 nt, Human
uggggccagagcugcagggagc

SEQ ID NO: 114827 - RNA, 22 nt, Human
uggggccagcggggaggacuca

SEQ ID NO: 114828 - RNA, 22 nt, Human
uggggccugagguggagcugca

SEQ ID NO: 114829 - RNA, 22 nt, Human
uggggccugugacggguccaga

SEQ ID NO: 114830 - RNA, 22 nt, Human
uggggcuagaauccugcaggaa

SEQ ID NO: 114831 - RNA, 22 nt, Human
ugggggaacuguugcgcgcggg

SEQ ID NO: 114832 - RNA, 22 nt, Human
ugggggagaguuuagaugauuu

SEQ ID NO: 114833 - RNA, 22 nt, Human
ugggggcugggaugucacuuuc

SEQ ID NO: 114834 - RNA, 22 nt, Human
ugggggucaggaugaggccuug

SEQ ID NO: 114835 - RNA, 22 nt, Human
uggggguccuccucugcuuaag

SEQ ID NO: 114836 - RNA, 21 nt, Human
ugggggucuucacgguguugu

SEQ ID NO: 114837 - RNA, 22 nt, Human
ugggggugaaagucuggacagu

SEQ ID NO: 114838 - RNA, 22 nt, Human
ugggggugugccagggaccucc

SEQ ID NO: 114839 - RNA, 22 nt, Human
ugggguaggagucagcgagaga

SEQ ID NO: 114840 - RNA, 22 nt, Human
ugggguagguaugaaaacuagg

SEQ ID NO: 114841 - RNA, 19 nt, Human
uggggucaagagaggcuuc

SEQ ID NO: 114842 - RNA, 17 nt, Human
ugggguccccgauggug

SEQ ID NO: 114843 - RNA, 22 nt, Human
ugggguccucucacuuggaggg

SEQ ID NO: 114844 - RNA, 22 nt, Human
uggggugaggcagccacauuua

SEQ ID NO: 114845 - RNA, 22 nt, Human
ugggguggauagaaagugaugu

SEQ ID NO: 114846 - RNA, 17 nt, Human
ugggguguugaaggguu

SEQ ID NO: 114847 - RNA, 22 nt, Human
ugggguucuuuguuuccugccu

SEQ ID NO: 114848 - RNA, 22 nt, Human
uggugaggccaaagccaugaca

SEQ ID NO: 114849 - RNA, 22 nt, Human
uggugaucagucaacugucuuc

SEQ ID NO: 114850 - RNA, 22 nt, Human
uggugcagacaggagccccgcu

SEQ ID NO: 114851 - RNA, 22 nt, Human
uggugcagaugcaggucacugg

SEQ ID NO: 114852 - RNA, 22 nt, Human
uggugcaggccaagcugcgagc

SEQ ID NO: 114853 - RNA, 22 nt, Human
uggugcaguucccagggccggg

SEQ ID NO: 114854 - RNA, 23 nt, Human
uggugccucagaagcagugggcu

SEQ ID NO: 114855 - RNA, 21 nt, Human
uggugccuucagcugucuuuu

SEQ ID NO: 114856 - RNA, 22 nt, Human
uggugccuugggccuacagcgc

SEQ ID NO: 114857 - RNA, 19 nt, Human
uggugcgcuguuccugagc

SEQ ID NO: 114858 - RNA, 22 nt, Human
uggugcugauaauggcaggauu

SEQ ID NO: 114859 - RNA, 22 nt, Human
uggugcugccaccuccucugcu

SEQ ID NO: 114860 - RNA, 22 nt, Human
uggugcugccaggcuccugcca

SEQ ID NO: 114861 - RNA, 22 nt, Human
uggugcugccucagaugccuua

SEQ ID NO: 114862 - RNA, 22 nt, Human
uggugcugucuacuuugugcag

SEQ ID NO: 114863 - RNA, 22 nt, Human
ugguggaaauaaacauccaauu

SEQ ID NO: 114864 - RNA, 22 nt, Human
ugguggacaucccagggugaaa

SEQ ID NO: 114865 - RNA, 21 nt, Human
ugguggaccagugcugggaga

SEQ ID NO: 114866 - RNA, 22 nt, Human
ugguggaccuggcauugaaccu

SEQ ID NO: 114867 - RNA, 22 nt, Human
ugguggagggaacuauuuccag

SEQ ID NO: 114868 - RNA, 22 nt, Human
ugguggaggugcauuucggagc

SEQ ID NO: 114869 - RNA, 22 nt, Human
ugguggcacugacaucagacac

SEQ ID NO: 114870 - RNA, 22 nt, Human
ugguggcagagcaagagcugga

SEQ ID NO: 114871 - RNA, 22 nt, Human
ugguggcagcaggagggccccu

SEQ ID NO: 114872 - RNA, 22 nt, Human
ugguggcaugauagugugaaug

SEQ ID NO: 114873 - RNA, 22 nt, Human
ugguggccuugauggcaucugc

SEQ ID NO: 114874 - RNA, 22 nt, Human
ugguggcugcucccugccuuga

SEQ ID NO: 114875 - RNA, 22 nt, Human
uggugggaguccgcugugcugc

SEQ ID NO: 114876 - RNA, 22 nt, Human
uggugguccacaaauggguaca

SEQ ID NO: 114877 - RNA, 15 nt, Human
uggugguguugagac

SEQ ID NO: 114878 - RNA, 22 nt, Human
uggugucuccauccugcccugc

SEQ ID NO: 114879 - RNA, 22 nt, Human
uggugucuuggaaguaggugcu

SEQ ID NO: 114880 - RNA, 22 nt, Human
ugguguuuaaugggcuguuuau

SEQ ID NO: 114881 - RNA, 22 nt, Human
ugguuaaaugggaagagcaaca

SEQ ID NO: 114882 - RNA, 22 nt, Human
ugguuacauauccuuuggagcc

SEQ ID NO: 114883 - RNA, 22 nt, Human
ugguuacccagucgcuggaguu

SEQ ID NO: 114884 - RNA, 22 nt, Human
ugguuagacacaugcaugucau

SEQ ID NO: 114885 - RNA, 22 nt, Human
ugguuauaaaaguccucucauu

SEQ ID NO: 114886 - RNA, 22 nt, Human
ugguucauagccucacaggaua

SEQ ID NO: 114887 - RNA, 22 nt, Human
ugguucaugcucauggugauag

SEQ ID NO: 114888 - RNA, 22 nt, Human
ugguuccaguuuucaauagagc

SEQ ID NO: 114889 - RNA, 22 nt, Human
ugguuccuacgcacauugaauu

SEQ ID NO: 114890 - RNA, 22 nt, Human
uuugugauuaauuuucaaccuc

SEQ ID NO: 114891 - RNA, 22 nt, Human
uuugugcaauuuauguacuaua

SEQ ID NO: 114892 - RNA, 22 nt, Human
uuugugcacauugcuuuucuau

SEQ ID NO: 114893 - RNA, 22 nt, Human
uuugugcagauaggagacaauc

SEQ ID NO: 114894 - RNA, 22 nt, Human
uuugugcaggugugucagaucg

SEQ ID NO: 114895 - RNA, 22 nt, Human
uuugugcauaaagggcuauagu

SEQ ID NO: 114896 - RNA, 22 nt, Human
uuuguggauggaaaauagcagg

SEQ ID NO: 114897 - RNA, 22 nt, Human
uuugugugguggauacugggua

SEQ ID NO: 114898 - RNA, 22 nt, Human
uuuguguguauauccuuccaga

SEQ ID NO: 114899 - RNA, 22 nt, Human
uuuguguguguauaggaaagga

SEQ ID NO: 114900 - RNA, 22 nt, Human
uuuguguuggaagaaaugcuac

SEQ ID NO: 114901 - RNA, 22 nt, Human
uuuguguuguuuuaagccacua

SEQ ID NO: 114902 - RNA, 22 nt, Human
uuuguguuuguacaaugcacua

SEQ ID NO: 114903 - RNA, 22 nt, Human
uuuguguuuucacuagcagugu

SEQ ID NO: 114904 - RNA, 22 nt, Human
uuuguguuuucccauacuauug

SEQ ID NO: 114905 - RNA, 22 nt, Human
uuuguuaaauauuuauugagug

SEQ ID NO: 114906 - RNA, 22 nt, Human
uuuguuaaggaguauugcuucu

SEQ ID NO: 114907 - RNA, 22 nt, Human
uuuguuacauuaaaaaguaggu

SEQ ID NO: 114908 - RNA, 22 nt, Human
uuuguuagagugugggaggcug

SEQ ID NO: 114909 - RNA, 22 nt, Human
uuuguucaaaaauuauaagaua

SEQ ID NO: 114910 - RNA, 22 nt, Human
uuuguucaauccagacaauagc

SEQ ID NO: 114911 - RNA, 22 nt, Human
uuuguucacugauguaucccaa

SEQ ID NO: 114912 - RNA, 21 nt, Human
uuuguucaggggcaaaguuaa

SEQ ID NO: 114913 - RNA, 22 nt, Human
uuuguucauaauggcaaagaga

SEQ ID NO: 114914 - RNA, 22 nt, Human
uuuguucauuaaaagugcugua

SEQ ID NO: 114915 - RNA, 22 nt, Human
uuuguucuagaucguguuugug

SEQ ID NO: 114916 - RNA, 22 nt, Human
uuuguucuauuuuagagaugaa

SEQ ID NO: 114917 - RNA, 22 nt, Human
uuuguucugcaucacagaaaaa

SEQ ID NO: 114918 - RNA, 22 nt, Human
uuuguugacaucccuguacuuu

SEQ ID NO: 114919 - RNA, 22 nt, Human
uuuguugguugcacuggugggu

SEQ ID NO: 114920 - RNA, 22 nt, Human
uuuguuucugcaauaccuauag

SEQ ID NO: 114921 - RNA, 22 nt, Human
uuuuaaaggcuguaugaccaag

SEQ ID NO: 114922 - RNA, 22 nt, Human
uuuuaagaugcuaguauuucag

SEQ ID NO: 114923 - RNA, 22 nt, Human
uuuuaagcaaaagaauggugug

SEQ ID NO: 114924 - RNA, 19 nt, Human
uuuuaaguccucucuauuc

SEQ ID NO: 114925 - RNA, 22 nt, Human
uuuuaaguuggauugcuaagua

SEQ ID NO: 114926 - RNA, 22 nt, Human
uuuuaaguuuauuccaguacau

SEQ ID NO: 114927 - RNA, 22 nt, Human
uuuuaaucaugcuucuaugucc

SEQ ID NO: 114928 - RNA, 22 nt, Human
uuuuacaccucagaugagcaga

SEQ ID NO: 114929 - RNA, 22 nt, Human
uuuuacacuucgguugugugca

SEQ ID NO: 114930 - RNA, 22 nt, Human
uuuuacaggucauagguauagu

SEQ ID NO: 114931 - RNA, 22 nt, Human
uuuuacaggugugagccaccau

SEQ ID NO: 114932 - RNA, 18 nt, Human
uuuuacucauagcaggcc

SEQ ID NO: 114933 - RNA, 22 nt, Human
uuuuacuucauuccugacuuca

SEQ ID NO: 114934 - RNA, 22 nt, Human
uuuuagaaagaucccuggcagg

SEQ ID NO: 114935 - RNA, 22 nt, Human
uuuuagaaguucaugugggauu

SEQ ID NO: 114936 - RNA, 20 nt, Human
uuuuagcacuuguuauggug

SEQ ID NO: 114937 - RNA, 23 nt, Human
uuuuagugacuccuuuaucugcc

SEQ ID NO: 114938 - RNA, 22 nt, Human
uuuuaguuacugcaguagcaaa

SEQ ID NO: 114939 - RNA, 22 nt, Human
uuuuauacacaugaacaugcag

SEQ ID NO: 114940 - RNA, 22 nt, Human
uuuuauacuuaagacagaguuu

SEQ ID NO: 114941 - RNA, 22 nt, Human
uuuuauagcugaauaguauucc

SEQ ID NO: 114942 - RNA, 22 nt, Human
uuuuaucaaucauuaagacauu

SEQ ID NO: 114943 - RNA, 22 nt, Human
uuuuaucauuacccagcugaaa

SEQ ID NO: 114944 - RNA, 22 nt, Human
uuuuaugaagauaauuuucuga

SEQ ID NO: 114945 - RNA, 22 nt, Human
uuuuaugagugucccucugugg

SEQ ID NO: 114946 - RNA, 22 nt, Human
uuuuaugauugagcuggcuaca

SEQ ID NO: 114947 - RNA, 20 nt, Human
uuuuaugucaccuuccuguc

SEQ ID NO: 114948 - RNA, 22 nt, Human
uuuuaugugcuggacuggcagu

SEQ ID NO: 114949 - RNA, 22 nt, Human
uuuuauguugcuauaauaggua

SEQ ID NO: 114950 - RNA, 22 nt, Human
uuuuauuaguggcuagaugggg

SEQ ID NO: 114951 - RNA, 22 nt, Human
uuuuauucucaagacaauggga

SEQ ID NO: 114952 - RNA, 22 nt, Human
uuuuauugucaaugaagacaga

SEQ ID NO: 114953 - RNA, 16 nt, Human
uuuuauugugacagcc

SEQ ID NO: 114954 - RNA, 22 nt, Human
uuuucacaaggguccaacuagu

SEQ ID NO: 114955 - RNA, 22 nt, Human
uuuucacauugucccagcacua

SEQ ID NO: 114956 - RNA, 22 nt, Human
uuuucacuuaaggaauuucaug

SEQ ID NO: 114957 - RNA, 22 nt, Human
ugucugaaucucgguuuccuca

SEQ ID NO: 114958 - RNA, 22 nt, Human
ugucugagcgagaaaguagugu

SEQ ID NO: 114959 - RNA, 22 nt, Human
ugucugagcuggggcagacaga

SEQ ID NO: 114960 - RNA, 22 nt, Human
ugucugagcuuuaugauggaag

SEQ ID NO: 114961 - RNA, 19 nt, Human
ugucugaguaugcugacaa

SEQ ID NO: 114962 - RNA, 22 nt, Human
ugucugagucaugcagagauau

SEQ ID NO: 114963 - RNA, 22 nt, Human
ugucugaguuagcucuucucag

SEQ ID NO: 114964 - RNA, 18 nt, Human
ugucugaguucuuccauu

SEQ ID NO: 114965 - RNA, 22 nt, Human
ugucugaugauagugucucucc

SEQ ID NO: 114966 - RNA, 22 nt, Human
ugucugcagaagauggcauggg

SEQ ID NO: 114967 - RNA, 22 nt, Human
ugucugccaaagcuuccuccug

SEQ ID NO: 114968 - RNA, 22 nt, Human
ugucugccaccccaucaagcuc

SEQ ID NO: 114969 - RNA, 22 nt, Human
ugucugccauuagcccagucca

SEQ ID NO: 114970 - RNA, 22 nt, Human
ugucugcccucaacccagaggc

SEQ ID NO: 114971 - RNA, 21 nt, Human
ugucugccugcuucuucacuc

SEQ ID NO: 114972 - RNA, 22 nt, Human
ugucugcuagcugguggcaauu

SEQ ID NO: 114973 - RNA, 21 nt, Human
ugucugcugaaggcuggucac

SEQ ID NO: 114974 - RNA, 22 nt, Human
ugucugcugaugucacauagcc

SEQ ID NO: 114975 - RNA, 22 nt, Human
ugucugcugguugggagcuuaa

SEQ ID NO: 114976 - RNA, 22 nt, Human
ugucuggaugucuggagcaucg

SEQ ID NO: 114977 - RNA, 23 nt, Human
ugucuggcucauggugggucuca

SEQ ID NO: 114978 - RNA, 22 nt, Human
ugucugggagacugaucacccg

SEQ ID NO: 114979 - RNA, 22 nt, Human
ugucugggauguaauuccugcc

SEQ ID NO: 114980 - RNA, 22 nt, Human
ugucugggauguuggcagccac

SEQ ID NO: 114981 - RNA, 22 nt, Human
ugucuggggaacugugcaucca

SEQ ID NO: 114982 - RNA, 22 nt, Human
ugucugggucaccccuccuggc

SEQ ID NO: 114983 - RNA, 22 nt, Human
ugucuggguuuugggucauauu

SEQ ID NO: 114984 - RNA, 23 nt, Human
ugucugguucaugcuuauuuugg

SEQ ID NO: 114985 - RNA, 23 nt, Human
ugucugguuucuuuuauuuagca

SEQ ID NO: 114986 - RNA, 22 nt, Human
ugucugguuugaaguccaugau

SEQ ID NO: 114987 - RNA, 22 nt, Human
ugucuguauugaggugcauauu

SEQ ID NO: 114988 - RNA, 22 nt, Human
ugucugucagauauuaaguuuc

SEQ ID NO: 114989 - RNA, 17 nt, Human
ugucugucaucaguucc

SEQ ID NO: 114990 - RNA, 23 nt, Human
ugucugucauggaauuucaaggu

SEQ ID NO: 114991 - RNA, 22 nt, Human
ugucuguccaucugucugggac

SEQ ID NO: 114992 - RNA, 22 nt, Human
ugucugucugcacagcucaugg

SEQ ID NO: 114993 - RNA, 22 nt, Human
ugucugugacagaccuuugcua

SEQ ID NO: 114994 - RNA, 22 nt, Human
ugucugugaccucuuaggcaag

SEQ ID NO: 114995 - RNA, 20 nt, Human
ugucugugccacggcacucc

SEQ ID NO: 114996 - RNA, 22 nt, Human
ugucugugcccaaggcucccgg

SEQ ID NO: 114997 - RNA, 22 nt, Human
ugucuguggcaauuguggguaa

SEQ ID NO: 114998 - RNA, 22 nt, Human
ugucugugggcaacgccuccca

SEQ ID NO: 114999 - RNA, 22 nt, Human
ugucuguuauugguguauaaga

SEQ ID NO: 115000 - RNA, 22 nt, Human
ugucuuaacauaaaaggaaauc

SEQ ID NO: 115001 - RNA, 22 nt, Human
ugucuuaaguagauuacagccu

SEQ ID NO: 115002 - RNA, 22 nt, Human
ugucuuaauaguauccagguuc

SEQ ID NO: 115003 - RNA, 22 nt, Human
ugucuuauggcauguccacugg

SEQ ID NO: 115004 - RNA, 22 nt, Human
ugucuuauuaagaccagugacu

SEQ ID NO: 115005 - RNA, 22 nt, Human
ugucuucaucucagacacaguu

SEQ ID NO: 115006 - RNA, 20 nt, Human
ugucuuccagcagguguuua

SEQ ID NO: 115007 - RNA, 23 nt, Human
ugucuucgacuccugcgugcuuc

SEQ ID NO: 115008 - RNA, 22 nt, Human
ugucuucgcuacaaugaaaagg

SEQ ID NO: 115009 - RNA, 22 nt, Human
ugucuucuaccuugacagcauu

SEQ ID NO: 115010 - RNA, 22 nt, Human
ugucuucuguauucaagucuau

SEQ ID NO: 115011 - RNA, 22 nt, Human
ugucuucuucauaaggagagug

SEQ ID NO: 115012 - RNA, 22 nt, Human
ugucuugacuuuagagccagga

SEQ ID NO: 115013 - RNA, 22 nt, Human
ugucuugaggcgcaguguagau

SEQ ID NO: 115014 - RNA, 22 nt, Human
ugucuugauuagaaugaugggc

SEQ ID NO: 115015 - RNA, 22 nt, Human
ugucuugucugugagggcauug

SEQ ID NO: 115016 - RNA, 22 nt, Human
ugucuuuaagcaaacaguguuu

SEQ ID NO: 115017 - RNA, 22 nt, Human
ugucuuuacuuagaaguucagg

SEQ ID NO: 115018 - RNA, 22 nt, Human
ugucuuuagccacuugccucuu

SEQ ID NO: 115019 - RNA, 22 nt, Human
ugucuuuagccagcagucuucu

SEQ ID NO: 115020 - RNA, 22 nt, Human
ugucuuuaguugcuuagauuug

SEQ ID NO: 115021 - RNA, 22 nt, Human
ugucuuuauauauuuggaaaau

SEQ ID NO: 115022 - RNA, 22 nt, Human
ugucuuucugcaccaccucaca

SEQ ID NO: 115023 - RNA, 23 nt, Human
ugucuuugaaugggcuguagaca

SEQ ID NO: 115024 - RNA, 22 nt, Human
ugucuuuguguacaggaucgcc

SEQ ID NO: 115025 - RNA, 22 nt, Human
ugucuuuguuauuguggacagg

SEQ ID NO: 115026 - RNA, 22 nt, Human
ugucuuuuggagcaucuuucuu

SEQ ID NO: 115027 - RNA, 22 nt, Human
ugugaaaaaaguucuagaagga

SEQ ID NO: 115028 - RNA, 22 nt, Human
ugugaaaagggcuuuguacaaa

SEQ ID NO: 115029 - RNA, 22 nt, Human
ugugaaagauacuaggcagagg

SEQ ID NO: 115030 - RNA, 22 nt, Human
ugugaaaggggucacagggaaa

SEQ ID NO: 115031 - RNA, 22 nt, Human
ugugaaagucaaauuaauugaa

SEQ ID NO: 115032 - RNA, 22 nt, Human
ugugaaaucacaggcuauuuag

SEQ ID NO: 115033 - RNA, 22 nt, Human
ugugaaaugaguauauuugaau

SEQ ID NO: 115034 - RNA, 22 nt, Human
ugugaaaugcuauugugacaaa

SEQ ID NO: 115035 - RNA, 22 nt, Human
ugugaaauguggauguuaauag

SEQ ID NO: 115036 - RNA, 22 nt, Human
ugugaaauguguguauaauuaa

SEQ ID NO: 115037 - RNA, 22 nt, Human
ugugaaauugaaugcccauugc

SEQ ID NO: 115038 - RNA, 22 nt, Human
ugugaacaguaugucauuucac

SEQ ID NO: 115039 - RNA, 22 nt, Human
ugugaaccuuggugagucagua

SEQ ID NO: 115040 - RNA, 22 nt, Human
ugugaacuggcagguggacggg

SEQ ID NO: 115041 - RNA, 22 nt, Human
ugugaagaguagacauguggug

SEQ ID NO: 115042 - RNA, 22 nt, Human
ugugaaggcagagccagugaaa

SEQ ID NO: 115043 - RNA, 23 nt, Human
ugugaagguggguccaagggcug

SEQ ID NO: 115044 - RNA, 22 nt, Human
ugugaauagucagcauuuuguu

SEQ ID NO: 115045 - RNA, 22 nt, Human
ugugaauagugccgcaauaaac

SEQ ID NO: 115046 - RNA, 22 nt, Human
ugugacagaauuggucuguucu

SEQ ID NO: 115047 - RNA, 22 nt, Human
ugugacagaucucuauacauga

SEQ ID NO: 115048 - RNA, 23 nt, Human
ugugacagugacaauacugacuu

SEQ ID NO: 115049 - RNA, 22 nt, Human
ugugacagugccagcuucauag

SEQ ID NO: 115050 - RNA, 22 nt, Human
ugugaccauaauuuguaaauaa

SEQ ID NO: 115051 - RNA, 22 nt, Human
ugugacugaggcuccaagcuag

SEQ ID NO: 115052 - RNA, 22 nt, Human
ugugacuguggacuuuuguggg

SEQ ID NO: 115053 - RNA, 22 nt, Human
ugugacuuaauccuuggguggg

SEQ ID NO: 115054 - RNA, 22 nt, Human
ugugagaaaaugauugcacagu

SEQ ID NO: 115055 - RNA, 22 nt, Human
ugugagacguaggccaucgagg

SEQ ID NO: 115056 - RNA, 20 nt, Human
ugugagaggguggcuugccc

SEQ ID NO: 115057 - RNA, 22 nt, Human
ugugagcaagauucagagauuc

SEQ ID NO: 115058 - RNA, 22 nt, Human
ugugagcacuauggcuaggcuc

SEQ ID NO: 115059 - RNA, 17 nt, Human
ugugagcaucuauagaa

SEQ ID NO: 115060 - RNA, 22 nt, Human
ugugagcuuaggacagggcuau

SEQ ID NO: 115061 - RNA, 22 nt, Human
ugugaggagggucaaacugagu

SEQ ID NO: 115062 - RNA, 22 nt, Human
ugugaggauaaaaaggaaggag

SEQ ID NO: 115063 - RNA, 22 nt, Human
ugugaggauguuaaggggauga

SEQ ID NO: 115064 - RNA, 22 nt, Human
ugugaggauuaaaugcauagug

SEQ ID NO: 115065 - RNA, 22 nt, Human
ugugaggccuagacagccuggg

SEQ ID NO: 115066 - RNA, 22 nt, Human
uggcuucucaaaauaacugguu

SEQ ID NO: 115067 - RNA, 22 nt, Human
uggcuucucagaauacucugga

SEQ ID NO: 115068 - RNA, 22 nt, Human
uggcuucucaguuucauaauga

SEQ ID NO: 115069 - RNA, 22 nt, Human
uggcuucucuggcauccccauc

SEQ ID NO: 115070 - RNA, 22 nt, Human
uggcuucugcucccagaaugau

SEQ ID NO: 115071 - RNA, 22 nt, Human
uggcuucuggcuggugagaaau

SEQ ID NO: 115072 - RNA, 19 nt, Human
uggcuucuguuuucauguu

SEQ ID NO: 115073 - RNA, 16 nt, Human
uggcuucuuauuucua

SEQ ID NO: 115074 - RNA, 22 nt, Human
uggcuucuucauaugugaucuu

SEQ ID NO: 115075 - RNA, 22 nt, Human
uggcuucuugucuaauuuguua

SEQ ID NO: 115076 - RNA, 22 nt, Human
uggcuucuuuccacuguccugu

SEQ ID NO: 115077 - RNA, 22 nt, Human
uggcuucuuucuuuccaugugu

SEQ ID NO: 115078 - RNA, 23 nt, Human
uggcuugcuaauguuccaaauaa

SEQ ID NO: 115079 - RNA, 22 nt, Human
uggcuuggugagcagaguguag

SEQ ID NO: 115080 - RNA, 22 nt, Human
uggcuuuaaaaugguuugguau

SEQ ID NO: 115081 - RNA, 20 nt, Human
uggcuuuaaguuuuuugcua

SEQ ID NO: 115082 - RNA, 22 nt, Human
uggcuuuacacauccacugccu

SEQ ID NO: 115083 - RNA, 22 nt, Human
uggcuuuacuuaaacugaauca

SEQ ID NO: 115084 - RNA, 22 nt, Human
uggcuuuagguugcauguuucu

SEQ ID NO: 115085 - RNA, 22 nt, Human
uggcuuuauaaauccacugguu

SEQ ID NO: 115086 - RNA, 22 nt, Human
uggcuuugaaauccagucauua

SEQ ID NO: 115087 - RNA, 21 nt, Human
uggcuuuuauggagcucuggg

SEQ ID NO: 115088 - RNA, 22 nt, Human
uggcuuuugaaaaggugaugua

SEQ ID NO: 115089 - RNA, 22 nt, Human
ugggaaagccagcagugucacc

SEQ ID NO: 115090 - RNA, 20 nt, Human
ugggaaagucuaagugccuc

SEQ ID NO: 115091 - RNA, 22 nt, Human
ugggaaauuguauuucuauuuc

SEQ ID NO: 115092 - RNA, 22 nt, Human
ugggaacauuuugagcugagag

SEQ ID NO: 115093 - RNA, 22 nt, Human
ugggaaccacaggacucggcac

SEQ ID NO: 115094 - RNA, 22 nt, Human
ugggaaccaggacuggcugagg

SEQ ID NO: 115095 - RNA, 22 nt, Human
ugggaacugcagguguuacaua

SEQ ID NO: 115096 - RNA, 22 nt, Human
ugggaagacuccucaggaggcg

SEQ ID NO: 115097 - RNA, 22 nt, Human
ugggaagaggagcacuggaaug

SEQ ID NO: 115098 - RNA, 22 nt, Human
ugggaagaugauaauucacagu

SEQ ID NO: 115099 - RNA, 22 nt, Human
ugggaagccuagcagacagcug

SEQ ID NO: 115100 - RNA, 22 nt, Human
ugggaagcuuuaaauggguguc

SEQ ID NO: 115101 - RNA, 22 nt, Human
ugggaaggacagaacauaauug

SEQ ID NO: 115102 - RNA, 22 nt, Human
ugggaaggacgugucaguggca

SEQ ID NO: 115103 - RNA, 22 nt, Human
ugggaagggccgauggagccuc

SEQ ID NO: 115104 - RNA, 22 nt, Human
ugggaaguuguaccuucuguua

SEQ ID NO: 115105 - RNA, 18 nt, Human
ugggaaugcucaaggccc

SEQ ID NO: 115106 - RNA, 22 nt, Human
ugggaaugcugauuucaggaac

SEQ ID NO: 115107 - RNA, 22 nt, Human
ugggacagagugagcuuuggcc

SEQ ID NO: 115108 - RNA, 22 nt, Human
ugggacagauuauaagucugca

SEQ ID NO: 115109 - RNA, 22 nt, Human
ugggacaggaugaccagaaggu

SEQ ID NO: 115110 - RNA, 22 nt, Human
ugggacagggaaucugaucccc

SEQ ID NO: 115111 - RNA, 22 nt, Human
ugggaccaagucauuucuuuag

SEQ ID NO: 115112 - RNA, 22 nt, Human
ugggaccugaagcagguuggca

SEQ ID NO: 115113 - RNA, 22 nt, Human
ugggaccugcccuggccccauc

SEQ ID NO: 115114 - RNA, 22 nt, Human
ugggaccuguuacauugaguua

SEQ ID NO: 115115 - RNA, 23 nt, Human
ugggaccuguuugcccacagaug

SEQ ID NO: 115116 - RNA, 22 nt, Human
ugggacugagaauaugaugggg

SEQ ID NO: 115117 - RNA, 22 nt, Human
ugggacugcucuugcugggguc

SEQ ID NO: 115118 - RNA, 22 nt, Human
ugggacuuguguggcaguauuu

SEQ ID NO: 115119 - RNA, 22 nt, Human
ugggagaaagaacccugaguga

SEQ ID NO: 115120 - RNA, 22 nt, Human
ugggagaauauauuuaaaacuu

SEQ ID NO: 115121 - RNA, 22 nt, Human
ugggagacuccagaacugaucc

SEQ ID NO: 115122 - RNA, 23 nt, Human
ugggagacuuuucauuuuguucu

SEQ ID NO: 115123 - RNA, 22 nt, Human
ugggagagaauaaucaauaggu

SEQ ID NO: 115124 - RNA, 22 nt, Human
ugggagagcagagaacccucuu

SEQ ID NO: 115125 - RNA, 22 nt, Human
ugggagaggcugccaucuugca

SEQ ID NO: 115126 - RNA, 22 nt, Human
ugggagcacucuuugggaagca

SEQ ID NO: 115127 - RNA, 22 nt, Human
ugggagcagcauugccaugugc

SEQ ID NO: 115128 - RNA, 22 nt, Human
ugggagcagcugggaacacagc

SEQ ID NO: 115129 - RNA, 22 nt, Human
ugggagcaguugcaucuccagu

SEQ ID NO: 115130 - RNA, 22 nt, Human
ugggagcaguugugaagcucag

SEQ ID NO: 115131 - RNA, 22 nt, Human
ugggagccauuuuagaggcugc

SEQ ID NO: 115132 - RNA, 22 nt, Human
ugggagcuccuggagggcagga

SEQ ID NO: 115133 - RNA, 20 nt, Human
ugggagcuggugaggucuca

SEQ ID NO: 115134 - RNA, 22 nt, Human
ugggaggaagugcuaaugggag

SEQ ID NO: 115135 - RNA, 22 nt, Human
ugggaggacuugugggcuucau

SEQ ID NO: 115136 - RNA, 22 nt, Human
ugggaggcagaaguugacugga

SEQ ID NO: 115137 - RNA, 22 nt, Human
ugggaggcccaggccuggcagg

SEQ ID NO: 115138 - RNA, 22 nt, Human
ugggaguagaugaggagugggc

SEQ ID NO: 115139 - RNA, 22 nt, Human
ugggagucaacccucacgagca

SEQ ID NO: 115140 - RNA, 22 nt, Human
ugggagucaucguguuuggauc

SEQ ID NO: 115141 - RNA, 22 nt, Human
uguuuacugcauucuauuugcu

SEQ ID NO: 115142 - RNA, 22 nt, Human
uguuuacuuaaauguuuucaua

SEQ ID NO: 115143 - RNA, 22 nt, Human
uguuuacuuaugugggucacau

SEQ ID NO: 115144 - RNA, 22 nt, Human
uguuuacuugagguggaaacaa

SEQ ID NO: 115145 - RNA, 21 nt, Human
uguuuauggaaaagagacaaa

SEQ ID NO: 115146 - RNA, 22 nt, Human
uguuuauugcagugcugggcug

SEQ ID NO: 115147 - RNA, 18 nt, Human
uguuuauuuuucucuuac

SEQ ID NO: 115148 - RNA, 22 nt, Human
uguuucaaaacagugauaauuu

SEQ ID NO: 115149 - RNA, 22 nt, Human
uguuucaaagguuauacaguca

SEQ ID NO: 115150 - RNA, 22 nt, Human
uguuucaaauuacuugaggauu

SEQ ID NO: 115151 - RNA, 17 nt, Human
uguuucacuuggggaaa

SEQ ID NO: 115152 - RNA, 22 nt, Human
uguuucagagcacugggcuuau

SEQ ID NO: 115153 - RNA, 22 nt, Human
uguuucaugaaacauguuuagg

SEQ ID NO: 115154 - RNA, 22 nt, Human
uguuucauguggacauaguugu

SEQ ID NO: 115155 - RNA, 22 nt, Human
uguuuccaaagucuuuucuuaa

SEQ ID NO: 115156 - RNA, 22 nt, Human
uguuuccaaaugguauaaagac

SEQ ID NO: 115157 - RNA, 22 nt, Human
uguuuccagaauguagcugcuu

SEQ ID NO: 115158 - RNA, 22 nt, Human
uguuuccccaaccccacaagua

SEQ ID NO: 115159 - RNA, 22 nt, Human
uguuuccuucugucucuuugga

SEQ ID NO: 115160 - RNA, 23 nt, Human
uguuucuagaaucauugaugucu

SEQ ID NO: 115161 - RNA, 22 nt, Human
uguuucuaucuggaucaauaga

SEQ ID NO: 115162 - RNA, 22 nt, Human
uguuucugggugugucucaccu

SEQ ID NO: 115163 - RNA, 20 nt, Human
uguuucuuuuaaugagcggc

SEQ ID NO: 115164 - RNA, 16 nt, Human
uguuugcaaagcaauc

SEQ ID NO: 115165 - RNA, 22 nt, Human
uguuugcucugacuaucuugcg

SEQ ID NO: 115166 - RNA, 22 nt, Human
uguuuguagagacagcugaugc

SEQ ID NO: 115167 - RNA, 22 nt, Human
uguuuguauggaccuguucuau

SEQ ID NO: 115168 - RNA, 20 nt, Human
uguuugugccagcuuuguca

SEQ ID NO: 115169 - RNA, 22 nt, Human
uguuuguucccucucuuuccug

SEQ ID NO: 115170 - RNA, 22 nt, Human
uguuuuagcugacacauggagc

SEQ ID NO: 115171 - RNA, 22 nt, Human
uguuuucuauuaccugagauug

SEQ ID NO: 115172 - RNA, 22 nt, Human
uguuuucucuugaaaagcaguc

SEQ ID NO: 115173 - RNA, 17 nt, Human
uguuuucugcuaccuuu

SEQ ID NO: 115174 - RNA, 22 nt, Human
uguuuugcuucucuguuuccca

SEQ ID NO: 115175 - RNA, 21 nt, Human
uggucugaaaguauuuguggc

SEQ ID NO: 115176 - RNA, 22 nt, Human
uggucugaacacauuuuaggua

SEQ ID NO: 115177 - RNA, 22 nt, Human
uggucugagcaacugcccuauc

SEQ ID NO: 115178 - RNA, 22 nt, Human
uggucugauaccggauuccagu

SEQ ID NO: 115179 - RNA, 22 nt, Human
uggucugauggucccaccaccg

SEQ ID NO: 115180 - RNA, 22 nt, Human
uggucugauuccaccuaacuga

SEQ ID NO: 115181 - RNA, 22 nt, Human
uggucugauucuugcuccccaa

SEQ ID NO: 115182 - RNA, 22 nt, Human
uggucugccuggaucacagccc

SEQ ID NO: 115183 - RNA, 17 nt, Human
uggucuggaagaacuga

SEQ ID NO: 115184 - RNA, 22 nt, Human
uggucuuugagagaaguugauu

SEQ ID NO: 115185 - RNA, 18 nt, Human
uggugaaggguggaggag

SEQ ID NO: 115186 - RNA, 22 nt, Human
uggugaagucagcggagcccgg

SEQ ID NO: 115187 - RNA, 20 nt, Human
uggugagagcaccugauggg

SEQ ID NO: 115188 - RNA, 22 nt, Human
uggugagagcugaccgugcgag

SEQ ID NO: 115189 - RNA, 22 nt, Human
uggugcaagucucugaggaggg

SEQ ID NO: 115190 - RNA, 22 nt, Human
uggugcaggaguuggcagggac

SEQ ID NO: 115191 - RNA, 22 nt, Human
uggugcagguguugaugcagga

SEQ ID NO: 115192 - RNA, 23 nt, Human
uggugccacagcugaagucaggu

SEQ ID NO: 115193 - RNA, 22 nt, Human
uggugccacccuccuucagcug

SEQ ID NO: 115194 - RNA, 22 nt, Human
uggugccacuucuuaggcuggu

SEQ ID NO: 115195 - RNA, 18 nt, Human
uggugccuuucacucuuc

SEQ ID NO: 115196 - RNA, 22 nt, Human
uggugcugagaugaagugcucc

SEQ ID NO: 115197 - RNA, 22 nt, Human
uggugcuguggaggggcagaag

SEQ ID NO: 115198 - RNA, 20 nt, Human
ugguggagagaagcuauuug

SEQ ID NO: 115199 - RNA, 22 nt, Human
ugguggcaacauugcuggagug

SEQ ID NO: 115200 - RNA, 22 nt, Human
ugguggcaucaauugacuucuc

SEQ ID NO: 115201 - RNA, 22 nt, Human
ugguggccaauucacagggcuc

SEQ ID NO: 115202 - RNA, 20 nt, Human
ugguggccagugcugcaggc

SEQ ID NO: 115203 - RNA, 22 nt, Human
ugguggccgaagcccucucuca

SEQ ID NO: 115204 - RNA, 22 nt, Human
ugguggcuguugcagaacugag

SEQ ID NO: 115205 - RNA, 22 nt, Human
ugguggcuucugaggauggcga

SEQ ID NO: 115206 - RNA, 22 nt, Human
uggugggacaucugaggagagg

SEQ ID NO: 115207 - RNA, 23 nt, Human
uggugggcccugcuugcucacug

SEQ ID NO: 115208 - RNA, 22 nt, Human
ugguggggauucccucccuggc

SEQ ID NO: 115209 - RNA, 22 nt, Human
ugguggggucaucgucagaugc

SEQ ID NO: 115210 - RNA, 22 nt, Human
ugguggucaaagccaguguucu

SEQ ID NO: 115211 - RNA, 22 nt, Human
uggugguuaugcgcuuuguggg

SEQ ID NO: 115212 - RNA, 22 nt, Human
uggugucaagcagaacugugaa

SEQ ID NO: 115213 - RNA, 22 nt, Human
uggugucucuuaguacauagau

SEQ ID NO: 115214 - RNA, 22 nt, Human
uggugugaggcgggaguguagu

SEQ ID NO: 115215 - RNA, 22 nt, Human
uggugugggcguggcaggcaag

SEQ ID NO: 115216 - RNA, 22 nt, Human
ugguuaaaaugcagauucagua

SEQ ID NO: 115217 - RNA, 22 nt, Human
ugguuacacagcauguggacuu

SEQ ID NO: 115218 - RNA, 22 nt, Human
ugguuagaggcuucuugcuugg

SEQ ID NO: 115219 - RNA, 21 nt, Human
ugguuaguuauuggcagugcc

SEQ ID NO: 115220 - RNA, 22 nt, Human
ugguucaggcaggguguugcug

SEQ ID NO: 115221 - RNA, 22 nt, Human
ugguucauugagaagacugaag

SEQ ID NO: 115222 - RNA, 22 nt, Human
ugguuccaagauggcugccaca

SEQ ID NO: 115223 - RNA, 22 nt, Human
ugguucccuuaacagcuguaua

SEQ ID NO: 115224 - RNA, 22 nt, Human
ugguuccucaagcgcuggcggc

SEQ ID NO: 115225 - RNA, 22 nt, Human
ugguuccucagggcagcuguac

SEQ ID NO: 115226 - RNA, 22 nt, Human
ugguuccuucugcauuuucagc

SEQ ID NO: 115227 - RNA, 22 nt, Human
ugguuggcugagcagagucacu

SEQ ID NO: 115228 - RNA, 22 nt, Human
ugguuuaaccugucucuuauua

SEQ ID NO: 115229 - RNA, 22 nt, Human
ugguuucacggagugccuugcu

SEQ ID NO: 115230 - RNA, 22 nt, Human
ugguuucucugaacucuacgac

SEQ ID NO: 115231 - RNA, 20 nt, Human
uguaaaacaaggugaauccu

SEQ ID NO: 115232 - RNA, 22 nt, Human
uguaaaaccaaaucaaucuagu

SEQ ID NO: 115233 - RNA, 22 nt, Human
uguaaaauaccauuccuuguca

SEQ ID NO: 115234 - RNA, 20 nt, Human
uguaaacaauaguguucuug

SEQ ID NO: 115235 - RNA, 22 nt, Human
uguaaacauauguauguaugua

SEQ ID NO: 115236 - RNA, 22 nt, Human
uguaaacucaguauguuuuacu

SEQ ID NO: 115237 - RNA, 22 nt, Human
uguaaacuguagaaaauacuuu

SEQ ID NO: 115238 - RNA, 22 nt, Human
uguaaagaaauagcauuuguag

SEQ ID NO: 115239 - RNA, 22 nt, Human
uguaaagauuagauuacaugaa

SEQ ID NO: 115240 - RNA, 22 nt, Human
uguaaagcaucucugucauaua

SEQ ID NO: 115241 - RNA, 22 nt, Human
uguaaagcauuuccuaaaucca

SEQ ID NO: 115242 - RNA, 22 nt, Human
uguaaagcuuugaguguuuauc

SEQ ID NO: 115243 - RNA, 22 nt, Human
uguaaaggguguuaaauuacuc

SEQ ID NO: 115244 - RNA, 22 nt, Human
uguaaauaaugcauguaaauca

SEQ ID NO: 115245 - RNA, 22 nt, Human
uguaaaugaaacagcuaaaucc

SEQ ID NO: 115246 - RNA, 22 nt, Human
uguaaauucuauacacuuaaaa

SEQ ID NO: 115247 - RNA, 21 nt, Human
uguaacaaaauacugcagauu

SEQ ID NO: 115248 - RNA, 22 nt, Human
uguaacaagugcuuacuuuggg

SEQ ID NO: 115249 - RNA, 23 nt, Human
uguaacaauucccagccuuugcc

SEQ ID NO: 115250 - RNA, 22 nt, Human
uguaacagcucuccaugugggg

SEQ ID NO: 115251 - RNA, 22 nt, Human
uguaacaguuauaacaaugugg

SEQ ID NO: 115252 - RNA, 22 nt, Human
uguaacauauguaaaagcaccu

SEQ ID NO: 115253 - RNA, 22 nt, Human
uguaacugccauguagccuguc

SEQ ID NO: 115254 - RNA, 22 nt, Human
uguaagaacaacugucaaaugu

SEQ ID NO: 115255 - RNA, 22 nt, Human
uguaagaauaaugauuucuaag

SEQ ID NO: 115256 - RNA, 22 nt, Human
uguaagaugcugggauagauga

SEQ ID NO: 115257 - RNA, 22 nt, Human
uguaagcuucaaauaucuguga

SEQ ID NO: 115258 - RNA, 22 nt, Human
ugggaguccaaggcaggcggau

SEQ ID NO: 115259 - RNA, 22 nt, Human
ugggaguccaagguuuuuauag

SEQ ID NO: 115260 - RNA, 22 nt, Human
ugggagugaggcagagucuauc

SEQ ID NO: 115261 - RNA, 19 nt, Human
ugggaguggggaagguccu

SEQ ID NO: 115262 - RNA, 22 nt, Human
ugggauauaccuauccuagaag

SEQ ID NO: 115263 - RNA, 17 nt, Human
ugggauccgucucugug

SEQ ID NO: 115264 - RNA, 22 nt, Human
ugggaugaggccucuguuguga

SEQ ID NO: 115265 - RNA, 22 nt, Human
ugggaugagggugagccacaug

SEQ ID NO: 115266 - RNA, 22 nt, Human
ugggaugcccugacccucugga

SEQ ID NO: 115267 - RNA, 18 nt, Human
ugggauggagaguaacug

SEQ ID NO: 115268 - RNA, 22 nt, Human
ugggauggagccugaguauagu

SEQ ID NO: 115269 - RNA, 22 nt, Human
ugggauggccuuugaaagccag

SEQ ID NO: 115270 - RNA, 22 nt, Human
ugggaugggaucucgcuguguc

SEQ ID NO: 115271 - RNA, 20 nt, Human
ugggauuguuuuuuagcuuc

SEQ ID NO: 115272 - RNA, 22 nt, Human
ugggcaaaugucacuuucuuuu

SEQ ID NO: 115273 - RNA, 20 nt, Human
ugggcacagcuuuggagggc

SEQ ID NO: 115274 - RNA, 22 nt, Human
ugggcacaggggaauggaugaa

SEQ ID NO: 115275 - RNA, 22 nt, Human
ugggcacuggaagccugcugug

SEQ ID NO: 115276 - RNA, 22 nt, Human
ugggcagaaaucaguaucagau

SEQ ID NO: 115277 - RNA, 22 nt, Human
ugggcagaauugugguaguuaa

SEQ ID NO: 115278 - RNA, 22 nt, Human
ugggcagaguugugaugaacug

SEQ ID NO: 115279 - RNA, 15 nt, Human
ugggcagaucacuug

SEQ ID NO: 115280 - RNA, 22 nt, Human
ugggcagaucuuugguggcuag

SEQ ID NO: 115281 - RNA, 22 nt, Human
ugggcagauguccucugaagug

SEQ ID NO: 115282 - RNA, 20 nt, Human
ugggcagcacugcuggcugg

SEQ ID NO: 115283 - RNA, 22 nt, Human
ugggcagcagaaccaggccgac

SEQ ID NO: 115284 - RNA, 22 nt, Human
ugggcagccaucccagccucuc

SEQ ID NO: 115285 - RNA, 22 nt, Human
uuacugaugaucuggaggggcu

SEQ ID NO: 115286 - RNA, 22 nt, Human
uuacugaugucauuagaaacag

SEQ ID NO: 115287 - RNA, 22 nt, Human
uuacugcuguuaggauauuuuu

SEQ ID NO: 115288 - RNA, 22 nt, Human
uuacuggcugggccugagggcu

SEQ ID NO: 115289 - RNA, 22 nt, Human
uuacuguagaagagaaugauuc

SEQ ID NO: 115290 - RNA, 22 nt, Human
uuacuguucauguuguacacuu

SEQ ID NO: 115291 - RNA, 22 nt, Human
uuacuguuugaaaaaugaaugu

SEQ ID NO: 115292 - RNA, 22 nt, Human
uuacuguuuuuaacuaauugug

SEQ ID NO: 115293 - RNA, 22 nt, Human
uuacuugaaugcugugaucuca

SEQ ID NO: 115294 - RNA, 22 nt, Human
uuacuugauuguggagucugag

SEQ ID NO: 115295 - RNA, 22 nt, Human
uuacuugauuugaaaaucauag

SEQ ID NO: 115296 - RNA, 22 nt, Human
uuacuugcuuauaaucaaaaca

SEQ ID NO: 115297 - RNA, 22 nt, Human
uuacuuucaaaaacuacguggg

SEQ ID NO: 115298 - RNA, 22 nt, Human
uuacuuucaaguggcugggggu

SEQ ID NO: 115299 - RNA, 22 nt, Human
uuacuuugcuuucucauuacag

SEQ ID NO: 115300 - RNA, 22 nt, Human
uuacuuuguucucaagauaugu

SEQ ID NO: 115301 - RNA, 22 nt, Human
uuagaaaaaggcuguggucuua

SEQ ID NO: 115302 - RNA, 22 nt, Human
uuagaaacccagacucuuaggu

SEQ ID NO: 115303 - RNA, 19 nt, Human
uuagaaacuguugacacug

SEQ ID NO: 115304 - RNA, 22 nt, Human
uuagaaagaguauaccagaaac

SEQ ID NO: 115305 - RNA, 22 nt, Human
uuagaaagcuuuccauagucaa

SEQ ID NO: 115306 - RNA, 22 nt, Human
uuagaaaggaaucuucauuuca

SEQ ID NO: 115307 - RNA, 22 nt, Human
uuagaaaggcuuauggugccuu

SEQ ID NO: 115308 - RNA, 22 nt, Human
uuagaaagggugucugaaucug

SEQ ID NO: 115309 - RNA, 22 nt, Human
uuagaaauacaagugagguuga

SEQ ID NO: 115310 - RNA, 21 nt, Human
uuagaacaauauuugguauag

SEQ ID NO: 115311 - RNA, 22 nt, Human
uuagaacacugagaaagugaug

SEQ ID NO: 115312 - RNA, 22 nt, Human
uuagaacauagcaacagaauua

SEQ ID NO: 115313 - RNA, 22 nt, Human
uuagaacaucucucuucugcca

SEQ ID NO: 115314 - RNA, 22 nt, Human
uuagaaccaggguuacgauucu

SEQ ID NO: 115315 - RNA, 22 nt, Human
uuagaaccauaaugaaucaaug

SEQ ID NO: 115316 - RNA, 22 nt, Human
uuagaagcaucaccuguucugg

SEQ ID NO: 115317 - RNA, 22 nt, Human
uuagaagccaggauggagcagg

SEQ ID NO: 115318 - RNA, 21 nt, Human
uuagaagcuaaugcagcuggu

SEQ ID NO: 115319 - RNA, 22 nt, Human
uuagaagucaucuagucuaaaa

SEQ ID NO: 115320 - RNA, 22 nt, Human
uuagaagugaaauagcuguaca

SEQ ID NO: 115321 - RNA, 22 nt, Human
uuagaagugguaaguagaaaga

SEQ ID NO: 115322 - RNA, 22 nt, Human
uuagaauuauuguuuccuucua

SEQ ID NO: 115323 - RNA, 22 nt, Human
uuagagaauuccaaaugacuac

SEQ ID NO: 115324 - RNA, 22 nt, Human
uuagagauacauuuguagcuug

SEQ ID NO: 115325 - RNA, 22 nt, Human
uuagagauugguugacagauuu

SEQ ID NO: 115326 - RNA, 22 nt, Human
uuagagcuacggccuuuaaaaa

SEQ ID NO: 115327 - RNA, 22 nt, Human
uuagaggggcugcugaauggga

SEQ ID NO: 115328 - RNA, 22 nt, Human
uuagaggugucaggagcacagg

SEQ ID NO: 115329 - RNA, 22 nt, Human
uuagagucaaaauggcauguua

SEQ ID NO: 115330 - RNA, 22 nt, Human
uuagaguugaguuucuaugaga

SEQ ID NO: 115331 - RNA, 22 nt, Human
uuagaguuuuaucauugccuua

SEQ ID NO: 115332 - RNA, 22 nt, Human
uuagauaaagugauguaggcua

SEQ ID NO: 115333 - RNA, 22 nt, Human
uuagauaaauuaagacuuuaca

SEQ ID NO: 115334 - RNA, 22 nt, Human
uuagauaaauugcaacuugauu

SEQ ID NO: 115335 - RNA, 22 nt, Human
uuagauaauguuauuguaauuu

SEQ ID NO: 115336 - RNA, 22 nt, Human
uuagcaaaaauaucucauauua

SEQ ID NO: 115337 - RNA, 17 nt, Human
uuagcaaaauagcacuu

SEQ ID NO: 115338 - RNA, 22 nt, Human
uuagcaaacaaaugaaaugguu

SEQ ID NO: 115339 - RNA, 22 nt, Human
uuagcaaacaucuucgugugag

SEQ ID NO: 115340 - RNA, 22 nt, Human
uuagcaaauaucuugaaacagg

SEQ ID NO: 115341 - RNA, 22 nt, Human
uuagcaauuccagguaaguuau

SEQ ID NO: 115342 - RNA, 22 nt, Human
uuagcaauugauucucauaagc

SEQ ID NO: 115343 - RNA, 22 nt, Human
uuagcaccuugaacagacccug

SEQ ID NO: 115344 - RNA, 22 nt, Human
uuagcacuuugauucaugcaga

SEQ ID NO: 115345 - RNA, 22 nt, Human
uuagcagcuaaacugacagacc

SEQ ID NO: 115346 - RNA, 20 nt, Human
uuagcaguagagugugcuuc

SEQ ID NO: 115347 - RNA, 21 nt, Human
uuagcaguuguugauuuccag

SEQ ID NO: 115348 - RNA, 22 nt, Human
uuagcauucuucuggggggcac

SEQ ID NO: 115349 - RNA, 22 nt, Human
uuagccaggggagcagcuuguc

SEQ ID NO: 115350 - RNA, 22 nt, Human
uuagccauauagaaaaagagcu

SEQ ID NO: 115351 - RNA, 22 nt, Human
uuagccauauagugcucuugua

SEQ ID NO: 115352 - RNA, 22 nt, Human
uuagccaugugggaaaaacagc

SEQ ID NO: 115353 - RNA, 22 nt, Human
uuagccauuaaauuacaaggug

SEQ ID NO: 115354 - RNA, 22 nt, Human
uuagccauuaauguccugugca

SEQ ID NO: 115355 - RNA, 22 nt, Human
uuagccauugucagcacauggc

SEQ ID NO: 115356 - RNA, 22 nt, Human
uuagccauuuuauucagcaggu

SEQ ID NO: 115357 - RNA, 22 nt, Human
uuagccuuagaagcuuagcaaa

SEQ ID NO: 115358 - RNA, 22 nt, Human
uuagcuauaguaugucugcuuu

SEQ ID NO: 115359 - RNA, 22 nt, Human
uuagcucagaaaauuuaaacuu

SEQ ID NO: 115360 - RNA, 22 nt, Human
uuagcugaaaaaauucaugcaa

SEQ ID NO: 115361 - RNA, 22 nt, Human
uuagcuuucagccuuucucacc

SEQ ID NO: 115362 - RNA, 21 nt, Human
uuagcuuucuagaaucuuugu

SEQ ID NO: 115363 - RNA, 22 nt, Human
uuagcuuucuuggagaauuaca

SEQ ID NO: 115364 - RNA, 22 nt, Human
uuagcuuucuuuggcagacgug

SEQ ID NO: 115365 - RNA, 22 nt, Human
uuagcuuuucucuauguuggcu

SEQ ID NO: 115366 - RNA, 22 nt, Human
uuaggaaaaugaaauuaccugu

SEQ ID NO: 115367 - RNA, 19 nt, Human
uuaggaaaccacuuuccuu

SEQ ID NO: 115368 - RNA, 22 nt, Human
uuaggaaagaagcagcuaggag

SEQ ID NO: 115369 - RNA, 22 nt, Human
uuaggaaaggguuuucuaacag

SEQ ID NO: 115370 - RNA, 22 nt, Human
uuaggaaaucacuuugcucacc

SEQ ID NO: 115371 - RNA, 22 nt, Human
uuaggaaauuccaccuguauuc

SEQ ID NO: 115372 - RNA, 22 nt, Human
uggggcucaugccugcuggaac

SEQ ID NO: 115373 - RNA, 22 nt, Human
uggggcugaggagccucacucu

SEQ ID NO: 115374 - RNA, 22 nt, Human
uggggcugucccgguuuggcga

SEQ ID NO: 115375 - RNA, 22 nt, Human
uggggcuguccuuagucugaga

SEQ ID NO: 115376 - RNA, 19 nt, Human
uggggcuguguuuugaccc

SEQ ID NO: 115377 - RNA, 22 nt, Human
uggggcuucuccuguaggcuca

SEQ ID NO: 115378 - RNA, 22 nt, Human
ugggggaagagcuuguuaaagu

SEQ ID NO: 115379 - RNA, 22 nt, Human
ugggggagagaggcauucuuuc

SEQ ID NO: 115380 - RNA, 22 nt, Human
ugggggagauagagucugaugg

SEQ ID NO: 115381 - RNA, 22 nt, Human
ugggggagccuucacaguagcu

SEQ ID NO: 115382 - RNA, 22 nt, Human
ugggggagcgacagacauaauu

SEQ ID NO: 115383 - RNA, 22 nt, Human
ugggggauuguuuuaaugaaua

SEQ ID NO: 115384 - RNA, 22 nt, Human
ugggggcacuucgaggucgccu

SEQ ID NO: 115385 - RNA, 22 nt, Human
ugggggcauggaccagccuggc

SEQ ID NO: 115386 - RNA, 17 nt, Human
ugggggcgccagggucu

SEQ ID NO: 115387 - RNA, 22 nt, Human
ugggggcuagaacccagggauu

SEQ ID NO: 115388 - RNA, 22 nt, Human
ugggggcugaguaagaugagau

SEQ ID NO: 115389 - RNA, 22 nt, Human
uggggggcacuucagcacaaug

SEQ ID NO: 115390 - RNA, 22 nt, Human
uggggggcaugaaccuccacgg

SEQ ID NO: 115391 - RNA, 22 nt, Human
ugggggugacuaucucgggaau

SEQ ID NO: 115392 - RNA, 22 nt, Human
ugggggugcugagaagacagga

SEQ ID NO: 115393 - RNA, 22 nt, Human
ugggguacacguggggcaggau

SEQ ID NO: 115394 - RNA, 22 nt, Human
uuagggaaggacagugaagaaa

SEQ ID NO: 115395 - RNA, 22 nt, Human
uuagggaaguguuauucucagg

SEQ ID NO: 115396 - RNA, 22 nt, Human
uuagggacaaauuugcagaacc

SEQ ID NO: 115397 - RNA, 19 nt, Human
uuagggacaugaauucuag

SEQ ID NO: 115398 - RNA, 19 nt, Human
uuagggguaugaaguggua

SEQ ID NO: 115399 - RNA, 22 nt, Human
uuagguaaggauggugacagua

SEQ ID NO: 115400 - RNA, 22 nt, Human
uuagguauuuuguuaugucagc

SEQ ID NO: 115401 - RNA, 22 nt, Human
uuagguuuaagugacuggaauc

SEQ ID NO: 115402 - RNA, 22 nt, Human
uuaguaagcacucacacauucc

SEQ ID NO: 115403 - RNA, 22 nt, Human
uuaguacaagagauuaauuacu

SEQ ID NO: 115404 - RNA, 22 nt, Human
uuaguaguaagagucauaugua

SEQ ID NO: 115405 - RNA, 22 nt, Human
uuagucaaaucauucuguuucu

SEQ ID NO: 115406 - RNA, 22 nt, Human
uuagucuccagcuuaggguuug

SEQ ID NO: 115407 - RNA, 22 nt, Human
uuagucucuuugcauugccaua

SEQ ID NO: 115408 - RNA, 22 nt, Human
uuagucuucuuccuuauauguu

SEQ ID NO: 115409 - RNA, 22 nt, Human
uuagugauaggaagccagauug

SEQ ID NO: 115410 - RNA, 22 nt, Human
uuagugauaggacuuuaaagcc

SEQ ID NO: 115411 - RNA, 22 nt, Human
uuagugcaauucagagaacaau

SEQ ID NO: 115412 - RNA, 22 nt, Human
uuagugcagcugagccccaugg

SEQ ID NO: 115413 - RNA, 22 nt, Human
uuagugcucacguguuagaaag

SEQ ID NO: 115414 - RNA, 22 nt, Human
uuagugcuuggcacacaauaca

SEQ ID NO: 115415 - RNA, 22 nt, Human
uuaguggagaguuauuaucagc

SEQ ID NO: 115416 - RNA, 22 nt, Human
uuagugguacucagggagggaa

SEQ ID NO: 115417 - RNA, 22 nt, Human
uuaguguaaauugugcuugaga

SEQ ID NO: 115418 - RNA, 22 nt, Human
uuaguguauuuucaaauguaga

SEQ ID NO: 115419 - RNA, 22 nt, Human
uuaguguccagaguuuuuauua

SEQ ID NO: 115420 - RNA, 22 nt, Human
uuaguguccuuaugucacaagc

SEQ ID NO: 115421 - RNA, 22 nt, Human
uuagugucuggcuauauuuaaa

SEQ ID NO: 115422 - RNA, 22 nt, Human
uuagugucuucuucauccucug

SEQ ID NO: 115423 - RNA, 22 nt, Human
uuaguguuuaaagguuucagag

SEQ ID NO: 115424 - RNA, 22 nt, Human
uuaguuaaaagauaauuuugga

SEQ ID NO: 115425 - RNA, 22 nt, Human
uuaguuaauugacuauguugca

SEQ ID NO: 115426 - RNA, 22 nt, Human
uuaguucacugcuauaucauca

SEQ ID NO: 115427 - RNA, 22 nt, Human
uuaguucauagaauguaacagg

SEQ ID NO: 115428 - RNA, 22 nt, Human
uuauaaagugagaagugcuaug

SEQ ID NO: 115429 - RNA, 22 nt, Human
uuauaacacugccuugucacca

SEQ ID NO: 115430 - RNA, 22 nt, Human
uuauaagcucugaaaucuccua

SEQ ID NO: 115431 - RNA, 22 nt, Human
uuauacaccaucacugccuugg

SEQ ID NO: 115432 - RNA, 22 nt, Human
uuauacauguguuuugagauga

SEQ ID NO: 115433 - RNA, 22 nt, Human
uuauaccugaagcaggugaugu

SEQ ID NO: 115434 - RNA, 22 nt, Human
uuauacuaaaacgcauugaauu

SEQ ID NO: 115435 - RNA, 22 nt, Human
uuauacuuuauacuacaucauu

SEQ ID NO: 115436 - RNA, 22 nt, Human
uuauagaauccaguuguuguau

SEQ ID NO: 115437 - RNA, 22 nt, Human
uuauagaaugguggauuuucug

SEQ ID NO: 115438 - RNA, 22 nt, Human
uuauagaugccuugaguaaaug

SEQ ID NO: 115439 - RNA, 22 nt, Human
uuauagguccacugcaauuugc

SEQ ID NO: 115440 - RNA, 22 nt, Human
uuauaguaugugcauaugugug

SEQ ID NO: 115441 - RNA, 22 nt, Human
uuauaguuaugaaagacugagg

SEQ ID NO: 115442 - RNA, 19 nt, Human
uuauauacuugguuucucu

SEQ ID NO: 115443 - RNA, 22 nt, Human
uuauauaucuugauuuguucca

SEQ ID NO: 115444 - RNA, 22 nt, Human
uuauaucuuuuuacaucucucc

SEQ ID NO: 115445 - RNA, 22 nt, Human
uuauaugaguaucauaucacuu

SEQ ID NO: 115446 - RNA, 22 nt, Human
uuauauguuucuguuuggaggc

SEQ ID NO: 115447 - RNA, 22 nt, Human
uuaucaagggagaaacaggagg

SEQ ID NO: 115448 - RNA, 22 nt, Human
uuaucagaguccccaaaagaaa

SEQ ID NO: 115449 - RNA, 22 nt, Human
uuaucaugacuucaagcaucca

SEQ ID NO: 115450 - RNA, 22 nt, Human
uuaucauugucgcagucuaauu

SEQ ID NO: 115451 - RNA, 22 nt, Human
uuauccaaacuggugaaucauu

SEQ ID NO: 115452 - RNA, 18 nt, Human
uuaucucuggcaugugcc

SEQ ID NO: 115453 - RNA, 20 nt, Human
uuaucugucaaucugucuca

SEQ ID NO: 115454 - RNA, 22 nt, Human
uuaucuguugcuuaaugcgcau

SEQ ID NO: 115455 - RNA, 22 nt, Human
uuaucuguuguuuuaguacaau

SEQ ID NO: 115456 - RNA, 17 nt, Human
uuaucuugcuguuucua

SEQ ID NO: 115457 - RNA, 22 nt, Human
uuaucuugguguuuuaguaauu

SEQ ID NO: 115458 - RNA, 22 nt, Human
uuaugaaggaucagguacuugg

SEQ ID NO: 115459 - RNA, 22 nt, Human
uuaugagacuguuuuacacacu

SEQ ID NO: 115460 - RNA, 22 nt, Human
uuaugagauauuuauacugcug

SEQ ID NO: 115461 - RNA, 18 nt, Human
uuaugcaaaacuguuuuc

SEQ ID NO: 115462 - RNA, 20 nt, Human
uuaugcaagcaucaauauug

SEQ ID NO: 115463 - RNA, 22 nt, Human
uuaugcauauagcagauacgag

SEQ ID NO: 115464 - RNA, 22 nt, Human
uuaugcuaaccucaucuucucc

SEQ ID NO: 115465 - RNA, 22 nt, Human
uuauggaaaauacaauuauaag

SEQ ID NO: 115466 - RNA, 22 nt, Human
uuauggaauaaccuuucugaaa

SEQ ID NO: 115467 - RNA, 21 nt, Human
uuauggagaaggaaaguaagg

SEQ ID NO: 115468 - RNA, 22 nt, Human
uuaugggcgaugcaaaccugau

SEQ ID NO: 115469 - RNA, 22 nt, Human
uuaugucaaaaugguugagauu

SEQ ID NO: 115470 - RNA, 22 nt, Human
uuauguuuuaaguguguaucuu

SEQ ID NO: 115471 - RNA, 22 nt, Human
uuauuaauacaugcaccugcau

SEQ ID NO: 115472 - RNA, 22 nt, Human
uuauuaaucuuaucuuuggaaa

SEQ ID NO: 115473 - RNA, 22 nt, Human
uuauuaaugaguacaaguuauu

SEQ ID NO: 115474 - RNA, 22 nt, Human
uuauuacacugaaagaauugcg

SEQ ID NO: 115475 - RNA, 22 nt, Human
uuauuagcugggcuucagggug

SEQ ID NO: 115476 - RNA, 22 nt, Human
uuauuagguuuacauaaagguu

SEQ ID NO: 115477 - RNA, 22 nt, Human
uuauuauaaugagggauaaaaa

SEQ ID NO: 115478 - RNA, 22 nt, Human
uuauuauagauuaugcaagauu

SEQ ID NO: 115479 - RNA, 22 nt, Human
uuauuauggcaguuuucuaggu

SEQ ID NO: 115480 - RNA, 22 nt, Human
uuauuaugguauuucuuugcag

SEQ ID NO: 115481 - RNA, 22 nt, Human
uuauuauugauucgcucucaaa

SEQ ID NO: 115482 - RNA, 22 nt, Human
uuauuauugugguugcauuauc

SEQ ID NO: 115483 - RNA, 22 nt, Human
uuauucaccauuuauuauguga

SEQ ID NO: 115484 - RNA, 22 nt, Human
uuauucacuucuuggucccuca

SEQ ID NO: 115485 - RNA, 18 nt, Human
uuauucagacgcauauga

SEQ ID NO: 115486 - RNA, 22 nt, Human
uuauucagcagggacuuccuuu

SEQ ID NO: 115487 - RNA, 22 nt, Human
uuauucagugccuuugaaagaa

SEQ ID NO: 115488 - RNA, 22 nt, Human
uuauuccagguacuugguuucu

SEQ ID NO: 115489 - RNA, 22 nt, Human
ugguccacagggaguccgugcu

SEQ ID NO: 115490 - RNA, 22 nt, Human
ugguccagacuuugaccucuca

SEQ ID NO: 115491 - RNA, 22 nt, Human
ugguccagcuugauucucuucu

SEQ ID NO: 115492 - RNA, 22 nt, Human
ugguccaggguguaguacagag

SEQ ID NO: 115493 - RNA, 22 nt, Human
ugguccauguccuccaucucuc

SEQ ID NO: 115494 - RNA, 22 nt, Human
uggucccauuguucugcccagg

SEQ ID NO: 115495 - RNA, 22 nt, Human
uggucccugccugccaagugcu

SEQ ID NO: 115496 - RNA, 22 nt, Human
ugguccugaucaccgcugggca

SEQ ID NO: 115497 - RNA, 22 nt, Human
ugguccugccccgugcacagag

SEQ ID NO: 115498 - RNA, 22 nt, Human
ugguccugcuacaggggauuag

SEQ ID NO: 115499 - RNA, 22 nt, Human
ugguccugcuugcugcuuaaga

SEQ ID NO: 115500 - RNA, 22 nt, Human
ugguccuggagaucaauaugca

SEQ ID NO: 115501 - RNA, 22 nt, Human
ugguccuggucaucugggcugg

SEQ ID NO: 115502 - RNA, 22 nt, Human
ugguccuuuaagucuuucucug

SEQ ID NO: 115503 - RNA, 22 nt, Human
ugucuucacucaagucucuugg

SEQ ID NO: 115504 - RNA, 22 nt, Human
ugucuucaguaaaauacacuau

SEQ ID NO: 115505 - RNA, 22 nt, Human
ugucuucaugccugaaagaaga

SEQ ID NO: 115506 - RNA, 20 nt, Human
ugucuucauuauggugcccu

SEQ ID NO: 115507 - RNA, 22 nt, Human
ugucuucauuccccaugaaguc

SEQ ID NO: 115508 - RNA, 17 nt, Human
ugucuucugaagagagc

SEQ ID NO: 115509 - RNA, 22 nt, Human
ugucuuggaugaggauuaacag

SEQ ID NO: 115510 - RNA, 19 nt, Human
ugucuuuaacuggaaccac

SEQ ID NO: 115511 - RNA, 22 nt, Human
ugucuuuaauucuacauaucuc

SEQ ID NO: 115512 - RNA, 22 nt, Human
ugucuuuacuuaauaaauauac

SEQ ID NO: 115513 - RNA, 22 nt, Human
ugucuuuggaauauuuagcuga

SEQ ID NO: 115514 - RNA, 18 nt, Human
ugucuuuggaccacugaa

SEQ ID NO: 115515 - RNA, 22 nt, Human
ugucuuuuaccuaaugagcugg

SEQ ID NO: 115516 - RNA, 22 nt, Human
ugucuuuucuacuguaagcaua

SEQ ID NO: 115517 - RNA, 22 nt, Human
ugucuuuuuaccugugaugagu

SEQ ID NO: 115518 - RNA, 22 nt, Human
ugugaaaggaaggcaugaaaag

SEQ ID NO: 115519 - RNA, 22 nt, Human
ugugaaaugcuauuuccaugag

SEQ ID NO: 115520 - RNA, 22 nt, Human
ugugaaauucuugaaaugcaca

SEQ ID NO: 115521 - RNA, 23 nt, Human
ugugaaauuugaggucagugcuu

SEQ ID NO: 115522 - RNA, 22 nt, Human
ugugaacuuaagauuccuuauc

SEQ ID NO: 115523 - RNA, 22 nt, Human
ugugaagaauuaaugugaauca

SEQ ID NO: 115524 - RNA, 22 nt, Human
ugugaagagaguaauaaaguca

SEQ ID NO: 115525 - RNA, 22 nt, Human
ugugaagauagcuguuacaucu

SEQ ID NO: 115526 - RNA, 22 nt, Human
ugugaagauuaaguuacugggc

SEQ ID NO: 115527 - RNA, 22 nt, Human
ugugaagauuuggcaugcagaa

SEQ ID NO: 115528 - RNA, 22 nt, Human
ugugaagcgugugcaggggaca

SEQ ID NO: 115529 - RNA, 22 nt, Human
ugugaaggagcaugcagagggg

SEQ ID NO: 115530 - RNA, 22 nt, Human
ugugaaggcagcagcucugucc

SEQ ID NO: 115531 - RNA, 22 nt, Human
ugugaagguuuuuaugggauau

SEQ ID NO: 115532 - RNA, 22 nt, Human
ugugaauacagcaugugcuucu

SEQ ID NO: 115533 - RNA, 22 nt, Human
ugugaauauacuuaaugccacu

SEQ ID NO: 115534 - RNA, 22 nt, Human
ugugacaagcauuguauauugg

SEQ ID NO: 115535 - RNA, 22 nt, Human
ugugacacugacaucugcuccc

SEQ ID NO: 115536 - RNA, 22 nt, Human
ugugacagcacgguucaacugc

SEQ ID NO: 115537 - RNA, 22 nt, Human
ugugacaucgcugugucuguuu

SEQ ID NO: 115538 - RNA, 19 nt, Human
ugugaccccagacaagcug

SEQ ID NO: 115539 - RNA, 22 nt, Human
ugugacccccgucacggcugcu

SEQ ID NO: 115540 - RNA, 22 nt, Human
ugugacccucuccgaugggcag

SEQ ID NO: 115541 - RNA, 22 nt, Human
ugugacguuguucuggauuccc

SEQ ID NO: 115542 - RNA, 22 nt, Human
ugugacuaggccugagcucuug

SEQ ID NO: 115543 - RNA, 22 nt, Human
ugugacugaagugucuagaccu

SEQ ID NO: 115544 - RNA, 22 nt, Human
ugugacugagcugcagaguguc

SEQ ID NO: 115545 - RNA, 22 nt, Human
ugugacuuuucacaggcugguc

SEQ ID NO: 115546 - RNA, 22 nt, Human
ugugagaauuccugaucacagg

SEQ ID NO: 115547 - RNA, 22 nt, Human
ugugagaggagaaaugcauuaa

SEQ ID NO: 115548 - RNA, 22 nt, Human
ugugagaguugagauauuuugc

SEQ ID NO: 115549 - RNA, 22 nt, Human
ugugagauuuuauuugauaugc

SEQ ID NO: 115550 - RNA, 22 nt, Human
uguuaggguccugugcaggggc

SEQ ID NO: 115551 - RNA, 22 nt, Human
uguuauauaacuuacaaccugu

SEQ ID NO: 115552 - RNA, 22 nt, Human
uguuauaucuaaauagccacau

SEQ ID NO: 115553 - RNA, 22 nt, Human
uguuaucacuuagacaugcuag

SEQ ID NO: 115554 - RNA, 22 nt, Human
uguuaucacuuguaaaagcaau

SEQ ID NO: 115555 - RNA, 22 nt, Human
uguuauccucagcucaccucua

SEQ ID NO: 115556 - RNA, 22 nt, Human
uguuaucugagcaacgucgacg

SEQ ID NO: 115557 - RNA, 22 nt, Human
uguuaugaacuucuagaaaaca

SEQ ID NO: 115558 - RNA, 22 nt, Human
uguuaugugccacacuugaggg

SEQ ID NO: 115559 - RNA, 22 nt, Human
uguuauucucugccuacaaguc

SEQ ID NO: 115560 - RNA, 22 nt, Human
uguucaaguggauguggcuuuu

SEQ ID NO: 115561 - RNA, 22 nt, Human
uguucacacagucuauacggau

SEQ ID NO: 115562 - RNA, 20 nt, Human
uguucacaguaguugcugcu

SEQ ID NO: 115563 - RNA, 21 nt, Human
uguucacauggagcagaaugu

SEQ ID NO: 115564 - RNA, 22 nt, Human
uguucagagacagaaauucuaa

SEQ ID NO: 115565 - RNA, 22 nt, Human
uguucauuacugcuguuugcca

SEQ ID NO: 115566 - RNA, 22 nt, Human
uguucauuaguggaaguaaguu

SEQ ID NO: 115567 - RNA, 22 nt, Human
uguucauuauucuucaucugcc

SEQ ID NO: 115568 - RNA, 22 nt, Human
uguucauuccggggagggcuaa

SEQ ID NO: 115569 - RNA, 22 nt, Human
uguucauuuggcccuuuuguau

SEQ ID NO: 115570 - RNA, 22 nt, Human
uguuccaagcugcuggauaagc

SEQ ID NO: 115571 - RNA, 22 nt, Human
uguuccagggcgcgaagguggu

SEQ ID NO: 115572 - RNA, 22 nt, Human
uguuccauaaguggugcuuugu

SEQ ID NO: 115573 - RNA, 22 nt, Human
uguuccaugucuuuguaggacu

SEQ ID NO: 115574 - RNA, 22 nt, Human
uguucccacaccagccucagcc

SEQ ID NO: 115575 - RNA, 22 nt, Human
uguuccugaggcaugugucaau

SEQ ID NO: 115576 - RNA, 22 nt, Human
uguuccuggggaccugccuucc

SEQ ID NO: 115577 - RNA, 23 nt, Human
uguuccugucaaauuuucuuccc

SEQ ID NO: 115578 - RNA, 22 nt, Human
uguuccuguuucugcguaguuu

SEQ ID NO: 115579 - RNA, 22 nt, Human
uguucguagcacguaguuucuu

SEQ ID NO: 115580 - RNA, 22 nt, Human
uguucuaaguguuuuguucaug

SEQ ID NO: 115581 - RNA, 22 nt, Human
uguucuagcaacacaguuuugg

SEQ ID NO: 115582 - RNA, 22 nt, Human
uguucuaugcucuuuaagguga

SEQ ID NO: 115583 - RNA, 22 nt, Human
uguucucacuggaugcuucaca

SEQ ID NO: 115584 - RNA, 22 nt, Human
uguucucuaagaaaagaagcau

SEQ ID NO: 115585 - RNA, 22 nt, Human
uguucucucuccuuuugaagug

SEQ ID NO: 115586 - RNA, 22 nt, Human
uguucucuuuuccugcugagcc

SEQ ID NO: 115587 - RNA, 22 nt, Human
uguucugcaaugcugccuccuu

SEQ ID NO: 115588 - RNA, 22 nt, Human
uguucuggcuccuuuuaaaugu

SEQ ID NO: 115589 - RNA, 22 nt, Human
uguucugggguugagagacaau

SEQ ID NO: 115590 - RNA, 22 nt, Human
uguucugugcaucuagccagua

SEQ ID NO: 115591 - RNA, 22 nt, Human
uguucuuacggaacuuaucuuu

SEQ ID NO: 115592 - RNA, 22 nt, Human
uguucuuaugaugaagcacuga

SEQ ID NO: 115593 - RNA, 22 nt, Human
uguucuuugccagugauuuaau

SEQ ID NO: 115594 - RNA, 22 nt, Human
uguucuuuggcuucacagcucu

SEQ ID NO: 115595 - RNA, 22 nt, Human
uguucuuuucucuaaacugaua

SEQ ID NO: 115596 - RNA, 18 nt, Human
uguugaaacuucagguaa

SEQ ID NO: 115597 - RNA, 22 nt, Human
uguugaagauaaaguucucauu

SEQ ID NO: 115598 - RNA, 22 nt, Human
uguugauuaguguuuagacuua

SEQ ID NO: 115599 - RNA, 19 nt, Human
uguugccagguaucauguu

SEQ ID NO: 115600 - RNA, 22 nt, Human
uguugccuggggaagcucugau

SEQ ID NO: 115601 - RNA, 22 nt, Human
uguugcuaaggggaaugagagc

SEQ ID NO: 115602 - RNA, 22 nt, Human
uguugcuguaugaauaggaagg

SEQ ID NO: 115603 - RNA, 22 nt, Human
uguuggagcccgagucagggag

SEQ ID NO: 115604 - RNA, 22 nt, Human
uguuggaugaccuuguaauuau

SEQ ID NO: 115605 - RNA, 22 nt, Human
uguuggcaucucugagagaguu

SEQ ID NO: 115606 - RNA, 22 nt, Human
uguugggaucgaaugguggaac

SEQ ID NO: 115607 - RNA, 22 nt, Human
uguuggggucaggagcuagccu

SEQ ID NO: 115608 - RNA, 22 nt, Human
uguugguaaauagcuuagcaau

SEQ ID NO: 115609 - RNA, 22 nt, Human
uguugguaggauuugcuucagc

SEQ ID NO: 115610 - RNA, 19 nt, Human
uguuggugcggauguggag

SEQ ID NO: 115611 - RNA, 22 nt, Human
uguuuaagauccgucagucacu

SEQ ID NO: 115612 - RNA, 22 nt, Human
ugugcuucugcagagacuauuu

SEQ ID NO: 115613 - RNA, 22 nt, Human
ugugcuugucguggagccaggc

SEQ ID NO: 115614 - RNA, 22 nt, Human
ugugcuuucaaaguuaaguaaa

SEQ ID NO: 115615 - RNA, 20 nt, Human
uguggaaaaacagaagcaga

SEQ ID NO: 115616 - RNA, 22 nt, Human
uguggaaaagaauaagggagau

SEQ ID NO: 115617 - RNA, 22 nt, Human
uguggaagggacacuggacugg

SEQ ID NO: 115618 - RNA, 22 nt, Human
uguggaaugggagugagaagac

SEQ ID NO: 115619 - RNA, 22 nt, Human
uguggaauuucuuucagguaug

SEQ ID NO: 115620 - RNA, 22 nt, Human
uguggacauacuaggccuaggc

SEQ ID NO: 115621 - RNA, 22 nt, Human
uguggacuugaaauuacuuuuc

SEQ ID NO: 115622 - RNA, 22 nt, Human
uguggacuuuaguaggugagag

SEQ ID NO: 115623 - RNA, 22 nt, Human
uguggacuuuggcauuggacuu

SEQ ID NO: 115624 - RNA, 22 nt, Human
uguggagcccccaggagugggg

SEQ ID NO: 115625 - RNA, 22 nt, Human
uguggaggauucugaugccagc

SEQ ID NO: 115626 - RNA, 22 nt, Human
uguggaugagggagugaacaaa

SEQ ID NO: 115627 - RNA, 22 nt, Human
uguggcacuucucuccuuguaa

SEQ ID NO: 115628 - RNA, 21 nt, Human
uguggcagagacaaugcuagu

SEQ ID NO: 115629 - RNA, 22 nt, Human
uguggcagagagagcuuccuug

SEQ ID NO: 115630 - RNA, 22 nt, Human
uguggcagaguaaggacccagu

SEQ ID NO: 115631 - RNA, 22 nt, Human
uguggcagauuuuauaaauugc

SEQ ID NO: 115632 - RNA, 22 nt, Human
uguggcaggcaagauguacaga

SEQ ID NO: 115633 - RNA, 18 nt, Human
uguggcaggggugggaga

SEQ ID NO: 115634 - RNA, 22 nt, Human
uguggcaguauaagagcuagaa

SEQ ID NO: 115635 - RNA, 21 nt, Human
uguggcaucauugaucuguga

SEQ ID NO: 115636 - RNA, 22 nt, Human
uguggccaccagagcugcuauu

SEQ ID NO: 115637 - RNA, 22 nt, Human
uguggccacuguuucuuuuccu

SEQ ID NO: 115638 - RNA, 22 nt, Human
uguggccagagguacuauuuua

SEQ ID NO: 115639 - RNA, 22 nt, Human
uguggccucucaggcuugauca

SEQ ID NO: 115640 - RNA, 22 nt, Human
uguggccugggagcugaggucu

SEQ ID NO: 115641 - RNA, 22 nt, Human
uguggccuuucaaggauggaau

SEQ ID NO: 115642 - RNA, 22 nt, Human
uguggcucucaugcacucccag

SEQ ID NO: 115643 - RNA, 21 nt, Human
uguggcugacacccuuuggga

SEQ ID NO: 115644 - RNA, 22 nt, Human
uguggcugcuccugggugguca

SEQ ID NO: 115645 - RNA, 22 nt, Human
uguggcuggauugauuuuaccu

SEQ ID NO: 115646 - RNA, 15 nt, Human
uguggcuggcuccug

SEQ ID NO: 115647 - RNA, 18 nt, Human
uguggcugguccacacug

SEQ ID NO: 115648 - RNA, 22 nt, Human
uguggcugucuguucuccuagg

SEQ ID NO: 115649 - RNA, 22 nt, Human
uguggcuguugaggaccccaag

SEQ ID NO: 115650 - RNA, 22 nt, Human
ugugggaagauguugcaggaga

SEQ ID NO: 115651 - RNA, 22 nt, Human
ugugggaaguuuggagggaaag

SEQ ID NO: 115652 - RNA, 23 nt, Human
ugugggaauguuggagaggaaac

SEQ ID NO: 115653 - RNA, 22 nt, Human
ugugggagaaggaagcaagcug

SEQ ID NO: 115654 - RNA, 22 nt, Human
ugugggcaaaggguagcugggu

SEQ ID NO: 115655 - RNA, 19 nt, Human
ugugggcaagggauggcag

SEQ ID NO: 115656 - RNA, 22 nt, Human
ugugggcacuaaugacaugcag

SEQ ID NO: 115657 - RNA, 22 nt, Human
ugugggcaggcccgggucugag

SEQ ID NO: 115658 - RNA, 22 nt, Human
ugugggccaggaggccucagug

SEQ ID NO: 115659 - RNA, 22 nt, Human
ugugggccucagcaggacucca

SEQ ID NO: 115660 - RNA, 20 nt, Human
ugugggccuucggcgugcuc

SEQ ID NO: 115661 - RNA, 23 nt, Human
ugugggcgcauuguaaggguagc

SEQ ID NO: 115662 - RNA, 22 nt, Human
ugugggcucuaauggcagcaga

SEQ ID NO: 115663 - RNA, 22 nt, Human
ugugggcuguacugagggcagg

SEQ ID NO: 115664 - RNA, 22 nt, Human
ugugggcuuuggagucaggaag

SEQ ID NO: 115665 - RNA, 22 nt, Human
uguggggaagaguaugacuugg

SEQ ID NO: 115666 - RNA, 22 nt, Human
uguggggcagcuagccggccug

SEQ ID NO: 115667 - RNA, 22 nt, Human
uguggggccucgugcuagcugg

SEQ ID NO: 115668 - RNA, 22 nt, Human
uuccuuaggcuguuugcagugc

SEQ ID NO: 115669 - RNA, 22 nt, Human
uuccuuaggggacagggggaua

SEQ ID NO: 115670 - RNA, 22 nt, Human
uuccuuagugccucuuccgcug

SEQ ID NO: 115671 - RNA, 22 nt, Human
uuccuucaaacgccuccugcac

SEQ ID NO: 115672 - RNA, 22 nt, Human
uuccuuccagcuugugacaguc

SEQ ID NO: 115673 - RNA, 22 nt, Human
uuccuuccauagcaaaacaugc

SEQ ID NO: 115674 - RNA, 22 nt, Human
uuccuuccccuagcugagaaac

SEQ ID NO: 115675 - RNA, 22 nt, Human
uuccuucuaauauucugccugu

SEQ ID NO: 115676 - RNA, 22 nt, Human
uuccuucucagcccucgaggau

SEQ ID NO: 115677 - RNA, 18 nt, Human
uuccuucugauguauaug

SEQ ID NO: 115678 - RNA, 22 nt, Human
uuccuucuggagcccggggagc

SEQ ID NO: 115679 - RNA, 22 nt, Human
uuccuucuucauuguguuacag

SEQ ID NO: 115680 - RNA, 22 nt, Human
uuccuucuuccaaacccaucau

SEQ ID NO: 115681 - RNA, 22 nt, Human
uuccuucuuguaaugaucugcc

SEQ ID NO: 115682 - RNA, 22 nt, Human
uuccuugaaagcuggacauggg

SEQ ID NO: 115683 - RNA, 22 nt, Human
uuccuugaaugagucauggaaa

SEQ ID NO: 115684 - RNA, 22 nt, Human
uuccuuggaaagagacgucgcu

SEQ ID NO: 115685 - RNA, 22 nt, Human
uuccuuggccccaugcccaggg

SEQ ID NO: 115686 - RNA, 18 nt, Human
uuccuugguaacauaugc

SEQ ID NO: 115687 - RNA, 22 nt, Human
uuccuugguagggacaacucug

SEQ ID NO: 115688 - RNA, 22 nt, Human
uuccuuggugcccgauguauuu

SEQ ID NO: 115689 - RNA, 22 nt, Human
uuccuuucacguuuuaaugcac

SEQ ID NO: 115690 - RNA, 22 nt, Human
uuccuuucucuggacugcagcc

SEQ ID NO: 115691 - RNA, 22 nt, Human
uuccuuugggaaaucacuaagg

SEQ ID NO: 115692 - RNA, 22 nt, Human
uuccuuuuacaaauagccuccu

SEQ ID NO: 115693 - RNA, 22 nt, Human
uuccuuuuagaaucaugaagac

SEQ ID NO: 115694 - RNA, 22 nt, Human
uucgaguuggcuuuauuaaacu

SEQ ID NO: 115695 - RNA, 22 nt, Human
uucgcagccagugagcagagga

SEQ ID NO: 115696 - RNA, 22 nt, Human
uucgcagggagacaggcucucu

SEQ ID NO: 115697 - RNA, 20 nt, Human
uucgcugggaguggccaggc

SEQ ID NO: 115698 - RNA, 22 nt, Human
uucuaaaauaaguuuaucuggu

SEQ ID NO: 115699 - RNA, 22 nt, Human
uucuaaacacuacgggauuugg

SEQ ID NO: 115700 - RNA, 20 nt, Human
uucuaaacuguuaggcuugc

SEQ ID NO: 115701 - RNA, 22 nt, Human
uucuaaauggggauccuuucug

SEQ ID NO: 115702 - RNA, 22 nt, Human
uucuaacaaguggcuuguuagu

SEQ ID NO: 115703 - RNA, 22 nt, Human
uucuaacuaaagucuuuguuuu

SEQ ID NO: 115704 - RNA, 22 nt, Human
uucuaacuaauuggaaauggaa

SEQ ID NO: 115705 - RNA, 22 nt, Human
uucuaacuccacuucccacucc

SEQ ID NO: 115706 - RNA, 22 nt, Human
uucuaagaaauggaaaacgauu

SEQ ID NO: 115707 - RNA, 22 nt, Human
uucuaagauucaugaggacagg

SEQ ID NO: 115708 - RNA, 22 nt, Human
uucuaagggguucacaggcaua

SEQ ID NO: 115709 - RNA, 23 nt, Human
uucuaagguaugguuuauaccug

SEQ ID NO: 115710 - RNA, 22 nt, Human
uucuaaguccuaccugaaagca

SEQ ID NO: 115711 - RNA, 22 nt, Human
uucuaagugauucuagcuggac

SEQ ID NO: 115712 - RNA, 22 nt, Human
uucuaaguguugacaaagucua

SEQ ID NO: 115713 - RNA, 22 nt, Human
uucuaaucccagcucuacuacu

SEQ ID NO: 115714 - RNA, 22 nt, Human
uucuaaucugggcuucugcagu

SEQ ID NO: 115715 - RNA, 22 nt, Human
uucuaauugaccuuaggcugug

SEQ ID NO: 115716 - RNA, 22 nt, Human
uucuaauuguguuugcauaucu

SEQ ID NO: 115717 - RNA, 22 nt, Human
uucuacaauaugaauaaugaag

SEQ ID NO: 115718 - RNA, 22 nt, Human
uucuacacagugcggguuaaca

SEQ ID NO: 115719 - RNA, 21 nt, Human
uucuacaggaugaaugaaaac

SEQ ID NO: 115720 - RNA, 22 nt, Human
uucuacagguacugaaguacau

SEQ ID NO: 115721 - RNA, 22 nt, Human
uuagcagcuaagucaugcugca

SEQ ID NO: 115722 - RNA, 22 nt, Human
uuagcagcuuagacugccuggg

SEQ ID NO: 115723 - RNA, 22 nt, Human
uuagcagcuuuuaaaugguucu

SEQ ID NO: 115724 - RNA, 22 nt, Human
uuagcagguuucuggcucuugg

SEQ ID NO: 115725 - RNA, 22 nt, Human
uuagcaguuuccauuuugguca

SEQ ID NO: 115726 - RNA, 22 nt, Human
uuagcaucugcuguaagcuuau

SEQ ID NO: 115727 - RNA, 22 nt, Human
uuagcauucucauuugcauaaa

SEQ ID NO: 115728 - RNA, 22 nt, Human
uuagcauuucaguacacauguu

SEQ ID NO: 115729 - RNA, 22 nt, Human
uuagcauuucauuucaagagga

SEQ ID NO: 115730 - RNA, 22 nt, Human
uuagccagugaaauggagaaau

SEQ ID NO: 115731 - RNA, 22 nt, Human
uuagccauggacugaauugacu

SEQ ID NO: 115732 - RNA, 22 nt, Human
uuagccauguugaagauuuaga

SEQ ID NO: 115733 - RNA, 22 nt, Human
uuagccauucugauagguaugu

SEQ ID NO: 115734 - RNA, 22 nt, Human
uuagccauuugaggucuucauu

SEQ ID NO: 115735 - RNA, 22 nt, Human
uuagcgcacaucacagggggaa

SEQ ID NO: 115736 - RNA, 22 nt, Human
uuagcucuuuguagcuauuucu

SEQ ID NO: 115737 - RNA, 22 nt, Human
uuagcugucaagguggcugcag

SEQ ID NO: 115738 - RNA, 22 nt, Human
uuagcuucuuacauuucauccu

SEQ ID NO: 115739 - RNA, 22 nt, Human
uuagcuuucaugaaccuggucg

SEQ ID NO: 115740 - RNA, 22 nt, Human
uuagcuuuggauugcauuuagu

SEQ ID NO: 115741 - RNA, 22 nt, Human
uuagcuuuuaagugugcuacau

SEQ ID NO: 115742 - RNA, 22 nt, Human
uuagcuuuugagaaugauuucu

SEQ ID NO: 115743 - RNA, 22 nt, Human
uuaggaaaagaagacauuucua

SEQ ID NO: 115744 - RNA, 22 nt, Human
uuaggaaaauggaguccuuuua

SEQ ID NO: 115745 - RNA, 22 nt, Human
uuaggaagcacacaguaaauau

SEQ ID NO: 115746 - RNA, 22 nt, Human
uuaggaaggacuuggauucugg

SEQ ID NO: 115747 - RNA, 20 nt, Human
uuaggaagucacaauuucag

SEQ ID NO: 115748 - RNA, 22 nt, Human
uuaggaauauagacuaaguaga

SEQ ID NO: 115749 - RNA, 22 nt, Human
uuaggaauauuuucugaguagu

SEQ ID NO: 115750 - RNA, 22 nt, Human
uuaggaaucaccugcagaucuu

SEQ ID NO: 115751 - RNA, 22 nt, Human
uuaggaaugagauuucuaguga

SEQ ID NO: 115752 - RNA, 22 nt, Human
uuaggaauuuaucacagacugg

SEQ ID NO: 115753 - RNA, 22 nt, Human
uuaggaggucuauggacauccu

SEQ ID NO: 115754 - RNA, 22 nt, Human
uuaggauagucuguuagaaaag

SEQ ID NO: 115755 - RNA, 22 nt, Human
uuaggcaaagauauuacguagu

SEQ ID NO: 115756 - RNA, 22 nt, Human
uuaggcaaagcuggaauccagg

SEQ ID NO: 115757 - RNA, 22 nt, Human
uuaggcaaugaauuauuccaag

SEQ ID NO: 115758 - RNA, 22 nt, Human
uuaggcauuggaaggucagcuu

SEQ ID NO: 115759 - RNA, 22 nt, Human
uuagggaaacaaacauuuucuu

SEQ ID NO: 115760 - RNA, 22 nt, Human
uuagggaaagcagcauucccuu

SEQ ID NO: 115761 - RNA, 22 nt, Human
uuagggaaauaaaauuaucagu

SEQ ID NO: 115762 - RNA, 22 nt, Human
uuagggcaggcaugagagaacu

SEQ ID NO: 115763 - RNA, 22 nt, Human
uuagggcuuuucugaauaggcc

SEQ ID NO: 115764 - RNA, 22 nt, Human
uuagguaaguaggaucaaaaaa

SEQ ID NO: 115765 - RNA, 22 nt, Human
uuaggucauucccugagcagau

SEQ ID NO: 115766 - RNA, 22 nt, Human
uuaguaaauaaagucuacuuuc

SEQ ID NO: 115767 - RNA, 22 nt, Human
uuaguaauuagaaaguaauucu

SEQ ID NO: 115768 - RNA, 22 nt, Human
uuaguacauagaugaugguuga

SEQ ID NO: 115769 - RNA, 22 nt, Human
uuaguagaagacagauaacaaa

SEQ ID NO: 115770 - RNA, 22 nt, Human
uuaguagaauguuauagcaauu

SEQ ID NO: 115771 - RNA, 22 nt, Human
uuaguaucuggaaaucacauua

SEQ ID NO: 115772 - RNA, 22 nt, Human
uuagucacaugcccaucucuga

SEQ ID NO: 115773 - RNA, 22 nt, Human
uuagugaguuaaguguccugag

SEQ ID NO: 115774 - RNA, 22 nt, Human
uuagugauuacuacauagauga

SEQ ID NO: 115775 - RNA, 22 nt, Human
uuagugguaaggaugaaauuuc

SEQ ID NO: 115776 - RNA, 23 nt, Human
uuaguguaaggcaggcacaguug

SEQ ID NO: 115777 - RNA, 22 nt, Human
uuaguguacuuagugcucuaag

SEQ ID NO: 115778 - RNA, 22 nt, Human
uuagugucucaccuaaaaucug

SEQ ID NO: 115779 - RNA, 22 nt, Human
uuaguguuagggccuguuaccu

SEQ ID NO: 115780 - RNA, 22 nt, Human
uuaguuaauaggucuucagcuu

SEQ ID NO: 115781 - RNA, 22 nt, Human
uuaguuagagcccuauguuagg

SEQ ID NO: 115782 - RNA, 22 nt, Human
uuaguuaggaaacaaaguuguu

SEQ ID NO: 115783 - RNA, 22 nt, Human
uuaguuaggauuuggugguaua

SEQ ID NO: 115784 - RNA, 22 nt, Human
uuaguuagggcuccugaggacc

SEQ ID NO: 115785 - RNA, 22 nt, Human
uuaguuauacuacugaauggag

SEQ ID NO: 115786 - RNA, 22 nt, Human
uuaguucucaugaauuuuaagu

SEQ ID NO: 115787 - RNA, 22 nt, Human
uuaguugauagccaaaauuuau

SEQ ID NO: 115788 - RNA, 22 nt, Human
uguuacacagcagaauagcaag

SEQ ID NO: 115789 - RNA, 21 nt, Human
uguuacaguccaaauguuugu

SEQ ID NO: 115790 - RNA, 22 nt, Human
uguuacaguggcuuuuuaaaca

SEQ ID NO: 115791 - RNA, 22 nt, Human
uguuaccaaggcugcuucuagu

SEQ ID NO: 115792 - RNA, 22 nt, Human
uguuacuauuaguuugagcaua

SEQ ID NO: 115793 - RNA, 22 nt, Human
uguuacugauuugauauacagu

SEQ ID NO: 115794 - RNA, 22 nt, Human
uguuacuuugauugguauucua

SEQ ID NO: 115795 - RNA, 22 nt, Human
uguuaggacuccccagaagcug

SEQ ID NO: 115796 - RNA, 22 nt, Human
uguuaguauuggcaaauuuguu

SEQ ID NO: 115797 - RNA, 22 nt, Human
uguuaguguaauuccaguuuuc

SEQ ID NO: 115798 - RNA, 22 nt, Human
uguuauaacaucgguugacuaa

SEQ ID NO: 115799 - RNA, 22 nt, Human
uguuauacuauuuagagguaca

SEQ ID NO: 115800 - RNA, 22 nt, Human
uguuaucagagagaggugcugu

SEQ ID NO: 115801 - RNA, 19 nt, Human
uguuaugacuuugccuuuu

SEQ ID NO: 115802 - RNA, 22 nt, Human
uguuaugagaaagacauuaggu

SEQ ID NO: 115803 - RNA, 22 nt, Human
uguuauuaaauaauucucucuu

SEQ ID NO: 115804 - RNA, 23 nt, Human
uguuauuccagguuaauguacuu

SEQ ID NO: 115805 - RNA, 22 nt, Human
uguuauugagguuacuuauaag

SEQ ID NO: 115806 - RNA, 21 nt, Human
uguucaaacguacacauuucu

SEQ ID NO: 115807 - RNA, 22 nt, Human
uguucaaaugaucuucuuaaau

SEQ ID NO: 115808 - RNA, 22 nt, Human
uguucacaacgugcagguuugu

SEQ ID NO: 115809 - RNA, 22 nt, Human
uguucacaagcagauguugcuu

SEQ ID NO: 115810 - RNA, 22 nt, Human
uguucacaggggagccauuuau

SEQ ID NO: 115811 - RNA, 22 nt, Human
uguucacaucgauggauuuugc

SEQ ID NO: 115812 - RNA, 22 nt, Human
uguucacauguacaugaauauu

SEQ ID NO: 115813 - RNA, 22 nt, Human
uguucagaaaacagauaacuaa

SEQ ID NO: 115814 - RNA, 22 nt, Human
uguucagcccucuauuaaucag

SEQ ID NO: 115815 - RNA, 22 nt, Human
uguucaguccaauguuggaaaa

SEQ ID NO: 115816 - RNA, 22 nt, Human
uguucauuacccaucccagguc

SEQ ID NO: 115817 - RNA, 22 nt, Human
uguucauucugugaccugguuc

SEQ ID NO: 115818 - RNA, 22 nt, Human
uguucauuugcaacaaccaaau

SEQ ID NO: 115819 - RNA, 20 nt, Human
uguuccaagcuaaugaauga

SEQ ID NO: 115820 - RNA, 22 nt, Human
uguuccagauucggcgugggac

SEQ ID NO: 115821 - RNA, 22 nt, Human
uguuccagauuuagccaaccga

SEQ ID NO: 115822 - RNA, 22 nt, Human
uguuccaucaguuuuugguuga

SEQ ID NO: 115823 - RNA, 22 nt, Human
uguucccaagauaagauuauga

SEQ ID NO: 115824 - RNA, 22 nt, Human
uguucccugguaaacugacucc

SEQ ID NO: 115825 - RNA, 22 nt, Human
uguuccgaccgugggguuugau

SEQ ID NO: 115826 - RNA, 22 nt, Human
uguuccugaaugccuggcuggc

SEQ ID NO: 115827 - RNA, 22 nt, Human
uguuccugacggccaaagaggu

SEQ ID NO: 115828 - RNA, 22 nt, Human
uguuccuggaaagccagguggg

SEQ ID NO: 115829 - RNA, 19 nt, Human
uguucuagcggcaccaggc

SEQ ID NO: 115830 - RNA, 22 nt, Human
uuaucugaaacuuuugggacca

SEQ ID NO: 115831 - RNA, 19 nt, Human
uuaucuguguugcaguggu

SEQ ID NO: 115832 - RNA, 22 nt, Human
uuaucuguuuucugugcguuuc

SEQ ID NO: 115833 - RNA, 22 nt, Human
uuaucuugaguauugagauucu

SEQ ID NO: 115834 - RNA, 22 nt, Human
uuaugaaagacauuucuguugg

SEQ ID NO: 115835 - RNA, 22 nt, Human
uuaugaaguuccuguuacagug

SEQ ID NO: 115836 - RNA, 22 nt, Human
uuaugcaaagaaauagacuaau

SEQ ID NO: 115837 - RNA, 22 nt, Human
uuaugcaaaggggccucuuccu

SEQ ID NO: 115838 - RNA, 22 nt, Human
uuaugcaaggacuuauuacagu

SEQ ID NO: 115839 - RNA, 22 nt, Human
uuaugcuaaguggaauaagcca

SEQ ID NO: 115840 - RNA, 22 nt, Human
uuauggaauacuuaugcugcag

SEQ ID NO: 115841 - RNA, 22 nt, Human
uuauggaauggagaaagucugc

SEQ ID NO: 115842 - RNA, 22 nt, Human
uuauggaauuugcaaaagguua

SEQ ID NO: 115843 - RNA, 18 nt, Human
uuauggcugugaaagagu

SEQ ID NO: 115844 - RNA, 22 nt, Human
uuauggcuucugugaagaauuu

SEQ ID NO: 115845 - RNA, 22 nt, Human
uuaugggagcaauuggggaggu

SEQ ID NO: 115846 - RNA, 22 nt, Human
uuauguaauuuguuugcucuuc

SEQ ID NO: 115847 - RNA, 22 nt, Human
uuauguagcagaaagauguuug

SEQ ID NO: 115848 - RNA, 22 nt, Human
uuauguagucacuguggucuug

SEQ ID NO: 115849 - RNA, 22 nt, Human
uuauguagugacugacuguuag

SEQ ID NO: 115850 - RNA, 22 nt, Human
uuauguaugaauauaguagaag

SEQ ID NO: 115851 - RNA, 22 nt, Human
uuauguauggauggcugaaagu

SEQ ID NO: 115852 - RNA, 22 nt, Human
uuauguucagcaucugcuuuau

SEQ ID NO: 115853 - RNA, 22 nt, Human
uuauguugggaaaagucagauu

SEQ ID NO: 115854 - RNA, 22 nt, Human
uuauguuuuauggcuauaucau

SEQ ID NO: 115855 - RNA, 22 nt, Human
uuauuaagugcguacuguaugc

SEQ ID NO: 115856 - RNA, 22 nt, Human
uuauuacaaugcagaaaauaga

SEQ ID NO: 115857 - RNA, 22 nt, Human
uuauuagaucuguuagggaucc

SEQ ID NO: 115858 - RNA, 22 nt, Human
uuauuaggaacucaggauuuuu

SEQ ID NO: 115859 - RNA, 22 nt, Human
uuauuagguuauucucuguacu

SEQ ID NO: 115860 - RNA, 22 nt, Human
uuauuauguggaugaaagaugu

SEQ ID NO: 115861 - RNA, 22 nt, Human
uuauuauuccccaagucauuau

SEQ ID NO: 115862 - RNA, 22 nt, Human
uuauuauuggugaguuaaggaa

SEQ ID NO: 115863 - RNA, 22 nt, Human
uuauucacaugggcucauucua

SEQ ID NO: 115864 - RNA, 22 nt, Human
uuauucaccucuauuagacuca

SEQ ID NO: 115865 - RNA, 22 nt, Human
uuauucacucugaagccauccu

SEQ ID NO: 115866 - RNA, 22 nt, Human
uuauucagcauuuagaggaagg

SEQ ID NO: 115867 - RNA, 22 nt, Human
uuauucaggaagguguuacuua

SEQ ID NO: 115868 - RNA, 22 nt, Human
uuauucaggaggugcucgaagg

SEQ ID NO: 115869 - RNA, 22 nt, Human
uuauucagggauaacauccagg

SEQ ID NO: 115870 - RNA, 22 nt, Human
uuauucagucugucuagggagu

SEQ ID NO: 115871 - RNA, 22 nt, Human
uuauucaguucccuucacucuc

SEQ ID NO: 115872 - RNA, 22 nt, Human
uuauuccaaaucaugguugcau

SEQ ID NO: 115873 - RNA, 22 nt, Human
uuauuccacagcucagaauuuu

SEQ ID NO: 115874 - RNA, 22 nt, Human
uuauuccagcuaagaguccugg

SEQ ID NO: 115875 - RNA, 22 nt, Human
uuauuccagugggugguuucuc

SEQ ID NO: 115876 - RNA, 22 nt, Human
uuauucugaacuagacucucau

SEQ ID NO: 115877 - RNA, 22 nt, Human
uuauucugacuaauguauaacu

SEQ ID NO: 115878 - RNA, 21 nt, Human
uuauucugagaugagauucuu

SEQ ID NO: 115879 - RNA, 22 nt, Human
uuauucugugaacaugguuaau

SEQ ID NO: 115880 - RNA, 22 nt, Human
uuauucuucuucucuugccagg

SEQ ID NO: 115881 - RNA, 22 nt, Human
uuauugaaggaacugaaauaaa

SEQ ID NO: 115882 - RNA, 22 nt, Human
uuauugacucccagcuuuucca

SEQ ID NO: 115883 - RNA, 22 nt, Human
uuauugacugaaaugagaguga

SEQ ID NO: 115884 - RNA, 22 nt, Human
uuauugacugaucagagaggga

SEQ ID NO: 115885 - RNA, 21 nt, Human
uuauugagacauuuguggaaa

SEQ ID NO: 115886 - RNA, 22 nt, Human
uuauugagcaacucuggggcuc

SEQ ID NO: 115887 - RNA, 22 nt, Human
uuauugaguuuacagcuuuaga

SEQ ID NO: 115888 - RNA, 23 nt, Human
uuauugcaagguaaaauugcuga

SEQ ID NO: 115889 - RNA, 17 nt, Human
uuauugcuauaagcuga

SEQ ID NO: 115890 - RNA, 22 nt, Human
uuauugcuauggugagagggau

SEQ ID NO: 115891 - RNA, 22 nt, Human
uuauugcucuauuauggccuaa

SEQ ID NO: 115892 - RNA, 22 nt, Human
uuauuggaaaagggcuguaauu

SEQ ID NO: 115893 - RNA, 18 nt, Human
uuauuggugcugcuguuc

SEQ ID NO: 115894 - RNA, 22 nt, Human
uuauuuaaaagugguaagauuc

SEQ ID NO: 115895 - RNA, 22 nt, Human
uuauuuacaacucuucucuucc

SEQ ID NO: 115896 - RNA, 22 nt, Human
uuauuuaggagaaggaacccug

SEQ ID NO: 115897 - RNA, 22 nt, Human
uuauuuauguuaacagucgaga

SEQ ID NO: 115898 - RNA, 22 nt, Human
uuauuucauugauuucuaagac

SEQ ID NO: 115899 - RNA, 20 nt, Human
uuauuuccaguccagguccu

SEQ ID NO: 115900 - RNA, 22 nt, Human
uuauuuccuagggaauuugccu

SEQ ID NO: 115901 - RNA, 22 nt, Human
uuauuuccucucuaauagggua

SEQ ID NO: 115902 - RNA, 22 nt, Human
uuauuuccugacacagcugauu

SEQ ID NO: 115903 - RNA, 22 nt, Human
uuauuucuugucuauguagcca

SEQ ID NO: 115904 - RNA, 22 nt, Human
uuauuugacuucuugcuaugcu

SEQ ID NO: 115905 - RNA, 22 nt, Human
uugaaaaguuuugaaacacucu

SEQ ID NO: 115906 - RNA, 19 nt, Human
uugaaaauauggaucugag

SEQ ID NO: 115907 - RNA, 20 nt, Human
uugaaaaugcauugugcagu

SEQ ID NO: 115908 - RNA, 22 nt, Human
uugaaaaugguaagcaugauau

SEQ ID NO: 115909 - RNA, 22 nt, Human
uugaaacauucuccuauugauu

SEQ ID NO: 115910 - RNA, 22 nt, Human
uugaaacucccuuuugucuagu

SEQ ID NO: 115911 - RNA, 22 nt, Human
uugaaacugcuuauugaauuug

SEQ ID NO: 115912 - RNA, 22 nt, Human
uugaaacugggaagcagggggu

SEQ ID NO: 115913 - RNA, 22 nt, Human
uugaaagacuucuccugugaaa

SEQ ID NO: 115914 - RNA, 22 nt, Human
uugaaagauauguuaaucuuuc

SEQ ID NO: 115915 - RNA, 19 nt, Human
uugaaagauuagcuuucua

SEQ ID NO: 115916 - RNA, 22 nt, Human
uugaaagcuccauauuguagag

SEQ ID NO: 115917 - RNA, 22 nt, Human
uugaaaggaauacagaggccua

SEQ ID NO: 115918 - RNA, 22 nt, Human
uugaaaggcacaggcaccuggg

SEQ ID NO: 115919 - RNA, 22 nt, Human
uugaaagggauauaucuuucug

SEQ ID NO: 115920 - RNA, 22 nt, Human
uugaaaggugacauuguuagag

SEQ ID NO: 115921 - RNA, 21 nt, Human
uugaaaguaaauucagcagcu

SEQ ID NO: 115922 - RNA, 22 nt, Human
uugaaagucacaauggcauuaa

SEQ ID NO: 115923 - RNA, 22 nt, Human
uugaaauagaugcgucagagau

SEQ ID NO: 115924 - RNA, 22 nt, Human
uugaaaucaccacuagcauuug

SEQ ID NO: 115925 - RNA, 22 nt, Human
uugaaaugagacuaauugauug

SEQ ID NO: 115926 - RNA, 22 nt, Human
uugaaaugaucuauuucaguag

SEQ ID NO: 115927 - RNA, 22 nt, Human
uugaaauggaagugaaaauucu

SEQ ID NO: 115928 - RNA, 22 nt, Human
uugaaauuuuaggccuugcaau

SEQ ID NO: 115929 - RNA, 22 nt, Human
uugaacaauuugguauacaaac

SEQ ID NO: 115930 - RNA, 22 nt, Human
uugaacauaaaucacuggucag

SEQ ID NO: 115931 - RNA, 22 nt, Human
uugaacauuagaauaaguaauu

SEQ ID NO: 115932 - RNA, 22 nt, Human
uugaacauuggcaauuucauau

SEQ ID NO: 115933 - RNA, 22 nt, Human
uugaacuaauagguaucuugua

SEQ ID NO: 115934 - RNA, 22 nt, Human
uugaacugguaguuggaaaucu

SEQ ID NO: 115935 - RNA, 22 nt, Human
uugaacuuugaaccauuccuau

SEQ ID NO: 115936 - RNA, 19 nt, Human
uugaagaauaaaaacacau

SEQ ID NO: 115937 - RNA, 22 nt, Human
uugaagacacagacauauagag

SEQ ID NO: 115938 - RNA, 22 nt, Human
uugaagacuaauuuagauaaug

SEQ ID NO: 115939 - RNA, 22 nt, Human
uuccucagggcggaugggcagg

SEQ ID NO: 115940 - RNA, 22 nt, Human
uuccucaguuagugccugaggc

SEQ ID NO: 115941 - RNA, 22 nt, Human
uuccucaucugugcaccucacu

SEQ ID NO: 115942 - RNA, 22 nt, Human
uuccuccacgugacaggagcca

SEQ ID NO: 115943 - RNA, 22 nt, Human
uuccuccagccuggagcacuuc

SEQ ID NO: 115944 - RNA, 17 nt, Human
uuccuccucaccauguu

SEQ ID NO: 115945 - RNA, 22 nt, Human
uuccuccuucccauuccugggg

SEQ ID NO: 115946 - RNA, 22 nt, Human
uuccucuagcuucucacuaaca

SEQ ID NO: 115947 - RNA, 22 nt, Human
uuccucuauucuaacaaaagua

SEQ ID NO: 115948 - RNA, 22 nt, Human
uuccucuccucccaccagguga

SEQ ID NO: 115949 - RNA, 22 nt, Human
uuccucucgcucuccggggccc

SEQ ID NO: 115950 - RNA, 22 nt, Human
uuccucuuccaucuucccaggg

SEQ ID NO: 115951 - RNA, 22 nt, Human
uuccucuuucucugugcuaugu

SEQ ID NO: 115952 - RNA, 22 nt, Human
uuccucuuugcauccucaacuc

SEQ ID NO: 115953 - RNA, 22 nt, Human
uuccugaaaauacagggagacc

SEQ ID NO: 115954 - RNA, 22 nt, Human
uuccugaaaauacagggagaga

SEQ ID NO: 115955 - RNA, 22 nt, Human
uuccugaacauuucuaaguuga

SEQ ID NO: 115956 - RNA, 22 nt, Human
uuccugagaacauggcagcuua

SEQ ID NO: 115957 - RNA, 22 nt, Human
uuccugagucccggguaaagau

SEQ ID NO: 115958 - RNA, 23 nt, Human
uuccugagugcuggagagagugc

SEQ ID NO: 115959 - RNA, 22 nt, Human
uuccugcaaagccagaugucga

SEQ ID NO: 115960 - RNA, 22 nt, Human
uuccugcagcaaggagaagcug

SEQ ID NO: 115961 - RNA, 22 nt, Human
uuccugcauggauugaggcuau

SEQ ID NO: 115962 - RNA, 22 nt, Human
uuccugcuccauuugcugagcu

SEQ ID NO: 115963 - RNA, 22 nt, Human
uuccuggagaguuuucccaaag

SEQ ID NO: 115964 - RNA, 21 nt, Human
uuccuggaggcagaaacguga

SEQ ID NO: 115965 - RNA, 22 nt, Human
uuccuggcaaagugagcaucac

SEQ ID NO: 115966 - RNA, 22 nt, Human
uuccuggcacugcagugguuga

SEQ ID NO: 115967 - RNA, 23 nt, Human
uuccuggcagguacaacuuuuac

SEQ ID NO: 115968 - RNA, 22 nt, Human
uuccuggcauuaugggaggcug

SEQ ID NO: 115969 - RNA, 22 nt, Human
uuccuggccaagcagaguggaa

SEQ ID NO: 115970 - RNA, 22 nt, Human
uuccuggccuaagguaggugac

SEQ ID NO: 115971 - RNA, 22 nt, Human
uuccuggcugucaugcccuagu

SEQ ID NO: 115972 - RNA, 22 nt, Human
uuccugggaggcuguguacuug

SEQ ID NO: 115973 - RNA, 22 nt, Human
uuccugggauuauugucaagca

SEQ ID NO: 115974 - RNA, 22 nt, Human
uuccugggggcagcagucuuga

SEQ ID NO: 115975 - RNA, 22 nt, Human
uuccuggggggauagauuucac

SEQ ID NO: 115976 - RNA, 19 nt, Human
uuccugggguuccauugug

SEQ ID NO: 115977 - RNA, 22 nt, Human
uuccuggguugugcauuguaca

SEQ ID NO: 115978 - RNA, 22 nt, Human
uuccuggguuuacguauugggu

SEQ ID NO: 115979 - RNA, 22 nt, Human
uuccugguuugccuggaaucca

SEQ ID NO: 115980 - RNA, 22 nt, Human
uuccuguaguugugcaauguac

SEQ ID NO: 115981 - RNA, 22 nt, Human
uuccugugaaauauagguccau

SEQ ID NO: 115982 - RNA, 22 nt, Human
uuccugugauauuagccacugu

SEQ ID NO: 115983 - RNA, 22 nt, Human
uuccuguggccuuacaucugug

SEQ ID NO: 115984 - RNA, 23 nt, Human
uuccugugguauauuuuauaggg

SEQ ID NO: 115985 - RNA, 22 nt, Human
uuccugugguccagagucaucc

SEQ ID NO: 115986 - RNA, 22 nt, Human
uuccuguguacguguuucgcug

SEQ ID NO: 115987 - RNA, 22 nt, Human
uuccugugugaccgagacagug

SEQ ID NO: 115988 - RNA, 22 nt, Human
uuccugugugacucaagugguu

SEQ ID NO: 115989 - RNA, 22 nt, Human
uuccuguuucauagaaaacuga

SEQ ID NO: 115990 - RNA, 22 nt, Human
uuccuuagccugccuuccaggg

SEQ ID NO: 115991 - RNA, 22 nt, Human
uuccuuagcuccucauggccug

SEQ ID NO: 115992 - RNA, 20 nt, Human
uuccuuaggcauuggaagaa

SEQ ID NO: 115993 - RNA, 22 nt, Human
uuccuuagggucagccagaucu

SEQ ID NO: 115994 - RNA, 22 nt, Human
uuccuuaguuauuugguccccu

SEQ ID NO: 115995 - RNA, 22 nt, Human
uuccuucccucaguggcugaag

SEQ ID NO: 115996 - RNA, 22 nt, Human
uuccuuccgggcaccaggcacu

SEQ ID NO: 115997 - RNA, 22 nt, Human
uuccuucuaauuuuacaccuga

SEQ ID NO: 115998 - RNA, 22 nt, Human
uuccuucuagagcuuguuuagg

SEQ ID NO: 115999 - RNA, 22 nt, Human
uuccuucuuccuuuaguaacca

SEQ ID NO: 116000 - RNA, 22 nt, Human
uuccuugauuaguacaugaagg

SEQ ID NO: 116001 - RNA, 22 nt, Human
uuccuuggauacaaguaacuuu

SEQ ID NO: 116002 - RNA, 22 nt, Human
uuccuuguugaaaaugucugca

SEQ ID NO: 116003 - RNA, 20 nt, Human
uuccuuuucgccucucuccc

SEQ ID NO: 116004 - RNA, 22 nt, Human
uuccuuuuuacauaaucacauu

SEQ ID NO: 116005 - RNA, 22 nt, Human
uucgcauucagcuuugccacug

SEQ ID NO: 116006 - RNA, 22 nt, Human
uucggucuggcuguuauacgcu

SEQ ID NO: 116007 - RNA, 22 nt, Human
uucguguggagauguuucugca

SEQ ID NO: 116008 - RNA, 22 nt, Human
uucguuuaguccacaaaugcau

SEQ ID NO: 116009 - RNA, 22 nt, Human
uucuaaaaccaauucugcuucu

SEQ ID NO: 116010 - RNA, 22 nt, Human
uucuaaacggcuucacaggaau

SEQ ID NO: 116011 - RNA, 22 nt, Human
uucuaaacugaaguauuuuaaa

SEQ ID NO: 116012 - RNA, 22 nt, Human
uucuaaacuucaauucuaaauu

SEQ ID NO: 116013 - RNA, 22 nt, Human
uucuaaagugcaaucugacaga

SEQ ID NO: 116014 - RNA, 22 nt, Human
uucuaaauguaaauaguaugau

SEQ ID NO: 116015 - RNA, 23 nt, Human
uucuaaccuuaaagcccuuugga

SEQ ID NO: 116016 - RNA, 22 nt, Human
uucuaacucaaagcuucuuuca

SEQ ID NO: 116017 - RNA, 22 nt, Human
uucuaacucuacacuagcuuug

SEQ ID NO: 116018 - RNA, 22 nt, Human
uucuaacuggcuugacaguuuc

SEQ ID NO: 116019 - RNA, 22 nt, Human
uucuaacuggugcagugcugca

SEQ ID NO: 116020 - RNA, 22 nt, Human
uucuaacuuucaagguccuuuc

SEQ ID NO: 116021 - RNA, 20 nt, Human
uucuaagguuuuggugcaca

SEQ ID NO: 116022 - RNA, 22 nt, Human
uucuaagucugcugucuucauc

SEQ ID NO: 116023 - RNA, 19 nt, Human
uucuaaguuuugcuugcug

SEQ ID NO: 116024 - RNA, 22 nt, Human
uucuaaugaaaguggaccaugg

SEQ ID NO: 116025 - RNA, 22 nt, Human
uucuaauuaaaucuacgcuagg

SEQ ID NO: 116026 - RNA, 22 nt, Human
uucuacacucacccagcuguaa

SEQ ID NO: 116027 - RNA, 22 nt, Human
uucuacacuuuucauuagcuag

SEQ ID NO: 116028 - RNA, 22 nt, Human
uucuacagacuauaacugugau

SEQ ID NO: 116029 - RNA, 22 nt, Human
uucuacagugacugcagccaua

SEQ ID NO: 116030 - RNA, 22 nt, Human
uucuacauugugaaguucuuua

SEQ ID NO: 116031 - RNA, 22 nt, Human
uucuagaacaggcaaaaccaau

SEQ ID NO: 116032 - RNA, 22 nt, Human
uucuagaaccaugacuucaggg

SEQ ID NO: 116033 - RNA, 22 nt, Human
uucuagaagaacuagccaggaa

SEQ ID NO: 116034 - RNA, 22 nt, Human
uucuagaagcugaaaaggggga

SEQ ID NO: 116035 - RNA, 20 nt, Human
uucuagaaguuugcuaccca

SEQ ID NO: 116036 - RNA, 22 nt, Human
uugggccucucaaagugcuggg

SEQ ID NO: 116037 - RNA, 22 nt, Human
uugggccugaucggaauaagga

SEQ ID NO: 116038 - RNA, 21 nt, Human
uugggccuuuucugguagcuu

SEQ ID NO: 116039 - RNA, 22 nt, Human
uugggcucaggaguuugagacc

SEQ ID NO: 116040 - RNA, 22 nt, Human
uugggcugaggagggcguggcc

SEQ ID NO: 116041 - RNA, 22 nt, Human
uugggcugcagcaauuauuagu

SEQ ID NO: 116042 - RNA, 22 nt, Human
uugggcuggagaugaucugcug

SEQ ID NO: 116043 - RNA, 22 nt, Human
uugggcuggauaagucuuuguu

SEQ ID NO: 116044 - RNA, 23 nt, Human
uugggcuggcucucgaugccucu

SEQ ID NO: 116045 - RNA, 22 nt, Human
uugggcuugacaagcugucaag

SEQ ID NO: 116046 - RNA, 22 nt, Human
uuggggagaaaugaaaugaagu

SEQ ID NO: 116047 - RNA, 22 nt, Human
uuggggcaugauuagauuauga

SEQ ID NO: 116048 - RNA, 22 nt, Human
uucagcagagaaauuacauaau

SEQ ID NO: 116049 - RNA, 22 nt, Human
uucagcagguggugaguucugc

SEQ ID NO: 116050 - RNA, 22 nt, Human
uucagcagucguccaggaaaag

SEQ ID NO: 116051 - RNA, 22 nt, Human
uucagccaauuagaagccccac

SEQ ID NO: 116052 - RNA, 22 nt, Human
uucagccugucugcagaccccu

SEQ ID NO: 116053 - RNA, 22 nt, Human
uucagcuaaugggaauaagagu

SEQ ID NO: 116054 - RNA, 20 nt, Human
uucagcuaccagguaucuuc

SEQ ID NO: 116055 - RNA, 17 nt, Human
uucagcuacucaacaca

SEQ ID NO: 116056 - RNA, 22 nt, Human
uucagcuauuauacccacuuuu

SEQ ID NO: 116057 - RNA, 21 nt, Human
uucagcuauucagaaggggag

SEQ ID NO: 116058 - RNA, 22 nt, Human
uucagcucagcacugacaagau

SEQ ID NO: 116059 - RNA, 22 nt, Human
uucagcucagucugugcagcag

SEQ ID NO: 116060 - RNA, 22 nt, Human
uucaggaagugcugccuggugu

SEQ ID NO: 116061 - RNA, 20 nt, Human
uucaggaauaagauagcagc

SEQ ID NO: 116062 - RNA, 22 nt, Human
uucaggagaaaguucaguacuu

SEQ ID NO: 116063 - RNA, 22 nt, Human
uucaggaggugagcaagaaggg

SEQ ID NO: 116064 - RNA, 22 nt, Human
uucaggagugucaggagugccu

SEQ ID NO: 116065 - RNA, 22 nt, Human
uucaggauaugugauaucugaa

SEQ ID NO: 116066 - RNA, 22 nt, Human
uucaggaucaaguugccaguag

SEQ ID NO: 116067 - RNA, 22 nt, Human
uucaggauccccaccgcguuua

SEQ ID NO: 116068 - RNA, 22 nt, Human
uucaggaugacaccauguccag

SEQ ID NO: 116069 - RNA, 22 nt, Human
uucaggauucucucccauuuac

SEQ ID NO: 116070 - RNA, 22 nt, Human
uucaggauucugugucugacaa

SEQ ID NO: 116071 - RNA, 22 nt, Human
uucaggauucuuucagacuggg

SEQ ID NO: 116072 - RNA, 22 nt, Human
uucaggauuguguuuuuccuga

SEQ ID NO: 116073 - RNA, 22 nt, Human
uucaggcauggaaacuggauua

SEQ ID NO: 116074 - RNA, 22 nt, Human
uucagggacuuagugucaguuu

SEQ ID NO: 116075 - RNA, 22 nt, Human
uucagggcaugagggacacauc

SEQ ID NO: 116076 - RNA, 20 nt, Human
uucagggcuuuggggacacc

SEQ ID NO: 116077 - RNA, 22 nt, Human
uucagggucuagaguaucuacc

SEQ ID NO: 116078 - RNA, 22 nt, Human
uucaggugggccuuuugagcau

SEQ ID NO: 116079 - RNA, 22 nt, Human
uucaguaaaacacugcaauguc

SEQ ID NO: 116080 - RNA, 22 nt, Human
uucaguauaaaaucaaagugau

SEQ ID NO: 116081 - RNA, 22 nt, Human
uucaguaucccugcuuggacag

SEQ ID NO: 116082 - RNA, 22 nt, Human
uucaguaucugcaaaaugggga

SEQ ID NO: 116083 - RNA, 21 nt, Human
uucaguaugcgucaugcuguu

SEQ ID NO: 116084 - RNA, 22 nt, Human
uucaguauguuggacguuaugu

SEQ ID NO: 116085 - RNA, 22 nt, Human
uucaguauucaaauaugucuua

SEQ ID NO: 116086 - RNA, 22 nt, Human
uucagucagugacuaagcaguu

SEQ ID NO: 116087 - RNA, 22 nt, Human
uucaguccucacaaccucacua

SEQ ID NO: 116088 - RNA, 22 nt, Human
uucagucucaagugcugcucac

SEQ ID NO: 116089 - RNA, 22 nt, Human
uucagucucaauuuaaguuuaa

SEQ ID NO: 116090 - RNA, 22 nt, Human
uucagugcagacgccgaagccc

SEQ ID NO: 116091 - RNA, 22 nt, Human
uucagugcuaaaaagucucaag

SEQ ID NO: 116092 - RNA, 22 nt, Human
uucagugugccuaagucaguug

SEQ ID NO: 116093 - RNA, 22 nt, Human
uucagugugcuucaggacguua

SEQ ID NO: 116094 - RNA, 22 nt, Human
uucaguguggcccaugaagagg

SEQ ID NO: 116095 - RNA, 22 nt, Human
uucaguguggugcacaguuuug

SEQ ID NO: 116096 - RNA, 22 nt, Human
uucaguguuaaauucaaagagu

SEQ ID NO: 116097 - RNA, 22 nt, Human
uucaguuccuugugcgaauucc

SEQ ID NO: 116098 - RNA, 22 nt, Human
uucaguuucaaauccuggaugc

SEQ ID NO: 116099 - RNA, 19 nt, Human
uucaguuuccucaucugga

SEQ ID NO: 116100 - RNA, 22 nt, Human
uucaguuucguuaucuaugaga

SEQ ID NO: 116101 - RNA, 22 nt, Human
uucaguuucuaaaugcuccucu

SEQ ID NO: 116102 - RNA, 22 nt, Human
uucaguuucuucccugugaaau

SEQ ID NO: 116103 - RNA, 22 nt, Human
uucaguuugcuacaagcaacau

SEQ ID NO: 116104 - RNA, 22 nt, Human
uucauaaguugguguugacuuu

SEQ ID NO: 116105 - RNA, 19 nt, Human
uucauaaguuuagugaggg

SEQ ID NO: 116106 - RNA, 22 nt, Human
uucauaaucaccaaaaacugga

SEQ ID NO: 116107 - RNA, 22 nt, Human
uucauacaaugggauauuauga

SEQ ID NO: 116108 - RNA, 22 nt, Human
uucauacacgaaaaugcaugca

SEQ ID NO: 116109 - RNA, 23 nt, Human
uucauacagaaacaucacuucau

SEQ ID NO: 116110 - RNA, 22 nt, Human
uucauacaugagacuagaugca

SEQ ID NO: 116111 - RNA, 22 nt, Human
uucauacauguguacuguucca

SEQ ID NO: 116112 - RNA, 22 nt, Human
uucauacucacuccaauaacug

SEQ ID NO: 116113 - RNA, 22 nt, Human
uucauacucuucccugggcaaa

SEQ ID NO: 116114 - RNA, 22 nt, Human
uucauacuguguuuccaaguuu

SEQ ID NO: 116115 - RNA, 22 nt, Human
uucauagacccagaacucauua

SEQ ID NO: 116116 - RNA, 22 nt, Human
uucauagguuugcugugaacau

SEQ ID NO: 116117 - RNA, 22 nt, Human
uucauagugauuguucagauag

SEQ ID NO: 116118 - RNA, 22 nt, Human
uucauagugcuuaauuugauaa

SEQ ID NO: 116119 - RNA, 22 nt, Human
uucauauaaauggaaucagaau

SEQ ID NO: 116120 - RNA, 22 nt, Human
uucauauuucuuuaaggacuuu

SEQ ID NO: 116121 - RNA, 22 nt, Human
uucauauuugaaacagaaguua

SEQ ID NO: 116122 - RNA, 23 nt, Human
uucaucaguugcuguugcagaac

SEQ ID NO: 116123 - RNA, 22 nt, Human
uucaucaugauguuccccucua

SEQ ID NO: 116124 - RNA, 22 nt, Human
uucaucauuacagucauguuau

SEQ ID NO: 116125 - RNA, 22 nt, Human
uucaucauugccagucuuuaaa

SEQ ID NO: 116126 - RNA, 22 nt, Human
uucauccauaugcagagagcuu

SEQ ID NO: 116127 - RNA, 22 nt, Human
uucaucuagugugcucguaacg

SEQ ID NO: 116128 - RNA, 22 nt, Human
uucaucuggaauuuauguuaua

SEQ ID NO: 116129 - RNA, 22 nt, Human
uucaucuguagcaucuuccaau

SEQ ID NO: 116130 - RNA, 22 nt, Human
uucaucuguaguuuuuccaagg

SEQ ID NO: 116131 - RNA, 22 nt, Human
uucaugaacgaacauauguaua

SEQ ID NO: 116132 - RNA, 22 nt, Human
uucaugaagggugaauauaguc

SEQ ID NO: 116133 - RNA, 22 nt, Human
uucaugaauaccccuucuguaa

SEQ ID NO: 116134 - RNA, 22 nt, Human
uucaugaauauauugaauuagc

SEQ ID NO: 116135 - RNA, 21 nt, Human
uucaugagauaaccagcugua

SEQ ID NO: 116136 - RNA, 22 nt, Human
uucaugagcagaagggaggggu

SEQ ID NO: 116137 - RNA, 22 nt, Human
uucaugcacuauuucuucuagc

SEQ ID NO: 116138 - RNA, 20 nt, Human
uucaugcagugguugcugug

SEQ ID NO: 116139 - RNA, 22 nt, Human
uucaugcuuguuccuccaccug

SEQ ID NO: 116140 - RNA, 22 nt, Human
uucauggccuacuuugcuucaa

SEQ ID NO: 116141 - RNA, 22 nt, Human
uucauguaacuuuucuucucca

SEQ ID NO: 116142 - RNA, 22 nt, Human
uucauguaccguguaccaggca

SEQ ID NO: 116143 - RNA, 22 nt, Human
uucauguaguguaaugucuuca

SEQ ID NO: 116144 - RNA, 22 nt, Human
uucauguaugaggccaaucuuu

SEQ ID NO: 116145 - RNA, 22 nt, Human
uucauguauugcauuguguccu

SEQ ID NO: 116146 - RNA, 22 nt, Human
uucauguauuuaucauguaaau

SEQ ID NO: 116147 - RNA, 22 nt, Human
uucaugugaucacagauuguaa

SEQ ID NO: 116148 - RNA, 23 nt, Human
uucauguggaccuagaggccugu

SEQ ID NO: 116149 - RNA, 22 nt, Human
uucauguguuugauagcccaga

SEQ ID NO: 116150 - RNA, 22 nt, Human
uucauguucaugcuuaggaaaa

SEQ ID NO: 116151 - RNA, 22 nt, Human
uucauguuggcauguuuuuagg

SEQ ID NO: 116152 - RNA, 22 nt, Human
uucauguuguaguauguaucag

SEQ ID NO: 116153 - RNA, 22 nt, Human
uugugcucuguguuauuuaagg

SEQ ID NO: 116154 - RNA, 23 nt, Human
uuguggaagggagauggcaacag

SEQ ID NO: 116155 - RNA, 22 nt, Human
uuguggcucgugagauguuagg

SEQ ID NO: 116156 - RNA, 22 nt, Human
uuguggcugucgagaauugagg

SEQ ID NO: 116157 - RNA, 22 nt, Human
uucuucuucaagugcugcauuc

SEQ ID NO: 116158 - RNA, 22 nt, Human
uucauguuuccucuugugcugc

SEQ ID NO: 116159 - RNA, 22 nt, Human
uucauguuuguaggacugaggc

SEQ ID NO: 116160 - RNA, 22 nt, Human
uucauguuuuauucaguaauua

SEQ ID NO: 116161 - RNA, 17 nt, Human
uucauuaauaaaagcaa

SEQ ID NO: 116162 - RNA, 22 nt, Human
uucauuaauucauucagugacu

SEQ ID NO: 116163 - RNA, 22 nt, Human
uucauuacauucaaaaggcauu

SEQ ID NO: 116164 - RNA, 22 nt, Human
uucauuacugcgguagucacac

SEQ ID NO: 116165 - RNA, 22 nt, Human
uucauuagcaaggucuucaagu

SEQ ID NO: 116166 - RNA, 22 nt, Human
uucauucaaagaggcauccaag

SEQ ID NO: 116167 - RNA, 22 nt, Human
uucauucagugagacuaggacg

SEQ ID NO: 116168 - RNA, 22 nt, Human
uucauucauuacgugccaggca

SEQ ID NO: 116169 - RNA, 22 nt, Human
uucauucccuuauauuagcauu

SEQ ID NO: 116170 - RNA, 22 nt, Human
uucauuccuucuguaccuugcc

SEQ ID NO: 116171 - RNA, 22 nt, Human
uucauucuuauuugugaucugg

SEQ ID NO: 116172 - RNA, 22 nt, Human
uucauucuugggaucagagagu

SEQ ID NO: 116173 - RNA, 22 nt, Human
uucauucuuuuacaugugaaua

SEQ ID NO: 116174 - RNA, 22 nt, Human
uucauugaaccacuuuauucuu

SEQ ID NO: 116175 - RNA, 22 nt, Human
uucauugagcuguacacuuagg

SEQ ID NO: 116176 - RNA, 22 nt, Human
uucauugauuccaggcucuucu

SEQ ID NO: 116177 - RNA, 22 nt, Human
uucauuguacuuuaagagaugc

SEQ ID NO: 116178 - RNA, 22 nt, Human
uucauugucucuguuugccuuc

SEQ ID NO: 116179 - RNA, 22 nt, Human
uucauuuaaucagaaucucuaa

SEQ ID NO: 116180 - RNA, 22 nt, Human
uucauuuaauuuguguauuaac

SEQ ID NO: 116181 - RNA, 23 nt, Human
uucauuuaggaguucauaagagc

SEQ ID NO: 116182 - RNA, 22 nt, Human
uucauuuauucagcagguauuu

SEQ ID NO: 116183 - RNA, 22 nt, Human
uucauuugucugcuauagaucc

SEQ ID NO: 116184 - RNA, 22 nt, Human
uuccaaacugccaauucagaag

SEQ ID NO: 116185 - RNA, 22 nt, Human
uuccaaaguuaguuauuagaaa

SEQ ID NO: 116186 - RNA, 22 nt, Human
uuccaaauuaaaauguacaaug

SEQ ID NO: 116187 - RNA, 22 nt, Human
uuccaacaauguguuauuguuc

SEQ ID NO: 116188 - RNA, 22 nt, Human
uuccaaggagagcucgaccuca

SEQ ID NO: 116189 - RNA, 22 nt, Human
uuccaaggcaacagccuaggcu

SEQ ID NO: 116190 - RNA, 22 nt, Human
uuccaaggccagacagggcagu

SEQ ID NO: 116191 - RNA, 22 nt, Human
uuccaagguguucugcugguuu

SEQ ID NO: 116192 - RNA, 22 nt, Human
uuccaaguagaagcauuugcau

SEQ ID NO: 116193 - RNA, 22 nt, Human
uuccaagugggggaagcugagu

SEQ ID NO: 116194 - RNA, 22 nt, Human
uuccaagugucagaucagauuu

SEQ ID NO: 116195 - RNA, 22 nt, Human
uuccaauauuuacaaugcauua

SEQ ID NO: 116196 - RNA, 22 nt, Human
uuccaauugcagaucagauaca

SEQ ID NO: 116197 - RNA, 22 nt, Human
uuccaauugugagauuuuuuaa

SEQ ID NO: 116198 - RNA, 22 nt, Human
uuccaauuguucuuuggaaucu

SEQ ID NO: 116199 - RNA, 22 nt, Human
uuccacaacaaccaagcauaua

SEQ ID NO: 116200 - RNA, 22 nt, Human
uuccacaaugguuaagcucguu

SEQ ID NO: 116201 - RNA, 22 nt, Human
uuccacagaugaaaauuaaguu

SEQ ID NO: 116202 - RNA, 22 nt, Human
uuccacaggacuaaaugucauc

SEQ ID NO: 116203 - RNA, 22 nt, Human
uuccacagguuucagacuguuc

SEQ ID NO: 116204 - RNA, 22 nt, Human
uuccacucuacucuggccaguc

SEQ ID NO: 116205 - RNA, 19 nt, Human
uuccacuuggguuagaauu

SEQ ID NO: 116206 - RNA, 22 nt, Human
uuccagaaaccugaaaguuucu

SEQ ID NO: 116207 - RNA, 21 nt, Human
uuccagaaaucucuuucuuca

SEQ ID NO: 116208 - RNA, 22 nt, Human
uuccagaacucaagaaaugccc

SEQ ID NO: 116209 - RNA, 22 nt, Human
uuccagagaaaagguuuauuuc

SEQ ID NO: 116210 - RNA, 22 nt, Human
uuccagagaggcucauguuccc

SEQ ID NO: 116211 - RNA, 23 nt, Human
uuccagaggaagaagucaugacu

SEQ ID NO: 116212 - RNA, 22 nt, Human
uuccagaggcucuaggggagaa

SEQ ID NO: 116213 - RNA, 22 nt, Human
uuccagaggcuugaggaaaauu

SEQ ID NO: 116214 - RNA, 22 nt, Human
uuccagagguagcaaugacuug

SEQ ID NO: 116215 - RNA, 22 nt, Human
uuccagagguucucagcccugu

SEQ ID NO: 116216 - RNA, 22 nt, Human
uuccagagugacugugccacuu

SEQ ID NO: 116217 - RNA, 22 nt, Human
uuccagaguugggggagugguu

SEQ ID NO: 116218 - RNA, 22 nt, Human
uuccagauauuuuuauguggaa

SEQ ID NO: 116219 - RNA, 22 nt, Human
uuccagcuuagagcaucauguu

SEQ ID NO: 116220 - RNA, 22 nt, Human
uuccaggaacaaacucaccuua

SEQ ID NO: 116221 - RNA, 22 nt, Human
uuccaggaagcaguuagcagcc

SEQ ID NO: 116222 - RNA, 22 nt, Human
uuccaggaagcucucggccucu

SEQ ID NO: 116223 - RNA, 22 nt, Human
uuccaggaggcacugacagagg

SEQ ID NO: 116224 - RNA, 22 nt, Human
uuccaggaggucaaaggccugu

SEQ ID NO: 116225 - RNA, 22 nt, Human
uuccaggauagcuuucaggaau

SEQ ID NO: 116226 - RNA, 22 nt, Human
uuccaggauggcaauaaugaau

SEQ ID NO: 116227 - RNA, 22 nt, Human
uuccaggccgggcaggaaacac

SEQ ID NO: 116228 - RNA, 22 nt, Human
uuccaggcuauucccuuuggag

SEQ ID NO: 116229 - RNA, 22 nt, Human
uuccaggcuucucuggggcguc

SEQ ID NO: 116230 - RNA, 22 nt, Human
uuccagggaagagcaaggcagu

SEQ ID NO: 116231 - RNA, 22 nt, Human
uuccagggcuaauuccugugga

SEQ ID NO: 116232 - RNA, 19 nt, Human
uuccaggugcuguggggag

SEQ ID NO: 116233 - RNA, 18 nt, Human
uuccaguagcuguaucac

SEQ ID NO: 116234 - RNA, 22 nt, Human
uuccagucuaguaccuggaugc

SEQ ID NO: 116235 - RNA, 22 nt, Human
uuccaguucagaugcaacaggg

SEQ ID NO: 116236 - RNA, 19 nt, Human
uuccaguucuaaucucuuc

SEQ ID NO: 116237 - RNA, 22 nt, Human
uuccaguugguagaauguaagg

SEQ ID NO: 116238 - RNA, 22 nt, Human
uuccaguuugcaguugacacua

SEQ ID NO: 116239 - RNA, 22 nt, Human
uuccauaauaaccugagagaaa

SEQ ID NO: 116240 - RNA, 22 nt, Human
uuccauauguauauagcuguua

SEQ ID NO: 116241 - RNA, 22 nt, Human
uuccauauuguacucuuuggag

SEQ ID NO: 116242 - RNA, 22 nt, Human
uuccauauuuguguggcaaaag

SEQ ID NO: 116243 - RNA, 22 nt, Human
uuccaucugcuagguaaaugaa

SEQ ID NO: 116244 - RNA, 22 nt, Human
uuccaugaaagugaaauggagc

SEQ ID NO: 116245 - RNA, 22 nt, Human
uuccaugaagggcagccucuca

SEQ ID NO: 116246 - RNA, 22 nt, Human
uuccaugaguagcaguauuucc

SEQ ID NO: 116247 - RNA, 22 nt, Human
uuccauugaguaccuggagaca

SEQ ID NO: 116248 - RNA, 22 nt, Human
uuccauuuauucuuguccagau

SEQ ID NO: 116249 - RNA, 22 nt, Human
uucccacacccauauugugauu

SEQ ID NO: 116250 - RNA, 22 nt, Human
uucccacaguucagaacaaagg

SEQ ID NO: 116251 - RNA, 22 nt, Human
uucccacauucuuuacauucau

SEQ ID NO: 116252 - RNA, 22 nt, Human
uucccagaaugaauggauggag

SEQ ID NO: 116253 - RNA, 22 nt, Human
uucccagaauuguugggaacug

SEQ ID NO: 116254 - RNA, 22 nt, Human
uucccagaccuguaggaucaga

SEQ ID NO: 116255 - RNA, 22 nt, Human
uucccagagauaagacgucuua

SEQ ID NO: 116256 - RNA, 22 nt, Human
uucccaggaagccucuccaagc

SEQ ID NO: 116257 - RNA, 22 nt, Human
uucccagugauuaaggcagugg

SEQ ID NO: 116258 - RNA, 22 nt, Human
uucccauuugugguagugaauu

SEQ ID NO: 116259 - RNA, 22 nt, Human
uuccccuugauaaugcaguaag

SEQ ID NO: 116260 - RNA, 22 nt, Human
uuccccuugcacuaucacccug

SEQ ID NO: 116261 - RNA, 22 nt, Human
uuccccuuuuugugugcagcug

SEQ ID NO: 116262 - RNA, 22 nt, Human
uucccuaagcauugcaauggcg

SEQ ID NO: 116263 - RNA, 22 nt, Human
uucccucccuggcugccauuuc

SEQ ID NO: 116264 - RNA, 22 nt, Human
uucccuccgaaccucagugcug

SEQ ID NO: 116265 - RNA, 22 nt, Human
uucccuccuaugcccacugaaa

SEQ ID NO: 116266 - RNA, 22 nt, Human
uuuauuaugauggacaccuucg

SEQ ID NO: 116267 - RNA, 22 nt, Human
uuuauuauguacaggcacuaua

SEQ ID NO: 116268 - RNA, 22 nt, Human
uuuauuauucucuggagaaugu

SEQ ID NO: 116269 - RNA, 22 nt, Human
uuuauuauucuguucucucuac

SEQ ID NO: 116270 - RNA, 19 nt, Human
uuuauucaccuuuaccuug

SEQ ID NO: 116271 - RNA, 22 nt, Human
uuuauucaucaucuguucauau

SEQ ID NO: 116272 - RNA, 22 nt, Human
uuuauuccaguguuucucaaau

SEQ ID NO: 116273 - RNA, 22 nt, Human
uuuauuccaugugucuaugacc

SEQ ID NO: 116274 - RNA, 18 nt, Human
uuuauuccugcccccagc

SEQ ID NO: 116275 - RNA, 22 nt, Human
uugaccuuggcuuuuaaaauau

SEQ ID NO: 116276 - RNA, 22 nt, Human
uugacuauacucuggcggaaaa

SEQ ID NO: 116277 - RNA, 17 nt, Human
uugacuguuaauggguu

SEQ ID NO: 116278 - RNA, 22 nt, Human
uugacuucagaauguugauggu

SEQ ID NO: 116279 - RNA, 22 nt, Human
uugagaaaacacagaguuuauu

SEQ ID NO: 116280 - RNA, 22 nt, Human
uugagaaaggggucaauaucuc

SEQ ID NO: 116281 - RNA, 22 nt, Human
uugagaaauacuuuuguagccu

SEQ ID NO: 116282 - RNA, 22 nt, Human
uugagaaccacugaguuagaua

SEQ ID NO: 116283 - RNA, 22 nt, Human
uugagaacucuguauguccagc

SEQ ID NO: 116284 - RNA, 22 nt, Human
uugagaagaauguguugaguuu

SEQ ID NO: 116285 - RNA, 19 nt, Human
uugagaauuaucugaguca

SEQ ID NO: 116286 - RNA, 22 nt, Human
uugagacacaaggcacaguaag

SEQ ID NO: 116287 - RNA, 22 nt, Human
uugagacuccugguguagaaua

SEQ ID NO: 116288 - RNA, 22 nt, Human
uugagacugccuugucgucugc

SEQ ID NO: 116289 - RNA, 22 nt, Human
uugagagaaaaaauuuauuggu

SEQ ID NO: 116290 - RNA, 22 nt, Human
uugagagaggaaacauagucuc

SEQ ID NO: 116291 - RNA, 22 nt, Human
uugagaguuaccagcagaggaa

SEQ ID NO: 116292 - RNA, 22 nt, Human
uugagauagguggaaucucuuu

SEQ ID NO: 116293 - RNA, 22 nt, Human
uugagcaagccugcggcgggaa

SEQ ID NO: 116294 - RNA, 22 nt, Human
uugagcacaacucuuggagagc

SEQ ID NO: 116295 - RNA, 22 nt, Human
uugagcagaucgggcugugggg

SEQ ID NO: 116296 - RNA, 20 nt, Human
uugagcagcagugcuguguc

SEQ ID NO: 116297 - RNA, 22 nt, Human
uugagcaggaacuagaagauag

SEQ ID NO: 116298 - RNA, 22 nt, Human
uugagcaggauggcuaugcaca

SEQ ID NO: 116299 - RNA, 19 nt, Human
uugagcagugcuuagcacc

SEQ ID NO: 116300 - RNA, 22 nt, Human
uugagcauaugcauuuccaauu

SEQ ID NO: 116301 - RNA, 22 nt, Human
uugagcauuuguuuugaaagag

SEQ ID NO: 116302 - RNA, 22 nt, Human
uugagcccaggaggccugggug

SEQ ID NO: 116303 - RNA, 22 nt, Human
uugagcucagugacucgacuuu

SEQ ID NO: 116304 - RNA, 22 nt, Human
uugagcuguaaggugggaugug

SEQ ID NO: 116305 - RNA, 20 nt, Human
uugagcuuccaagucuuugu

SEQ ID NO: 116306 - RNA, 22 nt, Human
uugagcuugaggaguuauuuga

SEQ ID NO: 116307 - RNA, 22 nt, Human
uugagcuuuacaacagcuguua

SEQ ID NO: 116308 - RNA, 20 nt, Human
uugagcuuuuaguacagaca

SEQ ID NO: 116309 - RNA, 22 nt, Human
uugaggagaagacuuugcuucc

SEQ ID NO: 116310 - RNA, 22 nt, Human
uugaggagcacuagucagguau

SEQ ID NO: 116311 - RNA, 22 nt, Human
uugaggaguagaagcuuugaau

SEQ ID NO: 116312 - RNA, 22 nt, Human
uugaggagucaggggcacggaa

SEQ ID NO: 116313 - RNA, 22 nt, Human
uugaggaguggcgcuggacuua

SEQ ID NO: 116314 - RNA, 23 nt, Human
uugaggcaaacauguaaguagga

SEQ ID NO: 116315 - RNA, 20 nt, Human
uugaggcaugucuagaagua

SEQ ID NO: 116316 - RNA, 22 nt, Human
uugaggccaaaaaguccuauga

SEQ ID NO: 116317 - RNA, 22 nt, Human
uugaggcugcacaguacaggcu

SEQ ID NO: 116318 - RNA, 22 nt, Human
uugagggagaaagcugaggugu

SEQ ID NO: 116319 - RNA, 22 nt, Human
uugagggauuuuaaaugaacaa

SEQ ID NO: 116320 - RNA, 19 nt, Human
uugaggggccaggggagau

SEQ ID NO: 116321 - RNA, 21 nt, Human
uugagggguauugcuuuucuc

SEQ ID NO: 116322 - RNA, 22 nt, Human
uugagguaauaaacagccauuc

SEQ ID NO: 116323 - RNA, 22 nt, Human
uugagguacaaacaugagguuu

SEQ ID NO: 116324 - RNA, 22 nt, Human
uugagguacaaugggucaguua

SEQ ID NO: 116325 - RNA, 22 nt, Human
uugagguagagaaaggaaauga

SEQ ID NO: 116326 - RNA, 22 nt, Human
uugagguauugauaaaacauuu

SEQ ID NO: 116327 - RNA, 20 nt, Human
uugaggucaaggacuaggcc

SEQ ID NO: 116328 - RNA, 22 nt, Human
uugagguccaggugugggcagg

SEQ ID NO: 116329 - RNA, 22 nt, Human
uugagguccagucuccacccac

SEQ ID NO: 116330 - RNA, 22 nt, Human
uugaggucccaaacccacugag

SEQ ID NO: 116331 - RNA, 22 nt, Human
uugaggucugugauaaaaguca

SEQ ID NO: 116332 - RNA, 22 nt, Human
uugagucaguaauuccauuucu

SEQ ID NO: 116333 - RNA, 18 nt, Human
uugagucuagccauggaa

SEQ ID NO: 116334 - RNA, 22 nt, Human
uugagucucugccaaaacacaa

SEQ ID NO: 116335 - RNA, 22 nt, Human
uugagucuucaguaaaagggua

SEQ ID NO: 116336 - RNA, 22 nt, Human
uugaguucagggguugauugga

SEQ ID NO: 116337 - RNA, 22 nt, Human
uugaguuccaggaugguuguua

SEQ ID NO: 116338 - RNA, 22 nt, Human
uugaguucuguguauccuuugu

SEQ ID NO: 116339 - RNA, 22 nt, Human
uugauaaaaugauaucuucuuu

SEQ ID NO: 116340 - RNA, 22 nt, Human
uugauaaaaugaugaaaucacu

SEQ ID NO: 116341 - RNA, 18 nt, Human
uugauaaacaauuucauu

SEQ ID NO: 116342 - RNA, 23 nt, Human
uugauacagaagaaucaguuugu

SEQ ID NO: 116343 - RNA, 22 nt, Human
uugauacauuuuuaggauaaac

SEQ ID NO: 116344 - RNA, 22 nt, Human
uugauacuauuaagcacugggc

SEQ ID NO: 116345 - RNA, 20 nt, Human
uugauaggcagcuugucagg

SEQ ID NO: 116346 - RNA, 22 nt, Human
uugauauuagaguauuuguuug

SEQ ID NO: 116347 - RNA, 22 nt, Human
uugauauucugagaagcugaag

SEQ ID NO: 116348 - RNA, 22 nt, Human
uugaucaucuaagaguaauagu

SEQ ID NO: 116349 - RNA, 22 nt, Human
uugaucaucuugugcugacggc

SEQ ID NO: 116350 - RNA, 22 nt, Human
uugaucauuuuucugguaaaau

SEQ ID NO: 116351 - RNA, 22 nt, Human
uugauccaguugaaagugauga

SEQ ID NO: 116352 - RNA, 22 nt, Human
uugaucucauuguucuccucag

SEQ ID NO: 116353 - RNA, 22 nt, Human
uugaucucuguugcugucuuug

SEQ ID NO: 116354 - RNA, 22 nt, Human
uugaucuuacaguguucuucca

SEQ ID NO: 116355 - RNA, 22 nt, Human
uugaugcugucuuucagaauca

SEQ ID NO: 116356 - RNA, 22 nt, Human
uugauggcuuuuuggcagagcu

SEQ ID NO: 116357 - RNA, 22 nt, Human
uugauguacagaauuguucaca

SEQ ID NO: 116358 - RNA, 22 nt, Human
uugauguucauaaaugauacag

SEQ ID NO: 116359 - RNA, 22 nt, Human
uugauuaaacaggcauauucaa

SEQ ID NO: 116360 - RNA, 22 nt, Human
uugauucacaauuaccaagacu

SEQ ID NO: 116361 - RNA, 22 nt, Human
uugauucagagaagauuggccc

SEQ ID NO: 116362 - RNA, 20 nt, Human
uugauucccucuaaacucgc

SEQ ID NO: 116363 - RNA, 22 nt, Human
uugauuccuugaaauauccuug

SEQ ID NO: 116364 - RNA, 22 nt, Human
uugauucuauggcuccgggagu

SEQ ID NO: 116365 - RNA, 22 nt, Human
uugauucuauguuguugucuca

SEQ ID NO: 116366 - RNA, 23 nt, Human
uugauucuccaguaugggcugag

SEQ ID NO: 116367 - RNA, 22 nt, Human
uugauucugggcucauuucuuu

SEQ ID NO: 116368 - RNA, 22 nt, Human
uugauuucuauucagauguaga

SEQ ID NO: 116369 - RNA, 22 nt, Human
uugauuuuuuucuacuaugcgc

SEQ ID NO: 116370 - RNA, 23 nt, Human
uugcaaaaugagucuugagugaa

SEQ ID NO: 116371 - RNA, 22 nt, Human
uugcaaagagauaauccuaggc

SEQ ID NO: 116372 - RNA, 22 nt, Human
uugcaaauaaacaaguauacau

SEQ ID NO: 116373 - RNA, 22 nt, Human
uugcaaauauuccccuaggucu

SEQ ID NO: 116374 - RNA, 22 nt, Human
uugcaaauauuguuuaccuuuc

SEQ ID NO: 116375 - RNA, 22 nt, Human
uuucaguucauguauuccgagu

SEQ ID NO: 116376 - RNA, 22 nt, Human
uuucaguucuguacaaguccag

SEQ ID NO: 116377 - RNA, 22 nt, Human
uuucaguugauugcuuggguua

SEQ ID NO: 116378 - RNA, 20 nt, Human
uuucaguugguuaauggcau

SEQ ID NO: 116379 - RNA, 22 nt, Human
uuucaguuguccuguuaauagc

SEQ ID NO: 116380 - RNA, 22 nt, Human
uuucaguuugucggccuuggac

SEQ ID NO: 116381 - RNA, 22 nt, Human
uuucaguuuuugcucgauguau

SEQ ID NO: 116382 - RNA, 22 nt, Human
uuucauaaccucaagcuacagu

SEQ ID NO: 116383 - RNA, 22 nt, Human
uuucauaaggguuucuagacuu

SEQ ID NO: 116384 - RNA, 22 nt, Human
uuucauaauacuguacaugaaa

SEQ ID NO: 116385 - RNA, 22 nt, Human
uuucauaauagugcaguuuguu

SEQ ID NO: 116386 - RNA, 22 nt, Human
uuucauagucaaguguguauga

SEQ ID NO: 116387 - RNA, 22 nt, Human
uuucauauuauuccuugagucu

SEQ ID NO: 116388 - RNA, 22 nt, Human
uucuacaugagaaaauguauuu

SEQ ID NO: 116389 - RNA, 22 nt, Human
uucuacaugguugcucagaggg

SEQ ID NO: 116390 - RNA, 22 nt, Human
uucuacauuuaaaaggaaaauc

SEQ ID NO: 116391 - RNA, 22 nt, Human
uucuaccuacccucugcauaca

SEQ ID NO: 116392 - RNA, 19 nt, Human
uucuaccuuacuguaggcu

SEQ ID NO: 116393 - RNA, 22 nt, Human
uucuacuugccaaaugacacau

SEQ ID NO: 116394 - RNA, 22 nt, Human
uucuacuuuagcaugcucauuc

SEQ ID NO: 116395 - RNA, 22 nt, Human
uucuagaaacacaugcaaacag

SEQ ID NO: 116396 - RNA, 21 nt, Human
uucuagaaccgugggcgguuc

SEQ ID NO: 116397 - RNA, 22 nt, Human
uucuagaagcucuaggggagaa

SEQ ID NO: 116398 - RNA, 22 nt, Human
uucuagaaggcaggcugggcca

SEQ ID NO: 116399 - RNA, 22 nt, Human
uucuagaauguuuugaaaggga

SEQ ID NO: 116400 - RNA, 22 nt, Human
uucuagauaucuaguguauaac

SEQ ID NO: 116401 - RNA, 22 nt, Human
uucuagauugccuguaaguaaa

SEQ ID NO: 116402 - RNA, 22 nt, Human
uucuagcacugccuggaagaca

SEQ ID NO: 116403 - RNA, 22 nt, Human
uucuagcagagggcaucugcug

SEQ ID NO: 116404 - RNA, 23 nt, Human
uucuaggcucugauugggcuucc

SEQ ID NO: 116405 - RNA, 22 nt, Human
uucuagggaaugggaugaggau

SEQ ID NO: 116406 - RNA, 22 nt, Human
uucuaguguccuuggacuugcu

SEQ ID NO: 116407 - RNA, 22 nt, Human
uucuaguuauagaaaaagcauu

SEQ ID NO: 116408 - RNA, 22 nt, Human
uucuauauuggaagugagaaau

SEQ ID NO: 116409 - RNA, 22 nt, Human
uucuaugauucauuuagaaguu

SEQ ID NO: 116410 - RNA, 22 nt, Human
uucuaugccauguucagcuacu

SEQ ID NO: 116411 - RNA, 22 nt, Human
uucuaugccugagaagaagccg

SEQ ID NO: 116412 - RNA, 22 nt, Human
uucuaugcuaguggaaagcuuc

SEQ ID NO: 116413 - RNA, 22 nt, Human
uucuauguagauaaggcugcuc

SEQ ID NO: 116414 - RNA, 22 nt, Human
uucuauguaguagcagagccaa

SEQ ID NO: 116415 - RNA, 22 nt, Human
uucuauguggauauagaacugc

SEQ ID NO: 116416 - RNA, 22 nt, Human
uucuauguggcaucaagcucag

SEQ ID NO: 116417 - RNA, 22 nt, Human
uucuauguguugacaagccuga

SEQ ID NO: 116418 - RNA, 22 nt, Human
uucuauguucuaagucucaagg

SEQ ID NO: 116419 - RNA, 22 nt, Human
uucuauuaauauguuaauucug

SEQ ID NO: 116420 - RNA, 22 nt, Human
uucuauuuccaguccuucagag

SEQ ID NO: 116421 - RNA, 22 nt, Human
uucucacaauucuuguauuugc

SEQ ID NO: 116422 - RNA, 22 nt, Human
uucucacacuuuccacugaggu

SEQ ID NO: 116423 - RNA, 22 nt, Human
uucucacagaagcacgaagccu

SEQ ID NO: 116424 - RNA, 22 nt, Human
uucucacaggaaguaggacuuu

SEQ ID NO: 116425 - RNA, 22 nt, Human
uucucacaggauuucuuuuagu

SEQ ID NO: 116426 - RNA, 22 nt, Human
uucucacaggcuggaaugauga

SEQ ID NO: 116427 - RNA, 22 nt, Human
uucucacauucagaacuuuuau

SEQ ID NO: 116428 - RNA, 22 nt, Human
uucucacguuauuggcugagag

SEQ ID NO: 116429 - RNA, 22 nt, Human
uucucacuauguauguagauug

SEQ ID NO: 116430 - RNA, 22 nt, Human
uucucagaaaagcaagcuuucu

SEQ ID NO: 116431 - RNA, 22 nt, Human
uucucagacuuccagcaccagc

SEQ ID NO: 116432 - RNA, 18 nt, Human
uucucagacuuuggaagu

SEQ ID NO: 116433 - RNA, 22 nt, Human
uucucagagcacugcugacaaa

SEQ ID NO: 116434 - RNA, 22 nt, Human
uucucagagcucacuguaguaa

SEQ ID NO: 116435 - RNA, 21 nt, Human
uucucagagucuauuacaguu

SEQ ID NO: 116436 - RNA, 21 nt, Human
uucucagaucgaguagugaga

SEQ ID NO: 116437 - RNA, 22 nt, Human
uucucagaugauucagauaaac

SEQ ID NO: 116438 - RNA, 22 nt, Human
uucucagauuccccuuuuaaua

SEQ ID NO: 116439 - RNA, 23 nt, Human
uucucaggagcccccaggucagg

SEQ ID NO: 116440 - RNA, 22 nt, Human
uucucaggcacuucuuccccgc

SEQ ID NO: 116441 - RNA, 22 nt, Human
uucucaggguagaggugacacu

SEQ ID NO: 116442 - RNA, 22 nt, Human
uucucagggucuugugcaaggg

SEQ ID NO: 116443 - RNA, 22 nt, Human
uucucaggucaccagggugcca

SEQ ID NO: 116444 - RNA, 22 nt, Human
uucucaguauuacaugcuaaug

SEQ ID NO: 116445 - RNA, 21 nt, Human
uucucaguguccauguuaguu

SEQ ID NO: 116446 - RNA, 22 nt, Human
uucucaguuucauagcugagca

SEQ ID NO: 116447 - RNA, 22 nt, Human
uucucauaaauccugagaccua

SEQ ID NO: 116448 - RNA, 22 nt, Human
uucucauaugcacucuauuuga

SEQ ID NO: 116449 - RNA, 22 nt, Human
uucucauguaaaugccaucauc

SEQ ID NO: 116450 - RNA, 22 nt, Human
uucuccaagaugaagcugugua

SEQ ID NO: 116451 - RNA, 22 nt, Human
uucuccaagguucauauuuauc

SEQ ID NO: 116452 - RNA, 22 nt, Human
uucuccagaccacugccucugu

SEQ ID NO: 116453 - RNA, 21 nt, Human
uucuccaggcaaccauuucag

SEQ ID NO: 116454 - RNA, 19 nt, Human
uucuccaggcugcagaggg

SEQ ID NO: 116455 - RNA, 22 nt, Human
uucuccaggcuugggccagguc

SEQ ID NO: 116456 - RNA, 19 nt, Human
uucuccagggacuuaggga

SEQ ID NO: 116457 - RNA, 22 nt, Human
uucuccagucacugacuucgag

SEQ ID NO: 116458 - RNA, 22 nt, Human
uucuccaguuucucccuucagu

SEQ ID NO: 116459 - RNA, 21 nt, Human
uucuccccagcgaauccucgg

SEQ ID NO: 116460 - RNA, 22 nt, Human
uucuccccugacccugaugagg

SEQ ID NO: 116461 - RNA, 22 nt, Human
uucuccuaggaucagggguccu

SEQ ID NO: 116462 - RNA, 22 nt, Human
uucuccucuacauagacugugc

SEQ ID NO: 116463 - RNA, 23 nt, Human
uucuccugaggaagcagggacug

SEQ ID NO: 116464 - RNA, 22 nt, Human
uucuccuggagugcuuguuggg

SEQ ID NO: 116465 - RNA, 22 nt, Human
uucuccuggggccgugauguga

SEQ ID NO: 116466 - RNA, 21 nt, Human
uucuccuguuuugcaccacag

SEQ ID NO: 116467 - RNA, 22 nt, Human
uucuccuugaaaagcugcaucu

SEQ ID NO: 116468 - RNA, 22 nt, Human
uucucuaaaugugaaccggcuu

SEQ ID NO: 116469 - RNA, 22 nt, Human
uucucuaagagaugcagaaguu

SEQ ID NO: 116470 - RNA, 22 nt, Human
uucucuaaggucccguucugga

SEQ ID NO: 116471 - RNA, 22 nt, Human
uucucuaauacauuuugacaaa

SEQ ID NO: 116472 - RNA, 22 nt, Human
uucucuacuucacaagggaugg

SEQ ID NO: 116473 - RNA, 20 nt, Human
uucucuagccuuccccuggg

SEQ ID NO: 116474 - RNA, 22 nt, Human
uucucucauucaaauuaaagug

SEQ ID NO: 116475 - RNA, 22 nt, Human
uucucucccaugaagcuucuau

SEQ ID NO: 116476 - RNA, 22 nt, Human
uucucuccuccuagaggcuuuu

SEQ ID NO: 116477 - RNA, 22 nt, Human
uucucucugugucauuauggac

SEQ ID NO: 116478 - RNA, 22 nt, Human
uucucucuuacugccaugcugu

SEQ ID NO: 116479 - RNA, 22 nt, Human
uucucugagucuugguuucuua

SEQ ID NO: 116480 - RNA, 22 nt, Human
uucucugcuacauacuagggcu

SEQ ID NO: 116481 - RNA, 22 nt, Human
uucucuggacuauuugcacucc

SEQ ID NO: 116482 - RNA, 20 nt, Human
uucucuggauagccagaugu

SEQ ID NO: 116483 - RNA, 22 nt, Human
uucucuggggacugucucuauu

SEQ ID NO: 116484 - RNA, 22 nt, Human
uuguuuuuaaacaugugacuga

SEQ ID NO: 116485 - RNA, 22 nt, Human
uuuaaaaaacuagucugagucu

SEQ ID NO: 116486 - RNA, 23 nt, Human
uuuaaaaguuguaauguaggcuu

SEQ ID NO: 116487 - RNA, 22 nt, Human
uuuaaaaucagaugggaguugg

SEQ ID NO: 116488 - RNA, 22 nt, Human
uuuaaaauuuagaccucuccac

SEQ ID NO: 116489 - RNA, 22 nt, Human
uuuaaacuguugauuuuaugaa

SEQ ID NO: 116490 - RNA, 21 nt, Human
uuuaaagaauaggaagggagg

SEQ ID NO: 116491 - RNA, 22 nt, Human
uuuaaaggccuugcugagccac

SEQ ID NO: 116492 - RNA, 22 nt, Human
uuuaaaugcagacguugauuca

SEQ ID NO: 116493 - RNA, 22 nt, Human
uuuaaauggcauuuucccagau

SEQ ID NO: 116494 - RNA, 22 nt, Human
uuuaacacuaguuucuuuaacu

SEQ ID NO: 116495 - RNA, 22 nt, Human
uuuaacagaugcuaugucuacc

SEQ ID NO: 116496 - RNA, 22 nt, Human
uuuaacagaugugaaauuuuca

SEQ ID NO: 116497 - RNA, 22 nt, Human
uuuaacauguaauugcugcuuu

SEQ ID NO: 116498 - RNA, 22 nt, Human
uuuaaccaguuuacaaagaauu

SEQ ID NO: 116499 - RNA, 22 nt, Human
uuuaacucugucauucucuuua

SEQ ID NO: 116500 - RNA, 22 nt, Human
uuuaacuuagaagagauauccu

SEQ ID NO: 116501 - RNA, 22 nt, Human
uuuaagacucuuguaguacaca

SEQ ID NO: 116502 - RNA, 22 nt, Human
uuuaagacuuaggaaagaggau

SEQ ID NO: 116503 - RNA, 22 nt, Human
uuuaagcaaguugacauagcau

SEQ ID NO: 116504 - RNA, 22 nt, Human
uuuaagcuguggcauuaauucu

SEQ ID NO: 116505 - RNA, 22 nt, Human
uuuaaggcuucacuggaguggg

SEQ ID NO: 116506 - RNA, 22 nt, Human
uuuaagguggacaucuaaguca

SEQ ID NO: 116507 - RNA, 22 nt, Human
uuuaauacuauggggaugaaca

SEQ ID NO: 116508 - RNA, 22 nt, Human
uuuaaucuucaaaauagucuua

SEQ ID NO: 116509 - RNA, 22 nt, Human
uuuaaugauagcuguuucacau

SEQ ID NO: 116510 - RNA, 22 nt, Human
uuuaaugauagucuuacgaaaa

SEQ ID NO: 116511 - RNA, 22 nt, Human
uuuaauggcaagaaggcugcag

SEQ ID NO: 116512 - RNA, 22 nt, Human
uuuaaugggauccaucugguua

SEQ ID NO: 116513 - RNA, 22 nt, Human
uuuaauguagcgugaaaugauu

SEQ ID NO: 116514 - RNA, 22 nt, Human
uuuaaugugacaucuuuuagag

SEQ ID NO: 116515 - RNA, 22 nt, Human
uuuaauugcauuuaaagaugga

SEQ ID NO: 116516 - RNA, 22 nt, Human
uuuaauuugaaaugaguaaccc

SEQ ID NO: 116517 - RNA, 22 nt, Human
uuuaauuuguauuucuagaggg

SEQ ID NO: 116518 - RNA, 22 nt, Human
uuuaauuuuccucuuccuggag

SEQ ID NO: 116519 - RNA, 22 nt, Human
uugcagggcaucuaugucuggu

SEQ ID NO: 116520 - RNA, 18 nt, Human
uugcagguaccucuaucu

SEQ ID NO: 116521 - RNA, 22 nt, Human
uugcaggucuggggguccuggu

SEQ ID NO: 116522 - RNA, 22 nt, Human
uugcaggugagggaaaugacug

SEQ ID NO: 116523 - RNA, 22 nt, Human
uugcaguagguggagugaauuu

SEQ ID NO: 116524 - RNA, 22 nt, Human
uugcaguugcauaugccccuac

SEQ ID NO: 116525 - RNA, 22 nt, Human
uugcaguugcuuucuauauuga

SEQ ID NO: 116526 - RNA, 22 nt, Human
uugcaguugucuuuccuaauuu

SEQ ID NO: 116527 - RNA, 22 nt, Human
uugcaguuuucugccucauuuc

SEQ ID NO: 116528 - RNA, 22 nt, Human
uugcauacugaccucuaagcuu

SEQ ID NO: 116529 - RNA, 22 nt, Human
uugcauaugaagcugacuuaaa

SEQ ID NO: 116530 - RNA, 22 nt, Human
uugcaucaaauauguaccacag

SEQ ID NO: 116531 - RNA, 22 nt, Human
uugcauccgggcuacuuccaca

SEQ ID NO: 116532 - RNA, 22 nt, Human
uugcaucuagggcaacccagag

SEQ ID NO: 116533 - RNA, 22 nt, Human
uugcaugcuagaaagauugauu

SEQ ID NO: 116534 - RNA, 22 nt, Human
uugcauggaggaacauggccca

SEQ ID NO: 116535 - RNA, 23 nt, Human
uugcauguagcccaugaguaacu

SEQ ID NO: 116536 - RNA, 22 nt, Human
uugcauguguaauuuuucuaaa

SEQ ID NO: 116537 - RNA, 22 nt, Human
uugcauugaucccagcuugggc

SEQ ID NO: 116538 - RNA, 22 nt, Human
uugcauugauguuccuucuugc

SEQ ID NO: 116539 - RNA, 19 nt, Human
uugcauuguaguuggacug

SEQ ID NO: 116540 - RNA, 22 nt, Human
uugcauuguugcaaugaaguau

SEQ ID NO: 116541 - RNA, 22 nt, Human
uugcauuuaaguagauguuaca

SEQ ID NO: 116542 - RNA, 22 nt, Human
uugcauuucacuuucaguaggc

SEQ ID NO: 116543 - RNA, 22 nt, Human
uugcauuugagaaaguucuccu

SEQ ID NO: 116544 - RNA, 22 nt, Human
uugcauuuguggcauggguguu

SEQ ID NO: 116545 - RNA, 21 nt, Human
uugcauuuuaaguuuacugcu

SEQ ID NO: 116546 - RNA, 22 nt, Human
uugcauuuugguuguaaauaug

SEQ ID NO: 116547 - RNA, 22 nt, Human
uugccacugaaccagucuugca

SEQ ID NO: 116548 - RNA, 22 nt, Human
uugccaggcuuguuucuaggcu

SEQ ID NO: 116549 - RNA, 22 nt, Human
uugccauugcaaaguacuauga

SEQ ID NO: 116550 - RNA, 22 nt, Human
uugccauuuaguaugcuuguau

SEQ ID NO: 116551 - RNA, 22 nt, Human
uugcccagagcugccuguuaca

SEQ ID NO: 116552 - RNA, 21 nt, Human
uugccccugaguuuuucugag

SEQ ID NO: 116553 - RNA, 22 nt, Human
uugcccugaagaacgucccaga

SEQ ID NO: 116554 - RNA, 22 nt, Human
uugcccugcagcggugaguggu

SEQ ID NO: 116555 - RNA, 22 nt, Human
uugcccugcguuaccaucucuu

SEQ ID NO: 116556 - RNA, 22 nt, Human
uugcccuguggggccuccagcc

SEQ ID NO: 116557 - RNA, 22 nt, Human
uugccuauuguucuuacauguu

SEQ ID NO: 116558 - RNA, 22 nt, Human
uugccuggaugguccccagaga

SEQ ID NO: 116559 - RNA, 22 nt, Human
uugccugguccugugggugcug

SEQ ID NO: 116560 - RNA, 22 nt, Human
uugccugugaggauucugguug

SEQ ID NO: 116561 - RNA, 22 nt, Human
uugccugugucagcagguggaa

SEQ ID NO: 116562 - RNA, 22 nt, Human
uugccuguuugagagcuguguu

SEQ ID NO: 116563 - RNA, 22 nt, Human
uugccuuauagugcucugcauu

SEQ ID NO: 116564 - RNA, 22 nt, Human
uugccuuugacggugcagcagu

SEQ ID NO: 116565 - RNA, 22 nt, Human
uugcuaaaggauuuuguauuua

SEQ ID NO: 116566 - RNA, 22 nt, Human
uugcuaaaucccuauaauauuc

SEQ ID NO: 116567 - RNA, 22 nt, Human
uugcuaauagaagauuugggaa

SEQ ID NO: 116568 - RNA, 22 nt, Human
uugcuaauuuaacuaccuuguu

SEQ ID NO: 116569 - RNA, 22 nt, Human
uugcuaauuuguauaaugaaaa

SEQ ID NO: 116570 - RNA, 22 nt, Human
uugcuacaugguuucaaagcug

SEQ ID NO: 116571 - RNA, 22 nt, Human
uugcuaggauucauucuauacu

SEQ ID NO: 116572 - RNA, 22 nt, Human
uugcuauaaauggucuaucuuu

SEQ ID NO: 116573 - RNA, 22 nt, Human
uugcuauaaaugguuucauauu

SEQ ID NO: 116574 - RNA, 22 nt, Human
uugcuaugugagauggcucaag

SEQ ID NO: 116575 - RNA, 22 nt, Human
uugcuauguggguugugcacuc

SEQ ID NO: 116576 - RNA, 22 nt, Human
uugcuauuuugagagucauagu

SEQ ID NO: 116577 - RNA, 22 nt, Human
uugcucauauuugcauguguuu

SEQ ID NO: 116578 - RNA, 22 nt, Human
uugcucuacccugaucaguuaa

SEQ ID NO: 116579 - RNA, 22 nt, Human
uugcucuauguuuguaaacaga

SEQ ID NO: 116580 - RNA, 22 nt, Human
uugcucugaaccacaccaucac

SEQ ID NO: 116581 - RNA, 22 nt, Human
uugcucugacuggagugcagug

SEQ ID NO: 116582 - RNA, 22 nt, Human
uugcugaaaagcuggccuuugu

SEQ ID NO: 116583 - RNA, 22 nt, Human
uugcugaagugaagguauguuu

SEQ ID NO: 116584 - RNA, 22 nt, Human
uugcugaaguuaaugcuugcaa

SEQ ID NO: 116585 - RNA, 22 nt, Human
uugcugagagcgugucaacaag

SEQ ID NO: 116586 - RNA, 22 nt, Human
uugcugagcaguguuuaauugu

SEQ ID NO: 116587 - RNA, 22 nt, Human
uugcugaggacgcagugcagug

SEQ ID NO: 116588 - RNA, 22 nt, Human
uugcugagucucuagguaugau

SEQ ID NO: 116589 - RNA, 22 nt, Human
uugcugauaccaugaauguuaa

SEQ ID NO: 116590 - RNA, 22 nt, Human
uugcugaucugugaaucagcca

SEQ ID NO: 116591 - RNA, 22 nt, Human
uugcugaugguauuaugcuagu

SEQ ID NO: 116592 - RNA, 22 nt, Human
uugcugauuuccccuugagugu

SEQ ID NO: 116593 - RNA, 22 nt, Human
uuuucuguuuacagagggaccu

SEQ ID NO: 116594 - RNA, 22 nt, Human
uuuucuuacugucugugauccu

SEQ ID NO: 116595 - RNA, 22 nt, Human
uuuucuuauagagcuuaaaguu

SEQ ID NO: 116596 - RNA, 22 nt, Human
uuuucuucggugcuggguugau

SEQ ID NO: 116597 - RNA, 22 nt, Human
uuuucuucuaccugcuguccaa

SEQ ID NO: 116598 - RNA, 19 nt, Human
uuuugaaguaugagacagg

SEQ ID NO: 116599 - RNA, 23 nt, Human
uuuugacaggaggaagguguuga

SEQ ID NO: 116600 - RNA, 20 nt, Human
uuuugauagcaaagacggua

SEQ ID NO: 116601 - RNA, 22 nt, Human
uuuugcaaaguacauuaucagg

SEQ ID NO: 116602 - RNA, 20 nt, Human
uuuugcagagaaggcgacug

SEQ ID NO: 116603 - RNA, 22 nt, Human
uuuugccugagagugaaaauaa

SEQ ID NO: 116604 - RNA, 22 nt, Human
uuuugccugugaauacuaucuu

SEQ ID NO: 116605 - RNA, 22 nt, Human
uuuugcugggguggcuagcuua

SEQ ID NO: 116606 - RNA, 22 nt, Human
uuuugcuguuauaugcuauuau

SEQ ID NO: 116607 - RNA, 21 nt, Human
uuuugcuguuuuagaaugaga

SEQ ID NO: 116608 - RNA, 22 nt, Human
uuuugcuuaucugagugcagcc

SEQ ID NO: 116609 - RNA, 22 nt, Human
uuuugcuuuaagauggagagga

SEQ ID NO: 116610 - RNA, 19 nt, Human
uuuuggaaaugugaacagc

SEQ ID NO: 116611 - RNA, 22 nt, Human
uuuuggaagccgcggcugggca

SEQ ID NO: 116612 - RNA, 22 nt, Human
uuuuggaaucauuuacagagca

SEQ ID NO: 116613 - RNA, 22 nt, Human
uuuuggcaagcugggagauauu

SEQ ID NO: 116614 - RNA, 22 nt, Human
uuuugggugaauuugccaguua

SEQ ID NO: 116615 - RNA, 22 nt, Human
uuuuggguggaagcuguuaugg

SEQ ID NO: 116616 - RNA, 22 nt, Human
uuuugguagccaacaaaauguu

SEQ ID NO: 116617 - RNA, 22 nt, Human
uuuuggucagguuggucucgaa

SEQ ID NO: 116618 - RNA, 22 nt, Human
uuuuggugcccugguucccacc

SEQ ID NO: 116619 - RNA, 22 nt, Human
uuuuguauagucaaagacaaga

SEQ ID NO: 116620 - RNA, 22 nt, Human
uuuuguaugagaagugcuuuac

SEQ ID NO: 116621 - RNA, 22 nt, Human
uuuugucaccugauuugcccac

SEQ ID NO: 116622 - RNA, 22 nt, Human
uuuugugagaugcguaugaaug

SEQ ID NO: 116623 - RNA, 19 nt, Human
uuuuguguagcugcugguu

SEQ ID NO: 116624 - RNA, 22 nt, Human
uuuuuaagagucuggaaauagu

SEQ ID NO: 116625 - RNA, 22 nt, Human
uuuuuaccuggaggauaaaugu

SEQ ID NO: 116626 - RNA, 22 nt, Human
uuuuucaugagacuagaaguca

SEQ ID NO: 116627 - RNA, 22 nt, Human
uuuuuccuagugcuuucuggua

SEQ ID NO: 116628 - RNA, 22 nt, Human
uuuuuccuuagggguuacucac

SEQ ID NO: 116629 - RNA, 22 nt, Human
uuuuuccuuggaugugucucuc

SEQ ID NO: 116630 - RNA, 22 nt, Human
uuuuucuaauggcuuaggaugu

SEQ ID NO: 116631 - RNA, 22 nt, Human
uuuuucuacugcccacauugua

SEQ ID NO: 116632 - RNA, 22 nt, Human
uuuuucucuaugccaggggccu

SEQ ID NO: 116633 - RNA, 22 nt, Human
uuuuucucuucuguaaaguggu

SEQ ID NO: 116634 - RNA, 22 nt, Human
uuuuucuggauaacuguaucuc

SEQ ID NO: 116635 - RNA, 22 nt, Human
uuuuugaaggcugaugugauua

SEQ ID NO: 116636 - RNA, 22 nt, Human
uugggaagaauggaggugguua

SEQ ID NO: 116637 - RNA, 22 nt, Human
uugggaaguuuaaugacagacu

SEQ ID NO: 116638 - RNA, 22 nt, Human
uugggacaaagacuccuugaau

SEQ ID NO: 116639 - RNA, 22 nt, Human
uugggacaucuggcauacaguu

SEQ ID NO: 116640 - RNA, 17 nt, Human
uugggagagaaagguau

SEQ ID NO: 116641 - RNA, 22 nt, Human
uugggagauauuguucuuuaca

SEQ ID NO: 116642 - RNA, 22 nt, Human
uugggagauucauugagccaag

SEQ ID NO: 116643 - RNA, 22 nt, Human
uugggaucuacauagcuaugua

SEQ ID NO: 116644 - RNA, 22 nt, Human
uugggcagaggccaggaggaug

SEQ ID NO: 116645 - RNA, 22 nt, Human
uugggcagauguuuccugugga

SEQ ID NO: 116646 - RNA, 22 nt, Human
uugggcagcauugcaguucccu

SEQ ID NO: 116647 - RNA, 22 nt, Human
uugggccaaagauguccuuguu

SEQ ID NO: 116648 - RNA, 22 nt, Human
uugggccacuuuaguuuccuua

SEQ ID NO: 116649 - RNA, 22 nt, Human
uugggcccugcucugaguugcu

SEQ ID NO: 116650 - RNA, 22 nt, Human
uugggccucggccaaggacggg

SEQ ID NO: 116651 - RNA, 22 nt, Human
uugggcugaaguagagggcaga

SEQ ID NO: 116652 - RNA, 22 nt, Human
uugggcugggcaagaaucaaug

SEQ ID NO: 116653 - RNA, 22 nt, Human
uugggcuugucugggaaacugc

SEQ ID NO: 116654 - RNA, 22 nt, Human
uuggggaagcuuugaaauacuu

SEQ ID NO: 116655 - RNA, 22 nt, Human
uuggggagguugccacauucca

SEQ ID NO: 116656 - RNA, 22 nt, Human
uuggggcucugaaaaagaugua

SEQ ID NO: 116657 - RNA, 19 nt, Human
uuggggugaaugccagaca

SEQ ID NO: 116658 - RNA, 22 nt, Human
uuggguaggagaaagaacagau

SEQ ID NO: 116659 - RNA, 22 nt, Human
uugggucuuauggcuggaguag

SEQ ID NO: 116660 - RNA, 22 nt, Human
uuggguuuugauacaugucuaa

SEQ ID NO: 116661 - RNA, 22 nt, Human
uugguacaugcagauauuuagu

SEQ ID NO: 116662 - RNA, 22 nt, Human
uugguauacaaauauuuagcac

SEQ ID NO: 116663 - RNA, 22 nt, Human
uugguauauugugcuacuuuau

SEQ ID NO: 116664 - RNA, 22 nt, Human
uugguauuuccucaggcauguc

SEQ ID NO: 116665 - RNA, 22 nt, Human
uuggucagaugugucuccuccu

SEQ ID NO: 116666 - RNA, 22 nt, Human
uuggucagucagagaauggagu

SEQ ID NO: 116667 - RNA, 22 nt, Human
uuggucccucauggacacauga

SEQ ID NO: 116668 - RNA, 22 nt, Human
uugguccugcagaggggucugg

SEQ ID NO: 116669 - RNA, 22 nt, Human
uugguccugcccccuccagguc

SEQ ID NO: 116670 - RNA, 22 nt, Human
uuggucugcucugauguuuucu

SEQ ID NO: 116671 - RNA, 22 nt, Human
uuggucuguguuacaucauuua

SEQ ID NO: 116672 - RNA, 22 nt, Human
uuggucuucagagaucuggugg

SEQ ID NO: 116673 - RNA, 22 nt, Human
uuggucuuuucuauuaaauaua

SEQ ID NO: 116674 - RNA, 22 nt, Human
uuggugaacacauacacauuuu

SEQ ID NO: 116675 - RNA, 22 nt, Human
uugguggaccucaucagaaccg

SEQ ID NO: 116676 - RNA, 22 nt, Human
uuggugggagagaugaggguug

SEQ ID NO: 116677 - RNA, 19 nt, Human
uugguggugguuuugguuc

SEQ ID NO: 116678 - RNA, 22 nt, Human
uugguguacaucuccccuucau

SEQ ID NO: 116679 - RNA, 22 nt, Human
uugguucaaaacauggaagggu

SEQ ID NO: 116680 - RNA, 22 nt, Human
uugguucaaagggauucaauuu

SEQ ID NO: 116681 - RNA, 22 nt, Human
uugguucaacuuuucuaaguag

SEQ ID NO: 116682 - RNA, 19 nt, Human
uugguucauggaugcccaa

SEQ ID NO: 116683 - RNA, 23 nt, Human
uugguuuacaggaauaagcaggg

SEQ ID NO: 116684 - RNA, 22 nt, Human
uugguuuaccagagggaacgug

SEQ ID NO: 116685 - RNA, 22 nt, Human
uugguuuagagagugugguuac

SEQ ID NO: 116686 - RNA, 22 nt, Human
uugguuuagcaacuuccugugu

SEQ ID NO: 116687 - RNA, 22 nt, Human
uugguuuugaaauagcuuauug

SEQ ID NO: 116688 - RNA, 22 nt, Human
uuguaaacauagagauuuaggu

SEQ ID NO: 116689 - RNA, 22 nt, Human
uuguaaacaucuguugcuuaga

SEQ ID NO: 116690 - RNA, 22 nt, Human
uuguaaacuguuaaaagccaga

SEQ ID NO: 116691 - RNA, 22 nt, Human
uuguaaaugaccuuuucuaauu

SEQ ID NO: 116692 - RNA, 22 nt, Human
uuguaacaaagacacuccaaaa

SEQ ID NO: 116693 - RNA, 22 nt, Human
uuguaacagcugcuuaauagag

SEQ ID NO: 116694 - RNA, 22 nt, Human
uuguaacagcuguuuauauagu

SEQ ID NO: 116695 - RNA, 22 nt, Human
uuguaacuuaaguuuugcauau

SEQ ID NO: 116696 - RNA, 22 nt, Human
uuguaagaauaugaauacaaau

SEQ ID NO: 116697 - RNA, 22 nt, Human
uuguaagacuguagaaugcaaa

SEQ ID NO: 116698 - RNA, 22 nt, Human
uuguaauggagcaaacagguug

SEQ ID NO: 116699 - RNA, 22 nt, Human
uuguaauuuguucccaagcaga

SEQ ID NO: 116700 - RNA, 22 nt, Human
uuguacaacacauauucuacag

SEQ ID NO: 116701 - RNA, 22 nt, Human
uuguacaaguuuugagcuuaag

SEQ ID NO: 116702 - RNA, 22 nt, Human
uugucuguccaggcaccccaag

SEQ ID NO: 116703 - RNA, 22 nt, Human
uugucugucccagcuugugcau

SEQ ID NO: 116704 - RNA, 19 nt, Human
uugucuuagcugcauaaga

SEQ ID NO: 116705 - RNA, 22 nt, Human
uugugaaaagccgcaaguauag

SEQ ID NO: 116706 - RNA, 22 nt, Human
uugugaauagugccgcaauaaa

SEQ ID NO: 116707 - RNA, 22 nt, Human
uugugaauagugcugcaauaaa

SEQ ID NO: 116708 - RNA, 22 nt, Human
uugugacacaugccguccugag

SEQ ID NO: 116709 - RNA, 22 nt, Human
uugugagagccaaacauguaag

SEQ ID NO: 116710 - RNA, 22 nt, Human
uugugagcauguuuacuugauu

SEQ ID NO: 116711 - RNA, 22 nt, Human
uugugcaagaagccagcaccaa

SEQ ID NO: 116712 - RNA, 22 nt, Human
uugugcaauaguuuucucauga

SEQ ID NO: 116713 - RNA, 22 nt, Human
uugugcaugacugugaauagcu

SEQ ID NO: 116714 - RNA, 22 nt, Human
uugugcauggcuacuuuuuaug

SEQ ID NO: 116715 - RNA, 22 nt, Human
uugugcauuagggaaaggaacu

SEQ ID NO: 116716 - RNA, 22 nt, Human
uugugccauaaccacccugacu

SEQ ID NO: 116717 - RNA, 22 nt, Human
uugugcuaagcaauuugcuuaa

SEQ ID NO: 116718 - RNA, 22 nt, Human
uugugcuccugugagaaucuag

SEQ ID NO: 116719 - RNA, 22 nt, Human
uugugcucuuauugugcaggga

SEQ ID NO: 116720 - RNA, 22 nt, Human
uugugcuugcccuggaggugcg

SEQ ID NO: 116721 - RNA, 22 nt, Human
uuguggaaauacagacuccaag

SEQ ID NO: 116722 - RNA, 23 nt, Human
uuguggagugguuguuuucuagg

SEQ ID NO: 116723 - RNA, 22 nt, Human
uuguggcagaccaugagucuaa

SEQ ID NO: 116724 - RNA, 22 nt, Human
uuguggcucuugaggcucucgu

SEQ ID NO: 116725 - RNA, 22 nt, Human
uuguggcugugcaccgcugccu

SEQ ID NO: 116726 - RNA, 22 nt, Human
uugugggauggcucuucccaaa

SEQ ID NO: 116727 - RNA, 22 nt, Human
uugugggcuugccuggcucuug

SEQ ID NO: 116728 - RNA, 22 nt, Human
uuguggggaggauuugaugaga

SEQ ID NO: 116729 - RNA, 22 nt, Human
uuguggggcaacagcaggugaa

SEQ ID NO: 116730 - RNA, 22 nt, Human
uuguguacagguguuuccaagu

SEQ ID NO: 116731 - RNA, 22 nt, Human
uuguguccaaggcuauggugau

SEQ ID NO: 116732 - RNA, 22 nt, Human
uuguguccuaagcaccagaugg

SEQ ID NO: 116733 - RNA, 22 nt, Human
uuguguccucuaaucucaccac

SEQ ID NO: 116734 - RNA, 22 nt, Human
uugugucuggaaugcguggagc

SEQ ID NO: 116735 - RNA, 22 nt, Human
uugugucuuaaagauuaaaugg

SEQ ID NO: 116736 - RNA, 22 nt, Human
uugugugguagcuucauugaac

SEQ ID NO: 116737 - RNA, 22 nt, Human
uuguguguagacucagccauug

SEQ ID NO: 116738 - RNA, 22 nt, Human
uuguguguguaacuuuaugaga

SEQ ID NO: 116739 - RNA, 22 nt, Human
uuguguuaaggugcaucuagug

SEQ ID NO: 116740 - RNA, 22 nt, Human
uuguguuucccuugcauauucc

SEQ ID NO: 116741 - RNA, 22 nt, Human
uuguguuugaugcugacacgca

SEQ ID NO: 116742 - RNA, 22 nt, Human
uuguuaaaggcaaaacaagcac

SEQ ID NO: 116743 - RNA, 22 nt, Human
uuguuacagaucacauuucugc

SEQ ID NO: 116744 - RNA, 22 nt, Human
uuguuacagcacuuaaccuuuu

SEQ ID NO: 116745 - RNA, 22 nt, Human
uuguuacagcagugauuucaga

SEQ ID NO: 116746 - RNA, 22 nt, Human
uuguuacauacagcagaacaua

SEQ ID NO: 116747 - RNA, 22 nt, Human
uuguuagcugaucuugagugca

SEQ ID NO: 116748 - RNA, 22 nt, Human
uuguuaguaagugacaaaaauc

SEQ ID NO: 116749 - RNA, 22 nt, Human
uuguuaucugcgugaagaaaau

SEQ ID NO: 116750 - RNA, 22 nt, Human
uuguuauuuaggucuggguuag

SEQ ID NO: 116751 - RNA, 22 nt, Human
uuguucagaaauuuggacuccu

SEQ ID NO: 116752 - RNA, 22 nt, Human
uuguucagaaguuuaaagaauu

SEQ ID NO: 116753 - RNA, 22 nt, Human
uuguucaucguccuugcucugu

SEQ ID NO: 116754 - RNA, 22 nt, Human
uuguucaucuggaacccagagc

SEQ ID NO: 116755 - RNA, 22 nt, Human
uuguucaugguuguaaguuuga

SEQ ID NO: 116756 - RNA, 22 nt, Human
uuguucauuagcgcuugggcac

SEQ ID NO: 116757 - RNA, 23 nt, Human
uuguucuaucaaccuagacuuag

SEQ ID NO: 116758 - RNA, 23 nt, Human
uuguucuuggaucuuccugaagc

SEQ ID NO: 116759 - RNA, 22 nt, Human
uuguucuuuauccuggaagccu

SEQ ID NO: 116760 - RNA, 22 nt, Human
uuguucuuuugcuuagacagau

SEQ ID NO: 116761 - RNA, 22 nt, Human
uuguugacgacuugacuuucuc

SEQ ID NO: 116762 - RNA, 21 nt, Human
uuguugagaguuagaacaugg

SEQ ID NO: 116763 - RNA, 22 nt, Human
uuuccucugucaugacagcuga

SEQ ID NO: 116764 - RNA, 22 nt, Human
uuuccucuuccgagggggaggc

SEQ ID NO: 116765 - RNA, 22 nt, Human
uuuccugcacccgcugaugcca

SEQ ID NO: 116766 - RNA, 22 nt, Human
uuuccugugcuuaacaaauauu

SEQ ID NO: 116767 - RNA, 22 nt, Human
uuuccuuccuugcuagccugag

SEQ ID NO: 116768 - RNA, 22 nt, Human
uuuccuucuuagcgguguucuu

SEQ ID NO: 116769 - RNA, 22 nt, Human
uuuccuugccuccuguccuucu

SEQ ID NO: 116770 - RNA, 22 nt, Human
uuuccuuugggagcaugaauuu

SEQ ID NO: 116771 - RNA, 22 nt, Human
uuuccuuugggcacccgagcuc

SEQ ID NO: 116772 - RNA, 22 nt, Human
uuuccuuuuggcuaggugugaa

SEQ ID NO: 116773 - RNA, 22 nt, Human
uuucggaauaaauacgaacauc

SEQ ID NO: 116774 - RNA, 22 nt, Human
uuucggccgcgugaaguuuucu

SEQ ID NO: 116775 - RNA, 21 nt, Human
uuucggucccagaugccugug

SEQ ID NO: 116776 - RNA, 22 nt, Human
uuucuaaacuggauucagccug

SEQ ID NO: 116777 - RNA, 22 nt, Human
uuucuaagaauauugcucuuaa

SEQ ID NO: 116778 - RNA, 22 nt, Human
uuucuaaggugagguagaaaau

SEQ ID NO: 116779 - RNA, 21 nt, Human
uuucuaaguaacuggcagcau

SEQ ID NO: 116780 - RNA, 22 nt, Human
uuucuaagugugauuuuagauu

SEQ ID NO: 116781 - RNA, 22 nt, Human
uuucuaaguguguuucauagga

SEQ ID NO: 116782 - RNA, 22 nt, Human
uuucuaaucugauucuccuacc

SEQ ID NO: 116783 - RNA, 19 nt, Human
uuucuaauguguuuuucuu

SEQ ID NO: 116784 - RNA, 22 nt, Human
uuucuacacuucgugguguuuu

SEQ ID NO: 116785 - RNA, 22 nt, Human
uuucuacaguacugauuucaua

SEQ ID NO: 116786 - RNA, 17 nt, Human
uuucuacaguuggcagc

SEQ ID NO: 116787 - RNA, 22 nt, Human
uuucuacauguuuucuauugaa

SEQ ID NO: 116788 - RNA, 22 nt, Human
uuucuagaaugacucaucugag

SEQ ID NO: 116789 - RNA, 22 nt, Human
uuucuagacucaaagaggauau

SEQ ID NO: 116790 - RNA, 22 nt, Human
uuucuagaucaaacuuuuauau

SEQ ID NO: 116791 - RNA, 22 nt, Human
uuucuagaugcggggcuugugc

SEQ ID NO: 116792 - RNA, 17 nt, Human
uuucuagauuauccucu

SEQ ID NO: 116793 - RNA, 22 nt, Human
uuucuagcaagaaagaggugga

SEQ ID NO: 116794 - RNA, 22 nt, Human
uuucuagcaugacacaguccuc

SEQ ID NO: 116795 - RNA, 22 nt, Human
uuucuagcugacaaaaauguuu

SEQ ID NO: 116796 - RNA, 22 nt, Human
uuucuaggauacucuaaaugua

SEQ ID NO: 116797 - RNA, 22 nt, Human
uuucuagguuuacaauacugca

SEQ ID NO: 116798 - RNA, 22 nt, Human
uuucuaguaaucaauauaaagu

SEQ ID NO: 116799 - RNA, 22 nt, Human
uuucuaguauauaacuagaucu

SEQ ID NO: 116800 - RNA, 22 nt, Human
uuucuaguucucugccaaaaaa

SEQ ID NO: 116801 - RNA, 20 nt, Human
uuucuauggggccagcacau

SEQ ID NO: 116802 - RNA, 22 nt, Human
uuucuauugaucuaauaaacau

SEQ ID NO: 116803 - RNA, 22 nt, Human
uuucucaaauacuguuccagga

SEQ ID NO: 116804 - RNA, 22 nt, Human
uuucucaaauugcaugaguagc

SEQ ID NO: 116805 - RNA, 22 nt, Human
uuucucaacagaguaugcccuu

SEQ ID NO: 116806 - RNA, 22 nt, Human
uuucucaacuguauuaugcaga

SEQ ID NO: 116807 - RNA, 18 nt, Human
uuucucaaggcugacauu

SEQ ID NO: 116808 - RNA, 21 nt, Human
uuucucaccaugguauggaaa

SEQ ID NO: 116809 - RNA, 22 nt, Human
uuucucacccaagaguuauuuu

SEQ ID NO: 116810 - RNA, 23 nt, Human
uuucucauccagagagucagucc

SEQ ID NO: 116811 - RNA, 22 nt, Human
uuucucauggaacaucguuuag

SEQ ID NO: 116812 - RNA, 22 nt, Human
uuucucccaaagugcaaccaca

SEQ ID NO: 116813 - RNA, 22 nt, Human
uuucuccccagucuaaucugga

SEQ ID NO: 116814 - RNA, 22 nt, Human
uuucucccuuuauaagacugua

SEQ ID NO: 116815 - RNA, 22 nt, Human
uuuaaugaauaauucaaaucug

SEQ ID NO: 116816 - RNA, 19 nt, Human
uuuaaugugugcugcaauc

SEQ ID NO: 116817 - RNA, 22 nt, Human
uuuaauguucaucucaaaggau

SEQ ID NO: 116818 - RNA, 22 nt, Human
uuuaauguuugagucaguauau

SEQ ID NO: 116819 - RNA, 22 nt, Human
uuuaauuagcaagccagagagc

SEQ ID NO: 116820 - RNA, 22 nt, Human
uuuaauuaggaaaugggcaggg

SEQ ID NO: 116821 - RNA, 22 nt, Human
uuuaauugauucacagucugua

SEQ ID NO: 116822 - RNA, 22 nt, Human
uuuaauuuucugggcccagcag

SEQ ID NO: 116823 - RNA, 22 nt, Human
uuuacaaccucauauucugaug

SEQ ID NO: 116824 - RNA, 22 nt, Human
uuuacaagaaaucaugaugcua

SEQ ID NO: 116825 - RNA, 22 nt, Human
uuuacaauagggucugaaugaa

SEQ ID NO: 116826 - RNA, 22 nt, Human
uuuacaauucuggugccagcua

SEQ ID NO: 116827 - RNA, 22 nt, Human
uuuacacagaggacacugggcu

SEQ ID NO: 116828 - RNA, 22 nt, Human
uuuacacauaaauguguagaca

SEQ ID NO: 116829 - RNA, 22 nt, Human
uuuacacauaccucuuuaaagu

SEQ ID NO: 116830 - RNA, 22 nt, Human
uuuacacauuauuuucagugug

SEQ ID NO: 116831 - RNA, 22 nt, Human
uuuacacugcuugaacaaucuc

SEQ ID NO: 116832 - RNA, 22 nt, Human
uuuacagagguguccugcauug

SEQ ID NO: 116833 - RNA, 22 nt, Human
uuuacagaugaggaaacugaga

SEQ ID NO: 116834 - RNA, 22 nt, Human
uuuacaggaagcugaaaaacau

SEQ ID NO: 116835 - RNA, 23 nt, Human
uuuacagggcacucuuaugcagc

SEQ ID NO: 116836 - RNA, 22 nt, Human
uuuacagucucuauagucaaaa

SEQ ID NO: 116837 - RNA, 22 nt, Human
uuuacaguuaagaaauguuacc

SEQ ID NO: 116838 - RNA, 22 nt, Human
uuuacaguuccaugugauaggc

SEQ ID NO: 116839 - RNA, 20 nt, Human
uuuacauuuugaaacaguga

SEQ ID NO: 116840 - RNA, 22 nt, Human
uuuaccaagaguugucacuguu

SEQ ID NO: 116841 - RNA, 22 nt, Human
uuuaccacagaaaaaaguaacu

SEQ ID NO: 116842 - RNA, 22 nt, Human
uuuaccauacaucaaaauauuu

SEQ ID NO: 116843 - RNA, 22 nt, Human
uuuacccauauuagcaucaagu

SEQ ID NO: 116844 - RNA, 19 nt, Human
uuuaccuucuugagagcag

SEQ ID NO: 116845 - RNA, 22 nt, Human
uuuacuaagcccaguuauaugc

SEQ ID NO: 116846 - RNA, 18 nt, Human
uuuacucauaggccugac

SEQ ID NO: 116847 - RNA, 19 nt, Human
uuuacucuccaaggugagu

SEQ ID NO: 116848 - RNA, 22 nt, Human
uuuacugaacugcuaguacagg

SEQ ID NO: 116849 - RNA, 22 nt, Human
uuuacugaauuugguauauucc

SEQ ID NO: 116850 - RNA, 21 nt, Human
uuuacugagcacuuacuaugu

SEQ ID NO: 116851 - RNA, 22 nt, Human
uuuacuucauuuccagugagga

SEQ ID NO: 116852 - RNA, 22 nt, Human
uuuacuugauauggagcugagg

SEQ ID NO: 116853 - RNA, 22 nt, Human
uuuagaacagauauuguaacuu

SEQ ID NO: 116854 - RNA, 20 nt, Human
uuuagaagaaugagcacuuu

SEQ ID NO: 116855 - RNA, 19 nt, Human
uuuagaaguugaaacucug

SEQ ID NO: 116856 - RNA, 22 nt, Human
uuuagaaugugacuguauuuga

SEQ ID NO: 116857 - RNA, 22 nt, Human
uuuagacagcggcucugaacca

SEQ ID NO: 116858 - RNA, 22 nt, Human
uuuagacaggggcaaaauaagg

SEQ ID NO: 116859 - RNA, 22 nt, Human
uuuagacauagcugaaaucauu

SEQ ID NO: 116860 - RNA, 22 nt, Human
uuuagacauggcuugcucacuu

SEQ ID NO: 116861 - RNA, 22 nt, Human
uuuagacuaauuccuaaagggc

SEQ ID NO: 116862 - RNA, 22 nt, Human
uuuagagaguguaaaaauauau

SEQ ID NO: 116863 - RNA, 22 nt, Human
uuuagaguugaguauucauugg

SEQ ID NO: 116864 - RNA, 22 nt, Human
uuuagcaaauuacucacagggu

SEQ ID NO: 116865 - RNA, 22 nt, Human
uuuagcaagaugcccuggcuuu

SEQ ID NO: 116866 - RNA, 22 nt, Human
uuuagcaaggagaaauaauccu

SEQ ID NO: 116867 - RNA, 22 nt, Human
uuuagcagcugguguuaccaua

SEQ ID NO: 116868 - RNA, 22 nt, Human
uuuagcauauuuaaggaaugau

SEQ ID NO: 116869 - RNA, 22 nt, Human
uuuagcauuacuaaaaugaaaa

SEQ ID NO: 116870 - RNA, 22 nt, Human
uuuagcauuccugggaugauuu

SEQ ID NO: 116871 - RNA, 22 nt, Human
uuuagccaacuauaugacuagu

SEQ ID NO: 116872 - RNA, 22 nt, Human
uuucuuccuggauuccuacuuc

SEQ ID NO: 116873 - RNA, 22 nt, Human
uuucuucuaagauuucaaacua

SEQ ID NO: 116874 - RNA, 22 nt, Human
uuucuucuaugugugauauuuu

SEQ ID NO: 116875 - RNA, 22 nt, Human
uuucuucuccauggcagguccu

SEQ ID NO: 116876 - RNA, 22 nt, Human
uuucuucucugauuaaggcuca

SEQ ID NO: 116877 - RNA, 22 nt, Human
uuucuucuguuuguaguuacac

SEQ ID NO: 116878 - RNA, 22 nt, Human
uuucuucuugauuuaaacaggg

SEQ ID NO: 116879 - RNA, 22 nt, Human
uuucuucuuucccagugauggg

SEQ ID NO: 116880 - RNA, 22 nt, Human
uuucuugacugcuuaggaaugc

SEQ ID NO: 116881 - RNA, 22 nt, Human
uuucuugagcccaggaggugga

SEQ ID NO: 116882 - RNA, 22 nt, Human
uuucuugagcuaggaaccuggg

SEQ ID NO: 116883 - RNA, 22 nt, Human
uuucuugagugaugcuuagugu

SEQ ID NO: 116884 - RNA, 22 nt, Human
uuucuuggagcucuuagggucg

SEQ ID NO: 116885 - RNA, 22 nt, Human
uuucuuggucuucccgaccugg

SEQ ID NO: 116886 - RNA, 22 nt, Human
uuucuugugccuaauuuugggc

SEQ ID NO: 116887 - RNA, 22 nt, Human
uuucuuuaauucucacagcaau

SEQ ID NO: 116888 - RNA, 22 nt, Human
uuucuuuauccuccuuugcaca

SEQ ID NO: 116889 - RNA, 22 nt, Human
uuucuuuccagagugauuggca

SEQ ID NO: 116890 - RNA, 22 nt, Human
uuucuuuccauacauauugcua

SEQ ID NO: 116891 - RNA, 22 nt, Human
uuucuuuguuguuaucacauca

SEQ ID NO: 116892 - RNA, 22 nt, Human
uuucuuuuccaauaucccuacu

SEQ ID NO: 116893 - RNA, 22 nt, Human
uuucuuuugaauaguguguggu

SEQ ID NO: 116894 - RNA, 22 nt, Human
uuucuuuugcccuguggguuag

SEQ ID NO: 116895 - RNA, 22 nt, Human
uuugaaaacuuaauuuggucgu

SEQ ID NO: 116896 - RNA, 22 nt, Human
uuugaaaagaaccaucgccuua

SEQ ID NO: 116897 - RNA, 22 nt, Human
uuugaaacccgucacuuugagu

SEQ ID NO: 116898 - RNA, 22 nt, Human
uuugaaacucugaacauguuuc

SEQ ID NO: 116899 - RNA, 19 nt, Human
uuugaaagaguuuuauugg

SEQ ID NO: 116900 - RNA, 22 nt, Human
uuugaaaggaauuaggaugaca

SEQ ID NO: 116901 - RNA, 22 nt, Human
uuugaaaggagcuuuauccaga

SEQ ID NO: 116902 - RNA, 22 nt, Human
uuugaaaggguuaugagacuga

SEQ ID NO: 116903 - RNA, 22 nt, Human
uuugaaaggugucgagaugugu

SEQ ID NO: 116904 - RNA, 23 nt, Human
uuugaaaguaucaacucgccuga

SEQ ID NO: 116905 - RNA, 21 nt, Human
uuugaaagugggugauucuuu

SEQ ID NO: 116906 - RNA, 22 nt, Human
uuugaaaguucuucugacacua

SEQ ID NO: 116907 - RNA, 22 nt, Human
uuugaacaagagcuucacauua

SEQ ID NO: 116908 - RNA, 22 nt, Human
uuugaacagacacuuucuacag

SEQ ID NO: 116909 - RNA, 22 nt, Human
uuugaaccugagcuucugcaug

SEQ ID NO: 116910 - RNA, 22 nt, Human
uuugaacucagcuucagacaac

SEQ ID NO: 116911 - RNA, 22 nt, Human
uuugaacuguucuaggauuuaa

SEQ ID NO: 116912 - RNA, 20 nt, Human
uuugaacuuuguacucuguu

SEQ ID NO: 116913 - RNA, 22 nt, Human
uuugaagacauuugaauacuuu

SEQ ID NO: 116914 - RNA, 22 nt, Human
uuugaagauaaauauggagaaa

SEQ ID NO: 116915 - RNA, 22 nt, Human
uuugaagauuaugccagaguga

SEQ ID NO: 116916 - RNA, 22 nt, Human
uuugaagucagacacugcuuug

SEQ ID NO: 116917 - RNA, 23 nt, Human
uuugaaguugacugccuuccaga

SEQ ID NO: 116918 - RNA, 22 nt, Human
uuugaauaugugcuuguuaaau

SEQ ID NO: 116919 - RNA, 22 nt, Human
uuugaaugagggaaccacaguu

SEQ ID NO: 116920 - RNA, 23 nt, Human
uuugaaugggucuauuuuucuua

SEQ ID NO: 116921 - RNA, 22 nt, Human
uuugaauguaaaugcugcagcu

SEQ ID NO: 116922 - RNA, 22 nt, Human
uuugaaugugugaguuaacuuu

SEQ ID NO: 116923 - RNA, 22 nt, Human
uuugacaaauccuucagcaaug

SEQ ID NO: 116924 - RNA, 22 nt, Human
uuugacaauucaugacauuuau

SEQ ID NO: 116925 - RNA, 22 nt, Human
uuugacagauagauguuauguu

SEQ ID NO: 116926 - RNA, 22 nt, Human
uuugacagcuugcagugagacc

SEQ ID NO: 116927 - RNA, 22 nt, Human
uuugacaggagguggcuacuca

SEQ ID NO: 116928 - RNA, 22 nt, Human
uuugacagugcugcuaaaaugc

SEQ ID NO: 116929 - RNA, 22 nt, Human
uuuaugacccaagaagauacca

SEQ ID NO: 116930 - RNA, 22 nt, Human
uuuaugacuucuaaucugaagc

SEQ ID NO: 116931 - RNA, 18 nt, Human
uuuaugagcugugggacc

SEQ ID NO: 116932 - RNA, 22 nt, Human
uuuaugcacacuuagacauggc

SEQ ID NO: 116933 - RNA, 23 nt, Human
uuuaugcagcauguagaacaugg

SEQ ID NO: 116934 - RNA, 22 nt, Human
uuuaugcagccucaguaucaga

SEQ ID NO: 116935 - RNA, 22 nt, Human
uuuaugccuccagaucuugcuu

SEQ ID NO: 116936 - RNA, 22 nt, Human
uuuauguacauauccacaagga

SEQ ID NO: 116937 - RNA, 19 nt, Human
uuuaugucauugaggucau

SEQ ID NO: 116938 - RNA, 22 nt, Human
uuuaugugaugcaucccagaaa

SEQ ID NO: 116939 - RNA, 22 nt, Human
uuuauuaaaacuguuggcucug

SEQ ID NO: 116940 - RNA, 21 nt, Human
uuuauuaacaacuguggacgu

SEQ ID NO: 116941 - RNA, 22 nt, Human
uuuauuaauuagugacccaaug

SEQ ID NO: 116942 - RNA, 22 nt, Human
uuuauucacuggggucugcccg

SEQ ID NO: 116943 - RNA, 22 nt, Human
uuuauucuauaggcauuaagca

SEQ ID NO: 116944 - RNA, 21 nt, Human
uuuauucucagauacagggag

SEQ ID NO: 116945 - RNA, 20 nt, Human
uuuauugagcacguacugug

SEQ ID NO: 116946 - RNA, 22 nt, Human
uuuauuggauggauggauggau

SEQ ID NO: 116947 - RNA, 22 nt, Human
uuuauuggaugggucagcucua

SEQ ID NO: 116948 - RNA, 20 nt, Human
uuuauuggccuuucaggaac

SEQ ID NO: 116949 - RNA, 22 nt, Human
uuuauugggccuggaggaucua

SEQ ID NO: 116950 - RNA, 22 nt, Human
uuuauugucuaugaacugcuug

SEQ ID NO: 116951 - RNA, 22 nt, Human
uuuauuguguugaaacugaauu

SEQ ID NO: 116952 - RNA, 22 nt, Human
uuuauuguuguuagucauaagu

SEQ ID NO: 116953 - RNA, 22 nt, Human
uuuauuuaaagucguguguuaa

SEQ ID NO: 116954 - RNA, 22 nt, Human
uuuauuucuuaguuugccacag

SEQ ID NO: 116955 - RNA, 22 nt, Human
uuuauuugucuugccauuuagu

SEQ ID NO: 116956 - RNA, 22 nt, Human
uuucaaaauuuugcagugguaa

SEQ ID NO: 116957 - RNA, 22 nt, Human
uuucaaacauagaucugaauau

SEQ ID NO: 116958 - RNA, 22 nt, Human
uuucaaaccacugagguucuga

SEQ ID NO: 116959 - RNA, 22 nt, Human
uuucaaagacagccauauuugu

SEQ ID NO: 116960 - RNA, 23 nt, Human
uuucaaagacuuucccuuagagu

SEQ ID NO: 116961 - RNA, 22 nt, Human
uuucaaaggaggcugagaggau

SEQ ID NO: 116962 - RNA, 22 nt, Human
uuucaaaguugggaauuguaau

SEQ ID NO: 116963 - RNA, 22 nt, Human
uuucaaauggagucgugaaaug

SEQ ID NO: 116964 - RNA, 23 nt, Human
uuucaaauuacucugcagaugac

SEQ ID NO: 116965 - RNA, 22 nt, Human
uuucaacaccagagaccaugcg

SEQ ID NO: 116966 - RNA, 22 nt, Human
uuucaacauaccucaguguaug

SEQ ID NO: 116967 - RNA, 22 nt, Human
uuucaacaucaccuagcaguuc

SEQ ID NO: 116968 - RNA, 23 nt, Human
uuucaacuccugccauuauuucu

SEQ ID NO: 116969 - RNA, 22 nt, Human
uuucaacuuguuugcuuccaua

SEQ ID NO: 116970 - RNA, 22 nt, Human
uuucaagaacaacauucauuca

SEQ ID NO: 116971 - RNA, 22 nt, Human
uuucaagaagcaaauuaaaguc

SEQ ID NO: 116972 - RNA, 22 nt, Human
uuucaagacguuaagucagcuu

SEQ ID NO: 116973 - RNA, 22 nt, Human
uuucaagagcaggaaaaagguc

SEQ ID NO: 116974 - RNA, 22 nt, Human
uuucaagaggccagagcgaggc

SEQ ID NO: 116975 - RNA, 22 nt, Human
uuucaagcucuucaguguuauu

SEQ ID NO: 116976 - RNA, 22 nt, Human
uuucaagcugugguaacugaga

SEQ ID NO: 116977 - RNA, 17 nt, Human
uuucaagguuacguucc

SEQ ID NO: 116978 - RNA, 22 nt, Human
uuucaaguaagauacauuucag

SEQ ID NO: 116979 - RNA, 22 nt, Human
uuucaaguacuguaaacaugcu

SEQ ID NO: 116980 - RNA, 22 nt, Human
uuucaagugacuaugguuuuug

SEQ ID NO: 116981 - RNA, 22 nt, Human
uuucaaguucuguuccuaaacu

SEQ ID NO: 116982 - RNA, 22 nt, Human
uuucaaguuguugcauuaaaug

SEQ ID NO: 116983 - RNA, 21 nt, Human
uuucaauguguucuuuguagu

SEQ ID NO: 116984 - RNA, 21 nt, Human
uuucaauuugccuugagucau

SEQ ID NO: 116985 - RNA, 21 nt, Human
uuucacaaaaguaugugacaa

SEQ ID NO: 116986 - RNA, 22 nt, Human
uuucacaaguaaaguccuaagu

SEQ ID NO: 116987 - RNA, 23 nt, Human
uuucacaaugagcauuacagaau

SEQ ID NO: 116988 - RNA, 22 nt, Human
uuucacagaaagacaacagaua

SEQ ID NO: 116989 - RNA, 22 nt, Human
uuucacagaacucacuaaggag

SEQ ID NO: 116990 - RNA, 22 nt, Human
uuucacagauccuacagcuugu

SEQ ID NO: 116991 - RNA, 22 nt, Human
uuucacagcugauaccucuucc

SEQ ID NO: 116992 - RNA, 22 nt, Human
uuucacagcuggguggcagagu

SEQ ID NO: 116993 - RNA, 22 nt, Human
uuucacaggaguuguaccauuu

SEQ ID NO: 116994 - RNA, 22 nt, Human
uuucacaggggcaaccuccaug

SEQ ID NO: 116995 - RNA, 22 nt, Human
uuucacagguauccacgggucu

SEQ ID NO: 116996 - RNA, 22 nt, Human
uuucacagucaauuuggaguca

SEQ ID NO: 116997 - RNA, 22 nt, Human
uuucacauaaauauuaugccua

SEQ ID NO: 116998 - RNA, 22 nt, Human
uuucacauagaaagugauuuac

SEQ ID NO: 116999 - RNA, 22 nt, Human
uuucacauaugguuguugauug

SEQ ID NO: 117000 - RNA, 22 nt, Human
uuucacauccugaagccccacu

SEQ ID NO: 117001 - RNA, 22 nt, Human
uuucacaugguacugccuguuu

SEQ ID NO: 117002 - RNA, 22 nt, Human
uuucacauuggcuucuauuucu

SEQ ID NO: 117003 - RNA, 23 nt, Human
uuucacauuuacuguuagauggc

SEQ ID NO: 117004 - RNA, 22 nt, Human
uuucacauuuuauacuuaagcc

SEQ ID NO: 117005 - RNA, 20 nt, Human
uuucaccaucuuggccaggc

SEQ ID NO: 117006 - RNA, 20 nt, Human
uuucacuggcuugauaaggu

SEQ ID NO: 117007 - RNA, 22 nt, Human
uuucacugggcuugcagaaauc

SEQ ID NO: 117008 - RNA, 22 nt, Human
uuucagaaagcaucaucaaagu

SEQ ID NO: 117009 - RNA, 22 nt, Human
uuucagaacagggauugggccu

SEQ ID NO: 117010 - RNA, 22 nt, Human
uuucagaauaucgauucaguga

SEQ ID NO: 117011 - RNA, 22 nt, Human
uuucagacauaccaguuauuga

SEQ ID NO: 117012 - RNA, 22 nt, Human
uuucagacaugggggcaaacag

SEQ ID NO: 117013 - RNA, 22 nt, Human
uuucagacauuaagugauggga

SEQ ID NO: 117014 - RNA, 22 nt, Human
uuucagaccuggaugugggggc

SEQ ID NO: 117015 - RNA, 22 nt, Human
uuucagacucaucucaagcuuu

SEQ ID NO: 117016 - RNA, 22 nt, Human
uuucagacugcccauguuugcc

SEQ ID NO: 117017 - RNA, 22 nt, Human
uuucagacuguacuuugggguu

SEQ ID NO: 117018 - RNA, 22 nt, Human
uuucagagaggcuucaaaucuu

SEQ ID NO: 117019 - RNA, 22 nt, Human
uuucagagaugucuagccuauu

SEQ ID NO: 117020 - RNA, 22 nt, Human
uuucagagccugcaaucccaau

SEQ ID NO: 117021 - RNA, 22 nt, Human
uuucagagcucagcagcuagag

SEQ ID NO: 117022 - RNA, 22 nt, Human
uuucagagcugagaugccacag

SEQ ID NO: 117023 - RNA, 22 nt, Human
uuucagagguaugcugcuuauc

SEQ ID NO: 117024 - RNA, 22 nt, Human
uuucagagucuggcugcagccu

SEQ ID NO: 117025 - RNA, 22 nt, Human
uuucagaucauuuuuuaaguac

SEQ ID NO: 117026 - RNA, 22 nt, Human
uuucagauggagguuuaggaca

SEQ ID NO: 117027 - RNA, 20 nt, Human
uuucagauuuacagaaaugu

SEQ ID NO: 117028 - RNA, 22 nt, Human
uuucagccagugaugcugaaga

SEQ ID NO: 117029 - RNA, 22 nt, Human
uuucagcugguaaaggaguagc

SEQ ID NO: 117030 - RNA, 22 nt, Human
uuucaggaaggugaggcacaug

SEQ ID NO: 117031 - RNA, 22 nt, Human
uuucaggacucaaaacgauaau

SEQ ID NO: 117032 - RNA, 19 nt, Human
uuucaggagcuaugcaggg

SEQ ID NO: 117033 - RNA, 22 nt, Human
uuucagggucagccuguaugug

SEQ ID NO: 117034 - RNA, 22 nt, Human
uuucagucaugaguuguuuuca

SEQ ID NO: 117035 - RNA, 22 nt, Human
uuucagucuuauuuuguugaua

SEQ ID NO: 117036 - RNA, 22 nt, Human
uuucagugcccagagcuuugca

SEQ ID NO: 117037 - RNA, 22 nt, Human
uuucagugcuucuguuuaccgg

SEQ ID NO: 117038 - RNA, 22 nt, Human
uuucagugugagugucuuauuu

SEQ ID NO: 117039 - RNA, 22 nt, Human
uuucaguuguuuuagcucugug

SEQ ID NO: 117040 - RNA, 22 nt, Human
uuuggagauagggccuagcaau

SEQ ID NO: 117041 - RNA, 22 nt, Human
uuuggagauggagagagggcau

SEQ ID NO: 117042 - RNA, 22 nt, Human
uuuggcaaagaucaacauguua

SEQ ID NO: 117043 - RNA, 22 nt, Human
uuuggcaacggagaacuuacuc

SEQ ID NO: 117044 - RNA, 22 nt, Human
uuuggcacauucugucacauuc

SEQ ID NO: 117045 - RNA, 22 nt, Human
uuuggcacucacuuaucauugg

SEQ ID NO: 117046 - RNA, 23 nt, Human
uuuggcauguuaacuucacuuac

SEQ ID NO: 117047 - RNA, 22 nt, Human
uuuggccucguuuagaaauggc

SEQ ID NO: 117048 - RNA, 22 nt, Human
uuuggccuuguguucucuccau

SEQ ID NO: 117049 - RNA, 22 nt, Human
uuuggcggggcaauucugaagc

SEQ ID NO: 117050 - RNA, 22 nt, Human
uuuggcuagccaagaaacaaaa

SEQ ID NO: 117051 - RNA, 22 nt, Human
uuuggcucgauggacuuugaau

SEQ ID NO: 117052 - RNA, 22 nt, Human
uuuggcucggcugcugauggug

SEQ ID NO: 117053 - RNA, 23 nt, Human
uuuggcugggcugugggcacacc

SEQ ID NO: 117054 - RNA, 22 nt, Human
uuugggaaauaaaccuagagga

SEQ ID NO: 117055 - RNA, 22 nt, Human
uuugggaauagcagggacugag

SEQ ID NO: 117056 - RNA, 22 nt, Human
uuugggaugcuagacaccucag

SEQ ID NO: 117057 - RNA, 22 nt, Human
uuugggauuuuacauuguaugg

SEQ ID NO: 117058 - RNA, 22 nt, Human
uuugggcaauucagugggaccu

SEQ ID NO: 117059 - RNA, 22 nt, Human
uuugggcagaaacaugcgcccc

SEQ ID NO: 117060 - RNA, 22 nt, Human
uuugggcaggcuuuucccuaga

SEQ ID NO: 117061 - RNA, 22 nt, Human
uuugggcauauagcuguucccu

SEQ ID NO: 117062 - RNA, 22 nt, Human
uuugggcauguuguggccagcu

SEQ ID NO: 117063 - RNA, 22 nt, Human
uuugggcugagaugugggccga

SEQ ID NO: 117064 - RNA, 18 nt, Human
uuugggcugauguugggc

SEQ ID NO: 117065 - RNA, 22 nt, Human
uuuggggcucagcaggcuguuu

SEQ ID NO: 117066 - RNA, 22 nt, Human
uuugguaacaguuuuuggcacu

SEQ ID NO: 117067 - RNA, 17 nt, Human
uuugguaauauauuaag

SEQ ID NO: 117068 - RNA, 22 nt, Human
uuugguauugcacacugucuuc

SEQ ID NO: 117069 - RNA, 22 nt, Human
uuuggucuggaaucuucagggu

SEQ ID NO: 117070 - RNA, 22 nt, Human
uuuggucuuuuauuuaaagcag

SEQ ID NO: 117071 - RNA, 22 nt, Human
uuuggugagcugcgagugagga

SEQ ID NO: 117072 - RNA, 22 nt, Human
uuugguuuagggucauuuaaca

SEQ ID NO: 117073 - RNA, 22 nt, Human
uuugguuugccugaguacccuc

SEQ ID NO: 117074 - RNA, 22 nt, Human
uuuuuuaucuaugguaguacca

SEQ ID NO: 117075 - RNA, 22 nt, Human
uuuuuuggauaauaaacgaucu

SEQ ID NO: 117076 - RNA, 22 nt, Human
uuuuuuguagcaagcgcagaua

SEQ ID NO: 117077 - RNA, 22 nt, Human adenovirus A
aacaaugcuauuauugagcauu

SEQ ID NO: 117078 - RNA, 22 nt, Human adenovirus A
acugcggugcgugucacagcau

SEQ ID NO: 117079 - RNA, 19 nt, Human adenovirus A
auuaagaugucagcugcga

SEQ ID NO: 117080 - RNA, 23 nt, Human adenovirus A
caaaaaggacgaggugcgauaac

SEQ ID NO: 117081 - RNA, 22 nt, Human adenovirus A
ccaauguuguaaugacuaagca

SEQ ID NO: 117082 - RNA, 22 nt, Human adenovirus A
gcgcucuuguguuaagugugag

SEQ ID NO: 117083 - RNA, 22 nt, Human adenovirus A
gggaugcuuuugggacgcuggu

SEQ ID NO: 117084 - RNA, 22 nt, Human adenovirus A
ugccagcguccggguucacuac

SEQ ID NO: 117085 - RNA, 22 nt, Human adenovirus A
uugcugcuggcuucugauuugu

SEQ ID NO: 117086 - RNA, 22 nt, Human adenovirus A
gucuacggcuaggggcuguggc

SEQ ID NO: 117087 - RNA, 22 nt, Human adenovirus A
augaguguauggaaaauuuggg

SEQ ID NO: 117088 - RNA, 22 nt, Human adenovirus A
caagcuuggcaagcauaacagu

SEQ ID NO: 117089 - RNA, 21 nt, Human adenovirus A
ccacgguacccaggcgugggc

SEQ ID NO: 117090 - RNA, 22 nt, Human adenovirus A
gacaccuucuuaaaaguguggu

SEQ ID NO: 117091 - RNA, 22 nt, Human adenovirus A
uauuugguuacgccgggcucgu

SEQ ID NO: 117092 - RNA, 22 nt, Human adenovirus A
ugaaagcacuggcggguaccaa

SEQ ID NO: 117093 - RNA, 22 nt, Human adenovirus A
ugugcucauagcggauccugcc

SEQ ID NO: 117094 - RNA, 22 nt, Human adenovirus A
uuuacugcuaggggggcgcucc

SEQ ID NO: 117095 - RNA, 22 nt, Human adenovirus A
caggccaacucacggaggaguc

SEQ ID NO: 117096 - RNA, 22 nt, Human adenovirus A
gggguccggcgcuuaaccaauu

SEQ ID NO: 117097 - RNA, 22 nt, Human adenovirus A
gggguuccucgcuaugguaccc

SEQ ID NO: 117098 - RNA, 22 nt, Human adenovirus A
guacucagccggcuaauguucc

SEQ ID NO: 117099 - RNA, 22 nt, Human adenovirus A
uccuuagucauauugcauuggg

SEQ ID NO: 117100 - RNA, 22 nt, Human adenovirus C
acgcugccacuguccgugaagg

SEQ ID NO: 117101 - RNA, 22 nt, Human adenovirus C
agguagugccgggcccggcgcc

SEQ ID NO: 117102 - RNA, 22 nt, Human adenovirus C
auaggggcuacgcugguuagca

SEQ ID NO: 117103 - RNA, 22 nt, Human adenovirus C
augaaaaaauucauagauugga

SEQ ID NO: 117104 - RNA, 22 nt, Human adenovirus C
cacuccaguaggccgucaccgc

SEQ ID NO: 117105 - RNA, 22 nt, Human adenovirus C
cgcccgcgaugccgaagggggc

SEQ ID NO: 117106 - RNA, 22 nt, Human adenovirus C
gcugggcguuaccccgucgcgc

SEQ ID NO: 117107 - RNA, 22 nt, Human adenovirus C
ggcgccgggcccggcacuaccu

SEQ ID NO: 117108 - RNA, 22 nt, Human adenovirus C
ggcggacggaagacaacaguag

SEQ ID NO: 117109 - RNA, 20 nt, Human adenovirus C
gguugccucggcgguggcag

SEQ ID NO: 117110 - RNA, 22 nt, Human adenovirus C
gugagugcgcccauggacauaa

SEQ ID NO: 117111 - RNA, 22 nt, Human adenovirus C
guggaagccuggaccgauguaa

SEQ ID NO: 117112 - RNA, 22 nt, Human adenovirus C
uccccgcggcgacggcgcaugg

SEQ ID NO: 117113 - RNA, 22 nt, Human adenovirus C
aagcaagggcccgcggcugcug

SEQ ID NO: 117114 - RNA, 21 nt, Human adenovirus C
acauccaacagugcgggaaug

SEQ ID NO: 117115 - RNA, 22 nt, Human adenovirus C
agguuuuggccagcugguuuag

SEQ ID NO: 117116 - RNA, 22 nt, Human adenovirus C
cauccccgcccuguucgguguc

SEQ ID NO: 117117 - RNA, 22 nt, Human adenovirus C
cggcacguggagcucaaucucg

SEQ ID NO: 117118 - RNA, 22 nt, Human adenovirus C
cggcagcugcagcuucuuuuug

SEQ ID NO: 117119 - RNA, 22 nt, Human adenovirus C
cuguuagagcucuguuccagca

SEQ ID NO: 117120 - RNA, 22 nt, Human adenovirus C
gagcggugcggggugcauaggu

SEQ ID NO: 117121 - RNA, 22 nt, Human adenovirus C
gcgcguuucucgucgcguccaa

SEQ ID NO: 117122 - RNA, 22 nt, Human adenovirus C
ggucguccgccaugauacccuu

SEQ ID NO: 117123 - RNA, 22 nt, Human adenovirus C
guacuucccagagacgcccagg

SEQ ID NO: 117124 - RNA, 22 nt, Human adenovirus C
uccggccguccgccgugaucca

SEQ ID NO: 117125 - RNA, 22 nt, Human adenovirus C
ucgcgguacagugucagcaagu

SEQ ID NO: 117126 - RNA, 22 nt, Human adenovirus C
uugccugggaggagccccacag

SEQ ID NO: 117127 - RNA, 22 nt, Human adenovirus C
uuggcacuucgucgagcgaggc

SEQ ID NO: 117128 - RNA, 22 nt, Human adenovirus C
aaugauaggccuauagaugggg

SEQ ID NO: 117129 - RNA, 17 nt, Human adenovirus C
acccaacauagcuuuag

SEQ ID NO: 117130 - RNA, 22 nt, Human adenovirus C
augcgccaaagggugcgaucgc

SEQ ID NO: 117131 - RNA, 22 nt, Human adenovirus C
cuccugcuguugcuccuccguc

SEQ ID NO: 117132 - RNA, 22 nt, Human adenovirus C
cugaaagcaauguaauuggguc

SEQ ID NO: 117133 - RNA, 22 nt, Human adenovirus C
gaucaugucuaccugcggggcg

SEQ ID NO: 117134 - RNA, 22 nt, Human adenovirus C
gcauggaucacggcggacggcc

SEQ ID NO: 117135 - RNA, 22 nt, Human adenovirus C
guccucgucagcguagucuggg

SEQ ID NO: 117136 - RNA, 22 nt, Human adenovirus C
guugcgcgcggucauguccagc

SEQ ID NO: 117137 - RNA, 20 nt, Human adenovirus C
uccacguuggaaauuuugca

SEQ ID NO: 117138 - RNA, 22 nt, Human adenovirus C
ugcaaaauuccaagguaggaga

SEQ ID NO: 117139 - RNA, 22 nt, Human adenovirus C
ugucauaaucaguguggguucu

SEQ ID NO: 117140 - RNA, 22 nt, Human adenovirus C
uugccacugccacagagggcau

SEQ ID NO: 117141 - RNA, 22 nt, Human adenovirus C
auuguuccagucccgguucccu

SEQ ID NO: 117142 - RNA, 22 nt, Human adenovirus C
cuccgggcugcgcgcuggccag

SEQ ID NO: 117143 - RNA, 22 nt, Human adenovirus C
ugcagagcuucaugcugcgggg

SEQ ID NO: 117144 - RNA, 22 nt, Human adenovirus C
uuuuccgcuugcuuguauuccc

SEQ ID NO: 117145 - RNA, 20 nt, Human adenovirus D
aaggcggcucguccaccugc

SEQ ID NO: 117146 - RNA, 22 nt, Human adenovirus D
agcgauguccgccgacuuguug

SEQ ID NO: 117147 - RNA, 22 nt, Human adenovirus D
agcgccagucccucauccuccg

SEQ ID NO: 117148 - RNA, 22 nt, Human adenovirus D
cucccaggcccacaauacugug

SEQ ID NO: 117149 - RNA, 22 nt, Human adenovirus D
gcagcacauccuccucuccucc

SEQ ID NO: 117150 - RNA, 22 nt, Human adenovirus D
ggagggcauaucaauuuucucc

SEQ ID NO: 117151 - RNA, 22 nt, Human adenovirus D
uuggcggcacgcuccugcugcu

SEQ ID NO: 117152 - RNA, 22 nt, Human adenovirus D
cgggguuguggacuuccgcgua

SEQ ID NO: 117153 - RNA, 23 nt, Human adenovirus D
cgucacgacgcacggcuaacggu

SEQ ID NO: 117154 - RNA, 22 nt, Human adenovirus D
gacugcgauuggcuagacgcuu

SEQ ID NO: 117155 - RNA, 22 nt, Human adenovirus D
gaggaugagggacuggcgcugc

SEQ ID NO: 117156 - RNA, 22 nt, Human adenovirus D
gcuggcuggugccgaucucguu

SEQ ID NO: 117157 - RNA, 21 nt, Human adenovirus D
gggccugcaaacggugaaccu

SEQ ID NO: 117158 - RNA, 22 nt, Human adenovirus D
agcgucugccucaggcgcucgg

SEQ ID NO: 117159 - RNA, 22 nt, Human adenovirus D
ccaguucugggccuggcggcgg

SEQ ID NO: 117160 - RNA, 22 nt, Human adenovirus D
cgcaccgcggcacggucguggc

SEQ ID NO: 117161 - RNA, 18 nt, Human adenovirus D
gacuggugcugcgcgcgc

SEQ ID NO: 117162 - RNA, 20 nt, Human adenovirus D
gggaauccucgaucguccgc

SEQ ID NO: 117163 - RNA, 22 nt, Human adenovirus D
gucagguguguuuggcuuuagu

SEQ ID NO: 117164 - RNA, 22 nt, Human adenovirus D
ucggccagguccgaggcgacgg

SEQ ID NO: 117165 - RNA, 22 nt, Human adenovirus D
ugagaggagugugauaugcaca

SEQ ID NO: 117166 - RNA, 22 nt, Human adenovirus D
aagauucuccgauccggucgau

SEQ ID NO: 117167 - RNA, 22 nt, Human adenovirus D
accaacuaaaguuacguuugac

SEQ ID NO: 117168 - RNA, 22 nt, Human adenovirus D
aguugcaggaugcgcugcucgg

SEQ ID NO: 117169 - RNA, 22 nt, Human adenovirus D
ccguggccucuucgcccgaccg

SEQ ID NO: 117170 - RNA, 22 nt, Human adenovirus D
gauuggccgagaaacguugaug

SEQ ID NO: 117171 - RNA, 22 nt, Human adenovirus D
gcgucugcagcauugucugccu

SEQ ID NO: 117172 - RNA, 22 nt, Human adenovirus D
gcguggugggcaugccggccuu

SEQ ID NO: 117173 - RNA, 22 nt, Human adenovirus D
guuggacugcacguuugugcug

SEQ ID NO: 117174 - RNA, 22 nt, Human adenovirus D
ucaggaaguugcuguggucguu

SEQ ID NO: 117175 - RNA, 22 nt, Human adenovirus D
acauguaacuuagucguagggc

SEQ ID NO: 117176 - RNA, 20 nt, Human adenovirus D
agaaauuccauauguccgcc

SEQ ID NO: 117177 - RNA, 22 nt, Human adenovirus D
cagcagggcguuguacacuagc

SEQ ID NO: 117178 - RNA, 22 nt, Human adenovirus E
cagaauguucaccagguccagg

SEQ ID NO: 117179 - RNA, 21 nt, Human adenovirus E
cccugagcagcagcuugacgg

SEQ ID NO: 117180 - RNA, 22 nt, Human adenovirus E
ccugaagagguagugcagguuc

SEQ ID NO: 117181 - RNA, 22 nt, Human adenovirus E
ccugcaagaucuccaacgugga

SEQ ID NO: 117182 - RNA, 22 nt, Human adenovirus E
cgccucagcaaccugcugggca

SEQ ID NO: 117183 - RNA, 22 nt, Human adenovirus E
cgcuggcuccuggaccugguga

SEQ ID NO: 117184 - RNA, 22 nt, Human adenovirus E
uuucaguauguggaaucaggcg

SEQ ID NO: 117185 - RNA, 22 nt, Human adenovirus E
ccgcgucugcuccugcagcuga

SEQ ID NO: 117186 - RNA, 22 nt, Human adenovirus E
gugauuuccccguucuuggugg

SEQ ID NO: 117187 - RNA, 20 nt, Human adenovirus E
caucguggugcaggagcgcg

SEQ ID NO: 117188 - RNA, 22 nt, Human adenovirus E
gaggacgacggucuggcggcgg

SEQ ID NO: 117189 - RNA, 23 nt, Human adenovirus E
ucagcucgcccaggcgcuggguc

SEQ ID NO: 117190 - RNA, 22 nt, Human adenovirus E
accugguggacaacaagucggc

SEQ ID NO: 117191 - RNA, 22 nt, Human adenovirus E
cccgaggaaucgagguccaccc

SEQ ID NO: 117192 - RNA, 22 nt, Human adenovirus E
ccgugggcaucaugcugaggga

SEQ ID NO: 117193 - RNA, 22 nt, Human adenovirus E
ccucgggcucggugauauucag

SEQ ID NO: 117194 - RNA, 22 nt, Human adenovirus E
ggagaucuugcaggccuggcgc

SEQ ID NO: 117195 - RNA, 22 nt, Human adenovirus F
agcgguggggagaggugugauc

SEQ ID NO: 117196 - RNA, 22 nt, Human adenovirus F
cugcuguaugaugggcacgcgg

SEQ ID NO: 117197 - RNA, 22 nt, Human adenovirus F
gucaaaauugauggucugggua

SEQ ID NO: 117198 - RNA, 22 nt, Human adenovirus F
ucgcaucuuuuuugacuuggcu

SEQ ID NO: 117199 - RNA, 23 nt, Human adenovirus F
acugucaguggugcggcgguggc

SEQ ID NO: 117200 - RNA, 16 nt, Human adenovirus F
agucauuauuuuguac

SEQ ID NO: 117201 - RNA, 22 nt, Human adenovirus F
caccuguaccgggucuuggaaa

SEQ ID NO: 117202 - RNA, 22 nt, Human adenovirus F
cggaaggcauagugcagggacu

SEQ ID NO: 117203 - RNA, 22 nt, Human adenovirus F
gaggcguucgacgcgaggauga

SEQ ID NO: 117204 - RNA, 22 nt, Human adenovirus F
gccucugccaguguuaauacua

SEQ ID NO: 117205 - RNA, 22 nt, Human adenovirus F
gccugggagaaaggcauggauu

SEQ ID NO: 117206 - RNA, 22 nt, Human adenovirus F
ggagaucuugcaggccugacga

SEQ ID NO: 117207 - RNA, 22 nt, Human adenovirus F
ggagcguguuugucagagguag

SEQ ID NO: 117208 - RNA, 22 nt, Human adenovirus F
ggagggacguggagcgccugca

SEQ ID NO: 117209 - RNA, 22 nt, Human adenovirus F
ugaggcuuggcagucucuaccu

SEQ ID NO: 117210 - RNA, 22 nt, Human adenovirus F
uuuaaacgaccgcgacaggugg

SEQ ID NO: 117211 - RNA, 22 nt, Human adenovirus F
aguuagcgcccugucgcugccu

SEQ ID NO: 117212 - RNA, 22 nt, Human adenovirus F
cagugguucuuaauccgcaggc

SEQ ID NO: 117213 - RNA, 22 nt, Human adenovirus F
cgcccucuucugcaccugcacg

SEQ ID NO: 117214 - RNA, 22 nt, Human adenovirus F
gaccaccugucgcggucguuua

SEQ ID NO: 117215 - RNA, 22 nt, Human adenovirus F
gcaagcccauucugccaguugg

SEQ ID NO: 117216 - RNA, 22 nt, Human adenovirus F
ugcagagccaccggaggcuggc

SEQ ID NO: 117217 - RNA, 22 nt, Human adenovirus F
ugcggagccugagggucgcugg

SEQ ID NO: 117218 - RNA, 22 nt, Human adenovirus F
aacguaugcuguuccgcccuuc

SEQ ID NO: 117219 - RNA, 22 nt, Human adenovirus F
gugcaggugcagaagagggcga

SEQ ID NO: 117220 - RNA, 22 nt, Human astrovirus
cccagcagacuuccauccagug

SEQ ID NO: 117221 - RNA, 22 nt, Human coronavirus 229E
ccauagaagacauacuuuuuag

SEQ ID NO: 117222 - RNA, 22 nt, Human coronavirus 229E
uuaccagacuaacaucuauuca

SEQ ID NO: 117223 - RNA, 20 nt, Human coronavirus 229E
aucuucaaguugaaucugca

SEQ ID NO: 117224 - RNA, 22 nt, Human coronavirus 229E
gcagaggauguuuguacuuguu

SEQ ID NO: 117225 - RNA, 22 nt, Human coronavirus 229E
gcauaugaaacagcaagacaag

SEQ ID NO: 117226 - RNA, 22 nt, Human coronavirus 229E
gcuuuaacaccauuggccacaa

SEQ ID NO: 117227 - RNA, 18 nt, Human coronavirus 229E
ggucaaggucucuggggc

SEQ ID NO: 117228 - RNA, 22 nt, Human coronavirus 229E
gucugucauagauagccugaau

SEQ ID NO: 117229 - RNA, 22 nt, Human coronavirus 229E
ugagggcagaaccauuuauggu

SEQ ID NO: 117230 - RNA, 22 nt, Human coronavirus 229E
auuucuuuugcuccaugguggu

SEQ ID NO: 117231 - RNA, 22 nt, Human coronavirus 229E
gccuaucuacuuguugaucagc

SEQ ID NO: 117232 - RNA, 22 nt, Human coronavirus 229E
ggugcuaauuucacuggucaaa

SEQ ID NO: 117233 - RNA, 22 nt, Human coronavirus 229E
gugcaauuucuaaugaauggua

SEQ ID NO: 117234 - RNA, 20 nt, Human coronavirus 229E
uaguaugugguucucaaaca

SEQ ID NO: 117235 - RNA, 22 nt, Human coronavirus 229E
ugucugaaauccauaguagcua

SEQ ID NO: 117236 - RNA, 22 nt, Human coronavirus 229E
uguugcaacaugcuacaauucu

SEQ ID NO: 117237 - RNA, 22 nt, Human coronavirus 229E
uuaagauuggagcuguuaaaca

SEQ ID NO: 117238 - RNA, 22 nt, Human coronavirus 229E
uuugaacaguguaauuaagcuc

SEQ ID NO: 117239 - RNA, 22 nt, Human coronavirus 229E
uuuucaugcccuauuuuaugua

SEQ ID NO: 117240 - RNA, 22 nt, Human coronavirus 229E
agauguuaacaguuaauguggu

SEQ ID NO: 117241 - RNA, 20 nt, Human coronavirus 229E
auuguuaugacaagaacccu

SEQ ID NO: 117242 - RNA, 22 nt, Human coronavirus 229E
caagcugucacgcaaauaccug

SEQ ID NO: 117243 - RNA, 22 nt, Human coronavirus 229E
ccagaguauauugauguuaaua

SEQ ID NO: 117244 - RNA, 22 nt, Human coronavirus 229E
uacacauuuugacauugaagaa

SEQ ID NO: 117245 - RNA, 22 nt, Human coronavirus 229E
uauucaaucagcacuuucuguu

SEQ ID NO: 117246 - RNA, 22 nt, Human coronavirus 229E
uuuguuaaugacaaaauuacug

SEQ ID NO: 117247 - RNA, 22 nt, Human echovirus 1
acucggcacacaugggggccac

SEQ ID NO: 117248 - RNA, 22 nt, Human echovirus 1
ccaugggaggugaaggugucgu

SEQ ID NO: 117249 - RNA, 22 nt, Human echovirus 1
cucaaguguuuggcuuucaacu

SEQ ID NO: 117250 - RNA, 22 nt, Human herpesvirus 1
aaacgcgagcugcacgcggggc

SEQ ID NO: 117251 - RNA, 22 nt, Human herpesvirus 1
aagaagcucacauaguccccac

SEQ ID NO: 117252 - RNA, 22 nt, Human herpesvirus 1
acacgcgggacaucgcgcagcg

SEQ ID NO: 117253 - RNA, 22 nt, Human herpesvirus 1
accccaggcgugccgggggaac

SEQ ID NO: 117254 - RNA, 19 nt, Human herpesvirus 1
acgcaggcgcccccggcga

SEQ ID NO: 117255 - RNA, 22 nt, Human herpesvirus 1
agaacagcgucacccgauuacu

SEQ ID NO: 117256 - RNA, 22 nt, Human herpesvirus 1
agcgcgcucgucugacguuugg

SEQ ID NO: 117257 - RNA, 22 nt, Human herpesvirus 1
agcgcuggcggccgucucgagg

SEQ ID NO: 117258 - RNA, 22 nt, Human herpesvirus 1
agcucauccaacgccgcauggg

SEQ ID NO: 117259 - RNA, 22 nt, Human herpesvirus 1
ccauguccuuuugucaaucggu

SEQ ID NO: 117260 - RNA, 22 nt, Human herpesvirus 1
cccaugcggcguuggaugagcu

SEQ ID NO: 117261 - RNA, 22 nt, Human herpesvirus 1
ccccaugggcgguggaggaguu

SEQ ID NO: 117262 - RNA, 22 nt, Human herpesvirus 1
ccgccgcuugaucauuaucacc

SEQ ID NO: 117263 - RNA, 22 nt, Human herpesvirus 1
ccggagguuccggaggcgccgc

SEQ ID NO: 117264 - RNA, 22 nt, Human herpesvirus 1
ccggaucgagguaccgucggug

SEQ ID NO: 117265 - RNA, 22 nt, Human herpesvirus 1
accgggucucgagguaucgguu

SEQ ID NO: 117266 - RNA, 22 nt, Human herpesvirus 1
acgccgccaucgcgcccuuucg

SEQ ID NO: 117267 - RNA, 22 nt, Human herpesvirus 1
acgcgcgauagagucgacgacc

SEQ ID NO: 117268 - RNA, 22 nt, Human herpesvirus 1
agcugcucgagucccugccugu

SEQ ID NO: 117269 - RNA, 22 nt, Human herpesvirus 1
agguggcgcacccggacguggg

SEQ ID NO: 117270 - RNA, 22 nt, Human herpesvirus 1
caucaacaggaggucagugucc

SEQ ID NO: 117271 - RNA, 22 nt, Human herpesvirus 1
ccaacccuggguggucgcggaa

SEQ ID NO: 117272 - RNA, 22 nt, Human herpesvirus 1
ccgucccgggccuucgcggcca

SEQ ID NO: 117273 - RNA, 22 nt, Human herpesvirus 1
ccucgagacggccgccagcgcu

SEQ ID NO: 117274 - RNA, 22 nt, Human herpesvirus 1
cgaacgcacaacggcgcugcuc

SEQ ID NO: 117275 - RNA, 22 nt, Human herpesvirus 1
cgauagugccgaggcgccgccc

SEQ ID NO: 117276 - RNA, 22 nt, Human herpesvirus 1
cgcucacgcgcaugcccgccac

SEQ ID NO: 117277 - RNA, 22 nt, Human herpesvirus 1
cggaacagcaucguaccggggc

SEQ ID NO: 117278 - RNA, 17 nt, Human herpesvirus 1
cggccggccgccauggc

SEQ ID NO: 117279 - RNA, 18 nt, Human herpesvirus 1
cuuuccgagggcgagcuc

SEQ ID NO: 117280 - RNA, 22 nt, Human herpesvirus 1
gaacuugggggucgugagcagg

SEQ ID NO: 117281 - RNA, 22 nt, Human herpesvirus 1
gaagaggggucgggauccaaag

SEQ ID NO: 117282 - RNA, 22 nt, Human herpesvirus 1
gaccgcgagggacacguggugc

SEQ ID NO: 117283 - RNA, 22 nt, Human herpesvirus 1
gaucggugggcccgccgcggcc

SEQ ID NO: 117284 - RNA, 22 nt, Human herpesvirus 1
gcaggccgugugcaggcccugc

SEQ ID NO: 117285 - RNA, 21 nt, Human herpesvirus 1
gcgacaccuucccgugcaugc

SEQ ID NO: 117286 - RNA, 22 nt, Human herpesvirus 1
gcgcagacugucgacggccccc

SEQ ID NO: 117287 - RNA, 22 nt, Human herpesvirus 1
gcgcgugguccccggggacgug

SEQ ID NO: 117288 - RNA, 22 nt, Human herpesvirus 1
gcgugcaggaggcggacggccc

SEQ ID NO: 117289 - RNA, 22 nt, Human herpesvirus 1
ggagcugugccgccagacacgc

SEQ ID NO: 117290 - RNA, 22 nt, Human herpesvirus 1
ggccgcuguucgagggccagga

SEQ ID NO: 117291 - RNA, 22 nt, Human herpesvirus 1
ggccggggcccgcgcgcugaug

SEQ ID NO: 117292 - RNA, 22 nt, Human herpesvirus 1
gggacgcgaguacccacguuaa

SEQ ID NO: 117293 - RNA, 22 nt, Human herpesvirus 1
gggccuaccguggacuccauuu

SEQ ID NO: 117294 - RNA, 22 nt, Human herpesvirus 1
gggccuguucgguaucgucguu

SEQ ID NO: 117295 - RNA, 22 nt, Human herpesvirus 1
gggcguggccgcuauuauaaaa

SEQ ID NO: 117296 - RNA, 22 nt, Human herpesvirus 1
ggggcgagcugugcccgcguga

SEQ ID NO: 117297 - RNA, 22 nt, Human herpesvirus 1
ggggcggagcguugugugggcg

SEQ ID NO: 117298 - RNA, 22 nt, Human herpesvirus 1
ggucccggcgcuggcgguaagu

SEQ ID NO: 117299 - RNA, 22 nt, Human herpesvirus 1
gguccggagaucaugcgcgggu

SEQ ID NO: 117300 - RNA, 22 nt, Human herpesvirus 1
gguguuuacgaacgaguuugac

SEQ ID NO: 117301 - RNA, 22 nt, Human herpesvirus 1
guacgcgaccguguugguguga

SEQ ID NO: 117302 - RNA, 19 nt, Human herpesvirus 1
gucgacguagggggcgcgg

SEQ ID NO: 117303 - RNA, 22 nt, Human herpesvirus 1
gucgcucgguauucgaggccac

SEQ ID NO: 117304 - RNA, 23 nt, Human herpesvirus 1
guggaccugggaccgcgccgccc

SEQ ID NO: 117305 - RNA, 18 nt, Human herpesvirus 1
uacucgcgagcgcggggg

SEQ ID NO: 117306 - RNA, 22 nt, Human herpesvirus 1
uagcauaucacauaccccguuc

SEQ ID NO: 117307 - RNA, 17 nt, Human herpesvirus 1
ucgggccgugggcgacc

SEQ ID NO: 117308 - RNA, 22 nt, Human herpesvirus 1
ucgucgucagcaccgucaucca

SEQ ID NO: 117309 - RNA, 22 nt, Human herpesvirus 1
ugggggugugcguucgaugcgg

SEQ ID NO: 117310 - RNA, 22 nt, Human herpesvirus 1
uuggugccgguggggcguaccg

SEQ ID NO: 117311 - RNA, 22 nt, Human herpesvirus 1
gagcuuguuuucgugggggacg

SEQ ID NO: 117312 - RNA, 19 nt, Human herpesvirus 1
gcacggccgacgccgcggu

SEQ ID NO: 117313 - RNA, 22 nt, Human herpesvirus 1
gcagccuucgcucuccauccug

SEQ ID NO: 117314 - RNA, 22 nt, Human herpesvirus 1
gcagguugucguugccgcgggu

SEQ ID NO: 117315 - RNA, 22 nt, Human herpesvirus 1
gcgcccgaggccucgaaccggc

SEQ ID NO: 117316 - RNA, 18 nt, Human herpesvirus 1
gcggggguggauacgcug

SEQ ID NO: 117317 - RNA, 22 nt, Human herpesvirus 1
ggccuuguuugucuggcggauc

SEQ ID NO: 117318 - RNA, 22 nt, Human herpesvirus 1
ggcguuguugauggccacggug

SEQ ID NO: 117319 - RNA, 22 nt, Human herpesvirus 1
ggcucguguuguuuuccgagua

SEQ ID NO: 117320 - RNA, 22 nt, Human herpesvirus 1
ggcugguucgcagcgaggugca

SEQ ID NO: 117321 - RNA, 22 nt, Human herpesvirus 1
gggagugagggucgcgucgucu

SEQ ID NO: 117322 - RNA, 22 nt, Human herpesvirus 1
gggcccagcgcgaucuacggga

SEQ ID NO: 117323 - RNA, 17 nt, Human herpesvirus 1
gggggaagcgagauagg

SEQ ID NO: 117324 - RNA, 22 nt, Human herpesvirus 1
gucucggggucagccucgagcu

SEQ ID NO: 117325 - RNA, 22 nt, Human herpesvirus 1
gugggggaguuugagacggccg

SEQ ID NO: 117326 - RNA, 16 nt, Human herpesvirus 1
guggugcccggggcug

SEQ ID NO: 117327 - RNA, 22 nt, Human herpesvirus 1
guucggacggcaggcacacgua

SEQ ID NO: 117328 - RNA, 23 nt, Human herpesvirus 1
ucccgaggcgucgcugccggccc

SEQ ID NO: 117329 - RNA, 22 nt, Human herpesvirus 1
ucgucgagcguaccgacgggcg

SEQ ID NO: 117330 - RNA, 22 nt, Human herpesvirus 1
ugaucgggguacuucgccgccg

SEQ ID NO: 117331 - RNA, 22 nt, Human herpesvirus 1
ugccccccggccucgucgaggu

SEQ ID NO: 117332 - RNA, 22 nt, Human herpesvirus 1
ugccggacacccaggggcgauu

SEQ ID NO: 117333 - RNA, 22 nt, Human herpesvirus 1
uggccgucuuugacgagccgcc

SEQ ID NO: 117334 - RNA, 22 nt, Human herpesvirus 1
uggguuuggcgcgcguaugcgu

SEQ ID NO: 117335 - RNA, 22 nt, Human herpesvirus 1
uggucccgacgccaacccaggc

SEQ ID NO: 117336 - RNA, 22 nt, Human herpesvirus 1
cuccccugcggcguugcgacau

SEQ ID NO: 117337 - RNA, 18 nt, Human herpesvirus 1
gacaacaacgcccauguu

SEQ ID NO: 117338 - RNA, 22 nt, Human herpesvirus 1
gacgucgacucuaucgcgcgca

SEQ ID NO: 117339 - RNA, 22 nt, Human herpesvirus 1
gcccggcucgcgccgugcugac

SEQ ID NO: 117340 - RNA, 22 nt, Human herpesvirus 1
gccguguccuucacggggcucu

SEQ ID NO: 117341 - RNA, 22 nt, Human herpesvirus 1
gcgcuguggccucccguuccgg

SEQ ID NO: 117342 - RNA, 22 nt, Human herpesvirus 1
gcgggccugucguguagauucg

SEQ ID NO: 117343 - RNA, 22 nt, Human herpesvirus 1
gcggucccgcgucgggucgugg

SEQ ID NO: 117344 - RNA, 22 nt, Human herpesvirus 1
ggacgaggcgucggcgggccuc

SEQ ID NO: 117345 - RNA, 22 nt, Human herpesvirus 1
ggcagggcguuguucuggucaa

SEQ ID NO: 117346 - RNA, 22 nt, Human herpesvirus 1
ggcccagacgccguacccggug

SEQ ID NO: 117347 - RNA, 22 nt, Human herpesvirus 1
ggcgcgacacgaacaccgggcg

SEQ ID NO: 117348 - RNA, 22 nt, Human herpesvirus 1
ggggggccuccgacggugcguu

SEQ ID NO: 117349 - RNA, 22 nt, Human herpesvirus 1
ggguggcagcagcgccgggucu

SEQ ID NO: 117350 - RNA, 22 nt, Human herpesvirus 1
ggucgucggcgggcugacgauc

SEQ ID NO: 117351 - RNA, 22 nt, Human herpesvirus 1
gucccgccgaacgcauacaugc

SEQ ID NO: 117352 - RNA, 22 nt, Human herpesvirus 1
guccuuuggaucccgaccccuc

SEQ ID NO: 117353 - RNA, 22 nt, Human herpesvirus 1
gucgcggcguccuggaucgacg

SEQ ID NO: 117354 - RNA, 22 nt, Human herpesvirus 1
guucccccggcacgccuggggu

SEQ ID NO: 117355 - RNA, 20 nt, Human herpesvirus 1
uagggcgaagugcgagcacu

SEQ ID NO: 117356 - RNA, 22 nt, Human herpesvirus 1
uccccugugguguuuuugguua

SEQ ID NO: 117357 - RNA, 22 nt, Human herpesvirus 1
ucgaugugggggugaccuccgg

SEQ ID NO: 117358 - RNA, 22 nt, Human herpesvirus 1
ucgcagcgauuuucguacgggg

SEQ ID NO: 117359 - RNA, 22 nt, Human herpesvirus 1
ucucgucgacaaacagggggaa

SEQ ID NO: 117360 - RNA, 22 nt, Human herpesvirus 1
ugaauaucucguugcgauucac

SEQ ID NO: 117361 - RNA, 22 nt, Human herpesvirus 1
ugcccgggacccacguggcggc

SEQ ID NO: 117362 - RNA, 20 nt, Human herpesvirus 1
ugcgucgcccgcgucuggac

SEQ ID NO: 117363 - RNA, 22 nt, Human herpesvirus 1
uggacaggcucuggagcauccg

SEQ ID NO: 117364 - RNA, 23 nt, Human herpesvirus 1
uggccgucaggagcucggcgcag

SEQ ID NO: 117365 - RNA, 22 nt, Human herpesvirus 1
uggcgcacccggacguggggcg

SEQ ID NO: 117366 - RNA, 22 nt, Human herpesvirus 1
uggggaccacgcccccaacacg

SEQ ID NO: 117367 - RNA, 14 nt, Human herpesvirus 1
uggugcgauggcga

SEQ ID NO: 117368 - RNA, 22 nt, Human herpesvirus 1
uguggccucaccugaccaaccu

SEQ ID NO: 117369 - RNA, 20 nt, Human herpesvirus 1
uguggugccgccugugauac

SEQ ID NO: 117370 - RNA, 22 nt, Human herpesvirus 1
uugccgucgucguccucguccu

SEQ ID NO: 117371 - RNA, 22 nt, Human herpesvirus 1
uuggucaggugaggccacagcg

SEQ ID NO: 117372 - RNA, 22 nt, Human herpesvirus 1
acggcccgaagaugcguggcua

SEQ ID NO: 117373 - RNA, 18 nt, Human herpesvirus 1
acgggcugucauuccucg

SEQ ID NO: 117374 - RNA, 22 nt, Human herpesvirus 1
agaaccuccccggguugcucgu

SEQ ID NO: 117375 - RNA, 22 nt, Human herpesvirus 1
agaugggcugcgcugggcgcca

SEQ ID NO: 117376 - RNA, 22 nt, Human herpesvirus 1
agugcucgcacuucgcccuaau

SEQ ID NO: 117377 - RNA, 22 nt, Human herpesvirus 1
auaauuuuauuggugggucguu

SEQ ID NO: 117378 - RNA, 22 nt, Human herpesvirus 1
cagucgcacucgucccuggcuc

SEQ ID NO: 117379 - RNA, 22 nt, Human herpesvirus 1
caguuuggugggauuugcggcg

SEQ ID NO: 117380 - RNA, 22 nt, Human herpesvirus 1
caugcucacgcugcaggugcug

SEQ ID NO: 117381 - RNA, 22 nt, Human herpesvirus 1
ccacgggccgcagcggcaccgu

SEQ ID NO: 117382 - RNA, 22 nt, Human herpesvirus 1
ccccagcgugcaggcugcggcc

SEQ ID NO: 117383 - RNA, 22 nt, Human herpesvirus 1
cccccgagucggacccggaggc

SEQ ID NO: 117384 - RNA, 22 nt, Human herpesvirus 1
ccgggcaugaaaacgaccucca

SEQ ID NO: 117385 - RNA, 22 nt, Human herpesvirus 1
cgacaggauuugggaccuacca

SEQ ID NO: 117386 - RNA, 22 nt, Human herpesvirus 1
cgccccgacggccaggugcgug

SEQ ID NO: 117387 - RNA, 22 nt, Human herpesvirus 1
cggacgucuucggaggccccgc

SEQ ID NO: 117388 - RNA, 22 nt, Human herpesvirus 1
cgguuccgcgguaccccgaguc

SEQ ID NO: 117389 - RNA, 22 nt, Human herpesvirus 1
cgucgccugcacaggaaggacc

SEQ ID NO: 117390 - RNA, 22 nt, Human herpesvirus 1
cguugcggagcaucccgcgccu

SEQ ID NO: 117391 - RNA, 22 nt, Human herpesvirus 1
gaccaccggcgucggcgcccgg

SEQ ID NO: 117392 - RNA, 22 nt, Human herpesvirus 1
aaaggggucugcaaccaaaggu

SEQ ID NO: 117393 - RNA, 22 nt, Human herpesvirus 1
aaugcgcgcgauagagucgacg

SEQ ID NO: 117394 - RNA, 22 nt, Human herpesvirus 1
acccaggcggcgaacgggggcc

SEQ ID NO: 117395 - RNA, 22 nt, Human herpesvirus 1
accugcagcaaacggcaccacg

SEQ ID NO: 117396 - RNA, 22 nt, Human herpesvirus 1
acgggcgcuuuggcacccaguc

SEQ ID NO: 117397 - RNA, 22 nt, Human herpesvirus 1
agccccacgcagggucugcgag

SEQ ID NO: 117398 - RNA, 22 nt, Human herpesvirus 1
agcguucgcacuucgucccaau

SEQ ID NO: 117399 - RNA, 22 nt, Human herpesvirus 1
aggccccuaggucgcgacggcu

SEQ ID NO: 117400 - RNA, 22 nt, Human herpesvirus 1
cagaggggcgagguccguuucg

SEQ ID NO: 117401 - RNA, 22 nt, Human herpesvirus 1
cagcggccggccggcgcuuagg

SEQ ID NO: 117402 - RNA, 22 nt, Human herpesvirus 1
caucgggccagauucacgcuuc

SEQ ID NO: 117403 - RNA, 22 nt, Human herpesvirus 1
ccacaacauggagcauacgcuc

SEQ ID NO: 117404 - RNA, 22 nt, Human herpesvirus 1
ccccgagccacgccagaaccuu

SEQ ID NO: 117405 - RNA, 22 nt, Human herpesvirus 1
cccgcgagucggagcuggagcu

SEQ ID NO: 117406 - RNA, 22 nt, Human herpesvirus 1
cccgcgcgucgacgggacccag

SEQ ID NO: 117407 - RNA, 22 nt, Human herpesvirus 1
ccgcgugggccccgcuggcguu

SEQ ID NO: 117408 - RNA, 22 nt, Human herpesvirus 1
ccggagagcggcuuggugcgga

SEQ ID NO: 117409 - RNA, 22 nt, Human herpesvirus 1
ccggccuggccgcccugugucu

SEQ ID NO: 117410 - RNA, 22 nt, Human herpesvirus 1
cgagucggauuaugcccucuac

SEQ ID NO: 117411 - RNA, 15 nt, Human herpesvirus 1
cgccgcgcccgggcc

SEQ ID NO: 117412 - RNA, 22 nt, Human herpesvirus 1
cgccggggcugcccggccguga

SEQ ID NO: 117413 - RNA, 22 nt, Human herpesvirus 1
cgcgcgccaauggggucgggaa

SEQ ID NO: 117414 - RNA, 22 nt, Human herpesvirus 1
cgcggccggggccucgaugugg

SEQ ID NO: 117415 - RNA, 23 nt, Human herpesvirus 1
cggccggccgccauggcguagcc

SEQ ID NO: 117416 - RNA, 23 nt, Human herpesvirus 1
cgguccauggcgucgcgggcguc

SEQ ID NO: 117417 - RNA, 22 nt, Human herpesvirus 1
cggugcagcggacuggcaccga

SEQ ID NO: 117418 - RNA, 22 nt, Human herpesvirus 1
cgucgagcguaccgacgggcgg

SEQ ID NO: 117419 - RNA, 18 nt, Human herpesvirus 1
cgugacgggcggggcguc

SEQ ID NO: 117420 - RNA, 22 nt, Human herpesvirus 1
cucauggccacggcggccgccg

SEQ ID NO: 117421 - RNA, 22 nt, Human herpesvirus 1
ucggugcucuccaaggggcugu

SEQ ID NO: 117422 - RNA, 22 nt, Human herpesvirus 1
ucucggcgggggccgucuggcc

SEQ ID NO: 117423 - RNA, 22 nt, Human herpesvirus 1
ucugucucgccaggggcuggcc

SEQ ID NO: 117424 - RNA, 22 nt, Human herpesvirus 1
ugacgacagcuuuguaaagacu

SEQ ID NO: 117425 - RNA, 22 nt, Human herpesvirus 1
ugcaggucguacguggcccccg

SEQ ID NO: 117426 - RNA, 22 nt, Human herpesvirus 1
ugcgcaggugcaugccccaggu

SEQ ID NO: 117427 - RNA, 18 nt, Human herpesvirus 1
ugcuugccugucaaacuc

SEQ ID NO: 117428 - RNA, 20 nt, Human herpesvirus 1
uggccgucaggagcucggcg

SEQ ID NO: 117429 - RNA, 22 nt, Human herpesvirus 1
uggccgucgagugccuggccgc

SEQ ID NO: 117430 - RNA, 22 nt, Human herpesvirus 1
uggguuccgggagcaggcgugg

SEQ ID NO: 117431 - RNA, 22 nt, Human herpesvirus 1
uguaggcgaugcgggucccccg

SEQ ID NO: 117432 - RNA, 20 nt, Human herpesvirus 1
ugugucgcagggcggcccgc

SEQ ID NO: 117433 - RNA, 21 nt, Human herpesvirus 1
uuuauaauagcggccacgccc

SEQ ID NO: 117434 - RNA, 22 nt, Human herpesvirus 1
ccguccgccuucuccgugacau

SEQ ID NO: 117435 - RNA, 22 nt, Human herpesvirus 1
ccuuggccgccccggcugcagg

SEQ ID NO: 117436 - RNA, 22 nt, Human herpesvirus 1
cgcccccucccuguuugucgcc

SEQ ID NO: 117437 - RNA, 20 nt, Human herpesvirus 1
cgcggggugguuccgucacg

SEQ ID NO: 117438 - RNA, 22 nt, Human herpesvirus 1
cggggugaaugagcugggcggc

SEQ ID NO: 117439 - RNA, 22 nt, Human herpesvirus 1
cgucccccgacgaccucuugca

SEQ ID NO: 117440 - RNA, 23 nt, Human herpesvirus 1
cgucgacucuaucgcgcgugccg

SEQ ID NO: 117441 - RNA, 22 nt, Human herpesvirus 1
cguggagucgaaggccagcgcc

SEQ ID NO: 117442 - RNA, 22 nt, Human herpesvirus 1
cucgcugcgaaccagcccgggu

SEQ ID NO: 117443 - RNA, 22 nt, Human herpesvirus 1
cuggcgucggcgcguguggguc

SEQ ID NO: 117444 - RNA, 22 nt, Human herpesvirus 1
cuugccgaauccagggagggua

SEQ ID NO: 117445 - RNA, 22 nt, Human herpesvirus 1
gaaaggggucugcaaccaaagg

SEQ ID NO: 117446 - RNA, 22 nt, Human herpesvirus 1
gagugccagcccugggaccgaa

SEQ ID NO: 117447 - RNA, 22 nt, Human herpesvirus 1
gaguuugacaggcaagcaugug

SEQ ID NO: 117448 - RNA, 22 nt, Human herpesvirus 1
gaugugcgucgcguuguaccug

SEQ ID NO: 117449 - RNA, 22 nt, Human herpesvirus 1
gcaccucgugguggacguauag

SEQ ID NO: 117450 - RNA, 22 nt, Human herpesvirus 1
gccagggucgcgcggcccgaaa

SEQ ID NO: 117451 - RNA, 22 nt, Human herpesvirus 1
gcgccacggccuccgcguucuc

SEQ ID NO: 117452 - RNA, 22 nt, Human herpesvirus 1
gcggggcccccgcuuccggaug

SEQ ID NO: 117453 - RNA, 19 nt, Human herpesvirus 1
gcucggcuugcgccugccc

SEQ ID NO: 117454 - RNA, 22 nt, Human herpesvirus 1
gcuggccgagggcuucgacggc

SEQ ID NO: 117455 - RNA, 16 nt, Human herpesvirus 1
gcuuggaggccggaug

SEQ ID NO: 117456 - RNA, 22 nt, Human herpesvirus 1
ggacggccuggacguugcgagc

SEQ ID NO: 117457 - RNA, 22 nt, Human herpesvirus 1
ggcccccguucgccgccugggu

SEQ ID NO: 117458 - RNA, 22 nt, Human herpesvirus 1
ggcccgguuggcggcgacgcuu

SEQ ID NO: 117459 - RNA, 22 nt, Human herpesvirus 1
ggcggacguggugccucagcgu

SEQ ID NO: 117460 - RNA, 22 nt, Human herpesvirus 1
gggcccggaacgggaggccaca

SEQ ID NO: 117461 - RNA, 22 nt, Human herpesvirus 1
gggcucgaggucgcucgguggg

SEQ ID NO: 117462 - RNA, 22 nt, Human herpesvirus 1
ggggggugcucugauagucucg

SEQ ID NO: 117463 - RNA, 22 nt, Human herpesvirus 1
ggucgaugcggcccgaggauug

SEQ ID NO: 117464 - RNA, 22 nt, Human herpesvirus 1
gguggucagcacgcggcccccu

SEQ ID NO: 117465 - RNA, 22 nt, Human herpesvirus 1
guauuggucccaauggggucuc

SEQ ID NO: 117466 - RNA, 22 nt, Human herpesvirus 1
gucaagaaucccaucgcccgug

SEQ ID NO: 117467 - RNA, 22 nt, Human herpesvirus 1
gucucguccguccggcaucuuc

SEQ ID NO: 117468 - RNA, 22 nt, Human herpesvirus 1
gugccgggcgcgugcgacggug

SEQ ID NO: 117469 - RNA, 22 nt, Human herpesvirus 1
gugugcacggaugagaucgcgc

SEQ ID NO: 117470 - RNA, 22 nt, Human herpesvirus 1
uacugggcguggugauggacga

SEQ ID NO: 117471 - RNA, 22 nt, Human herpesvirus 1
uagggcgaagugcgagcacugg

SEQ ID NO: 117472 - RNA, 22 nt, Human herpesvirus 1
uccgcggaagacccaggccgcc

SEQ ID NO: 117473 - RNA, 22 nt, Human herpesvirus 1
ucgggggugccgacgcaggcgu

SEQ ID NO: 117474 - RNA, 22 nt, Human herpesvirus 2
aaacugcacgccgccacggcgg

SEQ ID NO: 117475 - RNA, 22 nt, Human herpesvirus 2
aaaguccgggaggggccgcagg

SEQ ID NO: 117476 - RNA, 23 nt, Human herpesvirus 2
aacgcccugggguugccgugagg

SEQ ID NO: 117477 - RNA, 22 nt, Human herpesvirus 2
aaggccgugguguugcggagcg

SEQ ID NO: 117478 - RNA, 22 nt, Human herpesvirus 2
agauggagguucagaucguacg

SEQ ID NO: 117479 - RNA, 22 nt, Human herpesvirus 2
agguggucgagauggcgucgga

SEQ ID NO: 117480 - RNA, 22 nt, Human herpesvirus 2
augacgccccggaugacguggc

SEQ ID NO: 117481 - RNA, 22 nt, Human herpesvirus 2
cacgagcucgcggcaccccggc

SEQ ID NO: 117482 - RNA, 22 nt, Human herpesvirus 2
ccagcgugucggggccgaagcg

SEQ ID NO: 117483 - RNA, 16 nt, Human herpesvirus 2
ccaucuccgugauggc

SEQ ID NO: 117484 - RNA, 18 nt, Human herpesvirus 2
cccgcgaugcuaaugaga

SEQ ID NO: 117485 - RNA, 22 nt, Human herpesvirus 2
cccgcgccgggcgcuaaugaga

SEQ ID NO: 117486 - RNA, 17 nt, Human herpesvirus 2
cgaucccgugaccgacc

SEQ ID NO: 117487 - RNA, 22 nt, Human herpesvirus 2
cgcccuccgcuacacgacccug

SEQ ID NO: 117488 - RNA, 22 nt, Human herpesvirus 2
cgccgccuggcggaccgcaucu

SEQ ID NO: 117489 - RNA, 22 nt, Human herpesvirus 2
cgcgccuccgaaagaugguguu

SEQ ID NO: 117490 - RNA, 22 nt, Human herpesvirus 2
cgcuggugcccauguccccgcg

SEQ ID NO: 117491 - RNA, 23 nt, Human herpesvirus 2
cggcccauaggaucucgcggcuc

SEQ ID NO: 117492 - RNA, 22 nt, Human herpesvirus 2
cggugccacgucagcuggcagg

SEQ ID NO: 117493 - RNA, 22 nt, Human herpesvirus 2
cgugcuggagcgccuggugccg

SEQ ID NO: 117494 - RNA, 22 nt, Human herpesvirus 2
cuccgacgccaucucgaccacc

SEQ ID NO: 117495 - RNA, 22 nt, Human herpesvirus 2
cugcagcagcgcgaggagccgu

SEQ ID NO: 117496 - RNA, 22 nt, Human herpesvirus 2
gaagaccagccugucgccuaug

SEQ ID NO: 117497 - RNA, 22 nt, Human herpesvirus 2
gagcuggcggaggaucccgggu

SEQ ID NO: 117498 - RNA, 22 nt, Human herpesvirus 2
gaggauggaagggcagaagaug

SEQ ID NO: 117499 - RNA, 22 nt, Human herpesvirus 2
gccccggcgcgucguccgucac

SEQ ID NO: 117500 - RNA, 22 nt, Human herpesvirus 2
gcccgguucgaggccucgggcg

SEQ ID NO: 117501 - RNA, 22 nt, Human herpesvirus 2
gccuccagggcgugggcgcgcu

SEQ ID NO: 117502 - RNA, 22 nt, Human herpesvirus 2
gccugcuggccacguacgcaau

SEQ ID NO: 117503 - RNA, 22 nt, Human herpesvirus 2
gcgcagacggcagaugugcgcg

SEQ ID NO: 117504 - RNA, 20 nt, Human herpesvirus 2
gcgcgccaaccgcccaccag

SEQ ID NO: 117505 - RNA, 23 nt, Human herpesvirus 2
gcggcgggggauguguccauggc

SEQ ID NO: 117506 - RNA, 22 nt, Human herpesvirus 2
gcgguccccggcacgaggguga

SEQ ID NO: 117507 - RNA, 18 nt, Human herpesvirus 2
gcggucggggucgcuacu

SEQ ID NO: 117508 - RNA, 22 nt, Human herpesvirus 2
gcuggcagcgguggccguggau

SEQ ID NO: 117509 - RNA, 22 nt, Human herpesvirus 2
gcuguacgcguguuccacgugc

SEQ ID NO: 117510 - RNA, 22 nt, Human herpesvirus 2
ggacgccggcacccccgaagcc

SEQ ID NO: 117511 - RNA, 22 nt, Human herpesvirus 2
ggacgugcgaucggaucccgcg

SEQ ID NO: 117512 - RNA, 22 nt, Human herpesvirus 2
ggcgcccggggacguggcgcug

SEQ ID NO: 117513 - RNA, 22 nt, Human herpesvirus 2
ccgcgaauagcuacggccgcuu

SEQ ID NO: 117514 - RNA, 22 nt, Human herpesvirus 2
ccggaccuguucuucaagcgcc

SEQ ID NO: 117515 - RNA, 23 nt, Human herpesvirus 2
ccgggcgugcguggccgccaggc

SEQ ID NO: 117516 - RNA, 22 nt, Human herpesvirus 2
ccuacgagggcacaagccccgg

SEQ ID NO: 117517 - RNA, 22 nt, Human herpesvirus 2
cgacggugcgcugguuuucggg

SEQ ID NO: 117518 - RNA, 22 nt, Human herpesvirus 2
cgagguuccgcccgaccgcacc

SEQ ID NO: 117519 - RNA, 22 nt, Human herpesvirus 2
cgcaucucgagggccccgggac

SEQ ID NO: 117520 - RNA, 22 nt, Human herpesvirus 2
cgcccgaacggcggggucgaug

SEQ ID NO: 117521 - RNA, 22 nt, Human herpesvirus 2
cgcccggaggacggccguggcg

SEQ ID NO: 117522 - RNA, 22 nt, Human herpesvirus 2
cgcccgugugggcgcccgagcu

SEQ ID NO: 117523 - RNA, 22 nt, Human herpesvirus 2
cgccgcugccgggcgaggaccu

SEQ ID NO: 117524 - RNA, 22 nt, Human herpesvirus 2
cggccaucugcaucgugggccc

SEQ ID NO: 117525 - RNA, 22 nt, Human herpesvirus 2
cgggggcugcagucggcgcuga

SEQ ID NO: 117526 - RNA, 22 nt, Human herpesvirus 2
cugucugauccacagcaccccg

SEQ ID NO: 117527 - RNA, 22 nt, Human herpesvirus 2
gcagaccgucacgcgaauggug

SEQ ID NO: 117528 - RNA, 22 nt, Human herpesvirus 2
gcccagcaacggcuccucgcgc

SEQ ID NO: 117529 - RNA, 22 nt, Human herpesvirus 2
gcccgccacccgcgacgagcug

SEQ ID NO: 117530 - RNA, 22 nt, Human herpesvirus 2
gcccggggcguuccgcucaaca

SEQ ID NO: 117531 - RNA, 22 nt, Human herpesvirus 2
gcggaccuggugcccggacguc

SEQ ID NO: 117532 - RNA, 18 nt, Human herpesvirus 2
gcucaugggcgacgagga

SEQ ID NO: 117533 - RNA, 22 nt, Human herpesvirus 2
gcucgguggccgcgcgguacgu

SEQ ID NO: 117534 - RNA, 22 nt, Human herpesvirus 2
ggaaccaagcggaggcaccccg

SEQ ID NO: 117535 - RNA, 22 nt, Human herpesvirus 2
ggcccggaggaggcgcucguca

SEQ ID NO: 117536 - RNA, 20 nt, Human herpesvirus 2
ggccggacaugguguccgug

SEQ ID NO: 117537 - RNA, 19 nt, Human herpesvirus 2
ggccuccgccucgacccgc

SEQ ID NO: 117538 - RNA, 19 nt, Human herpesvirus 2
ggcggggagccgacgaucc

SEQ ID NO: 117539 - RNA, 22 nt, Human herpesvirus 2
gggcggcgccuuggaaccaucg

SEQ ID NO: 117540 - RNA, 22 nt, Human herpesvirus 2
ggggccaacgugcgguaccgcg

SEQ ID NO: 117541 - RNA, 22 nt, Human herpesvirus 2
gggggaguuugagacggccgag

SEQ ID NO: 117542 - RNA, 22 nt, Human herpesvirus 2
ggguccuccgccgccgcgggcc

SEQ ID NO: 117543 - RNA, 22 nt, Human herpesvirus 2
gguccggcauccagagggcgcu

SEQ ID NO: 117544 - RNA, 22 nt, Human herpesvirus 2
ggucgcgcaugacccaggcuca

SEQ ID NO: 117545 - RNA, 22 nt, Human herpesvirus 2
gucuggcaugacacccagcucu

SEQ ID NO: 117546 - RNA, 18 nt, Human herpesvirus 2
guggaagacggugacggu

SEQ ID NO: 117547 - RNA, 22 nt, Human herpesvirus 2
uaggguagacucgagacggcgg

SEQ ID NO: 117548 - RNA, 22 nt, Human herpesvirus 2
ucacgcccggcggacagccucu

SEQ ID NO: 117549 - RNA, 20 nt, Human herpesvirus 2
ucagggagcuguggugggug

SEQ ID NO: 117550 - RNA, 22 nt, Human herpesvirus 2
ucggcgcggagcaucucgucca

SEQ ID NO: 117551 - RNA, 22 nt, Human herpesvirus 2
ucgucggcggccccgcggaggu

SEQ ID NO: 117552 - RNA, 22 nt, Human herpesvirus 2
ugccgagugaacucucccgccc

SEQ ID NO: 117553 - RNA, 22 nt, Human herpesvirus 2
ugcgcgaggccuuagacgcccu

SEQ ID NO: 117554 - RNA, 22 nt, Human herpesvirus 2
uggccagcugccggggcagcgu

SEQ ID NO: 117555 - RNA, 22 nt, Human herpesvirus 2
uggcggcguagaugcgucucuc

SEQ ID NO: 117556 - RNA, 22 nt, Human herpesvirus 2
ugggaaaucuauugaacucucc

SEQ ID NO: 117557 - RNA, 22 nt, Human herpesvirus 2
ugggagucugcgguugggagcg

SEQ ID NO: 117558 - RNA, 22 nt, Human herpesvirus 2
ugggcgucgacgaggcgucggc

SEQ ID NO: 117559 - RNA, 22 nt, Human herpesvirus 2
uuacaacaacaacgcccauguc

SEQ ID NO: 117560 - RNA, 23 nt, Human herpesvirus 2
uucaccgcgacuccaccuccgag

SEQ ID NO: 117561 - RNA, 22 nt, Human herpesvirus 2
uucaggagcccaaagucguccu

SEQ ID NO: 117562 - RNA, 22 nt, Human herpesvirus 2
uuggguuccgcggacgccgggc

SEQ ID NO: 117563 - RNA, 22 nt, Human herpesvirus 2
accgagcucguguucguggggg

SEQ ID NO: 117564 - RNA, 22 nt, Human herpesvirus 2
acggaggcgaguugcuggacgu

SEQ ID NO: 117565 - RNA, 22 nt, Human herpesvirus 2
agaggcuguccgccgggcguga

SEQ ID NO: 117566 - RNA, 22 nt, Human herpesvirus 2
agcgccccgugugugaccgagg

SEQ ID NO: 117567 - RNA, 20 nt, Human herpesvirus 2
agcgcgugaggccgggcgcc

SEQ ID NO: 117568 - RNA, 20 nt, Human herpesvirus 2
cagcuacaccgggagggcgu

SEQ ID NO: 117569 - RNA, 22 nt, Human herpesvirus 2
cagggcguggaggcagucgcgc

SEQ ID NO: 117570 - RNA, 22 nt, Human herpesvirus 2
cccgccccguacguugugcacg

SEQ ID NO: 117571 - RNA, 22 nt, Human herpesvirus 2
cccgcggcgucgcgacagacca

SEQ ID NO: 117572 - RNA, 22 nt, Human herpesvirus 2
cccugggcucucggggaacccg

SEQ ID NO: 117573 - RNA, 18 nt, Human herpesvirus 2
acaccucgaucaccgucc

SEQ ID NO: 117574 - RNA, 22 nt, Human herpesvirus 2
acgcgggugcuggugucucggg

SEQ ID NO: 117575 - RNA, 22 nt, Human herpesvirus 2
agaccugguuuuuggugccccu

SEQ ID NO: 117576 - RNA, 22 nt, Human herpesvirus 2
agcgcgccuccggagcgagcuc

SEQ ID NO: 117577 - RNA, 19 nt, Human herpesvirus 2
agcugggccuggagcccgg

SEQ ID NO: 117578 - RNA, 22 nt, Human herpesvirus 2
aggcgcaugacguguuucaggc

SEQ ID NO: 117579 - RNA, 22 nt, Human herpesvirus 2
agggucucauuagcaucgcggg

SEQ ID NO: 117580 - RNA, 22 nt, Human herpesvirus 2
agugguuaaaucgaccgugaug

SEQ ID NO: 117581 - RNA, 22 nt, Human herpesvirus 2
aguuccugcugcagggacguca

SEQ ID NO: 117582 - RNA, 22 nt, Human herpesvirus 2
auuagggcaaagugcgagcgcu

SEQ ID NO: 117583 - RNA, 22 nt, Human herpesvirus 2
auuguccacguaggugcugaag

SEQ ID NO: 117584 - RNA, 22 nt, Human herpesvirus 2
caccaacucguucgcgcgcugc

SEQ ID NO: 117585 - RNA, 22 nt, Human herpesvirus 2
cacggacggcgaccugcggcgc

SEQ ID NO: 117586 - RNA, 22 nt, Human herpesvirus 2
cacggccgacguccccagcgug

SEQ ID NO: 117587 - RNA, 22 nt, Human herpesvirus 2
cacgggcguccccggugucucc

SEQ ID NO: 117588 - RNA, 22 nt, Human herpesvirus 2
cagcucgcgcagcagcugcucg

SEQ ID NO: 117589 - RNA, 22 nt, Human herpesvirus 2
caguuuuuccgcggugagcugc

SEQ ID NO: 117590 - RNA, 22 nt, Human herpesvirus 2
caugguggaccgcgggcucggc

SEQ ID NO: 117591 - RNA, 22 nt, Human herpesvirus 2
cccccucguacuuccugaucgc

SEQ ID NO: 117592 - RNA, 22 nt, Human herpesvirus 2
cccggcgcgccggacuucugcg

SEQ ID NO: 117593 - RNA, 22 nt, Human herpesvirus 2
ccgacgccgguggucccggcga

SEQ ID NO: 117594 - RNA, 22 nt, Human herpesvirus 2
ccucggagguggagucgcggug

SEQ ID NO: 117595 - RNA, 22 nt, Human herpesvirus 2
cgcgcacguccuccgggucggg

SEQ ID NO: 117596 - RNA, 22 nt, Human herpesvirus 2
cgcucgcuaugggguucgucug

SEQ ID NO: 117597 - RNA, 22 nt, Human herpesvirus 2
cgcuguucgaggccacgcgcgu

SEQ ID NO: 117598 - RNA, 22 nt, Human herpesvirus 2
cggggccgccgguagcaccccg

SEQ ID NO: 117599 - RNA, 22 nt, Human herpesvirus 2
cggugccgucuggguggcuccc

SEQ ID NO: 117600 - RNA, 22 nt, Human herpesvirus 2
cgugggugugcuagaucgaacg

SEQ ID NO: 117601 - RNA, 22 nt, Human herpesvirus 2
cucggggcuccgccagggcgcc

SEQ ID NO: 117602 - RNA, 22 nt, Human herpesvirus 2
cugcgcggcggagaccgggacg

SEQ ID NO: 117603 - RNA, 18 nt, Human herpesvirus 2
cuggaaggcacaucucga

SEQ ID NO: 117604 - RNA, 22 nt, Human herpesvirus 2
gauguuggcaaucucgagacca

SEQ ID NO: 117605 - RNA, 22 nt, Human herpesvirus 2
gcaccccaccgaaaaacggagc

SEQ ID NO: 117606 - RNA, 22 nt, Human herpesvirus 2
gcagggcguuucguuggucuag

SEQ ID NO: 117607 - RNA, 22 nt, Human herpesvirus 2
gcauggccggcaacgaccgcgu

SEQ ID NO: 117608 - RNA, 22 nt, Human herpesvirus 2
gcccgcccucaccgucggccag

SEQ ID NO: 117609 - RNA, 22 nt, Human herpesvirus 2
gccgucagcgggggagcccugg

SEQ ID NO: 117610 - RNA, 22 nt, Human herpesvirus 2
gccugcgugggugccaucgcuc

SEQ ID NO: 117611 - RNA, 22 nt, Human herpesvirus 2
gccuucccgguguuggucgacg

SEQ ID NO: 117612 - RNA, 22 nt, Human herpesvirus 2
gcgcucucgaccgcgguucccg

SEQ ID NO: 117613 - RNA, 22 nt, Human herpesvirus 2
gcggccgcgacaugucccacag

SEQ ID NO: 117614 - RNA, 20 nt, Human herpesvirus 2
gcggcuccccuagcugcagc

SEQ ID NO: 117615 - RNA, 22 nt, Human herpesvirus 2
ggacgggugaguucgcuaggca

SEQ ID NO: 117616 - RNA, 22 nt, Human herpesvirus 2
ggaggcccaagaugccggcggu

SEQ ID NO: 117617 - RNA, 22 nt, Human herpesvirus 2
ggcuccaggccgccacgcuggg

SEQ ID NO: 117618 - RNA, 22 nt, Human herpesvirus 2
gggcguggccgcccuucuaaaa

SEQ ID NO: 117619 - RNA, 17 nt, Human herpesvirus 2
ggggaucaagauaggcu

SEQ ID NO: 117620 - RNA, 22 nt, Human herpesvirus 2
ggggcgcgucccuucagccacu

SEQ ID NO: 117621 - RNA, 22 nt, Human herpesvirus 2
ggggggcaagugcaguaaccca

SEQ ID NO: 117622 - RNA, 22 nt, Human herpesvirus 2
ggucacccuggaguugcuccug

SEQ ID NO: 117623 - RNA, 22 nt, Human herpesvirus 2
ggucgcgccugcccggcccaga

SEQ ID NO: 117624 - RNA, 22 nt, Human herpesvirus 2
guccacggccgugccggcccgc

SEQ ID NO: 117625 - RNA, 22 nt, Human herpesvirus 2
guccaggauaaaccggguggug

SEQ ID NO: 117626 - RNA, 22 nt, Human herpesvirus 2
guccucgcccggcagcggcgag

SEQ ID NO: 117627 - RNA, 22 nt, Human herpesvirus 2
gucugggggccuuucucugugu

SEQ ID NO: 117628 - RNA, 22 nt, Human herpesvirus 2
gugcggcggcgaccgggacgcc

SEQ ID NO: 117629 - RNA, 22 nt, Human herpesvirus 2
ucaaagggggcguggccgcccu

SEQ ID NO: 117630 - RNA, 22 nt, Human herpesvirus 2
uccgaaggucugcgcgaggccg

SEQ ID NO: 117631 - RNA, 22 nt, Human herpesvirus 2
ucguacccgggcaccacguggc

SEQ ID NO: 117632 - RNA, 22 nt, Human herpesvirus 2
ucugagccugggucaugcgcga

SEQ ID NO: 117633 - RNA, 21 nt, Human herpesvirus 2
uggcgaccgucaaguccccga

SEQ ID NO: 117634 - RNA, 20 nt, Human herpesvirus 2
aacgcccugggguugccgug

SEQ ID NO: 117635 - RNA, 17 nt, Human herpesvirus 2
acgcggugucggcggug

SEQ ID NO: 117636 - RNA, 22 nt, Human herpesvirus 2
agaguggcuccuggagcgcucg

SEQ ID NO: 117637 - RNA, 22 nt, Human herpesvirus 2
agcgcucgcacuuugcccuaau

SEQ ID NO: 117638 - RNA, 22 nt, Human herpesvirus 2
aggcgacaggcuggucuuccug

SEQ ID NO: 117639 - RNA, 22 nt, Human herpesvirus 2
aggugcggcuggacgccaacga

SEQ ID NO: 117640 - RNA, 22 nt, Human herpesvirus 2
aucgucggcuccccgccgcgcu

SEQ ID NO: 117641 - RNA, 22 nt, Human herpesvirus 2
caccgguccuucgcgggggccg

SEQ ID NO: 117642 - RNA, 22 nt, Human herpesvirus 2
caccucggucuccuccuccgag

SEQ ID NO: 117643 - RNA, 22 nt, Human herpesvirus 2
cacgaagccccggcggguuugu

SEQ ID NO: 117644 - RNA, 22 nt, Human herpesvirus 2
caucuucugcccuuccauccuc

SEQ ID NO: 117645 - RNA, 22 nt, Human herpesvirus 2
ccagggcgccaugcgcccgcac

SEQ ID NO: 117646 - RNA, 22 nt, Human herpesvirus 2
cccgggauccuccgccagcucg

SEQ ID NO: 117647 - RNA, 22 nt, Human herpesvirus 2
ccgaccgcgggcugacgcggcu

SEQ ID NO: 117648 - RNA, 22 nt, Human herpesvirus 2
cgaagagcucccguaggauaag

SEQ ID NO: 117649 - RNA, 22 nt, Human herpesvirus 2
cgaccgucaagagccugggccc

SEQ ID NO: 117650 - RNA, 22 nt, Human herpesvirus 2
cgacgcacccggagccgcuucu

SEQ ID NO: 117651 - RNA, 22 nt, Human herpesvirus 2
cgcgccggguccguuguaucuu

SEQ ID NO: 117652 - RNA, 22 nt, Human herpesvirus 2
cgcgucguggacaucauggcgc

SEQ ID NO: 117653 - RNA, 22 nt, Human herpesvirus 2
cguggucucgggagcagggcgc

SEQ ID NO: 117654 - RNA, 22 nt, Human herpesvirus 2
cucgccgucgagguggcggauc

SEQ ID NO: 117655 - RNA, 22 nt, Human herpesvirus 2
cugcccgcgaagaaacucucgc

SEQ ID NO: 117656 - RNA, 22 nt, Human herpesvirus 2
cugcugcagcuaggggagccgc

SEQ ID NO: 117657 - RNA, 22 nt, Human herpesvirus 2
cuggagagacgcaucuacgccg

SEQ ID NO: 117658 - RNA, 22 nt, Human herpesvirus 2
gaaagggguccguaaccaaagg

SEQ ID NO: 117659 - RNA, 22 nt, Human herpesvirus 2
gaagcugcugcggucgcgcccc

SEQ ID NO: 117660 - RNA, 17 nt, Human herpesvirus 2
gacgccgccauggccgc

SEQ ID NO: 117661 - RNA, 22 nt, Human herpesvirus 2
gagaggccguggagcuugccag

SEQ ID NO: 117662 - RNA, 22 nt, Human herpesvirus 2
gauggucgugcugggccucagc

SEQ ID NO: 117663 - RNA, 23 nt, Human herpesvirus 2
gccacgugcgugccgggcacgag

SEQ ID NO: 117664 - RNA, 22 nt, Human herpesvirus 2
gcccguuaaaagcugcuaauua

SEQ ID NO: 117665 - RNA, 22 nt, Human herpesvirus 2
gcgcgccaaugggcucgggaaa

SEQ ID NO: 117666 - RNA, 17 nt, Human herpesvirus 2
gcggaugcggguagcug

SEQ ID NO: 117667 - RNA, 22 nt, Human herpesvirus 2
gcgggcgagggcgucuaaggcc

SEQ ID NO: 117668 - RNA, 22 nt, Human herpesvirus 2
gcggggcuuggagcgaccgagg

SEQ ID NO: 117669 - RNA, 22 nt, Human herpesvirus 2
gcggguccgggggucguucacu

SEQ ID NO: 117670 - RNA, 22 nt, Human herpesvirus 2
ggccgucgaacagaucgggccg

SEQ ID NO: 117671 - RNA, 22 nt, Human herpesvirus 2
ggggcgcugccgaagguucgug

SEQ ID NO: 117672 - RNA, 22 nt, Human herpesvirus 2
guccccgcccaggcuguggagg

SEQ ID NO: 117673 - RNA, 22 nt, Human herpesvirus 2
guccuuguuuucggucugguac

SEQ ID NO: 117674 - RNA, 22 nt, Human herpesvirus 2
gucgaggcuucgggggugccgg

SEQ ID NO: 117675 - RNA, 22 nt, Human herpesvirus 2
gucggcgcggggguggccaaac

SEQ ID NO: 117676 - RNA, 22 nt, Human herpesvirus 2
gugggccgugaugcgcgggcgg

SEQ ID NO: 117677 - RNA, 20 nt, Human herpesvirus 2
uacggccauggaccugguuc

SEQ ID NO: 117678 - RNA, 22 nt, Human herpesvirus 2
ucacgcgggugcuggugucucg

SEQ ID NO: 117679 - RNA, 22 nt, Human herpesvirus 2
ucgaccccgccguucgggcggu

SEQ ID NO: 117680 - RNA, 22 nt, Human herpesvirus 2
ucgaugguggacgaggccguuc

SEQ ID NO: 117681 - RNA, 22 nt, Human herpesvirus 2
ucgggaaggccucgucggaccc

SEQ ID NO: 117682 - RNA, 22 nt, Human herpesvirus 2
ucugaauuucccgcagaaccuc

SEQ ID NO: 117683 - RNA, 22 nt, Human herpesvirus 2
ugugugcaccgcgaagaaucca

SEQ ID NO: 117684 - RNA, 23 nt, Human herpesvirus 2
uugcuggcggcggccguguacgc

SEQ ID NO: 117685 - RNA, 22 nt, Human herpesvirus 2
gggccagcacguggccgugcug

SEQ ID NO: 117686 - RNA, 22 nt, Human herpesvirus 2
gggcgcaugugucugccgagcg

SEQ ID NO: 117687 - RNA, 22 nt, Human herpesvirus 2
gggucgacucggucucgcagcg

SEQ ID NO: 117688 - RNA, 22 nt, Human herpesvirus 2
gucccggucgccgccgcaccag

SEQ ID NO: 117689 - RNA, 22 nt, Human herpesvirus 2
guggcgucggugguucuggucg

SEQ ID NO: 117690 - RNA, 22 nt, Human herpesvirus 2
ucaccaccauucgcgugacggu

SEQ ID NO: 117691 - RNA, 20 nt, Human herpesvirus 2
ucaccggcacgucggccucg

SEQ ID NO: 117692 - RNA, 22 nt, Human herpesvirus 2
ucucgucgccgauuaccgcggc

SEQ ID NO: 117693 - RNA, 22 nt, Human herpesvirus 2
ugcccgacccggaggacgugcg

SEQ ID NO: 117694 - RNA, 22 nt, Human herpesvirus 2
ugcgggccggcacggccgugga

SEQ ID NO: 117695 - RNA, 22 nt, Human herpesvirus 2
uggccccgaacacaaccggcuc

SEQ ID NO: 117696 - RNA, 22 nt, Human herpesvirus 2
ugggccgggcaggcgcgaccga

SEQ ID NO: 117697 - RNA, 22 nt, Human herpesvirus 2
uucaccgcgacuccaccuccga

SEQ ID NO: 117698 - RNA, 22 nt, Human herpesvirus 2
uugacgagcuucgcgguacuac

SEQ ID NO: 117699 - RNA, 22 nt, Human herpesvirus 2
uuugggucgggcucagggccag

SEQ ID NO: 117700 - RNA, 21 nt, Human herpesvirus 3
aaaagcagaugaugugccgau

SEQ ID NO: 117701 - RNA, 22 nt, Human herpesvirus 3
aaacguuaccgcaaaucaaucu

SEQ ID NO: 117702 - RNA, 22 nt, Human herpesvirus 3
acgaaacguguuuuuagcuaag

SEQ ID NO: 117703 - RNA, 22 nt, Human herpesvirus 3
aucgggguucuggaucgcggca

SEQ ID NO: 117704 - RNA, 22 nt, Human herpesvirus 3
cagcagaugaugcuggaguccg

SEQ ID NO: 117705 - RNA, 22 nt, Human herpesvirus 3
cauauacuguguuuuuauccau

SEQ ID NO: 117706 - RNA, 22 nt, Human herpesvirus 3
ccgguacuccgggucgagggug

SEQ ID NO: 117707 - RNA, 22 nt, Human herpesvirus 3
cgccugugaaauaacggucgcg

SEQ ID NO: 117708 - RNA, 22 nt, Human herpesvirus 3
gaaccgggcgcgguaguaacag

SEQ ID NO: 117709 - RNA, 22 nt, Human herpesvirus 3
gccguguuacugguaauggcgg

SEQ ID NO: 117710 - RNA, 22 nt, Human herpesvirus 3
guguuguuguuuccaaacggaa

SEQ ID NO: 117711 - RNA, 19 nt, Human herpesvirus 3
guguuuacgugcgauggua

SEQ ID NO: 117712 - RNA, 22 nt, Human herpesvirus 3
uauugcagacauuuguuucgau

SEQ ID NO: 117713 - RNA, 22 nt, Human herpesvirus 3
ucaggcgggcguaggcuagcga

SEQ ID NO: 117714 - RNA, 22 nt, Human herpesvirus 3
uccgaaccguuccaugcgucuu

SEQ ID NO: 117715 - RNA, 22 nt, Human herpesvirus 3
ucguggggggcgguaugaucaa

SEQ ID NO: 117716 - RNA, 22 nt, Human herpesvirus 3
ugcuucuugaaaaaggccacac

SEQ ID NO: 117717 - RNA, 19 nt, Human herpesvirus 3
ugggaauaauugugcaaac

SEQ ID NO: 117718 - RNA, 22 nt, Human herpesvirus 3
uucuaggauucgaacgacgaca

SEQ ID NO: 117719 - RNA, 15 nt, Human herpesvirus 3
agagcccacacaauc

SEQ ID NO: 117720 - RNA, 22 nt, Human herpesvirus 3
ccaaguccccguucauauugca

SEQ ID NO: 117721 - RNA, 21 nt, Human herpesvirus 3
agacgcauggaacgguucgga

SEQ ID NO: 117722 - RNA, 20 nt, Human herpesvirus 3
aguugcauguuaacgucgac

SEQ ID NO: 117723 - RNA, 22 nt, Human herpesvirus 3
cguguauaucuguccauggagu

SEQ ID NO: 117724 - RNA, 18 nt, Human herpesvirus 3
cuuauauuuuuggaagau

SEQ ID NO: 117725 - RNA, 22 nt, Human herpesvirus 3
gaguguuuuuucuagcucuugg

SEQ ID NO: 117726 - RNA, 22 nt, Human herpesvirus 3
gccaagauuugcgguaaugcga

SEQ ID NO: 117727 - RNA, 22 nt, Human herpesvirus 3
ggagccacacaauauucgcgaa

SEQ ID NO: 117728 - RNA, 22 nt, Human herpesvirus 3
uacgauucagacguuuuuucuc

SEQ ID NO: 117729 - RNA, 22 nt, Human herpesvirus 3
uccccggacgguccaaaccgca

SEQ ID NO: 117730 - RNA, 22 nt, Human herpesvirus 3
uguauguuggagauagagcgua

SEQ ID NO: 117731 - RNA, 22 nt, Human herpesvirus 3
uuagaccguuuguuaaccggag

SEQ ID NO: 117732 - RNA, 22 nt, Human herpesvirus 3
uugaagacagggauacggaggg

SEQ ID NO: 117733 - RNA, 22 nt, Human herpesvirus 3
uuugcuuggguuucuauguccg

SEQ ID NO: 117734 - RNA, 22 nt, Human herpesvirus 3
aagcguuuaauuguuaugccgu

SEQ ID NO: 117735 - RNA, 22 nt, Human herpesvirus 3
acucccauuggcaugauaaacg

SEQ ID NO: 117736 - RNA, 22 nt, Human herpesvirus 3
acucuuguagugugagcaaugc

SEQ ID NO: 117737 - RNA, 22 nt, Human herpesvirus 3
agaauacguuuaaugucgucuu

SEQ ID NO: 117738 - RNA, 22 nt, Human herpesvirus 3
cggcuauuggguaucacuguca

SEQ ID NO: 117739 - RNA, 22 nt, Human herpesvirus 3
cuaauuuaauagggcuaugucc

SEQ ID NO: 117740 - RNA, 22 nt, Human herpesvirus 3
cugaccacgagucuccgauucu

SEQ ID NO: 117741 - RNA, 22 nt, Human herpesvirus 3
gcaucauguuuccuugggcggg

SEQ ID NO: 117742 - RNA, 22 nt, Human herpesvirus 3
gcauguugcucgaagagcacau

SEQ ID NO: 117743 - RNA, 22 nt, Human herpesvirus 3
ggauacuuggcucuguauuaaa

SEQ ID NO: 117744 - RNA, 22 nt, Human herpesvirus 3
ucggcgcgcugcugaugugguu

SEQ ID NO: 117745 - RNA, 22 nt, Human herpesvirus 3
ucguaauucgaaugcagguggu

SEQ ID NO: 117746 - RNA, 22 nt, Human herpesvirus 3
uggaacaauuccaucagagucu

SEQ ID NO: 117747 - RNA, 22 nt, Human herpesvirus 3
ugggaggggugccgauccgggc

SEQ ID NO: 117748 - RNA, 22 nt, Human herpesvirus 3
uggguuaacgcucuuaacacgg

SEQ ID NO: 117749 - RNA, 22 nt, Human herpesvirus 3
ugucucuggcgccccgguuccc

SEQ ID NO: 117750 - RNA, 18 nt, Human herpesvirus 3
uuggacuuccguucucgg

SEQ ID NO: 117751 - RNA, 22 nt, Human herpesvirus 3
uuuggagacggcgguaaaggcu

SEQ ID NO: 117752 - RNA, 22 nt, Human herpesvirus 3
ccgaggcugguuagagagcgcu

SEQ ID NO: 117753 - RNA, 22 nt, Human herpesvirus 3
cgcguauguaaaucggugaaga

SEQ ID NO: 117754 - RNA, 22 nt, Human herpesvirus 3
cuguuuucccuuggcucuugug

SEQ ID NO: 117755 - RNA, 22 nt, Human herpesvirus 3
gauuuucuuccacugacaccuc

SEQ ID NO: 117756 - RNA, 22 nt, Human herpesvirus 3
gcugggcuaaauguggcgaggu

SEQ ID NO: 117757 - RNA, 22 nt, Human herpesvirus 3
ggauccacgcgggugcacgucu

SEQ ID NO: 117758 - RNA, 22 nt, Human herpesvirus 3
gggguuuuggauuaagaucucc

SEQ ID NO: 117759 - RNA, 22 nt, Human herpesvirus 3
gguugugucggucucuccaagc

SEQ ID NO: 117760 - RNA, 22 nt, Human herpesvirus 3
guccagccguguuacugguaau

SEQ ID NO: 117761 - RNA, 22 nt, Human herpesvirus 3
gucugacgugguaagugcggcu

SEQ ID NO: 117762 - RNA, 22 nt, Human herpesvirus 3
uacaccuucucguuggcgucgc

SEQ ID NO: 117763 - RNA, 22 nt, Human herpesvirus 3
uguauugauaccacggcggcua

SEQ ID NO: 117764 - RNA, 22 nt, Human herpesvirus 3
uuuaucaugccaaugggagugu

SEQ ID NO: 117765 - RNA, 22 nt, Human herpesvirus 4 [Epstein-Barr virus]
agcaccaucagcccggggggac

SEQ ID NO: 117766 - RNA, 17 nt, Human herpesvirus 4 [Epstein-Barr virus]
agcccugcucacgaaug

SEQ ID NO: 117767 - RNA, 22 nt, Human herpesvirus 4 [Epstein-Barr virus]
aggcucucccaacacaauagaa

SEQ ID NO: 117768 - RNA, 22 nt, Human herpesvirus 4 [Epstein-Barr virus]
aguucauccugggcuuuguggc

SEQ ID NO: 117769 - RNA, 22 nt, Human herpesvirus 4 [Epstein-Barr virus]
cagcagcaggcgcagcgacugg

SEQ ID NO: 117770 - RNA, 22 nt, Human herpesvirus 4 [Epstein-Barr virus]
ccagcuccugaacacggccccu

SEQ ID NO: 117771 - RNA, 22 nt, Human herpesvirus 4 [Epstein-Barr virus]
cggccacacggccggagcuccg

SEQ ID NO: 117772 - RNA, 22 nt, Human herpesvirus 4 [Epstein-Barr virus]
gaccacguccccccagacgcgc

SEQ ID NO: 117773 - RNA, 23 nt, Human herpesvirus 4 [Epstein-Barr virus]
gccugcacguccugccacgcccu

SEQ ID NO: 117774 - RNA, 22 nt, Human herpesvirus 4 [Epstein-Barr virus]
uaggcauagagagugaugagcc

SEQ ID NO: 117775 - RNA, 22 nt, Human herpesvirus 4 [Epstein-Barr virus]
ucugggguccaggagucugcug

SEQ ID NO: 117776 - RNA, 22 nt, Human herpesvirus 4 [Epstein-Barr virus]
uggcaaagugcugagagcaagg

SEQ ID NO: 117777 - RNA, 22 nt, Human herpesvirus 4 [Epstein-Barr virus]
aacuguguggcucucugcacca

SEQ ID NO: 117778 - RNA, 22 nt, Human herpesvirus 4 [Epstein-Barr virus]
agcucgaguacgacugugaggu

SEQ ID NO: 117779 - RNA, 22 nt, Human herpesvirus 4 [Epstein-Barr virus]
cagauagugaacguggagguug

SEQ ID NO: 117780 - RNA, 22 nt, Human herpesvirus 4 [Epstein-Barr virus]
cagcguccugaggcugcugcuu

SEQ ID NO: 117781 - RNA, 22 nt, Human herpesvirus 4 [Epstein-Barr virus]
cuguacauccagcugcuguaug

SEQ ID NO: 117782 - RNA, 22 nt, Human herpesvirus 4 [Epstein-Barr virus]
gaggcccacgguggcggcagac

SEQ ID NO: 117783 - RNA, 22 nt, Human herpesvirus 4 [Epstein-Barr virus]
gaggucucugaugagcuggaag

SEQ ID NO: 117784 - RNA, 22 nt, Human herpesvirus 4 [Epstein-Barr virus]
gcuccacgcaaagucagauugc

SEQ ID NO: 117785 - RNA, 22 nt, Human herpesvirus 4 [Epstein-Barr virus]
uaugaggacauuuucccaaucu

SEQ ID NO: 117786 - RNA, 22 nt, Human herpesvirus 4 [Epstein-Barr virus]
ugcgccugcugcugggaaccug

SEQ ID NO: 117787 - RNA, 22 nt, Human herpesvirus 4 [Epstein-Barr virus]
uggagggcaucuuccgggagua

SEQ ID NO: 117788 - RNA, 17 nt, Human herpesvirus 4 [Epstein-Barr virus]
uuauggcuagauuuccu

SEQ ID NO: 117789 - RNA, 22 nt, Human herpesvirus 4 [Epstein-Barr virus]
uuguggaccucucagaguuuca

SEQ ID NO: 117790 - RNA, 23 nt, Human herpesvirus 4 [Epstein-Barr virus]
aucagcaaauccaguuguauuca

SEQ ID NO: 117791 - RNA, 22 nt, Human herpesvirus 4 [Epstein-Barr virus]
caggaggccccgcggcaggagg

SEQ ID NO: 117792 - RNA, 18 nt, Human herpesvirus 4 [Epstein-Barr virus]
ccagcguguuucuuaucc

SEQ ID NO: 117793 - RNA, 22 nt, Human herpesvirus 4 [Epstein-Barr virus]
ccauguguguccagugccuaau

SEQ ID NO: 117794 - RNA, 22 nt, Human herpesvirus 4 [Epstein-Barr virus]
ccgggccguggaaugagggccu

SEQ ID NO: 117795 - RNA, 22 nt, Human herpesvirus 4 [Epstein-Barr virus]
cucacgccgcacgguccggcac

SEQ ID NO: 117796 - RNA, 22 nt, Human herpesvirus 4 [Epstein-Barr virus]
gagcuccaaagccaggcucgag

SEQ ID NO: 117797 - RNA, 22 nt, Human herpesvirus 4 [Epstein-Barr virus]
gagggggaucgcccgggucucu

SEQ ID NO: 117798 - RNA, 23 nt, Human herpesvirus 4 [Epstein-Barr virus]
gccacuagcacaggugagaagcg

SEQ ID NO: 117799 - RNA, 17 nt, Human herpesvirus 4 [Epstein-Barr virus]
ggccacaggggaggugg

SEQ ID NO: 117800 - RNA, 22 nt, Human herpesvirus 4 [Epstein-Barr virus]
gucaggagacacggcucuguca

SEQ ID NO: 117801 - RNA, 22 nt, Human herpesvirus 4 [Epstein-Barr virus]
uauuugcggcugggcuaaugau

SEQ ID NO: 117802 - RNA, 22 nt, Human herpesvirus 4 [Epstein-Barr virus]
uggagcuccuuggugcaggaga

SEQ ID NO: 117803 - RNA, 22 nt, Human herpesvirus 4 [Epstein-Barr virus]
gccacguggccacgugacacac

SEQ ID NO: 117804 - RNA, 22 nt, Human herpesvirus 4 [Epstein-Barr virus]
ucauggucuuuuuacaaacuca

SEQ ID NO: 117805 - RNA, 22 nt, Human herpesvirus 4 [Epstein-Barr virus]
ucggugggaggcauaggcccca

SEQ ID NO: 117806 - RNA, 22 nt, Human herpesvirus 4 [Epstein-Barr virus]
uggagcguucucagggaucgcu

SEQ ID NO: 117807 - RNA, 17 nt, Human herpesvirus 4 [Epstein-Barr virus]
uggcagacgcccuccug

SEQ ID NO: 117808 - RNA, 22 nt, Human herpesvirus 4 [Epstein-Barr virus]
uggugcagagagccacacaguu

SEQ ID NO: 117809 - RNA, 22 nt, Human herpesvirus 4 [Epstein-Barr virus]
auccaggccuucgcuggcuucu

SEQ ID NO: 117810 - RNA, 22 nt, Human herpesvirus 4 [Epstein-Barr virus]
cggggcaguauuuucgaccgag

SEQ ID NO: 117811 - RNA, 22 nt, Human herpesvirus 4 [Epstein-Barr virus]
gaugcguguagcccagaagcgu

SEQ ID NO: 117812 - RNA, 22 nt, Human herpesvirus 5
cucggcgcgucacaugagcgau

SEQ ID NO: 117813 - RNA, 22 nt, Human herpesvirus 5
cugagagucgccuguacgacgc

SEQ ID NO: 117814 - RNA, 22 nt, Human herpesvirus 5
cugcaggaaccaguugugcgga

SEQ ID NO: 117815 - RNA, 22 nt, Human herpesvirus 5
cugccuacgcgaucggcggccg

SEQ ID NO: 117816 - RNA, 22 nt, Human herpesvirus 5
cugcgcacgcucucggucacgg

SEQ ID NO: 117817 - RNA, 22 nt, Human herpesvirus 5
cugcgccuccagccgcuccgag

SEQ ID NO: 117818 - RNA, 22 nt, Human herpesvirus 5
cuggaaauggacuuuugcucuc

SEQ ID NO: 117819 - RNA, 22 nt, Human herpesvirus 5
cuucuugaccguuaucacggug

SEQ ID NO: 117820 - RNA, 22 nt, Human herpesvirus 5
gacaacgugguccaguacgucc

SEQ ID NO: 117821 - RNA, 22 nt, Human herpesvirus 5
gacagcaacaggcgcuccgggc

SEQ ID NO: 117822 - RNA, 22 nt, Human herpesvirus 5
gacguccgcccgacgguggugg

SEQ ID NO: 117823 - RNA, 22 nt, Human herpesvirus 5
gacuaggucgucuuggaagccg

SEQ ID NO: 117824 - RNA, 22 nt, Human herpesvirus 5
gagacgcacgacaguauacgug

SEQ ID NO: 117825 - RNA, 20 nt, Human herpesvirus 5
gauuugaugcgcuagcguca

SEQ ID NO: 117826 - RNA, 22 nt, Human herpesvirus 5
gcaagugcuucagcagcagcuu

SEQ ID NO: 117827 - RNA, 22 nt, Human herpesvirus 5
gcagcgagccgcguaacgucug

SEQ ID NO: 117828 - RNA, 22 nt, Human herpesvirus 5
gccgaggacgccgugggcggcg

SEQ ID NO: 117829 - RNA, 23 nt, Human herpesvirus 5
gccggcaaaauguagguggcguu

SEQ ID NO: 117830 - RNA, 22 nt, Human herpesvirus 5
gcgacggucuuuuuugccuggg

SEQ ID NO: 117831 - RNA, 22 nt, Human herpesvirus 5
gcgaggacacgcagacggcgga

SEQ ID NO: 117832 - RNA, 22 nt, Human herpesvirus 5
gcggaucggacaucauacugac

SEQ ID NO: 117833 - RNA, 23 nt, Human herpesvirus 5
gcgggcacugggucugcacgacg

SEQ ID NO: 117834 - RNA, 22 nt, Human herpesvirus 5
gcggggucguggcggcuguguc

SEQ ID NO: 117835 - RNA, 22 nt, Human herpesvirus 5
gcgugcugauuguaguuuuugc

SEQ ID NO: 117836 - RNA, 22 nt, Human herpesvirus 5
gcugugccugucauccacuugg

SEQ ID NO: 117837 - RNA, 22 nt, Human herpesvirus 5
gcuuggucuucacguccagcag

SEQ ID NO: 117838 - RNA, 22 nt, Human herpesvirus 5
ggcacggucucgcacgccaccu

SEQ ID NO: 117839 - RNA, 22 nt, Human herpesvirus 5
ggccgccuagcgcuuccagcug

SEQ ID NO: 117840 - RNA, 23 nt, Human herpesvirus 5
ggcgauucgccgccgccgauacc

SEQ ID NO: 117841 - RNA, 19 nt, Human herpesvirus 5
ggcugucggguacgugacg

SEQ ID NO: 117842 - RNA, 22 nt, Human herpesvirus 5
gguacuugacgcgggugcgcgu

SEQ ID NO: 117843 - RNA, 22 nt, Human herpesvirus 5
gguccgcgucgcguagcgcuuc

SEQ ID NO: 117844 - RNA, 22 nt, Human herpesvirus 5
aaacgacguagacgaugaaccg

SEQ ID NO: 117845 - RNA, 20 nt, Human herpesvirus 5
acgcaccgagagacugaggc

SEQ ID NO: 117846 - RNA, 22 nt, Human herpesvirus 5
acggcgugauugagcaccugcg

SEQ ID NO: 117847 - RNA, 22 nt, Human herpesvirus 5
acggguaucugcagcuggaccu

SEQ ID NO: 117848 - RNA, 22 nt, Human herpesvirus 5
acggugucgccaccguugacgu

SEQ ID NO: 117849 - RNA, 22 nt, Human herpesvirus 5
acuguugcagcgcuugggucag

SEQ ID NO: 117850 - RNA, 22 nt, Human herpesvirus 5
acuuccccgucguacuggcggc

SEQ ID NO: 117851 - RNA, 22 nt, Human herpesvirus 5
agacggguacggcgcgccgcau

SEQ ID NO: 117852 - RNA, 22 nt, Human herpesvirus 5
agaggucacucgcggcgugccg

SEQ ID NO: 117853 - RNA, 22 nt, Human herpesvirus 5
agcaccgagagcugcuguugcg

SEQ ID NO: 117854 - RNA, 22 nt, Human herpesvirus 5
agcgcgaggcgucggagcucgg

SEQ ID NO: 117855 - RNA, 22 nt, Human herpesvirus 5
agcggcgugaugauacggagcg

SEQ ID NO: 117856 - RNA, 22 nt, Human herpesvirus 5
agguggagauucuaaagccacg

SEQ ID NO: 117857 - RNA, 22 nt, Human herpesvirus 5
agguggugugcgaucccuucca

SEQ ID NO: 117858 - RNA, 20 nt, Human herpesvirus 5
agugcgccgagcggccguug

SEQ ID NO: 117859 - RNA, 22 nt, Human herpesvirus 5
auagauucaacgugaugagacc

SEQ ID NO: 117860 - RNA, 22 nt, Human herpesvirus 5
aucggcuuccaagacgaccuag

SEQ ID NO: 117861 - RNA, 21 nt, Human herpesvirus 5
aucuccucucgcucggcggcg

SEQ ID NO: 117862 - RNA, 22 nt, Human herpesvirus 5
aucugcuguagauaucauaacg

SEQ ID NO: 117863 - RNA, 22 nt, Human herpesvirus 5
aucuugagcggcagcgcguaca

SEQ ID NO: 117864 - RNA, 22 nt, Human herpesvirus 5
augucacaggcgcccgaggcgu

SEQ ID NO: 117865 - RNA, 21 nt, Human herpesvirus 5
augucgcugaaauugcggauc

SEQ ID NO: 117866 - RNA, 22 nt, Human herpesvirus 5
caaagagaccccgcugugccgc

SEQ ID NO: 117867 - RNA, 22 nt, Human herpesvirus 5
caaguaagaaacaggaugaggc

SEQ ID NO: 117868 - RNA, 22 nt, Human herpesvirus 5
cacccguuucugccgcucgcga

SEQ ID NO: 117869 - RNA, 22 nt, Human herpesvirus 5
cacggccagcgccuugucgcgg

SEQ ID NO: 117870 - RNA, 22 nt, Human herpesvirus 5
cagcgggucgcucuugauaaac

SEQ ID NO: 117871 - RNA, 22 nt, Human herpesvirus 5
cagggcgcuuuggcaaaaggcg

SEQ ID NO: 117872 - RNA, 22 nt, Human herpesvirus 5
caguugacugagauugagaucc

SEQ ID NO: 117873 - RNA, 22 nt, Human herpesvirus 5
cauacguuuuugggaaaguugg

SEQ ID NO: 117874 - RNA, 22 nt, Human herpesvirus 5
ccaacgcaacagaccuaggcac

SEQ ID NO: 117875 - RNA, 22 nt, Human herpesvirus 5
ccgacugugggaagcuguccac

SEQ ID NO: 117876 - RNA, 22 nt, Human herpesvirus 5
ccgguauucggaaacagcgucc

SEQ ID NO: 117877 - RNA, 17 nt, Human herpesvirus 5
ccgugaagacgaccugu

SEQ ID NO: 117878 - RNA, 22 nt, Human herpesvirus 5
cgagcugucggaauccucgucg

SEQ ID NO: 117879 - RNA, 22 nt, Human herpesvirus 5
cgaggccugauccguggagaac

SEQ ID NO: 117880 - RNA, 22 nt, Human herpesvirus 5
cgaggcggugcccgcgacucgc

SEQ ID NO: 117881 - RNA, 21 nt, Human herpesvirus 5
cgccugucuccugggcgagca

SEQ ID NO: 117882 - RNA, 22 nt, Human herpesvirus 5
cgcgcaggggcuccgacguggc

SEQ ID NO: 117883 - RNA, 22 nt, Human herpesvirus 5
cggcgaccgcggacucgccucg

SEQ ID NO: 117884 - RNA, 22 nt, Human herpesvirus 5
cggcggcgcccgagcgggacau

SEQ ID NO: 117885 - RNA, 22 nt, Human herpesvirus 5
cggugggggcgugccccgcaga

SEQ ID NO: 117886 - RNA, 17 nt, Human herpesvirus 5
cgguuucucauacgcgc

SEQ ID NO: 117887 - RNA, 22 nt, Human herpesvirus 5
cgugaugcgcaccuucggcggu

SEQ ID NO: 117888 - RNA, 22 nt, Human herpesvirus 5
cgugcacgccgucgccgaggau

SEQ ID NO: 117889 - RNA, 23 nt, Human herpesvirus 5
cucaguugucaaguccgagugcc

SEQ ID NO: 117890 - RNA, 22 nt, Human herpesvirus 5
cucgagaccgaagacgccguca

SEQ ID NO: 117891 - RNA, 22 nt, Human herpesvirus 5
uucaccgucgcugugcaacgcg

SEQ ID NO: 117892 - RNA, 22 nt, Human herpesvirus 5
uucgccguugcuguuccuccgc

SEQ ID NO: 117893 - RNA, 23 nt, Human herpesvirus 5
uucguagagaacgauggaggacg

SEQ ID NO: 117894 - RNA, 22 nt, Human herpesvirus 5
uucuggucguuuugcugcucau

SEQ ID NO: 117895 - RNA, 22 nt, Human herpesvirus 5
uuucugauacuggaucgucugu

SEQ ID NO: 117896 - RNA, 17 nt, Human herpesvirus 5
uuuggcuacgguggugu

SEQ ID NO: 117897 - RNA, 22 nt, Human herpesvirus 5
caaguauguggaacagcucgug

SEQ ID NO: 117898 - RNA, 22 nt, Human herpesvirus 5
cacgaacguguccucggugaag

SEQ ID NO: 117899 - RNA, 21 nt, Human herpesvirus 5
cacguugcgguccgugcccgc

SEQ ID NO: 117900 - RNA, 22 nt, Human herpesvirus 5
cagccgccgucgcuggugggca

SEQ ID NO: 117901 - RNA, 22 nt, Human herpesvirus 5
cagcucgucuuuuuagccguga

SEQ ID NO: 117902 - RNA, 22 nt, Human herpesvirus 5
caggucgcggauuuguuaucgg

SEQ ID NO: 117903 - RNA, 22 nt, Human herpesvirus 5
caguaucguguugugcuucaac

SEQ ID NO: 117904 - RNA, 22 nt, Human herpesvirus 5
cagugucagcgccgagccgcgg

SEQ ID NO: 117905 - RNA, 22 nt, Human herpesvirus 5
ccaccgauccgcacgaccgcga

SEQ ID NO: 117906 - RNA, 22 nt, Human herpesvirus 5
ccaggagcucaucauguucggg

SEQ ID NO: 117907 - RNA, 22 nt, Human herpesvirus 5
ccaucgagggccugcgcgccug

SEQ ID NO: 117908 - RNA, 22 nt, Human herpesvirus 5
cccagguuucuggagauuguac

SEQ ID NO: 117909 - RNA, 22 nt, Human herpesvirus 5
ccccucuuucugcgucguggcu

SEQ ID NO: 117910 - RNA, 22 nt, Human herpesvirus 5
ccgugaugagcacgguguucug

SEQ ID NO: 117911 - RNA, 22 nt, Human herpesvirus 5
cgacgaagaugcgucgaaucgc

SEQ ID NO: 117912 - RNA, 22 nt, Human herpesvirus 5
cgaggccgacagccuggagaug

SEQ ID NO: 117913 - RNA, 22 nt, Human herpesvirus 5
cgcacgauggccaugcgcguca

SEQ ID NO: 117914 - RNA, 22 nt, Human herpesvirus 5
cgccgcaggcccucauagucgc

SEQ ID NO: 117915 - RNA, 22 nt, Human herpesvirus 5
cgccgccagcggguacacgugc

SEQ ID NO: 117916 - RNA, 23 nt, Human herpesvirus 5
cgccucgucugagccggggugcc

SEQ ID NO: 117917 - RNA, 22 nt, Human herpesvirus 5
cgccugugcuuuguuacgacgg

SEQ ID NO: 117918 - RNA, 22 nt, Human herpesvirus 5
cgcgacggccucgcugacugga

SEQ ID NO: 117919 - RNA, 22 nt, Human herpesvirus 5
cgcguugcgaacggugucguua

SEQ ID NO: 117920 - RNA, 22 nt, Human herpesvirus 5
cgcuguuggagcugcucaucga

SEQ ID NO: 117921 - RNA, 22 nt, Human herpesvirus 5
cggacgugucaucucgcccgga

SEQ ID NO: 117922 - RNA, 22 nt, Human herpesvirus 5
cggaggucacgccacaugaagc

SEQ ID NO: 117923 - RNA, 22 nt, Human herpesvirus 5
cggcgguuucgccaccgcugac

SEQ ID NO: 117924 - RNA, 22 nt, Human herpesvirus 5
cgggccaguagcagagguggac

SEQ ID NO: 117925 - RNA, 18 nt, Human herpesvirus 5
cgguagcucucgucgcuc

SEQ ID NO: 117926 - RNA, 22 nt, Human herpesvirus 5
acgcaggggcuggacgugguua

SEQ ID NO: 117927 - RNA, 22 nt, Human herpesvirus 5
acgcuguuuccgaauaccggga

SEQ ID NO: 117928 - RNA, 22 nt, Human herpesvirus 5
acgcuguuuuacuuuugucggg

SEQ ID NO: 117929 - RNA, 22 nt, Human herpesvirus 5
acggcggacgaccggcauggcg

SEQ ID NO: 117930 - RNA, 22 nt, Human herpesvirus 5
acgucugagcgccgcugacagu

SEQ ID NO: 117931 - RNA, 21 nt, Human herpesvirus 5
acuggcccgacaagcggugca

SEQ ID NO: 117932 - RNA, 22 nt, Human herpesvirus 5
agcagacaguguaguucuugcc

SEQ ID NO: 117933 - RNA, 22 nt, Human herpesvirus 5
agcgcgugcuucggcgguugcu

SEQ ID NO: 117934 - RNA, 22 nt, Human herpesvirus 5
aggcgaguccgcggucgccgcc

SEQ ID NO: 117935 - RNA, 22 nt, Human herpesvirus 5
agggcauucaguugaugggugg

SEQ ID NO: 117936 - RNA, 20 nt, Human herpesvirus 5
agguugagccacccgccgca

SEQ ID NO: 117937 - RNA, 22 nt, Human herpesvirus 5
agugacggugagauccaggcug

SEQ ID NO: 117938 - RNA, 22 nt, Human herpesvirus 5
agugugagcacuacccuaguuu

SEQ ID NO: 117939 - RNA, 22 nt, Human herpesvirus 5
aucagcggcgugaugguaagca

SEQ ID NO: 117940 - RNA, 22 nt, Human herpesvirus 5
augaagggccagacgccuuuga

SEQ ID NO: 117941 - RNA, 22 nt, Human herpesvirus 5
augucucccuuggagaacgucg

SEQ ID NO: 117942 - RNA, 22 nt, Human herpesvirus 5
caaaacugucagcggcgcucag

SEQ ID NO: 117943 - RNA, 22 nt, Human herpesvirus 5
caacgacuggacgacgucguuu

SEQ ID NO: 117944 - RNA, 22 nt, Human herpesvirus 5
caaguucaccugguggaaacga

SEQ ID NO: 117945 - RNA, 22 nt, Human herpesvirus 5
cacugcgagggccagcccagcg

SEQ ID NO: 117946 - RNA, 21 nt, Human herpesvirus 5
ccaaccgucaagauccgcguu

SEQ ID NO: 117947 - RNA, 22 nt, Human herpesvirus 5
ccaagucagagcagcgucgguc

SEQ ID NO: 117948 - RNA, 22 nt, Human herpesvirus 5
ccauguuguccaaggguaucau

SEQ ID NO: 117949 - RNA, 22 nt, Human herpesvirus 5
ccgaucaccagaaggcggacau

SEQ ID NO: 117950 - RNA, 22 nt, Human herpesvirus 5
ccgcgugucuaaaccgcgugcu

SEQ ID NO: 117951 - RNA, 22 nt, Human herpesvirus 5
ccugaugcuggucaugguauau

SEQ ID NO: 117952 - RNA, 22 nt, Human herpesvirus 5
ccugccgcgucaccgugugucc

SEQ ID NO: 117953 - RNA, 22 nt, Human herpesvirus 5
ccugcgugccagucuguccguc

SEQ ID NO: 117954 - RNA, 22 nt, Human herpesvirus 5
cgacgacgaugcagccugccgc

SEQ ID NO: 117955 - RNA, 22 nt, Human herpesvirus 5
cgagcugcugaugugccgucgc

SEQ ID NO: 117956 - RNA, 22 nt, Human herpesvirus 5
cgcacgaccuaugguguugcug

SEQ ID NO: 117957 - RNA, 22 nt, Human herpesvirus 5
cgccgcccaugugccgcguucc

SEQ ID NO: 117958 - RNA, 19 nt, Human herpesvirus 5
cgcgagcggcggacuuggc

SEQ ID NO: 117959 - RNA, 22 nt, Human herpesvirus 5
cgcgcccagguaggccguuacu

SEQ ID NO: 117960 - RNA, 19 nt, Human herpesvirus 5
cgcggagccaggcugcggc

SEQ ID NO: 117961 - RNA, 22 nt, Human herpesvirus 5
cgcggccgggugggugugugcc

SEQ ID NO: 117962 - RNA, 22 nt, Human herpesvirus 5
cgcguaaccguuguccguuaua

SEQ ID NO: 117963 - RNA, 22 nt, Human herpesvirus 5
cgcuaaccuucggggcuguugc

SEQ ID NO: 117964 - RNA, 22 nt, Human herpesvirus 5
cggagaauggccggcgcugcgc

SEQ ID NO: 117965 - RNA, 22 nt, Human herpesvirus 5
cggcagcugcagcacguggaga

SEQ ID NO: 117966 - RNA, 22 nt, Human herpesvirus 5
cgggaagaggagggugguucau

SEQ ID NO: 117967 - RNA, 22 nt, Human herpesvirus 5
cgguagauguccaggugcuuac

SEQ ID NO: 117968 - RNA, 22 nt, Human herpesvirus 5
cgguuucggcuuagccucuggc

SEQ ID NO: 117969 - RNA, 22 nt, Human herpesvirus 5
cgucguguagccacacggucuc

SEQ ID NO: 117970 - RNA, 22 nt, Human herpesvirus 5
cguuguaaacaagcuauugcug

SEQ ID NO: 117971 - RNA, 22 nt, Human herpesvirus 5
cucaccuggaccggugguacug

SEQ ID NO: 117972 - RNA, 22 nt, Human herpesvirus 5
aacgcuuucgucguguuuuuca

SEQ ID NO: 117973 - RNA, 22 nt, Human herpesvirus 5
aaucacagguaccguaucuauu

SEQ ID NO: 117974 - RNA, 22 nt, Human herpesvirus 5
acaaacuagcauucuggugaga

SEQ ID NO: 117975 - RNA, 22 nt, Human herpesvirus 5
accagacgcgauggcccgcuau

SEQ ID NO: 117976 - RNA, 22 nt, Human herpesvirus 5
accaguccaagcacguccgguc

SEQ ID NO: 117977 - RNA, 21 nt, Human herpesvirus 5
acgcacgucgccguccauguc

SEQ ID NO: 117978 - RNA, 22 nt, Human herpesvirus 5
acgugguuuuugcuuccgagcu

SEQ ID NO: 117979 - RNA, 22 nt, Human herpesvirus 5
acuucuuucgcucccucgaccc

SEQ ID NO: 117980 - RNA, 22 nt, Human herpesvirus 5
agaggggacgucggggcccucc

SEQ ID NO: 117981 - RNA, 22 nt, Human herpesvirus 5
agccgcgcaugacgcaggugag

SEQ ID NO: 117982 - RNA, 22 nt, Human herpesvirus 5
agccgugcugggccucaacgcg

SEQ ID NO: 117983 - RNA, 22 nt, Human herpesvirus 5
agcggguaaguucuaagaaaca

SEQ ID NO: 117984 - RNA, 22 nt, Human herpesvirus 5
aggacgccguauuggugcgcga

SEQ ID NO: 117985 - RNA, 22 nt, Human herpesvirus 5
aggcggacgagguagagguuug

SEQ ID NO: 117986 - RNA, 22 nt, Human herpesvirus 5
aguauacuaauaugaagcgucg

SEQ ID NO: 117987 - RNA, 22 nt, Human herpesvirus 5
aguggcaggcccggguucgcga

SEQ ID NO: 117988 - RNA, 22 nt, Human herpesvirus 5
auagccuccggcugucaugggu

SEQ ID NO: 117989 - RNA, 22 nt, Human herpesvirus 5
aucaccaugguaauagcgauga

SEQ ID NO: 117990 - RNA, 22 nt, Human herpesvirus 5
augaaaaacacgacgaaagcgu

SEQ ID NO: 117991 - RNA, 22 nt, Human herpesvirus 5
auggagugagaggccggaccac

SEQ ID NO: 117992 - RNA, 22 nt, Human herpesvirus 5
auguggacauggccuaugccug

SEQ ID NO: 117993 - RNA, 23 nt, Human herpesvirus 5
auuugaguauacgguuaauguau

SEQ ID NO: 117994 - RNA, 22 nt, Human herpesvirus 5
caaaauaucgaacucuucgcgg

SEQ ID NO: 117995 - RNA, 22 nt, Human herpesvirus 5
caccaccgcagucggaggagga

SEQ ID NO: 117996 - RNA, 22 nt, Human herpesvirus 5
caccgcccauggguuccugcug

SEQ ID NO: 117997 - RNA, 22 nt, Human herpesvirus 5
cacgccguccuugacgacgcag

SEQ ID NO: 117998 - RNA, 22 nt, Human herpesvirus 5
cacguuaaugcgcgagacggcg

SEQ ID NO: 117999 - RNA, 22 nt, Human herpesvirus 5
caucacguccuuuaagagcugu

SEQ ID NO: 118000 - RNA, 22 nt, Human herpesvirus 5
ccacggaaaacgguaguuuugu

SEQ ID NO: 118001 - RNA, 22 nt, Human herpesvirus 5
ccagagcugcuaggaaccgguc

SEQ ID NO: 118002 - RNA, 22 nt, Human herpesvirus 5
ccagcaguaugacgugcgaugg

SEQ ID NO: 118003 - RNA, 21 nt, Human herpesvirus 5
cccaacaggaucaucgaccuc

SEQ ID NO: 118004 - RNA, 22 nt, Human herpesvirus 5
ccgccuccucgaguauuguucc

SEQ ID NO: 118005 - RNA, 22 nt, Human herpesvirus 5
ccgccucgcccauguguacgca

SEQ ID NO: 118006 - RNA, 22 nt, Human herpesvirus 5
ccggcgagcugacgaguggcgg

SEQ ID NO: 118007 - RNA, 22 nt, Human herpesvirus 5
ccgggaaagagcugcgacagcg

SEQ ID NO: 118008 - RNA, 23 nt, Human herpesvirus 5
ccuucgguaucaucgucuuugcu

SEQ ID NO: 118009 - RNA, 22 nt, Human herpesvirus 5
cgacgcagaaccacgcgcaguu

SEQ ID NO: 118010 - RNA, 18 nt, Human herpesvirus 5
cgagaacgcgcccuuucc

SEQ ID NO: 118011 - RNA, 22 nt, Human herpesvirus 5
cgcgcccacgguccgggcacaa

SEQ ID NO: 118012 - RNA, 19 nt, Human herpesvirus 5
cgcggcacaggcuuucgcg

SEQ ID NO: 118013 - RNA, 22 nt, Human herpesvirus 5
cgcguucuggacugcauccguc

SEQ ID NO: 118014 - RNA, 22 nt, Human herpesvirus 5
cggagacugggcugcaggcggc

SEQ ID NO: 118015 - RNA, 22 nt, Human herpesvirus 5
cgggcguacuaccccacgucaa

SEQ ID NO: 118016 - RNA, 22 nt, Human herpesvirus 5
cggucgacguuggcugcgcacc

SEQ ID NO: 118017 - RNA, 22 nt, Human herpesvirus 5
cgguuauuaucaacgucucugu

SEQ ID NO: 118018 - RNA, 20 nt, Human herpesvirus 5
cgucaagcgguuauaggugc

SEQ ID NO: 118019 - RNA, 22 nt, Human herpesvirus 5
cgucgcagugugagguguucac

SEQ ID NO: 118020 - RNA, 22 nt, Human herpesvirus 5
cguggaugagaucguagagggc

SEQ ID NO: 118021 - RNA, 22 nt, Human herpesvirus 5
cguguacgaucaccggcuggcu

SEQ ID NO: 118022 - RNA, 22 nt, Human herpesvirus 5
cgugucgaugcgcuggugccag

SEQ ID NO: 118023 - RNA, 22 nt, Human herpesvirus 5
cucgagaugcacuccgcuucag

SEQ ID NO: 118024 - RNA, 22 nt, Human herpesvirus 5
cugcugugaaaacgggcacggu

SEQ ID NO: 118025 - RNA, 22 nt, Human herpesvirus 5
cuggacacguuguuaagcggcg

SEQ ID NO: 118026 - RNA, 22 nt, Human herpesvirus 5
cuggagaacgccggggcagcag

SEQ ID NO: 118027 - RNA, 22 nt, Human herpesvirus 5
cuucagccaucaucccgaguuc

SEQ ID NO: 118028 - RNA, 22 nt, Human herpesvirus 5
cuugugguuaaguuguagauag

SEQ ID NO: 118029 - RNA, 21 nt, Human herpesvirus 5
gaacaugaugccguugcagac

SEQ ID NO: 118030 - RNA, 22 nt, Human herpesvirus 5
gaccucuggccagucgugcgcg

SEQ ID NO: 118031 - RNA, 22 nt, Human herpesvirus 5
gacggcgucuucggucucgagc

SEQ ID NO: 118032 - RNA, 22 nt, Human herpesvirus 5
gacguugaccguuguggggauu

SEQ ID NO: 118033 - RNA, 22 nt, Human herpesvirus 5
gagcucgccggcggcgaaacaa

SEQ ID NO: 118034 - RNA, 22 nt, Human herpesvirus 5
gaggagcgcauguucguggggu

SEQ ID NO: 118035 - RNA, 22 nt, Human herpesvirus 5
gaugagcagcuccaacagcgug

SEQ ID NO: 118036 - RNA, 22 nt, Human herpesvirus 5
gcaggugguucaccacguccgu

SEQ ID NO: 118037 - RNA, 22 nt, Human herpesvirus 5
gcaguacccgaacacggcgccc

SEQ ID NO: 118038 - RNA, 22 nt, Human herpesvirus 5
gcaguugcaguagagcaauuua

SEQ ID NO: 118039 - RNA, 22 nt, Human herpesvirus 5
gccaugucguuucgcgucggca

SEQ ID NO: 118040 - RNA, 20 nt, Human herpesvirus 5
gcgcaggauauggcagccug

SEQ ID NO: 118041 - RNA, 22 nt, Human herpesvirus 5
gcgcaugaaggguugcggguug

SEQ ID NO: 118042 - RNA, 22 nt, Human herpesvirus 5
gcgcucguuaaucugaacgaag

SEQ ID NO: 118043 - RNA, 22 nt, Human herpesvirus 5
gcggccuuggcggucgggucug

SEQ ID NO: 118044 - RNA, 22 nt, Human herpesvirus 5
gcgguccaacugcagccgcuuc

SEQ ID NO: 118045 - RNA, 23 nt, Human herpesvirus 5
gcgguucgccgucaucguugucg

SEQ ID NO: 118046 - RNA, 22 nt, Human herpesvirus 5
gcucgucuuuuuagccgugacc

SEQ ID NO: 118047 - RNA, 22 nt, Human herpesvirus 5
ggagaacuauuuucuuugucaa

SEQ ID NO: 118048 - RNA, 22 nt, Human herpesvirus 5
ggagcggggcguccgaaggcga

SEQ ID NO: 118049 - RNA, 22 nt, Human herpesvirus 5
ggcaagccgagcgggaggcggu

SEQ ID NO: 118050 - RNA, 22 nt, Human herpesvirus 5
ggcccucgcucgucgugccucu

SEQ ID NO: 118051 - RNA, 22 nt, Human herpesvirus 5
ggcgaccagaagcccggugccg

SEQ ID NO: 118052 - RNA, 22 nt, Human herpesvirus 5
ggcgcgcacagccuccugucga

SEQ ID NO: 118053 - RNA, 22 nt, Human herpesvirus 5
ggcgucggagccccgauacaug

SEQ ID NO: 118054 - RNA, 20 nt, Human herpesvirus 5
gggauuguugccggccaggu

SEQ ID NO: 118055 - RNA, 22 nt, Human herpesvirus 5
gggcgagucgcgggcaccgccu

SEQ ID NO: 118056 - RNA, 22 nt, Human herpesvirus 5
gggucccggcacgggccgagga

SEQ ID NO: 118057 - RNA, 22 nt, Human herpesvirus 5
gggucucggacgagucgacacg

SEQ ID NO: 118058 - RNA, 22 nt, Human herpesvirus 5
ggucgcgcugcuuuccccgagc

SEQ ID NO: 118059 - RNA, 22 nt, Human herpesvirus 5
gucgcagucagacccacuaccu

SEQ ID NO: 118060 - RNA, 22 nt, Human herpesvirus 5
gucucgagcgccccccgaugua

SEQ ID NO: 118061 - RNA, 22 nt, Human herpesvirus 5
guguucguggacgcguacggcg

SEQ ID NO: 118062 - RNA, 22 nt, Human herpesvirus 5
guugcacgcgucgcggcguaug

SEQ ID NO: 118063 - RNA, 20 nt, Human herpesvirus 5
guuuaacgugagguugaaga

SEQ ID NO: 118064 - RNA, 22 nt, Human herpesvirus 5
guuugucuuugagcgcgcgaca

SEQ ID NO: 118065 - RNA, 22 nt, Human herpesvirus 5
uaccgccgcgucgucucguauu

SEQ ID NO: 118066 - RNA, 22 nt, Human herpesvirus 5
uacgaugcgagccacggcuugg

SEQ ID NO: 118067 - RNA, 22 nt, Human herpesvirus 5
uacgucggccaacaaccacggc

SEQ ID NO: 118068 - RNA, 22 nt, Human herpesvirus 5
uacugcugaaugagcaucugaa

SEQ ID NO: 118069 - RNA, 20 nt, Human herpesvirus 5
uauccguguccaccaucggg

SEQ ID NO: 118070 - RNA, 22 nt, Human herpesvirus 5
ucccuagccagcgugccgugua

SEQ ID NO: 118071 - RNA, 22 nt, Human herpesvirus 5
uccgccguguuucucggcguac

SEQ ID NO: 118072 - RNA, 22 nt, Human herpesvirus 5
ucgcgaucuccgagaggaggag

SEQ ID NO: 118073 - RNA, 22 nt, Human herpesvirus 5
ucgcgcaccauaaacucgccua

SEQ ID NO: 118074 - RNA, 22 nt, Human herpesvirus 5
ucgcgcguacggacgaguggaa

SEQ ID NO: 118075 - RNA, 22 nt, Human herpesvirus 5
ucggccuacggagugcugacga

SEQ ID NO: 118076 - RNA, 22 nt, Human herpesvirus 5
ucucacgggaaggcuaguuaga

SEQ ID NO: 118077 - RNA, 22 nt, Human herpesvirus 5
ucuuuccagguguuuucaacgu

SEQ ID NO: 118078 - RNA, 22 nt, Human herpesvirus 5
ugaagcggagugcaucucgagu

SEQ ID NO: 118079 - RNA, 22 nt, Human herpesvirus 5
ugacaagccugacgagagcguu

SEQ ID NO: 118080 - RNA, 22 nt, Human herpesvirus 5
ugaggcucucggaucugcggcu

SEQ ID NO: 118081 - RNA, 22 nt, Human herpesvirus 5
ugauagaacuguuguauacgaa

SEQ ID NO: 118082 - RNA, 22 nt, Human herpesvirus 5
ugcagaucaucaugucgcugcu

SEQ ID NO: 118083 - RNA, 22 nt, Human herpesvirus 5
ugcgcuguuacacggaauccag

SEQ ID NO: 118084 - RNA, 22 nt, Human herpesvirus 5
ugcucgcaguaguggcgcagcu

SEQ ID NO: 118085 - RNA, 22 nt, Human herpesvirus 5
ugcugauaacuguuguacugua

SEQ ID NO: 118086 - RNA, 22 nt, Human herpesvirus 5
ugcuggagcgcgacgacgaggc

SEQ ID NO: 118087 - RNA, 22 nt, Human herpesvirus 5
ugcuuuuauugcugauaacugu

SEQ ID NO: 118088 - RNA, 22 nt, Human herpesvirus 5
uggaacaccaaauuguacgugg

SEQ ID NO: 118089 - RNA, 22 nt, Human herpesvirus 5
ugguccuuuuguuggugccgcc

SEQ ID NO: 118090 - RNA, 22 nt, Human herpesvirus 5
ugugaagcagcaacccgaacgc

SEQ ID NO: 118091 - RNA, 22 nt, Human herpesvirus 5
uguuguugcgggauguucaagg

SEQ ID NO: 118092 - RNA, 22 nt, Human herpesvirus 5
uuaaagcaaaaagucuggugag

SEQ ID NO: 118093 - RNA, 21 nt, Human herpesvirus 5
uuacgaggucugcauguuggu

SEQ ID NO: 118094 - RNA, 22 nt, Human herpesvirus 5
uucagcuucauaagaugucugc

SEQ ID NO: 118095 - RNA, 22 nt, Human herpesvirus 5
uugaccagcagcuugcagcgcu

SEQ ID NO: 118096 - RNA, 22 nt, Human herpesvirus 5
uugccgucguccgucacccggg

SEQ ID NO: 118097 - RNA, 22 nt, Human herpesvirus 5
aaagcaaggcacguucauaaug

SEQ ID NO: 118098 - RNA, 22 nt, Human herpesvirus 5
aaauaacgguacagagcgcgaa

SEQ ID NO: 118099 - RNA, 22 nt, Human herpesvirus 5
aacucgcgugccgacggggucu

SEQ ID NO: 118100 - RNA, 22 nt, Human herpesvirus 5
aaucauccuguacgaagaggaa

SEQ ID NO: 118101 - RNA, 21 nt, Human herpesvirus 5
aaugugaagaugguggaccgc

SEQ ID NO: 118102 - RNA, 22 nt, Human herpesvirus 5
acagggaaugggaaaaacacgc

SEQ ID NO: 118103 - RNA, 22 nt, Human herpesvirus 5
accgcuauccacgcccauugau

SEQ ID NO: 118104 - RNA, 22 nt, Human herpesvirus 5
accucgucaaucuugacgcgac

SEQ ID NO: 118105 - RNA, 21 nt, Human herpesvirus 5
acgcacgugaggcaaucuccg

SEQ ID NO: 118106 - RNA, 22 nt, Human herpesvirus 5
acgcaggagcgucugacuagca

SEQ ID NO: 118107 - RNA, 22 nt, Human herpesvirus 5
cuccuccuccgacugcgguggu

SEQ ID NO: 118108 - RNA, 23 nt, Human herpesvirus 5
cucgggcgccugugacaugaggc

SEQ ID NO: 118109 - RNA, 22 nt, Human herpesvirus 5
cugagcaagaucaguuggcugg

SEQ ID NO: 118110 - RNA, 22 nt, Human herpesvirus 5
cugcaggaaacguuggcgacgg

SEQ ID NO: 118111 - RNA, 22 nt, Human herpesvirus 5
cuguggcgggucgcgacgacga

SEQ ID NO: 118112 - RNA, 22 nt, Human herpesvirus 5
cuuggcguggcgcacgcagcga

SEQ ID NO: 118113 - RNA, 17 nt, Human herpesvirus 5
cuuugcgggcauguacg

SEQ ID NO: 118114 - RNA, 22 nt, Human herpesvirus 5
gaccguggcgguggcgggcaug

SEQ ID NO: 118115 - RNA, 22 nt, Human herpesvirus 5
gagaggaguggcugcuguguug

SEQ ID NO: 118116 - RNA, 22 nt, Human herpesvirus 5
gagccgcagauccgagagccuc

SEQ ID NO: 118117 - RNA, 22 nt, Human herpesvirus 5
gaguaucgggccgucgcuugcc

SEQ ID NO: 118118 - RNA, 22 nt, Human herpesvirus 5
gauaggugugacgaugucuuua

SEQ ID NO: 118119 - RNA, 19 nt, Human herpesvirus 5
gaucucuggcaucaugaga

SEQ ID NO: 118120 - RNA, 22 nt, Human herpesvirus 5
gcagcucgggcguguuuucguc

SEQ ID NO: 118121 - RNA, 22 nt, Human herpesvirus 5
gccacgcgauuggccgucggcg

SEQ ID NO: 118122 - RNA, 22 nt, Human herpesvirus 5
gccgucugcguguccucgcugg

SEQ ID NO: 118123 - RNA, 22 nt, Human herpesvirus 5
gccuucuuuggacucugcggcc

SEQ ID NO: 118124 - RNA, 22 nt, Human herpesvirus 5
gcgacauggacggcgacgugcg

SEQ ID NO: 118125 - RNA, 22 nt, Human herpesvirus 5
gcgccggcacgaugcagcuggc

SEQ ID NO: 118126 - RNA, 22 nt, Human herpesvirus 5
gcgccuggacguugcacgcggc

SEQ ID NO: 118127 - RNA, 22 nt, Human herpesvirus 5
gcgcuggaggaccugcugccca

SEQ ID NO: 118128 - RNA, 22 nt, Human herpesvirus 5
gcggagcagggagcgcaaggcc

SEQ ID NO: 118129 - RNA, 21 nt, Human herpesvirus 5
gcggcgaaucgcccgggcugc

SEQ ID NO: 118130 - RNA, 22 nt, Human herpesvirus 5
gcggcgucgaauuaccgggcgg

SEQ ID NO: 118131 - RNA, 22 nt, Human herpesvirus 5
gcucgcaguaguggcgcagcug

SEQ ID NO: 118132 - RNA, 22 nt, Human herpesvirus 5
gcugggaucguugcgguugucg

SEQ ID NO: 118133 - RNA, 22 nt, Human herpesvirus 5
ggagccguagcggcgggaaccg

SEQ ID NO: 118134 - RNA, 22 nt, Human herpesvirus 5
ggagugacggacggccaguacg

SEQ ID NO: 118135 - RNA, 22 nt, Human herpesvirus 5
ggcgugaccacgucaccgugcc

SEQ ID NO: 118136 - RNA, 22 nt, Human herpesvirus 5
ggcgugcgcgaccccuagucgg

SEQ ID NO: 118137 - RNA, 22 nt, Human herpesvirus 5
ggcguuggccuguggauagauu

SEQ ID NO: 118138 - RNA, 22 nt, Human herpesvirus 5
gggaucauuuucuuggccgugg

SEQ ID NO: 118139 - RNA, 22 nt, Human herpesvirus 5
gggccacgucgggcugcugccg

SEQ ID NO: 118140 - RNA, 22 nt, Human herpesvirus 5
gguccgagacacccagguuguu

SEQ ID NO: 118141 - RNA, 22 nt, Human herpesvirus 5
ggugguaaaacuucggcccgca

SEQ ID NO: 118142 - RNA, 22 nt, Human herpesvirus 5
guaaagacaaaugagacgcuga

SEQ ID NO: 118143 - RNA, 22 nt, Human herpesvirus 5
guacuuuccgcuguuuuccguc

SEQ ID NO: 118144 - RNA, 19 nt, Human herpesvirus 5
guauuaaggccugaacgcc

SEQ ID NO: 118145 - RNA, 22 nt, Human herpesvirus 5
gucacagagcgugcugacgugg

SEQ ID NO: 118146 - RNA, 22 nt, Human herpesvirus 5
gugcacgcgcugcuuucgcacg

SEQ ID NO: 118147 - RNA, 22 nt, Human herpesvirus 5
gugcucuuugucgacgacgugg

SEQ ID NO: 118148 - RNA, 22 nt, Human herpesvirus 5
guggccgcuaaauauggcgacg

SEQ ID NO: 118149 - RNA, 22 nt, Human herpesvirus 5
cgguaguaguaguuggggagga

SEQ ID NO: 118150 - RNA, 22 nt, Human herpesvirus 5
cguccucccgcccaggaccugu

SEQ ID NO: 118151 - RNA, 17 nt, Human herpesvirus 5
cgucucuuuauuuuuau

SEQ ID NO: 118152 - RNA, 22 nt, Human herpesvirus 5
cguuccggcgggugguugacgu

SEQ ID NO: 118153 - RNA, 22 nt, Human herpesvirus 5
cuaccugaccguagcgguuagc

SEQ ID NO: 118154 - RNA, 22 nt, Human herpesvirus 5
cuccccaacuacuacuaccgug

SEQ ID NO: 118155 - RNA, 22 nt, Human herpesvirus 5
cucgguuucgcuguagcugugg

SEQ ID NO: 118156 - RNA, 22 nt, Human herpesvirus 5
cugcgugcacggccaagacauu

SEQ ID NO: 118157 - RNA, 22 nt, Human herpesvirus 5
cugggaaaauugaaagacacgc

SEQ ID NO: 118158 - RNA, 22 nt, Human herpesvirus 5
cugucguuaucgcggcgaaugc

SEQ ID NO: 118159 - RNA, 22 nt, Human herpesvirus 5
cuucagaucguggacguguuug

SEQ ID NO: 118160 - RNA, 22 nt, Human herpesvirus 5
cuucgaggcccaugguucucug

SEQ ID NO: 118161 - RNA, 22 nt, Human herpesvirus 5
gaccgaccgccgcuuuggucgg

SEQ ID NO: 118162 - RNA, 22 nt, Human herpesvirus 5
gacggguguauaccagaugugg

SEQ ID NO: 118163 - RNA, 22 nt, Human herpesvirus 5
gacguuugugcugcuggucaua

SEQ ID NO: 118164 - RNA, 22 nt, Human herpesvirus 5
gacuucuacggaguuuucccuc

SEQ ID NO: 118165 - RNA, 19 nt, Human herpesvirus 5
gagaugcgggguggugcuc

SEQ ID NO: 118166 - RNA, 22 nt, Human herpesvirus 5
gagcagccggagcccgcacacu

SEQ ID NO: 118167 - RNA, 22 nt, Human herpesvirus 5
gaggcgcggaccgugaguuaua

SEQ ID NO: 118168 - RNA, 22 nt, Human herpesvirus 5
gcacuccgggcgagaugacacg

SEQ ID NO: 118169 - RNA, 22 nt, Human herpesvirus 5
gccgucugcagcucgucggccg

SEQ ID NO: 118170 - RNA, 22 nt, Human herpesvirus 5
gccgugugggaaugacggugau

SEQ ID NO: 118171 - RNA, 22 nt, Human herpesvirus 5
gccuccggaucacaugguuacu

SEQ ID NO: 118172 - RNA, 22 nt, Human herpesvirus 5
gcgcagccaacuuucauacuug

SEQ ID NO: 118173 - RNA, 22 nt, Human herpesvirus 5
gcgcucacggccgaguucggcc

SEQ ID NO: 118174 - RNA, 22 nt, Human herpesvirus 5
gcgcugaucugcagcugcacgg

SEQ ID NO: 118175 - RNA, 22 nt, Human herpesvirus 5
gcgucaaacuggugacgacgga

SEQ ID NO: 118176 - RNA, 22 nt, Human herpesvirus 5
gcguuucgguccacguguccug

SEQ ID NO: 118177 - RNA, 22 nt, Human herpesvirus 5
ggaggcuuucgccacaccuauc

SEQ ID NO: 118178 - RNA, 22 nt, Human herpesvirus 5
ggcacggaccgcaacgugcugc

SEQ ID NO: 118179 - RNA, 22 nt, Human herpesvirus 5
ggcgcguucucgcccuugaggc

SEQ ID NO: 118180 - RNA, 22 nt, Human herpesvirus 5
gggcgagacggugcaggagucc

SEQ ID NO: 118181 - RNA, 22 nt, Human herpesvirus 5
ggucugcgcgacauuuuggguc

SEQ ID NO: 118182 - RNA, 22 nt, Human herpesvirus 5
ggugaaguggagggccacggug

SEQ ID NO: 118183 - RNA, 22 nt, Human herpesvirus 5
ggugcacguugaugcuggggau

SEQ ID NO: 118184 - RNA, 18 nt, Human herpesvirus 5
guccgccgccgccgcggu

SEQ ID NO: 118185 - RNA, 22 nt, Human herpesvirus 5
guggcgguaggguaugugucug

SEQ ID NO: 118186 - RNA, 22 nt, Human herpesvirus 5
guucaucguaacguuguugcug

SEQ ID NO: 118187 - RNA, 18 nt, Human herpesvirus 5
guucuccaauggauacgu

SEQ ID NO: 118188 - RNA, 21 nt, Human herpesvirus 5
guuuaacgugagguugaagau

SEQ ID NO: 118189 - RNA, 22 nt, Human herpesvirus 5
uacuaguggaauaguuaacggu

SEQ ID NO: 118190 - RNA, 20 nt, Human herpesvirus 5
uaugcuggaucaagaucagc

SEQ ID NO: 118191 - RNA, 22 nt, Human herpesvirus 5
uccagucucuaacugccguguu

SEQ ID NO: 118192 - RNA, 22 nt, Human herpesvirus 5
uccgccacucgucagcucgccg

SEQ ID NO: 118193 - RNA, 22 nt, Human herpesvirus 5
uccgcguguaaugcacgcggug

SEQ ID NO: 118194 - RNA, 22 nt, Human herpesvirus 5
ucgccgucgaguacgugcugau

SEQ ID NO: 118195 - RNA, 22 nt, Human herpesvirus 5
ucguacgugagcgagucgaguc

SEQ ID NO: 118196 - RNA, 22 nt, Human herpesvirus 5
ucgugcagccgcaugagacgug

SEQ ID NO: 118197 - RNA, 22 nt, Human herpesvirus 5
ucuagagggaagguggggaaug

SEQ ID NO: 118198 - RNA, 21 nt, Human herpesvirus 5
ucuauacauuguaguucauca

SEQ ID NO: 118199 - RNA, 22 nt, Human herpesvirus 5
ucucaccagaaugcuaguuugu

SEQ ID NO: 118200 - RNA, 20 nt, Human herpesvirus 5
ucuccaggcugucggccucg

SEQ ID NO: 118201 - RNA, 21 nt, Human herpesvirus 5
ucugcgcgacauuuuggguca

SEQ ID NO: 118202 - RNA, 23 nt, Human herpesvirus 5
ucugcggaggaacagcaacggcg

SEQ ID NO: 118203 - RNA, 22 nt, Human herpesvirus 5
ucuuuuuucaauacgucaaggu

SEQ ID NO: 118204 - RNA, 22 nt, Human herpesvirus 5
ugcccgggccaugcaucgccuc

SEQ ID NO: 118205 - RNA, 20 nt, Human herpesvirus 5
ugcgccagguaguaaagcac

SEQ ID NO: 118206 - RNA, 22 nt, Human herpesvirus 5
ugcgggaacuggccuggcggcg

SEQ ID NO: 118207 - RNA, 22 nt, Human herpesvirus 5
uggagcgucagacccagggcgc

SEQ ID NO: 118208 - RNA, 22 nt, Human herpesvirus 5
ugguuugggguggcauccaaac

SEQ ID NO: 118209 - RNA, 22 nt, Human herpesvirus 5
ugucgguaggcgccuacggccg

SEQ ID NO: 118210 - RNA, 22 nt, Human herpesvirus 5
ugucugcucauucuggcggcgc

SEQ ID NO: 118211 - RNA, 22 nt, Human herpesvirus 5
ugugcucggaccgugacggugg

SEQ ID NO: 118212 - RNA, 22 nt, Human herpesvirus 5
guggcgcuucgcuacgcgguga

SEQ ID NO: 118213 - RNA, 22 nt, Human herpesvirus 5
guggcgguuguuucuccgucgc

SEQ ID NO: 118214 - RNA, 22 nt, Human herpesvirus 5
guucaugcugccuaucuacgag

SEQ ID NO: 118215 - RNA, 22 nt, Human herpesvirus 5
guugagguaaaugaugauauag

SEQ ID NO: 118216 - RNA, 22 nt, Human herpesvirus 5
guugcacgggcucgggugacgg

SEQ ID NO: 118217 - RNA, 22 nt, Human herpesvirus 5
guuucgcggcagcgcaagccgu

SEQ ID NO: 118218 - RNA, 22 nt, Human herpesvirus 5
guuuuccgacuuagccuuuggu

SEQ ID NO: 118219 - RNA, 22 nt, Human herpesvirus 5
uaauauuccuuugaacgcugag

SEQ ID NO: 118220 - RNA, 22 nt, Human herpesvirus 5
uaccgcgagauccucuuucguu

SEQ ID NO: 118221 - RNA, 17 nt, Human herpesvirus 5
uacgccgcgacgcgugc

SEQ ID NO: 118222 - RNA, 22 nt, Human herpesvirus 5
uagaagaagcaccggcggccgc

SEQ ID NO: 118223 - RNA, 22 nt, Human herpesvirus 5
uaggcgcacgauggccaugcgc

SEQ ID NO: 118224 - RNA, 22 nt, Human herpesvirus 5
ucaucguuugggguguagaauu

SEQ ID NO: 118225 - RNA, 22 nt, Human herpesvirus 5
ucgccgcgauaacgacagguca

SEQ ID NO: 118226 - RNA, 22 nt, Human herpesvirus 5
ucgcggcggcucccucucggcg

SEQ ID NO: 118227 - RNA, 19 nt, Human herpesvirus 5
ucggcccgugccgggaccc

SEQ ID NO: 118228 - RNA, 22 nt, Human herpesvirus 5
ucggcgucagguaggcgcgcag

SEQ ID NO: 118229 - RNA, 22 nt, Human herpesvirus 5
ucugcgcggcgacagcugcuuu

SEQ ID NO: 118230 - RNA, 23 nt, Human herpesvirus 5
ugagcagcaaaacgaccagaauc

SEQ ID NO: 118231 - RNA, 22 nt, Human herpesvirus 5
ugauccugagaacgucaucuau

SEQ ID NO: 118232 - RNA, 22 nt, Human herpesvirus 5
ugaugcugugcaauaaaauuuu

SEQ ID NO: 118233 - RNA, 22 nt, Human herpesvirus 5
ugcccgucuacgcgguccacgg

SEQ ID NO: 118234 - RNA, 22 nt, Human herpesvirus 5
ugccugugucuaggcugcucuc

SEQ ID NO: 118235 - RNA, 22 nt, Human herpesvirus 5
uggcggguuccgagggcggucc

SEQ ID NO: 118236 - RNA, 22 nt, Human herpesvirus 5
uguacucaagagagcgauuggu

SEQ ID NO: 118237 - RNA, 22 nt, Human herpesvirus 5
ugucggagcugucggcgcuggg

SEQ ID NO: 118238 - RNA, 22 nt, Human herpesvirus 5
uguucgaugaucguauguuaca

SEQ ID NO: 118239 - RNA, 22 nt, Human herpesvirus 5
uuccaccgugguguaaccgcga

SEQ ID NO: 118240 - RNA, 22 nt, Human herpesvirus 5
uugcgcguuaaguugcaauuuu

SEQ ID NO: 118241 - RNA, 22 nt, Human herpesvirus 5
uuguuucgccgccggcgagcuc

SEQ ID NO: 118242 - RNA, 22 nt, Human herpesvirus 5
uuuguuggcggggcucacggug

SEQ ID NO: 118243 - RNA, 22 nt, Human herpesvirus 5
aaacucaacggggugcagcgcu

SEQ ID NO: 118244 - RNA, 22 nt, Human herpesvirus 5
aaaggcuaagucggaaaacucg

SEQ ID NO: 118245 - RNA, 22 nt, Human herpesvirus 5
aaaguuggcugcgcccguuggu

SEQ ID NO: 118246 - RNA, 22 nt, Human herpesvirus 5
aacgacguggacuuuugguuac

SEQ ID NO: 118247 - RNA, 22 nt, Human herpesvirus 5
aacgagcgcuguguggccgucu

SEQ ID NO: 118248 - RNA, 21 nt, Human herpesvirus 5
aacgcggcacaugggcggcgg

SEQ ID NO: 118249 - RNA, 19 nt, Human herpesvirus 5
aagaguucgauauuuugcg

SEQ ID NO: 118250 - RNA, 22 nt, Human herpesvirus 5
aaggauggcaacuuggacacgu

SEQ ID NO: 118251 - RNA, 22 nt, Human herpesvirus 5
acaccuccguuuugagcguguu

SEQ ID NO: 118252 - RNA, 22 nt, Human herpesvirus 5
acacggcaguuagagacuggag

SEQ ID NO: 118253 - RNA, 22 nt, Human herpesvirus 5
accagccguagccaaucccgau

SEQ ID NO: 118254 - RNA, 22 nt, Human herpesvirus 5
accaguucugcccucggugcau

SEQ ID NO: 118255 - RNA, 19 nt, Human herpesvirus 5
acgaggcuggugagcgcga

SEQ ID NO: 118256 - RNA, 22 nt, Human herpesvirus 5
acgccgggucgcaccgaggugg

SEQ ID NO: 118257 - RNA, 22 nt, Human herpesvirus 5
acgcggccccgcaccggcggug

SEQ ID NO: 118258 - RNA, 22 nt, Human herpesvirus 5
acgucagcgguggcgaaaccgc

SEQ ID NO: 118259 - RNA, 22 nt, Human herpesvirus 5
acgucgcgagaccugguguuug

SEQ ID NO: 118260 - RNA, 22 nt, Human herpesvirus 5
acguucaaccccauguuuuuca

SEQ ID NO: 118261 - RNA, 22 nt, Human herpesvirus 5
acuuggaacgccgcggcgcaca

SEQ ID NO: 118262 - RNA, 22 nt, Human herpesvirus 5
agacgcagugguccgucggugu

SEQ ID NO: 118263 - RNA, 22 nt, Human herpesvirus 5
agcagcgugugcaguucggcgu

SEQ ID NO: 118264 - RNA, 22 nt, Human herpesvirus 5
agccguguuuuuugcacaauuu

SEQ ID NO: 118265 - RNA, 22 nt, Human herpesvirus 5
agcggucguuuuaaccgcaggu

SEQ ID NO: 118266 - RNA, 22 nt, Human herpesvirus 5
aggaacuaucuucaucgggccg

SEQ ID NO: 118267 - RNA, 22 nt, Human herpesvirus 5
aggagagccuacagacgggacg

SEQ ID NO: 118268 - RNA, 22 nt, Human herpesvirus 5
aggccagaggcuaagccgaaac

SEQ ID NO: 118269 - RNA, 22 nt, Human herpesvirus 5
aggcgugccggcgcccauggcc

SEQ ID NO: 118270 - RNA, 22 nt, Human herpesvirus 5
agguugaaaaaccgcguaucug

SEQ ID NO: 118271 - RNA, 22 nt, Human herpesvirus 5
agguugcuguugcggcgcgagc

SEQ ID NO: 118272 - RNA, 21 nt, Human herpesvirus 5
aguggcaggcccggguucgcg

SEQ ID NO: 118273 - RNA, 22 nt, Human herpesvirus 5
auguccaccucgaaggugucgg

SEQ ID NO: 118274 - RNA, 22 nt, Human herpesvirus 5
augucgcagccggucuagcagg

SEQ ID NO: 118275 - RNA, 22 nt, Human herpesvirus 5
caacaccguaaagccguugcgc

SEQ ID NO: 118276 - RNA, 22 nt, Human herpesvirus 5
gguuugcuuccuauauagugga

SEQ ID NO: 118277 - RNA, 22 nt, Human herpesvirus 5
guaucggggcuccgacgccuua

SEQ ID NO: 118278 - RNA, 22 nt, Human herpesvirus 5
gucaacgguggcgacaccguac

SEQ ID NO: 118279 - RNA, 22 nt, Human herpesvirus 5
guccgcacagagguaacaacgu

SEQ ID NO: 118280 - RNA, 22 nt, Human herpesvirus 5
gucguaacgauucacggagcac

SEQ ID NO: 118281 - RNA, 22 nt, Human herpesvirus 5
gucucuggccggcgccagaccg

SEQ ID NO: 118282 - RNA, 22 nt, Human herpesvirus 5
gucugcaggacggcgcucguuc

SEQ ID NO: 118283 - RNA, 22 nt, Human herpesvirus 5
gugacguagcaauuaucguauu

SEQ ID NO: 118284 - RNA, 22 nt, Human herpesvirus 5
gugauccgccgaucgaugacca

SEQ ID NO: 118285 - RNA, 22 nt, Human herpesvirus 5
gugaucuacgaacugguguagg

SEQ ID NO: 118286 - RNA, 22 nt, Human herpesvirus 5
gugcaacagcccgugucgcgca

SEQ ID NO: 118287 - RNA, 22 nt, Human herpesvirus 5
guggaugagggcucuucacggu

SEQ ID NO: 118288 - RNA, 22 nt, Human herpesvirus 5
guggguucaugcugccuaucua

SEQ ID NO: 118289 - RNA, 22 nt, Human herpesvirus 5
guucccaggccgagaacgcgca

SEQ ID NO: 118290 - RNA, 22 nt, Human herpesvirus 5
guuguccuccucguccucgugg

SEQ ID NO: 118291 - RNA, 21 nt, Human herpesvirus 5
guuguuggccgacguagcgcc

SEQ ID NO: 118292 - RNA, 22 nt, Human herpesvirus 5
uaaccacguccagccccugcgu

SEQ ID NO: 118293 - RNA, 21 nt, Human herpesvirus 5
uacgacaucaccgaggcggag

SEQ ID NO: 118294 - RNA, 22 nt, Human herpesvirus 5
uacgauuucaaaaugugcaauc

SEQ ID NO: 118295 - RNA, 16 nt, Human herpesvirus 5
uacggaguuuucccuc

SEQ ID NO: 118296 - RNA, 22 nt, Human herpesvirus 5
uacguggcuauguuugccaguu

SEQ ID NO: 118297 - RNA, 22 nt, Human herpesvirus 5
uagcuccggcauggugcugccg

SEQ ID NO: 118298 - RNA, 17 nt, Human herpesvirus 5
uaguggggcccuugugu

SEQ ID NO: 118299 - RNA, 22 nt, Human herpesvirus 5
uccaaggaucggaaaguagcgu

SEQ ID NO: 118300 - RNA, 22 nt, Human herpesvirus 5
uccccguagccggccuacggcg

SEQ ID NO: 118301 - RNA, 18 nt, Human herpesvirus 5
ucgacucguccgagaccc

SEQ ID NO: 118302 - RNA, 22 nt, Human herpesvirus 5
ucgcaacagcagcucucggugc

SEQ ID NO: 118303 - RNA, 22 nt, Human herpesvirus 5
ucggaggcgugcucguaucccg

SEQ ID NO: 118304 - RNA, 22 nt, Human herpesvirus 5
ucggccuuaaggcggccgcgug

SEQ ID NO: 118305 - RNA, 22 nt, Human herpesvirus 5
ucgucacgcucaaggacaucga

SEQ ID NO: 118306 - RNA, 22 nt, Human herpesvirus 5
ucguuuccaccaggugaacuug

SEQ ID NO: 118307 - RNA, 22 nt, Human herpesvirus 5
ucguuuucagcaggaacccaug

SEQ ID NO: 118308 - RNA, 22 nt, Human herpesvirus 5
ucuaacuagccuucccgugaga

SEQ ID NO: 118309 - RNA, 20 nt, Human herpesvirus 5
ucuccacggaucaggccucg

SEQ ID NO: 118310 - RNA, 22 nt, Human herpesvirus 5
ucugcagcucgucggccggcgu

SEQ ID NO: 118311 - RNA, 22 nt, Human herpesvirus 5
ucuuuccaggugucuucaacga

SEQ ID NO: 118312 - RNA, 22 nt, Human herpesvirus 5
ugcgccgguacgccgggaaggu

SEQ ID NO: 118313 - RNA, 22 nt, Human herpesvirus 5
ugcguuccagccuggccgcgcg

SEQ ID NO: 118314 - RNA, 22 nt, Human herpesvirus 5
ugcucacggccacgggcugcug

SEQ ID NO: 118315 - RNA, 22 nt, Human herpesvirus 5
ugcuccgacugucggggcgcag

SEQ ID NO: 118316 - RNA, 22 nt, Human herpesvirus 5
uggacgccgccucugccggcuc

SEQ ID NO: 118317 - RNA, 22 nt, Human herpesvirus 5
uggcguggcgcacgcagcgacc

SEQ ID NO: 118318 - RNA, 23 nt, Human herpesvirus 5
uggggcaguuugagcagcccacc

SEQ ID NO: 118319 - RNA, 22 nt, Human herpesvirus 5
uguaaggaagcuuuuaucgugc

SEQ ID NO: 118320 - RNA, 22 nt, Human herpesvirus 5
ugugaucugggcagcggcugcg

SEQ ID NO: 118321 - RNA, 22 nt, Human herpesvirus 5
uguggcgccagcgaaccggcgg

SEQ ID NO: 118322 - RNA, 22 nt, Human herpesvirus 5
uucagcgucucauuugucuuua

SEQ ID NO: 118323 - RNA, 22 nt, Human herpesvirus 5
uuccuuuccuguuuuguacucg

SEQ ID NO: 118324 - RNA, 22 nt, Human herpesvirus 5
uugcgauagcgggccaucgcgu

SEQ ID NO: 118325 - RNA, 22 nt, Human herpesvirus 5
uuucucaucaaccugucgaugg

SEQ ID NO: 118326 - RNA, 22 nt, Human herpesvirus 5
uuuuuccacugggcggccgcac

SEQ ID NO: 118327 - RNA, 22 nt, Human herpesvirus 5
uuuuugugcuggaacuucccuc

SEQ ID NO: 118328 - RNA, 22 nt, Human herpesvirus 6
aaggacuaucugagacagucca

SEQ ID NO: 118329 - RNA, 22 nt, Human herpesvirus 6
aauguuaugaagaaguuaacua

SEQ ID NO: 118330 - RNA, 22 nt, Human herpesvirus 6
accguuucguugcaaaugacuu

SEQ ID NO: 118331 - RNA, 21 nt, Human herpesvirus 6
acuuagcagauauucuagauu

SEQ ID NO: 118332 - RNA, 22 nt, Human herpesvirus 6
augcuuuaccucuuuagugacu

SEQ ID NO: 118333 - RNA, 22 nt, Human herpesvirus 6
cacacacggcgugagacgccgc

SEQ ID NO: 118334 - RNA, 22 nt, Human herpesvirus 6
caggucggcaggguguacgcgg

SEQ ID NO: 118335 - RNA, 16 nt, Human herpesvirus 6
ccuggcgauuuucgau

SEQ ID NO: 118336 - RNA, 22 nt, Human herpesvirus 6
cggcggauggagcccgcucggu

SEQ ID NO: 118337 - RNA, 22 nt, Human herpesvirus 6
cggugugucauuggagaaauac

SEQ ID NO: 118338 - RNA, 22 nt, Human herpesvirus 6
gaagaucacuuuguuucugaac

SEQ ID NO: 118339 - RNA, 22 nt, Human herpesvirus 6
gcuucccaacacuuuaagauaa

SEQ ID NO: 118340 - RNA, 22 nt, Human herpesvirus 6
gggugucuaaacgagucuggag

SEQ ID NO: 118341 - RNA, 22 nt, Human herpesvirus 6
uaagcagccgcgaacucguuaa

SEQ ID NO: 118342 - RNA, 22 nt, Human herpesvirus 6
uaccuuuguuuugcagagaaaa

SEQ ID NO: 118343 - RNA, 22 nt, Human herpesvirus 6
uauaucgaauuaucuuugaagc

SEQ ID NO: 118344 - RNA, 23 nt, Human herpesvirus 6
ucgaaaucgcggaugaauugcgg

SEQ ID NO: 118345 - RNA, 22 nt, Human herpesvirus 6
ucuauuagauggcgauuugaag

SEQ ID NO: 118346 - RNA, 22 nt, Human herpesvirus 6
ugcgagaccgagcgggcuccau

SEQ ID NO: 118347 - RNA, 22 nt, Human herpesvirus 6
uguuguuuagcguggagauguu

SEQ ID NO: 118348 - RNA, 22 nt, Human herpesvirus 6
uuaucguugguguuagaguuag

SEQ ID NO: 118349 - RNA, 19 nt, Human herpesvirus 6
uucauuucugacgucugaa

SEQ ID NO: 118350 - RNA, 22 nt, Human herpesvirus 6
uuccuuuucaguauagacauuu

SEQ ID NO: 118351 - RNA, 22 nt, Human herpesvirus 6
uucucgguaaaaauuuggucca

SEQ ID NO: 118352 - RNA, 18 nt, Human herpesvirus 6
uuucaacagccugucuag

SEQ ID NO: 118353 - RNA, 22 nt, Human herpesvirus 6
gcgagcauaguuuaguggguau

SEQ ID NO: 118354 - RNA, 22 nt, Human herpesvirus 6
gggcggauaguaggaguggguc

SEQ ID NO: 118355 - RNA, 22 nt, Human herpesvirus 6
gugccuauugcugcuaugccug

SEQ ID NO: 118356 - RNA, 22 nt, Human herpesvirus 6
uagcuguguguuauaaggaaga

SEQ ID NO: 118357 - RNA, 22 nt, Human herpesvirus 6
uaucagaugacgcaucaacuuu

SEQ ID NO: 118358 - RNA, 22 nt, Human herpesvirus 6
uccguccucgucuguuaaugua

SEQ ID NO: 118359 - RNA, 22 nt, Human herpesvirus 6
ucucaucguaaucuuuguaggc

SEQ ID NO: 118360 - RNA, 22 nt, Human herpesvirus 6
ugcuuugccaguauaacuguuu

SEQ ID NO: 118361 - RNA, 22 nt, Human herpesvirus 6
uggaaugaugaacgguaagcga

SEQ ID NO: 118362 - RNA, 22 nt, Human herpesvirus 6
uuucaacagccugucuagaaau

SEQ ID NO: 118363 - RNA, 22 nt, Human herpesvirus 6
aaccgcgguacccacugaucuu

SEQ ID NO: 118364 - RNA, 22 nt, Human herpesvirus 6
aacugauacuguucaaguccuu

SEQ ID NO: 118365 - RNA, 23 nt, Human herpesvirus 6
aagaaaaacaggaacugcgguug

SEQ ID NO: 118366 - RNA, 22 nt, Human herpesvirus 6
aagcuguuaaauguaaauggaa

SEQ ID NO: 118367 - RNA, 22 nt, Human herpesvirus 6
acacgucgugcguuuugucuuc

SEQ ID NO: 118368 - RNA, 22 nt, Human herpesvirus 6
acguagaaaaucgucaauggug

SEQ ID NO: 118369 - RNA, 22 nt, Human herpesvirus 6
agccgaugacggccuccggccc

SEQ ID NO: 118370 - RNA, 18 nt, Human herpesvirus 6
aucgcaaaauugauacaa

SEQ ID NO: 118371 - RNA, 21 nt, Human herpesvirus 6
aucgcaaaauugauacaaacg

SEQ ID NO: 118372 - RNA, 22 nt, Human herpesvirus 6
caaauaguuguguuauaaaagg

SEQ ID NO: 118373 - RNA, 22 nt, Human herpesvirus 6
cgcguuucucuccacaucuccg

SEQ ID NO: 118374 - RNA, 22 nt, Human herpesvirus 6
cucuguuuggagacauacugua

SEQ ID NO: 118375 - RNA, 22 nt, Human herpesvirus 6
gaauaucaucccuaccgaugaa

SEQ ID NO: 118376 - RNA, 23 nt, Human herpesvirus 6
gagaaaaguaacacaggucuccc

SEQ ID NO: 118377 - RNA, 22 nt, Human herpesvirus 6
gaggugugauuuuagaagguag

SEQ ID NO: 118378 - RNA, 22 nt, Human herpesvirus 6
gcauucgacacauggaauuuac

SEQ ID NO: 118379 - RNA, 22 nt, Human herpesvirus 6
gcuaauaauuccauaaauguca

SEQ ID NO: 118380 - RNA, 22 nt, Human herpesvirus 6
ggcaccgugccaggccaccgug

SEQ ID NO: 118381 - RNA, 22 nt, Human herpesvirus 6
guacaaaugauuuaauuucgcu

SEQ ID NO: 118382 - RNA, 22 nt, Human herpesvirus 6
aaaaauaaggcaacgcccacca

SEQ ID NO: 118383 - RNA, 23 nt, Human herpesvirus 6
aaagucaccuguauagauuuauu

SEQ ID NO: 118384 - RNA, 22 nt, Human herpesvirus 6
aaucuggguuccugcuuaguua

SEQ ID NO: 118385 - RNA, 22 nt, Human herpesvirus 6
acggagcccgcuggguaucgcg

SEQ ID NO: 118386 - RNA, 22 nt, Human herpesvirus 6
acggcaccauuaauauguucgc

SEQ ID NO: 118387 - RNA, 23 nt, Human herpesvirus 6
acuuguuuuuaucggggcggauc

SEQ ID NO: 118388 - RNA, 22 nt, Human herpesvirus 6
agcggaaacuguaacggccacg

SEQ ID NO: 118389 - RNA, 22 nt, Human herpesvirus 6
agcugggugucgauacauauau

SEQ ID NO: 118390 - RNA, 22 nt, Human herpesvirus 6
aguaaauauuuaucugcaugua

SEQ ID NO: 118391 - RNA, 22 nt, Human herpesvirus 6
auuccguuugcguggcuagauc

SEQ ID NO: 118392 - RNA, 22 nt, Human herpesvirus 6
auugcgaggagacggagacgga

SEQ ID NO: 118393 - RNA, 22 nt, Human herpesvirus 6
auuuacuacaggauaaaacuuc

SEQ ID NO: 118394 - RNA, 22 nt, Human herpesvirus 6
ccguggugcgucucuccgauag

SEQ ID NO: 118395 - RNA, 22 nt, Human herpesvirus 6
ccuuuuuaauuucgaguauugu

SEQ ID NO: 118396 - RNA, 22 nt, Human herpesvirus 6
cgacagaugugugucuuccgau

SEQ ID NO: 118397 - RNA, 22 nt, Human herpesvirus 6
cggcgaggcggccggagagccg

SEQ ID NO: 118398 - RNA, 22 nt, Human herpesvirus 6
cggugguuaguuuuuggguaga

SEQ ID NO: 118399 - RNA, 22 nt, Human herpesvirus 6
cgugugcgugcgccggacucug

SEQ ID NO: 118400 - RNA, 22 nt, Human herpesvirus 6
gaauguuugggagaacugagga

SEQ ID NO: 118401 - RNA, 22 nt, Human herpesvirus 6
gaguaaaucgaacgauacuuac

SEQ ID NO: 118402 - RNA, 22 nt, Human herpesvirus 6
gauucucauuauaacgcagaca

SEQ ID NO: 118403 - RNA, 22 nt, Human herpesvirus 6
gcgcgugggccagucucgccuc

SEQ ID NO: 118404 - RNA, 22 nt, Human herpesvirus 6
gcuaucuucggcaaaaaguuuu

SEQ ID NO: 118405 - RNA, 22 nt, Human herpesvirus 6
ggcgucucacgccgugugugcg

SEQ ID NO: 118406 - RNA, 23 nt, Human herpesvirus 6
gguggcacgucgcgcgcgauguc

SEQ ID NO: 118407 - RNA, 22 nt, Human herpesvirus 6
uaugacuagggguauggcuagg

SEQ ID NO: 118408 - RNA, 22 nt, Human herpesvirus 6
uccgagaacucgagccauaguu

SEQ ID NO: 118409 - RNA, 22 nt, Human herpesvirus 6
ucgccguuuacuauuguaaaau

SEQ ID NO: 118410 - RNA, 22 nt, Human herpesvirus 6
ucuacaaaauagaauuuaacga

SEQ ID NO: 118411 - RNA, 22 nt, Human herpesvirus 6
ugccaauuuugagcaauauaag

SEQ ID NO: 118412 - RNA, 22 nt, Human herpesvirus 6
uuccgauagggaaacucuauuc

SEQ ID NO: 118413 - RNA, 22 nt, Human herpesvirus 6
uuccuggacauggugaaacuug

SEQ ID NO: 118414 - RNA, 22 nt, Human herpesvirus 6
uuuaaaucuaauauucaucggc

SEQ ID NO: 118415 - RNA, 22 nt, Human herpesvirus 6
uuuaagucguugugucaugauu

SEQ ID NO: 118416 - RNA, 22 nt, Human herpesvirus 6
acaaauucgguguuuuuaaugu

SEQ ID NO: 118417 - RNA, 22 nt, Human herpesvirus 6
acauuuaaucacgagucuccuu

SEQ ID NO: 118418 - RNA, 22 nt, Human herpesvirus 6
acuuuuuguccgaucacaucuu

SEQ ID NO: 118419 - RNA, 22 nt, Human herpesvirus 6
agacugggaaccgcggcagcau

SEQ ID NO: 118420 - RNA, 22 nt, Human herpesvirus 6
aucgagucuuuauauuuucggu

SEQ ID NO: 118421 - RNA, 22 nt, Human herpesvirus 6
aucgauaauccucgggccaggg

SEQ ID NO: 118422 - RNA, 22 nt, Human herpesvirus 6
aucgcaaaauugauacaaacgu

SEQ ID NO: 118423 - RNA, 21 nt, Human herpesvirus 6
auggugucguuuaauuucaca

SEQ ID NO: 118424 - RNA, 22 nt, Human herpesvirus 6
auuacuagaugguaaagcguug

SEQ ID NO: 118425 - RNA, 22 nt, Human herpesvirus 6
auucucauuugaaagcgauaga

SEQ ID NO: 118426 - RNA, 21 nt, Human herpesvirus 6
auucucucacagcaugaugac

SEQ ID NO: 118427 - RNA, 22 nt, Human herpesvirus 6
cagcgacaguaacggcggcggc

SEQ ID NO: 118428 - RNA, 22 nt, Human herpesvirus 6
cgacgcggcgucuccgacgagu

SEQ ID NO: 118429 - RNA, 20 nt, Human herpesvirus 6
cgcguguuugcaucagugac

SEQ ID NO: 118430 - RNA, 22 nt, Human herpesvirus 6
cggcgguugccuguauaggcag

SEQ ID NO: 118431 - RNA, 22 nt, Human herpesvirus 6
cuauauaugcaagccaugacaa

SEQ ID NO: 118432 - RNA, 22 nt, Human herpesvirus 6
cugauguagauauuuuaaaaau

SEQ ID NO: 118433 - RNA, 22 nt, Human herpesvirus 6
gauugauaaguuuccgacaugc

SEQ ID NO: 118434 - RNA, 22 nt, Human herpesvirus 6
gauuuucucagcaauuuggaaa

SEQ ID NO: 118435 - RNA, 22 nt, Human herpesvirus 6
gccgcagaguugcaagaaaugu

SEQ ID NO: 118436 - RNA, 22 nt, Human herpesvirus 6
guccgugugaacuggcacgagu

SEQ ID NO: 118437 - RNA, 22 nt, Human herpesvirus 6
gucgcucaugcggacagucaaa

SEQ ID NO: 118438 - RNA, 22 nt, Human herpesvirus 6
gugacggugcuccgaucagggg

SEQ ID NO: 118439 - RNA, 18 nt, Human herpesvirus 6
guuauggaacguauguag

SEQ ID NO: 118440 - RNA, 21 nt, Human herpesvirus 6
guuucgugucaguucuguggu

SEQ ID NO: 118441 - RNA, 22 nt, Human herpesvirus 6
ucaguuuauaucuucguaaugg

SEQ ID NO: 118442 - RNA, 22 nt, Human herpesvirus 6
ugagacaucgagauucuuuaaa

SEQ ID NO: 118443 - RNA, 22 nt, Human herpesvirus 6
ugcagaauaucaaaaacucaug

SEQ ID NO: 118444 - RNA, 22 nt, Human herpesvirus 6
uguccauuucguaucgaaugaa

SEQ ID NO: 118445 - RNA, 22 nt, Human herpesvirus 6
uuaggauucuauguggagccgu

SEQ ID NO: 118446 - RNA, 22 nt, Human herpesvirus 6
uucguuaacaauaauacgcagu

SEQ ID NO: 118447 - RNA, 22 nt, Human herpesvirus 6
uuuaccgguaauuggcaguuuu

SEQ ID NO: 118448 - RNA, 22 nt, Human herpesvirus 6
uuuagaauuaaggaauugguau

SEQ ID NO: 118449 - RNA, 22 nt, Human herpesvirus 6
uuucacgugcacgagaucuguu

SEQ ID NO: 118450 - RNA, 22 nt, Human herpesvirus 6
uuuggcgacuguuugaaauauu

SEQ ID NO: 118451 - RNA, 22 nt, Human herpesvirus 6B
acugcgaggacacguugcgcga

SEQ ID NO: 118452 - RNA, 23 nt, Human herpesvirus 6B
agaaaaacaggaacugcgguugc

SEQ ID NO: 118453 - RNA, 22 nt, Human herpesvirus 6B
agcaucgguuguguuagcuucg

SEQ ID NO: 118454 - RNA, 22 nt, Human herpesvirus 6B
aggcagggagggauacggucac

SEQ ID NO: 118455 - RNA, 21 nt, Human herpesvirus 6B
aguuggccaaaggagggccgg

SEQ ID NO: 118456 - RNA, 19 nt, Human herpesvirus 6B
auucucauuaguguuauuc

SEQ ID NO: 118457 - RNA, 22 nt, Human herpesvirus 6B
cauguaugcauuaacucugggu

SEQ ID NO: 118458 - RNA, 22 nt, Human herpesvirus 6B
ccucuuccuucucguaccccgg

SEQ ID NO: 118459 - RNA, 22 nt, Human herpesvirus 6B
gaagugcgggaguuucgccgag

SEQ ID NO: 118460 - RNA, 22 nt, Human herpesvirus 6B
gaaucugaagcguuuucacgau

SEQ ID NO: 118461 - RNA, 21 nt, Human herpesvirus 6B
gcauucgacauauggaauuua

SEQ ID NO: 118462 - RNA, 22 nt, Human herpesvirus 6B
ggcgaacaauuggauuuucaga

SEQ ID NO: 118463 - RNA, 22 nt, Human herpesvirus 6B
gggcuccggcuuccucuccguc

SEQ ID NO: 118464 - RNA, 22 nt, Human herpesvirus 6B
uaagaauuggugucauucgugg

SEQ ID NO: 118465 - RNA, 20 nt, Human herpesvirus 6B
ucgcaaauaccgaucaguuc

SEQ ID NO: 118466 - RNA, 22 nt, Human herpesvirus 6B
ucugaauguuuucauguaauuu

SEQ ID NO: 118467 - RNA, 22 nt, Human herpesvirus 6B
ucugcuggaggcucugcuggag

SEQ ID NO: 118468 - RNA, 22 nt, Human herpesvirus 6B
ugaaugucaucgagauaaucgu

SEQ ID NO: 118469 - RNA, 18 nt, Human herpesvirus 6B
uuucaacagccugucuag

SEQ ID NO: 118470 - RNA, 22 nt, Human herpesvirus 6B
uuugcucggagucccggagauc

SEQ ID NO: 118471 - RNA, 22 nt, Human herpesvirus 6B
ggcauucgaggccgcccucuau

SEQ ID NO: 118472 - RNA, 22 nt, Human herpesvirus 6B
uaaccgcgguacacacugaccu

SEQ ID NO: 118473 - RNA, 17 nt, Human herpesvirus 6B
uaaugaaugugcuuugg

SEQ ID NO: 118474 - RNA, 22 nt, Human herpesvirus 6B
uaguaaacauuugauucagugg

SEQ ID NO: 118475 - RNA, 22 nt, Human herpesvirus 6B
ucgcguuggcaucgggcgcugc

SEQ ID NO: 118476 - RNA, 22 nt, Human herpesvirus 6B
ucguaauacaacagaagcaaau

SEQ ID NO: 118477 - RNA, 22 nt, Human herpesvirus 6B
uggcgccgacccugccgcggca

SEQ ID NO: 118478 - RNA, 22 nt, Human herpesvirus 6B
aaagaacuggaaagaagcaucc

SEQ ID NO: 118479 - RNA, 22 nt, Human herpesvirus 6B
aagcuguuaaauguaaauggaa

SEQ ID NO: 118480 - RNA, 22 nt, Human herpesvirus 6B
acaucuaucgccgcucagaauu

SEQ ID NO: 118481 - RNA, 22 nt, Human herpesvirus 6B
acauuucugaagaugaucuccu

SEQ ID NO: 118482 - RNA, 22 nt, Human herpesvirus 6B
acggcuguuuuugcucucugua

SEQ ID NO: 118483 - RNA, 22 nt, Human herpesvirus 6B
caagcagucccgaucuaugcga

SEQ ID NO: 118484 - RNA, 22 nt, Human herpesvirus 6B
gaaguuuaccuagagauuacaa

SEQ ID NO: 118485 - RNA, 22 nt, Human herpesvirus 6B
gagaagauuggaaaaauaucca

SEQ ID NO: 118486 - RNA, 22 nt, Human herpesvirus 6B
ggaugacaccggcuauaaaagc

SEQ ID NO: 118487 - RNA, 22 nt, Human herpesvirus 6B
gggugucuaaaugagucuggag

SEQ ID NO: 118488 - RNA, 22 nt, Human herpesvirus 6B
guaucacguaucucugguaaau

SEQ ID NO: 118489 - RNA, 22 nt, Human herpesvirus 6B
ucccgcccucgucuguugcugu

SEQ ID NO: 118490 - RNA, 22 nt, Human herpesvirus 6B
ucgaacaacgcguuggcgaaau

SEQ ID NO: 118491 - RNA, 19 nt, Human herpesvirus 6B
uuuugcguuuauguuucaa

SEQ ID NO: 118492 - RNA, 22 nt, Human herpesvirus 6B
aaucuauuuugagaaaaguuac

SEQ ID NO: 118493 - RNA, 22 nt, Human herpesvirus 6B
aauucucauuuaaaagcgauag

SEQ ID NO: 118494 - RNA, 22 nt, Human herpesvirus 6B
cccggagaucuaaugggggaga

SEQ ID NO: 118495 - RNA, 22 nt, Human herpesvirus 6B
cugccaaaugcugaucugucuc

SEQ ID NO: 118496 - RNA, 22 nt, Human herpesvirus 6B
cuguaguucauggauuaccaau

SEQ ID NO: 118497 - RNA, 22 nt, Human herpesvirus 6B
cuucccuuugcguuucucacgg

SEQ ID NO: 118498 - RNA, 22 nt, Human herpesvirus 6B
gaucccgcucggagcucucuca

SEQ ID NO: 118499 - RNA, 22 nt, Human herpesvirus 6B
ggcuuuuuguucaguugauuau

SEQ ID NO: 118500 - RNA, 22 nt, Human herpesvirus 6B
gguggcgcgucgcgaagucccg

SEQ ID NO: 118501 - RNA, 19 nt, Human herpesvirus 6B
gguuccacuugugcacggu

SEQ ID NO: 118502 - RNA, 22 nt, Human herpesvirus 6B
guacaaaugauuuaauuucgcu

SEQ ID NO: 118503 - RNA, 22 nt, Human herpesvirus 6B
gucgaaaucgcggaugaauugc

SEQ ID NO: 118504 - RNA, 22 nt, Human herpesvirus 6B
uaugugugacguccgcaucaug

SEQ ID NO: 118505 - RNA, 23 nt, Human herpesvirus 6B
ucagcggugguggcggaggcggu

SEQ ID NO: 118506 - RNA, 22 nt, Human herpesvirus 6B
ucuuugaaggacuaucugagac

SEQ ID NO: 118507 - RNA, 22 nt, Human herpesvirus 6B
ugaaaauggcugaauaauauua

SEQ ID NO: 118508 - RNA, 22 nt, Human herpesvirus 6B
ugacuguguacauucgccgauu

SEQ ID NO: 118509 - RNA, 21 nt, Human herpesvirus 6B
uggcgccgacccugccgcggc

SEQ ID NO: 118510 - RNA, 22 nt, Human herpesvirus 6B
ugguuuuauaagcucaagaggg

SEQ ID NO: 118511 - RNA, 22 nt, Human herpesvirus 6B
uugaaacggagggcggaaagcg

SEQ ID NO: 118512 - RNA, 22 nt, Human herpesvirus 6B
uugcacagcagacaauguaaua

SEQ ID NO: 118513 - RNA, 18 nt, Human herpesvirus 6B
uuuauggccacuuuaucu

SEQ ID NO: 118514 - RNA, 22 nt, Human herpesvirus 6B
uuucggaaaaagaggaggguau

SEQ ID NO: 118515 - RNA, 22 nt, Human herpesvirus 6B
uuuuuacaagucgaucuuuggu

SEQ ID NO: 118516 - RNA, 22 nt, Human herpesvirus 6B
aaacgaucucgauucugugcag

SEQ ID NO: 118517 - RNA, 21 nt, Human herpesvirus 6B
acuuucacacgcauagauggg

SEQ ID NO: 118518 - RNA, 22 nt, Human herpesvirus 6B
agugucguucuaucuacucggg

SEQ ID NO: 118519 - RNA, 22 nt, Human herpesvirus 6B
aguugcauggugauguguuagc

SEQ ID NO: 118520 - RNA, 21 nt, Human herpesvirus 6B
auacgucucccaguucguuaa

SEQ ID NO: 118521 - RNA, 22 nt, Human herpesvirus 6B
auguuauugggagcauuggaaa

SEQ ID NO: 118522 - RNA, 22 nt, Human herpesvirus 6B
auuugguuggcaaacacugagc

SEQ ID NO: 118523 - RNA, 22 nt, Human herpesvirus 6B
caacgcggcagagucggcgcca

SEQ ID NO: 118524 - RNA, 21 nt, Human herpesvirus 6B
cuaugcuuuuguacucgcuua

SEQ ID NO: 118525 - RNA, 22 nt, Human herpesvirus 6B
cuuuauagaaaaugucucacga

SEQ ID NO: 118526 - RNA, 22 nt, Human herpesvirus 6B
gaguggccaagcguccccgggg

SEQ ID NO: 118527 - RNA, 22 nt, Human herpesvirus 6B
gcaggaagagggaguccaacaa

SEQ ID NO: 118528 - RNA, 22 nt, Human herpesvirus 6B
gcuccgcuugguuuuccguguc

SEQ ID NO: 118529 - RNA, 22 nt, Human herpesvirus 6B
ggagggauacggucacgcgcac

SEQ ID NO: 118530 - RNA, 22 nt, Human herpesvirus 7
aaacacaggaaaaauaguggug

SEQ ID NO: 118531 - RNA, 20 nt, Human herpesvirus 7
aauaugucucugauggucuc

SEQ ID NO: 118532 - RNA, 22 nt, Human herpesvirus 7
aaucuauggaugcaccaaacac

SEQ ID NO: 118533 - RNA, 22 nt, Human herpesvirus 7
acacugaaacauaguacaaggg

SEQ ID NO: 118534 - RNA, 22 nt, Human herpesvirus 7
acauuuguggccaggcaauuga

SEQ ID NO: 118535 - RNA, 22 nt, Human herpesvirus 7
auucagaagaugaaagauuucu

SEQ ID NO: 118536 - RNA, 22 nt, Human herpesvirus 7
auuugaagaacaagaggcacug

SEQ ID NO: 118537 - RNA, 22 nt, Human herpesvirus 7
cacuggagaaugucgaggucuu

SEQ ID NO: 118538 - RNA, 22 nt, Human herpesvirus 7
caugugaaauuggcauuaaugc

SEQ ID NO: 118539 - RNA, 22 nt, Human herpesvirus 7
cgaggggccuauuuauuaguau

SEQ ID NO: 118540 - RNA, 22 nt, Human herpesvirus 7
gaauggucuauuuuuuacucga

SEQ ID NO: 118541 - RNA, 22 nt, Human herpesvirus 7
gauauuuuggguaauaugucuu

SEQ ID NO: 118542 - RNA, 22 nt, Human herpesvirus 7
gcagggguaauaacagaacauu

SEQ ID NO: 118543 - RNA, 22 nt, Human herpesvirus 7
gcuguacagauagaaaucguuc

SEQ ID NO: 118544 - RNA, 22 nt, Human herpesvirus 7
ggccauggcaaugcuacgaguu

SEQ ID NO: 118545 - RNA, 22 nt, Human herpesvirus 7
guuguugucauuaaaagagauu

SEQ ID NO: 118546 - RNA, 22 nt, Human herpesvirus 7
uacauuuuuuacgaugacaaac

SEQ ID NO: 118547 - RNA, 21 nt, Human herpesvirus 7
uaugaagaguucuuguuugga

SEQ ID NO: 118548 - RNA, 22 nt, Human herpesvirus 7
ucaccgccauagauguccgaca

SEQ ID NO: 118549 - RNA, 22 nt, Human herpesvirus 7
ucagaacacaaucuuucggugu

SEQ ID NO: 118550 - RNA, 22 nt, Human herpesvirus 7
ucagagcugcuucuagaucugu

SEQ ID NO: 118551 - RNA, 23 nt, Human herpesvirus 7
ucagaugaucuucuugcagcgca

SEQ ID NO: 118552 - RNA, 22 nt, Human herpesvirus 7
ugauggaucugguguccuucuu

SEQ ID NO: 118553 - RNA, 22 nt, Human herpesvirus 7
uggucucuggaagcguggucug

SEQ ID NO: 118554 - RNA, 22 nt, Human herpesvirus 7
ugugauuauugcauuugcuuca

SEQ ID NO: 118555 - RNA, 22 nt, Human herpesvirus 7
uuauagacguggaauuucuugg

SEQ ID NO: 118556 - RNA, 22 nt, Human herpesvirus 7
uugaucagcgaauugggaauaa

SEQ ID NO: 118557 - RNA, 22 nt, Human herpesvirus 7
uugcaagaugcugaggauuuaa

SEQ ID NO: 118558 - RNA, 22 nt, Human herpesvirus 7
uuuaucccaccgguccuuccuc

SEQ ID NO: 118559 - RNA, 22 nt, Human herpesvirus 7
uuuggaagugcagaaaguuggu

SEQ ID NO: 118560 - RNA, 22 nt, Human herpesvirus 7
acaguuuauggacaauuuuggc

SEQ ID NO: 118561 - RNA, 22 nt, Human herpesvirus 7
acauaaaaagagagaugucuac

SEQ ID NO: 118562 - RNA, 22 nt, Human herpesvirus 7
accugucaaaaauugauuagua

SEQ ID NO: 118563 - RNA, 22 nt, Human herpesvirus 7
agaagcuaugaugccugugaau

SEQ ID NO: 118564 - RNA, 22 nt, Human herpesvirus 7
agucauuuucaaauagaguuua

SEQ ID NO: 118565 - RNA, 22 nt, Human herpesvirus 7
auauuucugaugaauagcuuuu

SEQ ID NO: 118566 - RNA, 22 nt, Human herpesvirus 7
aucuucuagaguuauugccgug

SEQ ID NO: 118567 - RNA, 22 nt, Human herpesvirus 7
augaacaauaucguuuauuuca

SEQ ID NO: 118568 - RNA, 22 nt, Human herpesvirus 7
augccaccgcuaacuacggugg

SEQ ID NO: 118569 - RNA, 22 nt, Human herpesvirus 7
auggagcaaauguuuuacuacg

SEQ ID NO: 118570 - RNA, 22 nt, Human herpesvirus 7
auuuaccucacuuucuucagua

SEQ ID NO: 118571 - RNA, 22 nt, Human herpesvirus 7
auuugcguuucgcuguugccaa

SEQ ID NO: 118572 - RNA, 22 nt, Human herpesvirus 7
cguagagagcauuagcauuaaa

SEQ ID NO: 118573 - RNA, 22 nt, Human herpesvirus 7
cugcaacuuuucuccgcguccg

SEQ ID NO: 118574 - RNA, 22 nt, Human herpesvirus 7
cuguggaaauaaauccgcuugc

SEQ ID NO: 118575 - RNA, 22 nt, Human herpesvirus 7
gacauugaaaaaaucugcuguu

SEQ ID NO: 118576 - RNA, 22 nt, Human herpesvirus 7
guacuaggucuuguucuagcuu

SEQ ID NO: 118577 - RNA, 22 nt, Human herpesvirus 7
uaacaacacgcuauccaaagau

SEQ ID NO: 118578 - RNA, 22 nt, Human herpesvirus 7
uagaggcagaccuaaacccaga

SEQ ID NO: 118579 - RNA, 22 nt, Human herpesvirus 7
ugaagcagguuaaagauauugu

SEQ ID NO: 118580 - RNA, 22 nt, Human herpesvirus 7
ugauaacaguugaaagccaaau

SEQ ID NO: 118581 - RNA, 19 nt, Human herpesvirus 7
uggacguaaacaggaaaga

SEQ ID NO: 118582 - RNA, 22 nt, Human herpesvirus 7
uggauuuagaugcagaucuaga

SEQ ID NO: 118583 - RNA, 22 nt, Human herpesvirus 7
ugucaucguaauaauggaaacu

SEQ ID NO: 118584 - RNA, 22 nt, Human herpesvirus 7
uugauuggaaaucaaaauucug

SEQ ID NO: 118585 - RNA, 22 nt, Human herpesvirus 7
uuuaagacauuauuugcugaac

SEQ ID NO: 118586 - RNA, 22 nt, Human herpesvirus 7
aaaaagauauuuuauauagauu

SEQ ID NO: 118587 - RNA, 22 nt, Human herpesvirus 7
aaauuuuagcuucacugaaaag

SEQ ID NO: 118588 - RNA, 22 nt, Human herpesvirus 7
aaucuauauguuguauuaaaau

SEQ ID NO: 118589 - RNA, 22 nt, Human herpesvirus 7
aauggcaacgguugagcaaauu

SEQ ID NO: 118590 - RNA, 22 nt, Human herpesvirus 7
agggaauugauuugguuaauca

SEQ ID NO: 118591 - RNA, 22 nt, Human herpesvirus 7
agucucagcaccgcggauuuac

SEQ ID NO: 118592 - RNA, 18 nt, Human herpesvirus 7
auaucuaaaguggagaca

SEQ ID NO: 118593 - RNA, 22 nt, Human herpesvirus 7
cagaaucuauuccacuugaauc

SEQ ID NO: 118594 - RNA, 22 nt, Human herpesvirus 7
caggggcuaucagaaacuuuca

SEQ ID NO: 118595 - RNA, 22 nt, Human herpesvirus 7
cauguaaguauugguuugcuca

SEQ ID NO: 118596 - RNA, 22 nt, Human herpesvirus 7
cguuguucaguuuuuauaaaug

SEQ ID NO: 118597 - RNA, 22 nt, Human herpesvirus 7
cugaaggcgcggcucuguugcg

SEQ ID NO: 118598 - RNA, 19 nt, Human herpesvirus 7
gaaguucacaucuguucuu

SEQ ID NO: 118599 - RNA, 22 nt, Human herpesvirus 7
gacagguguuguuuccgaucua

SEQ ID NO: 118600 - RNA, 22 nt, Human herpesvirus 7
gagugcagaaaugcuccgcgcu

SEQ ID NO: 118601 - RNA, 22 nt, Human herpesvirus 7
gcucugaagauggguuguuauc

SEQ ID NO: 118602 - RNA, 22 nt, Human herpesvirus 7
gcuguucgugcuucacaguguu

SEQ ID NO: 118603 - RNA, 22 nt, Human herpesvirus 7
ggguuagggccgcagcccuagg

SEQ ID NO: 118604 - RNA, 22 nt, Human herpesvirus 7
guugaauauauacgcuuaaaau

SEQ ID NO: 118605 - RNA, 22 nt, Human herpesvirus 7
uaagcaauguagauauagugga

SEQ ID NO: 118606 - RNA, 22 nt, Human herpesvirus 7
uacgcuuuuuucgaguccaucg

SEQ ID NO: 118607 - RNA, 22 nt, Human herpesvirus 7
uagaaucaucaaugcuucaucg

SEQ ID NO: 118608 - RNA, 22 nt, Human herpesvirus 7
uagaugauacuuuugucaguuc

SEQ ID NO: 118609 - RNA, 22 nt, Human herpesvirus 7
uauagacauuucguuauuccau

SEQ ID NO: 118610 - RNA, 22 nt, Human herpesvirus 7
uccuucuugagaugcccaagga

SEQ ID NO: 118611 - RNA, 23 nt, Human herpesvirus 7
ucuaaaaauaucuauuugcuuau

SEQ ID NO: 118612 - RNA, 19 nt, Human herpesvirus 7
ucucuguguuuaccucacc

SEQ ID NO: 118613 - RNA, 22 nt, Human herpesvirus 7
ugccauugaaugcguuggaaau

SEQ ID NO: 118614 - RNA, 22 nt, Human herpesvirus 7
uggagggaauagacgauuauca

SEQ ID NO: 118615 - RNA, 22 nt, Human herpesvirus 7
ugucauaaauuuuaguugccgu

SEQ ID NO: 118616 - RNA, 22 nt, Human herpesvirus 7
ugugcucuggcgucucgauagg

SEQ ID NO: 118617 - RNA, 22 nt, Human herpesvirus 7
uucaggaaaaacgguguuguaa

SEQ ID NO: 118618 - RNA, 22 nt, Human herpesvirus 7
uucaugcucaucgucuccaagc

SEQ ID NO: 118619 - RNA, 22 nt, Human herpesvirus 7
uuccuauguguguaugaugaua

SEQ ID NO: 118620 - RNA, 22 nt, Human herpesvirus 7
uugacgguggaaaguucgacag

SEQ ID NO: 118621 - RNA, 22 nt, Human herpesvirus 7
uuggagucguucuauguaugaa

SEQ ID NO: 118622 - RNA, 22 nt, Human herpesvirus 7
aaauacuguguucugaauuuga

SEQ ID NO: 118623 - RNA, 22 nt, Human herpesvirus 7
aagacguauuggucaauauaau

SEQ ID NO: 118624 - RNA, 22 nt, Human herpesvirus 7
aaguugggacaaugcuuagaau

SEQ ID NO: 118625 - RNA, 22 nt, Human herpesvirus 7
accagguuaugcaauuuuuacc

SEQ ID NO: 118626 - RNA, 22 nt, Human herpesvirus 7
agaguuucgaauccuuuuaagc

SEQ ID NO: 118627 - RNA, 22 nt, Human herpesvirus 7
auccaaaucucagauauugcgu

SEQ ID NO: 118628 - RNA, 22 nt, Human herpesvirus 7
auucacaggcaucauagcuucu

SEQ ID NO: 118629 - RNA, 20 nt, Human herpesvirus 7
auuucuucaaaauugcuauu

SEQ ID NO: 118630 - RNA, 22 nt, Human herpesvirus 7
guuaggguuagggccgcagccc

SEQ ID NO: 118631 - RNA, 22 nt, Human herpesvirus 7
uaaauuccauuuauaguuacaa

SEQ ID NO: 118632 - RNA, 22 nt, Human herpesvirus 7
uaauuucugguauggaauuggc

SEQ ID NO: 118633 - RNA, 22 nt, Human herpesvirus 7
uacaugagacagucaggugagu

SEQ ID NO: 118634 - RNA, 22 nt, Human herpesvirus 7
uaggcugcauuguaaaauucga

SEQ ID NO: 118635 - RNA, 22 nt, Human herpesvirus 7
uauauuuccagacauauuguaa

SEQ ID NO: 118636 - RNA, 22 nt, Human herpesvirus 7
ucaaauguuugcauuguguuuc

SEQ ID NO: 118637 - RNA, 22 nt, Human herpesvirus 7
ucugugguugcagcagucauag

SEQ ID NO: 118638 - RNA, 22 nt, Human herpesvirus 7
ugauauuuuuaacacaauggca

SEQ ID NO: 118639 - RNA, 22 nt, Human herpesvirus 7
uugaaucaacugcauaaauucg

SEQ ID NO: 118640 - RNA, 21 nt, Human herpesvirus 7
aaaaagauugugagcaauuua

SEQ ID NO: 118641 - RNA, 22 nt, Human herpesvirus 7
aagaggaauagcacgucgcgga

SEQ ID NO: 118642 - RNA, 22 nt, Human herpesvirus 7
aaucaaguauuucagucuguag

SEQ ID NO: 118643 - RNA, 22 nt, Human herpesvirus 7
acaguaaguaaaaaugguuaca

SEQ ID NO: 118644 - RNA, 22 nt, Human herpesvirus 8 [Kaposi`s sarcoma-associated h
accgcaccaaaaauggcgucug

SEQ ID NO: 118645 - RNA, 22 nt, Human herpesvirus 8 [Kaposi`s sarcoma-associated h
agccuggacgauguacuugaac

SEQ ID NO: 118646 - RNA, 22 nt, Human herpesvirus 8 [Kaposi`s sarcoma-associated h
agucccgacuaaugaggacaau

SEQ ID NO: 118647 - RNA, 19 nt, Human herpesvirus 8 [Kaposi`s sarcoma-associated h
caaccuaaccuagugcugc

SEQ ID NO: 118648 - RNA, 22 nt, Human herpesvirus 8 [Kaposi`s sarcoma-associated h
caaucacgggaggcuugguggc

SEQ ID NO: 118649 - RNA, 22 nt, Human herpesvirus 8 [Kaposi`s sarcoma-associated h
cacccugauaucgacggccucg

SEQ ID NO: 118650 - RNA, 22 nt, Human herpesvirus 8 [Kaposi`s sarcoma-associated h
cagcaccagcuucugucggugu

SEQ ID NO: 118651 - RNA, 22 nt, Human herpesvirus 8 [Kaposi`s sarcoma-associated h
cagggggugucuccgucugcuc

SEQ ID NO: 118652 - RNA, 22 nt, Human herpesvirus 8 [Kaposi`s sarcoma-associated h
ccggggaugugaugaaguuggg

SEQ ID NO: 118653 - RNA, 22 nt, Human herpesvirus 8 [Kaposi`s sarcoma-associated h
cgaggaauaggcagcagaggca

SEQ ID NO: 118654 - RNA, 16 nt, Human herpesvirus 8 [Kaposi`s sarcoma-associated h
cgcccgagcugucguu

SEQ ID NO: 118655 - RNA, 22 nt, Human herpesvirus 8 [Kaposi`s sarcoma-associated h
guccaccauuccuccggugacu

SEQ ID NO: 118656 - RNA, 22 nt, Human herpesvirus 8 [Kaposi`s sarcoma-associated h
uguuuuuuguacuacagcucuc

SEQ ID NO: 118657 - RNA, 21 nt, Human herpesvirus 8 [Kaposi`s sarcoma-associated h
cggauuccauccguggugccc

SEQ ID NO: 118658 - RNA, 22 nt, Human herpesvirus 8 [Kaposi`s sarcoma-associated h
cuugugcacacggcccguaugg

SEQ ID NO: 118659 - RNA, 22 nt, Human herpesvirus 8 [Kaposi`s sarcoma-associated h
ggggacugucauccuguugguc

SEQ ID NO: 118660 - RNA, 22 nt, Human herpesvirus 8 [Kaposi`s sarcoma-associated h
gggucuccugcggaggccaaua

SEQ ID NO: 118661 - RNA, 22 nt, Human herpesvirus 8 [Kaposi`s sarcoma-associated h
ucuaaaucccagcaugccagau

SEQ ID NO: 118662 - RNA, 22 nt, Human herpesvirus 8 [Kaposi`s sarcoma-associated h
uggcgcuggaagaaggcugucg

SEQ ID NO: 118663 - RNA, 22 nt, Human herpesvirus 8 [Kaposi`s sarcoma-associated h
uguccaccggacgaguggcgcg

SEQ ID NO: 118664 - RNA, 22 nt, Human herpesvirus 8 [Kaposi`s sarcoma-associated h
cgccucagcgaggaccugcgca

SEQ ID NO: 118665 - RNA, 22 nt, Human herpesvirus 8 [Kaposi`s sarcoma-associated h
gacgauguggcucgggugaaug

SEQ ID NO: 118666 - RNA, 22 nt, Human herpesvirus 8 [Kaposi`s sarcoma-associated h
gacgguggacaugaucagggug

SEQ ID NO: 118667 - RNA, 22 nt, Human herpesvirus 8 [Kaposi`s sarcoma-associated h
gcaguuagacaccguuaucucc

SEQ ID NO: 118668 - RNA, 22 nt, Human herpesvirus 8 [Kaposi`s sarcoma-associated h
gcaucuuugacgagcgugacua

SEQ ID NO: 118669 - RNA, 22 nt, Human herpesvirus 8 [Kaposi`s sarcoma-associated h
gcuaccgacggacguauuccug

SEQ ID NO: 118670 - RNA, 22 nt, Human herpesvirus 8 [Kaposi`s sarcoma-associated h
uccagggucaccgccucacucu

SEQ ID NO: 118671 - RNA, 19 nt, Human herpesvirus 8 [Kaposi`s sarcoma-associated h
agggcggguuauuggcagu

SEQ ID NO: 118672 - RNA, 22 nt, Human herpesvirus 8 [Kaposi`s sarcoma-associated h
auuguaaaagauccgauccuca

SEQ ID NO: 118673 - RNA, 22 nt, Human herpesvirus 8 [Kaposi`s sarcoma-associated h
gauggccuugaagucuauguuu

SEQ ID NO: 118674 - RNA, 22 nt, Human herpesvirus 8 [Kaposi`s sarcoma-associated h
ggacaucgccguggaccccgga

SEQ ID NO: 118675 - RNA, 22 nt, Human herpesvirus 8 [Kaposi`s sarcoma-associated h
ggugccccuaaagaccgucugu

SEQ ID NO: 118676 - RNA, 22 nt, Human herpesvirus 8 [Kaposi`s sarcoma-associated h
uccaggucagagagcagggaug

SEQ ID NO: 118677 - RNA, 22 nt, Human herpesvirus 8 [Kaposi`s sarcoma-associated h
uccguggcaguggcagcauguu

SEQ ID NO: 118678 - RNA, 22 nt, Human herpesvirus 8 [Kaposi`s sarcoma-associated h
uggcugcgcaguccaagggcga

SEQ ID NO: 118679 - RNA, 22 nt, Human herpesvirus 8 [Kaposi`s sarcoma-associated h
cacaucagcuuguccugugggg

SEQ ID NO: 118680 - RNA, 22 nt, Human metapneumovirus
caucgccuaccuccaguguaaa

SEQ ID NO: 118681 - RNA, 22 nt, Human metapneumovirus
ggcauaugaagagucauuuuca

SEQ ID NO: 118682 - RNA, 22 nt, Human parainfluenza virus 1 strain Washington/1964
uucuauacaguuugugacaucu

SEQ ID NO: 118683 - RNA, 22 nt, Human parainfluenza virus 1 strain Washington/1964
uuggcacuuucguucauggagg

SEQ ID NO: 118684 - RNA, 22 nt, Human parainfluenza virus 1 strain Washington/1964
uaaugggugucauuauugagga

SEQ ID NO: 118685 - RNA, 22 nt, Human parainfluenza virus 1 strain Washington/1964
uccuccugauuuucccgaugcu

SEQ ID NO: 118686 - RNA, 22 nt, Human parainfluenza virus 1 strain Washington/1964
auugauaugaauuauuggucug

SEQ ID NO: 118687 - RNA, 22 nt, Human parainfluenza virus 2
acaagggaugcuuucucugcuc

SEQ ID NO: 118688 - RNA, 22 nt, Human parainfluenza virus 2
auugaauugaagaugcaagauu

SEQ ID NO: 118689 - RNA, 21 nt, Human parainfluenza virus 3
ucguuuuguucugggauuagu

SEQ ID NO: 118690 - RNA, 22 nt, Human parainfluenza virus 3
aagcauauugaauuauagauga

SEQ ID NO: 118691 - RNA, 22 nt, Human parechovirus 2
aaugcuuuagguuauuuacugu

SEQ ID NO: 118692 - RNA, 22 nt, Human parechovirus 2
ccaaauuucuucuuucccuuac

SEQ ID NO: 118693 - RNA, 23 nt, Human parechovirus 2
guaaauauagaggagauuuggca

SEQ ID NO: 118694 - RNA, 22 nt, Human parechovirus 2
aaggauaugguacuaucaguau

SEQ ID NO: 118695 - RNA, 21 nt, Human parechovirus 2
auagagauauuccuuagcuug

SEQ ID NO: 118696 - RNA, 22 nt, Human parechovirus 2
auuacaaagugaauucagaacu

SEQ ID NO: 118697 - RNA, 22 nt, Human parechovirus 2
cacgcaaggacgaaccaccauc

SEQ ID NO: 118698 - RNA, 22 nt, Human respiratory syncytial virus
acugaucaaaaaucaucaagug

SEQ ID NO: 118699 - RNA, 22 nt, Human respiratory syncytial virus
augacacuauagcuccaagaga

SEQ ID NO: 118700 - RNA, 22 nt, Human respiratory syncytial virus
aauuguuugaauacauuaaaua

SEQ ID NO: 118701 - RNA, 22 nt, Human respiratory syncytial virus
cccuuuauugauucuaggaauu

SEQ ID NO: 118702 - RNA, 22 nt, Human respiratory syncytial virus
cucaucuuauagauguuuuugu

SEQ ID NO: 118703 - RNA, 22 nt, Human respiratory syncytial virus
cuugguaaugucaaacuguuca

SEQ ID NO: 118704 - RNA, 22 nt, Human respiratory syncytial virus
uggacuguacuuuacaaguguc

SEQ ID NO: 118705 - RNA, 22 nt, Human respiratory syncytial virus
uucuuaggaucuuuggaugaug

SEQ ID NO: 118706 - RNA, 22 nt, Human respiratory syncytial virus
auuuuuguuggaugcagugcau

SEQ ID NO: 118707 - RNA, 22 nt, Human respiratory syncytial virus
ucacugagcaugauaaagguua

SEQ ID NO: 118708 - RNA, 22 nt, Human rhinovirus 89
cauuuguuccugauugccaugu

SEQ ID NO: 118709 - RNA, 22 nt, Human rhinovirus B
uggccauucagcauaacacaca

SEQ ID NO: 118710 - RNA, 19 nt, Human T-lymphotropic virus 1
guccaggccugacaagccc

SEQ ID NO: 118711 - RNA, 22 nt, Human T-lymphotropic virus 1
ggguuuuuuaggcuggacaacu

SEQ ID NO: 118712 - RNA, 22 nt, Human T-lymphotropic virus 2
ccacggcaguuauguuguagag

SEQ ID NO: 118713 - RNA, 22 nt, Human T-lymphotropic virus 2
ugagggugguaguaauggcauu

SEQ ID NO: 118714 - RNA, 22 nt, Human T-lymphotropic virus 2
uuuggcggaggauacaggggcc

SEQ ID NO: 118715 - RNA, 22 nt, Human T-lymphotropic virus 2
cucaugggguugaggacggcug

SEQ ID NO: 118716 - RNA, 22 nt, Human T-lymphotropic virus 2
cgguuuuguaaccgcuguggaa

SEQ ID NO: 118717 - RNA, 21 nt, Human T-lymphotropic virus 2
uaacgcauggaguuguugugg

SEQ ID NO: 118718 - RNA, 21 nt, Human T-lymphotropic virus 2
uauagggauuguagguguuug

SEQ ID NO: 118719 - RNA, 22 nt, Human T-lymphotropic virus 2
ucuguaaggucagcuggauaaa

SEQ ID NO: 118720 - RNA, 22 nt, Human T-lymphotropic virus 2
aaugaaccuccauuuaccauuu

SEQ ID NO: 118721 - RNA, 22 nt, Human T-lymphotropic virus 2
caagcucuugggucccgguacc

SEQ ID NO: 118722 - RNA, 22 nt, Human T-lymphotropic virus 2
uauccacgcaaaccaugcagga

SEQ ID NO: 118723 - RNA, 22 nt, Influenza A virus
acaggcauucaaaugggacugu

SEQ ID NO: 118724 - RNA, 22 nt, Influenza A virus
uccuggaagagaaggcaauggu

SEQ ID NO: 118725 - RNA, 22 nt, Influenza B virus
agauuagguaguugucugauuu

SEQ ID NO: 118726 - RNA, 22 nt, Japanese encephalitis virus
caccaccauggccaugacugac

SEQ ID NO: 118727 - RNA, 22 nt, Japanese encephalitis virus
uggcucgagcgagcaugcggug

SEQ ID NO: 118728 - RNA, 22 nt, Japanese encephalitis virus
aagcucaugagcaaaccuuggg

SEQ ID NO: 118729 - RNA, 22 nt, Japanese encephalitis virus
aggagguccuucgcaagaggug

SEQ ID NO: 118730 - RNA, 22 nt, Japanese encephalitis virus
cuuccucaccaccagcuacaua

SEQ ID NO: 118731 - RNA, 22 nt, Japanese encephalitis virus
uagcugguggugaggaagaaca

SEQ ID NO: 118732 - RNA, 22 nt, Japanese encephalitis virus
uaguagcugauguugagauaga

SEQ ID NO: 118733 - RNA, 22 nt, Japanese encephalitis virus
accaguccauugggcaugugua

SEQ ID NO: 118734 - RNA, 23 nt, Japanese encephalitis virus
ugccucuguccaaugggcuaggu

SEQ ID NO: 118735 - RNA, 22 nt, Marburg virus
gacccugaaccggauguuauga

SEQ ID NO: 118736 - RNA, 22 nt, Marburg virus
ggagcacauguuugauucuucg

SEQ ID NO: 118737 - RNA, 22 nt, Marburg virus
ucaucaucauuguuugggucug

SEQ ID NO: 118738 - RNA, 22 nt, Marburg virus
ugaagagcaccgaagcauccag

SEQ ID NO: 118739 - RNA, 22 nt, Measles virus
aacaucaugguggauuaauucu

SEQ ID NO: 118740 - RNA, 22 nt, Measles virus
auagaguuaagcaauccaucuu

SEQ ID NO: 118741 - RNA, 22 nt, Measles virus
gcaguuauugaggagaguuaua

SEQ ID NO: 118742 - RNA, 22 nt, Measles virus
gugccugcucuucugccaucgg

SEQ ID NO: 118743 - RNA, 22 nt, Measles virus
guugacucuuugucuucuaugu

SEQ ID NO: 118744 - RNA, 22 nt, Measles virus
uuugcagccaucaguuccucaa

SEQ ID NO: 118745 - RNA, 22 nt, Measles virus
aaguuguugccucuggauugga

SEQ ID NO: 118746 - RNA, 22 nt, Measles virus
acccuucaccugaagcuugagc

SEQ ID NO: 118747 - RNA, 22 nt, Measles virus
ucuucacauuagaagcacaggc

SEQ ID NO: 118748 - RNA, 22 nt, Measles virus
uggggccaaauaaugacaggau

SEQ ID NO: 118749 - RNA, 22 nt, Measles virus
acucuggaggagcagaugcaag

SEQ ID NO: 118750 - RNA, 19 nt, Measles virus
auuuggccccagcuuacgg

SEQ ID NO: 118751 - RNA, 22 nt, Measles virus
uccccuccuucugcaguuucaa

SEQ ID NO: 118752 - RNA, 22 nt, Measles virus
ucugucauuguggaacuuagga

SEQ ID NO: 118753 - RNA, 22 nt, Measles virus
acuguucucaguagucuccugu

SEQ ID NO: 118754 - RNA, 22 nt, Measles virus
auauggaauaugagagugggcc

SEQ ID NO: 118755 - RNA, 22 nt, Measles virus
aucugagcaauuugagcccuag

SEQ ID NO: 118756 - RNA, 23 nt, Measles virus
auuacaucuucacgucgaaacag

SEQ ID NO: 118757 - RNA, 22 nt, Measles virus
cugguuuuugcacuugguggga

SEQ ID NO: 118758 - RNA, 20 nt, Measles virus
gcagcaugcagggggagggu

SEQ ID NO: 118759 - RNA, 22 nt, Measles virus
uccuaaguuuuuuauaauggau

SEQ ID NO: 118760 - RNA, 22 nt, Molluscum contagiosum virus
aacucgcucgcuuagggagccc

SEQ ID NO: 118761 - RNA, 22 nt, Molluscum contagiosum virus
aagcacagcaggagcacgccug

SEQ ID NO: 118762 - RNA, 22 nt, Molluscum contagiosum virus
aaggcgucgggagcaccgucag

SEQ ID NO: 118763 - RNA, 22 nt, Molluscum contagiosum virus
aaguacuucucgauguugggaa

SEQ ID NO: 118764 - RNA, 22 nt, Molluscum contagiosum virus
aaugcgaggcgcgacuggcaca

SEQ ID NO: 118765 - RNA, 22 nt, Molluscum contagiosum virus
accuugucacugucgcgacaac

SEQ ID NO: 118766 - RNA, 22 nt, Molluscum contagiosum virus
acggcguacacaacuuccgcgu

SEQ ID NO: 118767 - RNA, 22 nt, Molluscum contagiosum virus
acgggcucccuaagcgagcgag

SEQ ID NO: 118768 - RNA, 20 nt, Molluscum contagiosum virus
acguacacgccgcacauugc

SEQ ID NO: 118769 - RNA, 22 nt, Molluscum contagiosum virus
agacacgcgcgcgugccugacg

SEQ ID NO: 118770 - RNA, 22 nt, Molluscum contagiosum virus
agaucgcgaucuugaaggagua

SEQ ID NO: 118771 - RNA, 22 nt, Molluscum contagiosum virus
agcaauucgcuuugcagcccgc

SEQ ID NO: 118772 - RNA, 22 nt, Molluscum contagiosum virus
agcacuucuccgaugggucggu

SEQ ID NO: 118773 - RNA, 22 nt, Molluscum contagiosum virus
agcccgucuacauuuugcggcg

SEQ ID NO: 118774 - RNA, 22 nt, Molluscum contagiosum virus
agcgaauauggaccuugcacgc

SEQ ID NO: 118775 - RNA, 22 nt, Molluscum contagiosum virus
agcgggcgcgccacucccuguc

SEQ ID NO: 118776 - RNA, 22 nt, Molluscum contagiosum virus
agcgguguugcugacgacugcg

SEQ ID NO: 118777 - RNA, 22 nt, Molluscum contagiosum virus
aggugcucgaugagaguucgcg

SEQ ID NO: 118778 - RNA, 22 nt, Molluscum contagiosum virus
aucagcgcgaucucgaucgaac

SEQ ID NO: 118779 - RNA, 22 nt, Molluscum contagiosum virus
auguuggccagguagguguucu

SEQ ID NO: 118780 - RNA, 22 nt, Molluscum contagiosum virus
cacgacggcggguucucguccc

SEQ ID NO: 118781 - RNA, 22 nt, Molluscum contagiosum virus
cacgcuagucguuggcgcgccc

SEQ ID NO: 118782 - RNA, 22 nt, Molluscum contagiosum virus
cacgggcgcggagaacugcacc

SEQ ID NO: 118783 - RNA, 22 nt, Molluscum contagiosum virus
cagacgcgacaccuuccgagcc

SEQ ID NO: 118784 - RNA, 22 nt, Molluscum contagiosum virus
cagcacgcgcagcguguccaug

SEQ ID NO: 118785 - RNA, 22 nt, Molluscum contagiosum virus
caucuucuugaugaucuugcgc

SEQ ID NO: 118786 - RNA, 22 nt, Molluscum contagiosum virus
ccaggccugggcuucggaagcg

SEQ ID NO: 118787 - RNA, 22 nt, Molluscum contagiosum virus
ccugcacguucacgcgcuccag

SEQ ID NO: 118788 - RNA, 22 nt, Molluscum contagiosum virus
ccugcagcagcaaugugcacac

SEQ ID NO: 118789 - RNA, 22 nt, Molluscum contagiosum virus
ccugcggggugccuuuccugcg

SEQ ID NO: 118790 - RNA, 22 nt, Molluscum contagiosum virus
cgacgccuucugagcccgagcu

SEQ ID NO: 118791 - RNA, 22 nt, Molluscum contagiosum virus
cgcggcacgccuucgucagcuu

SEQ ID NO: 118792 - RNA, 17 nt, Molluscum contagiosum virus
cgcguacguguccaugc

SEQ ID NO: 118793 - RNA, 22 nt, Molluscum contagiosum virus
cgcuggugucgcuuccaugggc

SEQ ID NO: 118794 - RNA, 22 nt, Molluscum contagiosum virus
cggcgcgucgagcuugggcgug

SEQ ID NO: 118795 - RNA, 22 nt, Molluscum contagiosum virus
cguaagccaccgcgcaggaccg

SEQ ID NO: 118796 - RNA, 22 nt, Molluscum contagiosum virus
cgucugcuuuugcgucgcgcgu

SEQ ID NO: 118797 - RNA, 22 nt, Molluscum contagiosum virus
cuacgugcuggaacaggugcac

SEQ ID NO: 118798 - RNA, 22 nt, Molluscum contagiosum virus
cucgggcggguuguuggcgugg

SEQ ID NO: 118799 - RNA, 22 nt, Molluscum contagiosum virus
cucugugucggaauccucgcgg

SEQ ID NO: 118800 - RNA, 22 nt, Molluscum contagiosum virus
cugccgcggggcuagcgcugca

SEQ ID NO: 118801 - RNA, 22 nt, Molluscum contagiosum virus
cugugcccgaguagaagagcgu

SEQ ID NO: 118802 - RNA, 22 nt, Molluscum contagiosum virus
cugugcgcgcaggccacggggu

SEQ ID NO: 118803 - RNA, 22 nt, Molluscum contagiosum virus
gaaguccagcacgcgcgcgugc

SEQ ID NO: 118804 - RNA, 17 nt, Molluscum contagiosum virus
gacggaaugcgagcgcc

SEQ ID NO: 118805 - RNA, 22 nt, Molluscum contagiosum virus
gacguccugcgccaugcgcagu

SEQ ID NO: 118806 - RNA, 22 nt, Molluscum contagiosum virus
gacugcuucguuuucgaccugg

SEQ ID NO: 118807 - RNA, 22 nt, Molluscum contagiosum virus
gagcacgugcgccgcuucgagg

SEQ ID NO: 118808 - RNA, 22 nt, Molluscum contagiosum virus
gagugucgcgaccguagaagau

SEQ ID NO: 118809 - RNA, 22 nt, Molluscum contagiosum virus
gaugcucauggacgcgcucggg

SEQ ID NO: 118810 - RNA, 22 nt, Molluscum contagiosum virus
gcagcauuuuggugggcacgca

SEQ ID NO: 118811 - RNA, 22 nt, Molluscum contagiosum virus
gcccuuugccacggcgagucac

SEQ ID NO: 118812 - RNA, 22 nt, Molluscum contagiosum virus
gcgcaagacgaguagugcgcga

SEQ ID NO: 118813 - RNA, 22 nt, Molluscum contagiosum virus
gcgcacacgggcucgagcucgg

SEQ ID NO: 118814 - RNA, 22 nt, Molluscum contagiosum virus
gcgccacgagcuugucccgcca

SEQ ID NO: 118815 - RNA, 22 nt, Molluscum contagiosum virus
gcgccgcgccuguguccgucuc

SEQ ID NO: 118816 - RNA, 22 nt, Molluscum contagiosum virus
gcgccgcuggaggcgagcguug

SEQ ID NO: 118817 - RNA, 23 nt, Molluscum contagiosum virus
gcgcgaaacgguaagcucgacgu

SEQ ID NO: 118818 - RNA, 22 nt, Molluscum contagiosum virus
gcgcgcuacacugugcucacgu

SEQ ID NO: 118819 - RNA, 20 nt, Molluscum contagiosum virus
gcgcuucgagcacgcuuucc

SEQ ID NO: 118820 - RNA, 22 nt, Molluscum contagiosum virus
gcggcccuucguguucgcggac

SEQ ID NO: 118821 - RNA, 19 nt, Molluscum contagiosum virus
gcggcgccgucuuguugcc

SEQ ID NO: 118822 - RNA, 22 nt, Molluscum contagiosum virus
gcggugcagcugccgcagagcc

SEQ ID NO: 118823 - RNA, 22 nt, Molluscum contagiosum virus
gcgugcgccgcagugcaccauc

SEQ ID NO: 118824 - RNA, 22 nt, Molluscum contagiosum virus
gcuagcgagcaaagucguggca

SEQ ID NO: 118825 - RNA, 22 nt, Molluscum contagiosum virus
gcucacggccuucgcguuccgg

SEQ ID NO: 118826 - RNA, 22 nt, Molluscum contagiosum virus
gcugucugugcauguagcaguc

SEQ ID NO: 118827 - RNA, 22 nt, Molluscum contagiosum virus
gcuugauccugcgauggccgug

SEQ ID NO: 118828 - RNA, 22 nt, Molluscum contagiosum virus
ggaagaccgucgugcuguuguc

SEQ ID NO: 118829 - RNA, 22 nt, Molluscum contagiosum virus
ggaagcgcucuagguugggugu

SEQ ID NO: 118830 - RNA, 22 nt, Molluscum contagiosum virus
ggaaggccacuggcgagcguac

SEQ ID NO: 118831 - RNA, 22 nt, Molluscum contagiosum virus
ggaucauggugugcacguucgc

SEQ ID NO: 118832 - RNA, 22 nt, Molluscum contagiosum virus
ggcaacgcaugcagucgacggc

SEQ ID NO: 118833 - RNA, 22 nt, Molluscum contagiosum virus
ggcucgcaacuacccgcaggcc

SEQ ID NO: 118834 - RNA, 18 nt, Molluscum contagiosum virus
gggccugccagccggcgc

SEQ ID NO: 118835 - RNA, 22 nt, Molluscum contagiosum virus
gggcgcugaacuuagcgcgcag

SEQ ID NO: 118836 - RNA, 22 nt, Molluscum contagiosum virus
ggggccugcaguugagagccuu

SEQ ID NO: 118837 - RNA, 22 nt, Molluscum contagiosum virus
ggucgagucguucucgcgguac

SEQ ID NO: 118838 - RNA, 22 nt, Molluscum contagiosum virus
ggugcacgcguagcacggccag

SEQ ID NO: 118839 - RNA, 22 nt, Molluscum contagiosum virus
gugggcggcagagagccggcgc

SEQ ID NO: 118840 - RNA, 22 nt, Molluscum contagiosum virus
guugccgucgucgcugcaguuu

SEQ ID NO: 118841 - RNA, 22 nt, Molluscum contagiosum virus
uaggcguguccgcagcugugcg

SEQ ID NO: 118842 - RNA, 21 nt, Molluscum contagiosum virus
uauccacgccaccaggccugg

SEQ ID NO: 118843 - RNA, 22 nt, Molluscum contagiosum virus
ucagcguuuaccccgagggccg

SEQ ID NO: 118844 - RNA, 22 nt, Molluscum contagiosum virus
uccggcgaaaagccgcucgcgu

SEQ ID NO: 118845 - RNA, 22 nt, Molluscum contagiosum virus
uccgugcacgggcucgagcgcg

SEQ ID NO: 118846 - RNA, 22 nt, Molluscum contagiosum virus
uccuccgcggccaauucgcgcu

SEQ ID NO: 118847 - RNA, 22 nt, Molluscum contagiosum virus
uccucgguguacugcuugcagu

SEQ ID NO: 118848 - RNA, 22 nt, Molluscum contagiosum virus
ucgcccagauccgcccagcuug

SEQ ID NO: 118849 - RNA, 22 nt, Molluscum contagiosum virus
ucgcguggaacuugacgccgua

SEQ ID NO: 118850 - RNA, 23 nt, Molluscum contagiosum virus
ucggggaagagcagguggaugcc

SEQ ID NO: 118851 - RNA, 22 nt, Molluscum contagiosum virus
ucucgcagcuggaccugcgcgc

SEQ ID NO: 118852 - RNA, 22 nt, Molluscum contagiosum virus
ucucugcgcgcaagucaccgcu

SEQ ID NO: 118853 - RNA, 22 nt, Molluscum contagiosum virus
ugcaccuguuccagcacguagc

SEQ ID NO: 118854 - RNA, 22 nt, Molluscum contagiosum virus
ugcgcauuggcagcgcuuuguu

SEQ ID NO: 118855 - RNA, 21 nt, Molluscum contagiosum virus
ugcggcuugggcaccgcgcgg

SEQ ID NO: 118856 - RNA, 21 nt, Molluscum contagiosum virus
ugcggguaccuuuccugcggg

SEQ ID NO: 118857 - RNA, 22 nt, Molluscum contagiosum virus
ugcuuugaugacuaugcgucuu

SEQ ID NO: 118858 - RNA, 22 nt, Molluscum contagiosum virus
uggcuucucgacuggagggggc

SEQ ID NO: 118859 - RNA, 22 nt, Molluscum contagiosum virus
ugugauggagggucuaggcuuc

SEQ ID NO: 118860 - RNA, 22 nt, Molluscum contagiosum virus
ugugcucgcgugccuugcgcgu

SEQ ID NO: 118861 - RNA, 22 nt, Molluscum contagiosum virus
ugugugugcgcucacacggaac

SEQ ID NO: 118862 - RNA, 22 nt, Molluscum contagiosum virus
uuccuggacacgcgcaucgugu

SEQ ID NO: 118863 - RNA, 22 nt, Molluscum contagiosum virus
uugaugcugaacgaucucugac

SEQ ID NO: 118864 - RNA, 22 nt, Molluscum contagiosum virus
uugccaucgauuaugcuugagu

SEQ ID NO: 118865 - RNA, 22 nt, Molluscum contagiosum virus
cagcgcgugccgcagaagguug

SEQ ID NO: 118866 - RNA, 22 nt, Molluscum contagiosum virus
caggaauugcagcgccugcgac

SEQ ID NO: 118867 - RNA, 22 nt, Molluscum contagiosum virus
caugacgcgcgugcgcaugucg

SEQ ID NO: 118868 - RNA, 22 nt, Molluscum contagiosum virus
ccagcgccgccaggacagcauu

SEQ ID NO: 118869 - RNA, 22 nt, Molluscum contagiosum virus
ccgcgcagaaaagccucgcagu

SEQ ID NO: 118870 - RNA, 22 nt, Molluscum contagiosum virus
ccuucucgguguagauguggua

SEQ ID NO: 118871 - RNA, 22 nt, Molluscum contagiosum virus
cgcacagcugcgggcugcggcu

SEQ ID NO: 118872 - RNA, 22 nt, Molluscum contagiosum virus
cgccggcuggcaauguagcgua

SEQ ID NO: 118873 - RNA, 22 nt, Molluscum contagiosum virus
cgcgacauggacaucgccagug

SEQ ID NO: 118874 - RNA, 21 nt, Molluscum contagiosum virus
cgcgcagguccagcugcgaga

SEQ ID NO: 118875 - RNA, 22 nt, Molluscum contagiosum virus
cgcgcccgaugaucugcuugag

SEQ ID NO: 118876 - RNA, 22 nt, Molluscum contagiosum virus
cgcgcucuuccguccgugcccg

SEQ ID NO: 118877 - RNA, 22 nt, Molluscum contagiosum virus
cgcggcaguccgagcuguucaa

SEQ ID NO: 118878 - RNA, 22 nt, Molluscum contagiosum virus
cgcgggagcggccuccggagaa

SEQ ID NO: 118879 - RNA, 22 nt, Molluscum contagiosum virus
cgcguaggccagcaccugagcc

SEQ ID NO: 118880 - RNA, 22 nt, Molluscum contagiosum virus
cgcuuccgaagcccaggccugg

SEQ ID NO: 118881 - RNA, 22 nt, Molluscum contagiosum virus
cggagacucgcgcaacagcgcu

SEQ ID NO: 118882 - RNA, 22 nt, Molluscum contagiosum virus
cgggcucagaaggcgucgggag

SEQ ID NO: 118883 - RNA, 22 nt, Molluscum contagiosum virus
cggugcacgcguagcacggcca

SEQ ID NO: 118884 - RNA, 19 nt, Molluscum contagiosum virus
cgugagggacagagucgcu

SEQ ID NO: 118885 - RNA, 22 nt, Molluscum contagiosum virus
cgugcucacggcagcguaaucc

SEQ ID NO: 118886 - RNA, 22 nt, Molluscum contagiosum virus
cguggucaagauccaagcgcaa

SEQ ID NO: 118887 - RNA, 22 nt, Molluscum contagiosum virus
cuccgcacacgugcucguugcc

SEQ ID NO: 118888 - RNA, 22 nt, Molluscum contagiosum virus
cuccucgggcaaggaggcgagc

SEQ ID NO: 118889 - RNA, 22 nt, Molluscum contagiosum virus
cucguggcguugcugcugcgcg

SEQ ID NO: 118890 - RNA, 22 nt, Molluscum contagiosum virus
cugcgcguacgccgcaugguug

SEQ ID NO: 118891 - RNA, 22 nt, Molluscum contagiosum virus
cuggacgacgugcagcaugcca

SEQ ID NO: 118892 - RNA, 22 nt, Molluscum contagiosum virus
gaaguucugcacagcacaggcc

SEQ ID NO: 118893 - RNA, 22 nt, Molluscum contagiosum virus
gacccaguggcguuugccguga

SEQ ID NO: 118894 - RNA, 22 nt, Molluscum contagiosum virus
gagaaagcugaugcccucguug

SEQ ID NO: 118895 - RNA, 22 nt, Molluscum contagiosum virus
gagauguuccccgagcucgacc

SEQ ID NO: 118896 - RNA, 22 nt, Molluscum contagiosum virus
gagcgagcgaacucgacaacgc

SEQ ID NO: 118897 - RNA, 22 nt, Molluscum contagiosum virus
gaugcgugcacgucgagcacgg

SEQ ID NO: 118898 - RNA, 22 nt, Molluscum contagiosum virus
gcacagcugcgggcugcggcua

SEQ ID NO: 118899 - RNA, 22 nt, Molluscum contagiosum virus
gcacgagcuggagcuggccuuc

SEQ ID NO: 118900 - RNA, 22 nt, Molluscum contagiosum virus
gcacgcuuuccuuugcggcgag

SEQ ID NO: 118901 - RNA, 20 nt, Molluscum contagiosum virus
gcagucguacgugagcaugc

SEQ ID NO: 118902 - RNA, 22 nt, Molluscum contagiosum virus
gcgcccugcgccgcacguaugg

SEQ ID NO: 118903 - RNA, 20 nt, Molluscum contagiosum virus
gcgcggacgcguuucuucgc

SEQ ID NO: 118904 - RNA, 22 nt, Molluscum contagiosum virus
gcgcugcuccgcucguucagca

SEQ ID NO: 118905 - RNA, 22 nt, Molluscum contagiosum virus
gcggcgcuaccugcacaaggag

SEQ ID NO: 118906 - RNA, 22 nt, Molluscum contagiosum virus
gcggucgacgggaacgagguca

SEQ ID NO: 118907 - RNA, 22 nt, Molluscum contagiosum virus
gcgucggacacguccagaaccu

SEQ ID NO: 118908 - RNA, 22 nt, Molluscum contagiosum virus
gcucagcauggaguuuugcaac

SEQ ID NO: 118909 - RNA, 22 nt, Molluscum contagiosum virus
gcuccgcguggcagugcgcggg

SEQ ID NO: 118910 - RNA, 22 nt, Molluscum contagiosum virus
gcugagcgcggagcuggcguug

SEQ ID NO: 118911 - RNA, 22 nt, Molluscum contagiosum virus
gcugaguauggacgugggcggc

SEQ ID NO: 118912 - RNA, 22 nt, Molluscum contagiosum virus
gcugcacgggucguagucgugc

SEQ ID NO: 118913 - RNA, 22 nt, Molluscum contagiosum virus
gcugccguccagguucagcgcg

SEQ ID NO: 118914 - RNA, 21 nt, Molluscum contagiosum virus
ggaagcgggcgagaucguggc

SEQ ID NO: 118915 - RNA, 22 nt, Molluscum contagiosum virus
ggacgcgucucaacgugggagu

SEQ ID NO: 118916 - RNA, 22 nt, Molluscum contagiosum virus
ggacgcucgugaggaaagcguu

SEQ ID NO: 118917 - RNA, 22 nt, Molluscum contagiosum virus
ggagaaaagggguuguaguccc

SEQ ID NO: 118918 - RNA, 22 nt, Molluscum contagiosum virus
ggcacgcuggcacuugcgggug

SEQ ID NO: 118919 - RNA, 22 nt, Molluscum contagiosum virus
ggcagcgaaacgcgugccucgc

SEQ ID NO: 118920 - RNA, 22 nt, Molluscum contagiosum virus
ggcgacaucuucaugguuacgg

SEQ ID NO: 118921 - RNA, 22 nt, Molluscum contagiosum virus
ggcguucgcagugcccgggggc

SEQ ID NO: 118922 - RNA, 22 nt, Molluscum contagiosum virus
ggcuccucgcgcagcgccacgu

SEQ ID NO: 118923 - RNA, 22 nt, Molluscum contagiosum virus
ggcuugcgcuuagaccuuuacg

SEQ ID NO: 118924 - RNA, 23 nt, Molluscum contagiosum virus
gggaagcgugucacuuuccgaug

SEQ ID NO: 118925 - RNA, 20 nt, Molluscum contagiosum virus
gguacacggccucuggcggc

SEQ ID NO: 118926 - RNA, 19 nt, Molluscum contagiosum virus
ggucgcguuccaggugcug

SEQ ID NO: 118927 - RNA, 22 nt, Molluscum contagiosum virus
ggucuaagcgcaagccagagcu

SEQ ID NO: 118928 - RNA, 22 nt, Molluscum contagiosum virus
ggugcucguacuccucaugaau

SEQ ID NO: 118929 - RNA, 22 nt, Molluscum contagiosum virus
guagcucuggaugugcucggug

SEQ ID NO: 118930 - RNA, 22 nt, Molluscum contagiosum virus
gucaaagaccgggcgguaguug

SEQ ID NO: 118931 - RNA, 22 nt, Molluscum contagiosum virus
guccugcgagcucgacaugucc

SEQ ID NO: 118932 - RNA, 18 nt, Molluscum contagiosum virus
gucgacugggcgcggcgc

SEQ ID NO: 118933 - RNA, 22 nt, Molluscum contagiosum virus
gucgcccaucacgucgaagauc

SEQ ID NO: 118934 - RNA, 22 nt, Molluscum contagiosum virus
gucugcuuuugcgucgcgcguu

SEQ ID NO: 118935 - RNA, 22 nt, Molluscum contagiosum virus
gugcgcuuugaggaacuagugc

SEQ ID NO: 118936 - RNA, 22 nt, Molluscum contagiosum virus
gugcgucgcugcgcgugguggg

SEQ ID NO: 118937 - RNA, 22 nt, Molluscum contagiosum virus
gugcuuggguucccguguaacc

SEQ ID NO: 118938 - RNA, 22 nt, Molluscum contagiosum virus
guuccagcuagaagaggccguc

SEQ ID NO: 118939 - RNA, 22 nt, Molluscum contagiosum virus
uagcucugcucgcucugcgaga

SEQ ID NO: 118940 - RNA, 22 nt, Molluscum contagiosum virus
uaugggcagcagcgagagcaug

SEQ ID NO: 118941 - RNA, 22 nt, Molluscum contagiosum virus
ucagcgcgaucucgaucgaaca

SEQ ID NO: 118942 - RNA, 22 nt, Molluscum contagiosum virus
uccacgaagcacagcaugcagu

SEQ ID NO: 118943 - RNA, 23 nt, Molluscum contagiosum virus
uccaggccacgucguugcggcac

SEQ ID NO: 118944 - RNA, 22 nt, Molluscum contagiosum virus
uccgcggacgcgggccuguccg

SEQ ID NO: 118945 - RNA, 19 nt, Molluscum contagiosum virus
ucgagcacgggcuuugcgu

SEQ ID NO: 118946 - RNA, 22 nt, Molluscum contagiosum virus
ucgcccguguucgcggagcugu

SEQ ID NO: 118947 - RNA, 22 nt, Molluscum contagiosum virus
aaugaaagacgugcugcugcug

SEQ ID NO: 118948 - RNA, 22 nt, Molluscum contagiosum virus
acagugcucgcaaaggagucgc

SEQ ID NO: 118949 - RNA, 22 nt, Molluscum contagiosum virus
accgagucggaccgcaucucgg

SEQ ID NO: 118950 - RNA, 22 nt, Molluscum contagiosum virus
agagcugcccgaguuucggaag

SEQ ID NO: 118951 - RNA, 22 nt, Molluscum contagiosum virus
agaucacgcuggaccuggcgca

SEQ ID NO: 118952 - RNA, 22 nt, Molluscum contagiosum virus
agaugcucauggacgcgcucgg

SEQ ID NO: 118953 - RNA, 22 nt, Molluscum contagiosum virus
agcgguagucggcgaugagccc

SEQ ID NO: 118954 - RNA, 22 nt, Molluscum contagiosum virus
agguccguguacccgcgcucgu

SEQ ID NO: 118955 - RNA, 22 nt, Molluscum contagiosum virus
aggucuucgccgcgggagaacu

SEQ ID NO: 118956 - RNA, 22 nt, Molluscum contagiosum virus
auggcggccagcguugcgccga

SEQ ID NO: 118957 - RNA, 23 nt, Molluscum contagiosum virus
auuucccugccggugcguuggca

SEQ ID NO: 118958 - RNA, 22 nt, Molluscum contagiosum virus
cacgccucaagcucgggcccag

SEQ ID NO: 118959 - RNA, 22 nt, Molluscum contagiosum virus
cacgcgcacgcucucgcuggcu

SEQ ID NO: 118960 - RNA, 22 nt, Molluscum contagiosum virus
cacgcgcagcucaaugagcgug

SEQ ID NO: 118961 - RNA, 22 nt, Molluscum contagiosum virus
cacugacaaggucuuucucgcg

SEQ ID NO: 118962 - RNA, 22 nt, Molluscum contagiosum virus
caucagguagcgcucguccacg

SEQ ID NO: 118963 - RNA, 22 nt, Molluscum contagiosum virus
caugggcucguccuguacuggc

SEQ ID NO: 118964 - RNA, 20 nt, Molluscum contagiosum virus
ccagcgccuguccgugggcg

SEQ ID NO: 118965 - RNA, 22 nt, Molluscum contagiosum virus
cccgagcucuucagcagcugca

SEQ ID NO: 118966 - RNA, 22 nt, Molluscum contagiosum virus
ccgcgugacgucuucucgcggg

SEQ ID NO: 118967 - RNA, 22 nt, Molluscum contagiosum virus
ccguuccugguagugcaccagg

SEQ ID NO: 118968 - RNA, 18 nt, Molluscum contagiosum virus
cgacaccuuccgagcccg

SEQ ID NO: 118969 - RNA, 18 nt, Molluscum contagiosum virus
cgacgccuucugagcccg

SEQ ID NO: 118970 - RNA, 22 nt, Molluscum contagiosum virus
cgagcagccgcgccgcacuguc

SEQ ID NO: 118971 - RNA, 22 nt, Molluscum contagiosum virus
cgccgacacgcgcgugcucauc

SEQ ID NO: 118972 - RNA, 18 nt, Molluscum contagiosum virus
cgccucaagcucgggccc

SEQ ID NO: 118973 - RNA, 22 nt, Molluscum contagiosum virus
cgcucgucuuccagagccugcg

SEQ ID NO: 118974 - RNA, 20 nt, Molluscum contagiosum virus
cgcugcguacguggucuugc

SEQ ID NO: 118975 - RNA, 22 nt, Molluscum contagiosum virus
cggacgcgggccuguccgcgga

SEQ ID NO: 118976 - RNA, 21 nt, Molluscum contagiosum virus
cggcccagcacgcgcggcucc

SEQ ID NO: 118977 - RNA, 18 nt, Molluscum contagiosum virus
cgggcgcgaccugcggcu

SEQ ID NO: 118978 - RNA, 22 nt, Molluscum contagiosum virus
cgucggacaggccuugcagacg

SEQ ID NO: 118979 - RNA, 22 nt, Molluscum contagiosum virus
cgugcgcaccugcgcaagaugu

SEQ ID NO: 118980 - RNA, 22 nt, Molluscum contagiosum virus
cgugcgccgcgcccagucgacc

SEQ ID NO: 118981 - RNA, 22 nt, Molluscum contagiosum virus
cuaggcguguccgcagcugugc

SEQ ID NO: 118982 - RNA, 22 nt, Molluscum contagiosum virus
cucccugcgcguacgccgcaug

SEQ ID NO: 118983 - RNA, 22 nt, Molluscum contagiosum virus
cucgcgcgucuccgcguagaau

SEQ ID NO: 118984 - RNA, 20 nt, Molluscum contagiosum virus
cucggcgcuaugccgcgugc

SEQ ID NO: 118985 - RNA, 22 nt, Molluscum contagiosum virus
cugccaugcccacauuggcgcc

SEQ ID NO: 118986 - RNA, 22 nt, Molluscum contagiosum virus
cuguucgcgcagagauguuguc

SEQ ID NO: 118987 - RNA, 17 nt, Molluscum contagiosum virus
cuucgcgcagcuuggcc

SEQ ID NO: 118988 - RNA, 20 nt, Molluscum contagiosum virus
gaccuucuggggcucgaguc

SEQ ID NO: 118989 - RNA, 22 nt, Molluscum contagiosum virus
gagccgcacaaagaacgcgcgu

SEQ ID NO: 118990 - RNA, 22 nt, Molluscum contagiosum virus
gcacgagcgaaaacgcgugucu

SEQ ID NO: 118991 - RNA, 20 nt, Molluscum contagiosum virus
gcagguccuccgugcugggc

SEQ ID NO: 118992 - RNA, 22 nt, Molluscum contagiosum virus
gccgcgacaucuuccgcuuccu

SEQ ID NO: 118993 - RNA, 22 nt, Molluscum contagiosum virus
gcgagcgccgugaacugugcag

SEQ ID NO: 118994 - RNA, 17 nt, Molluscum contagiosum virus
gcgcgccuuucccgucc

SEQ ID NO: 118995 - RNA, 22 nt, Molluscum contagiosum virus
gcgucgucgccguguuggaagu

SEQ ID NO: 118996 - RNA, 22 nt, Molluscum contagiosum virus
gcgugcuguggaagucgucaua

SEQ ID NO: 118997 - RNA, 22 nt, Molluscum contagiosum virus
gcguucccgcagcgccugcgga

SEQ ID NO: 118998 - RNA, 18 nt, Molluscum contagiosum virus
gcguucucggcaaugccc

SEQ ID NO: 118999 - RNA, 22 nt, Molluscum contagiosum virus
gcucagcaugauguacuugaug

SEQ ID NO: 119000 - RNA, 22 nt, Molluscum contagiosum virus
gcucauccaggcgccgcgcucg

SEQ ID NO: 119001 - RNA, 22 nt, Molluscum contagiosum virus
gcugcacaugugcgugcaccuc

SEQ ID NO: 119002 - RNA, 22 nt, Molluscum contagiosum virus
gcuggcgcucguagcucacgcg

SEQ ID NO: 119003 - RNA, 22 nt, Molluscum contagiosum virus
gcuuggcgggcagcggcgacga

SEQ ID NO: 119004 - RNA, 22 nt, Molluscum contagiosum virus
gcuuguguccaagcugggcugc

SEQ ID NO: 119005 - RNA, 22 nt, Molluscum contagiosum virus
ggaaaacgcccagaaugccgag

SEQ ID NO: 119006 - RNA, 22 nt, Molluscum contagiosum virus
ggaguagcgugcgccugcagcc

SEQ ID NO: 119007 - RNA, 22 nt, Molluscum contagiosum virus
ggaugccuuucaggggucuguc

SEQ ID NO: 119008 - RNA, 22 nt, Molluscum contagiosum virus
ggaugcuggugucgagcucgcg

SEQ ID NO: 119009 - RNA, 22 nt, Molluscum contagiosum virus
ggccugugcugugcagaacuuc

SEQ ID NO: 119010 - RNA, 22 nt, Molluscum contagiosum virus
ggccuucgcugccuucgaagag

SEQ ID NO: 119011 - RNA, 22 nt, Molluscum contagiosum virus
ggcucgaaaucugcgcgaggcc

SEQ ID NO: 119012 - RNA, 22 nt, Molluscum contagiosum virus
ggcucgggguuggcuuugugca

SEQ ID NO: 119013 - RNA, 22 nt, Molluscum contagiosum virus
ggcucguagauggcaggcacgu

SEQ ID NO: 119014 - RNA, 22 nt, Molluscum contagiosum virus
ggcugcagaaccgcgcgcugua

SEQ ID NO: 119015 - RNA, 22 nt, Molluscum contagiosum virus
gggaccggcaccugcuacuccc

SEQ ID NO: 119016 - RNA, 18 nt, Molluscum contagiosum virus
gggucuggucgcacggag

SEQ ID NO: 119017 - RNA, 22 nt, Molluscum contagiosum virus
gggugcagggcccuguuuugua

SEQ ID NO: 119018 - RNA, 22 nt, Molluscum contagiosum virus
gucgacugggcgcggcgcacgu

SEQ ID NO: 119019 - RNA, 22 nt, Molluscum contagiosum virus
gucggcgggcacggccagcguc

SEQ ID NO: 119020 - RNA, 22 nt, Molluscum contagiosum virus
gugagcacaguguagcgcgcgc

SEQ ID NO: 119021 - RNA, 22 nt, Molluscum contagiosum virus
gugccgucagcacccaccaaga

SEQ ID NO: 119022 - RNA, 18 nt, Molluscum contagiosum virus
gugcgcagcccgcugccc

SEQ ID NO: 119023 - RNA, 22 nt, Molluscum contagiosum virus
guggcaugcugcacgucgucca

SEQ ID NO: 119024 - RNA, 22 nt, Molluscum contagiosum virus
uacacguaguugaggucgcugc

SEQ ID NO: 119025 - RNA, 22 nt, Molluscum contagiosum virus
uacagccucuacacgcagaacg

SEQ ID NO: 119026 - RNA, 22 nt, Molluscum contagiosum virus
uacucggccacgcgguggugcg

SEQ ID NO: 119027 - RNA, 22 nt, Molluscum contagiosum virus
uaguuguagucgggcagcuugu

SEQ ID NO: 119028 - RNA, 20 nt, Molluscum contagiosum virus
ucauguggaugucgcaguag

SEQ ID NO: 119029 - RNA, 22 nt, Molluscum contagiosum virus
uccgcgggcgcgggccuguccg

SEQ ID NO: 119030 - RNA, 22 nt, Molluscum contagiosum virus
ucgcggcgccgcuguccuguga

SEQ ID NO: 119031 - RNA, 22 nt, Molluscum contagiosum virus
agcacguuguucuugcgcgugg

SEQ ID NO: 119032 - RNA, 22 nt, Molluscum contagiosum virus
agccgcgcugucgcugccugua

SEQ ID NO: 119033 - RNA, 22 nt, Molluscum contagiosum virus
agcgagauggcguugaugcugc

SEQ ID NO: 119034 - RNA, 22 nt, Molluscum contagiosum virus
agcgccgugaacugugcgacgc

SEQ ID NO: 119035 - RNA, 22 nt, Molluscum contagiosum virus
agcgcgaaaacacguuggagga

SEQ ID NO: 119036 - RNA, 22 nt, Molluscum contagiosum virus
agcgcgugagcuacgagcgcca

SEQ ID NO: 119037 - RNA, 22 nt, Molluscum contagiosum virus
aagggcucugccaccaugcgca

SEQ ID NO: 119038 - RNA, 20 nt, Molluscum contagiosum virus
accagugugaccaggucucc

SEQ ID NO: 119039 - RNA, 22 nt, Molluscum contagiosum virus
accccgagcugcggcgcgugcu

SEQ ID NO: 119040 - RNA, 22 nt, Molluscum contagiosum virus
acgugcucgauagcgcagagcu

SEQ ID NO: 119041 - RNA, 22 nt, Molluscum contagiosum virus
acguguucgaacugcucgcguu

SEQ ID NO: 119042 - RNA, 22 nt, Molluscum contagiosum virus
acugcgcagccgccgaguaugg

SEQ ID NO: 119043 - RNA, 22 nt, Molluscum contagiosum virus
agaagcuuuccaugccgcuccc

SEQ ID NO: 119044 - RNA, 22 nt, Molluscum contagiosum virus
agagaaacauguagaaggccag

SEQ ID NO: 119045 - RNA, 22 nt, Molluscum contagiosum virus
agcccgcaguauugcgcgagcc

SEQ ID NO: 119046 - RNA, 22 nt, Molluscum contagiosum virus
agcggcgacucuggcacguggu

SEQ ID NO: 119047 - RNA, 23 nt, Molluscum contagiosum virus
agcuugguguuauugacggcguc

SEQ ID NO: 119048 - RNA, 22 nt, Molluscum contagiosum virus
agugaaggucgcguuccaggug

SEQ ID NO: 119049 - RNA, 21 nt, Molluscum contagiosum virus
augcgcgccuuggcuagcagc

SEQ ID NO: 119050 - RNA, 22 nt, Molluscum contagiosum virus
auggccagcuucugcgccgcgc

SEQ ID NO: 119051 - RNA, 20 nt, Molluscum contagiosum virus
augucgcgcaucaccgagcg

SEQ ID NO: 119052 - RNA, 22 nt, Molluscum contagiosum virus
caaugcgugcgcccgucgccgu

SEQ ID NO: 119053 - RNA, 22 nt, Molluscum contagiosum virus
ccugcaugacgauguagcucuu

SEQ ID NO: 119054 - RNA, 22 nt, Molluscum contagiosum virus
ccuucgugcacgccuucgacgc

SEQ ID NO: 119055 - RNA, 22 nt, Molluscum contagiosum virus
ccuugcgcuugugcguacgcgc

SEQ ID NO: 119056 - RNA, 22 nt, Molluscum contagiosum virus
cgaggguggccacgucgagucu

SEQ ID NO: 119057 - RNA, 22 nt, Molluscum contagiosum virus
cgcagcacgcugagcguggcag

SEQ ID NO: 119058 - RNA, 22 nt, Molluscum contagiosum virus
cgccuggaaaccacgcuauccg

SEQ ID NO: 119059 - RNA, 22 nt, Molluscum contagiosum virus
cgcgagcgcuugcgaccugaag

SEQ ID NO: 119060 - RNA, 22 nt, Molluscum contagiosum virus
cgcguacaauguagcugccgau

SEQ ID NO: 119061 - RNA, 22 nt, Molluscum contagiosum virus
cgcgugugcggggcagcaggca

SEQ ID NO: 119062 - RNA, 22 nt, Molluscum contagiosum virus
cggacucgggcacaggcgugau

SEQ ID NO: 119063 - RNA, 22 nt, Molluscum contagiosum virus
cggccgcgagcagcuguggggg

SEQ ID NO: 119064 - RNA, 22 nt, Molluscum contagiosum virus
cgggccggaagcccacgauggc

SEQ ID NO: 119065 - RNA, 22 nt, Molluscum contagiosum virus
cggugcuggcgcgcgugcccug

SEQ ID NO: 119066 - RNA, 22 nt, Molluscum contagiosum virus
cgucaggcugggcgcgcgagcu

SEQ ID NO: 119067 - RNA, 22 nt, Molluscum contagiosum virus
cgugcccgagcacgcgugugug

SEQ ID NO: 119068 - RNA, 22 nt, Molluscum contagiosum virus
cgugcgguguugcucgaagggc

SEQ ID NO: 119069 - RNA, 22 nt, Molluscum contagiosum virus
cguggcgccgcugcuggaacag

SEQ ID NO: 119070 - RNA, 16 nt, Molluscum contagiosum virus
cguggcgcugcgcgag

SEQ ID NO: 119071 - RNA, 22 nt, Molluscum contagiosum virus
cuccgaugggucggucgugacu

SEQ ID NO: 119072 - RNA, 22 nt, Molluscum contagiosum virus
cucgaugacgcggcgguugcgc

SEQ ID NO: 119073 - RNA, 22 nt, Molluscum contagiosum virus
cucgcacacgcggaucuccuug

SEQ ID NO: 119074 - RNA, 22 nt, Molluscum contagiosum virus
cucgcgcaucugccgcgacucc

SEQ ID NO: 119075 - RNA, 22 nt, Molluscum contagiosum virus
cucugcgcuaucgagcacgucg

SEQ ID NO: 119076 - RNA, 22 nt, Molluscum contagiosum virus
cugcaugcugugcuucguggag

SEQ ID NO: 119077 - RNA, 22 nt, Molluscum contagiosum virus
cuggcgggcagcucugcuggca

SEQ ID NO: 119078 - RNA, 22 nt, Molluscum contagiosum virus
cugggagcaccgcguggcgcgc

SEQ ID NO: 119079 - RNA, 22 nt, Molluscum contagiosum virus
cugguguuuucguccauccacu

SEQ ID NO: 119080 - RNA, 22 nt, Molluscum contagiosum virus
cuucgccaaugacggcgucucu

SEQ ID NO: 119081 - RNA, 22 nt, Molluscum contagiosum virus
gaacgacacggagcggaucgug

SEQ ID NO: 119082 - RNA, 22 nt, Molluscum contagiosum virus
gacggcggguucucgucccgug

SEQ ID NO: 119083 - RNA, 22 nt, Molluscum contagiosum virus
gacguccuguagcaaggggucu

SEQ ID NO: 119084 - RNA, 22 nt, Molluscum contagiosum virus
gagcgcgagaagaaguacaucc

SEQ ID NO: 119085 - RNA, 22 nt, Molluscum contagiosum virus
gaggacgugcgcgagaacuacu

SEQ ID NO: 119086 - RNA, 22 nt, Molluscum contagiosum virus
gaggagaaaugucuugaucgug

SEQ ID NO: 119087 - RNA, 22 nt, Molluscum contagiosum virus
gaggauccgcauccucuaggcg

SEQ ID NO: 119088 - RNA, 22 nt, Molluscum contagiosum virus
gaggugcacgcagagcuggucg

SEQ ID NO: 119089 - RNA, 22 nt, Molluscum contagiosum virus
gaugaccucguucccgucgacc

SEQ ID NO: 119090 - RNA, 22 nt, Molluscum contagiosum virus
gcacagcucgcgcugcgucugc

SEQ ID NO: 119091 - RNA, 22 nt, Molluscum contagiosum virus
gcacgcgcgcgugucuuccagc

SEQ ID NO: 119092 - RNA, 22 nt, Molluscum contagiosum virus
gccgacgucaccgggcgcgcca

SEQ ID NO: 119093 - RNA, 19 nt, Molluscum contagiosum virus
gccgucgaugcgcaccagc

SEQ ID NO: 119094 - RNA, 19 nt, Molluscum contagiosum virus
gcgagcauguucugcgcga

SEQ ID NO: 119095 - RNA, 22 nt, Molluscum contagiosum virus
gcgaggcgcuggucucguucga

SEQ ID NO: 119096 - RNA, 22 nt, Molluscum contagiosum virus
gcgccacuugagacucgcaugu

SEQ ID NO: 119097 - RNA, 19 nt, Molluscum contagiosum virus
gcgccgugccuggccuggc

SEQ ID NO: 119098 - RNA, 23 nt, Molluscum contagiosum virus
gcgcgcagacguggugcucgugg

SEQ ID NO: 119099 - RNA, 22 nt, Molluscum contagiosum virus
gcgcgcggccauguguacgcag

SEQ ID NO: 119100 - RNA, 22 nt, Molluscum contagiosum virus
gcgcuggucacaugcacguacu

SEQ ID NO: 119101 - RNA, 22 nt, Molluscum contagiosum virus
gcguccagcuccagguuuagcu

SEQ ID NO: 119102 - RNA, 22 nt, Molluscum contagiosum virus
gcgucccggcucugcucgucca

SEQ ID NO: 119103 - RNA, 22 nt, Molluscum contagiosum virus
gcgugagccaauggacgccggg

SEQ ID NO: 119104 - RNA, 22 nt, Molluscum contagiosum virus
gcuccgcgggcgccauaaagag

SEQ ID NO: 119105 - RNA, 22 nt, Molluscum contagiosum virus
gcucgaucagguucgcggagug

SEQ ID NO: 119106 - RNA, 22 nt, Molluscum contagiosum virus
gcucuacggcgugcugugccug

SEQ ID NO: 119107 - RNA, 22 nt, Molluscum contagiosum virus
gcugcgaguacuuccuggaaug

SEQ ID NO: 119108 - RNA, 22 nt, Molluscum contagiosum virus
ggacgacgaguacgugcaugug

SEQ ID NO: 119109 - RNA, 22 nt, Molluscum contagiosum virus
ggagcagcggcucguagcuggu

SEQ ID NO: 119110 - RNA, 22 nt, Molluscum contagiosum virus
ggcgccucgagcgcgcuggacu

SEQ ID NO: 119111 - RNA, 22 nt, Molluscum contagiosum virus
ggcggaugcggacacguagacc

SEQ ID NO: 119112 - RNA, 22 nt, Molluscum contagiosum virus
ggcggaugucacgcagaagugg

SEQ ID NO: 119113 - RNA, 22 nt, Molluscum contagiosum virus
ggcguccuucuuugcgugcgcc

SEQ ID NO: 119114 - RNA, 23 nt, Molluscum contagiosum virus
ggcuugcgcuuagaccuuuacgu

SEQ ID NO: 119115 - RNA, 22 nt, Molluscum contagiosum virus
gggcagcguguagcggcacacc

SEQ ID NO: 119116 - RNA, 22 nt, Molluscum contagiosum virus
gggcgcgccgacgucaccgggc

SEQ ID NO: 119117 - RNA, 22 nt, Molluscum contagiosum virus
gggcguccgagggcgcgugccu

SEQ ID NO: 119118 - RNA, 22 nt, Molluscum contagiosum virus
gggcuugucggaauuucugucu

SEQ ID NO: 119119 - RNA, 22 nt, Molluscum contagiosum virus
gucgugcuccacgcgcagcuuc

SEQ ID NO: 119120 - RNA, 22 nt, Molluscum contagiosum virus
gucuagugcguccgcccuuacg

SEQ ID NO: 119121 - RNA, 22 nt, Molluscum contagiosum virus
gugcgcgucauuaaacuccagg

SEQ ID NO: 119122 - RNA, 22 nt, Molluscum contagiosum virus
uagugcucuuuguggaccgcgg

SEQ ID NO: 119123 - RNA, 20 nt, Molluscum contagiosum virus
uccaaguucaacaacgucuu

SEQ ID NO: 119124 - RNA, 18 nt, Molluscum contagiosum virus
uccagcagcaguguugcc

SEQ ID NO: 119125 - RNA, 21 nt, Molluscum contagiosum virus
ucgagaggucaugaugguaca

SEQ ID NO: 119126 - RNA, 22 nt, Molluscum contagiosum virus
ucgcuagcagugccgccuccuc

SEQ ID NO: 119127 - RNA, 22 nt, Molluscum contagiosum virus
ucggcaacgucggugcacguug

SEQ ID NO: 119128 - RNA, 22 nt, Molluscum contagiosum virus
ucggcgggcucggaaggugucg

SEQ ID NO: 119129 - RNA, 20 nt, Molluscum contagiosum virus
ucuacguguccgcauccgcc

SEQ ID NO: 119130 - RNA, 22 nt, Molluscum contagiosum virus
ucuccccggacggugcggucuu

SEQ ID NO: 119131 - RNA, 22 nt, Molluscum contagiosum virus
ucuguucgagaaccugcacgcg

SEQ ID NO: 119132 - RNA, 22 nt, Molluscum contagiosum virus
ugaugagcucgccguugguguu

SEQ ID NO: 119133 - RNA, 22 nt, Molluscum contagiosum virus
ugcuggccgcccuggcgcuguu

SEQ ID NO: 119134 - RNA, 19 nt, Molluscum contagiosum virus
uggaagaaucggacucgga

SEQ ID NO: 119135 - RNA, 22 nt, Molluscum contagiosum virus
uggccgugcccgccgacugccg

SEQ ID NO: 119136 - RNA, 22 nt, Molluscum contagiosum virus
aaagcggaaaaaugcacgcccg

SEQ ID NO: 119137 - RNA, 22 nt, Molluscum contagiosum virus
aacguuccgucgugugcuugcg

SEQ ID NO: 119138 - RNA, 22 nt, Molluscum contagiosum virus
aaggcgcacccucacaccuaga

SEQ ID NO: 119139 - RNA, 22 nt, Molluscum contagiosum virus
acauguccaagcugcaggaacg

SEQ ID NO: 119140 - RNA, 22 nt, Molluscum contagiosum virus
acguaaagacggcgauucgugc

SEQ ID NO: 119141 - RNA, 22 nt, Molluscum contagiosum virus
acguggcgggcaaggcgcgaca

SEQ ID NO: 119142 - RNA, 21 nt, Molluscum contagiosum virus
acuucgagaugaucucgcggc

SEQ ID NO: 119143 - RNA, 22 nt, Molluscum contagiosum virus
agagcccgugcaugugagccau

SEQ ID NO: 119144 - RNA, 22 nt, Molluscum contagiosum virus
agcgacucggacucgagcgacu

SEQ ID NO: 119145 - RNA, 22 nt, Molluscum contagiosum virus
agcgccuucuugaccagcacca

SEQ ID NO: 119146 - RNA, 22 nt, Molluscum contagiosum virus
agcucgcgcagcgcaucggggg

SEQ ID NO: 119147 - RNA, 22 nt, Molluscum contagiosum virus
aggagcacguuccugccgguga

SEQ ID NO: 119148 - RNA, 22 nt, Molluscum contagiosum virus
aggugcacgaccgcgcgcugcu

SEQ ID NO: 119149 - RNA, 22 nt, Molluscum contagiosum virus
aucagguagagcgcgcagccgg

SEQ ID NO: 119150 - RNA, 22 nt, Molluscum contagiosum virus
aucgagcccgagucuuccagcu

SEQ ID NO: 119151 - RNA, 20 nt, Molluscum contagiosum virus
aucuucguggagacggcgac

SEQ ID NO: 119152 - RNA, 22 nt, Molluscum contagiosum virus
augcaggcggagcagcugcugg

SEQ ID NO: 119153 - RNA, 22 nt, Molluscum contagiosum virus
auggccaccgggaugcgcaugg

SEQ ID NO: 119154 - RNA, 22 nt, Molluscum contagiosum virus
auggccccuugucuaguuggag

SEQ ID NO: 119155 - RNA, 22 nt, Molluscum contagiosum virus
caaugucugugugcgaucugga

SEQ ID NO: 119156 - RNA, 22 nt, Molluscum contagiosum virus
cagcaguagaaaaugcccagcc

SEQ ID NO: 119157 - RNA, 19 nt, Molluscum contagiosum virus
cagcagugccagcgcuguc

SEQ ID NO: 119158 - RNA, 22 nt, Molluscum contagiosum virus
cagcagugccagcgcuguccgc

SEQ ID NO: 119159 - RNA, 22 nt, Molluscum contagiosum virus
caugcacagccgcuuucugggc

SEQ ID NO: 119160 - RNA, 22 nt, Molluscum contagiosum virus
cauguggaugucgcaguagaug

SEQ ID NO: 119161 - RNA, 22 nt, Molluscum contagiosum virus
ccgcagugcucgcacacgugca

SEQ ID NO: 119162 - RNA, 22 nt, Molluscum contagiosum virus
ccggggugugccuuuuccuugu

SEQ ID NO: 119163 - RNA, 22 nt, Molluscum contagiosum virus
ugggcuacagacaggcacgcgc

SEQ ID NO: 119164 - RNA, 22 nt, Molluscum contagiosum virus
ugggcuccgugagcucguccga

SEQ ID NO: 119165 - RNA, 22 nt, Molluscum contagiosum virus
uggucuucuugccgcggcagcg

SEQ ID NO: 119166 - RNA, 22 nt, Molluscum contagiosum virus
uggugcacgaguccgcgggcgg

SEQ ID NO: 119167 - RNA, 22 nt, Molluscum contagiosum virus
ugguguagaggaagcgcaggug

SEQ ID NO: 119168 - RNA, 22 nt, Molluscum contagiosum virus
ugucaagcacggaaaggaagug

SEQ ID NO: 119169 - RNA, 22 nt, Molluscum contagiosum virus
uguccgagcgaaccgcggcagc

SEQ ID NO: 119170 - RNA, 22 nt, Molluscum contagiosum virus
ugugcacgcacgcgguugcgcc

SEQ ID NO: 119171 - RNA, 22 nt, Molluscum contagiosum virus
uguggacuccuugugcagguag

SEQ ID NO: 119172 - RNA, 22 nt, Molluscum contagiosum virus
uuugaacucuugcgagcggcaa

SEQ ID NO: 119173 - RNA, 22 nt, Molluscum contagiosum virus
uuuugcgggggcgcgcgaaugc

SEQ ID NO: 119174 - RNA, 22 nt, Molluscum contagiosum virus
ucgcgugugcggggcagcaggc

SEQ ID NO: 119175 - RNA, 21 nt, Molluscum contagiosum virus
ucggagggucggagccugagc

SEQ ID NO: 119176 - RNA, 22 nt, Molluscum contagiosum virus
ucggcgcaacgcuggccgccau

SEQ ID NO: 119177 - RNA, 19 nt, Molluscum contagiosum virus
ucuagcagcugcgccagcg

SEQ ID NO: 119178 - RNA, 22 nt, Molluscum contagiosum virus
ugaccuuguacugcacgugcuc

SEQ ID NO: 119179 - RNA, 22 nt, Molluscum contagiosum virus
ugcacgcuguccaggcgcugca

SEQ ID NO: 119180 - RNA, 22 nt, Molluscum contagiosum virus
ugcagcagcagcgcuuucaggu

SEQ ID NO: 119181 - RNA, 22 nt, Molluscum contagiosum virus
ugcaggccagugcgacguugcg

SEQ ID NO: 119182 - RNA, 22 nt, Molluscum contagiosum virus
ugcgcgcguggugugcuaccag

SEQ ID NO: 119183 - RNA, 22 nt, Molluscum contagiosum virus
ugcgugcccagcagguagcugg

SEQ ID NO: 119184 - RNA, 22 nt, Molluscum contagiosum virus
ugcuggcguucguucgcgccag

SEQ ID NO: 119185 - RNA, 22 nt, Molluscum contagiosum virus
uggaggacgugcacgggccagc

SEQ ID NO: 119186 - RNA, 22 nt, Molluscum contagiosum virus
uguccacguaccugucgagugc

SEQ ID NO: 119187 - RNA, 19 nt, Molluscum contagiosum virus
uguccugguucuuugcgcg

SEQ ID NO: 119188 - RNA, 22 nt, Molluscum contagiosum virus
ugucggucucgagcgccgccau

SEQ ID NO: 119189 - RNA, 21 nt, Molluscum contagiosum virus
ugugcgaggacguggcgcugc

SEQ ID NO: 119190 - RNA, 22 nt, Molluscum contagiosum virus
uuccaugcgcaacgugcugcgu

SEQ ID NO: 119191 - RNA, 22 nt, Molluscum contagiosum virus
uucguccaccagcgugugguug

SEQ ID NO: 119192 - RNA, 22 nt, Molluscum contagiosum virus
uuguaguugcgguggugcaucc

SEQ ID NO: 119193 - RNA, 22 nt, Molluscum contagiosum virus
ucgugcucuaggugugagggug

SEQ ID NO: 119194 - RNA, 22 nt, Molluscum contagiosum virus
ucucgacggggccguaguaggg

SEQ ID NO: 119195 - RNA, 17 nt, Molluscum contagiosum virus
ucugcgugacauccgcc

SEQ ID NO: 119196 - RNA, 21 nt, Molluscum contagiosum virus
ugaucguguccaaguucaaga

SEQ ID NO: 119197 - RNA, 22 nt, Molluscum contagiosum virus
ugaucguguccaaguucaagaa

SEQ ID NO: 119198 - RNA, 23 nt, Molluscum contagiosum virus
ugauggacauguacacgcgcgcg

SEQ ID NO: 119199 - RNA, 22 nt, Molluscum contagiosum virus
ugcacuacaaccauggcgcgcu

SEQ ID NO: 119200 - RNA, 22 nt, Molluscum contagiosum virus
ugccggcguccucuucccgcgg

SEQ ID NO: 119201 - RNA, 22 nt, Molluscum contagiosum virus
ugccuccugcacgcgguccauc

SEQ ID NO: 119202 - RNA, 22 nt, Molluscum contagiosum virus
ugcgagccauuaugcucggagu

SEQ ID NO: 119203 - RNA, 22 nt, Molluscum contagiosum virus
ugcgcgugaacaucggcagcgg

SEQ ID NO: 119204 - RNA, 22 nt, Molluscum contagiosum virus
ugcuaguccuagccgcgagccc

SEQ ID NO: 119205 - RNA, 20 nt, Molluscum contagiosum virus
ugcucgcucgugcugccggu

SEQ ID NO: 119206 - RNA, 22 nt, Molluscum contagiosum virus
ugcugcgcgccaguuuuccgug

SEQ ID NO: 119207 - RNA, 22 nt, Molluscum contagiosum virus
ugcuggucgucgccggcgccaa

SEQ ID NO: 119208 - RNA, 23 nt, Molluscum contagiosum virus
ugcuucuucgacgagcgcgcggg

SEQ ID NO: 119209 - RNA, 22 nt, Molluscum contagiosum virus
uggagaccggcggcucggaaug

SEQ ID NO: 119210 - RNA, 22 nt, Molluscum contagiosum virus
uggucgugcucgugcaccucgu

SEQ ID NO: 119211 - RNA, 22 nt, Molluscum contagiosum virus
uuacggacgcccuccucgaccu

SEQ ID NO: 119212 - RNA, 22 nt, Molluscum contagiosum virus
uucgggccuuaaaugaacacca

SEQ ID NO: 119213 - RNA, 22 nt, Molluscum contagiosum virus
uucuugaccuugaucgagaugu

SEQ ID NO: 119214 - RNA, 22 nt, Murray Valley encephalitis virus
ugcucauuuuuacgcuugccac

SEQ ID NO: 119215 - RNA, 22 nt, Murray Valley encephalitis virus
acagcuuggaugguguugcgag

SEQ ID NO: 119216 - RNA, 22 nt, Murray Valley encephalitis virus
gggaggcuuuccaaccguggag

SEQ ID NO: 119217 - RNA, 22 nt, Murray Valley encephalitis virus
ggggauauucgugcucuuccaa

SEQ ID NO: 119218 - RNA, 22 nt, Murray Valley encephalitis virus
uccauuguuggcagggacuccu

SEQ ID NO: 119219 - RNA, 22 nt, Norwalk virus
uggcaacaugugacaaugaaac

SEQ ID NO: 119220 - RNA, 22 nt, Norwalk virus
aguaagguugauuacagugcca

SEQ ID NO: 119221 - RNA, 22 nt, Poliovirus
caccuccugggagucaacugcu

SEQ ID NO: 119222 - RNA, 22 nt, Poliovirus
ggcccuguaagcguggcagggu

SEQ ID NO: 119223 - RNA, 22 nt, Poliovirus
cagcccugcuugguucgaggca

SEQ ID NO: 119224 - RNA, 22 nt, Poliovirus
cuuuaagagaugcuguccuuua

SEQ ID NO: 119225 - RNA, 22 nt, Respiratory syncytial virus
ugccuugauuucacagggugug

SEQ ID NO: 119226 - RNA, 22 nt, Rubella virus
acggcagcugauggugguggug

SEQ ID NO: 119227 - RNA, 22 nt, Rubella virus
cgugaugcuguggcacagggcg

SEQ ID NO: 119228 - RNA, 22 nt, Rubella virus
gcgagccagcaguuaugcaccu

SEQ ID NO: 119229 - RNA, 22 nt, Rubella virus
gcgcacgccuuuggggaccaug

SEQ ID NO: 119230 - RNA, 22 nt, Rubella virus
ucagccugacccgggccuccga

SEQ ID NO: 119231 - RNA, 22 nt, Rubella virus
uggggcacccggcacucgugua

SEQ ID NO: 119232 - RNA, 23 nt, Rubella virus
cgcgcgucccauggggcucacca

SEQ ID NO: 119233 - RNA, 22 nt, Rubella virus
gugccccaagugcgccuacggc

SEQ ID NO: 119234 - RNA, 22 nt, Rubella virus
uggcgagccagagggccgaggc

SEQ ID NO: 119235 - RNA, 22 nt, Rubella virus
agauggcaauugccucccccgg

SEQ ID NO: 119236 - RNA, 22 nt, Rubella virus
cauggccacggugguguugugc

SEQ ID NO: 119237 - RNA, 22 nt, Rubella virus
gcucgccgccuaccgccgcauc

SEQ ID NO: 119238 - RNA, 22 nt, Rubella virus
gugccgccaugauggccgucgu

SEQ ID NO: 119239 - RNA, 22 nt, Rubella virus
ucgaggucgacuucacugaguu

SEQ ID NO: 119240 - RNA, 20 nt, SARS coronavirus
aauaaauugccagaagcugc

SEQ ID NO: 119241 - RNA, 22 nt, SARS coronavirus
uuaacaauuuucuugaacuuac

SEQ ID NO: 119242 - RNA, 21 nt, SARS coronavirus
uuguccuccacuugcuaggua

SEQ ID NO: 119243 - RNA, 22 nt, SARS coronavirus
cacaaggcagaugggcuaugua

SEQ ID NO: 119244 - RNA, 22 nt, SARS coronavirus
cucuuaauggugaagcaaagua

SEQ ID NO: 119245 - RNA, 22 nt, SARS coronavirus
uacuagagcagcaacaaugaga

SEQ ID NO: 119246 - RNA, 22 nt, SARS coronavirus
uccaucauuaauaaugcuguuu

SEQ ID NO: 119247 - RNA, 22 nt, SARS coronavirus
auugugcagacaccuauuguag

SEQ ID NO: 119248 - RNA, 23 nt, SARS coronavirus
cucacgaauuuugcucacagcau

SEQ ID NO: 119249 - RNA, 22 nt, Seoul virus
aaagaugaaauuaugugcaauc

SEQ ID NO: 119250 - RNA, 20 nt, Seoul virus
ucauguggaguuugcuauua

SEQ ID NO: 119251 - RNA, 22 nt, Sin Nombre virus
uauaagaucacauuugauguug

SEQ ID NO: 119252 - RNA, 23 nt, Sin Nombre virus
auaacaaauuacugucuuccuug

SEQ ID NO: 119253 - RNA, 22 nt, Sin Nombre virus
auaagcaaugcuuuuauuauau

SEQ ID NO: 119254 - RNA, 22 nt, Tula virus
agcaugugcaauuagacauucu

SEQ ID NO: 119255 - RNA, 22 nt, Tula virus
ccauuuaagagugcacuugaug

SEQ ID NO: 119256 - RNA, 22 nt, Tula virus
accgagaagacucaaacacaga

SEQ ID NO: 119257 - RNA, 22 nt, Vaccinia virus
gaaaguguaaagacaacgaaua

SEQ ID NO: 119258 - RNA, 22 nt, Vaccinia virus
uguccgggaacauacgcuucca

SEQ ID NO: 119259 - RNA, 22 nt, Vaccinia virus
acaucgauucccauaugauguu

SEQ ID NO: 119260 - RNA, 22 nt, Vaccinia virus
gcuuugaguuuuguugaaucga

SEQ ID NO: 119261 - RNA, 20 nt, Vaccinia virus
ucgguugcaccuucagaugc

SEQ ID NO: 119262 - RNA, 22 nt, Variola virus
gucguaaagcguuaaaucaaua

SEQ ID NO: 119263 - RNA, 22 nt, West Nile virus
guggcugguugugcagagcaga

SEQ ID NO: 119264 - RNA, 22 nt, West Nile virus
guguucuagcaccaccagccac

SEQ ID NO: 119265 - RNA, 22 nt, B19 virus
aguuuugucuguaacauccuua

SEQ ID NO: 119266 - RNA, 22 nt, B19 virus
ggcagccauuuuaaguguuuca

SEQ ID NO: 119267 - RNA, 23 nt, Human
auaaugcaaguggugguaaucug

SEQ ID NO: 119268 - RNA, 22 nt, Human
gugcuugggggaaguaacagac

SEQ ID NO: 119269 - RNA, 22 nt, Human
ugggccacgugacccuuacccu

SEQ ID NO: 119270 - RNA, 22 nt, Human
cuucccacagaauucaaucagu

SEQ ID NO: 119271 - RNA, 22 nt, Human
uacaguagacaggaccacaggc

SEQ ID NO: 119272 - RNA, 22 nt, Human
gagggcugcuggaaaaaugcag

SEQ ID NO: 119273 - RNA, 22 nt, Human
aggcugagccugggcguggugg

SEQ ID NO: 119274 - RNA, 22 nt, Human
gucagcaccucuuuggggagcu

SEQ ID NO: 119275 - RNA, 20 nt, Human
ccugucucacguuccgcccc

SEQ ID NO: 119276 - RNA, 22 nt, Human
uuuaguauccuaucucauuuaa

SEQ ID NO: 119277 - RNA, 21 nt, Human
aggcagccagucaugcucccu

SEQ ID NO: 119278 - RNA, 22 nt, Human
gcugaguugaaagcagaggaua

SEQ ID NO: 119279 - RNA, 22 nt, Human
ugauuucuucuaauuuccauca

SEQ ID NO: 119280 - RNA, 22 nt, Human
uauuaggcauuugaggauaaac

SEQ ID NO: 119281 - RNA, 22 nt, Human
cacuguuuuauuccaacauagg

SEQ ID NO: 119282 - RNA, 22 nt, Human
caggacccaaccucccugcucu

SEQ ID NO: 119283 - RNA, 22 nt, Human
aggagggagcuuaagccaggca

SEQ ID NO: 119284 - RNA, 22 nt, Human
agaagccaugguaugcaacuac

SEQ ID NO: 119285 - RNA, 22 nt, Human
ucacaucaacauuauagcauga

SEQ ID NO: 119286 - RNA, 22 nt, Human
gagagaggccuccauguacuga

SEQ ID NO: 119287 - RNA, 23 nt, Human
cagaggguuccauggagcauggu

SEQ ID NO: 119288 - RNA, 22 nt, Human
agccagcaggugagugcagccu

SEQ ID NO: 119289 - RNA, 22 nt, Human
aacauuugaaaaucaagaaucu

SEQ ID NO: 119290 - RNA, 22 nt, Human
cagcacagaguauuuuauugau

SEQ ID NO: 119291 - RNA, 22 nt, Human
auuugucauauauaauacucuu

SEQ ID NO: 119292 - RNA, 22 nt, Human
ggagaugcuucuuguguuuauu

SEQ ID NO: 119293 - RNA, 22 nt, Human
ugaggcaggagaaucacaugaa

SEQ ID NO: 119294 - RNA, 22 nt, Human
aaaagaggagugguuuaugaca

SEQ ID NO: 119295 - RNA, 22 nt, Human
aaaugcaaggccaugugaagga

SEQ ID NO: 119296 - RNA, 20 nt, Human
aacauugcuucaauguaacc

SEQ ID NO: 119297 - RNA, 22 nt, Human
ugcacaguuggcuacaucgugg

SEQ ID NO: 119298 - RNA, 22 nt, Human
acaucagagggcucacaugauc

SEQ ID NO: 119299 - RNA, 22 nt, Human
aaacaugaugucauauaugcca

SEQ ID NO: 119300 - RNA, 22 nt, Human
uggcucaggaucuaagcagaau

SEQ ID NO: 119301 - RNA, 22 nt, Human
cggcagagcuuccugcucagcg

SEQ ID NO: 119302 - RNA, 22 nt, Human
gagggcaguagccucguacccu

SEQ ID NO: 119303 - RNA, 22 nt, Human
cuguugucccugggagcucagc

SEQ ID NO: 119304 - RNA, 22 nt, Human
aggaguggaauuacuggguucu

SEQ ID NO: 119305 - RNA, 22 nt, Human
agguauuaugcugcugaaugcu

SEQ ID NO: 119306 - RNA, 22 nt, Human
uacugugaauacaaaauaaauu

SEQ ID NO: 119307 - RNA, 22 nt, Human
cagagcccagggccuacguccc

SEQ ID NO: 119308 - RNA, 22 nt, Human
ugagaagcagcuuacagguguc

SEQ ID NO: 119309 - RNA, 22 nt, Human
ugaggcucagaagugccaagug

SEQ ID NO: 119310 - RNA, 23 nt, Human
cccagaccuugugcugcccuugg

SEQ ID NO: 119311 - RNA, 23 nt, Human
gcugggcuuacucuuucagugag

SEQ ID NO: 119312 - RNA, 16 nt, Human
aggcucagaggcugga

SEQ ID NO: 119313 - RNA, 22 nt, Human
cagauggaacacagaaaggaga

SEQ ID NO: 119314 - RNA, 22 nt, Human
cucugguucagggcucccuggc

SEQ ID NO: 119315 - RNA, 22 nt, Human
cagaggcaaaagagguggaggu

SEQ ID NO: 119316 - RNA, 21 nt, Human
caaagccaggcaacucucucc

SEQ ID NO: 119317 - RNA, 18 nt, Human
gagcagaggcucaacugg

SEQ ID NO: 119318 - RNA, 22 nt, Human
agguuuauuaaguaaauagagc

SEQ ID NO: 119319 - RNA, 22 nt, Human
cagagugaaauaggggaucaag

SEQ ID NO: 119320 - RNA, 22 nt, Human
uuuguucacauuuaggacucuc

SEQ ID NO: 119321 - RNA, 22 nt, Human
aaguggaggccgaguucacgca

SEQ ID NO: 119322 - RNA, 22 nt, Human
ugcaggcuggaggagggacuaa

SEQ ID NO: 119323 - RNA, 18 nt, Human
cuucagugacagucuggc

SEQ ID NO: 119324 - RNA, 22 nt, Human
gaggucaugcaaaauugaauca

SEQ ID NO: 119325 - RNA, 19 nt, Human
ccagguggaacugagguag

SEQ ID NO: 119326 - RNA, 22 nt, Human
gagucgagcagaaagccgucgg

SEQ ID NO: 119327 - RNA, 21 nt, Human
ucacuacaauguucucuuaua

SEQ ID NO: 119328 - RNA, 22 nt, Human
uuuacaaguuuacagaaugaug

SEQ ID NO: 119329 - RNA, 22 nt, Human
aaaugcagauugucauucagga

SEQ ID NO: 119330 - RNA, 22 nt, Human
uaacugauauugaaaaacauca

SEQ ID NO: 119331 - RNA, 18 nt, Human
cccagccucuccuuucua

SEQ ID NO: 119332 - RNA, 22 nt, Human
acuuaaaaagaaucuuuucacg

SEQ ID NO: 119333 - RNA, 22 nt, Human
aaugcacauaaauauggucuua

SEQ ID NO: 119334 - RNA, 22 nt, Human
acuugaauuauauuucuagaga

SEQ ID NO: 119335 - RNA, 22 nt, Human
cugugaccuccaggaaggggug

SEQ ID NO: 119336 - RNA, 22 nt, Human
aaggugucggcagagccgcuuc

SEQ ID NO: 119337 - RNA, 22 nt, Human
acauuugacucuguucauauua

SEQ ID NO: 119338 - RNA, 22 nt, Human
uggcagcaguagccaccccagc

SEQ ID NO: 119339 - RNA, 22 nt, Human
agggccaccagagcagggcagu

SEQ ID NO: 119340 - RNA, 19 nt, Human
ugggaguggggaagguccu

SEQ ID NO: 119341 - RNA, 22 nt, Human
ugcagggccaugguggcggcug

SEQ ID NO: 119342 - RNA, 18 nt, Human
uggcaggaaaugcacuuu

SEQ ID NO: 119343 - RNA, 22 nt, Human
acaguggaauuuguagaugugu

SEQ ID NO: 119344 - RNA, 22 nt, Human
uaugaacauugaagaggagccc

SEQ ID NO: 119345 - RNA, 22 nt, Human
uacaugaauguuucaauauugu

SEQ ID NO: 119346 - RNA, 22 nt, Human
aaagaggauggaguagucagcu

SEQ ID NO: 119347 - RNA, 23 nt, Human
agggcugaaugcagagaagcaga

SEQ ID NO: 119348 - RNA, 22 nt, Human
acagccugcugccugcuucuug

SEQ ID NO: 119349 - RNA, 22 nt, Human
uaguggagaaguggagucugug

SEQ ID NO: 119350 - RNA, 22 nt, Human
aggucaggguauucacgucugu

SEQ ID NO: 119351 - RNA, 22 nt, Human
cugaggcuggcguuugaggaag

SEQ ID NO: 119352 - RNA, 22 nt, Human
cagcagugucuccagcaucaca

SEQ ID NO: 119353 - RNA, 22 nt, Human
aagguauuggggaauauuugac

SEQ ID NO: 119354 - RNA, 22 nt, Human
cacucacuuauuucuaacagaa

SEQ ID NO: 119355 - RNA, 22 nt, Human
augauauauguguugagcuugc

SEQ ID NO: 119356 - RNA, 22 nt, Human
caggaggcaucauggagcggac

SEQ ID NO: 119357 - RNA, 22 nt, Human
gagccagggcugugagcugagc

SEQ ID NO: 119358 - RNA, 22 nt, Human
uacaguucuuugaaggaucuag

SEQ ID NO: 119359 - RNA, 22 nt, Human
gggcugagucaucuggggccuc

SEQ ID NO: 119360 - RNA, 22 nt, Human
agcagccaggaaucugcagagc

SEQ ID NO: 119361 - RNA, 22 nt, Human
acaguggaguugggguagcccu

SEQ ID NO: 119362 - RNA, 22 nt, Human
uaagacauuugaaaugugaucc

SEQ ID NO: 119363 - RNA, 22 nt, Human
ucugugcacaauaggcauuuuu

SEQ ID NO: 119364 - RNA, 22 nt, Human
ucagaagguggagguugcagug

SEQ ID NO: 119365 - RNA, 22 nt, Human
gaggcugguucugaaguacugu

SEQ ID NO: 119366 - RNA, 22 nt, Human
gaaggaagucauuagugcagac

SEQ ID NO: 119367 - RNA, 22 nt, Human
aguggcagccgagcaggagaug

SEQ ID NO: 119368 - RNA, 22 nt, Human
aacagugcugcauucauugagc

SEQ ID NO: 119369 - RNA, 22 nt, Human
augaggcaaucaugguccaguu

SEQ ID NO: 119370 - RNA, 22 nt, Human
cuauuauuuccucaucuauaaa

SEQ ID NO: 119371 - RNA, 22 nt, Human
acagcuguggggacucuugccc

SEQ ID NO: 119372 - RNA, 22 nt, Human
acacuguguggucucucucgga

SEQ ID NO: 119373 - RNA, 22 nt, Human
guuauuuucauuggcucagacu

SEQ ID NO: 119374 - RNA, 22 nt, Human
aauaacagagucuucaagauag

SEQ ID NO: 119375 - RNA, 22 nt, Human
ugaaggcauugaugaaggaauc

SEQ ID NO: 119376 - RNA, 22 nt, Human
acuguggccugcuguaugggcu

SEQ ID NO: 119377 - RNA, 22 nt, Human
uggagaaggccggccaggagug

SEQ ID NO: 119378 - RNA, 22 nt, Human
uugccucccagcaugggcagcu

SEQ ID NO: 119379 - RNA, 22 nt, Human
caccaggugcuggaggacauca

SEQ ID NO: 119380 - RNA, 22 nt, Human
cuaaacauggcuuagaacacuc

SEQ ID NO: 119381 - RNA, 22 nt, Human
acagaggccgccucucucacgg

SEQ ID NO: 119382 - RNA, 22 nt, Human
ggcugaaggaugaaagcugcag

SEQ ID NO: 119383 - RNA, 19 nt, Human
cagauguuuucaguucauu

SEQ ID NO: 119384 - RNA, 22 nt, Human
guggcacagugggagagcccca

SEQ ID NO: 119385 - RNA, 22 nt, Human
gcaggagccaggccgagcuggu

SEQ ID NO: 119386 - RNA, 22 nt, Human
gcaccaggaggcccuucucauc

SEQ ID NO: 119387 - RNA, 22 nt, Human
ccagggcuccauugcucauccu

SEQ ID NO: 119388 - RNA, 22 nt, Human
gggcugagcuaagcuggguuga

SEQ ID NO: 119389 - RNA, 19 nt, Human
aggagaaguagcagaaauu

SEQ ID NO: 119390 - RNA, 22 nt, Human
cagugcagguggcagaggacag

SEQ ID NO: 119391 - RNA, 22 nt, Human
ggcagaggaggggugaauuugc

SEQ ID NO: 119392 - RNA, 22 nt, Human
caguggaagcuggcugugaaga

SEQ ID NO: 119393 - RNA, 22 nt, Human
cuggagcagcagguggccaggg

SEQ ID NO: 119394 - RNA, 21 nt, Human
gcagaugggagucaucaggcu

SEQ ID NO: 119395 - RNA, 22 nt, Human
acaguggaggccauaugguccu

SEQ ID NO: 119396 - RNA, 22 nt, Human
acaguggauauauuaaaugaga

SEQ ID NO: 119397 - RNA, 22 nt, Human
uuauacauguguuuugagauga

SEQ ID NO: 119398 - RNA, 22 nt, Human
gcugggcaggccucgugagggc

SEQ ID NO: 119399 - RNA, 22 nt, Human
aagauuauggcagauaacaauu

SEQ ID NO: 119400 - RNA, 22 nt, Human
aggcccagagcaggaaaggguu

SEQ ID NO: 119401 - RNA, 22 nt, Human
uagaaacccauguuuauucagu

SEQ ID NO: 119402 - RNA, 22 nt, Human
ucugugcaggaagucauuauga

SEQ ID NO: 119403 - RNA, 22 nt, Human
cugugacuguguuggaugcaca

SEQ ID NO: 119404 - RNA, 22 nt, Human
aaggaggagcggaggcuuguug

SEQ ID NO: 119405 - RNA, 22 nt, Human
caggagaagucucuagggggug

SEQ ID NO: 119406 - RNA, 22 nt, Human
ccccuuccuuccucagacagcc

SEQ ID NO: 119407 - RNA, 22 nt, Human
uacaacaguucaugaaaugaaa

SEQ ID NO: 119408 - RNA, 22 nt, Human
ugggcaggcaagugaauaccuu

SEQ ID NO: 119409 - RNA, 22 nt, Human
agugagcaguacuuacuccugc

SEQ ID NO: 119410 - RNA, 22 nt, Human
aggcugaggggcgagggacccu

SEQ ID NO: 119411 - RNA, 22 nt, Human
aggauuaaaguauauuuuugag

SEQ ID NO: 119412 - RNA, 18 nt, Human
ccgggcuuuggugacaca

SEQ ID NO: 119413 - RNA, 22 nt, Human
gcacacacaugugaguacaugc

SEQ ID NO: 119414 - RNA, 22 nt, Human
cugccaggcacgugcagcauca

SEQ ID NO: 119415 - RNA, 22 nt, Human
ucauccaguaugacuggugucu

SEQ ID NO: 119416 - RNA, 22 nt, Human
cacauuuaagugcuuguucaga

SEQ ID NO: 119417 - RNA, 18 nt, Human
uacaggaagggguucucg

SEQ ID NO: 119418 - RNA, 20 nt, Human
ucucugagcuucucuugggg

SEQ ID NO: 119419 - RNA, 22 nt, Human
aaauacuggcaagugcuaauuc

SEQ ID NO: 119420 - RNA, 22 nt, Human
uggcagaggaaaaagucacugg

SEQ ID NO: 119421 - RNA, 22 nt, Human
gaaugcagauggcugguguaug

SEQ ID NO: 119422 - RNA, 22 nt, Human
caggaggcccaaagggcgcaga

SEQ ID NO: 119423 - RNA, 20 nt, Human
uaaacaguauuuacuaggag

SEQ ID NO: 119424 - RNA, 22 nt, Human
auucaguuucauggcacagcua

SEQ ID NO: 119425 - RNA, 22 nt, Human
cagguauucauagaauucagag

SEQ ID NO: 119426 - RNA, 22 nt, Human
ucaccccuacauuucccuugcu

SEQ ID NO: 119427 - RNA, 22 nt, Human
ugucauacaacaauaaguaccg

SEQ ID NO: 119428 - RNA, 22 nt, Human
auagaaauguauuuuggacuag

SEQ ID NO: 119429 - RNA, 22 nt, Human
ggagaugcgacucgcggggcug

SEQ ID NO: 119430 - RNA, 22 nt, Human
augaggcucucaggggagcugu

SEQ ID NO: 119431 - RNA, 17 nt, Human
ucaggcugggugcagug

SEQ ID NO: 119432 - RNA, 22 nt, Human
gagggcugugaaggagcggguu

SEQ ID NO: 119433 - RNA, 22 nt, Human
agaagagccuggggaccauggc

SEQ ID NO: 119434 - RNA, 22 nt, Human
ggugaagggccuuaggagacag

SEQ ID NO: 119435 - RNA, 22 nt, Human
agggccagaguacaucagggcu

SEQ ID NO: 119436 - RNA, 22 nt, Human
ggcagccaugcacgcugccugg

SEQ ID NO: 119437 - RNA, 22 nt, Human
aguacaugcagaacuaacagau

SEQ ID NO: 119438 - RNA, 22 nt, Human
ugcaaauagccugaugaaagaa

SEQ ID NO: 119439 - RNA, 22 nt, Human
uacaggcauguagcauggugau

SEQ ID NO: 119440 - RNA, 22 nt, Human
uuauagcagcaugauuuacaau

SEQ ID NO: 119441 - RNA, 22 nt, Human
auguuuuauguuccacucaagg

SEQ ID NO: 119442 - RNA, 22 nt, Human
uugcagagccaugaggcuggcu

SEQ ID NO: 119443 - RNA, 22 nt, Human
uugaaaggaauacagaggccua

SEQ ID NO: 119444 - RNA, 21 nt, Human
ucagggcagugggagguuccu

SEQ ID NO: 119445 - RNA, 22 nt, Human
ucucugagcgcauuccuccggc

SEQ ID NO: 119446 - RNA, 22 nt, Human
augcugugucaccuuaggauuu

SEQ ID NO: 119447 - RNA, 22 nt, Human
augcaagauguauagaagacuu

SEQ ID NO: 119448 - RNA, 22 nt, Human
cauaauuugugguaguggggga

SEQ ID NO: 119449 - RNA, 22 nt, Human
cugcuguguuggcauuggauag

SEQ ID NO: 119450 - RNA, 22 nt, Human
acacacuuuaaauuaaaccucu

SEQ ID NO: 119451 - RNA, 22 nt, Human
ugcaauacauacuuagacccag

SEQ ID NO: 119452 - RNA, 22 nt, Human
gccagguguaguggccacaccu

SEQ ID NO: 119453 - RNA, 22 nt, Human
cuugauauuuuaaacauacagu

SEQ ID NO: 119454 - RNA, 22 nt, Human
auuugcaaugauuucagugcuu

SEQ ID NO: 119455 - RNA, 21 nt, Human
ugcaggaaagugcugcgaccc

SEQ ID NO: 119456 - RNA, 22 nt, Human
gcaugagggggguuaggaaguu

SEQ ID NO: 119457 - RNA, 22 nt, Human
ucucucugccaacucacagcca

SEQ ID NO: 119458 - RNA, 22 nt, Human
augaacaauaaaauagaucaca

SEQ ID NO: 119459 - RNA, 22 nt, Human
gggagaaguggaaaucucauua

SEQ ID NO: 119460 - RNA, 22 nt, Human
gaaggcugagcagacaggccaa

SEQ ID NO: 119461 - RNA, 22 nt, Human
ugcugugcuccauugucuucac

SEQ ID NO: 119462 - RNA, 22 nt, Human
aaggaagaagacucuuuacucc

SEQ ID NO: 119463 - RNA, 22 nt, Human
gggaagggagggccuccaguca

SEQ ID NO: 119464 - RNA, 22 nt, Human
uuguuaaaaauagauuuccagg

SEQ ID NO: 119465 - RNA, 22 nt, Human
gcgagccucuggaguccucugg

SEQ ID NO: 119466 - RNA, 22 nt, Human
gauaaacaugaaguucugugua

SEQ ID NO: 119467 - RNA, 22 nt, Human
acaugcauacacguacauaccu

SEQ ID NO: 119468 - RNA, 22 nt, Human
gcagggaagacccggagcagcg

SEQ ID NO: 119469 - RNA, 22 nt, Human
cugggggucgcgccucugggca

SEQ ID NO: 119470 - RNA, 22 nt, Human
aacaugaaguuuucuauaguga

SEQ ID NO: 119471 - RNA, 20 nt, Human
caucuugaaggucuuccaca

SEQ ID NO: 119472 - RNA, 22 nt, Human
ugaaggagggaagaaggcucug

SEQ ID NO: 119473 - RNA, 22 nt, Human
augaggcagguggaggcugcca

SEQ ID NO: 119474 - RNA, 17 nt, Human
ugaugcaaagucagcug

SEQ ID NO: 119475 - RNA, 22 nt, Human
ccugucucuguuaccacauuug

SEQ ID NO: 119476 - RNA, 22 nt, Human
ugaggaaguuguuucucuucua

SEQ ID NO: 119477 - RNA, 22 nt, Human
ccugagugcuuccagagucaug

SEQ ID NO: 119478 - RNA, 22 nt, Human
aggcaggaacccugugugcgcc

SEQ ID NO: 119479 - RNA, 22 nt, Human
acuggacagaggaaauauggag

SEQ ID NO: 119480 - RNA, 22 nt, Human
acaguggaaaugugggagggga

SEQ ID NO: 119481 - RNA, 22 nt, Human
aacauguugcuuuaauaauauu

SEQ ID NO: 119482 - RNA, 22 nt, Human
auaugcaagcacauagaauacu

SEQ ID NO: 119483 - RNA, 22 nt, Human
uccagcuugccuggucuuuugg

SEQ ID NO: 119484 - RNA, 22 nt, Human
acauuugagcaucuacuaagug

SEQ ID NO: 119485 - RNA, 22 nt, Human
ugcaggcugggaagagggacaa

SEQ ID NO: 119486 - RNA, 22 nt, Human
cuacaguaugaaaccuuuacuc

SEQ ID NO: 119487 - RNA, 23 nt, Human
uucuucauuuucagaguugagca

SEQ ID NO: 119488 - RNA, 22 nt, Human
ucacaucacccugcucuuaauu

SEQ ID NO: 119489 - RNA, 22 nt, Human
augggcaguguauuggaaggaa

SEQ ID NO: 119490 - RNA, 22 nt, Human
ugcgggucaucagggagaacgu

SEQ ID NO: 119491 - RNA, 22 nt, Human
cuugcuacuaugccuggcuaau

SEQ ID NO: 119492 - RNA, 22 nt, Human
aaacaugaauagauauuaaaca

SEQ ID NO: 119493 - RNA, 22 nt, Human
gcaggagcuggaaagugauguu

SEQ ID NO: 119494 - RNA, 22 nt, Human
acacagugccaaauugcaguua

SEQ ID NO: 119495 - RNA, 16 nt, Human
cagccugcagugguca

SEQ ID NO: 119496 - RNA, 22 nt, Human
agaugcagaguugcuuaagcau

SEQ ID NO: 119497 - RNA, 22 nt, Human
uuuguucaugccuauauucuca

SEQ ID NO: 119498 - RNA, 22 nt, Human
aaauuggauugggagaauguga

SEQ ID NO: 119499 - RNA, 22 nt, Human
agaagccaaaugccagugaccu

SEQ ID NO: 119500 - RNA, 22 nt, Human
ccugugcaauguugagguuuca

SEQ ID NO: 119501 - RNA, 22 nt, Human
uggcucagagcagggacucugg

SEQ ID NO: 119502 - RNA, 22 nt, Human
aggcucagagaugaguaagcac

SEQ ID NO: 119503 - RNA, 22 nt, Human
gugugcagcagagacaggacuc

SEQ ID NO: 119504 - RNA, 22 nt, Human
ucaggcaggcucagaggaaaac

SEQ ID NO: 119505 - RNA, 22 nt, Human
ggagugaaguggcgcgaucucg

SEQ ID NO: 119506 - RNA, 22 nt, Human
acagcuguauccccagagcuca

SEQ ID NO: 119507 - RNA, 22 nt, Human
uucaucugcugguuuuuggcau

SEQ ID NO: 119508 - RNA, 22 nt, Human
ggcaggcaagucugcucuguga

SEQ ID NO: 119509 - RNA, 21 nt, Human
gcagaauagucucugucuuca

SEQ ID NO: 119510 - RNA, 22 nt, Human
gggcugagagugacuguucugu

SEQ ID NO: 119511 - RNA, 22 nt, Human
gaacuguaguuaauacuacaca

SEQ ID NO: 119512 - RNA, 22 nt, Human
uucauaugcagauuaacaaaua

SEQ ID NO: 119513 - RNA, 22 nt, Human
aaugcacagcuaaagugguucc

SEQ ID NO: 119514 - RNA, 22 nt, Human
ucacauuuuaucugagauugac

SEQ ID NO: 119515 - RNA, 22 nt, Human
uaggcucagggcugggugacgg

SEQ ID NO: 119516 - RNA, 23 nt, Human
uuuugcaauaagucacuggaaua

SEQ ID NO: 119517 - RNA, 22 nt, Human
ucaggcugaggucaucugcauc

SEQ ID NO: 119518 - RNA, 22 nt, Human
ugccaggcuuuggucaaaggcu

SEQ ID NO: 119519 - RNA, 22 nt, Human
ugcucauugcugauuuacaugu

SEQ ID NO: 119520 - RNA, 20 nt, Human
aguggcaggcgaucauuacu

SEQ ID NO: 119521 - RNA, 22 nt, Human
cuaguugaagaggcugucauca

SEQ ID NO: 119522 - RNA, 22 nt, Human
cauaacauccuugcuacuuuga

SEQ ID NO: 119523 - RNA, 22 nt, Human
agggcaugaagcaguggacagc

SEQ ID NO: 119524 - RNA, 22 nt, Human
guccuuugaaggcaaaaggaga

SEQ ID NO: 119525 - RNA, 22 nt, Human
guaaacaggaauguggucaugg

SEQ ID NO: 119526 - RNA, 22 nt, Human
cagaauaaagguacaauugagu

SEQ ID NO: 119527 - RNA, 22 nt, Human
aggcagagcuaggaagaauugu

SEQ ID NO: 119528 - RNA, 22 nt, Human
gagcagugacuggagcaugaga

SEQ ID NO: 119529 - RNA, 22 nt, Human
aggcugaggcagguggaucacu

SEQ ID NO: 119530 - RNA, 22 nt, Human
cuggagugaagcuuauuuuuca

SEQ ID NO: 119531 - RNA, 22 nt, Human
uauuuguauguguguacauaua

SEQ ID NO: 119532 - RNA, 22 nt, Human
gaggcagagacuccaccuucag

SEQ ID NO: 119533 - RNA, 22 nt, Human
aggugcagaaaaaaguccuuua

SEQ ID NO: 119534 - RNA, 22 nt, Human
uguguccuuuggaggaucagcg

SEQ ID NO: 119535 - RNA, 22 nt, Human
gcacaugguaggcauuugaugu

SEQ ID NO: 119536 - RNA, 22 nt, Human
aauuugauuuucuuaaaccaua

SEQ ID NO: 119537 - RNA, 22 nt, Human
uacaggcacugaaaugcuuauu

SEQ ID NO: 119538 - RNA, 22 nt, Human
agagaugcuguggguagaggca

SEQ ID NO: 119539 - RNA, 22 nt, Human
agggaggaucugcuccuugucu

SEQ ID NO: 119540 - RNA, 22 nt, Human
auguaaacuuagauaagcagua

SEQ ID NO: 119541 - RNA, 22 nt, Human
acaguggagcucagaugaaaau

SEQ ID NO: 119542 - RNA, 22 nt, Human
gggcgccgugggaaacagccgg

SEQ ID NO: 119543 - RNA, 22 nt, Human
ugagcagaggaggcugccaacu

SEQ ID NO: 119544 - RNA, 22 nt, Human
agaauaaacugcuuuagggcag

SEQ ID NO: 119545 - RNA, 22 nt, Human
gcaccugggacccagaggcacc

SEQ ID NO: 119546 - RNA, 22 nt, Human
uggcucauucuggggaagucag

SEQ ID NO: 119547 - RNA, 21 nt, Human
aucaccagcagaagcugcaga

SEQ ID NO: 119548 - RNA, 22 nt, Human
caaaugaagggagcugaagucu

SEQ ID NO: 119549 - RNA, 22 nt, Human
aaaggucuuaagguuaagcagg

SEQ ID NO: 119550 - RNA, 22 nt, Human
caggcugggcuccggagauaaa

SEQ ID NO: 119551 - RNA, 22 nt, Human
aggcaggugcuuaugacuugcu

SEQ ID NO: 119552 - RNA, 22 nt, Human
gccugagaguugaaguucagug

SEQ ID NO: 119553 - RNA, 22 nt, Human
guauuauuggguaguaugguaa

SEQ ID NO: 119554 - RNA, 22 nt, Human
agaagugagugugacucagcag

SEQ ID NO: 119555 - RNA, 22 nt, Human
ucccaggguuacagccagggca

SEQ ID NO: 119556 - RNA, 22 nt, Human
acugugcaugguauccuugaug

SEQ ID NO: 119557 - RNA, 22 nt, Human
ugcagggacacgaagacaaaua

SEQ ID NO: 119558 - RNA, 22 nt, Human
gaguccaguuagugaggcuggg

SEQ ID NO: 119559 - RNA, 22 nt, Human
cagugcagguuuagggcugggg

SEQ ID NO: 119560 - RNA, 22 nt, Human
ccaucccuucaccacagcagua

SEQ ID NO: 119561 - RNA, 22 nt, Human
ucauuuguucucauucucuacu

SEQ ID NO: 119562 - RNA, 22 nt, Human
ucaggcagaaaaaucacuaauu

SEQ ID NO: 119563 - RNA, 20 nt, Human
cagaggcaaggagacuugga

SEQ ID NO: 119564 - RNA, 22 nt, Human
cucagccccaauucuccccauu

SEQ ID NO: 119565 - RNA, 16 nt, Human
agccaggcugccucgg

SEQ ID NO: 119566 - RNA, 22 nt, Human
ugaguaaauauuuaugacuaga

SEQ ID NO: 119567 - RNA, 22 nt, Human
agggagguaggagcuucuagcu

SEQ ID NO: 119568 - RNA, 22 nt, Human
agggccacaguggggccugaga

SEQ ID NO: 119569 - RNA, 21 nt, Human
aucccagcacccaggagugca

SEQ ID NO: 119570 - RNA, 22 nt, Human
gugaagagcuguugcagagauu

SEQ ID NO: 119571 - RNA, 20 nt, Human
gcaaauggacacucagggaa

SEQ ID NO: 119572 - RNA, 22 nt, Human
auuucuacugugagaaacauga

SEQ ID NO: 119573 - RNA, 22 nt, Human
cuggcuuuggaaacaauuuauc

SEQ ID NO: 119574 - RNA, 22 nt, Human
ugauuacacaccacagugcucc

SEQ ID NO: 119575 - RNA, 22 nt, Human
gcacccagaauaaggacaggac

SEQ ID NO: 119576 - RNA, 22 nt, Human
ugcaggaauagcuacagagcug

SEQ ID NO: 119577 - RNA, 22 nt, Human
agugcacagcgugauguauugg

SEQ ID NO: 119578 - RNA, 22 nt, Human
gcaccugguuuauauaaucaua

SEQ ID NO: 119579 - RNA, 22 nt, Human
gacaauuucucaauauagaaac

SEQ ID NO: 119580 - RNA, 22 nt, Human
cugggcaguuuauucaguucug

SEQ ID NO: 119581 - RNA, 22 nt, Human
ucugugcauccuuaacgccugc

SEQ ID NO: 119582 - RNA, 22 nt, Human
ggcagggcagcgcugauuaggg

SEQ ID NO: 119583 - RNA, 22 nt, Human
augcagaaagagaauguaaugu

SEQ ID NO: 119584 - RNA, 22 nt, Human
aagaacuguaucaagauguagu

SEQ ID NO: 119585 - RNA, 22 nt, Human
gucugcauacaggacaugcaca

SEQ ID NO: 119586 - RNA, 22 nt, Human
gacauaaaccuugagauauuaa

SEQ ID NO: 119587 - RNA, 22 nt, Human
aacaucaucaugaacaacuaau

SEQ ID NO: 119588 - RNA, 22 nt, Human
uacagugacccuauuuccaaau

SEQ ID NO: 119589 - RNA, 22 nt, Human
cacuggggugggccugguagag

SEQ ID NO: 119590 - RNA, 22 nt, Human
aggcugagcuggcccuugaaau

SEQ ID NO: 119591 - RNA, 22 nt, Human
uuaacauuguccuuagcagauu

SEQ ID NO: 119592 - RNA, 22 nt, Human
uggggugugagaaguagaggga

SEQ ID NO: 119593 - RNA, 22 nt, Human
guuguacagcauccagugcaga

SEQ ID NO: 119594 - RNA, 22 nt, Human
uucauucauguauugucuaugg

SEQ ID NO: 119595 - RNA, 22 nt, Human
uacaacagaccuagaugaauga

SEQ ID NO: 119596 - RNA, 22 nt, Human
accaggagccacaggaggagcc

SEQ ID NO: 119597 - RNA, 22 nt, Human
uggcagagguauauugggagga

SEQ ID NO: 119598 - RNA, 19 nt, Human
gcugugggacagcagggug

SEQ ID NO: 119599 - RNA, 22 nt, Human
aagagggguggucugugaggau

SEQ ID NO: 119600 - RNA, 22 nt, Human
aucauaaaccacuuuguaaucu

SEQ ID NO: 119601 - RNA, 18 nt, Human
uggcagagugucuguucu

SEQ ID NO: 119602 - RNA, 22 nt, Human
caugucuuuguuaugcucacca

SEQ ID NO: 119603 - RNA, 22 nt, Human
aaucacauuacagcauaucugu

SEQ ID NO: 119604 - RNA, 22 nt, Human
ugaaacauuaggaaaucauuau

SEQ ID NO: 119605 - RNA, 22 nt, Human
cauuugcaaaccaacaagauga

SEQ ID NO: 119606 - RNA, 22 nt, Human
agggcagcaaugcagcugcugc

SEQ ID NO: 119607 - RNA, 22 nt, Human
ucuccccaaaggacucacucuc

SEQ ID NO: 119608 - RNA, 22 nt, Human
aaguggagccagggaaacugaa

SEQ ID NO: 119609 - RNA, 22 nt, Human
uuugcaaauaaauaagugcucg

SEQ ID NO: 119610 - RNA, 22 nt, Human
ccagcugucugguuccagagcc

SEQ ID NO: 119611 - RNA, 22 nt, Human
aaacaggucugaaaauagcuac

SEQ ID NO: 119612 - RNA, 22 nt, Human
ugcagcaaacaggccuucaggg

SEQ ID NO: 119613 - RNA, 22 nt, Human
ccagggcaaaugagaucauagc

SEQ ID NO: 119614 - RNA, 21 nt, Human
guuauuuuaagugagcuuugc

SEQ ID NO: 119615 - RNA, 22 nt, Human
acaaauggaagguguucucuuc

SEQ ID NO: 119616 - RNA, 21 nt, Human
ugggggagaauugguugcuuu

SEQ ID NO: 119617 - RNA, 22 nt, Human
cauccugcggggagcagagggc

SEQ ID NO: 119618 - RNA, 22 nt, Human
gaaggcuaaaggggcagagguu

SEQ ID NO: 119619 - RNA, 22 nt, Human
ugcagggccuugggaugugucc

SEQ ID NO: 119620 - RNA, 22 nt, Human
gggcugagacgauggggucuuc

SEQ ID NO: 119621 - RNA, 19 nt, Human
aggacccuuauccuggcuu

SEQ ID NO: 119622 - RNA, 22 nt, Human
ucugugcaccuucuaaugagua

SEQ ID NO: 119623 - RNA, 22 nt, Human
agggcaugcuggaggagagaca

SEQ ID NO: 119624 - RNA, 22 nt, Human
caugaaauguuagaauuagaca

SEQ ID NO: 119625 - RNA, 21 nt, Human
aggcucagagagaaacucuug

SEQ ID NO: 119626 - RNA, 22 nt, Human
gccaggaguucagaugcauguu

SEQ ID NO: 119627 - RNA, 22 nt, Human
cagguauuuucaaggcuugugu

SEQ ID NO: 119628 - RNA, 22 nt, Human
uccuuugguuguagacaggaau

SEQ ID NO: 119629 - RNA, 20 nt, Human
gggcagccucgggagugggu

SEQ ID NO: 119630 - RNA, 18 nt, Human
uggaggcagaguucuggc

SEQ ID NO: 119631 - RNA, 22 nt, Human
uagaaaggauauugagaugaau

SEQ ID NO: 119632 - RNA, 22 nt, Human
aggcugagcugguagugaguac

SEQ ID NO: 119633 - RNA, 23 nt, Human
ccagggccccuacaccacugucc

SEQ ID NO: 119634 - RNA, 22 nt, Human
gagaagucauuugaccaccuag

SEQ ID NO: 119635 - RNA, 22 nt, Human
gauuuucaugauaaacuuguga

SEQ ID NO: 119636 - RNA, 22 nt, Human
agggcagaaguacagacacuua

SEQ ID NO: 119637 - RNA, 20 nt, Human
aacauuuguagucaggcaca

SEQ ID NO: 119638 - RNA, 22 nt, Human
cagggcugagaauuuagagaca

SEQ ID NO: 119639 - RNA, 22 nt, Human
cagugcaguuucccagaugcug

SEQ ID NO: 119640 - RNA, 22 nt, Human
aaggugucaccagauuggcagg

SEQ ID NO: 119641 - RNA, 22 nt, Human
ucuuugcuccacacucuagaga

SEQ ID NO: 119642 - RNA, 22 nt, Human
gcaaauaauauacuuugaucuc

SEQ ID NO: 119643 - RNA, 22 nt, Human
auuuguagugaagugaaaauaa

SEQ ID NO: 119644 - RNA, 21 nt, Human
auggaaauuggcaaaugcuac

SEQ ID NO: 119645 - RNA, 22 nt, Human
cauuuagagaagauuacaagga

SEQ ID NO: 119646 - RNA, 22 nt, Human
aggaagcaaaaggcagggucua

SEQ ID NO: 119647 - RNA, 22 nt, Human
gccaccagcagaaaaggggcca

SEQ ID NO: 119648 - RNA, 22 nt, Human
ugccaggcauguaguagacuug

SEQ ID NO: 119649 - RNA, 22 nt, Human
ucagggcagguuaacuugggug

SEQ ID NO: 119650 - RNA, 22 nt, Human
gaagccacaacuuuuucuuagc

SEQ ID NO: 119651 - RNA, 20 nt, Human
ucugugcaguuuaggaaggc

SEQ ID NO: 119652 - RNA, 21 nt, Human
ugaggcucuguugugccugca

SEQ ID NO: 119653 - RNA, 22 nt, Human
gcugagaugucguuagauaucu

SEQ ID NO: 119654 - RNA, 22 nt, Human
aagggcagaauagagaagaugg

SEQ ID NO: 119655 - RNA, 22 nt, Human
agggcugaguggugcagucaaa

SEQ ID NO: 119656 - RNA, 22 nt, Human
ucagaggaccuuacugagaacc

SEQ ID NO: 119657 - RNA, 22 nt, Human
caguggcacccacgggcugggc

SEQ ID NO: 119658 - RNA, 22 nt, Human
acauggauaaauuuuacuuucc

SEQ ID NO: 119659 - RNA, 22 nt, Human
aggaauuaacaauauauuuagg

SEQ ID NO: 119660 - RNA, 22 nt, Human
auaacacuaaauguauguaaca

SEQ ID NO: 119661 - RNA, 22 nt, Human
auuuugcacacuaugcagcuuu

SEQ ID NO: 119662 - RNA, 22 nt, Human
gaggaaggcuaaggggcuuaga

SEQ ID NO: 119663 - RNA, 22 nt, Human
aggcaguuucugggacagcaua

SEQ ID NO: 119664 - RNA, 22 nt, Human
ugaagugaccuggggcagugua

SEQ ID NO: 119665 - RNA, 21 nt, Human
acaugagacacacauauaugu

SEQ ID NO: 119666 - RNA, 22 nt, Human
uggagaagucaaagugaacagg

SEQ ID NO: 119667 - RNA, 22 nt, Human
aagggcuguaagccaaguaaag

SEQ ID NO: 119668 - RNA, 22 nt, Human
aauuuugugugggaucaaagga

SEQ ID NO: 119669 - RNA, 22 nt, Human
cuuauuuugcugaugacccagg

SEQ ID NO: 119670 - RNA, 22 nt, Human
ggcugugcccucacauggggca

SEQ ID NO: 119671 - RNA, 22 nt, Human
ugccaggcuccggaacgacagu

SEQ ID NO: 119672 - RNA, 22 nt, Human
aauggcugccagggcaggaggu

SEQ ID NO: 119673 - RNA, 22 nt, Human
gcagaggcauuucugacgcugc

SEQ ID NO: 119674 - RNA, 22 nt, Human
aaauggaacugggcuacuaggu

SEQ ID NO: 119675 - RNA, 22 nt, Human
gaagcuaaugauuuauuuucug

SEQ ID NO: 119676 - RNA, 22 nt, Human
auuuucuauucugcugguuuag

SEQ ID NO: 119677 - RNA, 22 nt, Human
cuagggcacuaggacucaugug

SEQ ID NO: 119678 - RNA, 22 nt, Human
augcugagguuguuguccuauu

SEQ ID NO: 119679 - RNA, 19 nt, Human
ggagaggcuggagggaugc

SEQ ID NO: 119680 - RNA, 22 nt, Human
uaaaggcuucugcagggacuga

SEQ ID NO: 119681 - RNA, 22 nt, Human
gagcugaacaaauugcgagugg

SEQ ID NO: 119682 - RNA, 22 nt, Human
caggcagcgcucguggccuggc

SEQ ID NO: 119683 - RNA, 22 nt, Human
aacauaaauuugaaguggcaaa

SEQ ID NO: 119684 - RNA, 22 nt, Human
aggcagagaaaaaccagauaug

SEQ ID NO: 119685 - RNA, 22 nt, Human
gagaggcauggaacagauucuu

SEQ ID NO: 119686 - RNA, 22 nt, Human
ucccuccuggugagcaggggcu

SEQ ID NO: 119687 - RNA, 22 nt, Human
aacauucuaugugcauucagaa

SEQ ID NO: 119688 - RNA, 22 nt, Human
acauugaugaucccacuuacag

SEQ ID NO: 119689 - RNA, 22 nt, Human
uacagaagcugagacacugaga

SEQ ID NO: 119690 - RNA, 22 nt, Human
aaauacuguuuuauuccaugau

SEQ ID NO: 119691 - RNA, 22 nt, Human
agcagggccucuggcacugguc

SEQ ID NO: 119692 - RNA, 22 nt, Human
agggagcaugggugaagcaggc

SEQ ID NO: 119693 - RNA, 22 nt, Human
gcagggcaaacccagguguuca

SEQ ID NO: 119694 - RNA, 22 nt, Human
uguccuuuaugaaaugguguuu

SEQ ID NO: 119695 - RNA, 22 nt, Human
agggccugggucuguacuccuc

SEQ ID NO: 119696 - RNA, 22 nt, Human
gaggcacaguguuuggucagug

SEQ ID NO: 119697 - RNA, 20 nt, Human
acauccuggugacuagaacu

SEQ ID NO: 119698 - RNA, 22 nt, Human
cgggaggaaaggcgaggcucug

SEQ ID NO: 119699 - RNA, 22 nt, Human
aagggcuggaauaucucuuaga

SEQ ID NO: 119700 - RNA, 22 nt, Human
agacagugacuuagugaccaga

SEQ ID NO: 119701 - RNA, 22 nt, Human
aagagcuggcucuugcagcagc

SEQ ID NO: 119702 - RNA, 22 nt, Human
gcagaggagaugaagauacuuu

SEQ ID NO: 119703 - RNA, 22 nt, Human
uucucagauccaucagaagucc

SEQ ID NO: 119704 - RNA, 22 nt, Human
uggcugagaccuucccaaauuc

SEQ ID NO: 119705 - RNA, 22 nt, Human
agugcaugaaagcauacaaggc

SEQ ID NO: 119706 - RNA, 22 nt, Human
cugagggagaagucacgggcag

SEQ ID NO: 119707 - RNA, 19 nt, Human
ucugucauuucuucuguac

SEQ ID NO: 119708 - RNA, 22 nt, Human
ugauuuaugaccaaguuagaau

SEQ ID NO: 119709 - RNA, 22 nt, Human
uggcagaguucgcuccuauuca

SEQ ID NO: 119710 - RNA, 21 nt, Human
gcugugcacauaguagaagug

SEQ ID NO: 119711 - RNA, 19 nt, Human
ugcauauaucuaugaaaga

SEQ ID NO: 119712 - RNA, 21 nt, Human
agaggcaggcauuaaguacac

SEQ ID NO: 119713 - RNA, 22 nt, Human
ugccaggcacgugagaguggcc

SEQ ID NO: 119714 - RNA, 16 nt, Human
aggcagagauuuaccc

SEQ ID NO: 119715 - RNA, 22 nt, Human
guuauuuuaucucugagagguu

SEQ ID NO: 119716 - RNA, 21 nt, Human
gaaggagaaagcaagugcugc

SEQ ID NO: 119717 - RNA, 22 nt, Human
cagcugugaauugucuuaucua

SEQ ID NO: 119718 - RNA, 22 nt, Human
ccagagccucaacacagguccu

SEQ ID NO: 119719 - RNA, 22 nt, Human
uggaggaaguugcuggaaguca

SEQ ID NO: 119720 - RNA, 20 nt, Human
gagggcaggcacccauuuca

SEQ ID NO: 119721 - RNA, 22 nt, Human
ucauaaaaugcuccugauauug

SEQ ID NO: 119722 - RNA, 22 nt, Human
gauaacauuauaaguucacugu

SEQ ID NO: 119723 - RNA, 22 nt, Human
gacauaaaauucaauaauuugu

SEQ ID NO: 119724 - RNA, 22 nt, Human
cagcacagugcagaugcugacu

SEQ ID NO: 119725 - RNA, 22 nt, Human
gggcugagauuggugcccuguc

SEQ ID NO: 119726 - RNA, 22 nt, Human
uuaaaaugaauauugauuagca

SEQ ID NO: 119727 - RNA, 22 nt, Human
ggcugugcagggcagagucuca

SEQ ID NO: 119728 - RNA, 22 nt, Human
gggaagccaugcucagagguac

SEQ ID NO: 119729 - RNA, 22 nt, Human
gccagcugcuggaacagcgcga

SEQ ID NO: 119730 - RNA, 22 nt, Human
agaugcugugaggaagcuagga

SEQ ID NO: 119731 - RNA, 22 nt, Human
caggcagcucaaccuugggagc

SEQ ID NO: 119732 - RNA, 22 nt, Human
cauggcagugauucagccuuug

SEQ ID NO: 119733 - RNA, 22 nt, Human
ggucagugccuaucaugugggc

SEQ ID NO: 119734 - RNA, 22 nt, Human
ugucaauaacauuuacuucuau

SEQ ID NO: 119735 - RNA, 22 nt, Human
gugaaggcuacaagagaucaag

SEQ ID NO: 119736 - RNA, 22 nt, Human
ugcagggccuugggucuuucuu

SEQ ID NO: 119737 - RNA, 22 nt, Human
agcagugaugcaugacagccua

SEQ ID NO: 119738 - RNA, 18 nt, Human
acacacacaccuguguau

SEQ ID NO: 119739 - RNA, 22 nt, Human
uuuauauguuuguacaauuaag

SEQ ID NO: 119740 - RNA, 22 nt, Human
ugggcaggugcuauuuuccaug

SEQ ID NO: 119741 - RNA, 22 nt, Human
agacagugagaaugaguugaaa

SEQ ID NO: 119742 - RNA, 22 nt, Human
uaggugugggcucaggaaugug

SEQ ID NO: 119743 - RNA, 22 nt, Human
gggcagugacaaaggggaugaa

SEQ ID NO: 119744 - RNA, 22 nt, Human
gauacaguauuuaaagagcaac

SEQ ID NO: 119745 - RNA, 22 nt, Human
caaaugcauaguuuauaagaag

SEQ ID NO: 119746 - RNA, 22 nt, Human
caggaaagagcugccaggcagg

SEQ ID NO: 119747 - RNA, 22 nt, Human
uuacaacauaugauaggagucu

SEQ ID NO: 119748 - RNA, 22 nt, Human
uagcagcuuaaguaauuagaau

SEQ ID NO: 119749 - RNA, 22 nt, Human
ugaaaaaacaaguuggcccauu

SEQ ID NO: 119750 - RNA, 22 nt, Human
ugaagccauuacuguguuaggg

SEQ ID NO: 119751 - RNA, 23 nt, Human
uucaaagcuuaagcucuuuccac

SEQ ID NO: 119752 - RNA, 22 nt, Human
gccuguuggugacuuucuguug

SEQ ID NO: 119753 - RNA, 22 nt, Human
gaggcaguggucugaugcaagg

SEQ ID NO: 119754 - RNA, 22 nt, Human
agaggaggcuggguccagauaa

SEQ ID NO: 119755 - RNA, 22 nt, Human
ggagaggcuuggcccagccugg

SEQ ID NO: 119756 - RNA, 22 nt, Human
aggcuguccucucuugcucagu

SEQ ID NO: 119757 - RNA, 22 nt, Human
aguucccaggugaugcugaugu

SEQ ID NO: 119758 - RNA, 22 nt, Human
ggggccagcacugugccuuugu

SEQ ID NO: 119759 - RNA, 22 nt, Human
ccagaggaugcuggucagccuc

SEQ ID NO: 119760 - RNA, 22 nt, Human
acauuuugagaaaugacaagcu

SEQ ID NO: 119761 - RNA, 23 nt, Human
uuacuuuugcaccaaccuaauau

SEQ ID NO: 119762 - RNA, 22 nt, Human
agccucaguuucaggccuccuc

SEQ ID NO: 119763 - RNA, 22 nt, Human
gcaggcuggucugaccaucccu

SEQ ID NO: 119764 - RNA, 22 nt, Human
gaaggcuguuucugguagugau

SEQ ID NO: 119765 - RNA, 23 nt, Human
uggcagagacccagaaucuacau

SEQ ID NO: 119766 - RNA, 22 nt, Human
gggggagagacgagcggcucug

SEQ ID NO: 119767 - RNA, 22 nt, Human
uccagcuuauagguagauuuaa

SEQ ID NO: 119768 - RNA, 22 nt, Human
uaugaacacuuauuggggaagg

SEQ ID NO: 119769 - RNA, 22 nt, Human
uggcugaguguuccaaggagca

SEQ ID NO: 119770 - RNA, 22 nt, Human
uauaggauugguucccauuuua

SEQ ID NO: 119771 - RNA, 22 nt, Human
agaucauagcacaaaagugaca

SEQ ID NO: 119772 - RNA, 22 nt, Human
gcaccugggguacacagcuaca

SEQ ID NO: 119773 - RNA, 22 nt, Human
uggcucagaagaaaagguaaac

SEQ ID NO: 119774 - RNA, 22 nt, Human
cauaagaaauuuaacagaacuu

SEQ ID NO: 119775 - RNA, 22 nt, Human
aaggagaaaugguagaugugca

SEQ ID NO: 119776 - RNA, 22 nt, Human
aagucuguuugagugucacacu

SEQ ID NO: 119777 - RNA, 22 nt, Human
ugagaucugugcauguuaguua

SEQ ID NO: 119778 - RNA, 22 nt, Human
cagugcccaagaugugccaugc

SEQ ID NO: 119779 - RNA, 22 nt, Human
acauuugaggauguuaagaaug

SEQ ID NO: 119780 - RNA, 22 nt, Human
caggaugcacuaggaaccaggg

SEQ ID NO: 119781 - RNA, 19 nt, Human
agugucagaauucauugaa

SEQ ID NO: 119782 - RNA, 22 nt, Human
acccaggaggcagagguugcag

SEQ ID NO: 119783 - RNA, 20 nt, Human
ugaggcucagagagguugag

SEQ ID NO: 119784 - RNA, 22 nt, Human
caggagccagcugucccaacca

SEQ ID NO: 119785 - RNA, 22 nt, Human
acaaaggcaggauugacuuagu

SEQ ID NO: 119786 - RNA, 22 nt, Human
uuuaagcaaguugacauagcau

SEQ ID NO: 119787 - RNA, 22 nt, Human
aaggccagaguacuagaggcug

SEQ ID NO: 119788 - RNA, 16 nt, Human
ggcaccagugaacaca

SEQ ID NO: 119789 - RNA, 22 nt, Human
agaagugccgaaaggaagacag

SEQ ID NO: 119790 - RNA, 22 nt, Human
gcucccagucugauggaggaga

SEQ ID NO: 119791 - RNA, 22 nt, Human
gugaggcagagaugccaaaacu

SEQ ID NO: 119792 - RNA, 22 nt, Human
gcugagagaucaaggcaggauu

SEQ ID NO: 119793 - RNA, 22 nt, Human
gcagaggccaggccaccagcaa

SEQ ID NO: 119794 - RNA, 22 nt, Human
aggcugaguuucucauucucgc

SEQ ID NO: 119795 - RNA, 22 nt, Human
auacaguauaacuaauaaaccc

SEQ ID NO: 119796 - RNA, 22 nt, Human
ugcaguggugguaaagaugcuc

SEQ ID NO: 119797 - RNA, 22 nt, Human
aggcugcguuagccucacuccc

SEQ ID NO: 119798 - RNA, 22 nt, Human
agggggucuccuaucauggaag

SEQ ID NO: 119799 - RNA, 22 nt, Human
ucagaggaauuugcuuuucaug

SEQ ID NO: 119800 - RNA, 22 nt, Human
aguguacauaguuaggaacauc

SEQ ID NO: 119801 - RNA, 17 nt, Human
gagugcagacacaagca

SEQ ID NO: 119802 - RNA, 22 nt, Human
gaggcagcagaacauggaagag

SEQ ID NO: 119803 - RNA, 20 nt, Human
acauuuuggcauacucucaa

SEQ ID NO: 119804 - RNA, 22 nt, Human
ccagaagaccccguccaccucc

SEQ ID NO: 119805 - RNA, 22 nt, Human
uggaagaaggcagagaggcauu

SEQ ID NO: 119806 - RNA, 22 nt, Human
agggccagggaaacgaucagca

SEQ ID NO: 119807 - RNA, 22 nt, Human
cauauuucagucuaagaugugu

SEQ ID NO: 119808 - RNA, 22 nt, Human
uccugagggacugguuccucgc

SEQ ID NO: 119809 - RNA, 22 nt, Human
ugagagcugggaaauguuagcu

SEQ ID NO: 119810 - RNA, 20 nt, Human
ugcagggcugccucccagcu

SEQ ID NO: 119811 - RNA, 22 nt, Human
gaggaagaauugguuauuggag

SEQ ID NO: 119812 - RNA, 22 nt, Human
agucacuaggcugaaaguggag

SEQ ID NO: 119813 - RNA, 22 nt, Human
gaugaagaggcacugacauauu

SEQ ID NO: 119814 - RNA, 22 nt, Human
agggcagagaucugagugggca

SEQ ID NO: 119815 - RNA, 23 nt, Human
acaucagaguuaguucaaucagg

SEQ ID NO: 119816 - RNA, 22 nt, Human
accagggcccgggagagcucuc

SEQ ID NO: 119817 - RNA, 22 nt, Human
ugaggcagucacccccuccugc

SEQ ID NO: 119818 - RNA, 22 nt, Human
ggacaucuugguugcuuccaag

SEQ ID NO: 119819 - RNA, 22 nt, Human
cagccucuuuccacaucaggca

SEQ ID NO: 119820 - RNA, 22 nt, Human
ucccagauucuucugugugggc

SEQ ID NO: 119821 - RNA, 22 nt, Human
agagccaggaaguggcgugggg

SEQ ID NO: 119822 - RNA, 18 nt, Human
aacaguuuccagauucuc

SEQ ID NO: 119823 - RNA, 19 nt, Human
ucaguggagaaaggggaag

SEQ ID NO: 119824 - RNA, 22 nt, Human
agaggaggccaggcccacaccu

SEQ ID NO: 119825 - RNA, 22 nt, Human
cuguggaguggggaguacuggu

SEQ ID NO: 119826 - RNA, 22 nt, Human
uuuguacacugucuacuaugaa

SEQ ID NO: 119827 - RNA, 22 nt, Human
aggcucaggaggagcugccgga

SEQ ID NO: 119828 - RNA, 22 nt, Human
gacauuuguaugacacuuuaaa

SEQ ID NO: 119829 - RNA, 22 nt, Human
uauacacugauauaaggaguaa

SEQ ID NO: 119830 - RNA, 22 nt, Human
agagggcaugcuugguggccug

SEQ ID NO: 119831 - RNA, 20 nt, Human
agacaaaaugacuucaugca

SEQ ID NO: 119832 - RNA, 22 nt, Human
uaggugucugcucuuauuuaac

SEQ ID NO: 119833 - RNA, 22 nt, Human
gggcagugguccaggcuacagc

SEQ ID NO: 119834 - RNA, 22 nt, Human
auggaaauaucuuuagagcuua

SEQ ID NO: 119835 - RNA, 22 nt, Human
guuaaauucgaugauggauaaa

SEQ ID NO: 119836 - RNA, 22 nt, Human
cccagccugucuuucccaauga

SEQ ID NO: 119837 - RNA, 22 nt, Human
cacaggaagagguauacaauuc

SEQ ID NO: 119838 - RNA, 22 nt, Human
ccaagggaaaccgagaggcugg

SEQ ID NO: 119839 - RNA, 18 nt, Human
gauguaaaauaguagcuu

SEQ ID NO: 119840 - RNA, 22 nt, Human
uggcaugauaggaggugcagaa

SEQ ID NO: 119841 - RNA, 22 nt, Human
agacauuuggaagauacacaua

SEQ ID NO: 119842 - RNA, 21 nt, Human
ccuggccaaucugauaggguu

SEQ ID NO: 119843 - RNA, 22 nt, Human
cagagugaaaacugagcucaaa

SEQ ID NO: 119844 - RNA, 22 nt, Human
uggcugaggagggucuucuggu

SEQ ID NO: 119845 - RNA, 22 nt, Human
uggcugagagaagacggggaag

SEQ ID NO: 119846 - RNA, 23 nt, Human
gggcagguuuuuauaggcuucag

SEQ ID NO: 119847 - RNA, 22 nt, Human
augggcagacagggagcucacg

SEQ ID NO: 119848 - RNA, 22 nt, Human
aagagcuggaguuugcagcccu

SEQ ID NO: 119849 - RNA, 22 nt, Human
agggcugcuccuccuucaggcc

SEQ ID NO: 119850 - RNA, 22 nt, Human
ugaggcucagagcaccugcucc

SEQ ID NO: 119851 - RNA, 22 nt, Human
ugcagggcacggugcgcguggg

SEQ ID NO: 119852 - RNA, 22 nt, Human
cagggcagggagcuuagaauga

SEQ ID NO: 119853 - RNA, 21 nt, Human
acagggcaugcagcuggcugu

SEQ ID NO: 119854 - RNA, 22 nt, Human
aggcaggagugacccugacagg

SEQ ID NO: 119855 - RNA, 22 nt, Human
auggagauuuuuagaauuacag

SEQ ID NO: 119856 - RNA, 22 nt, Human
ugcccaggguggagugcagcgg

SEQ ID NO: 119857 - RNA, 22 nt, Human
agcagggcucugccaugggccc

SEQ ID NO: 119858 - RNA, 22 nt, Human
aggcugaggcggguagaucacc

SEQ ID NO: 119859 - RNA, 22 nt, Human
aagcagcauaugacagcaucca

SEQ ID NO: 119860 - RNA, 22 nt, Human
gauggcagcagcagccagggau

SEQ ID NO: 119861 - RNA, 20 nt, Human
cugcugugugugccucagcc

SEQ ID NO: 119862 - RNA, 22 nt, Human
cccaggacucuucacugcagcc

SEQ ID NO: 119863 - RNA, 20 nt, Human
uuacucaguuccugccaugc

SEQ ID NO: 119864 - RNA, 22 nt, Human
cagcacaggaauaugguggaca

SEQ ID NO: 119865 - RNA, 22 nt, Human
gaagccaguacugugcucugca

SEQ ID NO: 119866 - RNA, 22 nt, Human
gccaguggucacugaggaagaa

SEQ ID NO: 119867 - RNA, 22 nt, Human
ucagaggagccaaaguucugag

SEQ ID NO: 119868 - RNA, 18 nt, Human
cacaggaaggggaauauc

SEQ ID NO: 119869 - RNA, 22 nt, Human
agggcagaaaucgauuacaccu

SEQ ID NO: 119870 - RNA, 22 nt, Human
aaagaagggacagacugccucu

SEQ ID NO: 119871 - RNA, 22 nt, Human
gaaaucugaacaacagcuguca

SEQ ID NO: 119872 - RNA, 22 nt, Human
acugugcaggugaacuguuugc

SEQ ID NO: 119873 - RNA, 22 nt, Human
caguggcaaugggacagagcac

SEQ ID NO: 119874 - RNA, 22 nt, Human
gcugugcagugggaguucggug

SEQ ID NO: 119875 - RNA, 22 nt, Human
acugugcaagucaaagaugggc

SEQ ID NO: 119876 - RNA, 22 nt, Human
guaaacauuacugugcuguaua

SEQ ID NO: 119877 - RNA, 22 nt, Human
gaaagcaguaaaugggucccau

SEQ ID NO: 119878 - RNA, 22 nt, Human
auaaagcuaagacuuacaugaa

SEQ ID NO: 119879 - RNA, 22 nt, Human
augagcagcauugcuccucuua

SEQ ID NO: 119880 - RNA, 21 nt, Human
gggcgaggccugauguggcuc

SEQ ID NO: 119881 - RNA, 22 nt, Human
gcagagugaagcaguauggaaa

SEQ ID NO: 119882 - RNA, 22 nt, Human
augaggcauucacagaaggcac

SEQ ID NO: 119883 - RNA, 22 nt, Human
ugaggcucacaaaucugcauuu

SEQ ID NO: 119884 - RNA, 22 nt, Human
gaggaagcugcguggcauuuca

SEQ ID NO: 119885 - RNA, 22 nt, Human
ggagaugccuuguuucaggaac

SEQ ID NO: 119886 - RNA, 19 nt, Human
uggcagaggcaguuuguac

SEQ ID NO: 119887 - RNA, 22 nt, Human
acauuugagcauauuucuuguc

SEQ ID NO: 119888 - RNA, 22 nt, Human
gggaaggagguggcuugaagug

SEQ ID NO: 119889 - RNA, 22 nt, Human
agcagggcuguguagguaauga

SEQ ID NO: 119890 - RNA, 22 nt, Human
gggcacuguguucagagugcag

SEQ ID NO: 119891 - RNA, 22 nt, Human
uacagaccaguaguucucagcg

SEQ ID NO: 119892 - RNA, 22 nt, Human
ccucccacuucuugcugagguc

SEQ ID NO: 119893 - RNA, 22 nt, Human
ccugaggggcugcaggccagcu

SEQ ID NO: 119894 - RNA, 22 nt, Human
gagugggcaccgugggcacacu

SEQ ID NO: 119895 - RNA, 22 nt, Human
cagggagcuggcuggcugugcc

SEQ ID NO: 119896 - RNA, 18 nt, Human
uguagagccagguuugcc

SEQ ID NO: 119897 - RNA, 22 nt, Human
gagcagggagacaacucuggug

SEQ ID NO: 119898 - RNA, 22 nt, Human
aagggcugcuguagaagcagag

SEQ ID NO: 119899 - RNA, 18 nt, Human
uucaccagugugaugggu

SEQ ID NO: 119900 - RNA, 22 nt, Human
cagcaaaguaagcugacaugua

SEQ ID NO: 119901 - RNA, 22 nt, Human
ccacugucuuuuccaggcugaa

SEQ ID NO: 119902 - RNA, 22 nt, Human
uggggaggaagucagauuucag

SEQ ID NO: 119903 - RNA, 22 nt, Human
ucccacuggacgucugugcugg

SEQ ID NO: 119904 - RNA, 22 nt, Human
ugccagucucacccuggguccu

SEQ ID NO: 119905 - RNA, 22 nt, Human
gggggaagacugggcuagugau

SEQ ID NO: 119906 - RNA, 22 nt, Human
cagggcagugaagaacacacgu

SEQ ID NO: 119907 - RNA, 22 nt, Human
aaagccagcucugagcugcacc

SEQ ID NO: 119908 - RNA, 22 nt, Human
ugagaugcaggagaugggacug

SEQ ID NO: 119909 - RNA, 22 nt, Human
cucuggaguucuucaagcuacu

SEQ ID NO: 119910 - RNA, 23 nt, Human
ccuggaguacuaaggggauggaa

SEQ ID NO: 119911 - RNA, 22 nt, Human
ugggccacacacagaagaauca

SEQ ID NO: 119912 - RNA, 22 nt, Human
gacaacagugguuucagguucc

SEQ ID NO: 119913 - RNA, 22 nt, Human
ugcugugcucuuuaaggugcug

SEQ ID NO: 119914 - RNA, 22 nt, Human
uggcagguuuccuccucauagu

SEQ ID NO: 119915 - RNA, 22 nt, Human
caggcccagcccagcccuucga

SEQ ID NO: 119916 - RNA, 17 nt, Human
gcagugaaaagagauca

SEQ ID NO: 119917 - RNA, 22 nt, Human
auuaaauuaaguggcuaauuua

SEQ ID NO: 119918 - RNA, 22 nt, Human
agcuggugcucaggggcaugga

SEQ ID NO: 119919 - RNA, 22 nt, Human
agggucagagaucggccaugug

SEQ ID NO: 119920 - RNA, 22 nt, Human
ucaggcagagcuguggagcucu

SEQ ID NO: 119921 - RNA, 22 nt, Human
agggagaagguuuagcugugag

SEQ ID NO: 119922 - RNA, 22 nt, Human
aggcagcaugcucugcuucuac

SEQ ID NO: 119923 - RNA, 22 nt, Human
cauuuguauguuccuccuuagg

SEQ ID NO: 119924 - RNA, 22 nt, Human
aggcagcaugggccccagcucc

SEQ ID NO: 119925 - RNA, 22 nt, Human
gcugagagugggugcagugcuu

SEQ ID NO: 119926 - RNA, 22 nt, Human
uagugucagggagugauaaaug

SEQ ID NO: 119927 - RNA, 22 nt, Human
aggcugagacugugcauuagug

SEQ ID NO: 119928 - RNA, 22 nt, Human
aggcucaguauagcuggcaagu

SEQ ID NO: 119929 - RNA, 22 nt, Human
uuacauucauugaagugauuca

SEQ ID NO: 119930 - RNA, 22 nt, Human
acugauuaaaaacagacauuua

SEQ ID NO: 119931 - RNA, 22 nt, Human
aggcccagagagccaguuagug

SEQ ID NO: 119932 - RNA, 22 nt, Human
gaggcagaaguugcagugagca

SEQ ID NO: 119933 - RNA, 22 nt, Human
ugaacauugucacauuccuagc

SEQ ID NO: 119934 - RNA, 22 nt, Human
gcacggcuaauuuuuguauuuu

SEQ ID NO: 119935 - RNA, 22 nt, Human
aaggaagauauaucaagcuuaa

SEQ ID NO: 119936 - RNA, 23 nt, Human
agguucaggagauggaggaacaa

SEQ ID NO: 119937 - RNA, 22 nt, Human
aguuagagacacaugcacaugc

SEQ ID NO: 119938 - RNA, 22 nt, Human
cucagaagaacccaggguccca

SEQ ID NO: 119939 - RNA, 22 nt, Human
agcagggcucacauuaguggau

SEQ ID NO: 119940 - RNA, 22 nt, Human
uaguggagaguuguuuugugca

SEQ ID NO: 119941 - RNA, 22 nt, Human
uuuguacaauuagcagaggcua

SEQ ID NO: 119942 - RNA, 22 nt, Human
acaguggaagcaugaugcuauc

SEQ ID NO: 119943 - RNA, 22 nt, Human
ucaggcugguggucagauggcu

SEQ ID NO: 119944 - RNA, 20 nt, Human
ucaaaggcaaaggugggugu

SEQ ID NO: 119945 - RNA, 22 nt, Human
gucagcacuuuuccgaggcaga

SEQ ID NO: 119946 - RNA, 22 nt, Human
aucaccaggcaaaaugucagag

SEQ ID NO: 119947 - RNA, 22 nt, Human
aaugugaggccuugguaguuau

SEQ ID NO: 119948 - RNA, 18 nt, Human
uacaggaaaaguguuaca

SEQ ID NO: 119949 - RNA, 22 nt, Human
gauuuauuuuuaaucagcaggg

SEQ ID NO: 119950 - RNA, 19 nt, Human
agagaaggauccuaugguu

SEQ ID NO: 119951 - RNA, 22 nt, Human
ccagagcagauguggccuuggu

SEQ ID NO: 119952 - RNA, 22 nt, Human
uuucucaaccucaacacuauuu

SEQ ID NO: 119953 - RNA, 22 nt, Human
augaacaagagagggaagauuc

SEQ ID NO: 119954 - RNA, 22 nt, Human
gcagugauuggaucagagaugg

SEQ ID NO: 119955 - RNA, 22 nt, Human
gaugcugagcuguauggcuggu

SEQ ID NO: 119956 - RNA, 22 nt, Human
uggagaagauuggucaccauuc

SEQ ID NO: 119957 - RNA, 22 nt, Human
gggauggggagcuggaaagggg

SEQ ID NO: 119958 - RNA, 22 nt, Human
gccaggcauguccucugcagaa

SEQ ID NO: 119959 - RNA, 22 nt, Human
aagcauuuuaguaaugaacuug

SEQ ID NO: 119960 - RNA, 17 nt, Human
aguggcaggcagauggg

SEQ ID NO: 119961 - RNA, 22 nt, Human
auguuauuaaaguacagauucu

SEQ ID NO: 119962 - RNA, 22 nt, Human
aagguauuggucuggucuuccu

SEQ ID NO: 119963 - RNA, 22 nt, Human
ugugaaggagaugaagggagug

SEQ ID NO: 119964 - RNA, 22 nt, Human
ccugggcaacauagugagaccu

SEQ ID NO: 119965 - RNA, 19 nt, Human
gguagaagggaaguguuuu

SEQ ID NO: 119966 - RNA, 22 nt, Human
gacaugcaugaaugcaggucuc

SEQ ID NO: 119967 - RNA, 22 nt, Human
auauugcaauagaugcaucauu

SEQ ID NO: 119968 - RNA, 22 nt, Human
agggcccuaaggaaggcacaca

SEQ ID NO: 119969 - RNA, 22 nt, Human
ccaggugcucuugccagggcug

SEQ ID NO: 119970 - RNA, 22 nt, Human
gaauuaguguugaaaucagggc

SEQ ID NO: 119971 - RNA, 22 nt, Human
gggaaauagagcuggaaccuug

SEQ ID NO: 119972 - RNA, 22 nt, Human
auuacuagauugucaagauuua

SEQ ID NO: 119973 - RNA, 23 nt, Human
auguuuuaugucucuagcugcca

SEQ ID NO: 119974 - RNA, 20 nt, Human
agccaggccucaaguuaagu

SEQ ID NO: 119975 - RNA, 22 nt, Human
cacagcugaaguagccaugugg

SEQ ID NO: 119976 - RNA, 22 nt, Human
gcagccacccucaaggcugaau

SEQ ID NO: 119977 - RNA, 22 nt, Human
agggggucguccggaagaccug

SEQ ID NO: 119978 - RNA, 22 nt, Human
ggcagccauggacacuggcuag

SEQ ID NO: 119979 - RNA, 22 nt, Human
ggccaggccaagaggguuggaa

SEQ ID NO: 119980 - RNA, 22 nt, Human
uggucgaccaguuggaaaguaa

SEQ ID NO: 119981 - RNA, 22 nt, Human
cacauggaagagauacagugag

SEQ ID NO: 119982 - RNA, 22 nt, Human
agaagccacaggccucgucugg

SEQ ID NO: 119983 - RNA, 22 nt, Human
uaauccaggguauucuaguuuc

SEQ ID NO: 119984 - RNA, 17 nt, Human
agccgggcauggaccag

SEQ ID NO: 119985 - RNA, 22 nt, Human
uuucccaaguguaaacauggca

SEQ ID NO: 119986 - RNA, 22 nt, Human
ucccaggauguuggcggcaggu

SEQ ID NO: 119987 - RNA, 22 nt, Human
uugcaagaaauaaucgaauaga

SEQ ID NO: 119988 - RNA, 22 nt, Human
ucucccagaaguccucaguaca

SEQ ID NO: 119989 - RNA, 22 nt, Human
ggcagggcccugauuccugggg

SEQ ID NO: 119990 - RNA, 22 nt, Human
gaggcuggaauauuagaaaugu

SEQ ID NO: 119991 - RNA, 22 nt, Human
augaggcaggauuaagcuauca

SEQ ID NO: 119992 - RNA, 22 nt, Human
ccagguguggggaggacucaca

SEQ ID NO: 119993 - RNA, 22 nt, Human
aagggcagcuauuaucgucauc

SEQ ID NO: 119994 - RNA, 22 nt, Human
uuauauuaguuagacuugcugu

SEQ ID NO: 119995 - RNA, 22 nt, Human
cggcuggugucgggcacagcaa

SEQ ID NO: 119996 - RNA, 22 nt, Human
agccaggcugcaguuggcuggc

SEQ ID NO: 119997 - RNA, 21 nt, Human
aggaggaacccguggcugggc

SEQ ID NO: 119998 - RNA, 22 nt, Human
cagcacaggccugucuuugucu

SEQ ID NO: 119999 - RNA, 22 nt, Human
cagcugggugaucuugggcagg

SEQ ID NO: 120000 - RNA, 22 nt, Human
ggagaaagcuguaguggaaugu

SEQ ID NO: 120001 - RNA, 22 nt, Human
caguaggaaggaugcagaaaaa

SEQ ID NO: 120002 - RNA, 22 nt, Human
caguaacauuucaagguagagg

SEQ ID NO: 120003 - RNA, 22 nt, Human
agccaguguuaagugacugguu

SEQ ID NO: 120004 - RNA, 22 nt, Human
gaggcucauugcauugugcauu

SEQ ID NO: 120005 - RNA, 22 nt, Human
uggcugaguuacgaacagagca

SEQ ID NO: 120006 - RNA, 22 nt, Human
auguacaaccugcaugacaguc

SEQ ID NO: 120007 - RNA, 22 nt, Human
aaugcucaaaauguuucaucua

SEQ ID NO: 120008 - RNA, 21 nt, Human
aagggagauaggaaucaggcc

SEQ ID NO: 120009 - RNA, 22 nt, Human
cacaggagugcugcuauuguug

SEQ ID NO: 120010 - RNA, 22 nt, Human
uggagcugguaaacagugacau

SEQ ID NO: 120011 - RNA, 22 nt, Human
auugugauuagagaauauagag

SEQ ID NO: 120012 - RNA, 19 nt, Human
aucugaaguaggugcagcu

SEQ ID NO: 120013 - RNA, 22 nt, Human
aggggaaggccagccuguagag

SEQ ID NO: 120014 - RNA, 22 nt, Human
gaaggcuggcuuucugagagca

SEQ ID NO: 120015 - RNA, 22 nt, Human
ugucagcagcugguuugcuguu

SEQ ID NO: 120016 - RNA, 22 nt, Human
ucagggcaaugucccucagaag

SEQ ID NO: 120017 - RNA, 22 nt, Human
agagcugagcaccaagcauggu

SEQ ID NO: 120018 - RNA, 22 nt, Human
cucaggcuugggaggaggccca

SEQ ID NO: 120019 - RNA, 19 nt, Human
ugagcaugcgagcugagaa

SEQ ID NO: 120020 - RNA, 22 nt, Human
agucaggagcugcugcauugua

SEQ ID NO: 120021 - RNA, 22 nt, Human
uacaggaaggcucuggaggugc

SEQ ID NO: 120022 - RNA, 22 nt, Human
ggccugaggcgucccagcugug

SEQ ID NO: 120023 - RNA, 22 nt, Human
aggcgugggaggaucugaggcc

SEQ ID NO: 120024 - RNA, 22 nt, Human
cgggcagcggcguggccauggu

SEQ ID NO: 120025 - RNA, 22 nt, Human
ggugggucuuguggggcagcuu

SEQ ID NO: 120026 - RNA, 22 nt, Human
gcccaggauucuuucuuccuua

SEQ ID NO: 120027 - RNA, 22 nt, Human
guggagcaaucagagggucagu

SEQ ID NO: 120028 - RNA, 22 nt, Human
ucuaaauguaucacaucuggau

SEQ ID NO: 120029 - RNA, 22 nt, Human
uuagagcaggaguugacagauu

SEQ ID NO: 120030 - RNA, 22 nt, Human
acauucuguuuccccaaagaga

SEQ ID NO: 120031 - RNA, 22 nt, Human
cuagggaaugagagacuggauc

SEQ ID NO: 120032 - RNA, 22 nt, Human
cagagcaggcccacugcccucc

SEQ ID NO: 120033 - RNA, 22 nt, Human
guucaagguuuuacagagugua

SEQ ID NO: 120034 - RNA, 19 nt, Human
ucaguggaugaacauguuu

SEQ ID NO: 120035 - RNA, 22 nt, Human
aaggaaauuagguuauuuugcu

SEQ ID NO: 120036 - RNA, 22 nt, Human
cugagcugggagccuggcacca

SEQ ID NO: 120037 - RNA, 20 nt, Human
agcuaacccuacuuucuuug

SEQ ID NO: 120038 - RNA, 22 nt, Human
aggcaggggagcuggaagggua

SEQ ID NO: 120039 - RNA, 22 nt, Human
auacagugaauacuuacagugu

SEQ ID NO: 120040 - RNA, 22 nt, Human
gcaggcagaucaccugucagga

SEQ ID NO: 120041 - RNA, 22 nt, Human
cagagcagaagcgguccucaca

SEQ ID NO: 120042 - RNA, 17 nt, Human
aggugcagaggcagagc

SEQ ID NO: 120043 - RNA, 22 nt, Human
uggcagcauguuauguaaggaa

SEQ ID NO: 120044 - RNA, 22 nt, Human
gaggcagugucgguggcaggau

SEQ ID NO: 120045 - RNA, 22 nt, Human
ugagcagggacuuugaguguag

SEQ ID NO: 120046 - RNA, 22 nt, Human
gugggcugcccuugaggucagc

SEQ ID NO: 120047 - RNA, 20 nt, Human
uccugguggauacugcuuaa

SEQ ID NO: 120048 - RNA, 22 nt, Human
gaggcacaccagggagucuugu

SEQ ID NO: 120049 - RNA, 22 nt, Human
agugcccuggcccagcuggacc

SEQ ID NO: 120050 - RNA, 22 nt, Human
uguacaugugucuguauaucuu

SEQ ID NO: 120051 - RNA, 22 nt, Human
aggaagagcuggaccagaggac

SEQ ID NO: 120052 - RNA, 20 nt, Human
aggcucagcugagcucuugg

SEQ ID NO: 120053 - RNA, 22 nt, Human
cagggcuggauccuccagacuc

SEQ ID NO: 120054 - RNA, 22 nt, Human
ucccaggaucugagggcagaga

SEQ ID NO: 120055 - RNA, 22 nt, Human
augcaaacauucgcuugucucu

SEQ ID NO: 120056 - RNA, 22 nt, Human
uuguaaaugaccuuuucuaauu

SEQ ID NO: 120057 - RNA, 22 nt, Human
ccaggguuuaaauucugacuau

SEQ ID NO: 120058 - RNA, 22 nt, Human
aguggcagagccaaguagagcc

SEQ ID NO: 120059 - RNA, 22 nt, Human
aguaaacauagaauguucuucc

SEQ ID NO: 120060 - RNA, 22 nt, Human
acaacacagcaaaaccccaucu

SEQ ID NO: 120061 - RNA, 22 nt, Human
cugcugugcaacauugcaccua

SEQ ID NO: 120062 - RNA, 22 nt, Human
acagcugugaagcaagcacucu

SEQ ID NO: 120063 - RNA, 22 nt, Human
ggcagauguuauaugaucugag

SEQ ID NO: 120064 - RNA, 22 nt, Human
ugaaggaagaauaggcaguguu

SEQ ID NO: 120065 - RNA, 22 nt, Human
augcugugauuguagaaauauu

SEQ ID NO: 120066 - RNA, 22 nt, Human
uuauaugauugagcaucuuggu

SEQ ID NO: 120067 - RNA, 22 nt, Human
agaguccagaaaacagugugcu

SEQ ID NO: 120068 - RNA, 22 nt, Human
cagaggcauauaauugcugggg

SEQ ID NO: 120069 - RNA, 22 nt, Human
aggaaaaagaguugcugccuuc

SEQ ID NO: 120070 - RNA, 22 nt, Human
ggaggaggggugacugaaugcu

SEQ ID NO: 120071 - RNA, 22 nt, Human
ugggcagggagcuggaaccaca

SEQ ID NO: 120072 - RNA, 22 nt, Human
aaggaaaugugccugacacugc

SEQ ID NO: 120073 - RNA, 22 nt, Human
gccaggcugcuccagggaggcc

SEQ ID NO: 120074 - RNA, 19 nt, Human
ggcaugggguccggggacc

SEQ ID NO: 120075 - RNA, 19 nt, Human
ugggcagguucaguaaugg

SEQ ID NO: 120076 - RNA, 22 nt, Human
aaacaguuucuaaucauggaga

SEQ ID NO: 120077 - RNA, 22 nt, Human
acaggcugcugggcuccgugcu

SEQ ID NO: 120078 - RNA, 18 nt, Human
cccagcuggugggucagu

SEQ ID NO: 120079 - RNA, 20 nt, Human
ggcugugcccuuccguggcc

SEQ ID NO: 120080 - RNA, 22 nt, Human
cugagggagacagugcggacua

SEQ ID NO: 120081 - RNA, 22 nt, Human
gucagaggggacaagacacaga

SEQ ID NO: 120082 - RNA, 22 nt, Human
gcagggcacacaagaaugauaa

SEQ ID NO: 120083 - RNA, 22 nt, Human
aagggcuggaucucucugagca

SEQ ID NO: 120084 - RNA, 22 nt, Human
gaggaagccccauugaagccag

SEQ ID NO: 120085 - RNA, 22 nt, Human
acagggcagagaggcaggcuug

SEQ ID NO: 120086 - RNA, 22 nt, Human
cuuauuuuaagucaguuugggu

SEQ ID NO: 120087 - RNA, 22 nt, Human
uuguaaauaguaguaagaugcc

SEQ ID NO: 120088 - RNA, 22 nt, Human
ugguccuggggugcaggcugac

SEQ ID NO: 120089 - RNA, 22 nt, Human
ggcaggagaaaggucucuucuu

SEQ ID NO: 120090 - RNA, 22 nt, Human
aggugcuggaguagaagaaaaa

SEQ ID NO: 120091 - RNA, 22 nt, Human
aaaguggggucuagagggccug

SEQ ID NO: 120092 - RNA, 22 nt, Human
acugagcugugacaaugcuuaa

SEQ ID NO: 120093 - RNA, 22 nt, Human
agggcuggcaagggauugaaau

SEQ ID NO: 120094 - RNA, 22 nt, Human
auucuggccuuggcucugucac

SEQ ID NO: 120095 - RNA, 22 nt, Human
augcuguguggucaaguuaauu

SEQ ID NO: 120096 - RNA, 22 nt, Human
aggggccauuguucugcccgcu

SEQ ID NO: 120097 - RNA, 22 nt, Human
aauacacuauuuugugcucagu

SEQ ID NO: 120098 - RNA, 22 nt, Human
gcaggaagccuuaccaagccca

SEQ ID NO: 120099 - RNA, 22 nt, Human
ugaguccauugauggauaguga

SEQ ID NO: 120100 - RNA, 22 nt, Human
agggcugagugggagagaguug

SEQ ID NO: 120101 - RNA, 22 nt, Human
ugccaggccacguagcuucaag

SEQ ID NO: 120102 - RNA, 22 nt, Human
aucugguucuucuuaggcauca

SEQ ID NO: 120103 - RNA, 22 nt, Human
ucccugcacagccgagccaugc

SEQ ID NO: 120104 - RNA, 21 nt, Human
ugccaggccugagcugggguc

SEQ ID NO: 120105 - RNA, 22 nt, Human
auuuuaguuuuagcauccaugc

SEQ ID NO: 120106 - RNA, 22 nt, Human
agcagccacacgccuccuucuc

SEQ ID NO: 120107 - RNA, 22 nt, Human
acagugaugagggaauuuugug

SEQ ID NO: 120108 - RNA, 22 nt, Human
ugcaggaguccaaucaggagac

SEQ ID NO: 120109 - RNA, 20 nt, Human
aggcucagauacccagggaa

SEQ ID NO: 120110 - RNA, 22 nt, Human
gagaaggcuggucuuaagucga

SEQ ID NO: 120111 - RNA, 22 nt, Human
cccagccucugggcucacccaa

SEQ ID NO: 120112 - RNA, 20 nt, Human
aggcucaggguguuuaggaa

SEQ ID NO: 120113 - RNA, 22 nt, Human
ucuuaagcagagaagaaguuga

SEQ ID NO: 120114 - RNA, 22 nt, Human
cagugguauuugagagaaugga

SEQ ID NO: 120115 - RNA, 22 nt, Human
gugaggcagcaggagccucugu

SEQ ID NO: 120116 - RNA, 22 nt, Human
cauucauucagcaacuguuauu

SEQ ID NO: 120117 - RNA, 22 nt, Human
ugaggcaguucuuacuuguauu

SEQ ID NO: 120118 - RNA, 22 nt, Human
gacaucauagggugggaggaaa

SEQ ID NO: 120119 - RNA, 22 nt, Human
auauugaucuuggaacugauuu

SEQ ID NO: 120120 - RNA, 19 nt, Human
ggagaagcccaggaauccu

SEQ ID NO: 120121 - RNA, 22 nt, Human
guccugggggcagcugugucca

SEQ ID NO: 120122 - RNA, 22 nt, Human
caggaggcagagguugcagcga

SEQ ID NO: 120123 - RNA, 18 nt, Human
gguccugggccuggcuca

SEQ ID NO: 120124 - RNA, 22 nt, Human
caggaagagguaucaccgagca

SEQ ID NO: 120125 - RNA, 22 nt, Human
cagcuggaggagcagcuuccag

SEQ ID NO: 120126 - RNA, 22 nt, Human
gggacgggcaguccaagggguc

SEQ ID NO: 120127 - RNA, 22 nt, Human
cagggcuggcucaugaaaaguu

SEQ ID NO: 120128 - RNA, 22 nt, Human
gaagccacagagauuguggggg

SEQ ID NO: 120129 - RNA, 22 nt, Human
agcagggcuggggcacgagcca

SEQ ID NO: 120130 - RNA, 22 nt, Human
uaggcagauguuaacaggaaaa

SEQ ID NO: 120131 - RNA, 22 nt, Human
uuucucaacuguauuaugcaga

SEQ ID NO: 120132 - RNA, 22 nt, Human
ggagcagccacgucucagggca

SEQ ID NO: 120133 - RNA, 20 nt, Human
gaaggaagggggcaagguga

SEQ ID NO: 120134 - RNA, 22 nt, Human
uguguacacagauaguaauggc

SEQ ID NO: 120135 - RNA, 22 nt, Human
aauaugcaaauagguguaauga

SEQ ID NO: 120136 - RNA, 22 nt, Human
ggggacgggacuuagcaugagu

SEQ ID NO: 120137 - RNA, 22 nt, Human
gcagggcagcugaagcuaggug

SEQ ID NO: 120138 - RNA, 22 nt, Human
aggcagggugaugauaaugauu

SEQ ID NO: 120139 - RNA, 22 nt, Human
acaguuugagaaccacuagccu

SEQ ID NO: 120140 - RNA, 22 nt, Human
cauuugaagaagaaacguacua

SEQ ID NO: 120141 - RNA, 22 nt, Human
agcugauacauuucuuguagcc

SEQ ID NO: 120142 - RNA, 23 nt, Human
aggagacagggaagugccuggcu

SEQ ID NO: 120143 - RNA, 22 nt, Human
uucauacauguguacuguucca

SEQ ID NO: 120144 - RNA, 22 nt, Human
cuucuuucaagaauggauuagg

SEQ ID NO: 120145 - RNA, 22 nt, Human
uaugaacacacuuuggaaguga

SEQ ID NO: 120146 - RNA, 22 nt, Human
gucuggggcagcaaggcgcgcg

SEQ ID NO: 120147 - RNA, 22 nt, Human
aagggcagcuuaaauugguagc

SEQ ID NO: 120148 - RNA, 19 nt, Human
ugcagaagacacaguggug

SEQ ID NO: 120149 - RNA, 16 nt, Human
ucagggcagaauggca

SEQ ID NO: 120150 - RNA, 22 nt, Human
auacacuacuaagcacagauug

SEQ ID NO: 120151 - RNA, 22 nt, Human
ugcugagacaacaggaaacaag

SEQ ID NO: 120152 - RNA, 22 nt, Human
cagguauuaauaaauggagagu

SEQ ID NO: 120153 - RNA, 22 nt, Human
cagggacaauggcagagccuga

SEQ ID NO: 120154 - RNA, 22 nt, Human
cccaguggaaggaguagaagac

SEQ ID NO: 120155 - RNA, 22 nt, Human
gcagcuggauuucaagagggag

SEQ ID NO: 120156 - RNA, 22 nt, Human
ugcaaauguguagguuuacaua

SEQ ID NO: 120157 - RNA, 22 nt, Human
acauuuguuucucuagaguagg

SEQ ID NO: 120158 - RNA, 21 nt, Human
gguugguguguccaguggcca

SEQ ID NO: 120159 - RNA, 22 nt, Human
auacauuagcucauaugauuaa

SEQ ID NO: 120160 - RNA, 22 nt, Human
ugccaggccaauucuauuugac

SEQ ID NO: 120161 - RNA, 17 nt, Human
acaguuugucauucuaa

SEQ ID NO: 120162 - RNA, 22 nt, Human
aggagaaggaggccccucacac

SEQ ID NO: 120163 - RNA, 22 nt, Human
caggcagaaauuuuguuucauu

SEQ ID NO: 120164 - RNA, 22 nt, Human
agagucugaaugcucagaguug

SEQ ID NO: 120165 - RNA, 22 nt, Human
ugaggcuuagagaagaugggau

SEQ ID NO: 120166 - RNA, 22 nt, Human
agcaggugagcacagccaggcu

SEQ ID NO: 120167 - RNA, 22 nt, Human
agaucacaguggcaacucccuu

SEQ ID NO: 120168 - RNA, 22 nt, Human
uggggguccuccucugcuuaag

SEQ ID NO: 120169 - RNA, 22 nt, Human
caggaggcuuugggauccaagu

SEQ ID NO: 120170 - RNA, 22 nt, Human
uucaggauaugugauaucugaa

SEQ ID NO: 120171 - RNA, 22 nt, Human
uuuucucaagauccaaugcacu

SEQ ID NO: 120172 - RNA, 22 nt, Human
ucagaggagaccaaggggaaua

SEQ ID NO: 120173 - RNA, 20 nt, Human
gcagggcaucuuggccccca

SEQ ID NO: 120174 - RNA, 22 nt, Human
aggagggcuaggaaaaccagga

SEQ ID NO: 120175 - RNA, 22 nt, Human
aagggcagagggaaucccacau

SEQ ID NO: 120176 - RNA, 22 nt, Human
ucugugaacaucacauugacag

SEQ ID NO: 120177 - RNA, 22 nt, Human
ugaggcaggagaauggcgggaa

SEQ ID NO: 120178 - RNA, 22 nt, Human
guucagcccacagagggggccg

SEQ ID NO: 120179 - RNA, 22 nt, Human
aucaggaagccagucuaaugga

SEQ ID NO: 120180 - RNA, 22 nt, Human
uuuauauguauugacuuugaug

SEQ ID NO: 120181 - RNA, 22 nt, Human
cggggaggcuucggauuaaagc

SEQ ID NO: 120182 - RNA, 22 nt, Human
uggcugaguaaguugugauaug

SEQ ID NO: 120183 - RNA, 22 nt, Human
gggcugagaaguugaucccaag

SEQ ID NO: 120184 - RNA, 22 nt, Human
gcaaaggcuagagacacaggga

SEQ ID NO: 120185 - RNA, 22 nt, Human
ggugucuguugccuccugguua

SEQ ID NO: 120186 - RNA, 22 nt, Human
uuccucaggcuucccuuugucc

SEQ ID NO: 120187 - RNA, 22 nt, Human
agaagccauguuuaguaggaug

SEQ ID NO: 120188 - RNA, 22 nt, Human
acaguggagaagcaaaugcagu

SEQ ID NO: 120189 - RNA, 18 nt, Human
acauuuaggagagucaau

SEQ ID NO: 120190 - RNA, 22 nt, Human
uacaacauuguguugcuucaua

SEQ ID NO: 120191 - RNA, 22 nt, Human
ggcagugagcuggagggaagga

SEQ ID NO: 120192 - RNA, 22 nt, Human
caauuacuuuugcaccaauaua

SEQ ID NO: 120193 - RNA, 22 nt, Human
ggccaggcacugugugagauau

SEQ ID NO: 120194 - RNA, 22 nt, Human
cagcugagcucccaggccauca

SEQ ID NO: 120195 - RNA, 22 nt, Human
acagggcaugugcaagagacau

SEQ ID NO: 120196 - RNA, 22 nt, Human
agugcagagaccuggucaggca

SEQ ID NO: 120197 - RNA, 22 nt, Human
caugcugugguaaaucacugaa

SEQ ID NO: 120198 - RNA, 22 nt, Human
ugcaggagaaaguacggagcgu

SEQ ID NO: 120199 - RNA, 21 nt, Human
aggcucagcagguguauaaag

SEQ ID NO: 120200 - RNA, 22 nt, Human
uuauccaacaugacuuaugucc

SEQ ID NO: 120201 - RNA, 22 nt, Human
ggugggucuugcggggcagcuu

SEQ ID NO: 120202 - RNA, 22 nt, Human
caaggcaguuccccagagggcu

SEQ ID NO: 120203 - RNA, 22 nt, Human
agagcugcaauuucauguggug

SEQ ID NO: 120204 - RNA, 23 nt, Human
uggcugagguccagguaguuuca

SEQ ID NO: 120205 - RNA, 21 nt, Human
aggcccagagucuugggggga

SEQ ID NO: 120206 - RNA, 18 nt, Human
gcagugaagaaagagcuu

SEQ ID NO: 120207 - RNA, 22 nt, Human
uuuauaguagcaugauuuauag

SEQ ID NO: 120208 - RNA, 22 nt, Human
uccuggcccggccgggccugcu

SEQ ID NO: 120209 - RNA, 22 nt, Human
uuugugcaagacaugcuaagag

SEQ ID NO: 120210 - RNA, 22 nt, Human
uggcagagaugaagaguuguuu

SEQ ID NO: 120211 - RNA, 22 nt, Human
aucauaacuguaauucaucuac

SEQ ID NO: 120212 - RNA, 22 nt, Human
uggcugagggggcucugcucag

SEQ ID NO: 120213 - RNA, 22 nt, Human
ugccaggcugaacagggucuua

SEQ ID NO: 120214 - RNA, 23 nt, Human
uuucucaaagaguggcagcuuca

SEQ ID NO: 120215 - RNA, 22 nt, Human
aggcuucagaaagaguaauugg

SEQ ID NO: 120216 - RNA, 22 nt, Human
gaagggugugugugagggacac

SEQ ID NO: 120217 - RNA, 23 nt, Human
ggcaccaggccauggagcgggag

SEQ ID NO: 120218 - RNA, 22 nt, Human
cauaucauaggucuuggauaau

SEQ ID NO: 120219 - RNA, 22 nt, Human
uacaucuaucuagaugcucaga

SEQ ID NO: 120220 - RNA, 22 nt, Human
acugugcaguguuguaacccga

SEQ ID NO: 120221 - RNA, 23 nt, Human
cuggaagugcuuuuauagcuuug

SEQ ID NO: 120222 - RNA, 20 nt, Human
uauuuacaacuuagagccuc

SEQ ID NO: 120223 - RNA, 22 nt, Human
acaugaaacuguugcauuagaa

SEQ ID NO: 120224 - RNA, 22 nt, Human
agagugaaaagcuagagcagua

SEQ ID NO: 120225 - RNA, 22 nt, Human
uacagcuagagggcacgugaac

SEQ ID NO: 120226 - RNA, 22 nt, Human
ucccaggugaugcugaggccac

SEQ ID NO: 120227 - RNA, 22 nt, Human
ugagaagcugcuugugcuguau

SEQ ID NO: 120228 - RNA, 22 nt, Human
acauuagaacauuaauauuggg

SEQ ID NO: 120229 - RNA, 22 nt, Human
acauucuagauauguuauauuu

SEQ ID NO: 120230 - RNA, 22 nt, Human
ccccaccagcacccucucuauc

SEQ ID NO: 120231 - RNA, 20 nt, Human
uccaguggccugaaucugga

SEQ ID NO: 120232 - RNA, 22 nt, Human
uaggaaaauaucucuuauuggg

SEQ ID NO: 120233 - RNA, 22 nt, Human
gggcugaggcuaccacuggucu

SEQ ID NO: 120234 - RNA, 22 nt, Human
uccugaggcacaauccuagaau

SEQ ID NO: 120235 - RNA, 22 nt, Human
uggcugagccacuuguucagau

SEQ ID NO: 120236 - RNA, 19 nt, Human
gaaaggcugcugcuaccug

SEQ ID NO: 120237 - RNA, 22 nt, Human
gaagccaggggccugacaggca

SEQ ID NO: 120238 - RNA, 22 nt, Human
auuugcauaucugauagacuaa

SEQ ID NO: 120239 - RNA, 22 nt, Human
cauuauggcagccaggauauug

SEQ ID NO: 120240 - RNA, 22 nt, Human
ucaaaggcuugugguucuggga

SEQ ID NO: 120241 - RNA, 22 nt, Human
gauaacauuuugaagugcuagu

SEQ ID NO: 120242 - RNA, 22 nt, Human
ggcagagguagcuggaaccagg

SEQ ID NO: 120243 - RNA, 18 nt, Human
uacaucuauauaguguuu

SEQ ID NO: 120244 - RNA, 22 nt, Human
uuuugaaagccagguuuguaug

SEQ ID NO: 120245 - RNA, 22 nt, Human
augaacaucggaaaugagacug

SEQ ID NO: 120246 - RNA, 22 nt, Human
cagggcagagccaggauuucaa

SEQ ID NO: 120247 - RNA, 22 nt, Human
uacuguuuucuauaauggcugu

SEQ ID NO: 120248 - RNA, 22 nt, Human
ucucugagguuguuuccagcac

SEQ ID NO: 120249 - RNA, 22 nt, Human
uagggcagccuuauagcuccca

SEQ ID NO: 120250 - RNA, 22 nt, Human
aggcugagguaggaggaucgcu

SEQ ID NO: 120251 - RNA, 22 nt, Human
cagcagcauugcucuggauucc

SEQ ID NO: 120252 - RNA, 22 nt, Human
ccaggguaccccaagggcaggu

SEQ ID NO: 120253 - RNA, 22 nt, Human
gaggcagagguuguugcaguga

SEQ ID NO: 120254 - RNA, 22 nt, Human
aagccaguccucuacugggcac

SEQ ID NO: 120255 - RNA, 22 nt, Human
uugcagcuuagugauguuaucu

SEQ ID NO: 120256 - RNA, 22 nt, Human
uccugagaaggcacagcuugca

SEQ ID NO: 120257 - RNA, 22 nt, Human
acaugcauucucuaaaagcaaa

SEQ ID NO: 120258 - RNA, 22 nt, Human
cugagcaggauauucacagcag

SEQ ID NO: 120259 - RNA, 22 nt, Human
ugcacagugaccacugagcaag

SEQ ID NO: 120260 - RNA, 22 nt, Human
agcugcccaaggucacagagcu

SEQ ID NO: 120261 - RNA, 22 nt, Human
agcugcccuuuaugaugcugaa

SEQ ID NO: 120262 - RNA, 22 nt, Human
ugcucccaggcucuguggucug

SEQ ID NO: 120263 - RNA, 22 nt, Human
aggcagguccccuggaaggcac

SEQ ID NO: 120264 - RNA, 22 nt, Human
gucaucauuuuuagcauauggg

SEQ ID NO: 120265 - RNA, 22 nt, Human
uuguacauucugaaucuguccu

SEQ ID NO: 120266 - RNA, 22 nt, Human
gaggcaggguguugauuacaga

SEQ ID NO: 120267 - RNA, 20 nt, Human
caggcaguuugugguuaggg

SEQ ID NO: 120268 - RNA, 18 nt, Human
ggaaaccacaggguucug

SEQ ID NO: 120269 - RNA, 22 nt, Human
ucuccugguuuguuaaauaauu

SEQ ID NO: 120270 - RNA, 22 nt, Human
ugggggacugcacuggcgucag

SEQ ID NO: 120271 - RNA, 22 nt, Human
ccugcucagccccagcucaccc

SEQ ID NO: 120272 - RNA, 18 nt, Human
gugugcaguugcaggggu

SEQ ID NO: 120273 - RNA, 22 nt, Human
uaaacauguugacaucuuaccu

SEQ ID NO: 120274 - RNA, 22 nt, Human
ggccaggcugcccugggagcag

SEQ ID NO: 120275 - RNA, 22 nt, Human
auuugucauguauguaaaguug

SEQ ID NO: 120276 - RNA, 22 nt, Human
uguggcagcuggagguggagaa

SEQ ID NO: 120277 - RNA, 22 nt, Human
augaggcagucuggccugaggg

SEQ ID NO: 120278 - RNA, 22 nt, Human
gagagugaggcaucaggggcag

SEQ ID NO: 120279 - RNA, 22 nt, Human
agcuguggaagacugucagggu

SEQ ID NO: 120280 - RNA, 22 nt, Human
ugaggaaacuuacaaggcagaa

SEQ ID NO: 120281 - RNA, 22 nt, Human
uggcucaguuugggggauugaa

SEQ ID NO: 120282 - RNA, 22 nt, Human
agugcugucuccuucccccggg

SEQ ID NO: 120283 - RNA, 22 nt, Human
gaggcucaccuagggagcacug

SEQ ID NO: 120284 - RNA, 22 nt, Human
ugcagggaacuuggacagcuag

SEQ ID NO: 120285 - RNA, 22 nt, Human
uaugcacacauuagcacagggu

SEQ ID NO: 120286 - RNA, 22 nt, Human
caccauaaaaauaagagaugcc

SEQ ID NO: 120287 - RNA, 22 nt, Human
uccugaggacuaacaggaagga

SEQ ID NO: 120288 - RNA, 22 nt, Human
cuucuucagcacaauauugaug

SEQ ID NO: 120289 - RNA, 22 nt, Human
uggcugaguuucaugcaucaug

SEQ ID NO: 120290 - RNA, 22 nt, Human
cagcaguggcugcaggcagcug

SEQ ID NO: 120291 - RNA, 22 nt, Human
guggggguuucauuaagacaau

SEQ ID NO: 120292 - RNA, 22 nt, Human
ccugagugccaugagagcaccc

SEQ ID NO: 120293 - RNA, 22 nt, Human
uuuguaaauagcaguacucaug

SEQ ID NO: 120294 - RNA, 22 nt, Human
cucuguccuccaccugcuuuca

SEQ ID NO: 120295 - RNA, 22 nt, Human
agggaguuccgaucugugcacc

SEQ ID NO: 120296 - RNA, 20 nt, Human
uuggcucugaucaguggagc

SEQ ID NO: 120297 - RNA, 22 nt, Human
gggaagguauuuagcugcugaa

SEQ ID NO: 120298 - RNA, 22 nt, Human
gggcugagaauucagcuuuccu

SEQ ID NO: 120299 - RNA, 22 nt, Human
aggcuucagguuugcuuugcag

SEQ ID NO: 120300 - RNA, 22 nt, Human
ggugagggacaucacucagcca

SEQ ID NO: 120301 - RNA, 22 nt, Human
ucauuguuucugcuuuucauga

SEQ ID NO: 120302 - RNA, 22 nt, Human
aggcucagucccggcccgcgcc

SEQ ID NO: 120303 - RNA, 22 nt, Human
uaguggaguagaaaccaaagaa

SEQ ID NO: 120304 - RNA, 22 nt, Human
ccaggggaaacagggagcacuc

SEQ ID NO: 120305 - RNA, 17 nt, Human
agggacagcaguuuagg

SEQ ID NO: 120306 - RNA, 22 nt, Human
cugggggucuugaaagggagag

SEQ ID NO: 120307 - RNA, 22 nt, Human
gaggcagugaacaauuccugug

SEQ ID NO: 120308 - RNA, 22 nt, Human
cuggagguaauguuauuuuugu

SEQ ID NO: 120309 - RNA, 22 nt, Human
gcugagauuacgggcaugagcc

SEQ ID NO: 120310 - RNA, 22 nt, Human
gggagccacagugaggugcaug

SEQ ID NO: 120311 - RNA, 22 nt, Human
uuaucacuuaugagcuuuuugc

SEQ ID NO: 120312 - RNA, 22 nt, Human
ugaugauaugaaagaaucuuua

SEQ ID NO: 120313 - RNA, 22 nt, Human
ugaggcucaagaaagauuuguu

SEQ ID NO: 120314 - RNA, 22 nt, Human
uuauuauugugaccugagaaug

SEQ ID NO: 120315 - RNA, 22 nt, Human
aaauuauuaugccccucuauaa

SEQ ID NO: 120316 - RNA, 22 nt, Human
aggcugaggcaagaggaucacu

SEQ ID NO: 120317 - RNA, 22 nt, Human
cagggccaugaggcacaggguc

SEQ ID NO: 120318 - RNA, 23 nt, Human
agcaggaaaccgagggugauguu

SEQ ID NO: 120319 - RNA, 22 nt, Human
ugcuggaggcaguggaggugcc

SEQ ID NO: 120320 - RNA, 22 nt, Human
cauucauuagaauagauaugua

SEQ ID NO: 120321 - RNA, 22 nt, Human
gggcugagucugcugccuguca

SEQ ID NO: 120322 - RNA, 22 nt, Human
ggagucaccaaguaggagucuu

SEQ ID NO: 120323 - RNA, 22 nt, Human
ucagggcauccauugccuguug

SEQ ID NO: 120324 - RNA, 22 nt, Human
cugauuccaaagccaaagcuau

SEQ ID NO: 120325 - RNA, 22 nt, Human
caccaggcugcccaggacaggg

SEQ ID NO: 120326 - RNA, 22 nt, Human
cacccuagcugucauuucaguu

SEQ ID NO: 120327 - RNA, 22 nt, Human
ugaggcaggacuugcauaaagu

SEQ ID NO: 120328 - RNA, 22 nt, Human
cuguaaauaugaagaauauaug

SEQ ID NO: 120329 - RNA, 19 nt, Human
auacuaggucaugauaauc

SEQ ID NO: 120330 - RNA, 22 nt, Human
gccacaugucaugugcucagua

SEQ ID NO: 120331 - RNA, 22 nt, Human
ucagcccugaggacagaggcag

SEQ ID NO: 120332 - RNA, 20 nt, Human
ggcaccaggcuaggauugga

SEQ ID NO: 120333 - RNA, 20 nt, Human
cuucuucaguaguuuguucu

SEQ ID NO: 120334 - RNA, 22 nt, Human
agcagagguuuguuggaaaccu

SEQ ID NO: 120335 - RNA, 22 nt, Human
gcaagaaaaaggcuucaugaac

SEQ ID NO: 120336 - RNA, 22 nt, Human
auacauucaaaggaaggauaga

SEQ ID NO: 120337 - RNA, 22 nt, Human
aggcaguggagcuggaauaggc

SEQ ID NO: 120338 - RNA, 22 nt, Human
aauguggauccuuacagauacc

SEQ ID NO: 120339 - RNA, 22 nt, Human
agacauuuauugaacaccuagc

SEQ ID NO: 120340 - RNA, 22 nt, Human
aguggcagacacaaugugggca

SEQ ID NO: 120341 - RNA, 18 nt, Human
ugucauaauauaucaccu

SEQ ID NO: 120342 - RNA, 21 nt, Human
uuagaguugccauuauaugua

SEQ ID NO: 120343 - RNA, 22 nt, Human
auacacguguguguacaugcac

SEQ ID NO: 120344 - RNA, 22 nt, Human
cacaggagaacccacagauucu

SEQ ID NO: 120345 - RNA, 22 nt, Human
ugaggcaggaauggggaaaagu

SEQ ID NO: 120346 - RNA, 22 nt, Human
ccuccaguacuccaguccagcg

SEQ ID NO: 120347 - RNA, 22 nt, Human
ugagcagacuugaugaggcagc

SEQ ID NO: 120348 - RNA, 18 nt, Human
agaagccacgaggagucc

SEQ ID NO: 120349 - RNA, 17 nt, Human
ggcaccagacggagagu

SEQ ID NO: 120350 - RNA, 22 nt, Human
cagcugagaaauggggaaaggg

SEQ ID NO: 120351 - RNA, 21 nt, Human
ggagaaggacaauguugagua

SEQ ID NO: 120352 - RNA, 22 nt, Human
gcagggcauagaggcacggagg

SEQ ID NO: 120353 - RNA, 22 nt, Human
gggcuguaggagcuggaauggg

SEQ ID NO: 120354 - RNA, 22 nt, Human
ugggcagggucucuguuaucag

SEQ ID NO: 120355 - RNA, 22 nt, Human
acacuagcuauuaacuucacau

SEQ ID NO: 120356 - RNA, 22 nt, Human
agagaugcaggguacauggaau

SEQ ID NO: 120357 - RNA, 22 nt, Human
cagugcaguugguggcaggggu

SEQ ID NO: 120358 - RNA, 22 nt, Human
agagguauuagauuugcauagg

SEQ ID NO: 120359 - RNA, 22 nt, Human
aaggaagagucuagaacaggca

SEQ ID NO: 120360 - RNA, 22 nt, Human
gaaguggaauuacugggucaua

SEQ ID NO: 120361 - RNA, 22 nt, Human
ucagccucucugaguccagacc

SEQ ID NO: 120362 - RNA, 22 nt, Human
uugagcaauuaggaaauaaaga

SEQ ID NO: 120363 - RNA, 22 nt, Human
aaguacauguuguucaaaagcc

SEQ ID NO: 120364 - RNA, 22 nt, Human
agcagggccuggcacuccuggg

SEQ ID NO: 120365 - RNA, 18 nt, Human
gguggcaggucagaugcc

SEQ ID NO: 120366 - RNA, 22 nt, Human
ucagggcauucaagaggccugg

SEQ ID NO: 120367 - RNA, 22 nt, Human
caucaaauuaugugucaaagca

SEQ ID NO: 120368 - RNA, 22 nt, Human
acauuugugcaacguauccaca

SEQ ID NO: 120369 - RNA, 22 nt, Human
uuuacugucucagagagacaaa

SEQ ID NO: 120370 - RNA, 22 nt, Human
gacacagggggauguguggacg

SEQ ID NO: 120371 - RNA, 22 nt, Human
ccagguguagcacugcucacag

SEQ ID NO: 120372 - RNA, 22 nt, Human
uccugccuaccuugcggaggug

SEQ ID NO: 120373 - RNA, 22 nt, Human
agggcaguguggugggacugac

SEQ ID NO: 120374 - RNA, 22 nt, Human
agcugugcugccaaguugcuga

SEQ ID NO: 120375 - RNA, 22 nt, Human
uggcugaggucuggggcuucug

SEQ ID NO: 120376 - RNA, 22 nt, Human
ugcccauguuucucuguauccc

SEQ ID NO: 120377 - RNA, 22 nt, Human
cugaggcuggggaagggaagug

SEQ ID NO: 120378 - RNA, 22 nt, Human
agggagccuuccuggcuguggu

SEQ ID NO: 120379 - RNA, 22 nt, Human
gaggcucagagugguuaaauaa

SEQ ID NO: 120380 - RNA, 22 nt, Human
gaagggugcauggagggaaguc

SEQ ID NO: 120381 - RNA, 22 nt, Human
gccaccaggagcccaguccaaa

SEQ ID NO: 120382 - RNA, 22 nt, Human
augaacaaucuggcaagaacuu

SEQ ID NO: 120383 - RNA, 22 nt, Human
gucaaacagccuccuguucuaa

SEQ ID NO: 120384 - RNA, 22 nt, Human
acaggauuaauaaaaaauugua

SEQ ID NO: 120385 - RNA, 22 nt, Human
ucacucagguucaugucuuugu

SEQ ID NO: 120386 - RNA, 22 nt, Human
gagggcagugaauuuugaagcu

SEQ ID NO: 120387 - RNA, 17 nt, Human
aggcaggagauuggaga

SEQ ID NO: 120388 - RNA, 23 nt, Human
aguacauucgaaaaauucuguga

SEQ ID NO: 120389 - RNA, 22 nt, Human
gagcacagaaggagaaauaugg

SEQ ID NO: 120390 - RNA, 22 nt, Human
aggagguggcugaacuugaggg

SEQ ID NO: 120391 - RNA, 22 nt, Human
gggcagagagcuggaacuccuu

SEQ ID NO: 120392 - RNA, 22 nt, Human
ugucauggcugaaagugggggc

SEQ ID NO: 120393 - RNA, 22 nt, Human
agccaggccagcugucuugagu

SEQ ID NO: 120394 - RNA, 22 nt, Human
uuucucaacagaguaugcccuu

SEQ ID NO: 120395 - RNA, 22 nt, Human
cauuuguucaaccauucucgcu

SEQ ID NO: 120396 - RNA, 22 nt, Human
ugcacaguucgccuucuccaag

SEQ ID NO: 120397 - RNA, 22 nt, Human
aaagccaguucuuagagaaagc

SEQ ID NO: 120398 - RNA, 22 nt, Human
ugggcaggggcccugcuuccgu

SEQ ID NO: 120399 - RNA, 22 nt, Human
caggagccgccaggcacguugg

SEQ ID NO: 120400 - RNA, 22 nt, Human
caugggcaguuggcagggcuca

SEQ ID NO: 120401 - RNA, 22 nt, Human
ccuucauucauuaauuuagccc

SEQ ID NO: 120402 - RNA, 22 nt, Human
cacaggaauuagcagccuaaaa

SEQ ID NO: 120403 - RNA, 22 nt, Human
uggggcuccuccuggcaggagg

SEQ ID NO: 120404 - RNA, 23 nt, Human
uuuauauuccuaaugucuugagc

SEQ ID NO: 120405 - RNA, 22 nt, Human
cgcauacauagaaacacacaga

SEQ ID NO: 120406 - RNA, 22 nt, Human
ucuaauuuuggcauuuuaaccu

SEQ ID NO: 120407 - RNA, 22 nt, Human
uaugauuuguagacauuugauu

SEQ ID NO: 120408 - RNA, 22 nt, Human
ggcugugcgucauccggcugca

SEQ ID NO: 120409 - RNA, 22 nt, Human
ggccagagagcagccaggauuc

SEQ ID NO: 120410 - RNA, 22 nt, Human
ugcaaauccuguuuggaguaag

SEQ ID NO: 120411 - RNA, 22 nt, Human
cagggcccagucccugcuguca

SEQ ID NO: 120412 - RNA, 22 nt, Human
uaacauuuaaauuuuucacaua

SEQ ID NO: 120413 - RNA, 22 nt, Human
aguuggguuugugucaguugca

SEQ ID NO: 120414 - RNA, 22 nt, Human
agcugaggcucugagagggaag

SEQ ID NO: 120415 - RNA, 22 nt, Human
gagugcaguuggggugagggga

SEQ ID NO: 120416 - RNA, 16 nt, Human
uagggcugggaaggag

SEQ ID NO: 120417 - RNA, 22 nt, Human
gagaagcagguuuagcagacaa

SEQ ID NO: 120418 - RNA, 22 nt, Human
gguggaaggccuggaaggaggc

SEQ ID NO: 120419 - RNA, 22 nt, Human
auccaggguguggagagagcuc

SEQ ID NO: 120420 - RNA, 22 nt, Human
ugccaggcauauggccucuuug

SEQ ID NO: 120421 - RNA, 22 nt, Human
auccagggauaaaaguaagguu

SEQ ID NO: 120422 - RNA, 22 nt, Human
ggaggcagaacuucccgucagu

SEQ ID NO: 120423 - RNA, 22 nt, Human
ugcacaggccuugaagggagag

SEQ ID NO: 120424 - RNA, 21 nt, Human
agcagaggcagaauguaugca

SEQ ID NO: 120425 - RNA, 22 nt, Human
cggggagggcagaggcucccuc

SEQ ID NO: 120426 - RNA, 22 nt, Human
agcagguguagggcucuuugua

SEQ ID NO: 120427 - RNA, 21 nt, Human
uuacuggcagcagaaaccuga

SEQ ID NO: 120428 - RNA, 20 nt, Human
uggcugugggcaucuguuuc

SEQ ID NO: 120429 - RNA, 21 nt, Human
gaacauuuggguuguuucuac

SEQ ID NO: 120430 - RNA, 22 nt, Human
cugccaggacugacgucuucag

SEQ ID NO: 120431 - RNA, 21 nt, Human
gcugugcagaggauggagugg

SEQ ID NO: 120432 - RNA, 22 nt, Human
aguuuccaaauauuguuuuagc

SEQ ID NO: 120433 - RNA, 22 nt, Human
ucccugcagacguccugcgggu

SEQ ID NO: 120434 - RNA, 22 nt, Human
gcucccagggaccgcagggcag

SEQ ID NO: 120435 - RNA, 17 nt, Human
gcaagggaugggagauu

SEQ ID NO: 120436 - RNA, 22 nt, Human
acugcccucccaucuauugcaa

SEQ ID NO: 120437 - RNA, 22 nt, Human
ucagagguaguagcagaguuga

SEQ ID NO: 120438 - RNA, 22 nt, Human
ccagggcagcagaauuggggca

SEQ ID NO: 120439 - RNA, 22 nt, Human
ucaaacagcaggucuuucauag

SEQ ID NO: 120440 - RNA, 22 nt, Human
gcacuagauacuguucaggaaa

SEQ ID NO: 120441 - RNA, 19 nt, Human
ggugugaagugaggaguua

SEQ ID NO: 120442 - RNA, 22 nt, Human
cagucaccaccagguggcagua

SEQ ID NO: 120443 - RNA, 22 nt, Human
ggcaggugaccuggccucccag

SEQ ID NO: 120444 - RNA, 20 nt, Human
auuugcaucugaauaacuua

SEQ ID NO: 120445 - RNA, 18 nt, Human
ugaugcaagagugagcua

SEQ ID NO: 120446 - RNA, 22 nt, Human
guuuuccacuggauuguuugga

SEQ ID NO: 120447 - RNA, 22 nt, Human
gaagaagguggcccagggguag

SEQ ID NO: 120448 - RNA, 22 nt, Human
agccugugugcuuuggacaggg

SEQ ID NO: 120449 - RNA, 22 nt, Human
aguggcagaagccaagucugca

SEQ ID NO: 120450 - RNA, 22 nt, Human
aguggcaguuugggagcuacag

SEQ ID NO: 120451 - RNA, 22 nt, Human
ccugcgggcugguaagaggcuu

SEQ ID NO: 120452 - RNA, 22 nt, Human
aucagugcugagagacuaucaa

SEQ ID NO: 120453 - RNA, 22 nt, Human
ggucauuguucuuuucugugau

SEQ ID NO: 120454 - RNA, 22 nt, Human
uauuuacuuuuaaauugagaac

SEQ ID NO: 120455 - RNA, 22 nt, Human
agugcaaaauucagaagcaauu

SEQ ID NO: 120456 - RNA, 22 nt, Human
ugauuaaauuaauuaagaugag

SEQ ID NO: 120457 - RNA, 22 nt, Human
gaagccacuauagauauucuaa

SEQ ID NO: 120458 - RNA, 22 nt, Human
cccagccucuggauucugcccu

SEQ ID NO: 120459 - RNA, 22 nt, Human
acaguggaagaagcacugaacu

SEQ ID NO: 120460 - RNA, 22 nt, Human
cacagcuggugacagagcccag

SEQ ID NO: 120461 - RNA, 22 nt, Human
uuugacaugaaguagcuuauaa

SEQ ID NO: 120462 - RNA, 22 nt, Human
aggcagcauuucugcuuaucca

SEQ ID NO: 120463 - RNA, 22 nt, Human
acaaguggguccuacauaaagc

SEQ ID NO: 120464 - RNA, 22 nt, Human
ugggcagggaucucuuuugcaa

SEQ ID NO: 120465 - RNA, 22 nt, Human
ugggccaggcaugugaucagca

SEQ ID NO: 120466 - RNA, 22 nt, Human
aucaggaaauacuuauuuauaa

SEQ ID NO: 120467 - RNA, 22 nt, Human
ucucugagcugcuucuugcaua

SEQ ID NO: 120468 - RNA, 22 nt, Human
agagccacggcaggccuaggaa

SEQ ID NO: 120469 - RNA, 22 nt, Human
ugggagcacccugaggagcuuc

SEQ ID NO: 120470 - RNA, 22 nt, Human
gcauaucagcaucaaaacacag

SEQ ID NO: 120471 - RNA, 22 nt, Human
aauggcacuuuauaaauguuaa

SEQ ID NO: 120472 - RNA, 22 nt, Human
agccaggcagacucucuuucuu

SEQ ID NO: 120473 - RNA, 22 nt, Human
ggaccugaacauaaaacgaggc

SEQ ID NO: 120474 - RNA, 22 nt, Human
ccuucccuaaagcgucgcuuag

SEQ ID NO: 120475 - RNA, 22 nt, Human
gggagaaggagcuaguucuuga

SEQ ID NO: 120476 - RNA, 22 nt, Human
ccagugcacagccaggcaggug

SEQ ID NO: 120477 - RNA, 22 nt, Human
auauggaaugguaaucuacaau

SEQ ID NO: 120478 - RNA, 21 nt, Human
agccaggcaagcacccccacu

SEQ ID NO: 120479 - RNA, 22 nt, Human
ggaagccagaaagugagaauau

SEQ ID NO: 120480 - RNA, 22 nt, Human
uccuggggaggguucuggcucc

SEQ ID NO: 120481 - RNA, 22 nt, Human
gaauucugguccuguccaaggu

SEQ ID NO: 120482 - RNA, 22 nt, Human
gcauggcagugaggauggugcu

SEQ ID NO: 120483 - RNA, 22 nt, Human
uagagaugaauucugcagucuu

SEQ ID NO: 120484 - RNA, 22 nt, Human
ggagggagcauccccuugcuga

SEQ ID NO: 120485 - RNA, 22 nt, Human
aguggaguugaguugauggauu

SEQ ID NO: 120486 - RNA, 22 nt, Human
gcagagcaccaaagugaaagau

SEQ ID NO: 120487 - RNA, 22 nt, Human
ccagagggccuuuggaguuauc

SEQ ID NO: 120488 - RNA, 22 nt, Human
aaacagugauguugaguguaaa

SEQ ID NO: 120489 - RNA, 22 nt, Human
augagcaauuaggaagaaaaca

SEQ ID NO: 120490 - RNA, 22 nt, Human
caggagcagaggguggucagca

SEQ ID NO: 120491 - RNA, 22 nt, Human
agguggcaggaggucagagaaa

SEQ ID NO: 120492 - RNA, 19 nt, Human
gacucacaccuuccgcugu

SEQ ID NO: 120493 - RNA, 19 nt, Human
aggcaggugcagagguccc

SEQ ID NO: 120494 - RNA, 22 nt, Human
uuaaauuuuagaaacagacucu

SEQ ID NO: 120495 - RNA, 22 nt, Human
ucagggcagccuaaggcaccuc

SEQ ID NO: 120496 - RNA, 22 nt, Human
gaggccacgguuuuccuugggg

SEQ ID NO: 120497 - RNA, 22 nt, Human
cauaaacucucuguaccaauau

SEQ ID NO: 120498 - RNA, 22 nt, Human
uaggcaggcugaauguagauuu

SEQ ID NO: 120499 - RNA, 22 nt, Human
ucaucacauguguagucauccc

SEQ ID NO: 120500 - RNA, 22 nt, Human
gcagaggacacaggagggcaag

SEQ ID NO: 120501 - RNA, 22 nt, Human
gcugagagcaaagcaugucuag

SEQ ID NO: 120502 - RNA, 22 nt, Human
gagggaccccaggcuggcccuu

SEQ ID NO: 120503 - RNA, 22 nt, Human
accagagcuggcucugagcacc

SEQ ID NO: 120504 - RNA, 22 nt, Human
cauuuguaucauauguaucuua

SEQ ID NO: 120505 - RNA, 22 nt, Human
ggcagggcuugucucugugaug

SEQ ID NO: 120506 - RNA, 22 nt, Human
guuuacauuaaguauuagcauc

SEQ ID NO: 120507 - RNA, 21 nt, Human
augggcagaggcagagaggcu

SEQ ID NO: 120508 - RNA, 22 nt, Human
uaugaauucuguucauugauga

SEQ ID NO: 120509 - RNA, 18 nt, Human
ggcugugcguggaggcug

SEQ ID NO: 120510 - RNA, 22 nt, Human
ggggccagguccagcuuccaaa

SEQ ID NO: 120511 - RNA, 22 nt, Human
acuugguugaugucauaagguu

SEQ ID NO: 120512 - RNA, 22 nt, Human
auaccauuuccauguuacauua

SEQ ID NO: 120513 - RNA, 22 nt, Human
ggcuguggggccggguacagug

SEQ ID NO: 120514 - RNA, 22 nt, Human
uucauacauuuuuacuaacagc

SEQ ID NO: 120515 - RNA, 22 nt, Human
uaugcauagguaucuauacuca

SEQ ID NO: 120516 - RNA, 22 nt, Human
ggcuguggucauuaggagguug

SEQ ID NO: 120517 - RNA, 22 nt, Human
gggcaguggguggcugcagccu

SEQ ID NO: 120518 - RNA, 22 nt, Human
aggcugugcaauuaggguaaga

SEQ ID NO: 120519 - RNA, 22 nt, Human
caagauggagaagcagcaaggg

SEQ ID NO: 120520 - RNA, 22 nt, Human
gaggcucagggaguauaugaau

SEQ ID NO: 120521 - RNA, 22 nt, Human
agaaaauauucauugagaggcu

SEQ ID NO: 120522 - RNA, 22 nt, Human
uucagauguggcuuugucaggc

SEQ ID NO: 120523 - RNA, 22 nt, Human
aaagccacugcauguguaguau

SEQ ID NO: 120524 - RNA, 22 nt, Human
gaagcuaaaccacagcuaagaa

SEQ ID NO: 120525 - RNA, 22 nt, Human
cugcacaaugcaccaucaaguu

SEQ ID NO: 120526 - RNA, 22 nt, Human
uaaaaucauucuggugucagua

SEQ ID NO: 120527 - RNA, 22 nt, Human
ccagaggagggcucugaugagg

SEQ ID NO: 120528 - RNA, 22 nt, Human
aagccaguguccagaaugggca

SEQ ID NO: 120529 - RNA, 22 nt, Human
acugugcacccuggacaguguc

SEQ ID NO: 120530 - RNA, 23 nt, Human
acagugaaacacgcaguaagagu

SEQ ID NO: 120531 - RNA, 22 nt, Human
uuuauuaugauggacaccuucg

SEQ ID NO: 120532 - RNA, 22 nt, Human
auuaaauuggaucugcauaguu

SEQ ID NO: 120533 - RNA, 19 nt, Human
ggccaccucucuucccagg

SEQ ID NO: 120534 - RNA, 22 nt, Human
agcagggcuggauuuggcaaga

SEQ ID NO: 120535 - RNA, 22 nt, Human
ugauuacaauugucuuagauuu

SEQ ID NO: 120536 - RNA, 22 nt, Human
aguggcaguagaugagcugguu

SEQ ID NO: 120537 - RNA, 22 nt, Human
guagaaaaagcaguaagucuca

SEQ ID NO: 120538 - RNA, 22 nt, Human
cugcugugggcaggguagcugg

SEQ ID NO: 120539 - RNA, 22 nt, Human
uggcugagaaguucugguggga

SEQ ID NO: 120540 - RNA, 22 nt, Human
gcauccagagguagccacugug

SEQ ID NO: 120541 - RNA, 22 nt, Human
ucacuggggccaugugagggac

SEQ ID NO: 120542 - RNA, 22 nt, Human
ugcaguggaaucuggagagcag

SEQ ID NO: 120543 - RNA, 22 nt, Human
aauuuuauuaacuggauguagc

SEQ ID NO: 120544 - RNA, 22 nt, Human
acccuguugguggaucagauug

SEQ ID NO: 120545 - RNA, 20 nt, Human
ucucccaggcucagggaaga

SEQ ID NO: 120546 - RNA, 22 nt, Human
ggcagccauacucagaccuggg

SEQ ID NO: 120547 - RNA, 22 nt, Human
auuuggucacaccaguccacau

SEQ ID NO: 120548 - RNA, 22 nt, Human
ucaggauuauuucaguggcuuu

SEQ ID NO: 120549 - RNA, 20 nt, Human
gcuguugccaguacagaugg

SEQ ID NO: 120550 - RNA, 22 nt, Human
caccagggcagcagccuagucu

SEQ ID NO: 120551 - RNA, 19 nt, Human
ucugugcugggaggcagca

SEQ ID NO: 120552 - RNA, 22 nt, Human
uggcugagguuaugcugguugu

SEQ ID NO: 120553 - RNA, 22 nt, Human
gggcagaggggcgcuucccucu

SEQ ID NO: 120554 - RNA, 22 nt, Human
aagugauuuucuucuuaguuau

SEQ ID NO: 120555 - RNA, 22 nt, Human
ggaagggcaauaaaaucucagg

SEQ ID NO: 120556 - RNA, 21 nt, Human
gacauccaugugaguggcagu

SEQ ID NO: 120557 - RNA, 22 nt, Human
aacauugccaugguuaauuuua

SEQ ID NO: 120558 - RNA, 22 nt, Human
ugaggcaggacauggacaacug

SEQ ID NO: 120559 - RNA, 22 nt, Human
ucauuacacaguucaguggaaa

SEQ ID NO: 120560 - RNA, 22 nt, Human
agaggaauaugggugcacuaga

SEQ ID NO: 120561 - RNA, 22 nt, Human
caagggcagcagccucaagcgg

SEQ ID NO: 120562 - RNA, 22 nt, Human
uggcugaggcacagcugccgcc

SEQ ID NO: 120563 - RNA, 22 nt, Human
ccacugcccaccccgacgucua

SEQ ID NO: 120564 - RNA, 22 nt, Human
gccuggucucugggguugggua

SEQ ID NO: 120565 - RNA, 22 nt, Human
gaaggcugcgaggggagugccg

SEQ ID NO: 120566 - RNA, 22 nt, Human
aggcccagacucagcggggcgg

SEQ ID NO: 120567 - RNA, 21 nt, Human
aggagggcacaaggccaggaa

SEQ ID NO: 120568 - RNA, 22 nt, Human
agccugguuuaagcauuuuaua

SEQ ID NO: 120569 - RNA, 22 nt, Human
gggcaugccugcgcagugcaug

SEQ ID NO: 120570 - RNA, 22 nt, Human
caauuacugguccacagaaauu

SEQ ID NO: 120571 - RNA, 22 nt, Human
aguaaacacugucuuuauauau

SEQ ID NO: 120572 - RNA, 22 nt, Human
agagugcaaccgaaacaagcag

SEQ ID NO: 120573 - RNA, 22 nt, Human
aaguccagacuccuuugcgugg

SEQ ID NO: 120574 - RNA, 22 nt, Human
ucaugggugcuccagguggcug

SEQ ID NO: 120575 - RNA, 23 nt, Human
aggcugagcucucccagcuucag

SEQ ID NO: 120576 - RNA, 22 nt, Human
accaggcuggagugcaguggcg

SEQ ID NO: 120577 - RNA, 22 nt, Human
aagguuuauuaaaaguugaugg

SEQ ID NO: 120578 - RNA, 22 nt, Human
uuauucuucuucucuugccagg

SEQ ID NO: 120579 - RNA, 22 nt, Human
ucagaggaaagggaacauaguc

SEQ ID NO: 120580 - RNA, 22 nt, Human
cguagguggcucagcaccuggg

SEQ ID NO: 120581 - RNA, 19 nt, Human
gcaucagagcagaaggggu

SEQ ID NO: 120582 - RNA, 22 nt, Human
ccaggagccugggccaggcugg

SEQ ID NO: 120583 - RNA, 22 nt, Human
gagagaagggggauaugagccu

SEQ ID NO: 120584 - RNA, 22 nt, Human
uuguugucauuguagaggauuu

SEQ ID NO: 120585 - RNA, 20 nt, Human
auuuggcaugaaguauugau

SEQ ID NO: 120586 - RNA, 22 nt, Human
agaggauugaucaaacacugca

SEQ ID NO: 120587 - RNA, 22 nt, Human
uuucucaaguucagauauuuga

SEQ ID NO: 120588 - RNA, 19 nt, Human
ugcaagugucuuggacaag

SEQ ID NO: 120589 - RNA, 22 nt, Human
ggacaggaugcugaagaugaag

SEQ ID NO: 120590 - RNA, 22 nt, Human
ugaccugcagucaagaggggaa

SEQ ID NO: 120591 - RNA, 23 nt, Human
acuuugcauacccaaauuguuuu

SEQ ID NO: 120592 - RNA, 22 nt, Human
cugagagaaucaugcugcaggu

SEQ ID NO: 120593 - RNA, 22 nt, Human
uccuguggucuggaaggaaugg

SEQ ID NO: 120594 - RNA, 22 nt, Human
agugagcauucguuuggaaccc

SEQ ID NO: 120595 - RNA, 22 nt, Human
aguuccagcugugaccagaaaa

SEQ ID NO: 120596 - RNA, 22 nt, Human
augcuguguccuagugaaagaa

SEQ ID NO: 120597 - RNA, 22 nt, Human
gauaauuuaagucuugggggcu

SEQ ID NO: 120598 - RNA, 21 nt, Human
aggaaguggccagauugggaa

SEQ ID NO: 120599 - RNA, 22 nt, Human
cugagcugguucucuugugaaa

SEQ ID NO: 120600 - RNA, 22 nt, Human
gggcucagacaucccuccugga

SEQ ID NO: 120601 - RNA, 22 nt, Human
ugccaggccaaugaaggcaggg

SEQ ID NO: 120602 - RNA, 22 nt, Human
caccugggcuaaacuaugcagg

SEQ ID NO: 120603 - RNA, 22 nt, Human
auuuuccagccuuucuagaacu

SEQ ID NO: 120604 - RNA, 22 nt, Human
acaggcuguugggguccagggu

SEQ ID NO: 120605 - RNA, 22 nt, Human
ccagaagagaucacaguucuug

SEQ ID NO: 120606 - RNA, 21 nt, Human
uaaaacuguaacuuuguccug

SEQ ID NO: 120607 - RNA, 22 nt, Human
auuugucacugagagaguuaga

SEQ ID NO: 120608 - RNA, 22 nt, Human
uauuuuaucugccagaguggag

SEQ ID NO: 120609 - RNA, 22 nt, Human
ccagggcagggaccacgugucu

SEQ ID NO: 120610 - RNA, 22 nt, Human
ugcagggcuauaacuccauucu

SEQ ID NO: 120611 - RNA, 22 nt, Human
acaguggaaagaaacgaauuag

SEQ ID NO: 120612 - RNA, 22 nt, Human
ucugucaugccacaggacuugg

SEQ ID NO: 120613 - RNA, 22 nt, Human
aaaaaugucauuauggaacuga

SEQ ID NO: 120614 - RNA, 22 nt, Human
cuggaguguaaagagcauagaa

SEQ ID NO: 120615 - RNA, 22 nt, Human
gaugcauagugaagcugacaga

SEQ ID NO: 120616 - RNA, 22 nt, Human
ucugugcaguucuugucuugac

SEQ ID NO: 120617 - RNA, 22 nt, Human
aggcagaggaaggguggauuug

SEQ ID NO: 120618 - RNA, 22 nt, Human
agcugcccccagggcugugcuu

SEQ ID NO: 120619 - RNA, 22 nt, Human
cagccaccauacagcagaagcu

SEQ ID NO: 120620 - RNA, 22 nt, Human
ggcugugcugagggggaagccc

SEQ ID NO: 120621 - RNA, 22 nt, Human
guggugaagccccaucucugcu

SEQ ID NO: 120622 - RNA, 22 nt, Human
ggagaugcuauguaguuugguu

SEQ ID NO: 120623 - RNA, 22 nt, Human
aaauuggaugcacauuuagaaa

SEQ ID NO: 120624 - RNA, 22 nt, Human
ccagcugcccaagaggcauccu

SEQ ID NO: 120625 - RNA, 22 nt, Human
accagggcacaggagucugaag

SEQ ID NO: 120626 - RNA, 22 nt, Human
ucucugagaaguuccuuuguga

SEQ ID NO: 120627 - RNA, 22 nt, Human
augucuuuuaugauuacgggau

SEQ ID NO: 120628 - RNA, 22 nt, Human
aaaugcagcagcuaauugaaaa

SEQ ID NO: 120629 - RNA, 22 nt, Human
gcagucaguaaggcagccagaa

SEQ ID NO: 120630 - RNA, 22 nt, Human
gggcugagugucccaggccgaa

SEQ ID NO: 120631 - RNA, 21 nt, Human
uucuguuuuuuguaccagggc

SEQ ID NO: 120632 - RNA, 22 nt, Human
agggcagcuggaagguggcuuc

SEQ ID NO: 120633 - RNA, 22 nt, Human
uaaacauggcuguuucaguuau

SEQ ID NO: 120634 - RNA, 22 nt, Human
aguggagacaggacagucgaua

SEQ ID NO: 120635 - RNA, 22 nt, Human
uggcagaggcucugugauguug

SEQ ID NO: 120636 - RNA, 22 nt, Human
uauuugcaaagaacuacacuag

SEQ ID NO: 120637 - RNA, 22 nt, Human
gccucccugagucacccaagca

SEQ ID NO: 120638 - RNA, 23 nt, Human
ugccagaggcagucacaguggug

SEQ ID NO: 120639 - RNA, 22 nt, Human
cccugcagacgucuugaugccu

SEQ ID NO: 120640 - RNA, 22 nt, Human
uugcucugauuagguggaaaca

SEQ ID NO: 120641 - RNA, 21 nt, Human
uggcagagugcagucuauaca

SEQ ID NO: 120642 - RNA, 22 nt, Human
uagggcagcugcaucaggcacu

SEQ ID NO: 120643 - RNA, 22 nt, Human
ugaagccacacuagcuuguccu

SEQ ID NO: 120644 - RNA, 22 nt, Human
augaaacagugaauuagucaag

SEQ ID NO: 120645 - RNA, 22 nt, Human
ggcugugcuugguguccuugga

SEQ ID NO: 120646 - RNA, 22 nt, Human
gcugcagugagccaagaucgug

SEQ ID NO: 120647 - RNA, 22 nt, Human
ugcagggcaucuuugaagugug

SEQ ID NO: 120648 - RNA, 22 nt, Human
ucacacacauuugcugucugau

SEQ ID NO: 120649 - RNA, 22 nt, Human
cuucuucaagagaaugggagac

SEQ ID NO: 120650 - RNA, 22 nt, Human
ugaggaaacugaggcacagaug

SEQ ID NO: 120651 - RNA, 22 nt, Human
gggcgcaucaccugaggucagg

SEQ ID NO: 120652 - RNA, 23 nt, Human
gguauucauucauuuaugcuaag

SEQ ID NO: 120653 - RNA, 22 nt, Human
uugcugugucauuuguuuaauc

SEQ ID NO: 120654 - RNA, 22 nt, Human
ucacauucuagaauguuaucgu

SEQ ID NO: 120655 - RNA, 22 nt, Human
aaucuugaguguuacucucauu

SEQ ID NO: 120656 - RNA, 20 nt, Human
uucugcuugcaaauaucaag

SEQ ID NO: 120657 - RNA, 22 nt, Human
ucagaggauugccucagcgagc

SEQ ID NO: 120658 - RNA, 22 nt, Human
cuggagauguccgggugcuguu

SEQ ID NO: 120659 - RNA, 19 nt, Human
agccacagaacuugcagga

SEQ ID NO: 120660 - RNA, 22 nt, Human
cugaggcucaagggcagguggg

SEQ ID NO: 120661 - RNA, 23 nt, Human
agcagggccagaauacuugcugu

SEQ ID NO: 120662 - RNA, 22 nt, Human
agggagaaaauuggaugcacaa

SEQ ID NO: 120663 - RNA, 22 nt, Human
ugcagauaauacuagaacuuac

SEQ ID NO: 120664 - RNA, 22 nt, Human
ccagaagacaagaauguucuua

SEQ ID NO: 120665 - RNA, 22 nt, Human
gcucuugucaaaaauuaguuga

SEQ ID NO: 120666 - RNA, 22 nt, Human
gagcagagacaguacaacuggc

SEQ ID NO: 120667 - RNA, 22 nt, Human
caucuugaagguuucuuuagcu

SEQ ID NO: 120668 - RNA, 21 nt, Human
uuuucccacugaaagcuccca

SEQ ID NO: 120669 - RNA, 22 nt, Human
gcaggugaaugauggacuagga

SEQ ID NO: 120670 - RNA, 22 nt, Human
uuuauuagugcuuguaucacug

SEQ ID NO: 120671 - RNA, 22 nt, Human
aggcugagagcaacgugucaga

SEQ ID NO: 120672 - RNA, 22 nt, Human
ugaagccacagagcaucugccu

SEQ ID NO: 120673 - RNA, 23 nt, Human
ccugcucaggcgugugcccugcu

SEQ ID NO: 120674 - RNA, 22 nt, Human
aagcugaaaaugagacucuaca

SEQ ID NO: 120675 - RNA, 22 nt, Human
ucccuguuuuauauccuaacaa

SEQ ID NO: 120676 - RNA, 22 nt, Human
auuuccuauagauauggugagu

SEQ ID NO: 120677 - RNA, 18 nt, Human
gaucgggggcgccccaag

SEQ ID NO: 120678 - RNA, 22 nt, Human
ggcugagacuagagugaggcau

SEQ ID NO: 120679 - RNA, 22 nt, Human
agagaugcccuugaaaggauua

SEQ ID NO: 120680 - RNA, 22 nt, Human
agaugcuauacauuguaagaca

SEQ ID NO: 120681 - RNA, 22 nt, Human
ggcugugggaugcauaggagcu

SEQ ID NO: 120682 - RNA, 22 nt, Human
ugugggaggaauuagaauggga

SEQ ID NO: 120683 - RNA, 22 nt, Human
gggcagguguugucaaucuaau

SEQ ID NO: 120684 - RNA, 22 nt, Human
gcagcugagagaagaacagggc

SEQ ID NO: 120685 - RNA, 22 nt, Human
ucuguuuaaugggaaugauacu

SEQ ID NO: 120686 - RNA, 22 nt, Human
aaggaagguucauagucaaaga

SEQ ID NO: 120687 - RNA, 22 nt, Human
augaaacaugcuuuguggauga

SEQ ID NO: 120688 - RNA, 22 nt, Human
aacauacagugagcaguggacu

SEQ ID NO: 120689 - RNA, 22 nt, Human
ccucccagugccuccagagcag

SEQ ID NO: 120690 - RNA, 22 nt, Human
ggagaggggaacuuguugcuug

SEQ ID NO: 120691 - RNA, 22 nt, Human
cagcacauaaucagugauugug

SEQ ID NO: 120692 - RNA, 22 nt, Human
ggaaaucaagaagcagaugagu

SEQ ID NO: 120693 - RNA, 22 nt, Human
gaaauucugugucccagagugc

SEQ ID NO: 120694 - RNA, 22 nt, Human
ucugccugcaguguggcagggc

SEQ ID NO: 120695 - RNA, 22 nt, Human
uguggcaggcaagauguacaga

SEQ ID NO: 120696 - RNA, 22 nt, Human
agccaggcuaaaugagccauga

SEQ ID NO: 120697 - RNA, 22 nt, Human
uugagcacaggugaacagcauc

SEQ ID NO: 120698 - RNA, 22 nt, Human
cagaccugagguugaguaccag

SEQ ID NO: 120699 - RNA, 23 nt, Human
agggcaugaagcagaggacgugg

SEQ ID NO: 120700 - RNA, 22 nt, Human
ugcaacaggcugugacauggaa

SEQ ID NO: 120701 - RNA, 22 nt, Human
auaauaacaaugccagaugccu

SEQ ID NO: 120702 - RNA, 22 nt, Human
uacagugcuugguaucuaguaa

SEQ ID NO: 120703 - RNA, 22 nt, Human
gacaggcuuccuaagugccaga

SEQ ID NO: 120704 - RNA, 22 nt, Human
aggcucagucuguucaugcacu

SEQ ID NO: 120705 - RNA, 22 nt, Human
uugcagcuucuaccacuguuuc

SEQ ID NO: 120706 - RNA, 22 nt, Human
gcucccagacugaccagaggug

SEQ ID NO: 120707 - RNA, 22 nt, Human
agugauuagaaaguacacuugg

SEQ ID NO: 120708 - RNA, 22 nt, Human
uaugagcaagaguuugugaagg

SEQ ID NO: 120709 - RNA, 22 nt, Human
aggcugagcggggucccagagc

SEQ ID NO: 120710 - RNA, 22 nt, Human
cagggcaguuugugccuaugag

SEQ ID NO: 120711 - RNA, 22 nt, Human
uagcagcuggggcuauucauca

SEQ ID NO: 120712 - RNA, 22 nt, Human
cugaggcacagugaacuucucc

SEQ ID NO: 120713 - RNA, 19 nt, Human
acagggcagcaauaggaua

SEQ ID NO: 120714 - RNA, 22 nt, Human
gugugcagggaugagugcaggu

SEQ ID NO: 120715 - RNA, 22 nt, Human
gaggcucaguuauuuuagccug

SEQ ID NO: 120716 - RNA, 22 nt, Human
cucagaagaacaaaggcucuac

SEQ ID NO: 120717 - RNA, 22 nt, Human
ucaggaguaaagacagaguucc

SEQ ID NO: 120718 - RNA, 22 nt, Human
ugaucaguguugguucuaucua

SEQ ID NO: 120719 - RNA, 20 nt, Human
gcaaauggaucccacaagcc

SEQ ID NO: 120720 - RNA, 22 nt, Human
cagaagcauuccagcaaauagu

SEQ ID NO: 120721 - RNA, 22 nt, Human
agggaaaucuuucaacacuuca

SEQ ID NO: 120722 - RNA, 22 nt, Human
agucaguuaaccucacagcauc

SEQ ID NO: 120723 - RNA, 17 nt, Human
ugaagaugcauggcagc

SEQ ID NO: 120724 - RNA, 21 nt, Human
uggggaggggaccugauuaug

SEQ ID NO: 120725 - RNA, 22 nt, Human
guaauuaggaauaaaaugggaa

SEQ ID NO: 120726 - RNA, 22 nt, Human
ggugaagguggaacgcagagca

SEQ ID NO: 120727 - RNA, 22 nt, Human
ccagagccucgcccggagccuc

SEQ ID NO: 120728 - RNA, 22 nt, Human
acaaaggcauagugaauguuuu

SEQ ID NO: 120729 - RNA, 22 nt, Human
aagggcugcauuugauguguca

SEQ ID NO: 120730 - RNA, 22 nt, Human
gaagauugaaggcugggaauua

SEQ ID NO: 120731 - RNA, 22 nt, Human
ugccaggcagugucagauugag

SEQ ID NO: 120732 - RNA, 22 nt, Human
gagacguggccuuugccugagc

SEQ ID NO: 120733 - RNA, 22 nt, Human
gggugcagggucuccagcagcu

SEQ ID NO: 120734 - RNA, 22 nt, Human
gcugugcagguccccacugccu

SEQ ID NO: 120735 - RNA, 21 nt, Human
uucuucaugaugauuaauggc

SEQ ID NO: 120736 - RNA, 22 nt, Human
acauuuguauauaugcagcaua

SEQ ID NO: 120737 - RNA, 19 nt, Human
ucucccagcugagaagggc

SEQ ID NO: 120738 - RNA, 22 nt, Human
cagugcaggaagugagaugccu

SEQ ID NO: 120739 - RNA, 22 nt, Human
uacaguacacagguaccaagcu

SEQ ID NO: 120740 - RNA, 22 nt, Human
ggggccgaccgcgguucaggcc

SEQ ID NO: 120741 - RNA, 22 nt, Human
gagagggcaaacuuguagcuaa

SEQ ID NO: 120742 - RNA, 22 nt, Human
ggcagauggagaagcagcaggu

SEQ ID NO: 120743 - RNA, 23 nt, Human
guguucaucccagucugugcaau

SEQ ID NO: 120744 - RNA, 22 nt, Human
aagggcagcugacagaugcuua

SEQ ID NO: 120745 - RNA, 22 nt, Human
ugcucugucaagaaaagaugcc

SEQ ID NO: 120746 - RNA, 22 nt, Human
aggcagcauuugaauccagguc

SEQ ID NO: 120747 - RNA, 22 nt, Human
caggcagaugcugacaagaguu

SEQ ID NO: 120748 - RNA, 22 nt, Human
ugucuucaguaaaauacacuau

SEQ ID NO: 120749 - RNA, 22 nt, Human
acauuugacuguagauacuugc

SEQ ID NO: 120750 - RNA, 22 nt, Human
cugagucucccggcaguggagg

SEQ ID NO: 120751 - RNA, 22 nt, Human
gugcaugaagacucagaaaguc

SEQ ID NO: 120752 - RNA, 22 nt, Human
gcugguaaacuucuggugccau

SEQ ID NO: 120753 - RNA, 22 nt, Human
guguccuuauaagaagagaugc

SEQ ID NO: 120754 - RNA, 22 nt, Human
ucaggcugcuggccagcaggcu

SEQ ID NO: 120755 - RNA, 22 nt, Human
ugaggcagggagaguggauaug

SEQ ID NO: 120756 - RNA, 20 nt, Human
ugccaggcugcacgccugcc

SEQ ID NO: 120757 - RNA, 22 nt, Human
aacauuuguguuugcuaaaaau

SEQ ID NO: 120758 - RNA, 22 nt, Human
gcagggucuugagaggcagcca

SEQ ID NO: 120759 - RNA, 22 nt, Human
cagagccccucagcucucuccc

SEQ ID NO: 120760 - RNA, 22 nt, Human
agcagggcccacuaggggagau

SEQ ID NO: 120761 - RNA, 22 nt, Human
aaguccagguccucauuccauc

SEQ ID NO: 120762 - RNA, 22 nt, Human
ugggggaagagcuuguuaaagu

SEQ ID NO: 120763 - RNA, 22 nt, Human
cagaggaaaguauuucuggaag

SEQ ID NO: 120764 - RNA, 22 nt, Human
uguggcaguauaagagcuagaa

SEQ ID NO: 120765 - RNA, 17 nt, Human
cagggcugucugccuag

SEQ ID NO: 120766 - RNA, 22 nt, Human
ccugugcauugcaggguguuca

SEQ ID NO: 120767 - RNA, 22 nt, Human
agaugugguaguugaagggaag

SEQ ID NO: 120768 - RNA, 22 nt, Human
agaaugcauuuuguguagcuau

SEQ ID NO: 120769 - RNA, 22 nt, Human
agggaggugguuccccagugga

SEQ ID NO: 120770 - RNA, 22 nt, Human
caucaucaaaagugacagagaa

SEQ ID NO: 120771 - RNA, 23 nt, Human
caggcaggaugaggacuacacuc

SEQ ID NO: 120772 - RNA, 22 nt, Human
cauaacauugagcagcauuccu

SEQ ID NO: 120773 - RNA, 22 nt, Human
uuuaugcacaauuagucuuaua

SEQ ID NO: 120774 - RNA, 22 nt, Human
ugcugugcaucauaguguuugg

SEQ ID NO: 120775 - RNA, 22 nt, Human
gggagaagaaugugucaauugu

SEQ ID NO: 120776 - RNA, 22 nt, Human
ugcagugauuuguacaauuaga

SEQ ID NO: 120777 - RNA, 22 nt, Human
ccagggcaggggcuggaguuca

SEQ ID NO: 120778 - RNA, 22 nt, Human
cagggcagaacauauagauagu

SEQ ID NO: 120779 - RNA, 23 nt, Human
gguggcaggaguggaugcugagc

SEQ ID NO: 120780 - RNA, 22 nt, Human
gagagggccagggugagaacua

SEQ ID NO: 120781 - RNA, 22 nt, Human
auauaauucucagguuugacua

SEQ ID NO: 120782 - RNA, 22 nt, Human
ugacauuuaucaaagaaauggu

SEQ ID NO: 120783 - RNA, 22 nt, Human
aagacuugaccagguugaaggc

SEQ ID NO: 120784 - RNA, 22 nt, Human
uaacugauguucccuuacugua

SEQ ID NO: 120785 - RNA, 22 nt, Human
caguagcuugcuuaggcuuuua

SEQ ID NO: 120786 - RNA, 22 nt, Human
ccagggcauccucacaucgcag

SEQ ID NO: 120787 - RNA, 22 nt, Human
auguaacauugaauuauauagu

SEQ ID NO: 120788 - RNA, 22 nt, Human
auaauaacaccugaauaggaaa

SEQ ID NO: 120789 - RNA, 22 nt, Human
ccagggcaugggaagaacugaa

SEQ ID NO: 120790 - RNA, 22 nt, Human
gggcagugucggggcccaggga

SEQ ID NO: 120791 - RNA, 22 nt, Human
uggcagagcccagacuccaguc

SEQ ID NO: 120792 - RNA, 22 nt, Human
aagcugaagacacagcuccagu

SEQ ID NO: 120793 - RNA, 22 nt, Human
caaauagauuguucaauccuga

SEQ ID NO: 120794 - RNA, 22 nt, Human
gaggcugguaggaaaggaaaca

SEQ ID NO: 120795 - RNA, 22 nt, Human
ucaauuacuaaccaaauaaugu

SEQ ID NO: 120796 - RNA, 22 nt, Human
cagugaggcucugcugagcggu

SEQ ID NO: 120797 - RNA, 22 nt, Human
aguuaacaaguuggcaaucaac

SEQ ID NO: 120798 - RNA, 22 nt, Human
caggggcagucugugugcgugg

SEQ ID NO: 120799 - RNA, 22 nt, Human
gcauggcauuugaagguagaag

SEQ ID NO: 120800 - RNA, 22 nt, Human
acugagcucugaugagauuugg

SEQ ID NO: 120801 - RNA, 22 nt, Human
cugcuguguaucauuuuagaug

SEQ ID NO: 120802 - RNA, 22 nt, Human
aguggcaggcagaagcuucuca

SEQ ID NO: 120803 - RNA, 22 nt, Human
cucgcaggacagugcuaggacu

SEQ ID NO: 120804 - RNA, 22 nt, Human
uuucacaaucaaauggugaaau

SEQ ID NO: 120805 - RNA, 22 nt, Human
gugcugaggauacagcugugaa

SEQ ID NO: 120806 - RNA, 18 nt, Human
ucagaggagauaccuaaa

SEQ ID NO: 120807 - RNA, 22 nt, Human
ccagagggcaaaaugaagcuua

SEQ ID NO: 120808 - RNA, 22 nt, Human
auuuuaguaccucaaguaucca

SEQ ID NO: 120809 - RNA, 21 nt, Human
agcagaggggacauguuugau

SEQ ID NO: 120810 - RNA, 22 nt, Human
aaggauuaguagguacaguuca

SEQ ID NO: 120811 - RNA, 22 nt, Human
gaggagaaauuuggggaccuga

SEQ ID NO: 120812 - RNA, 22 nt, Human
agaagccaauucugugugaguc

SEQ ID NO: 120813 - RNA, 22 nt, Human
aaauggaaaaugcuguuuuggu

SEQ ID NO: 120814 - RNA, 22 nt, Human
gaccugggguggaaggaaggca

SEQ ID NO: 120815 - RNA, 22 nt, Human
cucuguuuuucaauaguucuug

SEQ ID NO: 120816 - RNA, 22 nt, Human
uggcagagguaauucaaauccc

SEQ ID NO: 120817 - RNA, 17 nt, Human
agaggcagauacuugga

SEQ ID NO: 120818 - RNA, 22 nt, Human
aagccaguguuuuugagaguug

SEQ ID NO: 120819 - RNA, 22 nt, Human
caucaucaaaacaaauggaguc

SEQ ID NO: 120820 - RNA, 22 nt, Human
acagugauuggcacugauucag

SEQ ID NO: 120821 - RNA, 22 nt, Human
agcugugccuauucguggcaag

SEQ ID NO: 120822 - RNA, 22 nt, Human
ugcauaaagugccauaguauua

SEQ ID NO: 120823 - RNA, 22 nt, Human
gggcagguguuuccaaggugag

SEQ ID NO: 120824 - RNA, 22 nt, Human
gcaugcugcagggaaugcuugu

SEQ ID NO: 120825 - RNA, 22 nt, Human
gaagucugcugcucaggaguuu

SEQ ID NO: 120826 - RNA, 22 nt, Human
gggaagggacuuguuuaagguc

SEQ ID NO: 120827 - RNA, 22 nt, Human
agccuccuguagcccucaccca

SEQ ID NO: 120828 - RNA, 22 nt, Human
caugagaaguggccuucaaaaa

SEQ ID NO: 120829 - RNA, 22 nt, Human
agagaugccaccuuuuugcugu

SEQ ID NO: 120830 - RNA, 22 nt, Human
aagccacuauggugauucucaa

SEQ ID NO: 120831 - RNA, 23 nt, Human
uuuguacauugaggaggcagaau

SEQ ID NO: 120832 - RNA, 22 nt, Human
gguggcagaggugcaucagccc

SEQ ID NO: 120833 - RNA, 22 nt, Human
agauggggcugaaaguuccaau

SEQ ID NO: 120834 - RNA, 18 nt, Human
uggugaaggguggaggag

SEQ ID NO: 120835 - RNA, 22 nt, Human
aauaugcacucugauuuagcag

SEQ ID NO: 120836 - RNA, 22 nt, Human
aaugggaagucacuacuguuac

SEQ ID NO: 120837 - RNA, 22 nt, Human
uggcagagagacucuccuugau

SEQ ID NO: 120838 - RNA, 22 nt, Human
gcagacaauuuauuagcagauu

SEQ ID NO: 120839 - RNA, 22 nt, Human
caggaggagcauuagcgucuca

SEQ ID NO: 120840 - RNA, 22 nt, Human
agggcagcugugagccacugug

SEQ ID NO: 120841 - RNA, 22 nt, Human
cauuuguaauacugacuugcag

SEQ ID NO: 120842 - RNA, 17 nt, Human
gacaggcucagugacga

SEQ ID NO: 120843 - RNA, 22 nt, Human
uggaggaauaacagcaaccuua

SEQ ID NO: 120844 - RNA, 22 nt, Human
acauuugagucauauuugcuua

SEQ ID NO: 120845 - RNA, 22 nt, Human
cugagcgcaugguugcugggga

SEQ ID NO: 120846 - RNA, 22 nt, Human
guuucaaagcacagcucacauu

SEQ ID NO: 120847 - RNA, 18 nt, Human
gccagagggaagcaggug

SEQ ID NO: 120848 - RNA, 22 nt, Human
cucucuguuaugcuuucaugaa

SEQ ID NO: 120849 - RNA, 22 nt, Human
caagggcauugcuugggaccuu

SEQ ID NO: 120850 - RNA, 22 nt, Human
acuaugaaaguauaauauugaa

SEQ ID NO: 120851 - RNA, 22 nt, Human
ugaggaagcaaaggcuugugug

SEQ ID NO: 120852 - RNA, 22 nt, Human
gagaagcaaucgugacaucucc

SEQ ID NO: 120853 - RNA, 22 nt, Human
gggagccagcagggcauggagc

SEQ ID NO: 120854 - RNA, 22 nt, Human
aggcagccaguucagguuucuu

SEQ ID NO: 120855 - RNA, 22 nt, Human
ucugggagauccaagcagaacu

SEQ ID NO: 120856 - RNA, 22 nt, Human
gcuggcagagagcuggugagga

SEQ ID NO: 120857 - RNA, 22 nt, Human
accaaaggcagagcugaacacu

SEQ ID NO: 120858 - RNA, 22 nt, Human
gagggcugauguugccaccuca

SEQ ID NO: 120859 - RNA, 22 nt, Human
gccaggcuccccggaucccugg

SEQ ID NO: 120860 - RNA, 22 nt, Human
ucagggcaaaagggaaaccauu

SEQ ID NO: 120861 - RNA, 22 nt, Human
agcugcagugaacuguuuuguc

SEQ ID NO: 120862 - RNA, 22 nt, Human
agaaagagcucgggauuaacag

SEQ ID NO: 120863 - RNA, 22 nt, Human
gagaaagggauaauuugaagag

SEQ ID NO: 120864 - RNA, 20 nt, Human
uccuggccucccuggggcuc

SEQ ID NO: 120865 - RNA, 22 nt, Human
gugugcaggugucagugcagcu

SEQ ID NO: 120866 - RNA, 22 nt, Human
caguuaccaucuucagugauga

SEQ ID NO: 120867 - RNA, 22 nt, Human
uuguauuuccuauaaccuuucu

SEQ ID NO: 120868 - RNA, 22 nt, Human
aauucugugcaggcagagcuau

SEQ ID NO: 120869 - RNA, 22 nt, Human
uauagaggccaccaacaugaaa

SEQ ID NO: 120870 - RNA, 19 nt, Human
ucagaggauuuggcuauga

SEQ ID NO: 120871 - RNA, 22 nt, Human
aggcagagcugauguucuguga

SEQ ID NO: 120872 - RNA, 22 nt, Human
uggagaagcuguagguggacuc

SEQ ID NO: 120873 - RNA, 22 nt, Human
cuccucuuuggggauuuacaca

SEQ ID NO: 120874 - RNA, 22 nt, Human
ucugccugagcagagggaggcc

SEQ ID NO: 120875 - RNA, 22 nt, Human
auguuuaaaggagucagagacu

SEQ ID NO: 120876 - RNA, 22 nt, Human
cagaaauggagcccaggaaucu

SEQ ID NO: 120877 - RNA, 22 nt, Human
agggccaggaacaccugaaggg

SEQ ID NO: 120878 - RNA, 22 nt, Human
guuagcaccagugcucauaaca

SEQ ID NO: 120879 - RNA, 22 nt, Human
acagggcaccugagguaggaag

SEQ ID NO: 120880 - RNA, 22 nt, Human
ggcugagcaauuuugaugacau

SEQ ID NO: 120881 - RNA, 22 nt, Human
aggggagguguccccaaaucuc

SEQ ID NO: 120882 - RNA, 19 nt, Human
gcgaggaagucacuguggc

SEQ ID NO: 120883 - RNA, 20 nt, Human
acauuugaguaucaucuacu

SEQ ID NO: 120884 - RNA, 22 nt, Human
ggaagccagagugcugggcagg

SEQ ID NO: 120885 - RNA, 22 nt, Human
cugagaguguggcuuccaggcc

SEQ ID NO: 120886 - RNA, 19 nt, Human
agaaaaacugguacugcug

SEQ ID NO: 120887 - RNA, 19 nt, Human
agccagugagccucugggu

SEQ ID NO: 120888 - RNA, 22 nt, Human
aaacauuuuucuucaucauccu

SEQ ID NO: 120889 - RNA, 22 nt, Human
acagcacaggaguugaaugggc

SEQ ID NO: 120890 - RNA, 22 nt, Human
aaacagauaagggacaauuuca

SEQ ID NO: 120891 - RNA, 22 nt, Human
ggguguccugugccaagcuggg

SEQ ID NO: 120892 - RNA, 22 nt, Human
aggcucagacaggaaaaguaac

SEQ ID NO: 120893 - RNA, 22 nt, Human
agaauaaaugcuaccuaucaca

SEQ ID NO: 120894 - RNA, 23 nt, Human
acagggcauugcuggccucgagg

SEQ ID NO: 120895 - RNA, 22 nt, Human
uuauuacacugaaagaauugcg

SEQ ID NO: 120896 - RNA, 22 nt, Human
ggcuguggcauuaggugaggcc

SEQ ID NO: 120897 - RNA, 22 nt, Human
acgcuggugaaagggugguuuu

SEQ ID NO: 120898 - RNA, 22 nt, Human
uaugcauaguggaauuagcaaa

SEQ ID NO: 120899 - RNA, 22 nt, Human
aaacuagagauggcagguggaa

SEQ ID NO: 120900 - RNA, 22 nt, Human
gggcacuggaggccaaggagcu

SEQ ID NO: 120901 - RNA, 22 nt, Human
acauucuuaacaguuaaaaacu

SEQ ID NO: 120902 - RNA, 22 nt, Human
aggucauuaaaguuaaaugagg

SEQ ID NO: 120903 - RNA, 22 nt, Human
gcugugcaguaguagguacagu

SEQ ID NO: 120904 - RNA, 22 nt, Human
cagaggaggcgguauacacugc

SEQ ID NO: 120905 - RNA, 22 nt, Human
gaggcagagucacaaagagucu

SEQ ID NO: 120906 - RNA, 22 nt, Human
cauuuguaguaucuguuuauau

SEQ ID NO: 120907 - RNA, 22 nt, Human
aaacaugaguuaaaaguaacug

SEQ ID NO: 120908 - RNA, 22 nt, Human
ggccugaggccaccagcagccc

SEQ ID NO: 120909 - RNA, 22 nt, Human
uggcugagggcacuaugaagcc

SEQ ID NO: 120910 - RNA, 21 nt, Human
uccugggggguaggugaguuu

SEQ ID NO: 120911 - RNA, 19 nt, Human
aggcagucauuggaauaua

SEQ ID NO: 120912 - RNA, 22 nt, Human
ucccaggaaaacacucgaggac

SEQ ID NO: 120913 - RNA, 22 nt, Human
gaugagcugucuagcuguugga

SEQ ID NO: 120914 - RNA, 22 nt, Human
ucagaggauagaaauacuuauu

SEQ ID NO: 120915 - RNA, 22 nt, Human
uccuguggagaggacuggaggu

SEQ ID NO: 120916 - RNA, 22 nt, Human
gaagaggaugacaggagccggu

SEQ ID NO: 120917 - RNA, 22 nt, Human
gccaccuggacagcugugcccu

SEQ ID NO: 120918 - RNA, 22 nt, Human
gggcaggugcccagggccagag

SEQ ID NO: 120919 - RNA, 22 nt, Human
gcauggcaaauaucgagggcag

SEQ ID NO: 120920 - RNA, 19 nt, Human
ucauaaaaaugguaaccca

SEQ ID NO: 120921 - RNA, 22 nt, Human
cagagcagacguugagauuaag

SEQ ID NO: 120922 - RNA, 23 nt, Human
agaggcaggaguggcuugcccgg

SEQ ID NO: 120923 - RNA, 20 nt, Human
acaguggaaauugaugucug

SEQ ID NO: 120924 - RNA, 17 nt, Human
aauguggaaguacaugc

SEQ ID NO: 120925 - RNA, 22 nt, Human
uauuagcgucaggaggugagua

SEQ ID NO: 120926 - RNA, 22 nt, Human
uggggcagggaugggaaacuau

SEQ ID NO: 120927 - RNA, 22 nt, Human
uugagcaaugcugcaaagagau

SEQ ID NO: 120928 - RNA, 22 nt, Human
agcuggcagagcauuuguggcc

SEQ ID NO: 120929 - RNA, 22 nt, Human
ucagccuuguggcccugcucca

SEQ ID NO: 120930 - RNA, 22 nt, Human
aggccagcaccagagucaagaa

SEQ ID NO: 120931 - RNA, 20 nt, Human
gcaauauaugagugcaauaa

SEQ ID NO: 120932 - RNA, 22 nt, Human
aggcugaugcuggcugaggcug

SEQ ID NO: 120933 - RNA, 19 nt, Human
gguguccuagagauaagag

SEQ ID NO: 120934 - RNA, 19 nt, Human
agaggcagucuccaacagg

SEQ ID NO: 120935 - RNA, 22 nt, Human
accagugcuuccugcuggagcu

SEQ ID NO: 120936 - RNA, 22 nt, Human
uuccucagccagcacuuagggg

SEQ ID NO: 120937 - RNA, 22 nt, Human
agggcagaccacgugcaaggau

SEQ ID NO: 120938 - RNA, 22 nt, Human
uuagggcaggcaugagagaacu

SEQ ID NO: 120939 - RNA, 23 nt, Human
uacauucuguauuuuuauagagu

SEQ ID NO: 120940 - RNA, 22 nt, Human
uuugucaaaucaaaccacauuc

SEQ ID NO: 120941 - RNA, 22 nt, Human
uacaacagacaggaauaagauu

SEQ ID NO: 120942 - RNA, 22 nt, Human
aaacaguuuauaacaugauacu

SEQ ID NO: 120943 - RNA, 22 nt, Human
gcaggguccauggaggcagccc

SEQ ID NO: 120944 - RNA, 22 nt, Human
gaagccaguguuugaagaauuu

SEQ ID NO: 120945 - RNA, 22 nt, Human
cugagagguaagcagcgcagug

SEQ ID NO: 120946 - RNA, 22 nt, Human
cagccagugguugaagaugcag

SEQ ID NO: 120947 - RNA, 22 nt, Human
auguuuaagaaagucuuccaua

SEQ ID NO: 120948 - RNA, 22 nt, Human
ugggagcaccuugagggcagaa

SEQ ID NO: 120949 - RNA, 18 nt, Human
aggugcagccucugaggc

SEQ ID NO: 120950 - RNA, 22 nt, Human
aaaaugaauaaguuaacccagg

SEQ ID NO: 120951 - RNA, 22 nt, Human
gcaggagcaaacugcagugugg

SEQ ID NO: 120952 - RNA, 22 nt, Human
uagcauauggaggguaagaggg

SEQ ID NO: 120953 - RNA, 22 nt, Human
ucugugcagggaccccaagagu

SEQ ID NO: 120954 - RNA, 22 nt, Human
aagguauuggcagggcugaguu

SEQ ID NO: 120955 - RNA, 20 nt, Human
aagggcagagggaacagacu

SEQ ID NO: 120956 - RNA, 22 nt, Human
ugccaggcauuugacagacacu

SEQ ID NO: 120957 - RNA, 22 nt, Human
gugugggcugcagaggcacagc

SEQ ID NO: 120958 - RNA, 22 nt, Human
uccugaaaaauuacauguucag

SEQ ID NO: 120959 - RNA, 22 nt, Human
cagguggaucucuaaggacuga

SEQ ID NO: 120960 - RNA, 19 nt, Human
cagaaauagcgaaguguaa

SEQ ID NO: 120961 - RNA, 22 nt, Human
uuagagcuucccaauuaaaacg

SEQ ID NO: 120962 - RNA, 18 nt, Human
aggaagcaggaggaaggc

SEQ ID NO: 120963 - RNA, 22 nt, Human
aauacaguaauuuugaugaguu

SEQ ID NO: 120964 - RNA, 23 nt, Human
aggcagugucucuuauccugucc

SEQ ID NO: 120965 - RNA, 22 nt, Human
gccagguguccucacagugagg

SEQ ID NO: 120966 - RNA, 22 nt, Human
gugcacaaucuucauauggcgu

SEQ ID NO: 120967 - RNA, 20 nt, Human
cagguauuacuuccuuuaug

SEQ ID NO: 120968 - RNA, 22 nt, Human
aggagaaggaagugcaucacua

SEQ ID NO: 120969 - RNA, 22 nt, Human
uugaucagguugcuguggugua

SEQ ID NO: 120970 - RNA, 22 nt, Human
uccugccuuagagcaaggaaaa

SEQ ID NO: 120971 - RNA, 22 nt, Human
uggggagguucgggaaucuugu

SEQ ID NO: 120972 - RNA, 18 nt, Human
ugcugugcacagcccuau

SEQ ID NO: 120973 - RNA, 22 nt, Human
ccacccugagccgcaagagcag

SEQ ID NO: 120974 - RNA, 22 nt, Human
caugcauauuacuagcacagca

SEQ ID NO: 120975 - RNA, 22 nt, Human
aggugcaggagcugugcaggga

SEQ ID NO: 120976 - RNA, 22 nt, Human
gccagguggcugagcagcugca

SEQ ID NO: 120977 - RNA, 22 nt, Human
ucagaaaugaucguuauucauu

SEQ ID NO: 120978 - RNA, 22 nt, Human
uuuuauacacaugaacaugcag

SEQ ID NO: 120979 - RNA, 22 nt, Human
cauuuguaguuaaaaaugucuc

SEQ ID NO: 120980 - RNA, 22 nt, Human
gguuuacucguaguggcgguuu

SEQ ID NO: 120981 - RNA, 22 nt, Human
uuuaaucuauucccuaaacacc

SEQ ID NO: 120982 - RNA, 22 nt, Human
uuugauuuacuggauauucuca

SEQ ID NO: 120983 - RNA, 22 nt, Human
aaggcugaauucaaggguaggc

SEQ ID NO: 120984 - RNA, 21 nt, Human
ccaccaggucuucugcucggg

SEQ ID NO: 120985 - RNA, 22 nt, Human
ugguccugguagcggugugcuu

SEQ ID NO: 120986 - RNA, 22 nt, Human
ugcuguggcaguuuauguauag

SEQ ID NO: 120987 - RNA, 22 nt, Human
ccagggcagcgccccuccacgc

SEQ ID NO: 120988 - RNA, 23 nt, Human
ugggcagcuucugcaugcccacc

SEQ ID NO: 120989 - RNA, 20 nt, Human
gggaggcgagggcugagcag

SEQ ID NO: 120990 - RNA, 22 nt, Human
aaggaagacuugagaagguucc

SEQ ID NO: 120991 - RNA, 22 nt, Human
agcacaauagagcaguuaaaaa

SEQ ID NO: 120992 - RNA, 18 nt, Human
ucauuuguuuugcaugaa

SEQ ID NO: 120993 - RNA, 22 nt, Human
ucucugaguucuccuccagccc

SEQ ID NO: 120994 - RNA, 22 nt, Human
ggugaaggucagagcaggaaaa

SEQ ID NO: 120995 - RNA, 22 nt, Human
aauuggaagaauugauuugcuu

SEQ ID NO: 120996 - RNA, 22 nt, Human
gguguccuugcagaaggcggcg

SEQ ID NO: 120997 - RNA, 22 nt, Human
ucacaagacagaaaacauuuag

SEQ ID NO: 120998 - RNA, 22 nt, Human
cauaacauuaagccucuauuuc

SEQ ID NO: 120999 - RNA, 21 nt, Human
uuagaguagagaacaugaucc

SEQ ID NO: 121000 - RNA, 22 nt, Human
ugcagggcaguggagguugagu

SEQ ID NO: 121001 - RNA, 22 nt, Human
uggcugaggagagggcggaagu

SEQ ID NO: 121002 - RNA, 22 nt, Human
agguuuaugauucugcacgugg

SEQ ID NO: 121003 - RNA, 22 nt, Human
uggagcaggacggggaguggua

SEQ ID NO: 121004 - RNA, 22 nt, Human
ucaaaggcgguccaggaauaaa

SEQ ID NO: 121005 - RNA, 22 nt, Human
agagcuauaacagcacuguaca

SEQ ID NO: 121006 - RNA, 22 nt, Human
gggaaggacauucugggcucag

SEQ ID NO: 121007 - RNA, 22 nt, Human
accaggcugugaagugagacua

SEQ ID NO: 121008 - RNA, 22 nt, Human
cagugggggugaggccgaggua

SEQ ID NO: 121009 - RNA, 22 nt, Human
aacauuuauugagcaccuacug

SEQ ID NO: 121010 - RNA, 21 nt, Human
gcagaggaaugguauacauaa

SEQ ID NO: 121011 - RNA, 22 nt, Human
caaaggcuuugcuaugaugcau

SEQ ID NO: 121012 - RNA, 22 nt, Human
uugcagcugcaguaaauguuca

SEQ ID NO: 121013 - RNA, 20 nt, Human
ggcagagggccugggagaag

SEQ ID NO: 121014 - RNA, 20 nt, Human
ucccaagggcugagaggauc

SEQ ID NO: 121015 - RNA, 16 nt, Human
uggcugagagaggguu

SEQ ID NO: 121016 - RNA, 22 nt, Human
uggcagagugcagaagaggcau

SEQ ID NO: 121017 - RNA, 22 nt, Human
gggcugagggccaauuccuacu

SEQ ID NO: 121018 - RNA, 22 nt, Human
uggggcaguuaauaaacauucu

SEQ ID NO: 121019 - RNA, 22 nt, Human
ucaggcaggacaauuauuuagg

SEQ ID NO: 121020 - RNA, 22 nt, Human
uggcugagaaugggaugaugcc

SEQ ID NO: 121021 - RNA, 22 nt, Human
uacuaggcaauuauguaaauaa

SEQ ID NO: 121022 - RNA, 22 nt, Human
caggagcaguuagaagcccacu

SEQ ID NO: 121023 - RNA, 22 nt, Human
uugauucaaaggggacaagugg

SEQ ID NO: 121024 - RNA, 22 nt, Human
aagaacaguugggaggugagcc

SEQ ID NO: 121025 - RNA, 22 nt, Human
aggcucagaggugagcaucugc

SEQ ID NO: 121026 - RNA, 22 nt, Human
agggcagugggaaagccugcuc

SEQ ID NO: 121027 - RNA, 22 nt, Human
aauaugcauguauacaugugua

SEQ ID NO: 121028 - RNA, 22 nt, Human
caggcagagcaacugguccaga

SEQ ID NO: 121029 - RNA, 22 nt, Human
accugagaccuaaucugacugu

SEQ ID NO: 121030 - RNA, 22 nt, Human
gugccagggggcacugaacaga

SEQ ID NO: 121031 - RNA, 21 nt, Human
aacaugauauguguauggauu

SEQ ID NO: 121032 - RNA, 17 nt, Human
cagugcagauaagugag

SEQ ID NO: 121033 - RNA, 22 nt, Human
augaguaaaaccacuauuuaca

SEQ ID NO: 121034 - RNA, 22 nt, Human
aggcugagcaaagggccuuacc

SEQ ID NO: 121035 - RNA, 22 nt, Human
aaguccaguuuuuccagguggu

SEQ ID NO: 121036 - RNA, 22 nt, Human
aagaggaagucuccauggagag

SEQ ID NO: 121037 - RNA, 22 nt, Human
aaauggaucuguggaauacauu

SEQ ID NO: 121038 - RNA, 22 nt, Human
ugguucaugcucauggugauag

SEQ ID NO: 121039 - RNA, 22 nt, Human
uccaaaaaacguuugaauaguu

SEQ ID NO: 121040 - RNA, 22 nt, Human
agacaacaccaaaugcuagugu

SEQ ID NO: 121041 - RNA, 22 nt, Human
ggucaguggcaggggguacuuc

SEQ ID NO: 121042 - RNA, 22 nt, Human
uggcagagaacacacaugauuc

SEQ ID NO: 121043 - RNA, 22 nt, Human
uucuugcucaaugucuguuuaa

SEQ ID NO: 121044 - RNA, 22 nt, Human
gcagaggagugauuaugccgug

SEQ ID NO: 121045 - RNA, 22 nt, Human
acauuuugaaagggaaauuguu

SEQ ID NO: 121046 - RNA, 22 nt, Human
uuccauaauaggcuuaagugaa

SEQ ID NO: 121047 - RNA, 22 nt, Human
agugggguccucaguaugguuc

SEQ ID NO: 121048 - RNA, 22 nt, Human
gagugaugucuguagugaagaa

SEQ ID NO: 121049 - RNA, 22 nt, Human
acauucuuugaguuuuguuaaa

SEQ ID NO: 121050 - RNA, 18 nt, Human
ggcuuugcugggguuucu

SEQ ID NO: 121051 - RNA, 23 nt, Human
aggaggaaaaguuaucugcugag

SEQ ID NO: 121052 - RNA, 22 nt, Human
acagugacaacccaggauaaau

SEQ ID NO: 121053 - RNA, 22 nt, Human
cagagugaacagugggaugugc

SEQ ID NO: 121054 - RNA, 22 nt, Human
aggcucaguuugguuuccauug

SEQ ID NO: 121055 - RNA, 22 nt, Human
aggcugugggguucugcuuuca

SEQ ID NO: 121056 - RNA, 22 nt, Human
ugaguccaucgcagggaagugg

SEQ ID NO: 121057 - RNA, 18 nt, Human
uccgaggcaccauaaaaa

SEQ ID NO: 121058 - RNA, 22 nt, Human
cuucuuaaugcauaaacugugu

SEQ ID NO: 121059 - RNA, 22 nt, Human
agcagccagagucugaacauua

SEQ ID NO: 121060 - RNA, 22 nt, Human
gcagagcucaugccugcaccuc

SEQ ID NO: 121061 - RNA, 20 nt, Human
auacaguaggugcucaauau

SEQ ID NO: 121062 - RNA, 22 nt, Human
ucacacacauggauaguauuuu

SEQ ID NO: 121063 - RNA, 22 nt, Human
cagccugcucucagauguugag

SEQ ID NO: 121064 - RNA, 22 nt, Human
gaauacaaauaauaccaaggug

SEQ ID NO: 121065 - RNA, 22 nt, Human
aacauuugagaaaaauacucuu

SEQ ID NO: 121066 - RNA, 22 nt, Human
gcugugcagaggugagaaucca

SEQ ID NO: 121067 - RNA, 22 nt, Human
uuuaaauuuagaagaaacacug

SEQ ID NO: 121068 - RNA, 23 nt, Human
aggagaagagauuuccacaugca

SEQ ID NO: 121069 - RNA, 22 nt, Human
uucugcagcccaacaguaguuu

SEQ ID NO: 121070 - RNA, 22 nt, Human
agggccagcccauaaugccaaa

SEQ ID NO: 121071 - RNA, 19 nt, Human
uggcaggcccaggauggac

SEQ ID NO: 121072 - RNA, 22 nt, Human
caaagccaggcuuucuaaugua

SEQ ID NO: 121073 - RNA, 22 nt, Human
gaggagagaagcuaacggugcu

SEQ ID NO: 121074 - RNA, 22 nt, Human
aaauauaauuucugccucaaua

SEQ ID NO: 121075 - RNA, 18 nt, Human
aggaaagaaaggcaggug

SEQ ID NO: 121076 - RNA, 22 nt, Human
ugcaauaaguuguguuaucacu

SEQ ID NO: 121077 - RNA, 22 nt, Human
ugaagccaucaggaagccagca

SEQ ID NO: 121078 - RNA, 22 nt, Human
uuaaaugugauuucauuuaugu

SEQ ID NO: 121079 - RNA, 22 nt, Human
aguaaacacuaaaaugacugcg

SEQ ID NO: 121080 - RNA, 22 nt, Human
gccaggcuguuuuuauuacugu

SEQ ID NO: 121081 - RNA, 22 nt, Human
cccaggucugccagccuguggg

SEQ ID NO: 121082 - RNA, 22 nt, Human
agaggagguccuuuucugaugu

SEQ ID NO: 121083 - RNA, 22 nt, Human
aauuuuauuagaaggcaagggg

SEQ ID NO: 121084 - RNA, 22 nt, Human
ugccaggcuuagagcaggggcu

SEQ ID NO: 121085 - RNA, 22 nt, Human
aacucuauuuacccuacuaaac

SEQ ID NO: 121086 - RNA, 22 nt, Human
ccaccaggacagcccugagggg

SEQ ID NO: 121087 - RNA, 22 nt, Human
gcauggaauucccuuaugggcc

SEQ ID NO: 121088 - RNA, 22 nt, Human
agggccaccucucuggguuccc

SEQ ID NO: 121089 - RNA, 22 nt, Human
ugaagaauguugcagugagcau

SEQ ID NO: 121090 - RNA, 22 nt, Human
uggcagagcuggcugcggauga

SEQ ID NO: 121091 - RNA, 22 nt, Human
aauggaauucuccauuagaugu

SEQ ID NO: 121092 - RNA, 22 nt, Human
ucugugcaggauuugaggaacc

SEQ ID NO: 121093 - RNA, 22 nt, Human
gccagucugcucccacaaguuc

SEQ ID NO: 121094 - RNA, 22 nt, Human
accuguuuucagaaaaugcaga

SEQ ID NO: 121095 - RNA, 22 nt, Human
aaauagauuuccuagcauugga

SEQ ID NO: 121096 - RNA, 22 nt, Human
aauaacagauuuucaagcugug

SEQ ID NO: 121097 - RNA, 22 nt, Human
cauguacacacaaagggacaau

SEQ ID NO: 121098 - RNA, 22 nt, Human
ucucccaguggugcagaaagca

SEQ ID NO: 121099 - RNA, 20 nt, Human
gggcuagaccagggcagagg

SEQ ID NO: 121100 - RNA, 22 nt, Human
aaggggaaaaaguguuaggagu

SEQ ID NO: 121101 - RNA, 22 nt, Human
ccugggcaauauagugaggccc

SEQ ID NO: 121102 - RNA, 22 nt, Human
ugcugugggcaguacauaagcu

SEQ ID NO: 121103 - RNA, 22 nt, Human
aggcagguguuaacccucugag

SEQ ID NO: 121104 - RNA, 22 nt, Human
ugugggcacuaaugacaugcag

SEQ ID NO: 121105 - RNA, 22 nt, Human
ugcagggcuaagucagagccug

SEQ ID NO: 121106 - RNA, 22 nt, Human
augaugaaauuuucuaucaugu

SEQ ID NO: 121107 - RNA, 22 nt, Human
ccacugcccccugaagaccagg

SEQ ID NO: 121108 - RNA, 22 nt, Human
ugugcagcucuagagccaagcc

SEQ ID NO: 121109 - RNA, 22 nt, Human
ggaaucuuaauggcauggaguu

SEQ ID NO: 121110 - RNA, 22 nt, Human
aaacaguuaauugcuuucaguu

SEQ ID NO: 121111 - RNA, 22 nt, Human
uggggcagcuccaucuauucca

SEQ ID NO: 121112 - RNA, 22 nt, Human
guggcaggucccauuggagcag

SEQ ID NO: 121113 - RNA, 22 nt, Human
aggugauuuucuccuuacgauu

SEQ ID NO: 121114 - RNA, 21 nt, Human
ccaaaggcuauguaucuucug

SEQ ID NO: 121115 - RNA, 22 nt, Human
caguucagcuagaagaaacaaa

SEQ ID NO: 121116 - RNA, 22 nt, Human
uggagaugcacgagcaggugga

SEQ ID NO: 121117 - RNA, 22 nt, Human
ucauuuauaaggaugcaauuaa

SEQ ID NO: 121118 - RNA, 22 nt, Human
augcugagauaaggcuuuaguc

SEQ ID NO: 121119 - RNA, 17 nt, Human
ugugcauagaauaauga

SEQ ID NO: 121120 - RNA, 22 nt, Human
uaugcacauucacacaaaaaug

SEQ ID NO: 121121 - RNA, 22 nt, Human
cauucauuuacuuucaacagcu

SEQ ID NO: 121122 - RNA, 22 nt, Human
agcacaaugugaaaagagcucu

SEQ ID NO: 121123 - RNA, 22 nt, Human
uguuaaacuguauugcauaagg

SEQ ID NO: 121124 - RNA, 22 nt, Human
uauaauccugcuucacauugaa

SEQ ID NO: 121125 - RNA, 22 nt, Human
acagugaaugcccaagaaaagu

SEQ ID NO: 121126 - RNA, 22 nt, Human
cccuucucuuucacucacuauu

SEQ ID NO: 121127 - RNA, 22 nt, Human
gaacauuuauauuagauagcua

SEQ ID NO: 121128 - RNA, 22 nt, Human
gagggcagagacagugauucac

SEQ ID NO: 121129 - RNA, 23 nt, Human
aacacauugcuaauuacauucaa

SEQ ID NO: 121130 - RNA, 22 nt, Human
agcagggcuccauuucacugcc

SEQ ID NO: 121131 - RNA, 22 nt, Human
gggcugagcuguucugaguuua

SEQ ID NO: 121132 - RNA, 22 nt, Human
agggccaggaucacagccaaga

SEQ ID NO: 121133 - RNA, 22 nt, Human
cuguuaagcaacaugaguaagu

SEQ ID NO: 121134 - RNA, 22 nt, Human
agcugugggauuugggugugcc

SEQ ID NO: 121135 - RNA, 22 nt, Human
aggugcuagguguguaguggag

SEQ ID NO: 121136 - RNA, 22 nt, Human
gggcugacucaaccuugcaaag

SEQ ID NO: 121137 - RNA, 22 nt, Human
gcagggcaucccugagcgggug

SEQ ID NO: 121138 - RNA, 22 nt, Human
agggaggucuggcugcccugag

SEQ ID NO: 121139 - RNA, 22 nt, Human
agggaggaguccucaaagucau

SEQ ID NO: 121140 - RNA, 22 nt, Human
gguggcagaauaauugaagguc

SEQ ID NO: 121141 - RNA, 22 nt, Human
gugcauuugugcaugcacaugu

SEQ ID NO: 121142 - RNA, 22 nt, Human
gaguggagcaaaagagguagau

SEQ ID NO: 121143 - RNA, 22 nt, Human
acaggcugcccgcuccccaccu

SEQ ID NO: 121144 - RNA, 22 nt, Human
gggcugagggguaucucauggg

SEQ ID NO: 121145 - RNA, 22 nt, Human
agcugaagaaaugggaagcauu

SEQ ID NO: 121146 - RNA, 22 nt, Human
uggcugaguucuccaggaguag

SEQ ID NO: 121147 - RNA, 22 nt, Human
ccagggcaauuauuuggagggu

SEQ ID NO: 121148 - RNA, 21 nt, Human
ugacauuuggauucauaguaa

SEQ ID NO: 121149 - RNA, 21 nt, Human
uuugagaauuggucagagugc

SEQ ID NO: 121150 - RNA, 20 nt, Human
uccuuuggccuuagagcugu

SEQ ID NO: 121151 - RNA, 22 nt, Human
ccaucccuccuccaccagcuag

SEQ ID NO: 121152 - RNA, 22 nt, Human
agggcagccaugagccuucagg

SEQ ID NO: 121153 - RNA, 22 nt, Human
gcaguggauggccagcaggggc

SEQ ID NO: 121154 - RNA, 22 nt, Human
guggggguggaaaggcaaguug

SEQ ID NO: 121155 - RNA, 22 nt, Human
augaaaacagccuccugugaua

SEQ ID NO: 121156 - RNA, 22 nt, Human
ugacauuuuaucaauaucacag

SEQ ID NO: 121157 - RNA, 22 nt, Human
agucagcagccuggccaggaga

SEQ ID NO: 121158 - RNA, 22 nt, Human
ugauugaauucaaaugcaaucu

SEQ ID NO: 121159 - RNA, 22 nt, Human
gaaaggaaauauucuaagcacu

SEQ ID NO: 121160 - RNA, 22 nt, Human
ucuauacaugugcacacacauc

SEQ ID NO: 121161 - RNA, 22 nt, Human
caccagguuccgggcagagcug

SEQ ID NO: 121162 - RNA, 22 nt, Human
caguccaggccuggaggagcca

SEQ ID NO: 121163 - RNA, 22 nt, Human
cuuugcaaaaguuaauuguuga

SEQ ID NO: 121164 - RNA, 22 nt, Human
uggcugagugauauuugcaaag

SEQ ID NO: 121165 - RNA, 22 nt, Human
ugaagccaccgaaccagaagag

SEQ ID NO: 121166 - RNA, 22 nt, Human
caggacaucgucaucaugggga

SEQ ID NO: 121167 - RNA, 22 nt, Human
gaggcagagaccuucaggaccu

SEQ ID NO: 121168 - RNA, 22 nt, Human
uuucacauuuaggcgugaauug

SEQ ID NO: 121169 - RNA, 22 nt, Human
gcagggcaugggcccugucugc

SEQ ID NO: 121170 - RNA, 22 nt, Human
caugggcaccuuaaaaugaggc

SEQ ID NO: 121171 - RNA, 22 nt, Human
accagggcugacaaucugaugg

SEQ ID NO: 121172 - RNA, 22 nt, Human
gggagggaagguaccuguguga

SEQ ID NO: 121173 - RNA, 22 nt, Human
gggaggaaggcuugggugagua

SEQ ID NO: 121174 - RNA, 22 nt, Human
uuucccaauugagagguucugu

SEQ ID NO: 121175 - RNA, 22 nt, Human
cuucauuacuugcucguagcac

SEQ ID NO: 121176 - RNA, 22 nt, Human
ggcagaggagcuggaaacaugg

SEQ ID NO: 121177 - RNA, 22 nt, Human
aauacagugaaagugagcaagg

SEQ ID NO: 121178 - RNA, 22 nt, Human
ggcucacgcaauuaucccggcc

SEQ ID NO: 121179 - RNA, 22 nt, Human
guccuggguccccgcaggucag

SEQ ID NO: 121180 - RNA, 20 nt, Human
gcugaagauucccaugcaag

SEQ ID NO: 121181 - RNA, 22 nt, Human
gaguccaguucuuuccagcagu

SEQ ID NO: 121182 - RNA, 23 nt, Human
agcagugaguaaacagauaggau

SEQ ID NO: 121183 - RNA, 22 nt, Human
ugaggcuugucucagauggggg

SEQ ID NO: 121184 - RNA, 22 nt, Human
auuuccaccggcucaggaaguu

SEQ ID NO: 121185 - RNA, 22 nt, Human
aagccaggccauucucugguuc

SEQ ID NO: 121186 - RNA, 22 nt, Human
ugaaggcacuugccuaggggca

SEQ ID NO: 121187 - RNA, 22 nt, Human
caagauaaaaucagcauuccaa

SEQ ID NO: 121188 - RNA, 22 nt, Human
uggcagagaauaaaucuugacu

SEQ ID NO: 121189 - RNA, 22 nt, Human
uuauuuaaaagugguaagauuc

SEQ ID NO: 121190 - RNA, 22 nt, Human
aggggaggcagcgauaaaccug

SEQ ID NO: 121191 - RNA, 22 nt, Human
aucuucaucaaguucacagugg

SEQ ID NO: 121192 - RNA, 21 nt, Human
ucacacacguuuccaagggca

SEQ ID NO: 121193 - RNA, 22 nt, Human
ugagcaguaacagcucacaggg

SEQ ID NO: 121194 - RNA, 22 nt, Human
aggccagcaagaaagagagucu

SEQ ID NO: 121195 - RNA, 22 nt, Human
cugcuguggaugcaggaccuca

SEQ ID NO: 121196 - RNA, 22 nt, Human
cucccuggcuuuguccugaggc

SEQ ID NO: 121197 - RNA, 22 nt, Human
aggcugaggcgggaggaucacu

SEQ ID NO: 121198 - RNA, 22 nt, Human
uagucucuggagacucuagggg

SEQ ID NO: 121199 - RNA, 22 nt, Human
gcucccaggaugaggagccagg

SEQ ID NO: 121200 - RNA, 22 nt, Human
gcacccagaggucagcagugcu

SEQ ID NO: 121201 - RNA, 22 nt, Human
caggaggcagagguugcaguga

SEQ ID NO: 121202 - RNA, 22 nt, Human
aggcugagucaaguuaggguga

SEQ ID NO: 121203 - RNA, 22 nt, Human
cagugggguuucugugggugcu

SEQ ID NO: 121204 - RNA, 22 nt, Human
aggcagcagucaugaggaaaga

SEQ ID NO: 121205 - RNA, 22 nt, Human
gcagaagaccaugguggaaaga

SEQ ID NO: 121206 - RNA, 22 nt, Human
aggcagcagacuguuaaucaga

SEQ ID NO: 121207 - RNA, 22 nt, Human
auggcagagaaagcgagccaca

SEQ ID NO: 121208 - RNA, 22 nt, Human
uuuucaucucugcuuuguaccu

SEQ ID NO: 121209 - RNA, 22 nt, Human
uggcagaguuggagguggaaga

SEQ ID NO: 121210 - RNA, 22 nt, Human
acacaccaugauuuauuuaccc

SEQ ID NO: 121211 - RNA, 22 nt, Human
gagagggcugccuggugugagg

SEQ ID NO: 121212 - RNA, 22 nt, Human
augaggcacaucacagccaaug

SEQ ID NO: 121213 - RNA, 22 nt, Human
ccuggccaggcauggagucaca

SEQ ID NO: 121214 - RNA, 19 nt, Human
cuggaaugagaacaugccc

SEQ ID NO: 121215 - RNA, 22 nt, Human
gauaaacacaaggugauuucau

SEQ ID NO: 121216 - RNA, 22 nt, Human
uccucccugaguggggacagcu

SEQ ID NO: 121217 - RNA, 22 nt, Human
ucaguggagcuaagcaugagau

SEQ ID NO: 121218 - RNA, 22 nt, Human
caagggcagaggcagggccccg

SEQ ID NO: 121219 - RNA, 22 nt, Human
ggagcagccgcgucucagggca

SEQ ID NO: 121220 - RNA, 22 nt, Human
aguggcagagugcacucaggca

SEQ ID NO: 121221 - RNA, 22 nt, Human
gcaggaagaugagcucagguaa

SEQ ID NO: 121222 - RNA, 22 nt, Human
uccaucaccacagaggacagag

SEQ ID NO: 121223 - RNA, 22 nt, Human
agggcagccucucagccuaggu

SEQ ID NO: 121224 - RNA, 22 nt, Human
caaauagacuuaagcaucugua

SEQ ID NO: 121225 - RNA, 22 nt, Human
guggcagugugaggauccugcu

SEQ ID NO: 121226 - RNA, 22 nt, Human
ggccaggcugguuccuugaccu

SEQ ID NO: 121227 - RNA, 22 nt, Human
acauuugauuccauccucuacu

SEQ ID NO: 121228 - RNA, 22 nt, Human
uaaggguucagaaugcaguggu

SEQ ID NO: 121229 - RNA, 22 nt, Human
ccagggcaucacauccaguguu

SEQ ID NO: 121230 - RNA, 22 nt, Human
uuucuacagaagauacacugcu

SEQ ID NO: 121231 - RNA, 21 nt, Human
agccugggaggcggagguugc

SEQ ID NO: 121232 - RNA, 22 nt, Human
cagcuggacuuuugauagaagu

SEQ ID NO: 121233 - RNA, 22 nt, Human
agcaugaagacuucagagcuag

SEQ ID NO: 121234 - RNA, 22 nt, Human
aaauugauguucccaguugaaa

SEQ ID NO: 121235 - RNA, 23 nt, Human
uucauauguugcugaaaacagca

SEQ ID NO: 121236 - RNA, 22 nt, Human
ggagcugucuguagggcacagg

SEQ ID NO: 121237 - RNA, 22 nt, Human
gguccuggcagcucugugucca

SEQ ID NO: 121238 - RNA, 22 nt, Human
uacagguagagucucuaguuua

SEQ ID NO: 121239 - RNA, 22 nt, Human
ucacauuuguucuugaaucuaa

SEQ ID NO: 121240 - RNA, 22 nt, Human
uagacauuuuaagacauauacc

SEQ ID NO: 121241 - RNA, 22 nt, Human
gccgugucaucugcggguggca

SEQ ID NO: 121242 - RNA, 23 nt, Human
ucuggcucuaugugacagcucuc

SEQ ID NO: 121243 - RNA, 21 nt, Human
uacagugagguguuaggaugu

SEQ ID NO: 121244 - RNA, 22 nt, Human
gccaggcugacucccccggccu

SEQ ID NO: 121245 - RNA, 22 nt, Human
ugaggauggaaugcugugcaag

SEQ ID NO: 121246 - RNA, 22 nt, Human
uuagaucauuuugaacuaauuu

SEQ ID NO: 121247 - RNA, 22 nt, Human
gcuuugcauuguuuaaucagga

SEQ ID NO: 121248 - RNA, 19 nt, Human
cucuccagcuccaguagcu

SEQ ID NO: 121249 - RNA, 22 nt, Human
cagugagggcauucagugcugg

SEQ ID NO: 121250 - RNA, 22 nt, Human
uuuauaguagcaugauuuauaa

SEQ ID NO: 121251 - RNA, 22 nt, Human
guuauuuuaacuucucaguaau

SEQ ID NO: 121252 - RNA, 22 nt, Human
ugaggcagggaguuuaauuguc

SEQ ID NO: 121253 - RNA, 22 nt, Human
uaccuucuaggugaugguuaca

SEQ ID NO: 121254 - RNA, 22 nt, Human
ugggcaggagagaagcuaaaga

SEQ ID NO: 121255 - RNA, 22 nt, Human
aaugugaaaccgcacagaauaa

SEQ ID NO: 121256 - RNA, 22 nt, Human
ccucacuggccagccaggggug

SEQ ID NO: 121257 - RNA, 22 nt, Human
cugggcagcugugcaaacaaua

SEQ ID NO: 121258 - RNA, 22 nt, Human
aggcaguuguugcugagcagcu

SEQ ID NO: 121259 - RNA, 22 nt, Human
acugugcaggggaagagagaaa

SEQ ID NO: 121260 - RNA, 22 nt, Human
ugccaggcgugguggugcgcac

SEQ ID NO: 121261 - RNA, 22 nt, Human
acagugauuuuaggauagaugg

SEQ ID NO: 121262 - RNA, 22 nt, Human
aaaaugaacagaacaaugggga

SEQ ID NO: 121263 - RNA, 22 nt, Human
acuaaauaguuuugacagaaca

SEQ ID NO: 121264 - RNA, 22 nt, Human
cagcugugcuagaagccacgaa

SEQ ID NO: 121265 - RNA, 21 nt, Human
agagacugucacugcaguacc

SEQ ID NO: 121266 - RNA, 22 nt, Human
aaggcaggagcuguaucuuauu

SEQ ID NO: 121267 - RNA, 21 nt, Human
acacugugucauaaugcuuaa

SEQ ID NO: 121268 - RNA, 22 nt, Human
agagaugcugcccgcagacgug

SEQ ID NO: 121269 - RNA, 22 nt, Human
aggugucuggauggguguccuu

SEQ ID NO: 121270 - RNA, 22 nt, Human
gcauggcauuaacaagauggaa

SEQ ID NO: 121271 - RNA, 22 nt, Human
ccagccuggacugggucuugug

SEQ ID NO: 121272 - RNA, 22 nt, Human
gaggcagcggcucacagagaaa

SEQ ID NO: 121273 - RNA, 22 nt, Human
cccagccucagcuuuacuucca

SEQ ID NO: 121274 - RNA, 22 nt, Human
cugucaauuuauguugacaugc

SEQ ID NO: 121275 - RNA, 22 nt, Human
uuccucagacccucauugugag

SEQ ID NO: 121276 - RNA, 23 nt, Human
acaugauacacaauuagcaaacc

SEQ ID NO: 121277 - RNA, 22 nt, Human
ucaggcagguuggcugcagguc

SEQ ID NO: 121278 - RNA, 22 nt, Human
uacaguaccugccacguuguug

SEQ ID NO: 121279 - RNA, 22 nt, Human
ucugccugagggagcugaggaa

SEQ ID NO: 121280 - RNA, 22 nt, Human
cagggcuggguuaaaagcaggg

SEQ ID NO: 121281 - RNA, 22 nt, Human
gaggaagggcugccugccgggc

SEQ ID NO: 121282 - RNA, 22 nt, Human
agugcagugaugaauaaugguu

SEQ ID NO: 121283 - RNA, 22 nt, Human
uggcaggaaaaagggccagagg

SEQ ID NO: 121284 - RNA, 22 nt, Human
cugcugugcuuguggccacccg

SEQ ID NO: 121285 - RNA, 22 nt, Human
agugcucaugcacauuuauagu

SEQ ID NO: 121286 - RNA, 22 nt, Human
ucagggcacauucugcaguggc

SEQ ID NO: 121287 - RNA, 22 nt, Human
aagagccagugggaaagucuug

SEQ ID NO: 121288 - RNA, 22 nt, Human
cugcugugcacccaggaaggcu

SEQ ID NO: 121289 - RNA, 22 nt, Human
ugaguccaccuuaguauauggg

SEQ ID NO: 121290 - RNA, 22 nt, Human
ugauggaaaauaaaucuuauuc

SEQ ID NO: 121291 - RNA, 22 nt, Human
gaaugcuaagcaugugggaguu

SEQ ID NO: 121292 - RNA, 21 nt, Human
aggcuguccuuugccagcccu

SEQ ID NO: 121293 - RNA, 22 nt, Human
cagaguaaggagcugucaaacg

SEQ ID NO: 121294 - RNA, 22 nt, Human
ugucauaugcugucauagccau

SEQ ID NO: 121295 - RNA, 22 nt, Human
auacaugacagcauagcauccu

SEQ ID NO: 121296 - RNA, 22 nt, Human
ccagugccugugggcauggugc

SEQ ID NO: 121297 - RNA, 22 nt, Human
caggcugccgugaagcaggccu

SEQ ID NO: 121298 - RNA, 22 nt, Human
aaacaguaaguucuaguauuau

SEQ ID NO: 121299 - RNA, 22 nt, Human
uucucaaagaaagcugucauua

SEQ ID NO: 121300 - RNA, 22 nt, Human
ggggcagccuccaggaaagcug

SEQ ID NO: 121301 - RNA, 22 nt, Human
augaaaacggaccagagcuauu

SEQ ID NO: 121302 - RNA, 19 nt, Human
ucaggcaguuauucacaaa

SEQ ID NO: 121303 - RNA, 22 nt, Human
agcagggcagcuuuuuucagaa

SEQ ID NO: 121304 - RNA, 22 nt, Human
agggucagugaugagggagccc

SEQ ID NO: 121305 - RNA, 22 nt, Human
aaaugugaguuauagcaauaga

SEQ ID NO: 121306 - RNA, 20 nt, Human
cagcacagagcuuggcucua

SEQ ID NO: 121307 - RNA, 22 nt, Human
gcaggagcagucaggggcagcu

SEQ ID NO: 121308 - RNA, 22 nt, Human
uuucacaucagagguagauuag

SEQ ID NO: 121309 - RNA, 16 nt, Human
uggcagagguucagcc

SEQ ID NO: 121310 - RNA, 20 nt, Human
uuucugcagauguuuacaug

SEQ ID NO: 121311 - RNA, 22 nt, Human
agagggaaugugauugcaccau

SEQ ID NO: 121312 - RNA, 22 nt, Human
aggcagcauccagaggagaaug

SEQ ID NO: 121313 - RNA, 21 nt, Human
caauuacuaugaaccaguuga

SEQ ID NO: 121314 - RNA, 22 nt, Human
agcagccagaaagggcagucga

SEQ ID NO: 121315 - RNA, 22 nt, Human
aggggcagccucacaauccucu

SEQ ID NO: 121316 - RNA, 22 nt, Human
aaauggaagaagugcaauacug

SEQ ID NO: 121317 - RNA, 22 nt, Human
ccaggcuuucccagccucucca

SEQ ID NO: 121318 - RNA, 22 nt, Human
ugguuguauaaugucacuaagc

SEQ ID NO: 121319 - RNA, 22 nt, Human
agagaugcaucucuuaaaauug

SEQ ID NO: 121320 - RNA, 22 nt, Human
gcagugaagccagaucugaaau

SEQ ID NO: 121321 - RNA, 22 nt, Human
uacagugcacauuucuuaggaa

SEQ ID NO: 121322 - RNA, 23 nt, Human
ucccagggaaggugagcgaggcu

SEQ ID NO: 121323 - RNA, 22 nt, Human
gagggcugauaaaugcgcaugg

SEQ ID NO: 121324 - RNA, 22 nt, Human
uccuggcccuguggccugcagu

SEQ ID NO: 121325 - RNA, 22 nt, Human
uccuguggcguuaucaugugau

SEQ ID NO: 121326 - RNA, 21 nt, Human
ugcuaagugucacaugucugc

SEQ ID NO: 121327 - RNA, 22 nt, Human
cuucaguuuaucccaucaucca

SEQ ID NO: 121328 - RNA, 22 nt, Human
uuaaugcagaaaucaaacugac

SEQ ID NO: 121329 - RNA, 22 nt, Human
cauguacaguuuuucuguccug

SEQ ID NO: 121330 - RNA, 22 nt, Human
uuucacauaugguuguugauug

SEQ ID NO: 121331 - RNA, 22 nt, Human
uggcagagcccagaacugagca

SEQ ID NO: 121332 - RNA, 22 nt, Human
gcugugcagagcacaggguccc

SEQ ID NO: 121333 - RNA, 22 nt, Human
caugauuauauuaauggcuuca

SEQ ID NO: 121334 - RNA, 22 nt, Human
uacaggaagucucaguacagua

SEQ ID NO: 121335 - RNA, 22 nt, Human
ugggcagguuguuauuugacau

SEQ ID NO: 121336 - RNA, 22 nt, Human
ugagccagucugucugggugaa

SEQ ID NO: 121337 - RNA, 22 nt, Human
gccaccagggggcuccagugag

SEQ ID NO: 121338 - RNA, 22 nt, Human
ugaauuaaaggaauucgaauuc

SEQ ID NO: 121339 - RNA, 22 nt, Human
cauucugagcuaauaugcuuau

SEQ ID NO: 121340 - RNA, 22 nt, Human
agggcccucuggcaggccaggc

SEQ ID NO: 121341 - RNA, 22 nt, Human
uuugaaguccaucuggcccagu

SEQ ID NO: 121342 - RNA, 22 nt, Human
aauguuugccugacuagagugg

SEQ ID NO: 121343 - RNA, 22 nt, Human
agagugguacuucuuuuucuuc

SEQ ID NO: 121344 - RNA, 22 nt, Human
ugcagcugaaccuagagucugu

SEQ ID NO: 121345 - RNA, 21 nt, Human
gcugugcaggugccccugcuc

SEQ ID NO: 121346 - RNA, 22 nt, Human
cuuaaauuggaugaguuaaguu

SEQ ID NO: 121347 - RNA, 22 nt, Human
ggcugugcgggcagccguggga

SEQ ID NO: 121348 - RNA, 22 nt, Human
gggggacuggaccguccugggu

SEQ ID NO: 121349 - RNA, 22 nt, Human
gaaacauuuguugaguacuugc

SEQ ID NO: 121350 - RNA, 22 nt, Human
ucucccaggugggugccuggag

SEQ ID NO: 121351 - RNA, 18 nt, Human
cagcugugcccuguuugg

SEQ ID NO: 121352 - RNA, 22 nt, Human
ggaagaggcucucauugagggc

SEQ ID NO: 121353 - RNA, 22 nt, Human
uuucccaagaaaaauaauugga

SEQ ID NO: 121354 - RNA, 22 nt, Human
agauuuauguggucacacucag

SEQ ID NO: 121355 - RNA, 22 nt, Human
aaagaaaccuaucagccacaug

SEQ ID NO: 121356 - RNA, 22 nt, Human
aggcgcauugaggcccuguugc

SEQ ID NO: 121357 - RNA, 22 nt, Human
gaggcaguuugccaugccagga

SEQ ID NO: 121358 - RNA, 22 nt, Human
gccaguggcaugcggcagggac

SEQ ID NO: 121359 - RNA, 22 nt, Human
aacaugaugacauuguaagcuu

SEQ ID NO: 121360 - RNA, 22 nt, Human
cugaggcaugaaugugggcuuu

SEQ ID NO: 121361 - RNA, 22 nt, Human
gcagaggaggacccaggaauua

SEQ ID NO: 121362 - RNA, 19 nt, Human
uugaaauuguuugauaugg

SEQ ID NO: 121363 - RNA, 20 nt, Human
aggcugaguucuaugcacuu

SEQ ID NO: 121364 - RNA, 22 nt, Human
ggaaucuuugaaggauuuuaag

SEQ ID NO: 121365 - RNA, 22 nt, Human
aggucauuuuugccuucuauuu

SEQ ID NO: 121366 - RNA, 22 nt, Human
guuagagcacauacuuugcaug

SEQ ID NO: 121367 - RNA, 22 nt, Human
gccgugcgugcgcaggugcugu

SEQ ID NO: 121368 - RNA, 22 nt, Human
gcagaggauagcauaugaaccu

SEQ ID NO: 121369 - RNA, 22 nt, Human
accacccucagcagagcugaaa

SEQ ID NO: 121370 - RNA, 22 nt, Human
gaugauaacucuuuaugaugaa

SEQ ID NO: 121371 - RNA, 22 nt, Human
uaagccacuagucuguuaugaa

SEQ ID NO: 121372 - RNA, 22 nt, Human
ugauuaaaauuuaacuuaguua

SEQ ID NO: 121373 - RNA, 22 nt, Human
acucccagguugccuggcaggc

SEQ ID NO: 121374 - RNA, 22 nt, Human
guaaacaucagccacucuauuu

SEQ ID NO: 121375 - RNA, 22 nt, Human
ugccagagaagacccagucacu

SEQ ID NO: 121376 - RNA, 22 nt, Human
aagccaggcugcacuugcuggg

SEQ ID NO: 121377 - RNA, 22 nt, Human
ggcaggucagguccaugaccaa

SEQ ID NO: 121378 - RNA, 22 nt, Human
uauaugcaauuuuuuagugcaa

SEQ ID NO: 121379 - RNA, 22 nt, Human
agcugcagcguucauuuuucca

SEQ ID NO: 121380 - RNA, 22 nt, Human
ugaggcagccugcauuaaagag

SEQ ID NO: 121381 - RNA, 22 nt, Human
ucagaggagaugguuaccaggg

SEQ ID NO: 121382 - RNA, 19 nt, Human
ugcagggcugcgccugggg

SEQ ID NO: 121383 - RNA, 22 nt, Human
gaggaagaagcaaaccagcuaa

SEQ ID NO: 121384 - RNA, 22 nt, Human
cccaguggagauaggagugugg

SEQ ID NO: 121385 - RNA, 22 nt, Human
ucugugcacuaacauuccuggu

SEQ ID NO: 121386 - RNA, 22 nt, Human
uuugcaaugugaaauuaaagaa

SEQ ID NO: 121387 - RNA, 22 nt, Human
ugaggcaggagguugagaacug

SEQ ID NO: 121388 - RNA, 22 nt, Human
aaagggagcauggcugcaggga

SEQ ID NO: 121389 - RNA, 22 nt, Human
uagcugagaggccaauugaacu

SEQ ID NO: 121390 - RNA, 22 nt, Human
agccaccaccacugaaagguua

SEQ ID NO: 121391 - RNA, 22 nt, Human
ucuaaaugucaguacagaauga

SEQ ID NO: 121392 - RNA, 20 nt, Human
ugucaauagcacugaggcug

SEQ ID NO: 121393 - RNA, 22 nt, Human
aggacccugaggucuccuguga

SEQ ID NO: 121394 - RNA, 22 nt, Human
gccucccuguagaggccagccu

SEQ ID NO: 121395 - RNA, 22 nt, Human
agaagccagucgcucucccgca

SEQ ID NO: 121396 - RNA, 22 nt, Human
aucugaagggaaguggaaggca

SEQ ID NO: 121397 - RNA, 21 nt, Human
ugagaugcuagaaggcaggga

SEQ ID NO: 121398 - RNA, 22 nt, Human
gggcaugguggugcacaccugu

SEQ ID NO: 121399 - RNA, 22 nt, Human
ccaguggaauuaaaaauaagug

SEQ ID NO: 121400 - RNA, 22 nt, Human
gggcagauggggcacaggcuga

SEQ ID NO: 121401 - RNA, 20 nt, Human
ggaagccagcauccuugagg

SEQ ID NO: 121402 - RNA, 23 nt, Human
gcaguggaaugucucuguuugga

SEQ ID NO: 121403 - RNA, 22 nt, Human
gccagaagacuggagucagcug

SEQ ID NO: 121404 - RNA, 18 nt, Human
cgaggcaggcggaucacg

SEQ ID NO: 121405 - RNA, 19 nt, Human
aauucuguuucagcagauc

SEQ ID NO: 121406 - RNA, 22 nt, Human
cggcagagacggcgcuuugaac

SEQ ID NO: 121407 - RNA, 22 nt, Human
gagaaggacuacacaucuggcc

SEQ ID NO: 121408 - RNA, 21 nt, Human
acugugcagccugaggaugug

SEQ ID NO: 121409 - RNA, 22 nt, Human
aaugggaaagagacuagaugcu

SEQ ID NO: 121410 - RNA, 22 nt, Human
uucuugauguaccaacuuggga

SEQ ID NO: 121411 - RNA, 22 nt, Human
gcugcugugugggagacaggcg

SEQ ID NO: 121412 - RNA, 22 nt, Human
caggaaagggaugggcugccac

SEQ ID NO: 121413 - RNA, 22 nt, Human
ggagaugcuuuccaguggggau

SEQ ID NO: 121414 - RNA, 22 nt, Human
agcagggcugugcuccuuccga

SEQ ID NO: 121415 - RNA, 22 nt, Human
cagcugaagagaggugcugagu

SEQ ID NO: 121416 - RNA, 22 nt, Human
acagugaaugagaauggagaaa

SEQ ID NO: 121417 - RNA, 22 nt, Human
ucucaaacuaacaaugauuaua

SEQ ID NO: 121418 - RNA, 22 nt, Human
gaggcaggcagauugcuugagg

SEQ ID NO: 121419 - RNA, 22 nt, Human
caagcuggcugggagaggcacg

SEQ ID NO: 121420 - RNA, 22 nt, Human
cacacacaguuuuguauucugu

SEQ ID NO: 121421 - RNA, 22 nt, Human
gagaugcugucaggcuaucugu

SEQ ID NO: 121422 - RNA, 22 nt, Human
ucaggcuggaaugcaguggggc

SEQ ID NO: 121423 - RNA, 22 nt, Human
aggcagugugggccaagcuucc

SEQ ID NO: 121424 - RNA, 22 nt, Human
aauuacugucuguaaagggaau

SEQ ID NO: 121425 - RNA, 22 nt, Human
acuugguuggucucacccuguu

SEQ ID NO: 121426 - RNA, 22 nt, Human
gcucaguguuucugguagaaaa

SEQ ID NO: 121427 - RNA, 22 nt, Human
aggcaggagcaagcccuacaag

SEQ ID NO: 121428 - RNA, 22 nt, Human
gagcgggaggaacggcucgggc

SEQ ID NO: 121429 - RNA, 22 nt, Human
agcccucugcaaacaccugaua

SEQ ID NO: 121430 - RNA, 22 nt, Human
aaugaacacagcccucuacuuu

SEQ ID NO: 121431 - RNA, 22 nt, Human
uggaggucgcuagcgagcgggc

SEQ ID NO: 121432 - RNA, 22 nt, Human
cagcugccuaugaccuagccuc

SEQ ID NO: 121433 - RNA, 22 nt, Human
uggagguccugcaggauggcac

SEQ ID NO: 121434 - RNA, 22 nt, Human
caugaacauugcagggauguga

SEQ ID NO: 121435 - RNA, 23 nt, Human
ucucugaguuguacuuucccuug

SEQ ID NO: 121436 - RNA, 22 nt, Human
caagcugguaucagcuagagcg

SEQ ID NO: 121437 - RNA, 22 nt, Human
agaggcaggaagagcugauuuu

SEQ ID NO: 121438 - RNA, 22 nt, Human
gucuugaaauucuguuaaagga

SEQ ID NO: 121439 - RNA, 22 nt, Human
ugccaggcccugugcuggaugc

SEQ ID NO: 121440 - RNA, 22 nt, Human
gguguccucaugauuuucuaga

SEQ ID NO: 121441 - RNA, 18 nt, Human
uuaugcaaaacuguuuuc

SEQ ID NO: 121442 - RNA, 21 nt, Human
auggagucaggggaaugggcc

SEQ ID NO: 121443 - RNA, 22 nt, Human
gcagggcagcucacugugguuc

SEQ ID NO: 121444 - RNA, 22 nt, Human
aagguauuauugucuauguacu

SEQ ID NO: 121445 - RNA, 22 nt, Human
cucauaaaagcuuuguuuacac

SEQ ID NO: 121446 - RNA, 19 nt, Human
aggagaagacucucucccc

SEQ ID NO: 121447 - RNA, 20 nt, Human
auacacaugcagacagaugc

SEQ ID NO: 121448 - RNA, 22 nt, Human
aagggagacaguugugugagga

SEQ ID NO: 121449 - RNA, 22 nt, Human
gaaguggaagccaucggcaguc

SEQ ID NO: 121450 - RNA, 22 nt, Human
cugaguccagggacagaggcgu

SEQ ID NO: 121451 - RNA, 22 nt, Human
gggcuagaaauucugcagugga

SEQ ID NO: 121452 - RNA, 22 nt, Human
cugagcacugggcacauagcug

SEQ ID NO: 121453 - RNA, 22 nt, Human
ugaagaagccaauugguaggcu

SEQ ID NO: 121454 - RNA, 22 nt, Human
ccagggcagugggagaaggugc

SEQ ID NO: 121455 - RNA, 22 nt, Human
ggcuagaguggaacuggagcgg

SEQ ID NO: 121456 - RNA, 22 nt, Human
ccagggagccuggugugucagc

SEQ ID NO: 121457 - RNA, 22 nt, Human
guggaggacaaaagaagccuuu

SEQ ID NO: 121458 - RNA, 22 nt, Human
uccugaaaauaauuucacaaga

SEQ ID NO: 121459 - RNA, 22 nt, Human
ggcugugcuuugcccaaagggc

SEQ ID NO: 121460 - RNA, 22 nt, Human
acugugcauuugucaugggguu

SEQ ID NO: 121461 - RNA, 22 nt, Human
uacacacaugcauuugccuuau

SEQ ID NO: 121462 - RNA, 22 nt, Human
ugggaguccaaggcaggcggau

SEQ ID NO: 121463 - RNA, 22 nt, Human
cagcugugggccugacguggca

SEQ ID NO: 121464 - RNA, 22 nt, Human
uccagggagauggcagaggcug

SEQ ID NO: 121465 - RNA, 22 nt, Human
agauguaaacucucaugucauu

SEQ ID NO: 121466 - RNA, 22 nt, Human
gacaucauggagaggacaaaca

SEQ ID NO: 121467 - RNA, 22 nt, Human
ccaggugugauuuggcaguguc

SEQ ID NO: 121468 - RNA, 22 nt, Human
uuucacauuggcuucuauuucu

SEQ ID NO: 121469 - RNA, 22 nt, Human
ucugcucuccauacuuccgcac

SEQ ID NO: 121470 - RNA, 22 nt, Human
agcugaggcauggacaggcugc

SEQ ID NO: 121471 - RNA, 21 nt, Human
uacaacagguuuuauuucgau

SEQ ID NO: 121472 - RNA, 22 nt, Human
gcgucaauuccaucauucuucu

SEQ ID NO: 121473 - RNA, 22 nt, Human
ugcagggaaugcuugcagcaug

SEQ ID NO: 121474 - RNA, 22 nt, Human
aggaggaggcuggaguacaccc

SEQ ID NO: 121475 - RNA, 22 nt, Human
aacacaguccugcucacuuauu

SEQ ID NO: 121476 - RNA, 22 nt, Human
aggagugaguguccucagcaga

SEQ ID NO: 121477 - RNA, 22 nt, Human
ucagggcaucaucaugaauaua

SEQ ID NO: 121478 - RNA, 17 nt, Human
aggaagggcaaguuucu

SEQ ID NO: 121479 - RNA, 22 nt, Human
ucugcagaauucgaggaagaaa

SEQ ID NO: 121480 - RNA, 22 nt, Human
acaguacagugcagaggaagau

SEQ ID NO: 121481 - RNA, 22 nt, Human
aagaugcaugcugaagcuggcu

SEQ ID NO: 121482 - RNA, 22 nt, Human
gcagggcaguaagagcuagagu

SEQ ID NO: 121483 - RNA, 22 nt, Human
aggguagggcccggagacagac

SEQ ID NO: 121484 - RNA, 22 nt, Human
auuuaucaucagaccuuuuaaa

SEQ ID NO: 121485 - RNA, 22 nt, Human
uggcagagaaccugggcuuugu

SEQ ID NO: 121486 - RNA, 22 nt, Human
cuuguucaucucauugggacug

SEQ ID NO: 121487 - RNA, 18 nt, Human
cugcugugucgucugggc

SEQ ID NO: 121488 - RNA, 21 nt, Human
aggcagcaggauccagggaca

SEQ ID NO: 121489 - RNA, 22 nt, Human
agggaaggagguuagaacccac

SEQ ID NO: 121490 - RNA, 21 nt, Human
uuuaugcagauaaugcuauuu

SEQ ID NO: 121491 - RNA, 22 nt, Human
uccaggcuccccugcgugcucc

SEQ ID NO: 121492 - RNA, 22 nt, Human
caggacagaaauaaggaauaua

SEQ ID NO: 121493 - RNA, 23 nt, Human
acaugggagggacauggaggcug

SEQ ID NO: 121494 - RNA, 22 nt, Human
gguccuggaaguguaaguggca

SEQ ID NO: 121495 - RNA, 22 nt, Human
aguaacaugcuaauuugauuau

SEQ ID NO: 121496 - RNA, 22 nt, Human
auugagcagcuucucugccauc

SEQ ID NO: 121497 - RNA, 22 nt, Human
gugcaggagguaacauagcaaa

SEQ ID NO: 121498 - RNA, 22 nt, Human
cuguggcaggaagggacuagca

SEQ ID NO: 121499 - RNA, 22 nt, Human
uagcagcugcaucauuuuacag

SEQ ID NO: 121500 - RNA, 22 nt, Human
aaagcagcagcacguggaagag

SEQ ID NO: 121501 - RNA, 22 nt, Human
agagaugcugacguuuacauuu

SEQ ID NO: 121502 - RNA, 22 nt, Human
cauucugacccuaugauuuaag

SEQ ID NO: 121503 - RNA, 22 nt, Human
agcugugguucugggcagcgac

SEQ ID NO: 121504 - RNA, 20 nt, Human
gaagccagaggggaaaggag

SEQ ID NO: 121505 - RNA, 22 nt, Human
gcaggaagaggcucgaagcccc

SEQ ID NO: 121506 - RNA, 22 nt, Human
gagaggaguagacacuuugguu

SEQ ID NO: 121507 - RNA, 22 nt, Human
uaaacauggauucugaucacag

SEQ ID NO: 121508 - RNA, 22 nt, Human
uuucacacuagucagaauacca

SEQ ID NO: 121509 - RNA, 20 nt, Human
uggcaggaauagggccagag

SEQ ID NO: 121510 - RNA, 22 nt, Human
aaggugaaacuggaagcuggcc

SEQ ID NO: 121511 - RNA, 18 nt, Human
ugaggcagucagugaugg

SEQ ID NO: 121512 - RNA, 22 nt, Human
aguggagaauaugcagaaagcc

SEQ ID NO: 121513 - RNA, 23 nt, Human
cagcacaguacauuuccugucuc

SEQ ID NO: 121514 - RNA, 22 nt, Human
uuccuaaaagaauacacuggau

SEQ ID NO: 121515 - RNA, 22 nt, Human
caggggaagaugccaagggaga

SEQ ID NO: 121516 - RNA, 23 nt, Human
cagaagcaccuguugacugcugc

SEQ ID NO: 121517 - RNA, 23 nt, Human
ggagaugcuuaagagugguugag

SEQ ID NO: 121518 - RNA, 22 nt, Human
ucuguuuagacucaguugaaac

SEQ ID NO: 121519 - RNA, 22 nt, Human
cggcugaggaucuccaggccug

SEQ ID NO: 121520 - RNA, 17 nt, Human
uguuuucauucauugcu

SEQ ID NO: 121521 - RNA, 22 nt, Human
uacagugcaaugugauguagau

SEQ ID NO: 121522 - RNA, 22 nt, Human
ccagaagggcuauugcagugac

SEQ ID NO: 121523 - RNA, 22 nt, Human
acauuacagcaaguuuacguua

SEQ ID NO: 121524 - RNA, 22 nt, Human
aguggcagagcaggugcuggaa

SEQ ID NO: 121525 - RNA, 22 nt, Human
agugcagagagcaauacucuac

SEQ ID NO: 121526 - RNA, 22 nt, Human
gucaggcugccagucuuuauug

SEQ ID NO: 121527 - RNA, 22 nt, Human
uuucacaacguuguggugagag

SEQ ID NO: 121528 - RNA, 22 nt, Human
cagggcugaacugagcuuguga

SEQ ID NO: 121529 - RNA, 19 nt, Human
ucauaaacugggcacagug

SEQ ID NO: 121530 - RNA, 22 nt, Human
cucugucccagacccaccucuc

SEQ ID NO: 121531 - RNA, 22 nt, Human
ucugugcauuguaacaacuaaa

SEQ ID NO: 121532 - RNA, 22 nt, Human
cagaagaguagcugaacaaguu

SEQ ID NO: 121533 - RNA, 22 nt, Human
agaugcagauuuggauucagga

SEQ ID NO: 121534 - RNA, 22 nt, Human
ccugggggccaggaagguguga

SEQ ID NO: 121535 - RNA, 22 nt, Human
ccugggcagggagaccaggcuc

SEQ ID NO: 121536 - RNA, 22 nt, Human
agcagggcagguaaggaucaga

SEQ ID NO: 121537 - RNA, 22 nt, Human
aucuaaacuauaguaccuaguc

SEQ ID NO: 121538 - RNA, 22 nt, Human
cagcagcaacaacggaagccuu

SEQ ID NO: 121539 - RNA, 22 nt, Human
acccagggaccccgcugacgcc

SEQ ID NO: 121540 - RNA, 22 nt, Human
ggcacuaugaguuauaagugga

SEQ ID NO: 121541 - RNA, 23 nt, Human
ggcugugcagccugcggcaaaag

SEQ ID NO: 121542 - RNA, 22 nt, Human
aguggcagcugucaugcccuag

SEQ ID NO: 121543 - RNA, 22 nt, Human
cuggagugaggucugggagccu

SEQ ID NO: 121544 - RNA, 22 nt, Human
cgcugugccuggcacccagugu

SEQ ID NO: 121545 - RNA, 22 nt, Human
auuugauaguaugacagggcag

SEQ ID NO: 121546 - RNA, 22 nt, Human
cauguuauuuauccauuaaaca

SEQ ID NO: 121547 - RNA, 19 nt, Human
auuuccaagaauuggagag

SEQ ID NO: 121548 - RNA, 22 nt, Human
cagucacuggaauagcugagga

SEQ ID NO: 121549 - RNA, 22 nt, Human
acuguggcgucaggaagaaauu

SEQ ID NO: 121550 - RNA, 22 nt, Human
aaagccagcaaggugaguuuca

SEQ ID NO: 121551 - RNA, 22 nt, Human
gcaggcagagucaauuugaucc

SEQ ID NO: 121552 - RNA, 22 nt, Human
uggaaucuugcgggcacauggc

SEQ ID NO: 121553 - RNA, 22 nt, Human
uuuugaaagggugauuuggcuu

SEQ ID NO: 121554 - RNA, 22 nt, Human
agaagggccagcuggacaccug

SEQ ID NO: 121555 - RNA, 19 nt, Human
agcuaacucacuaacuaug

SEQ ID NO: 121556 - RNA, 19 nt, Human
cuccucagucccagagguc

SEQ ID NO: 121557 - RNA, 22 nt, Human
ucagggcacaggccuguggguu

SEQ ID NO: 121558 - RNA, 22 nt, Human
ccaguggccaugcacgagcagc

SEQ ID NO: 121559 - RNA, 22 nt, Human
aggaagugcuaagagaacauca

SEQ ID NO: 121560 - RNA, 22 nt, Human
agaugcugggaggcugagugca

SEQ ID NO: 121561 - RNA, 22 nt, Human
cagaagaggacuggguagcuca

SEQ ID NO: 121562 - RNA, 22 nt, Human
aaggcagauauaaagacuagag

SEQ ID NO: 121563 - RNA, 23 nt, Human
aagguauuuauuuuaaagguaag

SEQ ID NO: 121564 - RNA, 22 nt, Human
ggcugagccuggagcaucuggu

SEQ ID NO: 121565 - RNA, 22 nt, Human
ugcaguggaggccgugagacag

SEQ ID NO: 121566 - RNA, 22 nt, Human
uggggaggauaugugaguuauu

SEQ ID NO: 121567 - RNA, 22 nt, Human
ugcugugguucccagaguggau

SEQ ID NO: 121568 - RNA, 22 nt, Human
gggggcaguaaccucaaagugu

SEQ ID NO: 121569 - RNA, 22 nt, Human
caggcagcuagauuuauaacaa

SEQ ID NO: 121570 - RNA, 22 nt, Human
aggcagccuuuagacagucugc

SEQ ID NO: 121571 - RNA, 22 nt, Human
uuuaauguagcgugaaaugauu

SEQ ID NO: 121572 - RNA, 22 nt, Human
uuauaccugaagcaggugaugu

SEQ ID NO: 121573 - RNA, 22 nt, Human
gcagagcugggucuguauccaa

SEQ ID NO: 121574 - RNA, 22 nt, Human
caggcccauucuaggcuugcua

SEQ ID NO: 121575 - RNA, 22 nt, Human
agaagccaccagcugaggaaga

SEQ ID NO: 121576 - RNA, 22 nt, Human
cacggucacccaucagagucca

SEQ ID NO: 121577 - RNA, 22 nt, Human
agcagccagaaauccagaggug

SEQ ID NO: 121578 - RNA, 22 nt, Human
gcuggagaugcuaugcagaggg

SEQ ID NO: 121579 - RNA, 22 nt, Human
aauuacugucuccugcuggugu

SEQ ID NO: 121580 - RNA, 22 nt, Human
agcagccacccagcugcucauu

SEQ ID NO: 121581 - RNA, 22 nt, Human
ccugggcaacauagugagaccc

SEQ ID NO: 121582 - RNA, 22 nt, Human
caggugucaaaauacuaagugg

SEQ ID NO: 121583 - RNA, 22 nt, Human
uagucucugcuuugcccuuggc

SEQ ID NO: 121584 - RNA, 22 nt, Human
aaaagcaguuaucugggaggaa

SEQ ID NO: 121585 - RNA, 22 nt, Human
ccauggagcgggugagugagug

SEQ ID NO: 121586 - RNA, 22 nt, Human
cagugagggaagaucucagcac

SEQ ID NO: 121587 - RNA, 22 nt, Human
gaguccaguguuuaccaggggu

SEQ ID NO: 121588 - RNA, 22 nt, Human
augggcagagcuggugggaggc

SEQ ID NO: 121589 - RNA, 22 nt, Human
gcagaggagcaagcuggacacc

SEQ ID NO: 121590 - RNA, 22 nt, Human
cugaagaggacgcagcagcaag

SEQ ID NO: 121591 - RNA, 22 nt, Human
gggcagguggagggcccagcca

SEQ ID NO: 121592 - RNA, 22 nt, Human
ugccaggcaacugcccagccau

SEQ ID NO: 121593 - RNA, 23 nt, Human
ugugaagguggguccaagggcug

SEQ ID NO: 121594 - RNA, 22 nt, Human
uccaugggaagauuuugagugg

SEQ ID NO: 121595 - RNA, 22 nt, Human
acugugcauuucaugucuuuuc

SEQ ID NO: 121596 - RNA, 22 nt, Human
gcucccaggaagagaagggcca

SEQ ID NO: 121597 - RNA, 19 nt, Human
ccagaggacuguuaaugaa

SEQ ID NO: 121598 - RNA, 22 nt, Human
agcgcugugggcgugcgaggag

SEQ ID NO: 121599 - RNA, 22 nt, Human
uccuggugucgccuggucaguu

SEQ ID NO: 121600 - RNA, 22 nt, Human
uggcucaguagcagugugguca

SEQ ID NO: 121601 - RNA, 22 nt, Human
ugaggcaggacugagcgggaug

SEQ ID NO: 121602 - RNA, 22 nt, Human
uaggcuggaacuuaggcagagg

SEQ ID NO: 121603 - RNA, 22 nt, Human
aggagggcaggcuggcugccua

SEQ ID NO: 121604 - RNA, 22 nt, Human
ugcagagguuuccaggcaaguu

SEQ ID NO: 121605 - RNA, 22 nt, Human
cauguacaugccuacuaucaau

SEQ ID NO: 121606 - RNA, 22 nt, Human
acugugcaugaaccgaaacaaa

SEQ ID NO: 121607 - RNA, 21 nt, Human
uaagccaccaugugaaaccag

SEQ ID NO: 121608 - RNA, 22 nt, Human
agaggcaacauggggaacagau

SEQ ID NO: 121609 - RNA, 22 nt, Human
ccagaauagaaggcagcuguca

SEQ ID NO: 121610 - RNA, 22 nt, Human
gcccagugguaaaagcaggccu

SEQ ID NO: 121611 - RNA, 22 nt, Human
uaacauuucggugacaguggga

SEQ ID NO: 121612 - RNA, 20 nt, Human
uauaugcagccaacacuccc

SEQ ID NO: 121613 - RNA, 22 nt, Human
gaggcucacuaggcauccuggg

SEQ ID NO: 121614 - RNA, 22 nt, Human
gcucaaagaauauucagaauga

SEQ ID NO: 121615 - RNA, 22 nt, Human
ucugccuggaugauggcagggc

SEQ ID NO: 121616 - RNA, 22 nt, Human
cuguggcauugugaggacugca

SEQ ID NO: 121617 - RNA, 22 nt, Human
ggagaagccacacauugggugu

SEQ ID NO: 121618 - RNA, 22 nt, Human
cagggcaggaauuugacauugc

SEQ ID NO: 121619 - RNA, 22 nt, Human
ggccaggagauggacaccacau

SEQ ID NO: 121620 - RNA, 22 nt, Human
cugaggcaguuuaauuuuugaa

SEQ ID NO: 121621 - RNA, 22 nt, Human
auggcagauggcuggagcaggu

SEQ ID NO: 121622 - RNA, 22 nt, Human
gggccguagaccacguccgggc

SEQ ID NO: 121623 - RNA, 22 nt, Human
ucacuccucauugcugcccauu

SEQ ID NO: 121624 - RNA, 22 nt, Human
ugagcauggugggugcagagca

SEQ ID NO: 121625 - RNA, 22 nt, Human
auguacauuuguaguaauauca

SEQ ID NO: 121626 - RNA, 22 nt, Human
uggcacagacagaucaggaguc

SEQ ID NO: 121627 - RNA, 19 nt, Human
ccugugcacauguguccuu

SEQ ID NO: 121628 - RNA, 22 nt, Human
gguguagcucugugucccacug

SEQ ID NO: 121629 - RNA, 22 nt, Human
gcuccucucccagagcugcagg

SEQ ID NO: 121630 - RNA, 22 nt, Human
gaggcucacgacgggacgaacu

SEQ ID NO: 121631 - RNA, 22 nt, Human
accagggcaaauguuuguacuc

SEQ ID NO: 121632 - RNA, 22 nt, Human
auuuggcaacauuaauugaauc

SEQ ID NO: 121633 - RNA, 22 nt, Human
agaguccaugaagacagcugag

SEQ ID NO: 121634 - RNA, 22 nt, Human
aaggcagaaagggaugugagug

SEQ ID NO: 121635 - RNA, 22 nt, Human
ccuggagccccucuggccagcc

SEQ ID NO: 121636 - RNA, 20 nt, Human
agccaggcucaagcuccccc

SEQ ID NO: 121637 - RNA, 22 nt, Human
ucauucaucugguguuaguccu

SEQ ID NO: 121638 - RNA, 22 nt, Human
auuuccaagaaagcuuuaggau

SEQ ID NO: 121639 - RNA, 22 nt, Human
ggaagccaugagggacaguucu

SEQ ID NO: 121640 - RNA, 22 nt, Human
uuuguacauguaagauugcauc

SEQ ID NO: 121641 - RNA, 22 nt, Human
agcaggaacucagggaguucuc

SEQ ID NO: 121642 - RNA, 22 nt, Human
gccugugguuugauuaagcauu

SEQ ID NO: 121643 - RNA, 22 nt, Human
uggaggaaaaaaccaggcagag

SEQ ID NO: 121644 - RNA, 22 nt, Human
aagggcugagcacagugagcca

SEQ ID NO: 121645 - RNA, 22 nt, Human
agaguuauauugguugagaauu

SEQ ID NO: 121646 - RNA, 22 nt, Human
agcucaguggcucaguggguau

SEQ ID NO: 121647 - RNA, 22 nt, Human
cugcuguguuucacaccucugg

SEQ ID NO: 121648 - RNA, 22 nt, Human
gaggcucaacccacagggguug

SEQ ID NO: 121649 - RNA, 22 nt, Human
uguuugcucugacuaucuugcg

SEQ ID NO: 121650 - RNA, 22 nt, Human
uagcugaaggcuacagcagaac

SEQ ID NO: 121651 - RNA, 22 nt, Human
acugucuuguguuaaagaacca

SEQ ID NO: 121652 - RNA, 22 nt, Human
uuaaaaugcagauucugauuca

SEQ ID NO: 121653 - RNA, 22 nt, Human
ugaggcucaagaaucugcauuu

SEQ ID NO: 121654 - RNA, 22 nt, Human
uggcugaggcuggagugcagug

SEQ ID NO: 121655 - RNA, 22 nt, Human
cauuguuaccaucuuuuaccua

SEQ ID NO: 121656 - RNA, 22 nt, Human
agcccagguugaggcugcagug

SEQ ID NO: 121657 - RNA, 22 nt, Human
ugucauggcacuagaguggggu

SEQ ID NO: 121658 - RNA, 20 nt, Human
augcaaaucccaaaaucagg

SEQ ID NO: 121659 - RNA, 22 nt, Human
uggagagcaagucgcagacaug

SEQ ID NO: 121660 - RNA, 21 nt, Human
agacagagugcagucuacaua

SEQ ID NO: 121661 - RNA, 22 nt, Human
ucagaggaugcuguucuuuaau

SEQ ID NO: 121662 - RNA, 22 nt, Human
auucaaacuguguuaggcagca

SEQ ID NO: 121663 - RNA, 22 nt, Human
agggccugcucuaucacucuca

SEQ ID NO: 121664 - RNA, 22 nt, Human
aaagaagguagggcuggugacu

SEQ ID NO: 121665 - RNA, 22 nt, Human
augaggcaugugaggagaaggg

SEQ ID NO: 121666 - RNA, 22 nt, Human
augcaguguuuggaagcuuaag

SEQ ID NO: 121667 - RNA, 23 nt, Human
caaaccuguucuccccacaugca

SEQ ID NO: 121668 - RNA, 22 nt, Human
ugccaaggagcuggaucagggc

SEQ ID NO: 121669 - RNA, 22 nt, Human
aggugucugggcuuuggaguca

SEQ ID NO: 121670 - RNA, 22 nt, Human
ugcuggagaggaaggugggguc

SEQ ID NO: 121671 - RNA, 22 nt, Human
gcaggcugggguagccccacuu

SEQ ID NO: 121672 - RNA, 22 nt, Human
gaggaggaaguucucuguaggc

SEQ ID NO: 121673 - RNA, 22 nt, Human
auucugauaucuuauucuagcu

SEQ ID NO: 121674 - RNA, 22 nt, Human
uacaguaggauuuucagggucu

SEQ ID NO: 121675 - RNA, 22 nt, Human
caugcauauaugcuacaugcaa

SEQ ID NO: 121676 - RNA, 22 nt, Human
aggcucagugcaaaucauucug

SEQ ID NO: 121677 - RNA, 22 nt, Human
aacaggcaaacugugggauccc

SEQ ID NO: 121678 - RNA, 22 nt, Human
uagggcagagcuuguacacgau

SEQ ID NO: 121679 - RNA, 20 nt, Human
accaggagauggaggcaggg

SEQ ID NO: 121680 - RNA, 23 nt, Human
cagguauugauuuuucuucuagg

SEQ ID NO: 121681 - RNA, 22 nt, Human
ucagggcaagucucagaagguu

SEQ ID NO: 121682 - RNA, 22 nt, Human
ucaguggauugacaugaaaaag

SEQ ID NO: 121683 - RNA, 22 nt, Human
ugcacacacucugcauauacuu

SEQ ID NO: 121684 - RNA, 22 nt, Human
agaugcuggauggaaaaugauc

SEQ ID NO: 121685 - RNA, 22 nt, Human
ucacuacaaccgcuaccugaca

SEQ ID NO: 121686 - RNA, 22 nt, Human
auuauucaacacuugagaaauu

SEQ ID NO: 121687 - RNA, 22 nt, Human
aggggcaguuccaaguuuugug

SEQ ID NO: 121688 - RNA, 18 nt, Human
gggaagccgggaagccgg

SEQ ID NO: 121689 - RNA, 22 nt, Human
ugaggcagugugagauaauaaa

SEQ ID NO: 121690 - RNA, 22 nt, Human
uggcugagaaaaaagagcuaua

SEQ ID NO: 121691 - RNA, 22 nt, Human
ccagggcauguaacuaauggug

SEQ ID NO: 121692 - RNA, 22 nt, Human
uaacaugaaacuccaaauggua

SEQ ID NO: 121693 - RNA, 22 nt, Human
gccagggcucgcggucccucgu

SEQ ID NO: 121694 - RNA, 22 nt, Human
uggaaauagcuccaguuaagca

SEQ ID NO: 121695 - RNA, 22 nt, Human
augcacaugaggcaagcaaaau

SEQ ID NO: 121696 - RNA, 22 nt, Human
gaggcuggcagaaaagcacagg

SEQ ID NO: 121697 - RNA, 22 nt, Human
gaguucaguguuucuaguagug

SEQ ID NO: 121698 - RNA, 22 nt, Human
agaaggcacucacacuggcacg

SEQ ID NO: 121699 - RNA, 23 nt, Human
aggaaagcauucauuuuuaccau

SEQ ID NO: 121700 - RNA, 22 nt, Human
agcugucucugguauuauguga

SEQ ID NO: 121701 - RNA, 22 nt, Human
ucagggcaccaaaaaagaugcc

SEQ ID NO: 121702 - RNA, 21 nt, Human
agaugcugaugcugcaggucc

SEQ ID NO: 121703 - RNA, 22 nt, Human
agaagccagaggcaguggguac

SEQ ID NO: 121704 - RNA, 22 nt, Human
ucauuuucaaguuugaacagga

SEQ ID NO: 121705 - RNA, 22 nt, Human
auucuguuacuuggugaucuuc

SEQ ID NO: 121706 - RNA, 22 nt, Human
aggaggggcauagaaauguaau

SEQ ID NO: 121707 - RNA, 22 nt, Human
cagggccaggcugauggccugg

SEQ ID NO: 121708 - RNA, 22 nt, Human
agggcugacagugaggagucaa

SEQ ID NO: 121709 - RNA, 22 nt, Human
ggacagaggguugacagaguau

SEQ ID NO: 121710 - RNA, 22 nt, Human
uguuaaaccuaguacagguccu

SEQ ID NO: 121711 - RNA, 19 nt, Human
gggcaguggcacuagggag

SEQ ID NO: 121712 - RNA, 22 nt, Human
gcugagacuggcagcaggaagu

SEQ ID NO: 121713 - RNA, 22 nt, Human
agggagguccaucccugcagag

SEQ ID NO: 121714 - RNA, 22 nt, Human
ugaagaaaggugugggauacuc

SEQ ID NO: 121715 - RNA, 22 nt, Human
gaggcucagagagguccacaua

SEQ ID NO: 121716 - RNA, 22 nt, Human
caugauaauuguuaacaaagua

SEQ ID NO: 121717 - RNA, 22 nt, Human
uguucccaagauaagauuauga

SEQ ID NO: 121718 - RNA, 22 nt, Human
ucauuuguugaacuuuagugcg

SEQ ID NO: 121719 - RNA, 22 nt, Human
ugagaagcaguuucaguaagaa

SEQ ID NO: 121720 - RNA, 22 nt, Human
guggaaaugcccccaaauagug

SEQ ID NO: 121721 - RNA, 22 nt, Human
aguggcaguggcugggcagagc

SEQ ID NO: 121722 - RNA, 22 nt, Human
auuccaaagcacaucagaacua

SEQ ID NO: 121723 - RNA, 22 nt, Human
ucucugagcccagugucccccu

SEQ ID NO: 121724 - RNA, 21 nt, Human
ccagcugucuguccuuaggca

SEQ ID NO: 121725 - RNA, 21 nt, Human
uggcugagccaggugugugga

SEQ ID NO: 121726 - RNA, 22 nt, Human
cugagcagcaacccagagccuc

SEQ ID NO: 121727 - RNA, 22 nt, Human
ugugaagguaaggaggggcaag

SEQ ID NO: 121728 - RNA, 23 nt, Human
aggcagcagguuguccaggguga

SEQ ID NO: 121729 - RNA, 22 nt, Human
ugaggaagaacaagaauuuaga

SEQ ID NO: 121730 - RNA, 22 nt, Human
agccaggcggggcagguuuccu

SEQ ID NO: 121731 - RNA, 21 nt, Human
uuagaagcuaaugcagcuggu

SEQ ID NO: 121732 - RNA, 22 nt, Human
ucugggagagcacguggcugac

SEQ ID NO: 121733 - RNA, 22 nt, Human
ccaaaggccaagcucagguaaa

SEQ ID NO: 121734 - RNA, 22 nt, Human
gccagguggagguugcagugag

SEQ ID NO: 121735 - RNA, 19 nt, Human
aaggcagaaguuggauaug

SEQ ID NO: 121736 - RNA, 22 nt, Human
cccuuccuugugacuggugggg

SEQ ID NO: 121737 - RNA, 22 nt, Human
caauuugauuaauaccauacuu

SEQ ID NO: 121738 - RNA, 22 nt, Human
aaacauuguuaugauaaauuac

SEQ ID NO: 121739 - RNA, 22 nt, Human
uaugcacacauguaugcaugug

SEQ ID NO: 121740 - RNA, 22 nt, Human
uuuguaaaggccugaauuucag

SEQ ID NO: 121741 - RNA, 22 nt, Human
gggggcaguaaggauauggaaa

SEQ ID NO: 121742 - RNA, 22 nt, Human
augauuacauguguuaauauac

SEQ ID NO: 121743 - RNA, 22 nt, Human
uggggagguaacaauuucaggc

SEQ ID NO: 121744 - RNA, 22 nt, Human
agaaauacuaggaauauucaua

SEQ ID NO: 121745 - RNA, 22 nt, Human
ugggcugagcacugaggaagga

SEQ ID NO: 121746 - RNA, 19 nt, Human
aacaucauggcucuuucca

SEQ ID NO: 121747 - RNA, 22 nt, Human
augcuguguuuuaaauggaaau

SEQ ID NO: 121748 - RNA, 22 nt, Human
ggucugagcuugagcccaugcu

SEQ ID NO: 121749 - RNA, 22 nt, Human
uggccaccccuuucucugcacu

SEQ ID NO: 121750 - RNA, 22 nt, Human
agggcgaggagacggaggcaca

SEQ ID NO: 121751 - RNA, 22 nt, Human
aauaacaggcucaucagaugcu

SEQ ID NO: 121752 - RNA, 22 nt, Human
aggcugaggagggauguugcuu

SEQ ID NO: 121753 - RNA, 22 nt, Human
gaaggcacugaacuccuucugg

SEQ ID NO: 121754 - RNA, 22 nt, Human
uggcaggagguuuucuccagga

SEQ ID NO: 121755 - RNA, 23 nt, Human
aggaaggagguccuaacaguauc

SEQ ID NO: 121756 - RNA, 22 nt, Human
augcacaucacucugaagaaaa

SEQ ID NO: 121757 - RNA, 22 nt, Human
gugauacagguguucuggauau

SEQ ID NO: 121758 - RNA, 22 nt, Human
gaaggcugaguggguacggagg

SEQ ID NO: 121759 - RNA, 22 nt, Human
aauuaggaauaaaugaguacuu

SEQ ID NO: 121760 - RNA, 22 nt, Human
ccagggcacuuaggcccagccc

SEQ ID NO: 121761 - RNA, 22 nt, Human
guccucuuagccacuuaauuau

SEQ ID NO: 121762 - RNA, 22 nt, Human
agaaccucaauuauuuuugcac

SEQ ID NO: 121763 - RNA, 22 nt, Human
uuucuacaguacugauuucaua

SEQ ID NO: 121764 - RNA, 22 nt, Human
ugcaggagacauaauagggacu

SEQ ID NO: 121765 - RNA, 22 nt, Human
ggaggaguguggggcacucugc

SEQ ID NO: 121766 - RNA, 22 nt, Human
gcggcaggaagagcgcagcccc

SEQ ID NO: 121767 - RNA, 22 nt, Human
caagaaggcuauaugggccagg

SEQ ID NO: 121768 - RNA, 22 nt, Human
gugcugaguagaaugaaugccu

SEQ ID NO: 121769 - RNA, 22 nt, Human
acacauaugguugcugcaguga

SEQ ID NO: 121770 - RNA, 22 nt, Human
ccuggaguuuuuugguugacuc

SEQ ID NO: 121771 - RNA, 22 nt, Human
gaguucaguaguuauagucuag

SEQ ID NO: 121772 - RNA, 19 nt, Human
agacagagacugaaauaga

SEQ ID NO: 121773 - RNA, 22 nt, Human
aauuugaaacauagucaccacu

SEQ ID NO: 121774 - RNA, 22 nt, Human
uuugagcagcagaugcacuuag

SEQ ID NO: 121775 - RNA, 21 nt, Human
accaggcuugugggagggagc

SEQ ID NO: 121776 - RNA, 22 nt, Human
aaugccucuuggaagaagacuu

SEQ ID NO: 121777 - RNA, 22 nt, Human
gcacacacuguuuuccucacau

SEQ ID NO: 121778 - RNA, 22 nt, Human
aagaggcagcccgcugaggcug

SEQ ID NO: 121779 - RNA, 22 nt, Human
cacccacauggaaauucacagu

SEQ ID NO: 121780 - RNA, 22 nt, Human
uaucaguagauaaacggauugc

SEQ ID NO: 121781 - RNA, 22 nt, Human
gcagugaacauaacacagaagg

SEQ ID NO: 121782 - RNA, 22 nt, Human
gcugaugcaggguugagaggag

SEQ ID NO: 121783 - RNA, 22 nt, Human
aagggcagaaagggacgcuuug

SEQ ID NO: 121784 - RNA, 21 nt, Human
ccagagagagggaaguggguu

SEQ ID NO: 121785 - RNA, 22 nt, Human
gggcagaggcucuggcccaucc

SEQ ID NO: 121786 - RNA, 22 nt, Human
aguaaacauguaauuguucauu

SEQ ID NO: 121787 - RNA, 22 nt, Human
acaggauuucaccauguuggcc

SEQ ID NO: 121788 - RNA, 22 nt, Human
ucccaggcuggcaggcagcagu

SEQ ID NO: 121789 - RNA, 23 nt, Human
acugauuaacaugugugauauuc

SEQ ID NO: 121790 - RNA, 22 nt, Human
cacagugcuuuaugagagaucu

SEQ ID NO: 121791 - RNA, 22 nt, Human
cucagggcuggaaagccaggaa

SEQ ID NO: 121792 - RNA, 22 nt, Human
ggugaccucaccuggucccacc

SEQ ID NO: 121793 - RNA, 22 nt, Human
acauugauauuucaaauacagg

SEQ ID NO: 121794 - RNA, 22 nt, Human
cggcugugucuucacaggagcc

SEQ ID NO: 121795 - RNA, 22 nt, Human
augcagaagcagaacuuacaca

SEQ ID NO: 121796 - RNA, 22 nt, Human
ucauacaggcucaagcuauacg

SEQ ID NO: 121797 - RNA, 22 nt, Human
ggagaugcuacaguucagcucu

SEQ ID NO: 121798 - RNA, 22 nt, Human
uguucagaacaaagguaaauga

SEQ ID NO: 121799 - RNA, 22 nt, Human
agacauuuccuagacaucaaug

SEQ ID NO: 121800 - RNA, 22 nt, Human
cagaggguugaugugaggcuua

SEQ ID NO: 121801 - RNA, 20 nt, Human
agugggagagggcagacugc

SEQ ID NO: 121802 - RNA, 19 nt, Human
aggcagcaggccagggaug

SEQ ID NO: 121803 - RNA, 22 nt, Human
ucagggcauggcugcacuuggc

SEQ ID NO: 121804 - RNA, 22 nt, Human
agagaagggccuguauguaauc

SEQ ID NO: 121805 - RNA, 22 nt, Human
acaaaggcagccaaucaucugc

SEQ ID NO: 121806 - RNA, 22 nt, Human
guuuauauucaacggaguaucu

SEQ ID NO: 121807 - RNA, 22 nt, Human
ugcagggcaguuuguuucggca

SEQ ID NO: 121808 - RNA, 22 nt, Human
gcagggcaaauguggaaaggag

SEQ ID NO: 121809 - RNA, 22 nt, Human
cauccauagauugagagauggu

SEQ ID NO: 121810 - RNA, 19 nt, Human
uaguggagugacaaguucu

SEQ ID NO: 121811 - RNA, 22 nt, Human
auggagugggccaauuuuagug

SEQ ID NO: 121812 - RNA, 22 nt, Human
ggcgcucaguguugccccagag

SEQ ID NO: 121813 - RNA, 22 nt, Human
acuguggcucaucaggcuggug

SEQ ID NO: 121814 - RNA, 22 nt, Human
ucaguggaguauggaugaaguc

SEQ ID NO: 121815 - RNA, 22 nt, Human
uggcagagucaucacaucugga

SEQ ID NO: 121816 - RNA, 22 nt, Human
uuauaacuuuggauaugacaag

SEQ ID NO: 121817 - RNA, 22 nt, Human
auuaugcauauacauuugacua

SEQ ID NO: 121818 - RNA, 22 nt, Human
aggcucagauccuuguguccug

SEQ ID NO: 121819 - RNA, 22 nt, Human
aguucuagaagacuuuuccauu

SEQ ID NO: 121820 - RNA, 18 nt, Human
gcuuugcagaaauacaga

SEQ ID NO: 121821 - RNA, 19 nt, Human
uggagguccaggaguaggg

SEQ ID NO: 121822 - RNA, 20 nt, Human
ugcuauauugaagugcaguu

SEQ ID NO: 121823 - RNA, 22 nt, Human
gagggagccgccacagacuggg

SEQ ID NO: 121824 - RNA, 22 nt, Human
aucauaaaauugcaccauuucu

SEQ ID NO: 121825 - RNA, 22 nt, Human
gcaaaggccacuggggcgaugg

SEQ ID NO: 121826 - RNA, 22 nt, Human
uggcucagagagggagugugga

SEQ ID NO: 121827 - RNA, 19 nt, Human
ucaaaggcaaggaggaacu

SEQ ID NO: 121828 - RNA, 23 nt, Human
cagugugacgaggugaggcaggc

SEQ ID NO: 121829 - RNA, 22 nt, Human
aguggcagagccaagauaugau

SEQ ID NO: 121830 - RNA, 22 nt, Human
gugccagggaguggaggagcuu

SEQ ID NO: 121831 - RNA, 22 nt, Human
uccugccugagcguggaggagg

SEQ ID NO: 121832 - RNA, 22 nt, Human
uagggcugcugcagaugacagg

SEQ ID NO: 121833 - RNA, 22 nt, Human
cagugaggaagcugucuggacc

SEQ ID NO: 121834 - RNA, 22 nt, Human
agcagggcagugcuucagcucu

SEQ ID NO: 121835 - RNA, 22 nt, Human
aguaggaggcgggagcaugaag

SEQ ID NO: 121836 - RNA, 23 nt, Human
uugaaagguagcuggcagcuaga

SEQ ID NO: 121837 - RNA, 22 nt, Human
ugucagagcaaugagguucagc

SEQ ID NO: 121838 - RNA, 22 nt, Human
uguacauagaucuugaaaauua

SEQ ID NO: 121839 - RNA, 22 nt, Human
augcuguguuugagaaccuagg

SEQ ID NO: 121840 - RNA, 22 nt, Human
aacuagaacgagaaagcugaac

SEQ ID NO: 121841 - RNA, 22 nt, Human
agcugcagagguuugugcaaca

SEQ ID NO: 121842 - RNA, 22 nt, Human
gccuguuggguaacagaguuca

SEQ ID NO: 121843 - RNA, 22 nt, Human
augggcagaguggggacaggaa

SEQ ID NO: 121844 - RNA, 21 nt, Human
cacuauuuauauaugccagcu

SEQ ID NO: 121845 - RNA, 19 nt, Human
cugugcaggccgggcugag

SEQ ID NO: 121846 - RNA, 22 nt, Human
cugagaauuacucugaugagua

SEQ ID NO: 121847 - RNA, 22 nt, Human
accugccucuaagcagcaggug

SEQ ID NO: 121848 - RNA, 20 nt, Human
cugcugugauucccuccucc

SEQ ID NO: 121849 - RNA, 22 nt, Human
aaagggaggggcgauaagccgg

SEQ ID NO: 121850 - RNA, 22 nt, Human
ugcagaugagggaugaaaauga

SEQ ID NO: 121851 - RNA, 22 nt, Human
ugggcaggaugcguugauucuu

SEQ ID NO: 121852 - RNA, 22 nt, Human
uggaggcaacugaagauguagu

SEQ ID NO: 121853 - RNA, 22 nt, Human
uuacuacugcuuuacuacuggg

SEQ ID NO: 121854 - RNA, 22 nt, Human
agggcagcuagcuguagaaaga

SEQ ID NO: 121855 - RNA, 22 nt, Human
cgaggcagaggcugaaacggcu

SEQ ID NO: 121856 - RNA, 22 nt, Human
aggcugagucgggaggaucacu

SEQ ID NO: 121857 - RNA, 22 nt, Human
ugcagggcacacgcacgggugu

SEQ ID NO: 121858 - RNA, 22 nt, Human
guggcagggugcucaucaugca

SEQ ID NO: 121859 - RNA, 22 nt, Human
guggcagguuauaagcaucuca

SEQ ID NO: 121860 - RNA, 22 nt, Human
uccaggcucucaggugucagca

SEQ ID NO: 121861 - RNA, 22 nt, Human
uggcagagagagugcagucgac

SEQ ID NO: 121862 - RNA, 22 nt, Human
gggcugagccauuugaaccuug

SEQ ID NO: 121863 - RNA, 22 nt, Human
gacaucauaucaggaggcaugu

SEQ ID NO: 121864 - RNA, 22 nt, Human
ugcacuccaggcugggugacag

SEQ ID NO: 121865 - RNA, 22 nt, Human
ucugugcagacauggggaagcc

SEQ ID NO: 121866 - RNA, 22 nt, Human
cauuuguacagaacagcuuuau

SEQ ID NO: 121867 - RNA, 22 nt, Human
acugugcaaugaguaauaaacu

SEQ ID NO: 121868 - RNA, 22 nt, Human
cagaccuggggccugggagccc

SEQ ID NO: 121869 - RNA, 22 nt, Human
gagagugagauccuccugggga

SEQ ID NO: 121870 - RNA, 22 nt, Human
ggcgcaggccuuggauccuggu

SEQ ID NO: 121871 - RNA, 22 nt, Human
ugaggcaggaaguuauauaaug

SEQ ID NO: 121872 - RNA, 18 nt, Human
ccucacagacuuccaugu

SEQ ID NO: 121873 - RNA, 22 nt, Human
agagccccugguggagugagaa

SEQ ID NO: 121874 - RNA, 22 nt, Human
uggcagaguucgcugugccuuu

SEQ ID NO: 121875 - RNA, 22 nt, Human
uccauggggcccaggaugagag

SEQ ID NO: 121876 - RNA, 22 nt, Human
agaagccacuggagguugagau

SEQ ID NO: 121877 - RNA, 22 nt, Human
aagggcagccugacucacgguc

SEQ ID NO: 121878 - RNA, 22 nt, Human
uuaacauuucuuuuccacucau

SEQ ID NO: 121879 - RNA, 22 nt, Human
agggcagacuaggauggaagug

SEQ ID NO: 121880 - RNA, 22 nt, Human
ugcagcaagaccggauaugucg

SEQ ID NO: 121881 - RNA, 22 nt, Human
ggcagcaaauauugucagcugu

SEQ ID NO: 121882 - RNA, 22 nt, Human
uuguuuaauccuuguacccaug

SEQ ID NO: 121883 - RNA, 22 nt, Human
ucauaaacacacuaguaugauu

SEQ ID NO: 121884 - RNA, 22 nt, Human
uucuuuuacauuaagauuucag

SEQ ID NO: 121885 - RNA, 22 nt, Human
acccuggacuggggcugaggcu

SEQ ID NO: 121886 - RNA, 22 nt, Human
uuuuagugccugauuaaugggu

SEQ ID NO: 121887 - RNA, 22 nt, Human
aguggagaagaggauggucucc

SEQ ID NO: 121888 - RNA, 21 nt, Human
ugacauuuccaauauaaagcc

SEQ ID NO: 121889 - RNA, 19 nt, Human
ugagaugccuuccagcccu

SEQ ID NO: 121890 - RNA, 22 nt, Human
ucaggcugaaucauccuagcuu

SEQ ID NO: 121891 - RNA, 22 nt, Human
gggcugaaaggccgccucagau

SEQ ID NO: 121892 - RNA, 22 nt, Human
acagcuguggccacuugcaucc

SEQ ID NO: 121893 - RNA, 21 nt, Human
ccagccucagaucagggagcu

SEQ ID NO: 121894 - RNA, 22 nt, Human
aggagugagcuuuggggucaga

SEQ ID NO: 121895 - RNA, 22 nt, Human
uucauucagguguauuuauggg

SEQ ID NO: 121896 - RNA, 22 nt, Human
ggcaggguggcagaggcucaga

SEQ ID NO: 121897 - RNA, 22 nt, Human
acaauucuggguauuuauauag

SEQ ID NO: 121898 - RNA, 21 nt, Human
aaacuagaguguggcaaagcu

SEQ ID NO: 121899 - RNA, 22 nt, Human
agggcugagacuaaggccagau

SEQ ID NO: 121900 - RNA, 22 nt, Human
caggguagacaguaggugucug

SEQ ID NO: 121901 - RNA, 22 nt, Human
agacauuuauguuucucuagga

SEQ ID NO: 121902 - RNA, 22 nt, Human
uuggauccaucucaggcauagg

SEQ ID NO: 121903 - RNA, 22 nt, Human
agggcugacaaauggcagugac

SEQ ID NO: 121904 - RNA, 22 nt, Human
augcagaaggagccaugcuugc

SEQ ID NO: 121905 - RNA, 22 nt, Human
ggcaggagcucuccaguuugcc

SEQ ID NO: 121906 - RNA, 22 nt, Human
aacauucugguucuaaaaaccu

SEQ ID NO: 121907 - RNA, 22 nt, Human
gccugagaaggauaggaagcga

SEQ ID NO: 121908 - RNA, 22 nt, Human
uauaugcaugcccauguauaca

SEQ ID NO: 121909 - RNA, 22 nt, Human
ggcaguggugggaggcucgcuc

SEQ ID NO: 121910 - RNA, 22 nt, Human
cccaggaccgcgcggcugagcg

SEQ ID NO: 121911 - RNA, 22 nt, Human
aaagggcugucaaauaagcaac

SEQ ID NO: 121912 - RNA, 22 nt, Human
ugcugugcuggcggcagaggcc

SEQ ID NO: 121913 - RNA, 22 nt, Human
cagaggcaggauaagaacugcg

SEQ ID NO: 121914 - RNA, 22 nt, Human
agggcugccugacuccagagcc

SEQ ID NO: 121915 - RNA, 23 nt, Human
acacauuuuucccguucugaggu

SEQ ID NO: 121916 - RNA, 22 nt, Human
aaagugccuucuauuuuaguga

SEQ ID NO: 121917 - RNA, 22 nt, Human
ugaaauaauaucuggaucaauc

SEQ ID NO: 121918 - RNA, 22 nt, Human
cacagccuugagcgaggacaag

SEQ ID NO: 121919 - RNA, 22 nt, Human
cauuuuauccucugggaagcua

SEQ ID NO: 121920 - RNA, 22 nt, Human
auggaaauguuccauauauuga

SEQ ID NO: 121921 - RNA, 22 nt, Human
aauguacaaaagucagccaacu

SEQ ID NO: 121922 - RNA, 22 nt, Human
uucaucuguagcaucuuccaau

SEQ ID NO: 121923 - RNA, 22 nt, Human
ccagggcauguccaagacuuag

SEQ ID NO: 121924 - RNA, 21 nt, Human
auaaacagcaugugauccaug

SEQ ID NO: 121925 - RNA, 22 nt, Human
aaggcugcuuuuaacaugcaua

SEQ ID NO: 121926 - RNA, 22 nt, Human
ccugcagggaaucgaggcagaa

SEQ ID NO: 121927 - RNA, 22 nt, Human
aggcuucagaugaccuuagcau

SEQ ID NO: 121928 - RNA, 22 nt, Human
gggacaggcugagacuugagcu

SEQ ID NO: 121929 - RNA, 22 nt, Human
acagggcauuuccucuaugugu

SEQ ID NO: 121930 - RNA, 22 nt, Human
ggcugagcguggcugccguggg

SEQ ID NO: 121931 - RNA, 22 nt, Human
guggggcaguggccugggagca

SEQ ID NO: 121932 - RNA, 22 nt, Human
gauuuaaaguagaccuuuguuu

SEQ ID NO: 121933 - RNA, 21 nt, Human
uuucuccaagugacugauucc

SEQ ID NO: 121934 - RNA, 22 nt, Human
cucccaggguagggagagacua

SEQ ID NO: 121935 - RNA, 22 nt, Human
ugccaggcgauugcuaucagca

SEQ ID NO: 121936 - RNA, 21 nt, Human
uuucacaaaaguaugugacaa

SEQ ID NO: 121937 - RNA, 22 nt, Human
ugaggcagauauuuauuggguu

SEQ ID NO: 121938 - RNA, 20 nt, Human
gaaauucucguauuaguuua

SEQ ID NO: 121939 - RNA, 17 nt, Human
ugcaaacaaucacauau

SEQ ID NO: 121940 - RNA, 22 nt, Human
uuaugcaacaggugagcagaca

SEQ ID NO: 121941 - RNA, 22 nt, Human
agcaugaaagcauaggacaguc

SEQ ID NO: 121942 - RNA, 22 nt, Human
gaagagcuccaaaaacagugag

SEQ ID NO: 121943 - RNA, 22 nt, Human
uagaggcagaagaaauugacaa

SEQ ID NO: 121944 - RNA, 22 nt, Human
aggacugacuuuugccaugaaa

SEQ ID NO: 121945 - RNA, 19 nt, Human
augcaaauagauuuggaau

SEQ ID NO: 121946 - RNA, 22 nt, Human
uuuguucaauccagacaauagc

SEQ ID NO: 121947 - RNA, 22 nt, Human
acaguggaugugauguccaggu

SEQ ID NO: 121948 - RNA, 22 nt, Human
gaagcccagcaaacugugauca

SEQ ID NO: 121949 - RNA, 22 nt, Human
agagauauauauuuguuuacca

SEQ ID NO: 121950 - RNA, 22 nt, Human
auagugcauuuuauuaucagca

SEQ ID NO: 121951 - RNA, 21 nt, Human
agaguaauuccugcuggaaag

SEQ ID NO: 121952 - RNA, 22 nt, Human
cagcagcagagauacugguuuc

SEQ ID NO: 121953 - RNA, 23 nt, Human
aggugcagcccuggaccugcccc

SEQ ID NO: 121954 - RNA, 22 nt, Human
ugcagggccuucuagaccaugg

SEQ ID NO: 121955 - RNA, 22 nt, Human
ugccaggccucaggagucucca

SEQ ID NO: 121956 - RNA, 22 nt, Human
acaggcagagaacucagccaga

SEQ ID NO: 121957 - RNA, 22 nt, Human
auauacguauauuccaaagggu

SEQ ID NO: 121958 - RNA, 22 nt, Human
ucagggcaggcgagcagcugcu

SEQ ID NO: 121959 - RNA, 22 nt, Human
ucagaggacuaccuucuccagu

SEQ ID NO: 121960 - RNA, 22 nt, Human
aaggccaggagacuuggaguca

SEQ ID NO: 121961 - RNA, 22 nt, Human
agggcugcuuugcuaaauaugg

SEQ ID NO: 121962 - RNA, 22 nt, Human
gaagaaggugccagaggcuuac

SEQ ID NO: 121963 - RNA, 22 nt, Human
uaaacagagugcuaguucacgg

SEQ ID NO: 121964 - RNA, 22 nt, Human
augcuacaggaagacgucaggc

SEQ ID NO: 121965 - RNA, 22 nt, Human
accugcaggcacaggugugcgc

SEQ ID NO: 121966 - RNA, 22 nt, Human
ccaaaggcggaacugagucucu

SEQ ID NO: 121967 - RNA, 22 nt, Human
acagcagcgugaaguguguuau

SEQ ID NO: 121968 - RNA, 22 nt, Human
ucuguuuaugugucuaaauaaa

SEQ ID NO: 121969 - RNA, 18 nt, Human
auguacauuugcuaaagc

SEQ ID NO: 121970 - RNA, 22 nt, Human
agugggaccggugcuauuccag

SEQ ID NO: 121971 - RNA, 22 nt, Human
aaacaucauaggcaugcaugau

SEQ ID NO: 121972 - RNA, 22 nt, Human
agaagccaaucagcucucugcu

SEQ ID NO: 121973 - RNA, 22 nt, Human
agccaggcuacuccuugcugac

SEQ ID NO: 121974 - RNA, 22 nt, Human
uuucuucauagaccuugucuug

SEQ ID NO: 121975 - RNA, 22 nt, Human
uaggcuggaggaagcagugccu

SEQ ID NO: 121976 - RNA, 22 nt, Human
cagggcagagggaaacuccuuu

SEQ ID NO: 121977 - RNA, 22 nt, Human
ugaagggcaaccccaggcccag

SEQ ID NO: 121978 - RNA, 22 nt, Human
ccugaagggacuccagagagca

SEQ ID NO: 121979 - RNA, 22 nt, Human
cccucccaagcacucugacaua

SEQ ID NO: 121980 - RNA, 20 nt, Human
aggccaggaaauguaguucu

SEQ ID NO: 121981 - RNA, 22 nt, Human
guacaugagcauaaacacacau

SEQ ID NO: 121982 - RNA, 22 nt, Human
uugagcaaaggaguaaaaugca

SEQ ID NO: 121983 - RNA, 22 nt, Human
uggauaaauagauacacuugca

SEQ ID NO: 121984 - RNA, 22 nt, Human
acuuugcagggcuugauaucca

SEQ ID NO: 121985 - RNA, 22 nt, Human
auacaaagcuaaauaugguuuc

SEQ ID NO: 121986 - RNA, 22 nt, Human
gcuggcagccaagugaagaggg

SEQ ID NO: 121987 - RNA, 20 nt, Human
cagaggcauuuucagacucu

SEQ ID NO: 121988 - RNA, 22 nt, Human
uguuuuaguucugucuugcaug

SEQ ID NO: 121989 - RNA, 22 nt, Human
aaauacuguugaaugaaguaag

SEQ ID NO: 121990 - RNA, 22 nt, Human
aaagcacauaguagaaggauuu

SEQ ID NO: 121991 - RNA, 22 nt, Human
aguugaagguuggcugauccau

SEQ ID NO: 121992 - RNA, 23 nt, Human
acucagagaccccgggaagugac

SEQ ID NO: 121993 - RNA, 22 nt, Human
guuuuccauggaggucugaccu

SEQ ID NO: 121994 - RNA, 22 nt, Human
cugaggcucccucgggucugcu

SEQ ID NO: 121995 - RNA, 22 nt, Human
ccaggugucaugcgugugaccc

SEQ ID NO: 121996 - RNA, 22 nt, Human
uacuuuuagccuauuugauucu

SEQ ID NO: 121997 - RNA, 22 nt, Human
uggcucaguuucaguccugguu

SEQ ID NO: 121998 - RNA, 22 nt, Human
acacauuuucaacacugucaag

SEQ ID NO: 121999 - RNA, 22 nt, Human
ucugucauuucauucauaugaa

SEQ ID NO: 122000 - RNA, 22 nt, Human
agccaggcgcaguggcuuaugc

SEQ ID NO: 122001 - RNA, 22 nt, Human
ggcccagaauacuuuguaaaau

SEQ ID NO: 122002 - RNA, 22 nt, Human
ucaggcugcuguacugugaaug

SEQ ID NO: 122003 - RNA, 22 nt, Human
ucucccaguccucugugcuuac

SEQ ID NO: 122004 - RNA, 22 nt, Human
uggaggaaguggacaguugugu

SEQ ID NO: 122005 - RNA, 22 nt, Human
ccucccuggccagagcagcagc

SEQ ID NO: 122006 - RNA, 22 nt, Human
aggcugagugcuccccuagaug

SEQ ID NO: 122007 - RNA, 22 nt, Human
caccuagggcaucccugcccca

SEQ ID NO: 122008 - RNA, 22 nt, Human
agggcagccugagugcuggccc

SEQ ID NO: 122009 - RNA, 22 nt, Human
uuuauaugugaagguuugcaga

SEQ ID NO: 122010 - RNA, 22 nt, Human
uuugggcaauucagugggaccu

SEQ ID NO: 122011 - RNA, 22 nt, Human
caguggagagacuuuuacucuu

SEQ ID NO: 122012 - RNA, 22 nt, Human
aucaggaaugaauacuuuugga

SEQ ID NO: 122013 - RNA, 22 nt, Human
augcaccugaacuccaucagcu

SEQ ID NO: 122014 - RNA, 22 nt, Human
caugcagugacucagacacagg

SEQ ID NO: 122015 - RNA, 19 nt, Human
ugaauacagagauacagaa

SEQ ID NO: 122016 - RNA, 22 nt, Human
uccagcuugacaaaugauuuua

SEQ ID NO: 122017 - RNA, 22 nt, Human
uuaaugcuugucuagaucuucu

SEQ ID NO: 122018 - RNA, 22 nt, Human
cuaggcuagauaguauauuggu

SEQ ID NO: 122019 - RNA, 22 nt, Human
uggcugaggcuuuucuuaaaga

SEQ ID NO: 122020 - RNA, 22 nt, Human
gggugaagcuccugcaggggcc

SEQ ID NO: 122021 - RNA, 22 nt, Human
ucagggcaucucuuaaguggug

SEQ ID NO: 122022 - RNA, 22 nt, Human
gcaggaguguauuugcauguaa

SEQ ID NO: 122023 - RNA, 22 nt, Human
gccugagaaggacacagcaggu

SEQ ID NO: 122024 - RNA, 22 nt, Human
uggaggcaguuuaagucugaga

SEQ ID NO: 122025 - RNA, 22 nt, Human
gaacauuugaugaugacauugg

SEQ ID NO: 122026 - RNA, 22 nt, Human
uucauucagcacauauuuauug

SEQ ID NO: 122027 - RNA, 22 nt, Human
cagaggaaggcucugggaaugu

SEQ ID NO: 122028 - RNA, 22 nt, Human
uuuaucuuuaggacuuugcaga

SEQ ID NO: 122029 - RNA, 22 nt, Human
acccaggggcagccuugcugug

SEQ ID NO: 122030 - RNA, 22 nt, Human
caaaugcauagaaagaugaaac

SEQ ID NO: 122031 - RNA, 22 nt, Human
uaucaacauuaauauuuucugg

SEQ ID NO: 122032 - RNA, 22 nt, Human
aagggcugggucugguuaaccc

SEQ ID NO: 122033 - RNA, 22 nt, Human
gaagccagcaguggagaaagga

SEQ ID NO: 122034 - RNA, 22 nt, Human
cagggcuggauuucauuucuag

SEQ ID NO: 122035 - RNA, 22 nt, Human
auucugauaugaacacacauau

SEQ ID NO: 122036 - RNA, 22 nt, Human
caacaguguugcaaucugaaaa

SEQ ID NO: 122037 - RNA, 21 nt, Human
aucagaaguuuuggucaguag

SEQ ID NO: 122038 - RNA, 22 nt, Human
agagaugcauucagcauggaug

SEQ ID NO: 122039 - RNA, 22 nt, Human
uccaggcaagggaggagcaugg

SEQ ID NO: 122040 - RNA, 22 nt, Human
ugaggcucugcuucuguggcuc

SEQ ID NO: 122041 - RNA, 22 nt, Human
gacccuguuucuacaaauaauu

SEQ ID NO: 122042 - RNA, 22 nt, Human
cagcuguggagggaggaaaugc

SEQ ID NO: 122043 - RNA, 22 nt, Human
gccucccuggcccacagcagcg

SEQ ID NO: 122044 - RNA, 20 nt, Human
cuucuucagccuaugcuuca

SEQ ID NO: 122045 - RNA, 22 nt, Human
augaugaaaugauagguuuguu

SEQ ID NO: 122046 - RNA, 18 nt, Human
uauauuucacacauauuc

SEQ ID NO: 122047 - RNA, 22 nt, Human
aauuuuaucucuaagcaggcuu

SEQ ID NO: 122048 - RNA, 22 nt, Human
ggaaucuuuuucauaagccuca

SEQ ID NO: 122049 - RNA, 22 nt, Human
agggcagagagaugaaugggau

SEQ ID NO: 122050 - RNA, 22 nt, Human
agugaagaggaaguggggcaca

SEQ ID NO: 122051 - RNA, 22 nt, Human
agaggucucaguuauguuuaaa

SEQ ID NO: 122052 - RNA, 22 nt, Human
uuauuugcccauguuuagcaga

SEQ ID NO: 122053 - RNA, 22 nt, Human
cagcccuggcuagggcgagggc

SEQ ID NO: 122054 - RNA, 22 nt, Human
agagaugcgguuccaugguuau

SEQ ID NO: 122055 - RNA, 23 nt, Human
ugcugugccuuugucugccucca

SEQ ID NO: 122056 - RNA, 22 nt, Human
aggcccaguagugcugccuuua

SEQ ID NO: 122057 - RNA, 22 nt, Human
agcagggcagugaucagaaagg

SEQ ID NO: 122058 - RNA, 22 nt, Human
aguauggggcugugugugcaca

SEQ ID NO: 122059 - RNA, 22 nt, Human
caucaugaagaugagaaagcau

SEQ ID NO: 122060 - RNA, 22 nt, Human
uaagcauuaacucugcugcaag

SEQ ID NO: 122061 - RNA, 22 nt, Human
uggagcuggaauuugagcugga

SEQ ID NO: 122062 - RNA, 22 nt, Human
agaagaaaugugaaggccacug

SEQ ID NO: 122063 - RNA, 22 nt, Human
caggaagauuagaccaagagcu

SEQ ID NO: 122064 - RNA, 22 nt, Human
gaggcucagagacuuuaaguuu

SEQ ID NO: 122065 - RNA, 22 nt, Human
augcaagcaaucugagcuuugg

SEQ ID NO: 122066 - RNA, 22 nt, Human
cagagcuggguuugggaaaccu

SEQ ID NO: 122067 - RNA, 18 nt, Human
cugugcagcaaacugagc

SEQ ID NO: 122068 - RNA, 22 nt, Human
gggccggagcugggucccgcgc

SEQ ID NO: 122069 - RNA, 22 nt, Human
aguuagagcgcauauuuuauua

SEQ ID NO: 122070 - RNA, 22 nt, Human
uaugucaugucuuagagaauga

SEQ ID NO: 122071 - RNA, 22 nt, Human
ugcagggcuacaggacuacaac

SEQ ID NO: 122072 - RNA, 22 nt, Human
uggcugagagucauccugugug

SEQ ID NO: 122073 - RNA, 22 nt, Human
gcugugcacuaccuauacaucc

SEQ ID NO: 122074 - RNA, 22 nt, Human
caugccaguuuugagaugcacc

SEQ ID NO: 122075 - RNA, 22 nt, Human
ucaucauaauauggaaucuugu

SEQ ID NO: 122076 - RNA, 22 nt, Human
aagggcaggugggcauuucugg

SEQ ID NO: 122077 - RNA, 22 nt, Human
gcaccuggacagugacccuagc

SEQ ID NO: 122078 - RNA, 22 nt, Human
gagcagcugagcuggaaugaga

SEQ ID NO: 122079 - RNA, 22 nt, Human
cacuagaugauaaucagcugga

SEQ ID NO: 122080 - RNA, 22 nt, Human
acagugcagggcgggaagaagg

SEQ ID NO: 122081 - RNA, 22 nt, Human
ccagcugcagguguuccagaug

SEQ ID NO: 122082 - RNA, 22 nt, Human
cacaucauucaauggugauauu

SEQ ID NO: 122083 - RNA, 22 nt, Human
agggcccuuacgcaggcccuuc

SEQ ID NO: 122084 - RNA, 22 nt, Human
aggugucugugaugggagcgau

SEQ ID NO: 122085 - RNA, 21 nt, Human
ugacauaauccauaguacaaa

SEQ ID NO: 122086 - RNA, 22 nt, Human
cacagugcuguuuguaaagaga

SEQ ID NO: 122087 - RNA, 22 nt, Human
auuuaaauuuucugauggagag

SEQ ID NO: 122088 - RNA, 22 nt, Human
cacaugcaucugucauguuugg

SEQ ID NO: 122089 - RNA, 22 nt, Human
ugccaggcuaaguggaggacuu

SEQ ID NO: 122090 - RNA, 22 nt, Human
agcaaguggaaucauggaaaag

SEQ ID NO: 122091 - RNA, 22 nt, Human
gcaggagagucugugccagguu

SEQ ID NO: 122092 - RNA, 22 nt, Human
gaagaaggugcuacacagggca

SEQ ID NO: 122093 - RNA, 22 nt, Human
ggccagagucuauaugcagaca

SEQ ID NO: 122094 - RNA, 22 nt, Human
gagggccaacuagcaccacuuu

SEQ ID NO: 122095 - RNA, 22 nt, Human
cuaaacaugcaagagcuucugg

SEQ ID NO: 122096 - RNA, 22 nt, Human
ugaggcaggagaaucaccggaa

SEQ ID NO: 122097 - RNA, 22 nt, Human
gagcuggaagucuguggucaga

SEQ ID NO: 122098 - RNA, 22 nt, Human
aaggggaaguagcaccagaggu

SEQ ID NO: 122099 - RNA, 22 nt, Human
auuuaaaugcuuaagaggguuu

SEQ ID NO: 122100 - RNA, 23 nt, Human
ccucccaggcugcgagucccgag

SEQ ID NO: 122101 - RNA, 19 nt, Human
ugcagaggguaggaaggcc

SEQ ID NO: 122102 - RNA, 22 nt, Human
aagacauuggacaauccagagg

SEQ ID NO: 122103 - RNA, 23 nt, Human
cagggcugguagggaagagcgug

SEQ ID NO: 122104 - RNA, 19 nt, Human
auuucaagagguuuauugg

SEQ ID NO: 122105 - RNA, 22 nt, Human
ugugagcagagccugacaugag

SEQ ID NO: 122106 - RNA, 22 nt, Human
aauaacaggguugauuugcaau

SEQ ID NO: 122107 - RNA, 22 nt, Human
uggccuggaaaaaugcagaugg

SEQ ID NO: 122108 - RNA, 22 nt, Human
ucugugcaagaccaacuuucaa

SEQ ID NO: 122109 - RNA, 22 nt, Human
ucacauuuguguuuuauuagag

SEQ ID NO: 122110 - RNA, 20 nt, Human
ucacaggagggaaggcaggu

SEQ ID NO: 122111 - RNA, 22 nt, Human
acagggcaaccucugggagacu

SEQ ID NO: 122112 - RNA, 21 nt, Human
uggcucaguugcugggcacag

SEQ ID NO: 122113 - RNA, 22 nt, Human
ugggacuugccucgagggcugc

SEQ ID NO: 122114 - RNA, 22 nt, Human
guacaguagagccagguucagu

SEQ ID NO: 122115 - RNA, 22 nt, Human
caacagugauucugcaugagga

SEQ ID NO: 122116 - RNA, 22 nt, Human
accuucaaacuagauagaaguu

SEQ ID NO: 122117 - RNA, 22 nt, Human
aaaacauugaauugcacacuau

SEQ ID NO: 122118 - RNA, 22 nt, Human
gaggcugaauggccagaagcca

SEQ ID NO: 122119 - RNA, 22 nt, Human
agaagccaauccuugucucucu

SEQ ID NO: 122120 - RNA, 22 nt, Human
augcacaucuuacagaugcaga

SEQ ID NO: 122121 - RNA, 22 nt, Human
cagggcaguaccgcccucuggc

SEQ ID NO: 122122 - RNA, 22 nt, Human
auguacaucuuuauaacaagcu

SEQ ID NO: 122123 - RNA, 22 nt, Human
gggcaguuuauucuagaugguu

SEQ ID NO: 122124 - RNA, 17 nt, Human
gcacagugauauuauuu

SEQ ID NO: 122125 - RNA, 22 nt, Human
ucagaacagaagaaggaacacg

SEQ ID NO: 122126 - RNA, 22 nt, Human
uggucagacaaaggagaauguu

SEQ ID NO: 122127 - RNA, 22 nt, Human
aggcugggaaauguauuccagc

SEQ ID NO: 122128 - RNA, 22 nt, Human
gcaggcagucaucuuucauauu

SEQ ID NO: 122129 - RNA, 22 nt, Human
uucagcacaagacuagacaggu

SEQ ID NO: 122130 - RNA, 22 nt, Human
uugaauaauuaauuacacucag

SEQ ID NO: 122131 - RNA, 22 nt, Human
gcaaauaaaugcucacugcugu

SEQ ID NO: 122132 - RNA, 22 nt, Human
augaggcaguacacacaaagcc

SEQ ID NO: 122133 - RNA, 22 nt, Human
ucuaugaaccucugcaaugaca

SEQ ID NO: 122134 - RNA, 22 nt, Human
ggcagcaacucggagagaagag

SEQ ID NO: 122135 - RNA, 22 nt, Human
cuguuuaaugagguguaacaac

SEQ ID NO: 122136 - RNA, 22 nt, Human
acacaaacagucuauagcacca

SEQ ID NO: 122137 - RNA, 22 nt, Human
augaggcaggagugcaguggca

SEQ ID NO: 122138 - RNA, 19 nt, Human
aguuuauuauaggugauuc

SEQ ID NO: 122139 - RNA, 22 nt, Human
aggcucagggacggggccccuu

SEQ ID NO: 122140 - RNA, 22 nt, Human
uccagcuuugagauuuuaugga

SEQ ID NO: 122141 - RNA, 22 nt, Human
uuucugcagguauugcauaagu

SEQ ID NO: 122142 - RNA, 22 nt, Human
ucacauuuuaucuauuuuaagu

SEQ ID NO: 122143 - RNA, 22 nt, Human
ucauuuguaccauuuuuuaaga

SEQ ID NO: 122144 - RNA, 21 nt, Human
ugggggucuucacgguguugu

SEQ ID NO: 122145 - RNA, 21 nt, Human
uuucccagcugaaaauaaaug

SEQ ID NO: 122146 - RNA, 22 nt, Human
auaacuucaucaaauaggcaca

SEQ ID NO: 122147 - RNA, 22 nt, Human
aagucagcacuccaggaagcca

SEQ ID NO: 122148 - RNA, 22 nt, Human
aagggcaggcacccacccucac

SEQ ID NO: 122149 - RNA, 21 nt, Human
ugcagauaauugaaagcugac

SEQ ID NO: 122150 - RNA, 22 nt, Human
aggaggaauacaauccagcagc

SEQ ID NO: 122151 - RNA, 22 nt, Human
ugaggcucagugagcccugcag

SEQ ID NO: 122152 - RNA, 22 nt, Human
cugugggagcagcaccaaggac

SEQ ID NO: 122153 - RNA, 22 nt, Human
gaggagcacaugaggcugaggg

SEQ ID NO: 122154 - RNA, 22 nt, Human
cugaggcugggcauggggucca

SEQ ID NO: 122155 - RNA, 22 nt, Human
gcuguggccgucagggaaaugg

SEQ ID NO: 122156 - RNA, 22 nt, Human
gaugcaggauagcuucacccag

SEQ ID NO: 122157 - RNA, 22 nt, Human
ucuaguucuagaucccugagga

SEQ ID NO: 122158 - RNA, 22 nt, Human
accaggaggccuggagcacaaa

SEQ ID NO: 122159 - RNA, 22 nt, Human
uuuucaagggcagggaaaucau

SEQ ID NO: 122160 - RNA, 22 nt, Human
caggcagcugcgacaagagagc

SEQ ID NO: 122161 - RNA, 19 nt, Human
gaucagagugucagcuugu

SEQ ID NO: 122162 - RNA, 22 nt, Human
ucaggcugaaggaggccuaucu

SEQ ID NO: 122163 - RNA, 22 nt, Human
auuccaaaggcuggccuggagg

SEQ ID NO: 122164 - RNA, 17 nt, Human
uggcaagaauggaaaug

SEQ ID NO: 122165 - RNA, 22 nt, Human
uggagccaaugaacauuugcug

SEQ ID NO: 122166 - RNA, 22 nt, Human
uguuagagcuaagauaacaucu

SEQ ID NO: 122167 - RNA, 22 nt, Human
gcugugcagucuuuggugugcc

SEQ ID NO: 122168 - RNA, 22 nt, Human
gauguaaaaacuccuuucgaaa

SEQ ID NO: 122169 - RNA, 22 nt, Human
cacaggaaugaacagggaaaga

SEQ ID NO: 122170 - RNA, 22 nt, Human
agggaggaccaaugugugguua

SEQ ID NO: 122171 - RNA, 22 nt, Human
aagcagaauuuaauagaaaggu

SEQ ID NO: 122172 - RNA, 21 nt, Human
aucucacagcccagagaagcc

SEQ ID NO: 122173 - RNA, 22 nt, Human
aaacauguaaguucagaucacc

SEQ ID NO: 122174 - RNA, 22 nt, Human
augcugagaaacagacguguug

SEQ ID NO: 122175 - RNA, 22 nt, Human
gcaggcagagguggaggagaca

SEQ ID NO: 122176 - RNA, 22 nt, Human
aguaugcaaaugucauaagcau

SEQ ID NO: 122177 - RNA, 22 nt, Human
gggcaguugauggaggucugga

SEQ ID NO: 122178 - RNA, 22 nt, Human
uuaaugauuuggaacccuuuaa

SEQ ID NO: 122179 - RNA, 22 nt, Human
acauuuagcuguacaaucuaug

SEQ ID NO: 122180 - RNA, 22 nt, Human
cagcugggagcuccauuagaua

SEQ ID NO: 122181 - RNA, 22 nt, Human
ucacauuuauuucaaaguuacu

SEQ ID NO: 122182 - RNA, 22 nt, Human
uauuacuguuacuucacacugu

SEQ ID NO: 122183 - RNA, 20 nt, Human
uguggcaggaugagggcgga

SEQ ID NO: 122184 - RNA, 20 nt, Human
ggaagccagggugcagggga

SEQ ID NO: 122185 - RNA, 22 nt, Human
agccagggacgcugcaggcuac

SEQ ID NO: 122186 - RNA, 22 nt, Human
cauuuucaugaguuucuguuca

SEQ ID NO: 122187 - RNA, 22 nt, Human
ugcugaaggcaggggagguggc

SEQ ID NO: 122188 - RNA, 22 nt, Human
aggcccaguccucugccgucug

SEQ ID NO: 122189 - RNA, 22 nt, Human
gcucccagcauugcugcugaau

SEQ ID NO: 122190 - RNA, 22 nt, Human
aggaagcccaagucucaucuuc

SEQ ID NO: 122191 - RNA, 22 nt, Human
gggcagguuauuggaguaggga

SEQ ID NO: 122192 - RNA, 22 nt, Human
cagugaaguucuacugaauggu

SEQ ID NO: 122193 - RNA, 22 nt, Human
gccaccagggggugcaaggucc

SEQ ID NO: 122194 - RNA, 19 nt, Human
ugggcagcucccucugucc

SEQ ID NO: 122195 - RNA, 22 nt, Human
gcagggcagaaggugcugagga

SEQ ID NO: 122196 - RNA, 22 nt, Human
agggucaguucugugagguguu

SEQ ID NO: 122197 - RNA, 22 nt, Human
acugugcauuugaagggaucau

SEQ ID NO: 122198 - RNA, 22 nt, Human
ugucacaguuuguacuuuauag

SEQ ID NO: 122199 - RNA, 22 nt, Human
agucaccaacaugguucccagg

SEQ ID NO: 122200 - RNA, 20 nt, Human
uuugucaacugcauccagca

SEQ ID NO: 122201 - RNA, 22 nt, Human
agcugagcuaguaguuccagug

SEQ ID NO: 122202 - RNA, 19 nt, Human
auacacauacguaaacuga

SEQ ID NO: 122203 - RNA, 22 nt, Human
auucucaaaacauaacuucacu

SEQ ID NO: 122204 - RNA, 22 nt, Human
ugaugauugggagacauuuggg

SEQ ID NO: 122205 - RNA, 22 nt, Human
aagcugaaacauuagccuaaac

SEQ ID NO: 122206 - RNA, 22 nt, Human
gcagugaaaaagugcacccugu

SEQ ID NO: 122207 - RNA, 22 nt, Human
aggcaguuguagagagggcucu

SEQ ID NO: 122208 - RNA, 22 nt, Human
uccaucaccauuucugcgagcu

SEQ ID NO: 122209 - RNA, 22 nt, Human
uuguccuuggaugaagcuggga

SEQ ID NO: 122210 - RNA, 22 nt, Human
gggcagagguucaacuucaaca

SEQ ID NO: 122211 - RNA, 22 nt, Human
uuacaaguauuuaagaugcugu

SEQ ID NO: 122212 - RNA, 22 nt, Human
aggcaguuuauccccagagccu

SEQ ID NO: 122213 - RNA, 22 nt, Human
uaaaaugguaacuuucauuugc

SEQ ID NO: 122214 - RNA, 22 nt, Human
augcaagacauaaauaaucuuu

SEQ ID NO: 122215 - RNA, 22 nt, Human
aaagccagagcaagcugucaca

SEQ ID NO: 122216 - RNA, 22 nt, Human
ugaguccacuuuaaaaugucag

SEQ ID NO: 122217 - RNA, 22 nt, Human
ccaggugugccagcagggacug

SEQ ID NO: 122218 - RNA, 22 nt, Human
uguuuauaccugcaaccuguca

SEQ ID NO: 122219 - RNA, 22 nt, Human
acuaugaauagccagauaguga

SEQ ID NO: 122220 - RNA, 22 nt, Human
gacaacaggcagacgucagaaa

SEQ ID NO: 122221 - RNA, 22 nt, Human
augggcaguuaggaggccagga

SEQ ID NO: 122222 - RNA, 22 nt, Human
uuauaugaacuggacuuuagga

SEQ ID NO: 122223 - RNA, 22 nt, Human
ucuaauccuugcuaccugggug

SEQ ID NO: 122224 - RNA, 22 nt, Human
cugagccagcgggcucacuuuu

SEQ ID NO: 122225 - RNA, 22 nt, Human
gauuuucauuauagcuaguuuc

SEQ ID NO: 122226 - RNA, 22 nt, Human
ugagcacauuucacaugacagg

SEQ ID NO: 122227 - RNA, 22 nt, Human
cuguuuaaccagaucucauauc

SEQ ID NO: 122228 - RNA, 22 nt, Human
uggcugagagcaauugacucug

SEQ ID NO: 122229 - RNA, 22 nt, Human
caccagggcucugagcucugaa

SEQ ID NO: 122230 - RNA, 22 nt, Human
cugaggcuuggaggggucuggu

SEQ ID NO: 122231 - RNA, 22 nt, Human
cuggagugaagucuggcagcuu

SEQ ID NO: 122232 - RNA, 22 nt, Human
uuuaucugugguaaauaacauu

SEQ ID NO: 122233 - RNA, 22 nt, Human
ugccaggcaggacccuagaacc

SEQ ID NO: 122234 - RNA, 19 nt, Human
cagugcccgacgcaggucu

SEQ ID NO: 122235 - RNA, 22 nt, Human
uuguuuuaguagguacacugag

SEQ ID NO: 122236 - RNA, 22 nt, Human
uucauacaugagacuagaugca

SEQ ID NO: 122237 - RNA, 23 nt, Human
ugcagggcaaguuagagacccca

SEQ ID NO: 122238 - RNA, 22 nt, Human
auggcagagggauugaacagcu

SEQ ID NO: 122239 - RNA, 22 nt, Human
acaauguaggaguaugacagua

SEQ ID NO: 122240 - RNA, 20 nt, Human
agcaggaaaagugccagucu

SEQ ID NO: 122241 - RNA, 22 nt, Human
ucaguggggucgaugugaggga

SEQ ID NO: 122242 - RNA, 22 nt, Human
ccaucccuucucuggccagcag

SEQ ID NO: 122243 - RNA, 22 nt, Human
uggcagagucucuccuuuccag

SEQ ID NO: 122244 - RNA, 22 nt, Human
ucacagcuaagcuuggucacug

SEQ ID NO: 122245 - RNA, 22 nt, Human
uuugauacugagaaaaacaaau

SEQ ID NO: 122246 - RNA, 22 nt, Human
gggaagcagcauugugcuggcu

SEQ ID NO: 122247 - RNA, 22 nt, Human
agggcugaugcaccauguagcc

SEQ ID NO: 122248 - RNA, 19 nt, Human
cauuuagaaguacauauua

SEQ ID NO: 122249 - RNA, 22 nt, Human
uuagaggcaugauucaguaaag

SEQ ID NO: 122250 - RNA, 22 nt, Human
caguggagugggacuggucuga

SEQ ID NO: 122251 - RNA, 22 nt, Human
caggguugcaugcaucuguggg

SEQ ID NO: 122252 - RNA, 22 nt, Human
augaucaagaauuuuguauucc

SEQ ID NO: 122253 - RNA, 22 nt, Human
acagcugugagggucacuugua

SEQ ID NO: 122254 - RNA, 22 nt, Human
cacaggagauugaucuauuggu

SEQ ID NO: 122255 - RNA, 22 nt, Human
agagcagcuggggcagagacca

SEQ ID NO: 122256 - RNA, 22 nt, Human
augaggcaaggcuggccguguu

SEQ ID NO: 122257 - RNA, 22 nt, Human
ggaaggaggggcaaagcaguuc

SEQ ID NO: 122258 - RNA, 22 nt, Human
gcagggcagccacaggcccccu

SEQ ID NO: 122259 - RNA, 22 nt, Human
ggagauaguccaggugaaggga

SEQ ID NO: 122260 - RNA, 22 nt, Human
agugggggccaacgagggcagc

SEQ ID NO: 122261 - RNA, 22 nt, Human
gaggagaagcuauuggaaggac

SEQ ID NO: 122262 - RNA, 22 nt, Human
agccagugggauuagagccucu

SEQ ID NO: 122263 - RNA, 22 nt, Human
agggcugacaguggcguggcgu

SEQ ID NO: 122264 - RNA, 22 nt, Human
gagaggggaccugugugucuag

SEQ ID NO: 122265 - RNA, 22 nt, Human
cagagcggccacuagagggcgc

SEQ ID NO: 122266 - RNA, 22 nt, Human
agguggagacccagagaaggcg

SEQ ID NO: 122267 - RNA, 22 nt, Human
uguacuugaacuugacuguaga

SEQ ID NO: 122268 - RNA, 22 nt, Human
agggucagcuggcugucagggg

SEQ ID NO: 122269 - RNA, 22 nt, Human
cagaggcagaauggagauuugg

SEQ ID NO: 122270 - RNA, 22 nt, Human
agggcuguuuuuggcaccuggg

SEQ ID NO: 122271 - RNA, 22 nt, Human
uaccucaugcuguacagcacgu

SEQ ID NO: 122272 - RNA, 22 nt, Human
uccuggggccagcacuggugga

SEQ ID NO: 122273 - RNA, 22 nt, Human
cccaggacucggcacucuccuu

SEQ ID NO: 122274 - RNA, 22 nt, Human
auucauuuagagggauuaagca

SEQ ID NO: 122275 - RNA, 22 nt, Human
cugcuguggguuaagacacugu

SEQ ID NO: 122276 - RNA, 22 nt, Human
gcaccugggcaaggauucagag

SEQ ID NO: 122277 - RNA, 18 nt, Human
aggggcagcuugugugga

SEQ ID NO: 122278 - RNA, 22 nt, Human
ccagagcuccagggcuacagaa

SEQ ID NO: 122279 - RNA, 22 nt, Human
aaagcaaucagauucagauguc

SEQ ID NO: 122280 - RNA, 22 nt, Human
gaaaggagaggguuaaggagcu

SEQ ID NO: 122281 - RNA, 22 nt, Human
augaggcagaaaaaagucggag

SEQ ID NO: 122282 - RNA, 22 nt, Human
auaaacuggguaucaagaggcc

SEQ ID NO: 122283 - RNA, 22 nt, Human
caauggauauuuuaugugagaa

SEQ ID NO: 122284 - RNA, 22 nt, Human
aagggugggcaccgccagguca

SEQ ID NO: 122285 - RNA, 22 nt, Human
ggagaugccagaauugcaaauu

SEQ ID NO: 122286 - RNA, 22 nt, Human
cuggagggggaaauguucauug

SEQ ID NO: 122287 - RNA, 22 nt, Human
cuacagugaagacuagcuauag

SEQ ID NO: 122288 - RNA, 22 nt, Human
gcagggcagggcaagaacuggg

SEQ ID NO: 122289 - RNA, 22 nt, Human
auuuucaucauggguuuaacau

SEQ ID NO: 122290 - RNA, 22 nt, Human
cauuugauuacuaaagauaauu

SEQ ID NO: 122291 - RNA, 22 nt, Human
auucugaucauucaagauguca

SEQ ID NO: 122292 - RNA, 22 nt, Human
acugugcauuccccaaccugug

SEQ ID NO: 122293 - RNA, 22 nt, Human
uauacugaguguguuaaugaug

SEQ ID NO: 122294 - RNA, 22 nt, Human
acaauguuucucuuuagucauu

SEQ ID NO: 122295 - RNA, 22 nt, Human
aggcagcaagauuauuuaaucc

SEQ ID NO: 122296 - RNA, 22 nt, Human
uuugaugaguuuaauaacagcc

SEQ ID NO: 122297 - RNA, 22 nt, Human
gcucccagguucuugggccuug

SEQ ID NO: 122298 - RNA, 22 nt, Human
gaggcacaauacaugucucaag

SEQ ID NO: 122299 - RNA, 22 nt, Human
ucagaggaaaggucagauggcu

SEQ ID NO: 122300 - RNA, 22 nt, Human
uuagaucauuuuagcuaaaugg

SEQ ID NO: 122301 - RNA, 22 nt, Human
cagaggaagcagacacaucuug

SEQ ID NO: 122302 - RNA, 22 nt, Human
guaguuacccagaacacuggaa

SEQ ID NO: 122303 - RNA, 22 nt, Human
aggaaggguucuuugugaaaga

SEQ ID NO: 122304 - RNA, 22 nt, Human
uucuccucuguuggccuucccu

SEQ ID NO: 122305 - RNA, 22 nt, Human
aguggcaggcggagauguagga

SEQ ID NO: 122306 - RNA, 22 nt, Human
uaucuguuuauuguuacuguca

SEQ ID NO: 122307 - RNA, 22 nt, Human
uucaggaugaaagugugcaaca

SEQ ID NO: 122308 - RNA, 18 nt, Human
agauuuugagaaauacaa

SEQ ID NO: 122309 - RNA, 22 nt, Human
guucaaggaagggaggaaagcc

SEQ ID NO: 122310 - RNA, 22 nt, Human
gcagccagggagagaaccaggg

SEQ ID NO: 122311 - RNA, 22 nt, Human
ggaagccacccagcuuugauag

SEQ ID NO: 122312 - RNA, 19 nt, Human
cagaggcaccagguauaga

SEQ ID NO: 122313 - RNA, 22 nt, Human
uugaaaguaauaacuuuguuca

SEQ ID NO: 122314 - RNA, 22 nt, Human
gcagggcagcuuagucccuguc

SEQ ID NO: 122315 - RNA, 22 nt, Human
uacuguuuuuuagacucauggu

SEQ ID NO: 122316 - RNA, 22 nt, Human
cugagcugguggaagcaugcag

SEQ ID NO: 122317 - RNA, 22 nt, Human
augcugaauugaugcgagggag

SEQ ID NO: 122318 - RNA, 22 nt, Human
cagggccagcgcccaggcccag

SEQ ID NO: 122319 - RNA, 22 nt, Human
acaguacauagaucucuacccu

SEQ ID NO: 122320 - RNA, 22 nt, Human
cugaggcugaagagggccuacg

SEQ ID NO: 122321 - RNA, 22 nt, Human
uccugggguccugacugcuucc

SEQ ID NO: 122322 - RNA, 22 nt, Human
ucaaucacguguuccauguucu

SEQ ID NO: 122323 - RNA, 22 nt, Human
cugaggcugggcugaggguaua

SEQ ID NO: 122324 - RNA, 22 nt, Human
acaguucccgucuugcacagcu

SEQ ID NO: 122325 - RNA, 22 nt, Human
ccugugcaugccaggguacacc

SEQ ID NO: 122326 - RNA, 22 nt, Human
caggagaaacauaauuuucugg

SEQ ID NO: 122327 - RNA, 22 nt, Human
ugucaauaucaggcagaccuaa

SEQ ID NO: 122328 - RNA, 22 nt, Human
cucccugggccucaguuucucu

SEQ ID NO: 122329 - RNA, 21 nt, Human
ggcaggauggcaguggacccc

SEQ ID NO: 122330 - RNA, 22 nt, Human
aggcagcagagguugaggaaag

SEQ ID NO: 122331 - RNA, 22 nt, Human
augcugaagagugcacaggcua

SEQ ID NO: 122332 - RNA, 22 nt, Human
acaguggaaagaacauggauuu

SEQ ID NO: 122333 - RNA, 19 nt, Human
agacagagcucaguggguu

SEQ ID NO: 122334 - RNA, 22 nt, Human
augaacaaucuguugacuucug

SEQ ID NO: 122335 - RNA, 22 nt, Human
ugagcagaguuguuucuccuga

SEQ ID NO: 122336 - RNA, 21 nt, Human
auuugcauuaaaauauuacgc

SEQ ID NO: 122337 - RNA, 22 nt, Human
ggcagaccucuccagccccaca

SEQ ID NO: 122338 - RNA, 22 nt, Human
acacuucucccaucuccuguug

SEQ ID NO: 122339 - RNA, 22 nt, Human
gaggcgagaagcuggagauggu

SEQ ID NO: 122340 - RNA, 20 nt, Human
cccaggugucugaagcucug

SEQ ID NO: 122341 - RNA, 22 nt, Human
ggaggaagagguuguucucuca

SEQ ID NO: 122342 - RNA, 19 nt, Human
caggccagugucagggggc

SEQ ID NO: 122343 - RNA, 22 nt, Human
ggagaggcgaugagucacagcc

SEQ ID NO: 122344 - RNA, 22 nt, Human
uaaacagaaagcagauguacuu

SEQ ID NO: 122345 - RNA, 22 nt, Human
aaaugauugucaaaguucuguu

SEQ ID NO: 122346 - RNA, 22 nt, Human
uucucacaguaccuaacaugua

SEQ ID NO: 122347 - RNA, 22 nt, Human
ucagaggagggacucagaccca

SEQ ID NO: 122348 - RNA, 22 nt, Human
ucauccagccucaucaggagcu

SEQ ID NO: 122349 - RNA, 22 nt, Human
gaggaaaauaacaacuaagggc

SEQ ID NO: 122350 - RNA, 22 nt, Human
ugcaggcucacccuggagcuga

SEQ ID NO: 122351 - RNA, 22 nt, Human
aggcugagccacggggcuggcu

SEQ ID NO: 122352 - RNA, 22 nt, Human
uaaaggcuuuuacaggagugca

SEQ ID NO: 122353 - RNA, 22 nt, Human
gagcugcagcggcugacgcaac

SEQ ID NO: 122354 - RNA, 22 nt, Human
ugcagggcagauaugacuguag

SEQ ID NO: 122355 - RNA, 22 nt, Human
ggaaagagcuaaaagggugaga

SEQ ID NO: 122356 - RNA, 21 nt, Human
gggcaggucucugaugucaac

SEQ ID NO: 122357 - RNA, 20 nt, Human
aggaaaaggguggugguaga

SEQ ID NO: 122358 - RNA, 22 nt, Human
guauuuucaugauuucagacca

SEQ ID NO: 122359 - RNA, 22 nt, Human
cgcagggccgcgagcgggacca

SEQ ID NO: 122360 - RNA, 22 nt, Human
aggcuucacgaugggugaggug

SEQ ID NO: 122361 - RNA, 22 nt, Human
gggcaguggcucacgccuguaa

SEQ ID NO: 122362 - RNA, 16 nt, Human
gcaggcagaucacaug

SEQ ID NO: 122363 - RNA, 22 nt, Human
cugccaggccuccgcugucccc

SEQ ID NO: 122364 - RNA, 19 nt, Human
gcauaaaaugucaaugugu

SEQ ID NO: 122365 - RNA, 22 nt, Human
uugaccuauguuucuucaucug

SEQ ID NO: 122366 - RNA, 21 nt, Human
gugguucuagagaaacagaau

SEQ ID NO: 122367 - RNA, 22 nt, Human
uuucuggcagcgggacaggggu

SEQ ID NO: 122368 - RNA, 22 nt, Human
agcagggcuuuggcuggcuuuc

SEQ ID NO: 122369 - RNA, 22 nt, Human
gggaggagugaagauucaccug

SEQ ID NO: 122370 - RNA, 22 nt, Human
ugaaggugaaugucuaugggga

SEQ ID NO: 122371 - RNA, 22 nt, Human
gcagauggcagcccaggcuggg

SEQ ID NO: 122372 - RNA, 22 nt, Human
ggaaucuucagccaugccaaga

SEQ ID NO: 122373 - RNA, 22 nt, Human
aacagcugucugccuaucucug

SEQ ID NO: 122374 - RNA, 22 nt, Human
gaaggcugucagagaggagggc

SEQ ID NO: 122375 - RNA, 23 nt, Human
gagugcagaauagacaugcagug

SEQ ID NO: 122376 - RNA, 22 nt, Human
acauuuauauaacucacuagga

SEQ ID NO: 122377 - RNA, 22 nt, Human
aggcagaugguaacugugauau

SEQ ID NO: 122378 - RNA, 22 nt, Human
acagggcagagugaaaugcuau

SEQ ID NO: 122379 - RNA, 22 nt, Human
aaauagauugcugaggcauuac

SEQ ID NO: 122380 - RNA, 22 nt, Human
gcacuauagcugcagcacagag

SEQ ID NO: 122381 - RNA, 22 nt, Human
agaagccaacagggcaggagag

SEQ ID NO: 122382 - RNA, 22 nt, Human
ugaaaaacugaauaguugagua

SEQ ID NO: 122383 - RNA, 22 nt, Human
gcaguaggagaagaggaugcuu

SEQ ID NO: 122384 - RNA, 22 nt, Human
caggcagagaggagcauuuaau

SEQ ID NO: 122385 - RNA, 22 nt, Human
uguuuauaccuugguauaacca

SEQ ID NO: 122386 - RNA, 22 nt, Human
aacaggaugucauuucucaugu

SEQ ID NO: 122387 - RNA, 20 nt, Human
uuuacauuuugaaacaguga

SEQ ID NO: 122388 - RNA, 22 nt, Human
aggcagccuauggggagcucag

SEQ ID NO: 122389 - RNA, 22 nt, Human
aucaggaagaagaauguguugg

SEQ ID NO: 122390 - RNA, 22 nt, Human
ugcagggcuuccucuuggaguu

SEQ ID NO: 122391 - RNA, 22 nt, Human
caugauuauguguuagaguuug

SEQ ID NO: 122392 - RNA, 22 nt, Human
cagcugcaugucuguggugguc

SEQ ID NO: 122393 - RNA, 22 nt, Human
ggcugugcaccauccaccuccc

SEQ ID NO: 122394 - RNA, 22 nt, Human
agugcagccgagaucaggugcu

SEQ ID NO: 122395 - RNA, 22 nt, Human
uggaggagggcuggugucugua

SEQ ID NO: 122396 - RNA, 22 nt, Human
aggcacaggaaugucauccagu

SEQ ID NO: 122397 - RNA, 22 nt, Human
auuuucucucaaaccuuaaaau

SEQ ID NO: 122398 - RNA, 22 nt, Human
gaggcagcaggcugaggaggau

SEQ ID NO: 122399 - RNA, 23 nt, Human
gcugugcacgagccacugccugu

SEQ ID NO: 122400 - RNA, 22 nt, Human
acaguggagaaggcaugaggcu

SEQ ID NO: 122401 - RNA, 22 nt, Human
acauuugagaugccuuuuaggu

SEQ ID NO: 122402 - RNA, 22 nt, Human
guauuaguuaucuacugcugug

SEQ ID NO: 122403 - RNA, 22 nt, Human
agcagcagaagggagacccagg

SEQ ID NO: 122404 - RNA, 22 nt, Human
ugaggcagcauucuucaagaca

SEQ ID NO: 122405 - RNA, 22 nt, Human
uuuauccagaaucaggauuuuu

SEQ ID NO: 122406 - RNA, 22 nt, Human
ugauuagacaaaggaaucaugc

SEQ ID NO: 122407 - RNA, 22 nt, Human
agcagggcacuggaaggcacug

SEQ ID NO: 122408 - RNA, 22 nt, Human
cuguggaccugcucuuagagac

SEQ ID NO: 122409 - RNA, 19 nt, Human
agcauuuggaauucuacac

SEQ ID NO: 122410 - RNA, 22 nt, Human
aguaacauuuagcuucucacug

SEQ ID NO: 122411 - RNA, 22 nt, Human
cuguugucuucauugucauauc

SEQ ID NO: 122412 - RNA, 19 nt, Human
gaaggcugaaaugaagcac

SEQ ID NO: 122413 - RNA, 21 nt, Human
gaguggaacgcucuucacacc

SEQ ID NO: 122414 - RNA, 22 nt, Human
gcagggcacagacagugccaag

SEQ ID NO: 122415 - RNA, 19 nt, Human
accaggccucagaggcccu

SEQ ID NO: 122416 - RNA, 22 nt, Human
uaaaggcuuuuagugaugguaa

SEQ ID NO: 122417 - RNA, 22 nt, Human
gaauucugggagagaucugaca

SEQ ID NO: 122418 - RNA, 22 nt, Human
cagaggcacaagaaagcaaggc

SEQ ID NO: 122419 - RNA, 22 nt, Human
aggcugaggcuggcagcuccag

SEQ ID NO: 122420 - RNA, 22 nt, Human
uuccucagagggcgcuggggaa

SEQ ID NO: 122421 - RNA, 22 nt, Human
gagcaggaugggagcuggggcc

SEQ ID NO: 122422 - RNA, 22 nt, Human
uggcugaguuccuggcacacgg

SEQ ID NO: 122423 - RNA, 22 nt, Human
cugagggccuuggcuccugccc

SEQ ID NO: 122424 - RNA, 22 nt, Human
aggauuuaggagcuggcuaacg

SEQ ID NO: 122425 - RNA, 23 nt, Human
agggccacugggaaggauuacug

SEQ ID NO: 122426 - RNA, 22 nt, Human
uguauuuaagcuuuaccuaaaa

SEQ ID NO: 122427 - RNA, 22 nt, Human
uuaccuguaaaacugcgauaua

SEQ ID NO: 122428 - RNA, 22 nt, Human
agcuguggcagcacuuuggagu

SEQ ID NO: 122429 - RNA, 22 nt, Human
auauuacuuccugguauaaaau

SEQ ID NO: 122430 - RNA, 22 nt, Human
gcaggaagcauagaagaaugcc

SEQ ID NO: 122431 - RNA, 22 nt, Human
gagcugaaauaugaagccaauu

SEQ ID NO: 122432 - RNA, 22 nt, Human
aagggcugccagggggugccag

SEQ ID NO: 122433 - RNA, 22 nt, Human
ucaccaggcaacuauguacucc

SEQ ID NO: 122434 - RNA, 22 nt, Human
uuauagugggcccaacauggcg

SEQ ID NO: 122435 - RNA, 22 nt, Human
cacaaaugacugaaacgacugu

SEQ ID NO: 122436 - RNA, 22 nt, Human
aagcauuucagguagagauauu

SEQ ID NO: 122437 - RNA, 22 nt, Human
ugcagagggacagccacagcuc

SEQ ID NO: 122438 - RNA, 22 nt, Human
augcugagguguguuuaauuua

SEQ ID NO: 122439 - RNA, 22 nt, Human
ugagggucauuuggaaguggaa

SEQ ID NO: 122440 - RNA, 22 nt, Human
gcuccucuccucggagucgggg

SEQ ID NO: 122441 - RNA, 22 nt, Human
guugauacaccucaugguuacu

SEQ ID NO: 122442 - RNA, 22 nt, Human
gccagaagggguggauccaggc

SEQ ID NO: 122443 - RNA, 22 nt, Human
ucugugcaauaguuuguuuuac

SEQ ID NO: 122444 - RNA, 22 nt, Human
agagguauuagguaauucagua

SEQ ID NO: 122445 - RNA, 22 nt, Human
aggucauuacaauuaucauuuu

SEQ ID NO: 122446 - RNA, 16 nt, Human
gcagaggaaaggggag

SEQ ID NO: 122447 - RNA, 22 nt, Human
agagggcauuaacucugucuug

SEQ ID NO: 122448 - RNA, 22 nt, Human
acauucuuucucuucaggaaac

SEQ ID NO: 122449 - RNA, 22 nt, Human
ucaaccagaguuuuucuuaaua

SEQ ID NO: 122450 - RNA, 23 nt, Human
uuucacaaugagcauuacagaau

SEQ ID NO: 122451 - RNA, 19 nt, Human
uggaagaggaagggaaaua

SEQ ID NO: 122452 - RNA, 22 nt, Human
uggguaggccaggaagcagugu

SEQ ID NO: 122453 - RNA, 22 nt, Human
cugggcaguaugaauauucaaa

SEQ ID NO: 122454 - RNA, 22 nt, Human
agcugggcagacugcagugguu

SEQ ID NO: 122455 - RNA, 22 nt, Human
agggaaauuaaugugagcaaug

SEQ ID NO: 122456 - RNA, 22 nt, Human
gagggcaggggucuugcacggu

SEQ ID NO: 122457 - RNA, 22 nt, Human
aacuauuuuuggagcuaacucu

SEQ ID NO: 122458 - RNA, 22 nt, Human
uuacaagauaaccugaugcugu

SEQ ID NO: 122459 - RNA, 22 nt, Human
auuccauuguguaaggauaucg

SEQ ID NO: 122460 - RNA, 23 nt, Human
ggagaggggugugggcaucuuua

SEQ ID NO: 122461 - RNA, 22 nt, Human
uggugggucggcugggagagcu

SEQ ID NO: 122462 - RNA, 22 nt, Human
cauucugcauuuggaaggggca

SEQ ID NO: 122463 - RNA, 22 nt, Human
aggauaacuauaggauaaugcu

SEQ ID NO: 122464 - RNA, 22 nt, Human
guguuuuaucagacaaaguaua

SEQ ID NO: 122465 - RNA, 22 nt, Human
acauuuaaugauccuacuguga

SEQ ID NO: 122466 - RNA, 22 nt, Human
ugcccaggauugugaggucagg

SEQ ID NO: 122467 - RNA, 22 nt, Human
ugacauuuaaucccuaaauauu

SEQ ID NO: 122468 - RNA, 21 nt, Human
uggcagggguaguaguacagc

SEQ ID NO: 122469 - RNA, 22 nt, Human
ucaugggguuuggcuggauguc

SEQ ID NO: 122470 - RNA, 22 nt, Human
uuucacauacaguguauaguag

SEQ ID NO: 122471 - RNA, 22 nt, Human
gcauuugaaaugcaagaaagug

SEQ ID NO: 122472 - RNA, 22 nt, Human
uagggcaguuucauguuaucuu

SEQ ID NO: 122473 - RNA, 22 nt, Human
guauucauuuauuuacucaucc

SEQ ID NO: 122474 - RNA, 22 nt, Human
agaggaggcucugggaucgucc

SEQ ID NO: 122475 - RNA, 22 nt, Human
cauucacagagggggaagcauc

SEQ ID NO: 122476 - RNA, 22 nt, Human
cuaauuguaagcuccuugaggg

SEQ ID NO: 122477 - RNA, 22 nt, Human
aaggucauuguugcauguucuc

SEQ ID NO: 122478 - RNA, 22 nt, Human
auugcagaacaugaggucuucu

SEQ ID NO: 122479 - RNA, 22 nt, Human
acaccauacucauguugguucc

SEQ ID NO: 122480 - RNA, 22 nt, Human
gaguccagacaccauaccugau

SEQ ID NO: 122481 - RNA, 22 nt, Human
gaggggaagacuucuggacagu

SEQ ID NO: 122482 - RNA, 22 nt, Human
cucccagggccaucgagucacu

SEQ ID NO: 122483 - RNA, 20 nt, Human
cuuguacaugauaaagauuu

SEQ ID NO: 122484 - RNA, 22 nt, Human
ucauuuguugcuguuaccugag

SEQ ID NO: 122485 - RNA, 22 nt, Human
uuuuaucaaucauuaagacauu

SEQ ID NO: 122486 - RNA, 20 nt, Human
ucagcacagcugacaagguu

SEQ ID NO: 122487 - RNA, 22 nt, Human
uugcucugaacccagggcacca

SEQ ID NO: 122488 - RNA, 22 nt, Human
caggaggaggguacaccaucag

SEQ ID NO: 122489 - RNA, 22 nt, Human
auuugcaaagucguaucuguga

SEQ ID NO: 122490 - RNA, 22 nt, Human
uuaaauuccagccucauaauag

SEQ ID NO: 122491 - RNA, 22 nt, Human
auaaaaugguaaacgaagcuga

SEQ ID NO: 122492 - RNA, 22 nt, Human
uaugugcaggggcaggagcuca

SEQ ID NO: 122493 - RNA, 19 nt, Human
ucugaaguccagggcauac

SEQ ID NO: 122494 - RNA, 22 nt, Human
ucacaucacuagcugguaauga

SEQ ID NO: 122495 - RNA, 22 nt, Human
acauuugacuacauuuauauau

SEQ ID NO: 122496 - RNA, 22 nt, Human
aggcucagagagcuguguccau

SEQ ID NO: 122497 - RNA, 22 nt, Human
uugauuuauagaauguucaagc

SEQ ID NO: 122498 - RNA, 19 nt, Human
agcacaguuuccacaugca

SEQ ID NO: 122499 - RNA, 22 nt, Human
ccaggugggaggaaagcagaga

SEQ ID NO: 122500 - RNA, 22 nt, Human
uggcugagguaacuaugaauaa

SEQ ID NO: 122501 - RNA, 22 nt, Human
ugggggagcgacagacauaauu

SEQ ID NO: 122502 - RNA, 22 nt, Human
ucaggcugcccguucagggcuc

SEQ ID NO: 122503 - RNA, 22 nt, Human
aaguccagcagugcuuguugau

SEQ ID NO: 122504 - RNA, 22 nt, Human
agcagugaaacagcugcauaug

SEQ ID NO: 122505 - RNA, 22 nt, Human
uagcagcuaugccauuuugaca

SEQ ID NO: 122506 - RNA, 22 nt, Human
auuugcauuuacauagcauaga

SEQ ID NO: 122507 - RNA, 18 nt, Human
aggcacagagcauacaua

SEQ ID NO: 122508 - RNA, 22 nt, Human
uauuuccaagcugaauccaaug

SEQ ID NO: 122509 - RNA, 22 nt, Human
agcugugcacacugugaaguag

SEQ ID NO: 122510 - RNA, 23 nt, Human
ugggaaauguagccuuggcauga

SEQ ID NO: 122511 - RNA, 22 nt, Human
caguggaaaucagagugagagu

SEQ ID NO: 122512 - RNA, 22 nt, Human
agggcugaaacauaauccuucu

SEQ ID NO: 122513 - RNA, 22 nt, Human
aagcauuuuucacagcaacagc

SEQ ID NO: 122514 - RNA, 22 nt, Human
ccaggagcaccaggccugugcc

SEQ ID NO: 122515 - RNA, 22 nt, Human
uuauacauguuuauaagguuga

SEQ ID NO: 122516 - RNA, 22 nt, Human
ucaguuaagaggccacggcagu

SEQ ID NO: 122517 - RNA, 22 nt, Human
guuuacaugcagaaaaucaaug

SEQ ID NO: 122518 - RNA, 22 nt, Human
cagugcaguggcugagcuggag

SEQ ID NO: 122519 - RNA, 22 nt, Human
ugugaaggagcaugcagagggg

SEQ ID NO: 122520 - RNA, 22 nt, Human
uccaggcuggaaaugucaaacu

SEQ ID NO: 122521 - RNA, 22 nt, Human
cugcaguguucuggaaugcauu

SEQ ID NO: 122522 - RNA, 22 nt, Human
gcacagggcugccaggcggcuu

SEQ ID NO: 122523 - RNA, 22 nt, Human
aaacagguagcccuagccuucu

SEQ ID NO: 122524 - RNA, 22 nt, Human
ucaaaggcaccaaggucacugc

SEQ ID NO: 122525 - RNA, 22 nt, Human
auuuccaaucucugcauauggg

SEQ ID NO: 122526 - RNA, 22 nt, Human
agggucagggagugaguauuua

SEQ ID NO: 122527 - RNA, 22 nt, Human
uggcagcaaaaccagaaucaga

SEQ ID NO: 122528 - RNA, 22 nt, Human
uugcagcuucgagucuaucugu

SEQ ID NO: 122529 - RNA, 22 nt, Human
uaucaugaucagcaacuaauca

SEQ ID NO: 122530 - RNA, 22 nt, Human
aaacaguuucauuuucaugacc

SEQ ID NO: 122531 - RNA, 22 nt, Human
gggcugagugaccucaggccaa

SEQ ID NO: 122532 - RNA, 22 nt, Human
gagggggacguauccugguaug

SEQ ID NO: 122533 - RNA, 22 nt, Human
agggccugggccagcacccuuu

SEQ ID NO: 122534 - RNA, 22 nt, Human
aaucaggaugacugucauuuca

SEQ ID NO: 122535 - RNA, 22 nt, Human
agcuggggguuggauaagggua

SEQ ID NO: 122536 - RNA, 20 nt, Human
ggagaugccucucaguccau

SEQ ID NO: 122537 - RNA, 22 nt, Human
gggcagagacucagaaacagaa

SEQ ID NO: 122538 - RNA, 22 nt, Human
ccugugcauugaccacacucuc

SEQ ID NO: 122539 - RNA, 22 nt, Human
agaggccggccgagcccauggg

SEQ ID NO: 122540 - RNA, 22 nt, Human
gccugccacgcaugcagaguca

SEQ ID NO: 122541 - RNA, 22 nt, Human
ucaggcugcagcugucagcagc

SEQ ID NO: 122542 - RNA, 22 nt, Human
uagggcagccacccaggcugcu

SEQ ID NO: 122543 - RNA, 22 nt, Human
caucccugcccucaugccuaua

SEQ ID NO: 122544 - RNA, 20 nt, Human
caggcagaggaugcugacca

SEQ ID NO: 122545 - RNA, 22 nt, Human
acaagagcccuuucagauugac

SEQ ID NO: 122546 - RNA, 22 nt, Human
gcacacaugcaugcacaggagu

SEQ ID NO: 122547 - RNA, 22 nt, Human
caccaggcugaaccagagggga

SEQ ID NO: 122548 - RNA, 22 nt, Human
uucagugucaauuuuuaaauau

SEQ ID NO: 122549 - RNA, 22 nt, Human
cagggcugucuccaaaggcccc

SEQ ID NO: 122550 - RNA, 22 nt, Human
cucagaaguucagccuagagua

SEQ ID NO: 122551 - RNA, 22 nt, Human
cuccugguucagagagcugaga

SEQ ID NO: 122552 - RNA, 22 nt, Human
uagcagagaggggacaguggca

SEQ ID NO: 122553 - RNA, 20 nt, Human
uuugacauauacaguucagg

SEQ ID NO: 122554 - RNA, 22 nt, Human
uggcugagaccaucagggugua

SEQ ID NO: 122555 - RNA, 22 nt, Human
caggcugcagcagcaguggccc

SEQ ID NO: 122556 - RNA, 22 nt, Human
gaggcucagagggagcaugguc

SEQ ID NO: 122557 - RNA, 22 nt, Human
gccaggcuccaggcccuccuga

SEQ ID NO: 122558 - RNA, 22 nt, Human
gaggaaacauuguagaagcagu

SEQ ID NO: 122559 - RNA, 19 nt, Human
ccugugacuaucuuuguaa

SEQ ID NO: 122560 - RNA, 22 nt, Human
ccaggaggcagaaguugcagug

SEQ ID NO: 122561 - RNA, 18 nt, Human
gagcugggagaaggaagg

SEQ ID NO: 122562 - RNA, 22 nt, Human
acugugcacacaaaaauagauu

SEQ ID NO: 122563 - RNA, 22 nt, Human
cugaggcauguuacaggacaua

SEQ ID NO: 122564 - RNA, 22 nt, Human
gaagccacccuccuuccagccc

SEQ ID NO: 122565 - RNA, 22 nt, Human
uccugccugcaaucccagcacu

SEQ ID NO: 122566 - RNA, 22 nt, Human
aggccacaguacuuugcagacc

SEQ ID NO: 122567 - RNA, 18 nt, Human
caucaguauccacuaggu

SEQ ID NO: 122568 - RNA, 22 nt, Human
ucaggcuggagugcaguggcgc

SEQ ID NO: 122569 - RNA, 23 nt, Human
aaauuauugcucuucaauugccu

SEQ ID NO: 122570 - RNA, 22 nt, Human
guggggcaugcacgcugcuccu

SEQ ID NO: 122571 - RNA, 18 nt, Human
cagaugagaugcaaucuc

SEQ ID NO: 122572 - RNA, 22 nt, Human
ugguccuggaagguccugaggg

SEQ ID NO: 122573 - RNA, 22 nt, Human
agaggcaggagguugacuugag

SEQ ID NO: 122574 - RNA, 22 nt, Human
auuugaauggcuuaacacaacg

SEQ ID NO: 122575 - RNA, 22 nt, Human
uaugcacacaucgcagcaggaa

SEQ ID NO: 122576 - RNA, 22 nt, Human
uauuugcaacauaaaacucuga

SEQ ID NO: 122577 - RNA, 22 nt, Human
auguacaaucuaucacaagaag

SEQ ID NO: 122578 - RNA, 22 nt, Human
gaggccaggguaccaucaacau

SEQ ID NO: 122579 - RNA, 22 nt, Human
aagcuggaacaucuugaggaag

SEQ ID NO: 122580 - RNA, 22 nt, Human
aagggcuggcccugggaagagu

SEQ ID NO: 122581 - RNA, 22 nt, Human
guaaacauuuucaucugugccc

SEQ ID NO: 122582 - RNA, 22 nt, Human
cacagcugcacagaggaggugc

SEQ ID NO: 122583 - RNA, 22 nt, Human
aggcucaguucuguggugagcc

SEQ ID NO: 122584 - RNA, 22 nt, Human
agggccugggauguccuccuag

SEQ ID NO: 122585 - RNA, 22 nt, Human
gcagaggaucaggcucuggaaa

SEQ ID NO: 122586 - RNA, 22 nt, Human
acaguuacaucacuuacugaca

SEQ ID NO: 122587 - RNA, 22 nt, Human
caggaggcaguuucagaaguca

SEQ ID NO: 122588 - RNA, 22 nt, Human
guguccuuuuaugugacugguu

SEQ ID NO: 122589 - RNA, 22 nt, Human
guggggaaaggaguggggcuca

SEQ ID NO: 122590 - RNA, 22 nt, Human
cacagcugugagaagggagccu

SEQ ID NO: 122591 - RNA, 22 nt, Human
agaauucugacaauagaauugg

SEQ ID NO: 122592 - RNA, 22 nt, Human
agcaugaaaggcgugccaacuu

SEQ ID NO: 122593 - RNA, 22 nt, Human
uguucccauuuucugcauaauc

SEQ ID NO: 122594 - RNA, 18 nt, Human
agaaggagcuaugggcag

SEQ ID NO: 122595 - RNA, 22 nt, Human
ugccaggcucaggaugucccug

SEQ ID NO: 122596 - RNA, 21 nt, Human
ggcagugaugugaagugcauc

SEQ ID NO: 122597 - RNA, 17 nt, Human
acagggcagaaacagcu

SEQ ID NO: 122598 - RNA, 22 nt, Human
uccaggcuggccucgcgugaca

SEQ ID NO: 122599 - RNA, 22 nt, Human
gacauucuaaaaaauauggaag

SEQ ID NO: 122600 - RNA, 22 nt, Human
acccaggacucucuuccaguag

SEQ ID NO: 122601 - RNA, 22 nt, Human
acagugcagugugaugaguauu

SEQ ID NO: 122602 - RNA, 22 nt, Human
cccacacauuuuucacuuaccg

SEQ ID NO: 122603 - RNA, 22 nt, Human
caauagcuauguaaccugaaga

SEQ ID NO: 122604 - RNA, 22 nt, Human
auuuugaugcuaucuaaugaau

SEQ ID NO: 122605 - RNA, 22 nt, Human
cgcagagggcaggcagugcugg

SEQ ID NO: 122606 - RNA, 22 nt, Human
cagugcagaggugcaagcaugu

SEQ ID NO: 122607 - RNA, 22 nt, Human
cggcagagugugugcgugcaug

SEQ ID NO: 122608 - RNA, 22 nt, Human
gcugugcaggggauuugguuau

SEQ ID NO: 122609 - RNA, 17 nt, Human
uuacaacaauucaugag

SEQ ID NO: 122610 - RNA, 17 nt, Human
agcugcagaugaaguug

SEQ ID NO: 122611 - RNA, 19 nt, Human
cagcugcaccgugaccauc

SEQ ID NO: 122612 - RNA, 22 nt, Human
agcugcuugggaaccaucaauu

SEQ ID NO: 122613 - RNA, 22 nt, Human
agcagggcucuguggagggugg

SEQ ID NO: 122614 - RNA, 22 nt, Human
cagcacacagugacucgcaccu

SEQ ID NO: 122615 - RNA, 22 nt, Human
cugggggugagcagcagcgacg

SEQ ID NO: 122616 - RNA, 19 nt, Human
agugguagaugagcaggag

SEQ ID NO: 122617 - RNA, 22 nt, Human
ucaucuuaggugaugagacagu

SEQ ID NO: 122618 - RNA, 22 nt, Human
auaguuguguggggauucuggu

SEQ ID NO: 122619 - RNA, 17 nt, Human
gcuuuggaaggguagac

SEQ ID NO: 122620 - RNA, 22 nt, Human
uggcugagcugcagcguggcuu

SEQ ID NO: 122621 - RNA, 20 nt, Human
cagggcacacugcagccucg

SEQ ID NO: 122622 - RNA, 19 nt, Human
gaagaagcuugagaaguag

SEQ ID NO: 122623 - RNA, 22 nt, Human
cauguauaguuggaacuacauc

SEQ ID NO: 122624 - RNA, 22 nt, Human
ccagaggacuugggggcugaau

SEQ ID NO: 122625 - RNA, 22 nt, Human
gcugaaggcccggaggacaggg

SEQ ID NO: 122626 - RNA, 22 nt, Human
acuuggcaaguaucuauaaagu

SEQ ID NO: 122627 - RNA, 22 nt, Human
aagagcugugggugguaguccu

SEQ ID NO: 122628 - RNA, 22 nt, Human
aagggcaggaaaagauggaugu

SEQ ID NO: 122629 - RNA, 22 nt, Human
acagaggaagcauauagcacaa

SEQ ID NO: 122630 - RNA, 22 nt, Human
gagggcagagucuaaugaugca

SEQ ID NO: 122631 - RNA, 22 nt, Human
gaaagccauagcccagcuuuac

SEQ ID NO: 122632 - RNA, 22 nt, Human
ccugugcagcccuugccaguuu

SEQ ID NO: 122633 - RNA, 22 nt, Human
gaaacauuguguucuacagauu

SEQ ID NO: 122634 - RNA, 22 nt, Human
ucacuacaaaagucucccuuuc

SEQ ID NO: 122635 - RNA, 22 nt, Human
gcugugcauaaguauaauaaac

SEQ ID NO: 122636 - RNA, 22 nt, Human
agugugaguaauucagggaggg

SEQ ID NO: 122637 - RNA, 22 nt, Human
ugcacaguuaauaugugacaga

SEQ ID NO: 122638 - RNA, 22 nt, Human
guggcgcagaggguggcagaga

SEQ ID NO: 122639 - RNA, 22 nt, Human
cugugcaguaggucagggcugg

SEQ ID NO: 122640 - RNA, 22 nt, Human
ucaggcagguggcuggcuaugg

SEQ ID NO: 122641 - RNA, 22 nt, Human
augacaaaaugaaugcagcuag

SEQ ID NO: 122642 - RNA, 22 nt, Human
ggagaggguagggguccugccc

SEQ ID NO: 122643 - RNA, 20 nt, Human
agcaagaguaaggacagcga

SEQ ID NO: 122644 - RNA, 22 nt, Human
ucucccaggucauacacagaga

SEQ ID NO: 122645 - RNA, 22 nt, Human
ugugaaggcagagccagugaaa

SEQ ID NO: 122646 - RNA, 22 nt, Human
gugugcagggcugccugugccg

SEQ ID NO: 122647 - RNA, 22 nt, Human
cagggcaggacagauacauuac

SEQ ID NO: 122648 - RNA, 22 nt, Human
gaggcucagagaagucauggua

SEQ ID NO: 122649 - RNA, 17 nt, Human
cagucgaggaggaccug

SEQ ID NO: 122650 - RNA, 22 nt, Human
caggugucuaauucucaccccc

SEQ ID NO: 122651 - RNA, 22 nt, Human
acugcccuguaacugccaggua

SEQ ID NO: 122652 - RNA, 22 nt, Human
aaaacagacagccaguguagag

SEQ ID NO: 122653 - RNA, 22 nt, Human
agcugugccuugcugcacggug

SEQ ID NO: 122654 - RNA, 22 nt, Human
gaggcucagagggacuuucaag

SEQ ID NO: 122655 - RNA, 22 nt, Human
agaaagcuuaugaaugggcaag

SEQ ID NO: 122656 - RNA, 22 nt, Human
agugcugacucugggcacagug

SEQ ID NO: 122657 - RNA, 22 nt, Human
agcaccauuucucuaaagcacu

SEQ ID NO: 122658 - RNA, 17 nt, Human
agggucaggugaaguuc

SEQ ID NO: 122659 - RNA, 22 nt, Human
cugaggcagagggcagaccaga

SEQ ID NO: 122660 - RNA, 22 nt, Human
aacauugcagcuuaauugcagg

SEQ ID NO: 122661 - RNA, 22 nt, Human
uacaggaaggagcacaucggga

SEQ ID NO: 122662 - RNA, 22 nt, Human
cauuugauccucacaacaaucu

SEQ ID NO: 122663 - RNA, 22 nt, Human
uuuugaaagaguccugcuacag

SEQ ID NO: 122664 - RNA, 22 nt, Human
augaaacacacacgcgcauacu

SEQ ID NO: 122665 - RNA, 22 nt, Human
agaguuauggacuuaaugcagg

SEQ ID NO: 122666 - RNA, 22 nt, Human
uuaaacacacugagauuuaugu

SEQ ID NO: 122667 - RNA, 22 nt, Human
aaggguugaagauaaauaaggu

SEQ ID NO: 122668 - RNA, 22 nt, Human
ggcagugaugucaaacagugaa

SEQ ID NO: 122669 - RNA, 22 nt, Human
cuccagugcgcaggacagcccc

SEQ ID NO: 122670 - RNA, 22 nt, Human
ucacaucauuaagacuucuccu

SEQ ID NO: 122671 - RNA, 22 nt, Human
uacagugauuucuacugguguu

SEQ ID NO: 122672 - RNA, 22 nt, Human
uugcaagagagucugaaaaaug

SEQ ID NO: 122673 - RNA, 22 nt, Human
uuuaucacagaauaagaaguca

SEQ ID NO: 122674 - RNA, 20 nt, Human
cgcccaggagggcccaugug

SEQ ID NO: 122675 - RNA, 22 nt, Human
cggccgcagcagugucggccca

SEQ ID NO: 122676 - RNA, 22 nt, Human
ggucucugacuuagagauggau

SEQ ID NO: 122677 - RNA, 22 nt, Human
gauguaaauggucuuuggcaga

SEQ ID NO: 122678 - RNA, 22 nt, Human
agggcagcacaaggcauggacu

SEQ ID NO: 122679 - RNA, 22 nt, Human
ugaggcagcaauuguauuguau

SEQ ID NO: 122680 - RNA, 22 nt, Human
caacagagagaccagaaacagg

SEQ ID NO: 122681 - RNA, 22 nt, Human
ucaaauggguaugcuuuauaau

SEQ ID NO: 122682 - RNA, 22 nt, Human
aggggagguggcagaaaugugc

SEQ ID NO: 122683 - RNA, 21 nt, Human
ugaggcaggggugcuuuuguc

SEQ ID NO: 122684 - RNA, 22 nt, Human
ugaugaaaauaugauucugagg

SEQ ID NO: 122685 - RNA, 22 nt, Human
agccaggccagacucacacccu

SEQ ID NO: 122686 - RNA, 22 nt, Human
ugucauggcacugguaggagug

SEQ ID NO: 122687 - RNA, 22 nt, Human
caggggagugagucccucucug

SEQ ID NO: 122688 - RNA, 22 nt, Human
acacugugucuagcauuuuaca

SEQ ID NO: 122689 - RNA, 22 nt, Human
cagaauaaacagaaacguagcu

SEQ ID NO: 122690 - RNA, 23 nt, Human
auguuauuauuagcagucuugcc

SEQ ID NO: 122691 - RNA, 22 nt, Human
aaguggagagcccuggaggucu

SEQ ID NO: 122692 - RNA, 22 nt, Human
cagugaugaucauuguaacauc

SEQ ID NO: 122693 - RNA, 22 nt, Human
gcucaguguucaucuguaugca

SEQ ID NO: 122694 - RNA, 22 nt, Human
ugccaggcugcccuccagucug

SEQ ID NO: 122695 - RNA, 22 nt, Human
gccagcagccacagaagucacu

SEQ ID NO: 122696 - RNA, 22 nt, Human
gaaggagagggucaaggauaau

SEQ ID NO: 122697 - RNA, 22 nt, Human
gugcagauccugauugcaguuc

SEQ ID NO: 122698 - RNA, 22 nt, Human
agcagggcugcggccccaccac

SEQ ID NO: 122699 - RNA, 22 nt, Human
aaugguaucaccucacagaauu

SEQ ID NO: 122700 - RNA, 22 nt, Human
cagugacguaaacugcaugugc

SEQ ID NO: 122701 - RNA, 22 nt, Human
ugaggcagaaauuccuguuuuc

SEQ ID NO: 122702 - RNA, 22 nt, Human
cccagguguuuguggcagaggu

SEQ ID NO: 122703 - RNA, 22 nt, Human
augaggcaucuaacauugcaaa

SEQ ID NO: 122704 - RNA, 22 nt, Human
gaggcucagggaaacagcgcag

SEQ ID NO: 122705 - RNA, 19 nt, Human
aaauggagcuaaucuuguc

SEQ ID NO: 122706 - RNA, 22 nt, Human
cauuuguauagugcuuagacca

SEQ ID NO: 122707 - RNA, 22 nt, Human
caggcaggugcagauuccucuu

SEQ ID NO: 122708 - RNA, 22 nt, Human
aggaggggcaaugauagucugg

SEQ ID NO: 122709 - RNA, 22 nt, Human
gaaaauuauugaaaauggcucu

SEQ ID NO: 122710 - RNA, 22 nt, Human
gauuacaauucagguugauaag

SEQ ID NO: 122711 - RNA, 22 nt, Human
guagcugauauuagcaaugagu

SEQ ID NO: 122712 - RNA, 22 nt, Human
acguggagagaauagggcacca

SEQ ID NO: 122713 - RNA, 19 nt, Human
ugcugcuguccuugcaggg

SEQ ID NO: 122714 - RNA, 23 nt, Human
auggaaauagcaugugucauuua

SEQ ID NO: 122715 - RNA, 22 nt, Human
caugcuguccugaaaagauauu

SEQ ID NO: 122716 - RNA, 22 nt, Human
uucugucaaauuugccauaugg

SEQ ID NO: 122717 - RNA, 20 nt, Human
ucaggcaguggggaaaggca

SEQ ID NO: 122718 - RNA, 22 nt, Human
gucacuguauccagguuccagc

SEQ ID NO: 122719 - RNA, 16 nt, Human
gaggcuggcagauguc

SEQ ID NO: 122720 - RNA, 22 nt, Human
uuuugcuugagugcacaaaaug

SEQ ID NO: 122721 - RNA, 22 nt, Human
ugcagaggagcuggaaggcugg

SEQ ID NO: 122722 - RNA, 22 nt, Human
gcugaggccccagggugauggg

SEQ ID NO: 122723 - RNA, 22 nt, Human
agaagccauucccuguaggcuc

SEQ ID NO: 122724 - RNA, 22 nt, Human
gggcaggucugggucagccuga

SEQ ID NO: 122725 - RNA, 22 nt, Human
agacauuuuagacauaaaagau

SEQ ID NO: 122726 - RNA, 22 nt, Human
uuacacuaugaaugagaauaua

SEQ ID NO: 122727 - RNA, 22 nt, Human
cugagccuguguuucucuggca

SEQ ID NO: 122728 - RNA, 22 nt, Human
cagggccacacggaagggaaca

SEQ ID NO: 122729 - RNA, 20 nt, Human
gaacauuuggccauacugag

SEQ ID NO: 122730 - RNA, 22 nt, Human
caggcagggagcuggaaaggau

SEQ ID NO: 122731 - RNA, 22 nt, Human
aguaaacauuucagauuuauuu

SEQ ID NO: 122732 - RNA, 22 nt, Human
uaaauuguuuucuagaaguugu

SEQ ID NO: 122733 - RNA, 22 nt, Human
cagcaucccucaggggccucug

SEQ ID NO: 122734 - RNA, 20 nt, Human
caguggcuucuguggaauau

SEQ ID NO: 122735 - RNA, 22 nt, Human
uccaggcugggcugaagggugc

SEQ ID NO: 122736 - RNA, 22 nt, Human
ccugcucagagcgucuugugug

SEQ ID NO: 122737 - RNA, 22 nt, Human
auucgcgggccuggaggguggg

SEQ ID NO: 122738 - RNA, 22 nt, Human
uugcauauccuccaacacaugg

SEQ ID NO: 122739 - RNA, 22 nt, Human
gaggcagaggaagguggucucu

SEQ ID NO: 122740 - RNA, 18 nt, Human
gugccaggaggcgcagcc

SEQ ID NO: 122741 - RNA, 22 nt, Human
gcagauggaaagugcuugaggg

SEQ ID NO: 122742 - RNA, 22 nt, Human
aaggcugugucagaagcucccu

SEQ ID NO: 122743 - RNA, 20 nt, Human
agggucaguagcacagagcu

SEQ ID NO: 122744 - RNA, 19 nt, Human
augaugcagagcugacuca

SEQ ID NO: 122745 - RNA, 23 nt, Human
guuuucaacacaauaaauguaac

SEQ ID NO: 122746 - RNA, 22 nt, Human
ucauucauugcaagcacacgca

SEQ ID NO: 122747 - RNA, 22 nt, Human
ugcaggcaggggaugagcagcc

SEQ ID NO: 122748 - RNA, 22 nt, Human
aacagagcugaccagugagggc

SEQ ID NO: 122749 - RNA, 22 nt, Human
cgaggcaggcaggcggaggaua

SEQ ID NO: 122750 - RNA, 22 nt, Human
agggccagcacuccuggcagga

SEQ ID NO: 122751 - RNA, 22 nt, Human
ucagcccugggacccagggaug

SEQ ID NO: 122752 - RNA, 16 nt, Human
agcagggcgggaagga

SEQ ID NO: 122753 - RNA, 22 nt, Human
aagaugcacaauguggcaauua

SEQ ID NO: 122754 - RNA, 22 nt, Human
uuucuacuuuggaaugcacuga

SEQ ID NO: 122755 - RNA, 22 nt, Human
ucacauuugcaauugcauuguu

SEQ ID NO: 122756 - RNA, 22 nt, Human
gggccagugaacaaugagggaa

SEQ ID NO: 122757 - RNA, 22 nt, Human
caggcccagugaucagggcucu

SEQ ID NO: 122758 - RNA, 22 nt, Human
acuguggaugccaaaggggagg

SEQ ID NO: 122759 - RNA, 22 nt, Human
aggggcaggugcugcacuuaga

SEQ ID NO: 122760 - RNA, 22 nt, Human
aaugucugaaaaucagacugca

SEQ ID NO: 122761 - RNA, 22 nt, Human
agcaggggcaggguuuugugcu

SEQ ID NO: 122762 - RNA, 22 nt, Human
uggggugugcucagagcagggg

SEQ ID NO: 122763 - RNA, 22 nt, Human
ugggcugaguggcagccagagu

SEQ ID NO: 122764 - RNA, 22 nt, Human
uagcuguguagacacucagagc

SEQ ID NO: 122765 - RNA, 22 nt, Human
ggcaguggguuccccaaggcac

SEQ ID NO: 122766 - RNA, 22 nt, Human
ugcauaacuagaguaauuacag

SEQ ID NO: 122767 - RNA, 22 nt, Human
cagggcagccaggccccguggg

SEQ ID NO: 122768 - RNA, 22 nt, Human
aggcagguguuaccucugguuu

SEQ ID NO: 122769 - RNA, 22 nt, Human
gcugagccccccugcguggguc

SEQ ID NO: 122770 - RNA, 22 nt, Human
uccuguguuacugccuggagcg

SEQ ID NO: 122771 - RNA, 22 nt, Human
ggaagccaggccaaugagaaca

SEQ ID NO: 122772 - RNA, 22 nt, Human
caugggggcugaggcugcugua

SEQ ID NO: 122773 - RNA, 22 nt, Human
ugagcugagaacacuugggcua

SEQ ID NO: 122774 - RNA, 22 nt, Human
uuucucaaguacugcacaugaa

SEQ ID NO: 122775 - RNA, 22 nt, Human
gaguccuucuggcuggcaggau

SEQ ID NO: 122776 - RNA, 23 nt, Human
cuagggcaguauuucacagacac

SEQ ID NO: 122777 - RNA, 22 nt, Human
uuguacuugccauagaacaaca

SEQ ID NO: 122778 - RNA, 22 nt, Human
ccagggaggguccuguggcuuc

SEQ ID NO: 122779 - RNA, 22 nt, Human
aagggcaggagaagacggauau

SEQ ID NO: 122780 - RNA, 22 nt, Human
ugacaaagguguugccagaggg

SEQ ID NO: 122781 - RNA, 22 nt, Human
ggccagagaagucagacccuug

SEQ ID NO: 122782 - RNA, 22 nt, Human
agcucugcaggcacagcugagg

SEQ ID NO: 122783 - RNA, 22 nt, Human
aaagccagugguaugagagaaa

SEQ ID NO: 122784 - RNA, 22 nt, Human
ccaggcucugagccucacucuu

SEQ ID NO: 122785 - RNA, 22 nt, Human
ugacauuugagagagauauaca

SEQ ID NO: 122786 - RNA, 22 nt, Human
uugcagagcaguaggaauauag

SEQ ID NO: 122787 - RNA, 22 nt, Human
uaaaggcucguauuguugugug

SEQ ID NO: 122788 - RNA, 22 nt, Human
ucaguggagagcuuccaggauu

SEQ ID NO: 122789 - RNA, 22 nt, Human
gacaggaaacaagaaggcagga

SEQ ID NO: 122790 - RNA, 22 nt, Human
cuacaguagagguugucaggga

SEQ ID NO: 122791 - RNA, 18 nt, Human
acaaaggucugcaagacc

SEQ ID NO: 122792 - RNA, 22 nt, Human
cgccaggcuugguagcucaugc

SEQ ID NO: 122793 - RNA, 22 nt, Human
gggcuggaggugagcaggacag

SEQ ID NO: 122794 - RNA, 23 nt, Human
uggcugagcccacuaucuuggcc

SEQ ID NO: 122795 - RNA, 22 nt, Human
uuuacugugcauuagaaucacc

SEQ ID NO: 122796 - RNA, 22 nt, Human
agggcugaccuaagcuccacuu

SEQ ID NO: 122797 - RNA, 22 nt, Human
aggcugagaaagugggaagaug

SEQ ID NO: 122798 - RNA, 22 nt, Human
agcagugagugggaggaccaug

SEQ ID NO: 122799 - RNA, 22 nt, Human
ugaggaagccaaacagcuacac

SEQ ID NO: 122800 - RNA, 22 nt, Human
agugggcaggcagggugcgcag

SEQ ID NO: 122801 - RNA, 22 nt, Human
ugaugacaguguuacagcucca

SEQ ID NO: 122802 - RNA, 22 nt, Human
cagaggaagcuggguguggagu

SEQ ID NO: 122803 - RNA, 18 nt, Human
cagcugccagcucaugga

SEQ ID NO: 122804 - RNA, 22 nt, Human
gcugaaggucucuggagagguc

SEQ ID NO: 122805 - RNA, 19 nt, Human
agggccugcagcucaagcu

SEQ ID NO: 122806 - RNA, 23 nt, Human
caguggagacucaugcuuccuua

SEQ ID NO: 122807 - RNA, 22 nt, Human
ggggcagcuaccggaaguaggg

SEQ ID NO: 122808 - RNA, 22 nt, Human
ccugggcagugcuggaguugaa

SEQ ID NO: 122809 - RNA, 22 nt, Human
gcuccucugucaaaugagagug

SEQ ID NO: 122810 - RNA, 22 nt, Human
aggcugagauagguggaucauu

SEQ ID NO: 122811 - RNA, 22 nt, Human
cugugcaguggcagcguguggg

SEQ ID NO: 122812 - RNA, 22 nt, Human
uccugccuugccugggacauca

SEQ ID NO: 122813 - RNA, 22 nt, Human
ucagggcauguauguuucuuua

SEQ ID NO: 122814 - RNA, 22 nt, Human
augacuaagugcauuuuaauug

SEQ ID NO: 122815 - RNA, 22 nt, Human
ugagaagcugcugacuuagccu

SEQ ID NO: 122816 - RNA, 22 nt, Human
uccaggcugauccaugaagaau

SEQ ID NO: 122817 - RNA, 22 nt, Human
uaagacauagccaagagcaucc

SEQ ID NO: 122818 - RNA, 22 nt, Human
agcauauaggaaauguugaauc

SEQ ID NO: 122819 - RNA, 22 nt, Human
ggggaaggauugaguugaccca

SEQ ID NO: 122820 - RNA, 18 nt, Human
acacaguggaugccuggu

SEQ ID NO: 122821 - RNA, 22 nt, Human
aagggcagggaguuugugucua

SEQ ID NO: 122822 - RNA, 22 nt, Human
acugugcagguagaugccuggg

SEQ ID NO: 122823 - RNA, 22 nt, Human
agaagcagcuuucaaggugauu

SEQ ID NO: 122824 - RNA, 22 nt, Human
agcugcccuuaauaggcauuca

SEQ ID NO: 122825 - RNA, 22 nt, Human
uaggggaacuggcacagggcag

SEQ ID NO: 122826 - RNA, 22 nt, Human
caaagccauagaguagauaaga

SEQ ID NO: 122827 - RNA, 22 nt, Human
aggcuuguggauuggagcgagu

SEQ ID NO: 122828 - RNA, 22 nt, Human
gccagaaagaggaggaccuggg

SEQ ID NO: 122829 - RNA, 22 nt, Human
uggaugaaaaaugagaauuuuc

SEQ ID NO: 122830 - RNA, 22 nt, Human
agggcagcacagcugugcuccu

SEQ ID NO: 122831 - RNA, 22 nt, Human
uuugauaucuugguauacagau

SEQ ID NO: 122832 - RNA, 19 nt, Human
ugcagccacgugagagacu

SEQ ID NO: 122833 - RNA, 22 nt, Human
caacuacuggugcucaggaaau

SEQ ID NO: 122834 - RNA, 20 nt, Human
uaacugaucauuuucaccag

SEQ ID NO: 122835 - RNA, 22 nt, Human
ugacauuucgguguaugugaug

SEQ ID NO: 122836 - RNA, 22 nt, Human
aguacaugugguccuggccaga

SEQ ID NO: 122837 - RNA, 22 nt, Human
ccagaggaguugaggcuuuggg

SEQ ID NO: 122838 - RNA, 22 nt, Human
gggcugagccacagcuuuuguu

SEQ ID NO: 122839 - RNA, 22 nt, Human
acauugauugagcacccauuau

SEQ ID NO: 122840 - RNA, 22 nt, Human
aggggaggagcuuuucuugccu

SEQ ID NO: 122841 - RNA, 22 nt, Human
uucugugaaucuuuuuucccac

SEQ ID NO: 122842 - RNA, 22 nt, Human
cacagcuggggaagcugaggcc

SEQ ID NO: 122843 - RNA, 22 nt, Human
gcagccuguuguaccagccugu

SEQ ID NO: 122844 - RNA, 21 nt, Human
ccacauucucauucugacugc

SEQ ID NO: 122845 - RNA, 22 nt, Human
uccaggcuaauuuugcauuguu

SEQ ID NO: 122846 - RNA, 22 nt, Human
uagggcaguuauaacauuagug

SEQ ID NO: 122847 - RNA, 22 nt, Human
gggaggaaagagaaguggucca

SEQ ID NO: 122848 - RNA, 22 nt, Human
uagggcugccuauggcuagaua

SEQ ID NO: 122849 - RNA, 22 nt, Human
uauacugagagcaaauacauuc

SEQ ID NO: 122850 - RNA, 20 nt, Human
ugccaggcacggagugcaug

SEQ ID NO: 122851 - RNA, 22 nt, Human
gcaccaggcuuagagccccagg

SEQ ID NO: 122852 - RNA, 22 nt, Human
ugaguccaagagccagugggaa

SEQ ID NO: 122853 - RNA, 22 nt, Human
ucuguuccauguuuuguuccau

SEQ ID NO: 122854 - RNA, 22 nt, Human
uacaggaaagaaauuugaacuc

SEQ ID NO: 122855 - RNA, 22 nt, Human
ccugugcacuaucugcauuuuu

SEQ ID NO: 122856 - RNA, 23 nt, Human
uuauuuggauuuuaguggaaaga

SEQ ID NO: 122857 - RNA, 22 nt, Human
ucauaacagcuaagucccuuuc

SEQ ID NO: 122858 - RNA, 22 nt, Human
aggguaggguaaaugaugcauc

SEQ ID NO: 122859 - RNA, 22 nt, Human
aagauuuuuuuccacagacuca

SEQ ID NO: 122860 - RNA, 22 nt, Human
gaguccaggcucagaaacccgu

SEQ ID NO: 122861 - RNA, 22 nt, Human
augauaacaacagcagugcugg

SEQ ID NO: 122862 - RNA, 22 nt, Human
ccagggcugguggcugcagagg

SEQ ID NO: 122863 - RNA, 20 nt, Human
aggcagagcgcacuuuuaga

SEQ ID NO: 122864 - RNA, 22 nt, Human
cuugucagccaauuguggauuu

SEQ ID NO: 122865 - RNA, 22 nt, Human
gggcugaggaacauauuuuguu

SEQ ID NO: 122866 - RNA, 21 nt, Human
aggugcagagccagggaccag

SEQ ID NO: 122867 - RNA, 22 nt, Human
augcacuacuagaugcaaaagu

SEQ ID NO: 122868 - RNA, 23 nt, Human
aggcagugggggccacuuugcuu

SEQ ID NO: 122869 - RNA, 22 nt, Human
aagguauuauuugcaaucauuu

SEQ ID NO: 122870 - RNA, 22 nt, Human
cagggccagccauccugcuggg

SEQ ID NO: 122871 - RNA, 22 nt, Human
gggcaggagagaacagucaugg

SEQ ID NO: 122872 - RNA, 22 nt, Human
ccaguggaguuuuuauacccag

SEQ ID NO: 122873 - RNA, 22 nt, Human
acagaguuaauggauaggcagg

SEQ ID NO: 122874 - RNA, 19 nt, Human
ucaggaguuaguugugcuc

SEQ ID NO: 122875 - RNA, 22 nt, Human
gucaaauaauuuucucaauagu

SEQ ID NO: 122876 - RNA, 22 nt, Human
auacaguaauuuguaacucauc

SEQ ID NO: 122877 - RNA, 21 nt, Human
gagagggcauuauaggaagug

SEQ ID NO: 122878 - RNA, 22 nt, Human
cauuugauuccuuuacucuuau

SEQ ID NO: 122879 - RNA, 22 nt, Human
cugaggcuuugugugcaugccu

SEQ ID NO: 122880 - RNA, 22 nt, Human
ggcugagcccccucugcguagg

SEQ ID NO: 122881 - RNA, 22 nt, Human
uuacaguuuaguccaagccaga

SEQ ID NO: 122882 - RNA, 22 nt, Human
gcaugggcuuucucagaguucu

SEQ ID NO: 122883 - RNA, 23 nt, Human
cugcauauggagguuagcaacuc

SEQ ID NO: 122884 - RNA, 22 nt, Human
cagcacagcuggcucuggaagc

SEQ ID NO: 122885 - RNA, 22 nt, Human
ccguggaguugugcugaguaug

SEQ ID NO: 122886 - RNA, 19 nt, Human
gaggaggcuucagcuuucu

SEQ ID NO: 122887 - RNA, 22 nt, Human
ggagaagcaggugcuuuggguc

SEQ ID NO: 122888 - RNA, 22 nt, Human
auccagcuuugucuggucuucg

SEQ ID NO: 122889 - RNA, 22 nt, Human
uuuuaucauuacccagcugaaa

SEQ ID NO: 122890 - RNA, 22 nt, Human
cacaggaaucagcauuaauggc

SEQ ID NO: 122891 - RNA, 17 nt, Human
caggcagacauguaagc

SEQ ID NO: 122892 - RNA, 22 nt, Human
ugcagggcauaggguccaguuu

SEQ ID NO: 122893 - RNA, 22 nt, Human
gagggccagcagccucagcaug

SEQ ID NO: 122894 - RNA, 22 nt, Human
gaggcuggaggucaaagaugaa

SEQ ID NO: 122895 - RNA, 22 nt, Human
agaugcagacuugguucaggca

SEQ ID NO: 122896 - RNA, 22 nt, Human
ugaguaaagggccagauaguaa

SEQ ID NO: 122897 - RNA, 22 nt, Human
gaacauuuaugaugcaauaccu

SEQ ID NO: 122898 - RNA, 17 nt, Human
agcugagcuggccaggg

SEQ ID NO: 122899 - RNA, 21 nt, Human
caauuacuuuugcaccgacuu

SEQ ID NO: 122900 - RNA, 22 nt, Human
ucugugcagaacucacagaagg

SEQ ID NO: 122901 - RNA, 22 nt, Human
ugcaguggaagagguggagauc

SEQ ID NO: 122902 - RNA, 22 nt, Human
uggcugagcucccuguguguug

SEQ ID NO: 122903 - RNA, 22 nt, Human
cugucuccagggcaggugcagg

SEQ ID NO: 122904 - RNA, 22 nt, Human
cauuucauaguugucacaauaa

SEQ ID NO: 122905 - RNA, 22 nt, Human
gggggaagaaagaacauggcau

SEQ ID NO: 122906 - RNA, 22 nt, Human
ggaggaagugcaguucuacuac

SEQ ID NO: 122907 - RNA, 21 nt, Human
uggcaggcagcuggaagcuug

SEQ ID NO: 122908 - RNA, 22 nt, Human
ccaggugugcucugcaguggau

SEQ ID NO: 122909 - RNA, 22 nt, Human
aggaggaggugggacacaguga

SEQ ID NO: 122910 - RNA, 22 nt, Human
ugagagugaaaugucacauguc

SEQ ID NO: 122911 - RNA, 22 nt, Human
aaggaagggaaauagugauguc

SEQ ID NO: 122912 - RNA, 22 nt, Human
ucaggcagcauuaaacuucagc

SEQ ID NO: 122913 - RNA, 21 nt, Human
ggcagcacuaccugaagcaua

SEQ ID NO: 122914 - RNA, 22 nt, Human
ccugugcauugaguuugcaccc

SEQ ID NO: 122915 - RNA, 22 nt, Human
gagaaacuaacaucugaaggug

SEQ ID NO: 122916 - RNA, 22 nt, Human
aggcagcagugauaagauagga

SEQ ID NO: 122917 - RNA, 22 nt, Human
aggaauucaagaccagcugggc

SEQ ID NO: 122918 - RNA, 22 nt, Human
uugcagagagguuaggaacuca

SEQ ID NO: 122919 - RNA, 22 nt, Human
gcagccugaggcccuuucuggc

SEQ ID NO: 122920 - RNA, 22 nt, Human
agggcugacaguaaaaguauga

SEQ ID NO: 122921 - RNA, 22 nt, Human
gaagucuggcugacgagaguua

SEQ ID NO: 122922 - RNA, 22 nt, Human
auguggaaugaacaaaggaggc

SEQ ID NO: 122923 - RNA, 22 nt, Human
ggcaggagcucagguugguucc

SEQ ID NO: 122924 - RNA, 22 nt, Human
cagaggcagaggucaucucugg

SEQ ID NO: 122925 - RNA, 22 nt, Human
gugauacaaauaaacauaugcu

SEQ ID NO: 122926 - RNA, 22 nt, Human
aagcauuugugaaauucagaug

SEQ ID NO: 122927 - RNA, 22 nt, Human
cugcugugaguuuggaggucua

SEQ ID NO: 122928 - RNA, 22 nt, Human
agacauuuccugugaaccuacu

SEQ ID NO: 122929 - RNA, 22 nt, Human
gaaggcuggaaggcaaguagga

SEQ ID NO: 122930 - RNA, 22 nt, Human
uagggcuguuuaaaagugaggu

SEQ ID NO: 122931 - RNA, 22 nt, Human
caggggcaagaaugcugucagc

SEQ ID NO: 122932 - RNA, 22 nt, Human
ccagagcagggcagcagggcuc

SEQ ID NO: 122933 - RNA, 22 nt, Human
ggucagcagugcagggcagagc

SEQ ID NO: 122934 - RNA, 22 nt, Human
aaacauuugcaacucgguuugg

SEQ ID NO: 122935 - RNA, 22 nt, Human
uggagcugagaaguggagcucu

SEQ ID NO: 122936 - RNA, 19 nt, Human
ggcuggaguggccaucugu

SEQ ID NO: 122937 - RNA, 22 nt, Human
aaagcagcagcaccugcauuuc

SEQ ID NO: 122938 - RNA, 22 nt, Human
cagcugggcuaagaguagaggc

SEQ ID NO: 122939 - RNA, 22 nt, Human
ucugugcaaguauuugacauuu

SEQ ID NO: 122940 - RNA, 22 nt, Human
cuacaggaguaaaauaauuuca

SEQ ID NO: 122941 - RNA, 22 nt, Human
cauguacaaggaugcucagagu

SEQ ID NO: 122942 - RNA, 22 nt, Human
ggcaggguccacaccugggaaa

SEQ ID NO: 122943 - RNA, 22 nt, Human
ggagaugcaauguagaaucugg

SEQ ID NO: 122944 - RNA, 22 nt, Human
cugccagguuggcgcucgcucu

SEQ ID NO: 122945 - RNA, 22 nt, Human
acaucaguccaccacugcaguu

SEQ ID NO: 122946 - RNA, 20 nt, Human
agggcagcuugaggagccgg

SEQ ID NO: 122947 - RNA, 22 nt, Human
uggcaggaaaguaacagagcac

SEQ ID NO: 122948 - RNA, 22 nt, Human
augcauaaagaaagcuaucugg

SEQ ID NO: 122949 - RNA, 22 nt, Human
agggccaguaccaggugggugg

SEQ ID NO: 122950 - RNA, 22 nt, Human
gagugcaguaugagaggcugcu

SEQ ID NO: 122951 - RNA, 22 nt, Human
agcagggcuucugugccugugc

SEQ ID NO: 122952 - RNA, 22 nt, Human
uccaggcuagaagucacaggcc

SEQ ID NO: 122953 - RNA, 22 nt, Human
caacauauaauauuugaguucu

SEQ ID NO: 122954 - RNA, 22 nt, Human
aggcugagcugaccugguuugg

SEQ ID NO: 122955 - RNA, 22 nt, Human
aguuuauagcccagauucaugg

SEQ ID NO: 122956 - RNA, 22 nt, Human
ccaggacccugcaaacccuguu

SEQ ID NO: 122957 - RNA, 22 nt, Human
uggagauguaaagcaaggcuua

SEQ ID NO: 122958 - RNA, 22 nt, Human
uggcucagucauggaugaguaa

SEQ ID NO: 122959 - RNA, 22 nt, Human
aagguauuuucuaauguauacu

SEQ ID NO: 122960 - RNA, 22 nt, Human
acaauuacccuggcuugauaaa

SEQ ID NO: 122961 - RNA, 22 nt, Human
uggcaggaaaaacauuggagau

SEQ ID NO: 122962 - RNA, 22 nt, Human
uuugaucagcaagauaaauaga

SEQ ID NO: 122963 - RNA, 22 nt, Human
cugccuuugugaucaguucuuu

SEQ ID NO: 122964 - RNA, 22 nt, Human
uggggcagaguaggauuuuggc

SEQ ID NO: 122965 - RNA, 18 nt, Human
cugaggcuuagagagguu

SEQ ID NO: 122966 - RNA, 22 nt, Human
uugauuuuaaaauagugacacu

SEQ ID NO: 122967 - RNA, 22 nt, Human
uacaggagagauuuaguaauca

SEQ ID NO: 122968 - RNA, 22 nt, Human
cauaacauguacauauaaaugc

SEQ ID NO: 122969 - RNA, 22 nt, Human
ugggcugaguguggaacuaguu

SEQ ID NO: 122970 - RNA, 22 nt, Human
uagaugaccuuguguuaggcaa

SEQ ID NO: 122971 - RNA, 22 nt, Human
uuuaaauuuguguuuagagggu

SEQ ID NO: 122972 - RNA, 23 nt, Human
agugcugaauugaaagcuccagg

SEQ ID NO: 122973 - RNA, 22 nt, Human
aacagugaguugaugacugaau

SEQ ID NO: 122974 - RNA, 22 nt, Human
caguggcugagaguggacacug

SEQ ID NO: 122975 - RNA, 21 nt, Human
uagggcaggcauuggaagaga

SEQ ID NO: 122976 - RNA, 22 nt, Human
ugucagaacucuauugaugucc

SEQ ID NO: 122977 - RNA, 22 nt, Human
gcuggcagguccaagauagagc

SEQ ID NO: 122978 - RNA, 22 nt, Human
uugcaagacacuuggaagcaca

SEQ ID NO: 122979 - RNA, 22 nt, Human
agagacuggagaugggcagugu

SEQ ID NO: 122980 - RNA, 19 nt, Human
acagcacagaaauauuuca

SEQ ID NO: 122981 - RNA, 22 nt, Human
agcagggcuugccgcuuguccu

SEQ ID NO: 122982 - RNA, 22 nt, Human
cuggacagaaaccaguccuggg

SEQ ID NO: 122983 - RNA, 22 nt, Human
uucagaaauucauggaguucag

SEQ ID NO: 122984 - RNA, 23 nt, Human
uggggagggaagucauuucugua

SEQ ID NO: 122985 - RNA, 22 nt, Human
caggucagaggcgcagccccca

SEQ ID NO: 122986 - RNA, 22 nt, Human
cauuugcaagagauaaauguuu

SEQ ID NO: 122987 - RNA, 22 nt, Human
ccagugcccagucucccugguc

SEQ ID NO: 122988 - RNA, 19 nt, Human
ccugcagggaugagagguu

SEQ ID NO: 122989 - RNA, 22 nt, Human
agaacauuugucgaucaauuug

SEQ ID NO: 122990 - RNA, 19 nt, Human
gaggaggaaaacuagugua

SEQ ID NO: 122991 - RNA, 22 nt, Human
gagucacaaaagaugcccaggg

SEQ ID NO: 122992 - RNA, 22 nt, Human
cagagcugguguuacaagucca

SEQ ID NO: 122993 - RNA, 22 nt, Human
agccaggccuuagggagaggca

SEQ ID NO: 122994 - RNA, 22 nt, Human
gaggaagaagggauuagaacuc

SEQ ID NO: 122995 - RNA, 22 nt, Human
cauucucaauaguagaugagua

SEQ ID NO: 122996 - RNA, 22 nt, Human
agguaguguagcugagugggau

SEQ ID NO: 122997 - RNA, 22 nt, Human
gagucugagaacugggcucagu

SEQ ID NO: 122998 - RNA, 19 nt, Human
agcugugcagacacuucgc

SEQ ID NO: 122999 - RNA, 22 nt, Human
agaggcaguauacaauccgagc

SEQ ID NO: 123000 - RNA, 22 nt, Human
gccacucaugggaggugugcaa

SEQ ID NO: 123001 - RNA, 22 nt, Human
uggggagugaugccucggauaa

SEQ ID NO: 123002 - RNA, 22 nt, Human
acaggauaguuuuuaaucuucc

SEQ ID NO: 123003 - RNA, 22 nt, Human
cauccugguuaccccauaguca

SEQ ID NO: 123004 - RNA, 22 nt, Human
uuugaaauaugaggcauuauga

SEQ ID NO: 123005 - RNA, 22 nt, Human
aaacaguuuuuuaagucucuag

SEQ ID NO: 123006 - RNA, 22 nt, Human
aauaugcaaagcguguuaucug

SEQ ID NO: 123007 - RNA, 22 nt, Human
caugcugugugguuagaacugu

SEQ ID NO: 123008 - RNA, 22 nt, Human
gcauggcaagaucaggagacca

SEQ ID NO: 123009 - RNA, 22 nt, Human
agaaggcagaugggacggagca

SEQ ID NO: 123010 - RNA, 22 nt, Human
ugaggaaguugaucucaucagu

SEQ ID NO: 123011 - RNA, 22 nt, Human
uuaaauuagucaagcuucucug

SEQ ID NO: 123012 - RNA, 22 nt, Human
gagggagggacuagcauucucu

SEQ ID NO: 123013 - RNA, 22 nt, Human
aggcagugagugugacuucaca

SEQ ID NO: 123014 - RNA, 22 nt, Human
ggcuguggacacugagcucaga

SEQ ID NO: 123015 - RNA, 22 nt, Human
aagaugcuugagaacuguuuga

SEQ ID NO: 123016 - RNA, 22 nt, Human
aagggcuggagacugggucuuc

SEQ ID NO: 123017 - RNA, 22 nt, Human
gcagccagguuugaggaccacu

SEQ ID NO: 123018 - RNA, 23 nt, Human
cagugcagggcaacucagacucc

SEQ ID NO: 123019 - RNA, 22 nt, Human
agcuguggcaaccuugucagac

SEQ ID NO: 123020 - RNA, 22 nt, Human
agagggcuggacgcagguugga

SEQ ID NO: 123021 - RNA, 16 nt, Human
gcacacacaucaauga

SEQ ID NO: 123022 - RNA, 22 nt, Human
cacaggcagccuuguagaagaa

SEQ ID NO: 123023 - RNA, 21 nt, Human
acagcuaagcaacaacuacug

SEQ ID NO: 123024 - RNA, 22 nt, Human
aguuugauaaacaccagcuagu

SEQ ID NO: 123025 - RNA, 22 nt, Human
gagagggcucuguguggguacu

SEQ ID NO: 123026 - RNA, 19 nt, Human
ugagacagggauucaggug

SEQ ID NO: 123027 - RNA, 22 nt, Human
caggacacagaauaaggcaguu

SEQ ID NO: 123028 - RNA, 22 nt, Human
gccuucccaagacgccugaguu

SEQ ID NO: 123029 - RNA, 22 nt, Human
ucagggcauacucuucaagguc

SEQ ID NO: 123030 - RNA, 20 nt, Human
aggcugagggugauuguguc

SEQ ID NO: 123031 - RNA, 22 nt, Human
uucaucuggaauuuauguuaua

SEQ ID NO: 123032 - RNA, 22 nt, Human
uguauaaaccauggacagcuuu

SEQ ID NO: 123033 - RNA, 22 nt, Human
augcugugucaggaauuugaua

SEQ ID NO: 123034 - RNA, 22 nt, Human
uaggauuauuuguucuauuucu

SEQ ID NO: 123035 - RNA, 22 nt, Human
ccugugcaggcuccauaauaga

SEQ ID NO: 123036 - RNA, 22 nt, Human
aagcagagccaccagcuuugga

SEQ ID NO: 123037 - RNA, 22 nt, Human
acagcugcugcuucucacuggg

SEQ ID NO: 123038 - RNA, 22 nt, Human
gcagaagcuguucgaaggccgc

SEQ ID NO: 123039 - RNA, 22 nt, Human
uagcacauaacuuagaauaguu

SEQ ID NO: 123040 - RNA, 22 nt, Human
cagaggaaguuccuugaugaga

SEQ ID NO: 123041 - RNA, 22 nt, Human
uggcucagauaauucaaggggc

SEQ ID NO: 123042 - RNA, 22 nt, Human
ccagagcugcauccagcagguu

SEQ ID NO: 123043 - RNA, 22 nt, Human
uggccagaaccugcaguaggcc

SEQ ID NO: 123044 - RNA, 17 nt, Human
agauggcaggaggcaga

SEQ ID NO: 123045 - RNA, 19 nt, Human
uggcugagcuggacugagg

SEQ ID NO: 123046 - RNA, 22 nt, Human
uugugcagcuauaaagaaaugg

SEQ ID NO: 123047 - RNA, 23 nt, Human
aaaugugagggaaaaucuuucug

SEQ ID NO: 123048 - RNA, 22 nt, Human
uuccagaauuuuguucugcuug

SEQ ID NO: 123049 - RNA, 22 nt, Human
ugcagggcccuugggguugaac

SEQ ID NO: 123050 - RNA, 22 nt, Human
ggaagccaggcugggggaucug

SEQ ID NO: 123051 - RNA, 22 nt, Human
cugaaaauguuacacaggaaga

SEQ ID NO: 123052 - RNA, 22 nt, Human
gaaaugaacugauuaucauugc

SEQ ID NO: 123053 - RNA, 22 nt, Human
aggcucaggcaggaauggcgga

SEQ ID NO: 123054 - RNA, 22 nt, Human
ucugugcagucagggcucaguc

SEQ ID NO: 123055 - RNA, 22 nt, Human
acuuccaaauaccaucacauug

SEQ ID NO: 123056 - RNA, 22 nt, Human
ucaguggauuguagaaggcuua

SEQ ID NO: 123057 - RNA, 22 nt, Human
cgcccagggcaggaggccgcuc

SEQ ID NO: 123058 - RNA, 22 nt, Human
acuauuuacucaaaugagguug

SEQ ID NO: 123059 - RNA, 22 nt, Human
uggcaggagacacauggcauag

SEQ ID NO: 123060 - RNA, 22 nt, Human
agucaacaaaaauguggagccu

SEQ ID NO: 123061 - RNA, 22 nt, Human
auuugcaauuacucaugucauu

SEQ ID NO: 123062 - RNA, 22 nt, Human
gggauuugugggauggccagug

SEQ ID NO: 123063 - RNA, 22 nt, Human
aauaaaauggucaguuuucuca

SEQ ID NO: 123064 - RNA, 22 nt, Human
gggagggacacaaagaguuccc

SEQ ID NO: 123065 - RNA, 22 nt, Human
gcagagcugucuaagucacuuc

SEQ ID NO: 123066 - RNA, 22 nt, Human
ucaauucugccucuaaauauuu

SEQ ID NO: 123067 - RNA, 22 nt, Human
ggaagccaguugcuuggugugg

SEQ ID NO: 123068 - RNA, 20 nt, Human
agaagccaagugacauguuu

SEQ ID NO: 123069 - RNA, 22 nt, Human
acagaggcagugugagauacug

SEQ ID NO: 123070 - RNA, 20 nt, Human
ugcagggccuaaaaagggaa

SEQ ID NO: 123071 - RNA, 22 nt, Human
uugcagaggcaaaaaugaacuc

SEQ ID NO: 123072 - RNA, 22 nt, Human
ucagaggaggcauuuaaacaga

SEQ ID NO: 123073 - RNA, 19 nt, Human
uuuaagcauagaggccaga

SEQ ID NO: 123074 - RNA, 22 nt, Human
uuguggcagaccaugagucuaa

SEQ ID NO: 123075 - RNA, 22 nt, Human
ucaccaggcuccuguuaagaug

SEQ ID NO: 123076 - RNA, 23 nt, Human
ucagaggaucaucaaacguuuuc

SEQ ID NO: 123077 - RNA, 22 nt, Human
acugugcacaauucuaaguccu

SEQ ID NO: 123078 - RNA, 22 nt, Human
uccugaggugcucagccaggaa

SEQ ID NO: 123079 - RNA, 22 nt, Human
uuugucaaguuugcaaauacgu

SEQ ID NO: 123080 - RNA, 23 nt, Human
cacuccuguuucuaagccagcau

SEQ ID NO: 123081 - RNA, 20 nt, Human
cauuaugguugggcacagug

SEQ ID NO: 123082 - RNA, 23 nt, Human
acagccaguucaccucuccuugg

SEQ ID NO: 123083 - RNA, 22 nt, Human
gcagggcuguggacacuuuggu

SEQ ID NO: 123084 - RNA, 22 nt, Human
caggcagaguuagugauuuagg

SEQ ID NO: 123085 - RNA, 22 nt, Human
ucuucauucucgccuuugucgu

SEQ ID NO: 123086 - RNA, 22 nt, Human
gaggucaucaccaauauaugcc

SEQ ID NO: 123087 - RNA, 22 nt, Human
cuggagugauacucagaaugug

SEQ ID NO: 123088 - RNA, 22 nt, Human
aguuugauggcuuaauaguaga

SEQ ID NO: 123089 - RNA, 22 nt, Human
uuuaaauuauaguuaaugucug

SEQ ID NO: 123090 - RNA, 22 nt, Human
uaggcagagguaugguaaggac

SEQ ID NO: 123091 - RNA, 22 nt, Human
gccagagguaucaaagauagua

SEQ ID NO: 123092 - RNA, 22 nt, Human
gggcugaguuccugccucacuc

SEQ ID NO: 123093 - RNA, 22 nt, Human
uccugaggacccugucaggggc

SEQ ID NO: 123094 - RNA, 22 nt, Human
ugcuaaauaaguggaauagaca

SEQ ID NO: 123095 - RNA, 22 nt, Human
uaacugaugugaacuuaccauu

SEQ ID NO: 123096 - RNA, 22 nt, Human
gaagucugacucuuuguaagcu

SEQ ID NO: 123097 - RNA, 22 nt, Human
uuugaugaugaugauaaaguuu

SEQ ID NO: 123098 - RNA, 22 nt, Human
ucucuuauuuugccuuugacaa

SEQ ID NO: 123099 - RNA, 22 nt, Human
ccaggugucuguggccagcccu

SEQ ID NO: 123100 - RNA, 21 nt, Human
ggacaccagucacacuggauu

SEQ ID NO: 123101 - RNA, 22 nt, Human
gcuguggcuugcagcuggggcu

SEQ ID NO: 123102 - RNA, 23 nt, Human
gggggccguccuggggauuauag

SEQ ID NO: 123103 - RNA, 22 nt, Human
aguccccucuaacccaacuuua

SEQ ID NO: 123104 - RNA, 22 nt, Human
uaguggagguggucugugaacu

SEQ ID NO: 123105 - RNA, 22 nt, Human
gaaggccuaggaaggaagccuu

SEQ ID NO: 123106 - RNA, 18 nt, Human
uguggcaggggugggaga

SEQ ID NO: 123107 - RNA, 22 nt, Human
gaggaggcacuaguuagugaca

SEQ ID NO: 123108 - RNA, 22 nt, Human
ccuaggccuuacuuuccugugc

SEQ ID NO: 123109 - RNA, 22 nt, Human
uccuggccgccgcguggggccg

SEQ ID NO: 123110 - RNA, 22 nt, Human
ggcucaguguuuguggaacaua

SEQ ID NO: 123111 - RNA, 22 nt, Human
ggagggagucagcugauuagaa

SEQ ID NO: 123112 - RNA, 22 nt, Human
uggaaucuguauguauguauaa

SEQ ID NO: 123113 - RNA, 17 nt, Human
cagguauuuaggcauug

SEQ ID NO: 123114 - RNA, 22 nt, Human
aagcauuucuguuuaucuaucg

SEQ ID NO: 123115 - RNA, 22 nt, Human
gaggcucacugggcaaagacuc

SEQ ID NO: 123116 - RNA, 22 nt, Human
gaagccagccuugucugccucu

SEQ ID NO: 123117 - RNA, 22 nt, Human
agcugagagguggcaagcugua

SEQ ID NO: 123118 - RNA, 22 nt, Human
agcugaggaggaaugaugggua

SEQ ID NO: 123119 - RNA, 22 nt, Human
agggccagggaagcuguauuuu

SEQ ID NO: 123120 - RNA, 22 nt, Human
gugggcagacagugcuuugcag

SEQ ID NO: 123121 - RNA, 22 nt, Human
ugugaccucaucuuaacuggaa

SEQ ID NO: 123122 - RNA, 22 nt, Human
uacagugcauagaggcaugaua

SEQ ID NO: 123123 - RNA, 22 nt, Human
guguccuuauuucugucucuca

SEQ ID NO: 123124 - RNA, 22 nt, Human
gcugaggcuccucgggaggaca

SEQ ID NO: 123125 - RNA, 22 nt, Human
cugcuguguuccuccugcaucu

SEQ ID NO: 123126 - RNA, 22 nt, Human
uucuccccugacccugaugagg

SEQ ID NO: 123127 - RNA, 22 nt, Human
agcaguggugugaggagggcuc

SEQ ID NO: 123128 - RNA, 22 nt, Human
uccuggccucacaguccugggu

SEQ ID NO: 123129 - RNA, 22 nt, Human
uccugggagagugggacuguau

SEQ ID NO: 123130 - RNA, 22 nt, Human
aauagugcuuuuguacauagga

SEQ ID NO: 123131 - RNA, 22 nt, Human
acauuugacauuuaguaucagc

SEQ ID NO: 123132 - RNA, 22 nt, Human
uuucuacaacacuucugaaucu

SEQ ID NO: 123133 - RNA, 22 nt, Human
ucaguggauauuucuguggcug

SEQ ID NO: 123134 - RNA, 22 nt, Human
gguggcagucuuaagagaucuu

SEQ ID NO: 123135 - RNA, 22 nt, Human
uauguaaaggauugagaugaau

SEQ ID NO: 123136 - RNA, 22 nt, Human
gcagaagggaauaaggagcuuu

SEQ ID NO: 123137 - RNA, 22 nt, Human
ugaggcaggaguucaggcugcg

SEQ ID NO: 123138 - RNA, 22 nt, Human
uucuguuuuagaaauaaguagu

SEQ ID NO: 123139 - RNA, 22 nt, Human
gcacaguggguggucauguaca

SEQ ID NO: 123140 - RNA, 21 nt, Human
uccuguaagcuuggguggcuc

SEQ ID NO: 123141 - RNA, 23 nt, Human
agucagagagugugagacaacug

SEQ ID NO: 123142 - RNA, 22 nt, Human
aagcaguguucccagcuggccc

SEQ ID NO: 123143 - RNA, 22 nt, Human
ggggcaggagguguucucuuuu

SEQ ID NO: 123144 - RNA, 21 nt, Human
cacuggaauuuucugugacau

SEQ ID NO: 123145 - RNA, 22 nt, Human
aacauuugugaaguacuuagau

SEQ ID NO: 123146 - RNA, 22 nt, Human
uuccagcuaacucacaucccuu

SEQ ID NO: 123147 - RNA, 22 nt, Human
uguccuuuucuuuagugcagcu

SEQ ID NO: 123148 - RNA, 22 nt, Human
ugaggcagugauguuuaagcac

SEQ ID NO: 123149 - RNA, 22 nt, Human
agcuggggcugcagagaacagg

SEQ ID NO: 123150 - RNA, 22 nt, Human
caguggaggccuugggaccuuu

SEQ ID NO: 123151 - RNA, 22 nt, Human
caucauaauaacccagacacag

SEQ ID NO: 123152 - RNA, 22 nt, Human
auuaacaugcagccagacacac

SEQ ID NO: 123153 - RNA, 22 nt, Human
agaugcagaaaaacuaagugau

SEQ ID NO: 123154 - RNA, 21 nt, Human
aggcucagagaucaaacagua

SEQ ID NO: 123155 - RNA, 22 nt, Human
accaaagggcagaacaugagca

SEQ ID NO: 123156 - RNA, 22 nt, Human
auaacaugaccugugcuucaca

SEQ ID NO: 123157 - RNA, 22 nt, Human
ugcauacacaagcauacaugua

SEQ ID NO: 123158 - RNA, 22 nt, Human
gucagaggaggcugaguaggaa

SEQ ID NO: 123159 - RNA, 22 nt, Human
aggacuuagaacauuauguacu

SEQ ID NO: 123160 - RNA, 22 nt, Human
agucucuuuugcgaagaguguu

SEQ ID NO: 123161 - RNA, 22 nt, Human
uaugcacaguuacaagaauauc

SEQ ID NO: 123162 - RNA, 22 nt, Human
acugugcagcugagugcuaauu

SEQ ID NO: 123163 - RNA, 22 nt, Human
acacagugugugcagucggacg

SEQ ID NO: 123164 - RNA, 20 nt, Human
uacaggaaucaagacugcau

SEQ ID NO: 123165 - RNA, 21 nt, Human
ugucagcaacaauacuuucuc

SEQ ID NO: 123166 - RNA, 20 nt, Human
uuggucagugguucaguuug

SEQ ID NO: 123167 - RNA, 22 nt, Human
auacuaaaguauagaacuuagu

SEQ ID NO: 123168 - RNA, 22 nt, Human
auuauuguacuuucaauaaggu

SEQ ID NO: 123169 - RNA, 22 nt, Human
aaauuauuacaagcuaguuggc

SEQ ID NO: 123170 - RNA, 22 nt, Human
ugggagaugguucugagacuuu

SEQ ID NO: 123171 - RNA, 22 nt, Human
ggcugaaguguaguggcucacu

SEQ ID NO: 123172 - RNA, 22 nt, Human
ucuuuauaaaagucauuauguc

SEQ ID NO: 123173 - RNA, 22 nt, Human
cagcuguggagauggggugcau

SEQ ID NO: 123174 - RNA, 22 nt, Human
ccagaagaggacacagugugga

SEQ ID NO: 123175 - RNA, 23 nt, Human
agugagcagcuguagggcaagga

SEQ ID NO: 123176 - RNA, 20 nt, Human
ugggcugaggaucaggugcc

SEQ ID NO: 123177 - RNA, 22 nt, Human
uggaagugcucuucugaccaac

SEQ ID NO: 123178 - RNA, 22 nt, Human
aaucuugaguaucagaccaaga

SEQ ID NO: 123179 - RNA, 23 nt, Human
cagaggcaucggauucaacauca

SEQ ID NO: 123180 - RNA, 22 nt, Human
ucucccuggagcccugaagcau

SEQ ID NO: 123181 - RNA, 22 nt, Human
gaugggggccagggccugcuuu

SEQ ID NO: 123182 - RNA, 22 nt, Human
uuuauccauaucauuaaaaucu

SEQ ID NO: 123183 - RNA, 22 nt, Human
uggaaggagcuaaggaccuggg

SEQ ID NO: 123184 - RNA, 22 nt, Human
cuauuauuagauaaucuacuug

SEQ ID NO: 123185 - RNA, 23 nt, Human
agcauggaauaggaaagaggcag

SEQ ID NO: 123186 - RNA, 22 nt, Human
agcuggaugaauuuggaacacu

SEQ ID NO: 123187 - RNA, 22 nt, Human
gccaguggcuugccaggcagga

SEQ ID NO: 123188 - RNA, 22 nt, Human
ccauguggugggaaggagaaug

SEQ ID NO: 123189 - RNA, 21 nt, Human
ucaggcagugcaaauacaugg

SEQ ID NO: 123190 - RNA, 22 nt, Human
aauuuuguucuuggaaaucagg

SEQ ID NO: 123191 - RNA, 22 nt, Human
ggcugcaggcaggguauccacu

SEQ ID NO: 123192 - RNA, 22 nt, Human
gcugugcauugagccugagagu

SEQ ID NO: 123193 - RNA, 21 nt, Human
gcugcucgagauccagugcuu

SEQ ID NO: 123194 - RNA, 22 nt, Human
aagacauugucauuuuauaauu

SEQ ID NO: 123195 - RNA, 22 nt, Human
ucugugcacugugucauuaggu

SEQ ID NO: 123196 - RNA, 22 nt, Human
ccuggccagaggcgugccugug

SEQ ID NO: 123197 - RNA, 22 nt, Human
aaaggauuaaauaaaugugcug

SEQ ID NO: 123198 - RNA, 22 nt, Human
cuguuuucccuggaguucagca

SEQ ID NO: 123199 - RNA, 22 nt, Human
gcagaugguggggcaggaaaau

SEQ ID NO: 123200 - RNA, 17 nt, Human
gcaguggagggguaguu

SEQ ID NO: 123201 - RNA, 22 nt, Human
uccauguuucagcaucuacauc

SEQ ID NO: 123202 - RNA, 22 nt, Human
aaagacuuggcuuaugauuugc

SEQ ID NO: 123203 - RNA, 22 nt, Human
augaacaacuugaagcuccaug

SEQ ID NO: 123204 - RNA, 22 nt, Human
ugagcugauaggcugugagccu

SEQ ID NO: 123205 - RNA, 22 nt, Human
uuuucauuguuccucgagcauu

SEQ ID NO: 123206 - RNA, 22 nt, Human
ugcauaaacagauacuucaugu

SEQ ID NO: 123207 - RNA, 22 nt, Human
aagaagguguggaaagaugcuc

SEQ ID NO: 123208 - RNA, 22 nt, Human
ugagaugcuaaagggcugcuca

SEQ ID NO: 123209 - RNA, 22 nt, Human
ccagggcaacgcugucucagag

SEQ ID NO: 123210 - RNA, 22 nt, Human
ucaccaggcuggaaugcagugg

SEQ ID NO: 123211 - RNA, 22 nt, Human
gcugugcagauguagggagugg

SEQ ID NO: 123212 - RNA, 22 nt, Human
uaguggagaggauguggagaaa

SEQ ID NO: 123213 - RNA, 22 nt, Human
gagaaagggaacuuacagagug

SEQ ID NO: 123214 - RNA, 20 nt, Human
uucaugggagcaaagaggcc

SEQ ID NO: 123215 - RNA, 22 nt, Human
gaggaagaaagcauaggugggg

SEQ ID NO: 123216 - RNA, 22 nt, Human
agaagcuugaaggagcagugac

SEQ ID NO: 123217 - RNA, 22 nt, Human
uuacuaagagaaguaaauauuu

SEQ ID NO: 123218 - RNA, 19 nt, Human
acacauuugcacaauccac

SEQ ID NO: 123219 - RNA, 22 nt, Human
gagggcugcaaugagacagaga

SEQ ID NO: 123220 - RNA, 22 nt, Human
aggcugagggcuccugagggca

SEQ ID NO: 123221 - RNA, 22 nt, Human
cggcagagcggcgagccccucc

SEQ ID NO: 123222 - RNA, 22 nt, Human
acagugaaaaguagcuaacaca

SEQ ID NO: 123223 - RNA, 22 nt, Human
gagcacagggaauagacagaua

SEQ ID NO: 123224 - RNA, 22 nt, Human
aaguccagaacuccugugauag

SEQ ID NO: 123225 - RNA, 22 nt, Human
uaucagcaggccaaagcugcaa

SEQ ID NO: 123226 - RNA, 22 nt, Human
ugcccaggcuccucgcagccuu

SEQ ID NO: 123227 - RNA, 22 nt, Human
ggaggccaugaggcucuaggug

SEQ ID NO: 123228 - RNA, 22 nt, Human
gggucaggcucagcagggcagc

SEQ ID NO: 123229 - RNA, 22 nt, Human
guaagcacaugugugugcaugg

SEQ ID NO: 123230 - RNA, 22 nt, Human
gacccuggaguuaguccugugu

SEQ ID NO: 123231 - RNA, 22 nt, Human
auagugggaauuacgauauacu

SEQ ID NO: 123232 - RNA, 22 nt, Human
gggcagugguuacacagcugag

SEQ ID NO: 123233 - RNA, 22 nt, Human
uguugauuaguguuuagacuua

SEQ ID NO: 123234 - RNA, 22 nt, Human
ugaaauuccaggagaguuaaaa

SEQ ID NO: 123235 - RNA, 22 nt, Human
gcuggcagacugggggcagaac

SEQ ID NO: 123236 - RNA, 22 nt, Human
auauaauuuuugguuagcucaa

SEQ ID NO: 123237 - RNA, 22 nt, Human
ucaggcugguccccacagugga

SEQ ID NO: 123238 - RNA, 22 nt, Human
uggaauggaaacaaacugagga

SEQ ID NO: 123239 - RNA, 22 nt, Human
ucacagaaggcaucacagaaga

SEQ ID NO: 123240 - RNA, 22 nt, Human
gaaaugcauggaucuuggcaga

SEQ ID NO: 123241 - RNA, 22 nt, Human
auacaugacucacacauucugc

SEQ ID NO: 123242 - RNA, 22 nt, Human
ucucccagugucuggcagucag

SEQ ID NO: 123243 - RNA, 22 nt, Human
uuacaugaugauuucauaaaca

SEQ ID NO: 123244 - RNA, 22 nt, Human
caggaggcagaggaugcccagu

SEQ ID NO: 123245 - RNA, 22 nt, Human
auuucgauagaccuaacaauug

SEQ ID NO: 123246 - RNA, 22 nt, Human
agguaaggcuguaagcuaagcc

SEQ ID NO: 123247 - RNA, 22 nt, Human
ugcuuugcaaauaauagaaugu

SEQ ID NO: 123248 - RNA, 22 nt, Human
uaggaaauacuguaaguuuggg

SEQ ID NO: 123249 - RNA, 22 nt, Human
gauuacugucuacuugggauag

SEQ ID NO: 123250 - RNA, 22 nt, Human
ugggagucugaggcgggucgau

SEQ ID NO: 123251 - RNA, 22 nt, Human
cagaaggcuuuguggaguagac

SEQ ID NO: 123252 - RNA, 22 nt, Human
aaacagcagcuguuuaauuugc

SEQ ID NO: 123253 - RNA, 22 nt, Human
ugcagugugaccuguagcgagc

SEQ ID NO: 123254 - RNA, 22 nt, Human
ccaguuuuuccagugcuuucug

SEQ ID NO: 123255 - RNA, 22 nt, Human
uacacacagaggccaugggauu

SEQ ID NO: 123256 - RNA, 22 nt, Human
ccaguggacaauuucugaggaa

SEQ ID NO: 123257 - RNA, 22 nt, Human
uguacaugaauaaaagaucuug

SEQ ID NO: 123258 - RNA, 22 nt, Human
gcuguggaugcuauggaucauc

SEQ ID NO: 123259 - RNA, 20 nt, Human
cuaagcacuuugauaaacug

SEQ ID NO: 123260 - RNA, 22 nt, Human
ccuccacaggagcugcagugcu

SEQ ID NO: 123261 - RNA, 22 nt, Human
ugccaggcccagcagggcggcc

SEQ ID NO: 123262 - RNA, 22 nt, Human
ccuggggaauagagucaagggg

SEQ ID NO: 123263 - RNA, 22 nt, Human
aagggcugaaugaaggguugaa

SEQ ID NO: 123264 - RNA, 22 nt, Human
agcagaggacaguucuuaggaa

SEQ ID NO: 123265 - RNA, 22 nt, Human
caucagagugguggccuggugu

SEQ ID NO: 123266 - RNA, 22 nt, Human
ggcucaccauuuucacucucug

SEQ ID NO: 123267 - RNA, 22 nt, Human
cagggcaguuuuacuucucucu

SEQ ID NO: 123268 - RNA, 22 nt, Human
cuaguggaaacuaacuggaauu

SEQ ID NO: 123269 - RNA, 22 nt, Human
aggcucaggugccucauucaca

SEQ ID NO: 123270 - RNA, 22 nt, Human
uuucuuauacuauauugucauc

SEQ ID NO: 123271 - RNA, 22 nt, Human
uucauuuaauuuguguauuaac

SEQ ID NO: 123272 - RNA, 22 nt, Human
gucaccagcaccaaugccacau

SEQ ID NO: 123273 - RNA, 22 nt, Human
ucugucauuuuguaucuacaug

SEQ ID NO: 123274 - RNA, 22 nt, Human
gcaaaggcuucuuuuauucucc

SEQ ID NO: 123275 - RNA, 22 nt, Human
aggaagugaaagggaaggaguu

SEQ ID NO: 123276 - RNA, 22 nt, Human
aggccucaggaagguaaagaag

SEQ ID NO: 123277 - RNA, 22 nt, Human
agcaggugggcaugaaagcuga

SEQ ID NO: 123278 - RNA, 22 nt, Human
agugggaggaaguggugauauu

SEQ ID NO: 123279 - RNA, 22 nt, Human
uugaaacauucuccuauugauu

SEQ ID NO: 123280 - RNA, 22 nt, Human
aggcugaggaucccuguguucu

SEQ ID NO: 123281 - RNA, 22 nt, Human
agcuguggaguaggggguugga

SEQ ID NO: 123282 - RNA, 21 nt, Human
aggaaaggccagcacguaggg

SEQ ID NO: 123283 - RNA, 22 nt, Human
aaaagcagagacucuggagcua

SEQ ID NO: 123284 - RNA, 22 nt, Human
aggcagagcuggguuuugaaau

SEQ ID NO: 123285 - RNA, 22 nt, Human
uaaaacagcagggcagagaagu

SEQ ID NO: 123286 - RNA, 22 nt, Human
uacagugacagauagggauaga

SEQ ID NO: 123287 - RNA, 22 nt, Human
gcugugcaucuucauucuggac

SEQ ID NO: 123288 - RNA, 22 nt, Human
augaggcagauguugcaugagg

SEQ ID NO: 123289 - RNA, 22 nt, Human
uggcagagucugggcuugggca

SEQ ID NO: 123290 - RNA, 20 nt, Human
cagguauuacaucugcaccu

SEQ ID NO: 123291 - RNA, 22 nt, Human
ucauuuucacacauaaauagca

SEQ ID NO: 123292 - RNA, 22 nt, Human
cucauaaagugagaauaugacc

SEQ ID NO: 123293 - RNA, 22 nt, Human
cggucaggugcagcguuggcac

SEQ ID NO: 123294 - RNA, 21 nt, Human
cccugcuuggggcagaacaac

SEQ ID NO: 123295 - RNA, 22 nt, Human
aggcaggaaaaucgcuugaacc

SEQ ID NO: 123296 - RNA, 22 nt, Human
gcugagggcagccuccuagguc

SEQ ID NO: 123297 - RNA, 18 nt, Human
agggucagugucacuggc

SEQ ID NO: 123298 - RNA, 20 nt, Human
aguuuauuccaggagaacug

SEQ ID NO: 123299 - RNA, 22 nt, Human
aaauuaguacauugcaaagucc

SEQ ID NO: 123300 - RNA, 22 nt, Human
agaggaaguaaucaggaccugc

SEQ ID NO: 123301 - RNA, 22 nt, Human
cuacagugacagaauuaaacag

SEQ ID NO: 123302 - RNA, 22 nt, Human
ucagggcaggacaguguaggcc

SEQ ID NO: 123303 - RNA, 22 nt, Human
uacuuguuaucaucuuuuccuu

SEQ ID NO: 123304 - RNA, 22 nt, Human
gaguccaguuguucacagaggc

SEQ ID NO: 123305 - RNA, 22 nt, Human
ggagaggaaaugccagcacuuc

SEQ ID NO: 123306 - RNA, 21 nt, Human
ugucauauuucaauacaguuu

SEQ ID NO: 123307 - RNA, 22 nt, Human
cccaguuguugccggcucugga

SEQ ID NO: 123308 - RNA, 22 nt, Human
uggagaugaauauguguaccug

SEQ ID NO: 123309 - RNA, 22 nt, Human
ggccaggcgaugaccccuccac

SEQ ID NO: 123310 - RNA, 22 nt, Human
accaugccaguggcagccagac

SEQ ID NO: 123311 - RNA, 22 nt, Human
ugcagauacaguauguggaagc

SEQ ID NO: 123312 - RNA, 22 nt, Human
auacaguagggaccaugucuga

SEQ ID NO: 123313 - RNA, 20 nt, Human
aagagcugacucacaguggu

SEQ ID NO: 123314 - RNA, 17 nt, Human
gcagccagugcagcagg

SEQ ID NO: 123315 - RNA, 22 nt, Human
cagcacaauuuucaggagucca

SEQ ID NO: 123316 - RNA, 22 nt, Human
aggcucagccccugggaggaga

SEQ ID NO: 123317 - RNA, 22 nt, Human
acaaaggugagcagaagacaca

SEQ ID NO: 123318 - RNA, 22 nt, Human
ggcuugggagcaggcaugugac

SEQ ID NO: 123319 - RNA, 22 nt, Human
gagcugagccuggguggaccgc

SEQ ID NO: 123320 - RNA, 22 nt, Human
caaaggcugccacuguggcugu

SEQ ID NO: 123321 - RNA, 22 nt, Human
cugggcagguauacaaaaaaug

SEQ ID NO: 123322 - RNA, 20 nt, Human
aaaagcagccagagauggua

SEQ ID NO: 123323 - RNA, 23 nt, Human
ccagcugugccuggcccaggagc

SEQ ID NO: 123324 - RNA, 21 nt, Human
agaugcagugacccacugggg

SEQ ID NO: 123325 - RNA, 19 nt, Human
acauggcaucccaggaggu

SEQ ID NO: 123326 - RNA, 22 nt, Human
gagggcagaaaauuaugcggug

SEQ ID NO: 123327 - RNA, 22 nt, Human
aggcccagcccguccucgugcu

SEQ ID NO: 123328 - RNA, 22 nt, Human
uauuauuaugcauagcaugaaa

SEQ ID NO: 123329 - RNA, 22 nt, Human
auucugucuuuuuauacaucua

SEQ ID NO: 123330 - RNA, 22 nt, Human
gaagcuaaugagauaaaugcca

SEQ ID NO: 123331 - RNA, 22 nt, Human
ucauuugugugagugauuugac

SEQ ID NO: 123332 - RNA, 22 nt, Human
acauuugauggaguuaguaggu

SEQ ID NO: 123333 - RNA, 22 nt, Human
ugagccagaguggagugugccu

SEQ ID NO: 123334 - RNA, 23 nt, Human
cagcugaagcagccugggcugga

SEQ ID NO: 123335 - RNA, 22 nt, Human
ggccaggcugcugggaccccgc

SEQ ID NO: 123336 - RNA, 22 nt, Human
cagcuguguagaugcaggguca

SEQ ID NO: 123337 - RNA, 15 nt, Human
ucugugcagcaaggg

SEQ ID NO: 123338 - RNA, 22 nt, Human
cugagagaugauauagcuuaau

SEQ ID NO: 123339 - RNA, 22 nt, Human
aaguggagucccuacaaccagc

SEQ ID NO: 123340 - RNA, 22 nt, Human
aggcucaggucucaggucuggc

SEQ ID NO: 123341 - RNA, 22 nt, Human
gcagacagccagacugcacugg

SEQ ID NO: 123342 - RNA, 23 nt, Human
ugaagugaaauuucacaagggac

SEQ ID NO: 123343 - RNA, 22 nt, Human
ugcauaaaauaugagaaaugua

SEQ ID NO: 123344 - RNA, 22 nt, Human
gagaaagauggaaucuuacagg

SEQ ID NO: 123345 - RNA, 22 nt, Human
uggcucagaggggaagugguuu

SEQ ID NO: 123346 - RNA, 22 nt, Human
uggcagaggagaauuaagauua

SEQ ID NO: 123347 - RNA, 22 nt, Human
agaagugcuccagugaguuggg

SEQ ID NO: 123348 - RNA, 22 nt, Human
cccagugccaggcacaggcagc

SEQ ID NO: 123349 - RNA, 22 nt, Human
auacaguauuaccuguucagga

SEQ ID NO: 123350 - RNA, 17 nt, Human
ggcugugccaggugaga

SEQ ID NO: 123351 - RNA, 22 nt, Human
aguaaacaauguaugaggacag

SEQ ID NO: 123352 - RNA, 22 nt, Human
uagggcaggugaagaaaagcua

SEQ ID NO: 123353 - RNA, 22 nt, Human
uauacugaucacugaggucauc

SEQ ID NO: 123354 - RNA, 22 nt, Human
uucugcaggagcccuaguguau

SEQ ID NO: 123355 - RNA, 19 nt, Human
gcgaggaagucacuguggu

SEQ ID NO: 123356 - RNA, 23 nt, Human
ggggaaguggcagugagugaggc

SEQ ID NO: 123357 - RNA, 22 nt, Human
ugggcugaaaugcuguggacua

SEQ ID NO: 123358 - RNA, 22 nt, Human
acaugcuaugagagauuacuuc

SEQ ID NO: 123359 - RNA, 22 nt, Human
cccaggucccgccccagcucua

SEQ ID NO: 123360 - RNA, 22 nt, Human
ugucauggaggccuccccuaaa

SEQ ID NO: 123361 - RNA, 22 nt, Human
gcaggcagguggcaucuuguga

SEQ ID NO: 123362 - RNA, 22 nt, Human
auuuagcaaaaaaugaugaagc

SEQ ID NO: 123363 - RNA, 22 nt, Human
gcagaggagcaaguugcuacag

SEQ ID NO: 123364 - RNA, 22 nt, Human
uaauaacaauuguaggacauga

SEQ ID NO: 123365 - RNA, 21 nt, Human
gcugugcaggauugaaagcag

SEQ ID NO: 123366 - RNA, 22 nt, Human
aaaucugaaauagugugaagua

SEQ ID NO: 123367 - RNA, 22 nt, Human
ccagguguaggacaccaaggga

SEQ ID NO: 123368 - RNA, 22 nt, Human
uaacucacuccaaaaaggcauu

SEQ ID NO: 123369 - RNA, 22 nt, Human
uuugcuuguucaagauuucugu

SEQ ID NO: 123370 - RNA, 22 nt, Human
ggaggguccacugugaggcaga

SEQ ID NO: 123371 - RNA, 22 nt, Human
agcuaacaugacuagaagcuuc

SEQ ID NO: 123372 - RNA, 22 nt, Human
cugcugugcagacagacucucu

SEQ ID NO: 123373 - RNA, 19 nt, Human
auuuauuguaugauuccau

SEQ ID NO: 123374 - RNA, 22 nt, Human
ccagagaggccaaggucguggu

SEQ ID NO: 123375 - RNA, 22 nt, Human
aaguaaaacacacaguccaccg

SEQ ID NO: 123376 - RNA, 22 nt, Human
ugucacuacaucauaaauauau

SEQ ID NO: 123377 - RNA, 22 nt, Human
aguuagaguuaauuuccuaaca

SEQ ID NO: 123378 - RNA, 22 nt, Human
cggcugagacggccauagacac

SEQ ID NO: 123379 - RNA, 22 nt, Human
ggcagagacuggguuggcagag

SEQ ID NO: 123380 - RNA, 18 nt, Human
acagggagggcgcugggg

SEQ ID NO: 123381 - RNA, 22 nt, Human
gugugcagggggccagcgcagc

SEQ ID NO: 123382 - RNA, 22 nt, Human
aaagugggaacaauggagagug

SEQ ID NO: 123383 - RNA, 22 nt, Human
uuacaacagacacauauucuaa

SEQ ID NO: 123384 - RNA, 22 nt, Human
ucauaaaacacaccagguaguu

SEQ ID NO: 123385 - RNA, 22 nt, Human
gaauucugguuuugaaaugaau

SEQ ID NO: 123386 - RNA, 22 nt, Human
aagugccugaccuagccuggag

SEQ ID NO: 123387 - RNA, 22 nt, Human
gcaggugauucacccugggccu

SEQ ID NO: 123388 - RNA, 22 nt, Human
ggcagugaaucugagagccugg

SEQ ID NO: 123389 - RNA, 22 nt, Human
cuugugcaaauccucgagcaca

SEQ ID NO: 123390 - RNA, 22 nt, Human
gcagauggcucagacacugggg

SEQ ID NO: 123391 - RNA, 22 nt, Human
gggcagguggcaaagccagagg

SEQ ID NO: 123392 - RNA, 18 nt, Human
gugagcagagagcaucac

SEQ ID NO: 123393 - RNA, 18 nt, Human
gauggaaaguguaugagu

SEQ ID NO: 123394 - RNA, 22 nt, Human
augcuguggggagugaggguag

SEQ ID NO: 123395 - RNA, 22 nt, Human
ugaggcaguauuuuagugacuu

SEQ ID NO: 123396 - RNA, 22 nt, Human
gggcugagugggccucuuacuu

SEQ ID NO: 123397 - RNA, 22 nt, Human
uuaguuuucccaucuuuauggu

SEQ ID NO: 123398 - RNA, 23 nt, Human
gacacaggagcacccagcugagc

SEQ ID NO: 123399 - RNA, 22 nt, Human
aucacaucgaggagcaaucaga

SEQ ID NO: 123400 - RNA, 22 nt, Human
acacugugcagauucccuguga

SEQ ID NO: 123401 - RNA, 20 nt, Human
agaaggcuccuuuugccaag

SEQ ID NO: 123402 - RNA, 22 nt, Human
ggcagcacgacaggaguggaag

SEQ ID NO: 123403 - RNA, 22 nt, Human
ggcagggagagcaugcugauaa

SEQ ID NO: 123404 - RNA, 22 nt, Human
augcaaaugcuagagaauguug

SEQ ID NO: 123405 - RNA, 22 nt, Human
ugcugugcaaaggugaugugag

SEQ ID NO: 123406 - RNA, 22 nt, Human
guauaugagaaccauggaggug

SEQ ID NO: 123407 - RNA, 19 nt, Human
agggcuaggcacauagggc

SEQ ID NO: 123408 - RNA, 22 nt, Human
uggcagagacuccuccugggag

SEQ ID NO: 123409 - RNA, 22 nt, Human
uggcugcaguucacaggagcaa

SEQ ID NO: 123410 - RNA, 22 nt, Human
gagccaccuucaacucaggaau

SEQ ID NO: 123411 - RNA, 22 nt, Human
accagagcucuucagcacagga

SEQ ID NO: 123412 - RNA, 22 nt, Human
ucauuuguucaucugcucuucu

SEQ ID NO: 123413 - RNA, 22 nt, Human
caaaugcaggucagcagguguc

SEQ ID NO: 123414 - RNA, 22 nt, Human
uaagacaucauuaaacagcaau

SEQ ID NO: 123415 - RNA, 22 nt, Human
uaugcauagugauuuagaacag

SEQ ID NO: 123416 - RNA, 22 nt, Human
uggggcucaugccugcuggaac

SEQ ID NO: 123417 - RNA, 22 nt, Human
ggaggggagguccagcugaucu

SEQ ID NO: 123418 - RNA, 22 nt, Human
acacaucagaaauaugaaugag

SEQ ID NO: 123419 - RNA, 22 nt, Human
uggcaagagggaugcaagguuu

SEQ ID NO: 123420 - RNA, 22 nt, Human
cagaagcaaaugccuugcugag

SEQ ID NO: 123421 - RNA, 22 nt, Human
caggcagcagccacucugguau

SEQ ID NO: 123422 - RNA, 22 nt, Human
caguccugugucccuugguggg

SEQ ID NO: 123423 - RNA, 22 nt, Human
ucuuuccauggccacacagucu

SEQ ID NO: 123424 - RNA, 22 nt, Human
agcagggcaugaauaaggguuu

SEQ ID NO: 123425 - RNA, 22 nt, Human
acccaggaugauaauguucaca

SEQ ID NO: 123426 - RNA, 22 nt, Human
gcugaggguaacacuucgggau

SEQ ID NO: 123427 - RNA, 22 nt, Human
gggcaggaggcuaauucugcau

SEQ ID NO: 123428 - RNA, 22 nt, Human
agagccaguuacaacuguggag

SEQ ID NO: 123429 - RNA, 22 nt, Human
agcagccacagucugggacagg

SEQ ID NO: 123430 - RNA, 22 nt, Human
gaugcugauuuuacuguuuucu

SEQ ID NO: 123431 - RNA, 22 nt, Human
uugcagagugguugugaggauu

SEQ ID NO: 123432 - RNA, 22 nt, Human
uggcagaguaggauggcccugu

SEQ ID NO: 123433 - RNA, 22 nt, Human
cugcccucuagaggaggacuga

SEQ ID NO: 123434 - RNA, 23 nt, Human
gccauggcugccccacaggccuc

SEQ ID NO: 123435 - RNA, 22 nt, Human
auuugaaccacucagaacucau

SEQ ID NO: 123436 - RNA, 22 nt, Human
agaggcugaaugaugucaucau

SEQ ID NO: 123437 - RNA, 20 nt, Human
ggggcagguuuuuauggcua

SEQ ID NO: 123438 - RNA, 22 nt, Human
ggggccagcaauguugaggaau

SEQ ID NO: 123439 - RNA, 22 nt, Human
ucaggcagagggagaagccaag

SEQ ID NO: 123440 - RNA, 22 nt, Human
cucccagguuccgacgccucuu

SEQ ID NO: 123441 - RNA, 22 nt, Human
agguagaggccuccaggcagca

SEQ ID NO: 123442 - RNA, 22 nt, Human
cugcugugagugguucuugccu

SEQ ID NO: 123443 - RNA, 22 nt, Human
gagugcaguaucuucugugucc

SEQ ID NO: 123444 - RNA, 22 nt, Human
augcggugaauugacuguuucu

SEQ ID NO: 123445 - RNA, 22 nt, Human
gguccagggaacuuugaaggau

SEQ ID NO: 123446 - RNA, 22 nt, Human
auuaaauuuucacuaggcuccc

SEQ ID NO: 123447 - RNA, 22 nt, Human
ggugaggaauuggggacugacc

SEQ ID NO: 123448 - RNA, 22 nt, Human
acgugauauauuuacuucccca

SEQ ID NO: 123449 - RNA, 23 nt, Human
ugagaagccaggggagcgugagg

SEQ ID NO: 123450 - RNA, 22 nt, Human
uugauacaugcucuagaguuga

SEQ ID NO: 123451 - RNA, 22 nt, Human
ugccaggcccucccacagauua

SEQ ID NO: 123452 - RNA, 22 nt, Human
auuacaugagagaauguaaaua

SEQ ID NO: 123453 - RNA, 22 nt, Human
uuuauauccaucuuugaaguaa

SEQ ID NO: 123454 - RNA, 22 nt, Human
gaggccugucgcuaggccucug

SEQ ID NO: 123455 - RNA, 22 nt, Human
agggccagccaggcccuacaaa

SEQ ID NO: 123456 - RNA, 22 nt, Human
ucaguggauuggaugagaucug

SEQ ID NO: 123457 - RNA, 22 nt, Human
agccuggcuaaauucucccaug

SEQ ID NO: 123458 - RNA, 22 nt, Human
cggcugagcagugcugauggaa

SEQ ID NO: 123459 - RNA, 19 nt, Human
cagagcagugguuccugaa

SEQ ID NO: 123460 - RNA, 22 nt, Human
uggcagaguggaccauacucaa

SEQ ID NO: 123461 - RNA, 22 nt, Human
uaacauugucaguucaacugcu

SEQ ID NO: 123462 - RNA, 22 nt, Human
aggcugaaaacgagauggcaau

SEQ ID NO: 123463 - RNA, 22 nt, Human
auuuccaaaaccacuuauugcc

SEQ ID NO: 123464 - RNA, 22 nt, Human
auaacauggaguuugucauuua

SEQ ID NO: 123465 - RNA, 18 nt, Human
aggcaggugcuggaaguc

SEQ ID NO: 123466 - RNA, 20 nt, Human
aguggggagucaggagugcc

SEQ ID NO: 123467 - RNA, 22 nt, Human
caccagguggaaaugucacagc

SEQ ID NO: 123468 - RNA, 22 nt, Human
uugggggaagaggauagacagu

SEQ ID NO: 123469 - RNA, 22 nt, Human
ccacuggcauccagcugccauc

SEQ ID NO: 123470 - RNA, 22 nt, Human
acaucuguuugagaaaaagaag

SEQ ID NO: 123471 - RNA, 22 nt, Human
cauggcagaaaccugagcugcu

SEQ ID NO: 123472 - RNA, 22 nt, Human
uacuucaugaguuaauaugcag

SEQ ID NO: 123473 - RNA, 22 nt, Human
agaguccauaugugggaggagu

SEQ ID NO: 123474 - RNA, 22 nt, Human
acuuucuauucccacagagaua

SEQ ID NO: 123475 - RNA, 22 nt, Human
agggccagaugaagccacaagc

SEQ ID NO: 123476 - RNA, 22 nt, Human
acagggcagagggcaguuggua

SEQ ID NO: 123477 - RNA, 18 nt, Human
cccagugcucacugccuc

SEQ ID NO: 123478 - RNA, 22 nt, Human
cagcugaagaaagagugguuag

SEQ ID NO: 123479 - RNA, 22 nt, Human
ggaggcaggaaagacagguuca

SEQ ID NO: 123480 - RNA, 22 nt, Human
auaacagugaccucucagcacc

SEQ ID NO: 123481 - RNA, 22 nt, Human
ggaggaagcacacggcuuguau

SEQ ID NO: 123482 - RNA, 22 nt, Human
ccuggccagccagggcuggggu

SEQ ID NO: 123483 - RNA, 22 nt, Human
ggcugugcuuuguuagguuguc

SEQ ID NO: 123484 - RNA, 22 nt, Human
acacuugauaggucaaaucagu

SEQ ID NO: 123485 - RNA, 22 nt, Human
cagggcuguggaaaacuggugc

SEQ ID NO: 123486 - RNA, 22 nt, Human
gaggaggcacuugagcagaugu

SEQ ID NO: 123487 - RNA, 22 nt, Human
ucauuuguggaagugauugugg

SEQ ID NO: 123488 - RNA, 22 nt, Human
ccagggcagaaaaagagggaau

SEQ ID NO: 123489 - RNA, 22 nt, Human
agccaggcgggucuuugcuccu

SEQ ID NO: 123490 - RNA, 21 nt, Human
uuucaauguguucuuuguagu

SEQ ID NO: 123491 - RNA, 22 nt, Human
uguacauacauagauauacaca

SEQ ID NO: 123492 - RNA, 22 nt, Human
ucaccacugaacagaccuuugg

SEQ ID NO: 123493 - RNA, 22 nt, Human
cagaggaaaugggaaggagaua

SEQ ID NO: 123494 - RNA, 22 nt, Human
ggagaagcagcuucuugaugaa

SEQ ID NO: 123495 - RNA, 20 nt, Human
acauuugaagucgcauuucu

SEQ ID NO: 123496 - RNA, 22 nt, Human
aaaauugagagucuugugcaag

SEQ ID NO: 123497 - RNA, 22 nt, Human
uuaaagcauguugcuuaacagg

SEQ ID NO: 123498 - RNA, 22 nt, Human
gagggcugauaacaggaauaca

SEQ ID NO: 123499 - RNA, 22 nt, Human
ugaaggcagcaugcacacuagu

SEQ ID NO: 123500 - RNA, 22 nt, Human
uuucuacagcuggugcaacuuu

SEQ ID NO: 123501 - RNA, 22 nt, Human
aaggugucggguuagcucagcc

SEQ ID NO: 123502 - RNA, 22 nt, Human
acacacacaagcagguugugga

SEQ ID NO: 123503 - RNA, 22 nt, Human
agggaaggaaaagcugucgcuu

SEQ ID NO: 123504 - RNA, 22 nt, Human
uucauucuuauuugugaucugg

SEQ ID NO: 123505 - RNA, 17 nt, Human
ucaggcugugccuggua

SEQ ID NO: 123506 - RNA, 22 nt, Human
gugcugagcugcagaugcgcuc

SEQ ID NO: 123507 - RNA, 22 nt, Human
cuggaagugggguuggcuugaa

SEQ ID NO: 123508 - RNA, 22 nt, Human
ugaggcucaaggucugguggag

SEQ ID NO: 123509 - RNA, 22 nt, Human
gagcucagcaaaggucugugug

SEQ ID NO: 123510 - RNA, 22 nt, Human
agcagggccugagugaccuaac

SEQ ID NO: 123511 - RNA, 20 nt, Human
aggaggggauagaaucaaag

SEQ ID NO: 123512 - RNA, 19 nt, Human
agcuguggggccuagcacc

SEQ ID NO: 123513 - RNA, 20 nt, Human
uggcagaguugucccaccca

SEQ ID NO: 123514 - RNA, 22 nt, Human
ucaaaggcugcuugucuucugg

SEQ ID NO: 123515 - RNA, 17 nt, Human
aaguccagccugcagcu

SEQ ID NO: 123516 - RNA, 22 nt, Human
aaggcaggaugcggacccaucu

SEQ ID NO: 123517 - RNA, 22 nt, Human
acauggaucaaccuauuuucuu

SEQ ID NO: 123518 - RNA, 22 nt, Human
acagggcagguggcuacugguc

SEQ ID NO: 123519 - RNA, 22 nt, Human
ugccaggcucagccccuaucuu

SEQ ID NO: 123520 - RNA, 22 nt, Human
uagagcaguguuguccaucaga

SEQ ID NO: 123521 - RNA, 22 nt, Human
cagugcagccaaggacaggcac

SEQ ID NO: 123522 - RNA, 22 nt, Human
uuuauuggauauuuacaagaua

SEQ ID NO: 123523 - RNA, 22 nt, Human
cuguuucauagaguugugaauu

SEQ ID NO: 123524 - RNA, 22 nt, Human
agccaggccuuuucucaagguu

SEQ ID NO: 123525 - RNA, 22 nt, Human
guggaggguuugcaaugugcag

SEQ ID NO: 123526 - RNA, 22 nt, Human
ugaggcucuccaagcagaugag

SEQ ID NO: 123527 - RNA, 22 nt, Human
cccuauuagugaccacaucaua

SEQ ID NO: 123528 - RNA, 22 nt, Human
ccacauuuuugauacucucacu

SEQ ID NO: 123529 - RNA, 22 nt, Human
uggaggcagucaaaugacugac

SEQ ID NO: 123530 - RNA, 22 nt, Human
gcugugcagccaagugccucug

SEQ ID NO: 123531 - RNA, 22 nt, Human
cugcugugugaccauggacagg

SEQ ID NO: 123532 - RNA, 19 nt, Human
aguggcagaucuggaagua

SEQ ID NO: 123533 - RNA, 22 nt, Human
agcagggcuccugaaagccgcg

SEQ ID NO: 123534 - RNA, 22 nt, Human
ucagaggaucaugucccuacuc

SEQ ID NO: 123535 - RNA, 22 nt, Human
gcaaccauuuggaauguaaaaa

SEQ ID NO: 123536 - RNA, 20 nt, Human
ggcagccaaucagcgugccg

SEQ ID NO: 123537 - RNA, 22 nt, Human
aggugucuuugcggcccgccgc

SEQ ID NO: 123538 - RNA, 22 nt, Human
augagcaaggcuuugugauagu

SEQ ID NO: 123539 - RNA, 22 nt, Human
ugccaggcccagcuccagagcu

SEQ ID NO: 123540 - RNA, 22 nt, Human
ucugggagggagccucagaauc

SEQ ID NO: 123541 - RNA, 22 nt, Human
gucaaacaaauuaacauaucca

SEQ ID NO: 123542 - RNA, 22 nt, Human
ugaguccauguggaggggaggu

SEQ ID NO: 123543 - RNA, 22 nt, Human
uucugaaugauagucuugaacu

SEQ ID NO: 123544 - RNA, 22 nt, Human
uggcagugggaagcuggaaguc

SEQ ID NO: 123545 - RNA, 22 nt, Human
ucagaggacaagcucccuggug

SEQ ID NO: 123546 - RNA, 22 nt, Human
caaggauucucacuagacuaga

SEQ ID NO: 123547 - RNA, 22 nt, Human
cuuguagaauugaaauggucuc

SEQ ID NO: 123548 - RNA, 21 nt, Human
ugaggcucaucuuauguggcu

SEQ ID NO: 123549 - RNA, 22 nt, Human
cuggcuuucugaacaucaguga

SEQ ID NO: 123550 - RNA, 23 nt, Human
gaggccacauuccccugcuugag

SEQ ID NO: 123551 - RNA, 22 nt, Human
guccugggcggagggcugcugu

SEQ ID NO: 123552 - RNA, 20 nt, Human
cugcccagccacugagggau

SEQ ID NO: 123553 - RNA, 22 nt, Human
ugaggcagugcugggaagccug

SEQ ID NO: 123554 - RNA, 22 nt, Human
agggaagugaaugacagauauc

SEQ ID NO: 123555 - RNA, 22 nt, Human
gcagaggacagggauuuagauu

SEQ ID NO: 123556 - RNA, 22 nt, Human
aggagcagaccguaguccugca

SEQ ID NO: 123557 - RNA, 22 nt, Human
gggaauuauagcugucacaggc

SEQ ID NO: 123558 - RNA, 22 nt, Human
gcgagggcacgcgguugaaggc

SEQ ID NO: 123559 - RNA, 22 nt, Human
accauucugguccauacuguuc

SEQ ID NO: 123560 - RNA, 22 nt, Human
auuuacauuuauuugagaaggu

SEQ ID NO: 123561 - RNA, 22 nt, Human
gcuguggcugaagaugcaggga

SEQ ID NO: 123562 - RNA, 22 nt, Human
ggcagaggugacagugucuuuu

SEQ ID NO: 123563 - RNA, 23 nt, Human
uuaugcaagcuuccuggucucag

SEQ ID NO: 123564 - RNA, 22 nt, Human
uagggguuaccuuuagcaucuc

SEQ ID NO: 123565 - RNA, 21 nt, Human
gcaggcuggucaaaccucagu

SEQ ID NO: 123566 - RNA, 22 nt, Human
aaguacauuauaugagcagaau

SEQ ID NO: 123567 - RNA, 22 nt, Human
caugcugugcaucuugaugacc

SEQ ID NO: 123568 - RNA, 22 nt, Human
aggacagagggaccagagccca

SEQ ID NO: 123569 - RNA, 18 nt, Human
cugaggcuggcaggagcc

SEQ ID NO: 123570 - RNA, 22 nt, Human
ugaagccacuuuccagaaucac

SEQ ID NO: 123571 - RNA, 22 nt, Human
uguggcaggaagagcuucugag

SEQ ID NO: 123572 - RNA, 22 nt, Human
aggcucagcaucugauucauau

SEQ ID NO: 123573 - RNA, 22 nt, Human
accgggaaguccugcacugggc

SEQ ID NO: 123574 - RNA, 22 nt, Human
ggcagccagcaaugagaaguuu

SEQ ID NO: 123575 - RNA, 22 nt, Human
gugagggcagcuuggucagugu

SEQ ID NO: 123576 - RNA, 22 nt, Human
uccuuugguucucuaagaugcu

SEQ ID NO: 123577 - RNA, 22 nt, Human
uggaaauacuugccauaaaacu

SEQ ID NO: 123578 - RNA, 22 nt, Human
uuagagcugauaguacacuggu

SEQ ID NO: 123579 - RNA, 22 nt, Human
aaaacuuagcuaggcaaguuuu

SEQ ID NO: 123580 - RNA, 23 nt, Human
agaguccacaagauuuuccagug

SEQ ID NO: 123581 - RNA, 22 nt, Human
gauacaguguguuaacgagaaa

SEQ ID NO: 123582 - RNA, 22 nt, Human
ucugucauuucaauaugguuaa

SEQ ID NO: 123583 - RNA, 22 nt, Human
gggcaugagagggcagcuggca

SEQ ID NO: 123584 - RNA, 22 nt, Human
gugggcagugguuugcgcgguc

SEQ ID NO: 123585 - RNA, 22 nt, Human
uagcuuccagaauuuaauguca

SEQ ID NO: 123586 - RNA, 22 nt, Human
uggagaaggggcagggucucca

SEQ ID NO: 123587 - RNA, 22 nt, Human
uacaucauguaagcagaaucau

SEQ ID NO: 123588 - RNA, 22 nt, Human
agaagccagauuguagugggac

SEQ ID NO: 123589 - RNA, 22 nt, Human
gcaccaggcagcugagcaggcc

SEQ ID NO: 123590 - RNA, 22 nt, Human
acacagauuucacuggaauaga

SEQ ID NO: 123591 - RNA, 22 nt, Human
uugaauucauuucucauugagu

SEQ ID NO: 123592 - RNA, 22 nt, Human
uaguggaggguguagcugcugg

SEQ ID NO: 123593 - RNA, 22 nt, Human
gaggcucaaaccuggacagagc

SEQ ID NO: 123594 - RNA, 22 nt, Human
ugggcaggauaauaucucaugu

SEQ ID NO: 123595 - RNA, 18 nt, Human
aaagaaggauuggagagc

SEQ ID NO: 123596 - RNA, 22 nt, Human
aggcucagugauguaaaauaua

SEQ ID NO: 123597 - RNA, 22 nt, Human
aggcgcagaaggccaggggccu

SEQ ID NO: 123598 - RNA, 22 nt, Human
gccagggcugugcagguuuguu

SEQ ID NO: 123599 - RNA, 22 nt, Human
uagcugagagcucacuugagga

SEQ ID NO: 123600 - RNA, 22 nt, Human
cauuugaucuccugaauaaaca

SEQ ID NO: 123601 - RNA, 22 nt, Human
agaggcagccguauuucaaagg

SEQ ID NO: 123602 - RNA, 22 nt, Human
aguggcagagguugacugcagu

SEQ ID NO: 123603 - RNA, 22 nt, Human
gcagaggcucuuuaaugcuuag

SEQ ID NO: 123604 - RNA, 22 nt, Human
agccaggcucaaggccugcucc

SEQ ID NO: 123605 - RNA, 22 nt, Human
uggcugcagacaccuauggcag

SEQ ID NO: 123606 - RNA, 22 nt, Human
cacaucauagagacucaaucca

SEQ ID NO: 123607 - RNA, 22 nt, Human
uggaaauacaagaaguauguca

SEQ ID NO: 123608 - RNA, 22 nt, Human
cugccaggccucaucccagcca

SEQ ID NO: 123609 - RNA, 22 nt, Human
uacaucauggcuucaugcugca

SEQ ID NO: 123610 - RNA, 22 nt, Human
aggcucagggacucccucccuc

SEQ ID NO: 123611 - RNA, 17 nt, Human
cugaagauaauggcaac

SEQ ID NO: 123612 - RNA, 22 nt, Human
acaggaaguuuggaaagccuca

SEQ ID NO: 123613 - RNA, 22 nt, Human
agaggauuguuacugauuagcu

SEQ ID NO: 123614 - RNA, 18 nt, Human
aacaggauccuccacuuc

SEQ ID NO: 123615 - RNA, 22 nt, Human
agggcugacacaccuuauccuc

SEQ ID NO: 123616 - RNA, 21 nt, Human
uggcagaguugaguaguuaug

SEQ ID NO: 123617 - RNA, 22 nt, Human
ggcugugagcaggcagaaugcu

SEQ ID NO: 123618 - RNA, 22 nt, Human
gggcagguggcagggucucugg

SEQ ID NO: 123619 - RNA, 22 nt, Human
ggcagccaugucccagggcuuc

SEQ ID NO: 123620 - RNA, 22 nt, Human
gcacagugauaggcaguugugc

SEQ ID NO: 123621 - RNA, 22 nt, Human
ccaaaggccaggcacugagguu

SEQ ID NO: 123622 - RNA, 21 nt, Human
uacaagauagagguaauauau

SEQ ID NO: 123623 - RNA, 22 nt, Human
cguuuauuuugaagauuccacu

SEQ ID NO: 123624 - RNA, 22 nt, Human
gaggccagcgcgcagcacuuuu

SEQ ID NO: 123625 - RNA, 22 nt, Human
uuauuagguuauucucuguacu

SEQ ID NO: 123626 - RNA, 22 nt, Human
uggcugagggggcaguucagga

SEQ ID NO: 123627 - RNA, 22 nt, Human
aggcaggcuagucgcuugagcc

SEQ ID NO: 123628 - RNA, 22 nt, Human
acucagaggcagcugcucaccc

SEQ ID NO: 123629 - RNA, 22 nt, Human
gaguccaguaguuaggacagag

SEQ ID NO: 123630 - RNA, 22 nt, Human
gaugcaaagauaaaacagacgc

SEQ ID NO: 123631 - RNA, 22 nt, Human
acaggcagguaauuuacauauu

SEQ ID NO: 123632 - RNA, 22 nt, Human
ucauccaguaccauggaaggca

SEQ ID NO: 123633 - RNA, 22 nt, Human
ugaugacagcaaaaaaugcuag

SEQ ID NO: 123634 - RNA, 22 nt, Human
cuguugucuccucucagauuau

SEQ ID NO: 123635 - RNA, 22 nt, Human
aagcauuugguucugaagacuc

SEQ ID NO: 123636 - RNA, 18 nt, Human
ccagguggugacagagau

SEQ ID NO: 123637 - RNA, 22 nt, Human
aagugauuugcaugcuuaauuc

SEQ ID NO: 123638 - RNA, 22 nt, Human
acauaugaguacuauacagugc

SEQ ID NO: 123639 - RNA, 23 nt, Human
ugaaacauuuaggguagaauuuc

SEQ ID NO: 123640 - RNA, 22 nt, Human
ccugcagguugcagaggcggaa

SEQ ID NO: 123641 - RNA, 22 nt, Human
gaaaccagcuagaggcagaggg

SEQ ID NO: 123642 - RNA, 22 nt, Human
ugagaggcagaauggugccugc

SEQ ID NO: 123643 - RNA, 22 nt, Human
cuaguucuagaucccugaggaa

SEQ ID NO: 123644 - RNA, 22 nt, Human
aggccagggucccacacucgca

SEQ ID NO: 123645 - RNA, 22 nt, Human
ucaggcagaauuaucaaaagau

SEQ ID NO: 123646 - RNA, 22 nt, Human
aggagaaguaaggcuagaugau

SEQ ID NO: 123647 - RNA, 22 nt, Human
gggcaagcacagcgagcgugcg

SEQ ID NO: 123648 - RNA, 22 nt, Human
acugugcaaaugacaggcacac

SEQ ID NO: 123649 - RNA, 19 nt, Human
cuuugucagaacaugcuuc

SEQ ID NO: 123650 - RNA, 22 nt, Human
agcagccauagauagcaugcaa

SEQ ID NO: 123651 - RNA, 20 nt, Human
uauuuguauuugggaaaguu

SEQ ID NO: 123652 - RNA, 22 nt, Human
acacauuugcauaauaccucau

SEQ ID NO: 123653 - RNA, 22 nt, Human
cagaccugaggagcacugagcc

SEQ ID NO: 123654 - RNA, 22 nt, Human
gggagccacaguuuauagugau

SEQ ID NO: 123655 - RNA, 22 nt, Human
ccucccugcgcuccugcggcgg

SEQ ID NO: 123656 - RNA, 22 nt, Human
caugucuuauauccugucuuca

SEQ ID NO: 123657 - RNA, 22 nt, Human
auguacauaaaauguauaauga

SEQ ID NO: 123658 - RNA, 22 nt, Human
cugcagugcaagcccagaugga

SEQ ID NO: 123659 - RNA, 22 nt, Human
uguuucauguggacauaguugu

SEQ ID NO: 123660 - RNA, 22 nt, Human
auccuucagcugcccuguuacc

SEQ ID NO: 123661 - RNA, 22 nt, Human
gcucccagcaauugaggcagcc

SEQ ID NO: 123662 - RNA, 22 nt, Human
ucugucauaagugcugaaguau

SEQ ID NO: 123663 - RNA, 22 nt, Human
uaguccaggacaaucuucauau

SEQ ID NO: 123664 - RNA, 22 nt, Human
aaagugccugacucauaguuag

SEQ ID NO: 123665 - RNA, 22 nt, Human
ccagcugucacucagaaaggcc

SEQ ID NO: 123666 - RNA, 22 nt, Human
ugagcacagcuuucacuagaaa

SEQ ID NO: 123667 - RNA, 22 nt, Human
agaggcagaaguguucaaaccc

SEQ ID NO: 123668 - RNA, 22 nt, Human
aauguuaguaacuugaguauuu

SEQ ID NO: 123669 - RNA, 22 nt, Human
ucagggcaaagggcagaguuug

SEQ ID NO: 123670 - RNA, 22 nt, Human
ccagggcacguugggacaguac

SEQ ID NO: 123671 - RNA, 22 nt, Human
gccaggcuggccagcaccuucu

SEQ ID NO: 123672 - RNA, 18 nt, Human
agcagggcauuuugccau

SEQ ID NO: 123673 - RNA, 17 nt, Human
ucucuuucccuuucugc

SEQ ID NO: 123674 - RNA, 22 nt, Human
cuacaugaacucuuaagucaca

SEQ ID NO: 123675 - RNA, 18 nt, Human
cacaggcaggugauaggu

SEQ ID NO: 123676 - RNA, 22 nt, Human
acaguuugguugcuacaguaaa

SEQ ID NO: 123677 - RNA, 22 nt, Human
uuucaaauagaaucuuuccaaa

SEQ ID NO: 123678 - RNA, 22 nt, Human
acacugugagcugaagggcugc

SEQ ID NO: 123679 - RNA, 22 nt, Human
ugaggcagcaauugauuauuca

SEQ ID NO: 123680 - RNA, 22 nt, Human
acagugcacauccugagugauu

SEQ ID NO: 123681 - RNA, 22 nt, Human
uuuauaugguugacuaugaguu

SEQ ID NO: 123682 - RNA, 21 nt, Human
cccaagggaggcaggauaagg

SEQ ID NO: 123683 - RNA, 22 nt, Human
ugggcagcagcaaagccagacu

SEQ ID NO: 123684 - RNA, 22 nt, Human
aucauacagccuuuguuagugu

SEQ ID NO: 123685 - RNA, 22 nt, Human
accaggagccauagagucaggc

SEQ ID NO: 123686 - RNA, 22 nt, Human
uccaugccaggcagucgaugca

SEQ ID NO: 123687 - RNA, 22 nt, Human
agggccagaaucccucagucua

SEQ ID NO: 123688 - RNA, 22 nt, Human
ggggcagggagguuaucgccga

SEQ ID NO: 123689 - RNA, 22 nt, Human
ggguuggggcccagcagucugc

SEQ ID NO: 123690 - RNA, 22 nt, Human
uuaugcaaggacuuauuacagu

SEQ ID NO: 123691 - RNA, 22 nt, Human
gcaguggauccaaugguaucuu

SEQ ID NO: 123692 - RNA, 22 nt, Human
uggaggucugcaaggcgcugga

SEQ ID NO: 123693 - RNA, 22 nt, Human
gcugaggccucagaaggcugag

SEQ ID NO: 123694 - RNA, 22 nt, Human
agaagccauaguaucucagggu

SEQ ID NO: 123695 - RNA, 22 nt, Human
auucauuuagguauucacuuac

SEQ ID NO: 123696 - RNA, 22 nt, Human
ugaggcaggaguuaaugugcuc

SEQ ID NO: 123697 - RNA, 22 nt, Human
ucauucaugaggugcuagugcu

SEQ ID NO: 123698 - RNA, 22 nt, Human
agcagggcugcagugugucuuu

SEQ ID NO: 123699 - RNA, 22 nt, Human
uacaugcacaugaacaugugug

SEQ ID NO: 123700 - RNA, 20 nt, Human
caucagugccugacaggucc

SEQ ID NO: 123701 - RNA, 22 nt, Human
cauaauuugauaugcuugaugg

SEQ ID NO: 123702 - RNA, 22 nt, Human
ggcagugaaugaaacagaggcu

SEQ ID NO: 123703 - RNA, 22 nt, Human
aguucaggcauaaggcaugaac

SEQ ID NO: 123704 - RNA, 22 nt, Human
aggcaagcauugggaacagggc

SEQ ID NO: 123705 - RNA, 22 nt, Human
uacaggaaguuacagacuauga

SEQ ID NO: 123706 - RNA, 19 nt, Human
agggccaggauucuggaac

SEQ ID NO: 123707 - RNA, 22 nt, Human
uuuugucagugagaacagaguu

SEQ ID NO: 123708 - RNA, 22 nt, Human
acccaggagccgugagagguua

SEQ ID NO: 123709 - RNA, 22 nt, Human
cagaggcauuacugaaaaggug

SEQ ID NO: 123710 - RNA, 23 nt, Human
ugguccugguugaggugggcccc

SEQ ID NO: 123711 - RNA, 22 nt, Human
agucaggauaugccuugugggc

SEQ ID NO: 123712 - RNA, 22 nt, Human
gccacccugagcugggccaggg

SEQ ID NO: 123713 - RNA, 22 nt, Human
uggaaauaugcuccauucuuuu

SEQ ID NO: 123714 - RNA, 22 nt, Human
aaagccacguggccuggggagc

SEQ ID NO: 123715 - RNA, 22 nt, Human
cgaggcagggaagcugcaaaag

SEQ ID NO: 123716 - RNA, 22 nt, Human
cagggcugugcccaucuucccc

SEQ ID NO: 123717 - RNA, 22 nt, Human
aacaugaaaacuaccugugauu

SEQ ID NO: 123718 - RNA, 22 nt, Human
uuuauaugaaagugaccagugg

SEQ ID NO: 123719 - RNA, 22 nt, Human
caguggaaacuaugcugcugga

SEQ ID NO: 123720 - RNA, 22 nt, Human
acaugggaucaaugaggcaggc

SEQ ID NO: 123721 - RNA, 22 nt, Human
uauuauuauauuggaugagacu

SEQ ID NO: 123722 - RNA, 19 nt, Human
ucagggcaguccggucccc

SEQ ID NO: 123723 - RNA, 18 nt, Human
cggcagagugcuucuagc

SEQ ID NO: 123724 - RNA, 22 nt, Human
ggaaagccaggugcucuggugu

SEQ ID NO: 123725 - RNA, 22 nt, Human
agccagugaugaagacucugga

SEQ ID NO: 123726 - RNA, 22 nt, Human
acauucuucuugugaauuuacu

SEQ ID NO: 123727 - RNA, 22 nt, Human
ggcagugagucccggagaggcc

SEQ ID NO: 123728 - RNA, 22 nt, Human
ggguggucuggcaggcuggaaa

SEQ ID NO: 123729 - RNA, 22 nt, Human
ucugccuguugcuagaauguca

SEQ ID NO: 123730 - RNA, 22 nt, Human
aggagugggggcgagaaguuaa

SEQ ID NO: 123731 - RNA, 22 nt, Human
ucuauguaaagccauauugaua

SEQ ID NO: 123732 - RNA, 18 nt, Human
cagggcuguggggucacu

SEQ ID NO: 123733 - RNA, 22 nt, Human
gugaagaaggcaauacaaagaa

SEQ ID NO: 123734 - RNA, 17 nt, Human
ccaggugggaggugggg

SEQ ID NO: 123735 - RNA, 20 nt, Human
ucccaggcugggcuccagcu

SEQ ID NO: 123736 - RNA, 22 nt, Human
uaguaugggaagaacuuuguag

SEQ ID NO: 123737 - RNA, 22 nt, Human
augcugagacuggagcagcugg

SEQ ID NO: 123738 - RNA, 22 nt, Human
ucagaggauuggacuuuuaugu

SEQ ID NO: 123739 - RNA, 20 nt, Human
caggaggcaaggucaagguc

SEQ ID NO: 123740 - RNA, 20 nt, Human
ucacauccucucccaacaug

SEQ ID NO: 123741 - RNA, 22 nt, Human
uuuucucaggugcuuaucuaag

SEQ ID NO: 123742 - RNA, 22 nt, Human
gggagaaggaggacugugcugu

SEQ ID NO: 123743 - RNA, 22 nt, Human
gccaggcauuauuccgaucccu

SEQ ID NO: 123744 - RNA, 22 nt, Human
cgggcagugcccagcggggcag

SEQ ID NO: 123745 - RNA, 22 nt, Human
aggcgcaggguuuggacccagg

SEQ ID NO: 123746 - RNA, 22 nt, Human
auuaaauuagcaaacugugaaa

SEQ ID NO: 123747 - RNA, 16 nt, Human
gagaagagcccggcag

SEQ ID NO: 123748 - RNA, 22 nt, Human
cugcugugugcuuacuuggguu

SEQ ID NO: 123749 - RNA, 22 nt, Human
cagggcugaagaaauucaaaag

SEQ ID NO: 123750 - RNA, 22 nt, Human
ugaagccaucccucagauggcc

SEQ ID NO: 123751 - RNA, 22 nt, Human
uagcaguauauuuuaaggaagc

SEQ ID NO: 123752 - RNA, 22 nt, Human
agugugagccuacaggccaaag

SEQ ID NO: 123753 - RNA, 22 nt, Human
ugaggcagguggauuacaaggu

SEQ ID NO: 123754 - RNA, 22 nt, Human
ucgccagggaugcuguaaggaa

SEQ ID NO: 123755 - RNA, 22 nt, Human
cagcacagggacaauagcagau

SEQ ID NO: 123756 - RNA, 22 nt, Human
ggagcugugcugggugaucagg

SEQ ID NO: 123757 - RNA, 18 nt, Human
uuacacuagccuugguuc

SEQ ID NO: 123758 - RNA, 22 nt, Human
aagggugggcccuggcagccau

SEQ ID NO: 123759 - RNA, 22 nt, Human
cagggcagggccacacccccug

SEQ ID NO: 123760 - RNA, 20 nt, Human
aggcugggguguuuugccca

SEQ ID NO: 123761 - RNA, 22 nt, Human
ucuaauuuuaggcauuuguuca

SEQ ID NO: 123762 - RNA, 19 nt, Human
cagagcugcuggccucguc

SEQ ID NO: 123763 - RNA, 19 nt, Human
caguggagauuggaggagg

SEQ ID NO: 123764 - RNA, 22 nt, Human
gaggcaggcccugaaugaguca

SEQ ID NO: 123765 - RNA, 22 nt, Human
ucuuacauauagcaugaguaca

SEQ ID NO: 123766 - RNA, 22 nt, Human
gcagagugagauaugaacccag

SEQ ID NO: 123767 - RNA, 22 nt, Human
uccuggcccgaucccugugaag

SEQ ID NO: 123768 - RNA, 22 nt, Human
uccuggccuugcuccugaugcc

SEQ ID NO: 123769 - RNA, 22 nt, Human
agggcuagaguugagaugggga

SEQ ID NO: 123770 - RNA, 22 nt, Human
cagcugugagcagccaguugcc

SEQ ID NO: 123771 - RNA, 22 nt, Human
caggaaggcgcggcugugccug

SEQ ID NO: 123772 - RNA, 23 nt, Human
agggaaauacugcaauuuuugga

SEQ ID NO: 123773 - RNA, 22 nt, Human
uggagaauucuauguugagggg

SEQ ID NO: 123774 - RNA, 19 nt, Human
gucagcaccauggacaggg

SEQ ID NO: 123775 - RNA, 22 nt, Human
aaugggaagccagaagacaagg

SEQ ID NO: 123776 - RNA, 22 nt, Human
caaaugcaggucauaaccugag

SEQ ID NO: 123777 - RNA, 22 nt, Human
cucauuuauguaaugauuaagg

SEQ ID NO: 123778 - RNA, 22 nt, Human
gugcugugucuaucaggaauaa

SEQ ID NO: 123779 - RNA, 22 nt, Human
agggcugaagggaggugcucau

SEQ ID NO: 123780 - RNA, 22 nt, Human
gggaggaaaugugcagcgaauu

SEQ ID NO: 123781 - RNA, 22 nt, Human
gaaggccugugguagugagacg

SEQ ID NO: 123782 - RNA, 22 nt, Human
aguggcagagaccccagccagc

SEQ ID NO: 123783 - RNA, 22 nt, Human
cauuaaacaaccuugaaucaau

SEQ ID NO: 123784 - RNA, 22 nt, Human
ggggaggaagcuggaacacggg

SEQ ID NO: 123785 - RNA, 22 nt, Human
auuauaugugggauagaauuua

SEQ ID NO: 123786 - RNA, 22 nt, Human
agguauauugaaugcuuacuua

SEQ ID NO: 123787 - RNA, 20 nt, Human
gcaugaggaaucauugcagc

SEQ ID NO: 123788 - RNA, 22 nt, Human
ggccaggcuggucucagacuuc

SEQ ID NO: 123789 - RNA, 22 nt, Human
aaggagucugggccauucagag

SEQ ID NO: 123790 - RNA, 22 nt, Human
uuuaccaaauagauuaugucag

SEQ ID NO: 123791 - RNA, 22 nt, Human
gagagugaggccugggaaucua

SEQ ID NO: 123792 - RNA, 22 nt, Human
aggcaggucacaugcuuggcga

SEQ ID NO: 123793 - RNA, 22 nt, Human
gaagagcuaaaggcacaggcuu

SEQ ID NO: 123794 - RNA, 22 nt, Human
acccuguaugcuauaucccuaa

SEQ ID NO: 123795 - RNA, 22 nt, Human
agggcagagggugccucaccug

SEQ ID NO: 123796 - RNA, 19 nt, Human
agggucaggacaaggacuu

SEQ ID NO: 123797 - RNA, 22 nt, Human
auuaaauuggacgcugggggaa

SEQ ID NO: 123798 - RNA, 22 nt, Human
acagugauugggguaucugcag

SEQ ID NO: 123799 - RNA, 22 nt, Human
caggcagagucagauuagacuu

SEQ ID NO: 123800 - RNA, 22 nt, Human
uuucugcauauguauguaugga

SEQ ID NO: 123801 - RNA, 22 nt, Human
uuacucagucucccauacauug

SEQ ID NO: 123802 - RNA, 22 nt, Human
gaaggagaggauugugaggcug

SEQ ID NO: 123803 - RNA, 22 nt, Human
aacaguacuggacaaggaguca

SEQ ID NO: 123804 - RNA, 22 nt, Human
ucaguggaacugucugggugag

SEQ ID NO: 123805 - RNA, 22 nt, Human
aauacugccugugagguaacuc

SEQ ID NO: 123806 - RNA, 19 nt, Human
uucauucucuuauuguugu

SEQ ID NO: 123807 - RNA, 22 nt, Human
uucagaaaucgaguuucauguc

SEQ ID NO: 123808 - RNA, 22 nt, Human
gggcagagaaauggacaguugg

SEQ ID NO: 123809 - RNA, 22 nt, Human
accaaaaauuguggggcugaau

SEQ ID NO: 123810 - RNA, 22 nt, Human
ucuuuugugauucuucaguuac

SEQ ID NO: 123811 - RNA, 22 nt, Human
gaguggagaucgugccacugca

SEQ ID NO: 123812 - RNA, 22 nt, Human
ggcugugccucuggcagcacau

SEQ ID NO: 123813 - RNA, 22 nt, Human
gggcugagcacauacugacagc

SEQ ID NO: 123814 - RNA, 22 nt, Human
cuguggcauugccgaggcuggc

SEQ ID NO: 123815 - RNA, 22 nt, Human
cccuuccuccucgccugucaga

SEQ ID NO: 123816 - RNA, 22 nt, Human
aaauggaagcuauuuaugauuc

SEQ ID NO: 123817 - RNA, 22 nt, Human
aggcugaggaucguacuuucca

SEQ ID NO: 123818 - RNA, 22 nt, Human
aguggcaguggggcagggcccu

SEQ ID NO: 123819 - RNA, 22 nt, Human
uagccgggugugguggaacucc

SEQ ID NO: 123820 - RNA, 22 nt, Human
cugagcugagccaaaucugucu

SEQ ID NO: 123821 - RNA, 22 nt, Human
gaggggucacaugggcuggcuu

SEQ ID NO: 123822 - RNA, 22 nt, Human
gugcagugacccuggagagcug

SEQ ID NO: 123823 - RNA, 18 nt, Human
cagaggagagacauucag

SEQ ID NO: 123824 - RNA, 22 nt, Human
agugcagaguacauuuguggca

SEQ ID NO: 123825 - RNA, 22 nt, Human
gaggccagaagucugagaucag

SEQ ID NO: 123826 - RNA, 22 nt, Human
ucaccagggagcuuguccucug

SEQ ID NO: 123827 - RNA, 22 nt, Human
uggaagaauaggauagaagaac

SEQ ID NO: 123828 - RNA, 22 nt, Human
auuacaguaaaugcuacaggca

SEQ ID NO: 123829 - RNA, 22 nt, Human
cauggaacuguauaaaggcacu

SEQ ID NO: 123830 - RNA, 22 nt, Human
aaggugugaagagaugggaaga

SEQ ID NO: 123831 - RNA, 22 nt, Human
uuucacaauuuuaaggagcaaa

SEQ ID NO: 123832 - RNA, 22 nt, Human
uucaucuggucuaguuuuuagu

SEQ ID NO: 123833 - RNA, 22 nt, Human
gaugaggcucaugcacccugcg

SEQ ID NO: 123834 - RNA, 22 nt, Human
auaugaauuuggcuggaaaggu

SEQ ID NO: 123835 - RNA, 22 nt, Human
uacaacaguaaucaagguuuuu

SEQ ID NO: 123836 - RNA, 22 nt, Human
aggaaagcucccaguagggcuc

SEQ ID NO: 123837 - RNA, 22 nt, Human
agcugccccaugagaggcaggu

SEQ ID NO: 123838 - RNA, 22 nt, Human
ggcagaggugaaguucacaagg

SEQ ID NO: 123839 - RNA, 22 nt, Human
aguaaacagaaagcaagaugau

SEQ ID NO: 123840 - RNA, 22 nt, Human
aagccacugagauuucacugca

SEQ ID NO: 123841 - RNA, 22 nt, Human
acuaaaugagauacugucuuca

SEQ ID NO: 123842 - RNA, 22 nt, Human
cauguuaaaauauacauucuga

SEQ ID NO: 123843 - RNA, 22 nt, Human
augcacaggaccacacauaaug

SEQ ID NO: 123844 - RNA, 22 nt, Human
acaacauucuuaaauacacuga

SEQ ID NO: 123845 - RNA, 22 nt, Human
gcagccucagggcacucagaug

SEQ ID NO: 123846 - RNA, 22 nt, Human
gucccaggaguugcugggccuu

SEQ ID NO: 123847 - RNA, 22 nt, Human
ccagagagaaaauggagggcca

SEQ ID NO: 123848 - RNA, 22 nt, Human
cauuugcagagggugacacucu

SEQ ID NO: 123849 - RNA, 22 nt, Human
aaagaacaauguggaaucuccu

SEQ ID NO: 123850 - RNA, 22 nt, Human
gagggcuguggggcaugaccag

SEQ ID NO: 123851 - RNA, 22 nt, Human
cagggcagaaggcacucuacuc

SEQ ID NO: 123852 - RNA, 22 nt, Human
ccagagagucgaugggggacac

SEQ ID NO: 123853 - RNA, 22 nt, Human
gcacauaacugaccacaucuaa

SEQ ID NO: 123854 - RNA, 20 nt, Human
aggcucagagcaguaguaca

SEQ ID NO: 123855 - RNA, 20 nt, Human
cugcuguguuauuguagaac

SEQ ID NO: 123856 - RNA, 22 nt, Human
aacccgggaggcagagguugug

SEQ ID NO: 123857 - RNA, 22 nt, Human
uggagagcgugcuuagcacucu

SEQ ID NO: 123858 - RNA, 22 nt, Human
ucugggggaggaggcauggccc

SEQ ID NO: 123859 - RNA, 20 nt, Human
aaacauucauguacaaguga

SEQ ID NO: 123860 - RNA, 22 nt, Human
uggaaauauuugcucauuaucu

SEQ ID NO: 123861 - RNA, 19 nt, Human
gggcggagccugaccuggg

SEQ ID NO: 123862 - RNA, 22 nt, Human
gcuguggcugaccaccaggggg

SEQ ID NO: 123863 - RNA, 22 nt, Human
aggagucagauuguuugaaugu

SEQ ID NO: 123864 - RNA, 22 nt, Human
agauguggccggcuagggagag

SEQ ID NO: 123865 - RNA, 22 nt, Human
uuucugcucgcucucaaucagg

SEQ ID NO: 123866 - RNA, 22 nt, Human
ggcugugccucaaggcuacuca

SEQ ID NO: 123867 - RNA, 22 nt, Human
uucacuguccugcaacucuaga

SEQ ID NO: 123868 - RNA, 22 nt, Human
agauuaugcuggcugcuacaag

SEQ ID NO: 123869 - RNA, 20 nt, Human
uccugggguaagccaugguc

SEQ ID NO: 123870 - RNA, 22 nt, Human
aggcaggccccugagaauagac

SEQ ID NO: 123871 - RNA, 22 nt, Human
aacauguaaauaucauuguacu

SEQ ID NO: 123872 - RNA, 22 nt, Human
cagagcauaauugacaugaggu

SEQ ID NO: 123873 - RNA, 22 nt, Human
caggcagccugcggucugcaca

SEQ ID NO: 123874 - RNA, 22 nt, Human
auggcagggcagccucucagag

SEQ ID NO: 123875 - RNA, 22 nt, Human
acaacaguaggaaaacaugucu

SEQ ID NO: 123876 - RNA, 22 nt, Human
gaggcugggaaguccaagauca

SEQ ID NO: 123877 - RNA, 22 nt, Human
caggcaggucagugaagaagga

SEQ ID NO: 123878 - RNA, 23 nt, Human
gcagaggagcaagcuggacacca

SEQ ID NO: 123879 - RNA, 22 nt, Human
agcuguggcagcagccguggca

SEQ ID NO: 123880 - RNA, 23 nt, Human
cagagcuggcucagagcugccug

SEQ ID NO: 123881 - RNA, 22 nt, Human
cagggcaggaugcugugauuau

SEQ ID NO: 123882 - RNA, 22 nt, Human
caggggaaggagccuugaaacu

SEQ ID NO: 123883 - RNA, 22 nt, Human
ugcagggccuuguugaugugcu

SEQ ID NO: 123884 - RNA, 22 nt, Human
gugagcaggauaggggcucccu

SEQ ID NO: 123885 - RNA, 17 nt, Human
uuagagcuacauguuga

SEQ ID NO: 123886 - RNA, 22 nt, Human
ggcagaguugguggagucaguu

SEQ ID NO: 123887 - RNA, 22 nt, Human
uagggcugugucuccaggacca

SEQ ID NO: 123888 - RNA, 22 nt, Human
auuaaagacagcagauggaugg

SEQ ID NO: 123889 - RNA, 22 nt, Human
gguugguaacucccugugcagu

SEQ ID NO: 123890 - RNA, 22 nt, Human
augcugugccuggaaagcggcu

SEQ ID NO: 123891 - RNA, 22 nt, Human
gcagggcacaaggacgcacagg

SEQ ID NO: 123892 - RNA, 22 nt, Human
uagaggcauuaaugaauaaaca

SEQ ID NO: 123893 - RNA, 22 nt, Human
auucacaaagaagggaaguaca

SEQ ID NO: 123894 - RNA, 22 nt, Human
uuugauucuguaaaauaacagg

SEQ ID NO: 123895 - RNA, 22 nt, Human
gccuuaggggucagacagagcu

SEQ ID NO: 123896 - RNA, 22 nt, Human
gggcaguagcuucguaggcauc

SEQ ID NO: 123897 - RNA, 22 nt, Human
ugcagggcuccuggcuccaauc

SEQ ID NO: 123898 - RNA, 22 nt, Human
cagcaggaccauugaggcauca

SEQ ID NO: 123899 - RNA, 22 nt, Human
acauucauugagcaacaacaau

SEQ ID NO: 123900 - RNA, 22 nt, Human
ccaguggacuucucccuguggu

SEQ ID NO: 123901 - RNA, 22 nt, Human
aaagccagggacagugugcaug

SEQ ID NO: 123902 - RNA, 22 nt, Human
uggcagaggaggcucagauuga

SEQ ID NO: 123903 - RNA, 22 nt, Human
aaauggaaguguauuuaguguu

SEQ ID NO: 123904 - RNA, 22 nt, Human
agggccagcugcagaauuagca

SEQ ID NO: 123905 - RNA, 22 nt, Human
agaauuagaggccauguacuug

SEQ ID NO: 123906 - RNA, 22 nt, Human
ccuggaggcucugggagggcag

SEQ ID NO: 123907 - RNA, 22 nt, Human
uguggcagaaccagaauucaaa

SEQ ID NO: 123908 - RNA, 21 nt, Human
auacauucuauuaagcauuua

SEQ ID NO: 123909 - RNA, 22 nt, Human
agcacccucagccuuauccaga

SEQ ID NO: 123910 - RNA, 22 nt, Human
gggccagguggaccccagccuc

SEQ ID NO: 123911 - RNA, 22 nt, Human
uucacaaagcuggagcauuucc

SEQ ID NO: 123912 - RNA, 22 nt, Human
aaggaaaggaugagcaugcauu

SEQ ID NO: 123913 - RNA, 22 nt, Human
caugucuugcccugauuaguag

SEQ ID NO: 123914 - RNA, 22 nt, Human
uuuguacauccuaauucugagu

SEQ ID NO: 123915 - RNA, 22 nt, Human
acagccuggccugaguuaaggc

SEQ ID NO: 123916 - RNA, 22 nt, Human
ucaaaggcccauugucccguug

SEQ ID NO: 123917 - RNA, 23 nt, Human
agggcugaugccauugcagcucu

SEQ ID NO: 123918 - RNA, 21 nt, Human
gccaaggggguagcuauuccu

SEQ ID NO: 123919 - RNA, 22 nt, Human
ggggccagcuucgcgugcucuu

SEQ ID NO: 123920 - RNA, 22 nt, Human
ucugugcagauguagaccaguu

SEQ ID NO: 123921 - RNA, 22 nt, Human
agugcaugccuuccuguggaug

SEQ ID NO: 123922 - RNA, 22 nt, Human
ugagcuuuguuguuaguauauu

SEQ ID NO: 123923 - RNA, 22 nt, Human
ugaggaagggugugacggcacc

SEQ ID NO: 123924 - RNA, 22 nt, Human
ugcaaauauuuccuuauagcca

SEQ ID NO: 123925 - RNA, 22 nt, Human
aucagaagaaauggaugugacu

SEQ ID NO: 123926 - RNA, 22 nt, Human
acauuucagauucaugaaguga

SEQ ID NO: 123927 - RNA, 22 nt, Human
gagugcaggccugagcaccauc

SEQ ID NO: 123928 - RNA, 23 nt, Human
cagggcccugcucaauuucucca

SEQ ID NO: 123929 - RNA, 22 nt, Human
augaggcaucugcagucacuag

SEQ ID NO: 123930 - RNA, 22 nt, Human
ccagccugaaaugccucauccu

SEQ ID NO: 123931 - RNA, 22 nt, Human
acacacuguugcucauccaggc

SEQ ID NO: 123932 - RNA, 22 nt, Human
agugggaggcggcugacgggcg

SEQ ID NO: 123933 - RNA, 22 nt, Human
cagugcaggcugggggcccugc

SEQ ID NO: 123934 - RNA, 22 nt, Human
augggcaguaacaguggcaguc

SEQ ID NO: 123935 - RNA, 22 nt, Human
auucacaauuagaaguagauaa

SEQ ID NO: 123936 - RNA, 23 nt, Human
gaagccacacaaaggucgccaag

SEQ ID NO: 123937 - RNA, 22 nt, Human
uuugauauccuauacaaguaaa

SEQ ID NO: 123938 - RNA, 22 nt, Human
uacugugcaaaaaugaauauug

SEQ ID NO: 123939 - RNA, 22 nt, Human
cacaucuucuuaacuccaaagu

SEQ ID NO: 123940 - RNA, 22 nt, Human
aaguggagcuauaggcucagau

SEQ ID NO: 123941 - RNA, 22 nt, Human
gcagaaggauccgcaggugcaa

SEQ ID NO: 123942 - RNA, 22 nt, Human
cuuaaauucuuaaugcccucau

SEQ ID NO: 123943 - RNA, 21 nt, Human
agcagaggcugccuggugacu

SEQ ID NO: 123944 - RNA, 22 nt, Human
uucuguuugccauauauaguag

SEQ ID NO: 123945 - RNA, 22 nt, Human
ucucugucccuaggagccuugc

SEQ ID NO: 123946 - RNA, 22 nt, Human
aaacaugagcaucucuucaagc

SEQ ID NO: 123947 - RNA, 22 nt, Human
ucccacugugccuguuguaauc

SEQ ID NO: 123948 - RNA, 22 nt, Human
uggaauuuaguuaauuccauuu

SEQ ID NO: 123949 - RNA, 22 nt, Human
auggaaaugauggaacauuaaa

SEQ ID NO: 123950 - RNA, 22 nt, Human
uaggcugggaagaaagauucuc

SEQ ID NO: 123951 - RNA, 22 nt, Human
uguccuuuuggcugucuauggu

SEQ ID NO: 123952 - RNA, 23 nt, Human
ccucagggucuagcagagagaag

SEQ ID NO: 123953 - RNA, 22 nt, Human
acuauuagcauaucaugaaugg

SEQ ID NO: 123954 - RNA, 22 nt, Human
uuuaaauucugucugccgcuua

SEQ ID NO: 123955 - RNA, 22 nt, Human
uacagguaaaauuaucagaaac

SEQ ID NO: 123956 - RNA, 22 nt, Human
uggagauggguuaauggagaga

SEQ ID NO: 123957 - RNA, 22 nt, Human
auuccaaagacagaagcagcug

SEQ ID NO: 123958 - RNA, 22 nt, Human
ccagggcaauaggaacacuuuu

SEQ ID NO: 123959 - RNA, 21 nt, Human
cagaggcagguccugggacgg

SEQ ID NO: 123960 - RNA, 21 nt, Human
ccauaauuuuguuucagaagu

SEQ ID NO: 123961 - RNA, 22 nt, Human
agcgugaaggcgggcagucggc

SEQ ID NO: 123962 - RNA, 22 nt, Human
augcaagaaacagagacgcuga

SEQ ID NO: 123963 - RNA, 22 nt, Human
ggcagggcaggaaagucaggaa

SEQ ID NO: 123964 - RNA, 18 nt, Human
ugcccagaaaagcaggga

SEQ ID NO: 123965 - RNA, 19 nt, Human
agcuguggaugugggauuu

SEQ ID NO: 123966 - RNA, 22 nt, Human
caggaagcugugaaggagacgg

SEQ ID NO: 123967 - RNA, 22 nt, Human
aggacagguguagugggcucug

SEQ ID NO: 123968 - RNA, 22 nt, Human
cuaacauuuauugagcacuuag

SEQ ID NO: 123969 - RNA, 22 nt, Human
augaaucaagugagaacagcau

SEQ ID NO: 123970 - RNA, 22 nt, Human
ugcagggcagcuagggagcuuu

SEQ ID NO: 123971 - RNA, 22 nt, Human
gaggagcaugggaaggcucugg

SEQ ID NO: 123972 - RNA, 22 nt, Human
aaggcagaaauucaacuacugg

SEQ ID NO: 123973 - RNA, 22 nt, Human
gcugugcaaaucgauuuguugg

SEQ ID NO: 123974 - RNA, 22 nt, Human
uuacaugaauacauaaccauuc

SEQ ID NO: 123975 - RNA, 20 nt, Human
aaagucuguuuaucucugga

SEQ ID NO: 123976 - RNA, 18 nt, Human
ggcaugugagugcugagg

SEQ ID NO: 123977 - RNA, 22 nt, Human
acauuugucuuccuccucagug

SEQ ID NO: 123978 - RNA, 22 nt, Human
gggcaggugccagcucccuguc

SEQ ID NO: 123979 - RNA, 22 nt, Human
cugugaauuaaguauuguuauc

SEQ ID NO: 123980 - RNA, 22 nt, Human
augcagcuucaggauuaugaug

SEQ ID NO: 123981 - RNA, 22 nt, Human
uuucauuacguguuugacuugu

SEQ ID NO: 123982 - RNA, 22 nt, Human
cagagcugggaucccaugggcg

SEQ ID NO: 123983 - RNA, 22 nt, Human
ugaggcagguaagcaaguuuug

SEQ ID NO: 123984 - RNA, 22 nt, Human
uuauauacugugguaguacugu

SEQ ID NO: 123985 - RNA, 18 nt, Human
ucauuuugucugccuuug

SEQ ID NO: 123986 - RNA, 22 nt, Human
cauuuguaggaugcuucuuguu

SEQ ID NO: 123987 - RNA, 22 nt, Human
gaggaaaauauucagggagguu

SEQ ID NO: 123988 - RNA, 20 nt, Human
gugcugagggcugggcaaug

SEQ ID NO: 123989 - RNA, 22 nt, Human
auuauuuuaugugcggccugau

SEQ ID NO: 123990 - RNA, 22 nt, Human
cauuugcauaugaagaaguaag

SEQ ID NO: 123991 - RNA, 22 nt, Human
ggcucaccauggccucccugcu

SEQ ID NO: 123992 - RNA, 22 nt, Human
aggcagagagcaguggccgucu

SEQ ID NO: 123993 - RNA, 22 nt, Human
gagaaggcugauccuuggaguu

SEQ ID NO: 123994 - RNA, 22 nt, Human
agcagggcaguuaaaggguccu

SEQ ID NO: 123995 - RNA, 22 nt, Human
agaguuaagacguacaugagug

SEQ ID NO: 123996 - RNA, 22 nt, Human
agcagggcuuugucucugugaa

SEQ ID NO: 123997 - RNA, 22 nt, Human
aaugguuucaaacacacuaagu

SEQ ID NO: 123998 - RNA, 22 nt, Human
agacaacaugaucagcaguccu

SEQ ID NO: 123999 - RNA, 22 nt, Human
gaauacaagccugccaccugga

SEQ ID NO: 124000 - RNA, 22 nt, Human
aauaacagaaacuugagcauca

SEQ ID NO: 124001 - RNA, 18 nt, Human
uggagcugagugcugugc

SEQ ID NO: 124002 - RNA, 22 nt, Human
agguggcucugacagcucuggu

SEQ ID NO: 124003 - RNA, 21 nt, Human
acauuuucuguuuuaggaagu

SEQ ID NO: 124004 - RNA, 22 nt, Human
ugaagccauaggacagaggaua

SEQ ID NO: 124005 - RNA, 22 nt, Human
agggcugcugaggaagccuugc

SEQ ID NO: 124006 - RNA, 22 nt, Human
ucuguuuaugcauauuuaaaac

SEQ ID NO: 124007 - RNA, 22 nt, Human
uuacuguacuagugagacuagg

SEQ ID NO: 124008 - RNA, 22 nt, Human
auguuuuauauuuugcagcagu

SEQ ID NO: 124009 - RNA, 23 nt, Human
uccuggugacaugccugagcauc

SEQ ID NO: 124010 - RNA, 22 nt, Human
cagggcuggcuguggcaaucuc

SEQ ID NO: 124011 - RNA, 22 nt, Human
ugagccaggaguuugaggcugu

SEQ ID NO: 124012 - RNA, 22 nt, Human
uuuaugcagccucaguaucaga

SEQ ID NO: 124013 - RNA, 22 nt, Human
acacuggaggguccagggaugu

SEQ ID NO: 124014 - RNA, 22 nt, Human
acaguagcuaauauugcauuau

SEQ ID NO: 124015 - RNA, 22 nt, Human
agugccuugugugugggcagcc

SEQ ID NO: 124016 - RNA, 22 nt, Human
aucagaagcuuguagucucucu

SEQ ID NO: 124017 - RNA, 22 nt, Human
cagugcccuuccaggacugcag

SEQ ID NO: 124018 - RNA, 22 nt, Human
uggcagagugcggcauccccug

SEQ ID NO: 124019 - RNA, 22 nt, Human
ugguagggacacuaugcagaaa

SEQ ID NO: 124020 - RNA, 22 nt, Human
uagccaggucacacuguguguu

SEQ ID NO: 124021 - RNA, 18 nt, Human
aaacagugccuaaguguc

SEQ ID NO: 124022 - RNA, 21 nt, Human
agaagccaugugguggagaac

SEQ ID NO: 124023 - RNA, 21 nt, Human
uguaaguuucaucugaauugg

SEQ ID NO: 124024 - RNA, 22 nt, Human
ggcaccaggcugggcauaggcc

SEQ ID NO: 124025 - RNA, 22 nt, Human
gcagagcagcaaauggaaagga

SEQ ID NO: 124026 - RNA, 20 nt, Human
uaacaggaagcauuauuuua

SEQ ID NO: 124027 - RNA, 22 nt, Human
gagaggaguaggcugauggugc

SEQ ID NO: 124028 - RNA, 22 nt, Human
auucacuagguugcaaaacugu

SEQ ID NO: 124029 - RNA, 22 nt, Human
ugccaggcugucaauucaccca

SEQ ID NO: 124030 - RNA, 19 nt, Human
cugggggugcucacgcucu

SEQ ID NO: 124031 - RNA, 22 nt, Human
caguggcagagaacagagaccu

SEQ ID NO: 124032 - RNA, 22 nt, Human
accaugggucagccaccucagc

SEQ ID NO: 124033 - RNA, 22 nt, Human
aagagccagcuagugaagaggc

SEQ ID NO: 124034 - RNA, 19 nt, Human
aggucauugauagugcagg

SEQ ID NO: 124035 - RNA, 22 nt, Human
ugagaucucugccuauauggau

SEQ ID NO: 124036 - RNA, 22 nt, Human
aguaaacaguaucuuuaguguc

SEQ ID NO: 124037 - RNA, 22 nt, Human
ucccaggcuggggccaggugac

SEQ ID NO: 124038 - RNA, 21 nt, Human
uggcugaguggaugcaugaau

SEQ ID NO: 124039 - RNA, 22 nt, Human
ggcugaggcucaugccaucuug

SEQ ID NO: 124040 - RNA, 22 nt, Human
acagugaugagccggcugaggc

SEQ ID NO: 124041 - RNA, 22 nt, Human
ucuugcacuucaugaauauguu

SEQ ID NO: 124042 - RNA, 22 nt, Human
cugaucaugugggaggauaugu

SEQ ID NO: 124043 - RNA, 22 nt, Human
acaugauuugcaugauuuguaa

SEQ ID NO: 124044 - RNA, 22 nt, Human
ugaggcaggaugcuugcacagg

SEQ ID NO: 124045 - RNA, 22 nt, Human
gggagggucugccaugcucccu

SEQ ID NO: 124046 - RNA, 22 nt, Human
ccagggcugcugugggacucca

SEQ ID NO: 124047 - RNA, 22 nt, Human
aauagugcugcuguggacaugg

SEQ ID NO: 124048 - RNA, 22 nt, Human
ucugugcagaaucaaggagcuu

SEQ ID NO: 124049 - RNA, 22 nt, Human
ugagaugcugcuguaacaaaua

SEQ ID NO: 124050 - RNA, 22 nt, Human
agcacccuccaacuucccugua

SEQ ID NO: 124051 - RNA, 22 nt, Human
ggcaguggaggacccugugucu

SEQ ID NO: 124052 - RNA, 22 nt, Human
caggcagaaggaaguaccaggc

SEQ ID NO: 124053 - RNA, 22 nt, Human
ugacauuuaagccucugauuuc

SEQ ID NO: 124054 - RNA, 22 nt, Human
agcugaaucucaggcauccuuu

SEQ ID NO: 124055 - RNA, 22 nt, Human
ucucccaggcugcccuguggac

SEQ ID NO: 124056 - RNA, 22 nt, Human
cuccucuuuacccgcauggucu

SEQ ID NO: 124057 - RNA, 22 nt, Human
auuuccacauaagggaaauaag

SEQ ID NO: 124058 - RNA, 22 nt, Human
ugaggcaguauucuccauucca

SEQ ID NO: 124059 - RNA, 22 nt, Human
acaauuugaggcuacucaauug

SEQ ID NO: 124060 - RNA, 22 nt, Human
gaggcacaucacuuggugcauu

SEQ ID NO: 124061 - RNA, 22 nt, Human
uugauacauagcacaguuuagg

SEQ ID NO: 124062 - RNA, 19 nt, Human
uuuucucagcuucuagcgg

SEQ ID NO: 124063 - RNA, 22 nt, Human
cuauuacauuucuggacauuca

SEQ ID NO: 124064 - RNA, 22 nt, Human
gcacaggcacagagggccacug

SEQ ID NO: 124065 - RNA, 22 nt, Human
ugaaacauuauagaauauuuau

SEQ ID NO: 124066 - RNA, 22 nt, Human
acauaugcucaucugcauuccc

SEQ ID NO: 124067 - RNA, 22 nt, Human
agaguggagagaaacaacucug

SEQ ID NO: 124068 - RNA, 19 nt, Human
uccuggggauguggucacc

SEQ ID NO: 124069 - RNA, 20 nt, Human
agcauuugaaauaugacuau

SEQ ID NO: 124070 - RNA, 22 nt, Human
uggagaaggacagccugagaaa

SEQ ID NO: 124071 - RNA, 22 nt, Human
gugugcagucugcuaggcaggg

SEQ ID NO: 124072 - RNA, 22 nt, Human
aacaggcaacaguugacucuga

SEQ ID NO: 124073 - RNA, 22 nt, Human
aacaugauuggaaaaugcuguc

SEQ ID NO: 124074 - RNA, 22 nt, Human
uuucacaaacugaggagacaau

SEQ ID NO: 124075 - RNA, 21 nt, Human
aagccagcccacagugguuug

SEQ ID NO: 124076 - RNA, 22 nt, Human
gaggggaaagugugaggcugcg

SEQ ID NO: 124077 - RNA, 22 nt, Human
ucaauuacagugucaccuuaag

SEQ ID NO: 124078 - RNA, 20 nt, Human
ugcagggcucugcuucucuc

SEQ ID NO: 124079 - RNA, 22 nt, Human
auacaguaauugcauaggcuuc

SEQ ID NO: 124080 - RNA, 22 nt, Human
uacagucagagugccuuucuaa

SEQ ID NO: 124081 - RNA, 22 nt, Human
aacauuuguuuggcuucaauua

SEQ ID NO: 124082 - RNA, 22 nt, Human
ugucauuaguuucagccauucu

SEQ ID NO: 124083 - RNA, 22 nt, Human
auaggaaagaaaauuauguagg

SEQ ID NO: 124084 - RNA, 22 nt, Human
cagaggcacagcuucuuuuaau

SEQ ID NO: 124085 - RNA, 20 nt, Human
ggggcaguggcucaugccug

SEQ ID NO: 124086 - RNA, 18 nt, Human
acagaggcagacauguau

SEQ ID NO: 124087 - RNA, 22 nt, Human
ucagaggaacacuguuucaugc

SEQ ID NO: 124088 - RNA, 22 nt, Human
ucuuccugaaacccuguuccag

SEQ ID NO: 124089 - RNA, 23 nt, Human
cugcuguguuggucucgauggga

SEQ ID NO: 124090 - RNA, 22 nt, Human
agaggaggcagcuuaacucagu

SEQ ID NO: 124091 - RNA, 22 nt, Human
ccuaggcccuaggcuuccauca

SEQ ID NO: 124092 - RNA, 23 nt, Human
ugagaagccauuagagcaggugg

SEQ ID NO: 124093 - RNA, 22 nt, Human
uggagcagcacaagaaagggga

SEQ ID NO: 124094 - RNA, 22 nt, Human
ugagaacuugugcuauugcaca

SEQ ID NO: 124095 - RNA, 22 nt, Human
cucugugagggucuguacagaa

SEQ ID NO: 124096 - RNA, 22 nt, Human
uguuauacuauuuagagguaca

SEQ ID NO: 124097 - RNA, 22 nt, Human
ggcagugaacagaaaugcagaa

SEQ ID NO: 124098 - RNA, 22 nt, Human
ugggcagcauccuccacaguca

SEQ ID NO: 124099 - RNA, 22 nt, Human
acauucuuucgaugucugauuu

SEQ ID NO: 124100 - RNA, 22 nt, Human
ugcaaauaagcuauuauggaau

SEQ ID NO: 124101 - RNA, 22 nt, Human
cuccagugggggugagccuaga

SEQ ID NO: 124102 - RNA, 19 nt, Human
ugauucaucuaacugccuc

SEQ ID NO: 124103 - RNA, 22 nt, Human
uugaaacaguagcucauagacc

SEQ ID NO: 124104 - RNA, 22 nt, Human
uauaugcagauuuucaucaucg

SEQ ID NO: 124105 - RNA, 21 nt, Human
auuuccaaggguaccuaagau

SEQ ID NO: 124106 - RNA, 22 nt, Human
auggggcugaaacauggaagag

SEQ ID NO: 124107 - RNA, 21 nt, Human
ucagggcagcugcucuucaga

SEQ ID NO: 124108 - RNA, 22 nt, Human
agaugcugucacacacacuguu

SEQ ID NO: 124109 - RNA, 22 nt, Human
auuaaacaauguaaaguucuug

SEQ ID NO: 124110 - RNA, 22 nt, Human
gugccaggcccagggagcgggg

SEQ ID NO: 124111 - RNA, 22 nt, Human
ggagcagggaauuacagcgcag

SEQ ID NO: 124112 - RNA, 22 nt, Human
uuugaucaugaagaggauaaac

SEQ ID NO: 124113 - RNA, 20 nt, Human
ucugugcaccugcuacaagg

SEQ ID NO: 124114 - RNA, 16 nt, Human
gagggcagaggcggaa

SEQ ID NO: 124115 - RNA, 22 nt, Human
gugaauggggcaggaaggaugg

SEQ ID NO: 124116 - RNA, 22 nt, Human
agggcugagcccaggcauguag

SEQ ID NO: 124117 - RNA, 22 nt, Human
ugcagggcccucauuccugucc

SEQ ID NO: 124118 - RNA, 22 nt, Human
uacaucauggugagcaggaggc

SEQ ID NO: 124119 - RNA, 22 nt, Human
uaggcagaaaggaaggcaaguu

SEQ ID NO: 124120 - RNA, 22 nt, Human
augauugaaaaugacauugcca

SEQ ID NO: 124121 - RNA, 22 nt, Human
cugugacuagaccugcaggaga

SEQ ID NO: 124122 - RNA, 22 nt, Human
auacacuaaucaugugcucagu

SEQ ID NO: 124123 - RNA, 22 nt, Human
ucugugcauuucaggaccugaa

SEQ ID NO: 124124 - RNA, 22 nt, Human
gcagaagcugggcagcgaggug

SEQ ID NO: 124125 - RNA, 22 nt, Human
guacauucagcuuagcacuucu

SEQ ID NO: 124126 - RNA, 22 nt, Human
ugggacuuguguggcaguauuu

SEQ ID NO: 124127 - RNA, 22 nt, Human
ucccaaggauaagagagucuga

SEQ ID NO: 124128 - RNA, 22 nt, Human
aaauagcacagcagcugaggcu

SEQ ID NO: 124129 - RNA, 22 nt, Human
auuuaucaacauguaccauugg

SEQ ID NO: 124130 - RNA, 22 nt, Human
cugacucccaaagaggacgcgu

SEQ ID NO: 124131 - RNA, 20 nt, Human
uuucacaucugucccuuuaa

SEQ ID NO: 124132 - RNA, 22 nt, Human
gcagggcagaccuccagccuau

SEQ ID NO: 124133 - RNA, 22 nt, Human
gacaucaugucacuaacugcua

SEQ ID NO: 124134 - RNA, 22 nt, Human
agggaggcaggaaaguugucug

SEQ ID NO: 124135 - RNA, 22 nt, Human
agaagcugagaaugaauuaaga

SEQ ID NO: 124136 - RNA, 22 nt, Human
agccaggcagggcucucgcucu

SEQ ID NO: 124137 - RNA, 17 nt, Human
uggcacagaggugcuau

SEQ ID NO: 124138 - RNA, 22 nt, Human
aaugucugcucuacucaggagg

SEQ ID NO: 124139 - RNA, 22 nt, Human
aagcuggacucugccauuuacu

SEQ ID NO: 124140 - RNA, 22 nt, Human
ugaggcagaguaagauacauga

SEQ ID NO: 124141 - RNA, 22 nt, Human
acaugaagcaagaaagaugcua

SEQ ID NO: 124142 - RNA, 22 nt, Human
cagaaggcauagaugaaggccu

SEQ ID NO: 124143 - RNA, 18 nt, Human
gcaaggcucaggccaggc

SEQ ID NO: 124144 - RNA, 22 nt, Human
gaacauuuggauuuguaaauuu

SEQ ID NO: 124145 - RNA, 22 nt, Human
auuguuaugaaaauaagauguu

SEQ ID NO: 124146 - RNA, 22 nt, Human
gggcugacaaccaucugacaag

SEQ ID NO: 124147 - RNA, 20 nt, Human
ccagguggugccuggagagg

SEQ ID NO: 124148 - RNA, 21 nt, Human
ucucacaauaugaugccagau

SEQ ID NO: 124149 - RNA, 22 nt, Human
gaauucugucgcuuacuagaug

SEQ ID NO: 124150 - RNA, 22 nt, Human
cauguauacaguagaauacuau

SEQ ID NO: 124151 - RNA, 22 nt, Human
uuugacaaaggaaaaaugcaca

SEQ ID NO: 124152 - RNA, 22 nt, Human
aagggcaggcagagaucauaua

SEQ ID NO: 124153 - RNA, 19 nt, Human
aggcagcauucuggggcuu

SEQ ID NO: 124154 - RNA, 22 nt, Human
ugggcagccaucccagccucuc

SEQ ID NO: 124155 - RNA, 17 nt, Human
agccaggcauaugaagu

SEQ ID NO: 124156 - RNA, 22 nt, Human
ggugaggaaagauggugacagu

SEQ ID NO: 124157 - RNA, 22 nt, Human
aggcgcagacauacagggucug

SEQ ID NO: 124158 - RNA, 22 nt, Human
agggaggucuuugaggggcuua

SEQ ID NO: 124159 - RNA, 22 nt, Human
ucaggcugcaucuguaagggug

SEQ ID NO: 124160 - RNA, 22 nt, Human
auggaguucugccagcgcugcu

SEQ ID NO: 124161 - RNA, 22 nt, Human
gaggagaaagcagugauuugug

SEQ ID NO: 124162 - RNA, 22 nt, Human
uugauacaggcucuauuucauc

SEQ ID NO: 124163 - RNA, 22 nt, Human
ugcaaaugggugaggguuagga

SEQ ID NO: 124164 - RNA, 22 nt, Human
cgaggcagacaaaaguuggaag

SEQ ID NO: 124165 - RNA, 23 nt, Human
uuggaaauggggagaacagauuc

SEQ ID NO: 124166 - RNA, 22 nt, Human
cauaauuuuccaugguuugcua

SEQ ID NO: 124167 - RNA, 22 nt, Human
auuccaaacagugcugcagacu

SEQ ID NO: 124168 - RNA, 22 nt, Human
ggagggaguuucauuccugccc

SEQ ID NO: 124169 - RNA, 22 nt, Human
cugcugugcaggugccuaugau

SEQ ID NO: 124170 - RNA, 22 nt, Human
caggaagagaacauggaggcug

SEQ ID NO: 124171 - RNA, 22 nt, Human
uggcaggaggaugaggcggcua

SEQ ID NO: 124172 - RNA, 22 nt, Human
ugcaggaauuuuuugcagaaag

SEQ ID NO: 124173 - RNA, 22 nt, Human
ccagugcccagcugcccaggca

SEQ ID NO: 124174 - RNA, 22 nt, Human
augcauuugacgggauauauuu

SEQ ID NO: 124175 - RNA, 22 nt, Human
cagacagagcucacaagucuuu

SEQ ID NO: 124176 - RNA, 22 nt, Human
aggcucagccugggccuagagc

SEQ ID NO: 124177 - RNA, 23 nt, Human
agcagcaaaaauuuaucuuucug

SEQ ID NO: 124178 - RNA, 22 nt, Human
guggcagagggugagcuggacu

SEQ ID NO: 124179 - RNA, 22 nt, Human
agcagggcagcugaugcgcacg

SEQ ID NO: 124180 - RNA, 22 nt, Human
aaugcaaacuccacuggagcag

SEQ ID NO: 124181 - RNA, 22 nt, Human
gaggcacauauauacagagccc

SEQ ID NO: 124182 - RNA, 22 nt, Human
gugugccaccagucaaggugaa

SEQ ID NO: 124183 - RNA, 22 nt, Human
agcaggaaggucugugugaguc

SEQ ID NO: 124184 - RNA, 22 nt, Human
agugucagcuaauuauucauga

SEQ ID NO: 124185 - RNA, 22 nt, Human
uccuggggaggucgaggcugag

SEQ ID NO: 124186 - RNA, 22 nt, Human
cuggaaguauaggggagaugau

SEQ ID NO: 124187 - RNA, 22 nt, Human
aggcugugagcaagaacaccua

SEQ ID NO: 124188 - RNA, 22 nt, Human
agcuaagcucucagauacuaag

SEQ ID NO: 124189 - RNA, 22 nt, Human
aaagcaaugggucuaagguaaa

SEQ ID NO: 124190 - RNA, 22 nt, Human
cagugaaguuuaaaguguagau

SEQ ID NO: 124191 - RNA, 22 nt, Human
uacagugaggugguuuccuuua

SEQ ID NO: 124192 - RNA, 22 nt, Human
uggcagagcaaaaagauagaau

SEQ ID NO: 124193 - RNA, 22 nt, Human
cauuacaucuuugaugcaguau

SEQ ID NO: 124194 - RNA, 22 nt, Human
ugaucaaagugcuggaauuaca

SEQ ID NO: 124195 - RNA, 22 nt, Human
uagaggcacccuggaggagacu

SEQ ID NO: 124196 - RNA, 22 nt, Human
acacugugacaaaggcuguucu

SEQ ID NO: 124197 - RNA, 22 nt, Human
agucagcagugaaagcacagcc

SEQ ID NO: 124198 - RNA, 20 nt, Human
agcaccagugggggcagccc

SEQ ID NO: 124199 - RNA, 22 nt, Human
ggcaggcaguguggugugaaac

SEQ ID NO: 124200 - RNA, 19 nt, Human
agugagcauggcuugacug

SEQ ID NO: 124201 - RNA, 22 nt, Human
agcagggcuuugcagacuuggg

SEQ ID NO: 124202 - RNA, 20 nt, Human
aagggagaauaaugauugua

SEQ ID NO: 124203 - RNA, 22 nt, Human
gauaacuacacuuaagacaacc

SEQ ID NO: 124204 - RNA, 22 nt, Human
aggaaccagagguugagcaacu

SEQ ID NO: 124205 - RNA, 22 nt, Human
acagccuguguaccagcuggga

SEQ ID NO: 124206 - RNA, 22 nt, Human
aaguggugguaugaaccgaggg

SEQ ID NO: 124207 - RNA, 22 nt, Human
caaaggcuuccacugcauccuu

SEQ ID NO: 124208 - RNA, 22 nt, Human
aggcaggcaaccaccugggaag

SEQ ID NO: 124209 - RNA, 22 nt, Human
cugccaggggccucacaggcca

SEQ ID NO: 124210 - RNA, 20 nt, Human
gcagggcaagggauaugaaa

SEQ ID NO: 124211 - RNA, 22 nt, Human
auuugcaauuuuacuuugcagu

SEQ ID NO: 124212 - RNA, 22 nt, Human
ucugaagggcugaguggaggag

SEQ ID NO: 124213 - RNA, 20 nt, Human
uggcaggaggcagcagugga

SEQ ID NO: 124214 - RNA, 22 nt, Human
ugaggcaguugagcuuccugag

SEQ ID NO: 124215 - RNA, 22 nt, Human
ccugagggcucagcccccagcc

SEQ ID NO: 124216 - RNA, 18 nt, Human
ugaauuaguuugugguuu

SEQ ID NO: 124217 - RNA, 22 nt, Human
gggcagguuggcaucccgggca

SEQ ID NO: 124218 - RNA, 22 nt, Human
cauuuguaucugggcugcugug

SEQ ID NO: 124219 - RNA, 22 nt, Human
uaguggaggccuguugugugca

SEQ ID NO: 124220 - RNA, 22 nt, Human
ugaagacucagaagcuaagaua

SEQ ID NO: 124221 - RNA, 22 nt, Human
ucuggaaguuagaggaggaaag

SEQ ID NO: 124222 - RNA, 22 nt, Human
gcagggcagagggagaaucucu

SEQ ID NO: 124223 - RNA, 21 nt, Human
ugcagaggcacaaacaagccc

SEQ ID NO: 124224 - RNA, 22 nt, Human
ucaaagcuuagauaauuucuuu

SEQ ID NO: 124225 - RNA, 22 nt, Human
ucagcuggauguggaagugcua

SEQ ID NO: 124226 - RNA, 22 nt, Human
cucccagguuacaucugagccu

SEQ ID NO: 124227 - RNA, 22 nt, Human
cuucauuuggagaacugugcuu

SEQ ID NO: 124228 - RNA, 22 nt, Human
auuuuccaaaauaauuguuacu

SEQ ID NO: 124229 - RNA, 22 nt, Human
gaggagggagcuggaagcucuu

SEQ ID NO: 124230 - RNA, 22 nt, Human
ucucugagacaguagccucugc

SEQ ID NO: 124231 - RNA, 22 nt, Human
agcagaggaggauuuaguuagg

SEQ ID NO: 124232 - RNA, 22 nt, Human
uuuguacaugaaugugcaccca

SEQ ID NO: 124233 - RNA, 22 nt, Human
aaaggauucucuugauuucagu

SEQ ID NO: 124234 - RNA, 22 nt, Human
ucugaaggucugagaaccagga

SEQ ID NO: 124235 - RNA, 19 nt, Human
acauuuagaauguacuugc

SEQ ID NO: 124236 - RNA, 22 nt, Human
uaggaaauuugaaauauguggg

SEQ ID NO: 124237 - RNA, 22 nt, Human
ugacauuuaucuucuacaauga

SEQ ID NO: 124238 - RNA, 22 nt, Human
cauccauaugaggcacauuggu

SEQ ID NO: 124239 - RNA, 22 nt, Human
gagcugaaguuuccauuuguac

SEQ ID NO: 124240 - RNA, 22 nt, Human
ugguccugcuacaggggauuag

SEQ ID NO: 124241 - RNA, 22 nt, Human
aggcagaggagaaugaucuucc

SEQ ID NO: 124242 - RNA, 22 nt, Human
gaggaggaggaaguggaaccca

SEQ ID NO: 124243 - RNA, 22 nt, Human
cccaggugggcaccucgaggaa

SEQ ID NO: 124244 - RNA, 22 nt, Human
agggucuguggaugcaucuggg

SEQ ID NO: 124245 - RNA, 22 nt, Human
cgagcaugaugacggcuguggc

SEQ ID NO: 124246 - RNA, 22 nt, Human
aguaaacauaauuuaccuguag

SEQ ID NO: 124247 - RNA, 22 nt, Human
ucagggcacguuucugcaaugc

SEQ ID NO: 124248 - RNA, 19 nt, Human
gagcugagaguagcacugg

SEQ ID NO: 124249 - RNA, 22 nt, Human
ucugugcaccagaaugauauuu

SEQ ID NO: 124250 - RNA, 22 nt, Human
ucaccaggauugggcuguaggc

SEQ ID NO: 124251 - RNA, 22 nt, Human
auacaugauacuuaguacguag

SEQ ID NO: 124252 - RNA, 22 nt, Human
gcagggcaaugaucccgagagg

SEQ ID NO: 124253 - RNA, 22 nt, Human
agggucagguuaagggagucau

SEQ ID NO: 124254 - RNA, 22 nt, Human
agcaggaacgaguucaugggga

SEQ ID NO: 124255 - RNA, 22 nt, Human
aggcucaguucacgucaacuuu

SEQ ID NO: 124256 - RNA, 22 nt, Human
guacaguaguaaaagugaauga

SEQ ID NO: 124257 - RNA, 22 nt, Human
cagggcagcuuccuuuguuagg

SEQ ID NO: 124258 - RNA, 22 nt, Human
aaugcaaacuucuuguuacuug

SEQ ID NO: 124259 - RNA, 22 nt, Human
aaguccagugcuuuagauucca

SEQ ID NO: 124260 - RNA, 22 nt, Human
uugauacagcagccugugaucc

SEQ ID NO: 124261 - RNA, 22 nt, Human
caagcuggaguuccucagagug

SEQ ID NO: 124262 - RNA, 22 nt, Human
cggcagagcccugagucagccu

SEQ ID NO: 124263 - RNA, 22 nt, Human
cagaggaagagauacaagcccu

SEQ ID NO: 124264 - RNA, 22 nt, Human
agaauuagguaaguucaucuga

SEQ ID NO: 124265 - RNA, 22 nt, Human
ugcuacacucaaucagugcuau

SEQ ID NO: 124266 - RNA, 22 nt, Human
ccagaaggcggagauugcagug

SEQ ID NO: 124267 - RNA, 22 nt, Human
aggcagccugguuugaauggaa

SEQ ID NO: 124268 - RNA, 22 nt, Human
caguggagaggcaugcuuggca

SEQ ID NO: 124269 - RNA, 22 nt, Human
aaaugcaugagaaaguauucug

SEQ ID NO: 124270 - RNA, 22 nt, Human
aaacuagaaaucagcaagauag

SEQ ID NO: 124271 - RNA, 22 nt, Human
aagagcugcacauauuuauauc

SEQ ID NO: 124272 - RNA, 22 nt, Human
ugaguccaauaggggccuggaa

SEQ ID NO: 124273 - RNA, 22 nt, Human
auuuauugagagggaggggaau

SEQ ID NO: 124274 - RNA, 22 nt, Human
acugugcaucuauugccauuua

SEQ ID NO: 124275 - RNA, 22 nt, Human
augcagcugugggcaagaaaug

SEQ ID NO: 124276 - RNA, 22 nt, Human
ccuuguccucugguuuccuguu

SEQ ID NO: 124277 - RNA, 22 nt, Human
gcuguggaaaugccuaacauga

SEQ ID NO: 124278 - RNA, 22 nt, Human
ucaggcugccuaucagacugug

SEQ ID NO: 124279 - RNA, 22 nt, Human
aggcagguuucccggcugucaa

SEQ ID NO: 124280 - RNA, 22 nt, Human
cagccagugugaccgaggagga

SEQ ID NO: 124281 - RNA, 17 nt, Human
cuuauacuuuacggaag

SEQ ID NO: 124282 - RNA, 22 nt, Human
aggcugugcacagggcaccugc

SEQ ID NO: 124283 - RNA, 22 nt, Human
ggcugagccaugggcacugcag

SEQ ID NO: 124284 - RNA, 22 nt, Human
ugcauacauaaagugcuaucau

SEQ ID NO: 124285 - RNA, 22 nt, Human
agggucugacugaauggaaaag

SEQ ID NO: 124286 - RNA, 22 nt, Human
cagaggguugucaggcgccuug

SEQ ID NO: 124287 - RNA, 22 nt, Human
uugcacaucuaauaaugcuaga

SEQ ID NO: 124288 - RNA, 22 nt, Human
ggccaccucugcccuacugagu

SEQ ID NO: 124289 - RNA, 22 nt, Human
auuaugcauuccaaccuuauuc

SEQ ID NO: 124290 - RNA, 22 nt, Human
uuacaagugucagguacuggca

SEQ ID NO: 124291 - RNA, 23 nt, Human
gcagauggccccagagugcugcc

SEQ ID NO: 124292 - RNA, 20 nt, Human
uuuauuggccuuucaggaac

SEQ ID NO: 124293 - RNA, 22 nt, Human
acaguggaauggugggccugca

SEQ ID NO: 124294 - RNA, 22 nt, Human
aaagccaaaugaaagaugguuc

SEQ ID NO: 124295 - RNA, 22 nt, Human
cuacccaggcuggagugcagua

SEQ ID NO: 124296 - RNA, 22 nt, Human
cuucuucaguugcauguauugg

SEQ ID NO: 124297 - RNA, 22 nt, Human
ccagggcucaggcucccagugg

SEQ ID NO: 124298 - RNA, 22 nt, Human
acucaguacaucuggaguuggc

SEQ ID NO: 124299 - RNA, 22 nt, Human
acagugaucaguuacugucugu

SEQ ID NO: 124300 - RNA, 22 nt, Human
aggagucacucagggcuucauc

SEQ ID NO: 124301 - RNA, 22 nt, Human
gaaagccaucuggcugcuggga

SEQ ID NO: 124302 - RNA, 22 nt, Human
auguaaacuuuaccagcucuga

SEQ ID NO: 124303 - RNA, 22 nt, Human
aaagccagaguguguuagagac

SEQ ID NO: 124304 - RNA, 22 nt, Human
ugaagccaaucugccaggcaga

SEQ ID NO: 124305 - RNA, 22 nt, Human
gcuccucuucucccacugaaug

SEQ ID NO: 124306 - RNA, 22 nt, Human
ugcccagggauaagccuagaga

SEQ ID NO: 124307 - RNA, 22 nt, Human
agucaccaucuguggcagccug

SEQ ID NO: 124308 - RNA, 22 nt, Human
cccaggaaugagcaggcagggg

SEQ ID NO: 124309 - RNA, 22 nt, Human
uucaucugcuucuugauuuugc

SEQ ID NO: 124310 - RNA, 22 nt, Human
gcagggcaggauuugaacccag

SEQ ID NO: 124311 - RNA, 22 nt, Human
uccugguggugccagcugcagg

SEQ ID NO: 124312 - RNA, 22 nt, Human
aaacacguauaaugugacagag

SEQ ID NO: 124313 - RNA, 22 nt, Human
gagggaggcaucaugaauccag

SEQ ID NO: 124314 - RNA, 22 nt, Human
ggcugaguugagaggauuacuu

SEQ ID NO: 124315 - RNA, 22 nt, Human
augaggcuaugaauggggagau

SEQ ID NO: 124316 - RNA, 22 nt, Human
uuaaagcaguuuguauacaugg

SEQ ID NO: 124317 - RNA, 22 nt, Human
gaaggcugcugggaaguguggu

SEQ ID NO: 124318 - RNA, 22 nt, Human
uaaugguuuuuuggagacugcu

SEQ ID NO: 124319 - RNA, 22 nt, Human
gcugagaguccaggaaaacauc

SEQ ID NO: 124320 - RNA, 22 nt, Human
ggcagaggaaggaugaauucac

SEQ ID NO: 124321 - RNA, 22 nt, Human
gcuguggccuggcgcagagcug

SEQ ID NO: 124322 - RNA, 22 nt, Human
ugauuaaagguggaaggcaggu

SEQ ID NO: 124323 - RNA, 22 nt, Human
agcaggaaggcuuuggggguuc

SEQ ID NO: 124324 - RNA, 22 nt, Human
gggcugagagcuggaaucugag

SEQ ID NO: 124325 - RNA, 22 nt, Human
cagcacaguuugcuuggcagag

SEQ ID NO: 124326 - RNA, 22 nt, Human
acaggcuggugguccuggccau

SEQ ID NO: 124327 - RNA, 22 nt, Human
agggcaugugggagaggagccu

SEQ ID NO: 124328 - RNA, 21 nt, Human
agggucaggaaccaggguacc

SEQ ID NO: 124329 - RNA, 22 nt, Human
uugcacaugauagaugauuucu

SEQ ID NO: 124330 - RNA, 22 nt, Human
uagggcagauucgguggaguuu

SEQ ID NO: 124331 - RNA, 22 nt, Human
uacauguacauugggcauuaau

SEQ ID NO: 124332 - RNA, 22 nt, Human
auggcagggaccaagcugucau

SEQ ID NO: 124333 - RNA, 22 nt, Human
uggcagagacaaggccgggccu

SEQ ID NO: 124334 - RNA, 22 nt, Human
gaagggagaagguugggugacg

SEQ ID NO: 124335 - RNA, 22 nt, Human
ccagugcaggugagcaccaggu

SEQ ID NO: 124336 - RNA, 23 nt, Human
ugggucagcugccuccaggacaa

SEQ ID NO: 124337 - RNA, 22 nt, Human
acagcuguggucuccuuagugu

SEQ ID NO: 124338 - RNA, 19 nt, Human
ggccaggcugacugugguc

SEQ ID NO: 124339 - RNA, 22 nt, Human
agcagggcaaagucaggcuaac

SEQ ID NO: 124340 - RNA, 22 nt, Human
agcugugcuguggucaucuggg

SEQ ID NO: 124341 - RNA, 22 nt, Human
uccagggaagagcagaggcuac

SEQ ID NO: 124342 - RNA, 22 nt, Human
aaggggaauagaguggguugug

SEQ ID NO: 124343 - RNA, 22 nt, Human
auagacauggucuuuugucauu

SEQ ID NO: 124344 - RNA, 22 nt, Human
gagggcugcugccagauaugcc

SEQ ID NO: 124345 - RNA, 22 nt, Human
acagggcagugucuugaaaaau

SEQ ID NO: 124346 - RNA, 18 nt, Human
cugucaccgccaccacac

SEQ ID NO: 124347 - RNA, 22 nt, Human
uucaggauggcggauguugggg

SEQ ID NO: 124348 - RNA, 22 nt, Human
uaguggaggggaugcaaagcuu

SEQ ID NO: 124349 - RNA, 18 nt, Human
guucaaggucaagagaga

SEQ ID NO: 124350 - RNA, 22 nt, Human
uagguacauuauuagaugcaug

SEQ ID NO: 124351 - RNA, 22 nt, Human
ugcaugaaauauuuucuguagg

SEQ ID NO: 124352 - RNA, 22 nt, Human
ugcgcaggagcucugccaggag

SEQ ID NO: 124353 - RNA, 22 nt, Human
cuguacucaagguaaaccagga

SEQ ID NO: 124354 - RNA, 22 nt, Human
uccuccucuaucagacagugcc

SEQ ID NO: 124355 - RNA, 22 nt, Human
agauuuugucucaauacuucug

SEQ ID NO: 124356 - RNA, 22 nt, Human
auaaacaucuguuucucuucug

SEQ ID NO: 124357 - RNA, 22 nt, Human
ucagaggacagcagcuaaauaa

SEQ ID NO: 124358 - RNA, 22 nt, Human
aauggagacccuaaggaagagg

SEQ ID NO: 124359 - RNA, 22 nt, Human
uacaguuccaggaucauagggu

SEQ ID NO: 124360 - RNA, 22 nt, Human
aaggaagagaauccuucucaga

SEQ ID NO: 124361 - RNA, 22 nt, Human
uuugagaaaugggcucugugcu

SEQ ID NO: 124362 - RNA, 22 nt, Human
uagagcuauacacugaguaaaa

SEQ ID NO: 124363 - RNA, 22 nt, Human
auucucaaagccagagucaacg

SEQ ID NO: 124364 - RNA, 22 nt, Human
uuccucuuucucugugcuaugu

SEQ ID NO: 124365 - RNA, 22 nt, Human
ggcacaauugcagcaauaaaca

SEQ ID NO: 124366 - RNA, 20 nt, Human
cuguggcaucugucauggug

SEQ ID NO: 124367 - RNA, 22 nt, Human
agugcacuggcaccaucucagc

SEQ ID NO: 124368 - RNA, 22 nt, Human
agcagggccaacaguaaacacc

SEQ ID NO: 124369 - RNA, 22 nt, Human
cacaucauguuaauucauuaca

SEQ ID NO: 124370 - RNA, 22 nt, Human
uuugucaaucccuugaaaaccu

SEQ ID NO: 124371 - RNA, 22 nt, Human
uaucacuacacuaagauacaga

SEQ ID NO: 124372 - RNA, 20 nt, Human
ggagaugcagcccaggugcc

SEQ ID NO: 124373 - RNA, 22 nt, Human
uauaugcagugugucauucaag

SEQ ID NO: 124374 - RNA, 22 nt, Human
ugaaggagcugauguaaggggu

SEQ ID NO: 124375 - RNA, 22 nt, Human
uggcugagaaaaugguuuuagg

SEQ ID NO: 124376 - RNA, 22 nt, Human
uacagagacuuuauggcacaaa

SEQ ID NO: 124377 - RNA, 22 nt, Human
cuggcuuucugcacagaauugg

SEQ ID NO: 124378 - RNA, 22 nt, Human
caauuugacaaguugcauguuu

SEQ ID NO: 124379 - RNA, 22 nt, Human
gggcaguguggucgugccuuug

SEQ ID NO: 124380 - RNA, 22 nt, Human
acacuucuauucccugcacaaa

SEQ ID NO: 124381 - RNA, 22 nt, Human
uauuugaugguucuaaaacagc

SEQ ID NO: 124382 - RNA, 22 nt, Human
cauuuucagcacccaucugaaa

SEQ ID NO: 124383 - RNA, 22 nt, Human
caggcagccugagggaucuggg

SEQ ID NO: 124384 - RNA, 22 nt, Human
augagcagaugcuccugccucu

SEQ ID NO: 124385 - RNA, 22 nt, Human
gagaagguggaccugaaggagc

SEQ ID NO: 124386 - RNA, 22 nt, Human
gagcugagaucgugccauugca

SEQ ID NO: 124387 - RNA, 22 nt, Human
uggcagagaacacggcugaucu

SEQ ID NO: 124388 - RNA, 22 nt, Human
cagugcagucaaggaagaacca

SEQ ID NO: 124389 - RNA, 22 nt, Human
uagccggguguugugucaugca

SEQ ID NO: 124390 - RNA, 22 nt, Human
gugugcaggccacaggccaggg

SEQ ID NO: 124391 - RNA, 22 nt, Human
acaaaggcagagaauucaacau

SEQ ID NO: 124392 - RNA, 22 nt, Human
uuaugcaaaggggccucuuccu

SEQ ID NO: 124393 - RNA, 22 nt, Human
acuucauauggacagcaaacua

SEQ ID NO: 124394 - RNA, 22 nt, Human
ugaauaaacuaugaggaggaau

SEQ ID NO: 124395 - RNA, 22 nt, Human
gaagaagcaggaguguguagca

SEQ ID NO: 124396 - RNA, 22 nt, Human
ggcuguggccagcggggcugag

SEQ ID NO: 124397 - RNA, 20 nt, Human
ucauacacaugagcaugcag

SEQ ID NO: 124398 - RNA, 23 nt, Human
gccuggagaaaagcugcaguuca

SEQ ID NO: 124399 - RNA, 18 nt, Human
ggcagcaagaagggaggg

SEQ ID NO: 124400 - RNA, 22 nt, Human
acaguaccugcucucaagcaaa

SEQ ID NO: 124401 - RNA, 17 nt, Human
augauuacaucuuuccu

SEQ ID NO: 124402 - RNA, 22 nt, Human
gaggagaaauuauccuuggugu

SEQ ID NO: 124403 - RNA, 22 nt, Human
uuccaggacaagauguuucagg

SEQ ID NO: 124404 - RNA, 22 nt, Human
cagccagggucaggcagcuucu

SEQ ID NO: 124405 - RNA, 22 nt, Human
aauggaaugccucacauguauu

SEQ ID NO: 124406 - RNA, 22 nt, Human
ugaggcucagagaagugcuguu

SEQ ID NO: 124407 - RNA, 22 nt, Human
uggggcagcagaccuuucuugg

SEQ ID NO: 124408 - RNA, 19 nt, Human
ggagaagcaucuagaaaua

SEQ ID NO: 124409 - RNA, 22 nt, Human
uuucucaaggugucauguauuu

SEQ ID NO: 124410 - RNA, 22 nt, Human
cagcacaucugauuauaugacu

SEQ ID NO: 124411 - RNA, 22 nt, Human
auaaaauuugcuacuguuaaau

SEQ ID NO: 124412 - RNA, 22 nt, Human
agcuaagacuuagugacuuagu

SEQ ID NO: 124413 - RNA, 22 nt, Human
aagucuggaagucucaguuuuc

SEQ ID NO: 124414 - RNA, 18 nt, Human
ggcuguggacaagauuag

SEQ ID NO: 124415 - RNA, 22 nt, Human
agaacagucguggugagagaaa

SEQ ID NO: 124416 - RNA, 22 nt, Human
ggggcagcucccgagggcagga

SEQ ID NO: 124417 - RNA, 22 nt, Human
cuaaccuaguucaacaacuguc

SEQ ID NO: 124418 - RNA, 23 nt, Human
uuccuuaacuguuaagauugucu

SEQ ID NO: 124419 - RNA, 22 nt, Human
uuuauaucuuaugucauuucaa

SEQ ID NO: 124420 - RNA, 22 nt, Human
aagaacuuccuaauauauuuuc

SEQ ID NO: 124421 - RNA, 22 nt, Human
ugccaggcuguccugggccugg

SEQ ID NO: 124422 - RNA, 22 nt, Human
ugacauuucuuguugauauaaa

SEQ ID NO: 124423 - RNA, 20 nt, Human
ucugugcaguggaggggcag

SEQ ID NO: 124424 - RNA, 22 nt, Human
cucuggagaugguucucaauug

SEQ ID NO: 124425 - RNA, 23 nt, Human
uggcugagauccuacuguuugcu

SEQ ID NO: 124426 - RNA, 22 nt, Human
cagggcagggauguugcggcag

SEQ ID NO: 124427 - RNA, 22 nt, Human
auuuuaucugcuuacuuucagg

SEQ ID NO: 124428 - RNA, 22 nt, Human
uagggcaggggaggaaucugaa

SEQ ID NO: 124429 - RNA, 22 nt, Human
guaggaaagggagugaagggaa

SEQ ID NO: 124430 - RNA, 22 nt, Human
uggaaguggcagaaaaugaaca

SEQ ID NO: 124431 - RNA, 20 nt, Human
ugaggcaggagaauggcaug

SEQ ID NO: 124432 - RNA, 22 nt, Human
aggcuggggaauugaauuugcu

SEQ ID NO: 124433 - RNA, 22 nt, Human
ucagggcaagauugguuaauaa

SEQ ID NO: 124434 - RNA, 22 nt, Human
acagccugcagccccaggucgc

SEQ ID NO: 124435 - RNA, 22 nt, Human
gccaguggcccucuggagaagg

SEQ ID NO: 124436 - RNA, 22 nt, Human
agcuguggggcaggcagcgagg

SEQ ID NO: 124437 - RNA, 22 nt, Human
aggcugaggcuuuccuuggaga

SEQ ID NO: 124438 - RNA, 22 nt, Human
ugcagggccagacuggguugga

SEQ ID NO: 124439 - RNA, 22 nt, Human
acaguggaugacauccuuuugc

SEQ ID NO: 124440 - RNA, 22 nt, Human
cagggcaguaacgggaacaucu

SEQ ID NO: 124441 - RNA, 20 nt, Human
ucugugcauugccugcuggu

SEQ ID NO: 124442 - RNA, 22 nt, Human
uuuauccauucaccaguugaac

SEQ ID NO: 124443 - RNA, 22 nt, Human
cagcacaguacaaggcacggau

SEQ ID NO: 124444 - RNA, 22 nt, Human
aauaugauccuuaaccuucaug

SEQ ID NO: 124445 - RNA, 22 nt, Human
gcagguggagcaguagucuggu

SEQ ID NO: 124446 - RNA, 21 nt, Human
cccaggucguggucuucccag

SEQ ID NO: 124447 - RNA, 22 nt, Human
auggcagccugagcagaggaau

SEQ ID NO: 124448 - RNA, 22 nt, Human
uggaggcaguaacugagcaaca

SEQ ID NO: 124449 - RNA, 22 nt, Human
aaggaaauacaacauguauuca

SEQ ID NO: 124450 - RNA, 22 nt, Human
uaggaaauugccaauauaugac

SEQ ID NO: 124451 - RNA, 22 nt, Human
augcaaauuaacauauaguaga

SEQ ID NO: 124452 - RNA, 22 nt, Human
ugggggucaggaugaggccuug

SEQ ID NO: 124453 - RNA, 22 nt, Human
uggcugagugaacauguccauu

SEQ ID NO: 124454 - RNA, 22 nt, Human
ucucugagcccaauguagcaau

SEQ ID NO: 124455 - RNA, 22 nt, Human
cuccacagccccuccaguggca

SEQ ID NO: 124456 - RNA, 22 nt, Human
aggcugucucaccucaggaggg

SEQ ID NO: 124457 - RNA, 22 nt, Human
gacaucauggagaggauaaaua

SEQ ID NO: 124458 - RNA, 21 nt, Human
ucauuugugaucugauuucca

SEQ ID NO: 124459 - RNA, 22 nt, Human
auguaaacaagguuauugucca

SEQ ID NO: 124460 - RNA, 22 nt, Human
auuacacuaaugugacaacaau

SEQ ID NO: 124461 - RNA, 22 nt, Human
aguaaacaggcaugauaguguu

SEQ ID NO: 124462 - RNA, 22 nt, Human
ucuugcaggcggcucagcaacc

SEQ ID NO: 124463 - RNA, 22 nt, Human
agggccagagucuguguagaua

SEQ ID NO: 124464 - RNA, 22 nt, Human
ugacuccaaacagaaaacgaau

SEQ ID NO: 124465 - RNA, 17 nt, Human
gcugagaggcagcacag

SEQ ID NO: 124466 - RNA, 22 nt, Human
uuauagcagcaugauuuauaau

SEQ ID NO: 124467 - RNA, 22 nt, Human
aggagcagaacuguuguggagg

SEQ ID NO: 124468 - RNA, 22 nt, Human
caguggaauauauaggggauuu

SEQ ID NO: 124469 - RNA, 22 nt, Human
cccagccucuggguucugccgg

SEQ ID NO: 124470 - RNA, 19 nt, Human
aggauuuauuaugugcuca

SEQ ID NO: 124471 - RNA, 22 nt, Human
aggcugaggcagguggaucacc

SEQ ID NO: 124472 - RNA, 20 nt, Human
gggagaagggcugaugagag

SEQ ID NO: 124473 - RNA, 22 nt, Human
aauauaaauuccugggcccagc

SEQ ID NO: 124474 - RNA, 22 nt, Human
aauuuuguuuaagugaucugcu

SEQ ID NO: 124475 - RNA, 22 nt, Human
acaugauuaaaagauuuuaaag

SEQ ID NO: 124476 - RNA, 20 nt, Human
ggcagggcaucaacagcucu

SEQ ID NO: 124477 - RNA, 22 nt, Human
gagaugcugaaaucugagugua

SEQ ID NO: 124478 - RNA, 22 nt, Human
gagaggagguggcuaugacagc

SEQ ID NO: 124479 - RNA, 22 nt, Human
agguguguauaaacauacauau

SEQ ID NO: 124480 - RNA, 22 nt, Human
aggcucagcccaagguggagag

SEQ ID NO: 124481 - RNA, 22 nt, Human
gaggucaggcuugcagcagggu

SEQ ID NO: 124482 - RNA, 22 nt, Human
aaggugucacugggacaggaaa

SEQ ID NO: 124483 - RNA, 22 nt, Human
gaggcucaguuaugucaucagg

SEQ ID NO: 124484 - RNA, 22 nt, Human
ugaccuauuagauuuccuugcc

SEQ ID NO: 124485 - RNA, 22 nt, Human
cuuaaauuuucaucuacaagaa

SEQ ID NO: 124486 - RNA, 22 nt, Human
gauacauaaaaaugugcucuau

SEQ ID NO: 124487 - RNA, 22 nt, Human
auuacaguaacagcuacaaugc

SEQ ID NO: 124488 - RNA, 22 nt, Human
agaugcugauugaauagauuuc

SEQ ID NO: 124489 - RNA, 22 nt, Human
ucugcucuaguugcuuccugcc

SEQ ID NO: 124490 - RNA, 22 nt, Human
gaaggcaacaccaggaugcacu

SEQ ID NO: 124491 - RNA, 22 nt, Human
agagcugaggauccagcugagc

SEQ ID NO: 124492 - RNA, 22 nt, Human
ggcagaggaagcuggaaguggg

SEQ ID NO: 124493 - RNA, 22 nt, Human
gggaggugauuaggaccaugua

SEQ ID NO: 124494 - RNA, 22 nt, Human
uggggcucaccuaggcuggaag

SEQ ID NO: 124495 - RNA, 22 nt, Human
auuugauuagcuguguaauuuu

SEQ ID NO: 124496 - RNA, 22 nt, Human
aggugucuucagggugagacag

SEQ ID NO: 124497 - RNA, 22 nt, Human
agcagagguguuuauuauggga

SEQ ID NO: 124498 - RNA, 22 nt, Human
gagggccaauggauuucaacug

SEQ ID NO: 124499 - RNA, 22 nt, Human
ucagggcagaauccaaagaauu

SEQ ID NO: 124500 - RNA, 22 nt, Human
acuaaacacaugagauuccugc

SEQ ID NO: 124501 - RNA, 22 nt, Human
ugaggcagaaaauagcaguuca

SEQ ID NO: 124502 - RNA, 22 nt, Human
uggggaggacgggcgccuuccu

SEQ ID NO: 124503 - RNA, 22 nt, Human
caucauacuguuuacacucaaa

SEQ ID NO: 124504 - RNA, 22 nt, Human
gucuucauucucauagcccugg

SEQ ID NO: 124505 - RNA, 22 nt, Human
gcagagugccgagauggaagcg

SEQ ID NO: 124506 - RNA, 22 nt, Human
agggcagcccuucugggagggc

SEQ ID NO: 124507 - RNA, 22 nt, Human
agaagccagaauauucauggau

SEQ ID NO: 124508 - RNA, 22 nt, Human
gcuggggagcaagaguagugag

SEQ ID NO: 124509 - RNA, 22 nt, Human
uccuuuggagcuugacugguag

SEQ ID NO: 124510 - RNA, 22 nt, Human
ugaaaugcuguagagacuguau

SEQ ID NO: 124511 - RNA, 22 nt, Human
uagagauagcaguauugauucg

SEQ ID NO: 124512 - RNA, 22 nt, Human
caccagggacaaugcuaggggu

SEQ ID NO: 124513 - RNA, 22 nt, Human
cuuccccaaccccgacugugug

SEQ ID NO: 124514 - RNA, 22 nt, Human
caguggauuagccagagcugga

SEQ ID NO: 124515 - RNA, 22 nt, Human
cagaaggcaaacaaaaggauuu

SEQ ID NO: 124516 - RNA, 22 nt, Human
cagaggacaauagaauggaaag

SEQ ID NO: 124517 - RNA, 22 nt, Human
aggcaguguguagcuggaagag

SEQ ID NO: 124518 - RNA, 22 nt, Human
augauauagagaguagauuaaa

SEQ ID NO: 124519 - RNA, 22 nt, Human
auccucaguguuucugacaucu

SEQ ID NO: 124520 - RNA, 22 nt, Human
auucauuccaggucagucagac

SEQ ID NO: 124521 - RNA, 22 nt, Human
uggcagggucuugcuguguugc

SEQ ID NO: 124522 - RNA, 20 nt, Human
ucagggcaugggacagcccc

SEQ ID NO: 124523 - RNA, 22 nt, Human
auuacuaugauuugaucauuac

SEQ ID NO: 124524 - RNA, 22 nt, Human
aggaagccuggcauuaaaaagc

SEQ ID NO: 124525 - RNA, 22 nt, Human
caguucaggccggcugacucag

SEQ ID NO: 124526 - RNA, 22 nt, Human
caaaagaagcucuuggggcuag

SEQ ID NO: 124527 - RNA, 22 nt, Human
acaaauggagaaacugaggccc

SEQ ID NO: 124528 - RNA, 18 nt, Human
gagaggagccagaauuuu

SEQ ID NO: 124529 - RNA, 22 nt, Human
gaaagguugggugaauggugga

SEQ ID NO: 124530 - RNA, 22 nt, Human
accaggcuugaugauuugcuua

SEQ ID NO: 124531 - RNA, 19 nt, Human
aaaugugaugguacaauuc

SEQ ID NO: 124532 - RNA, 22 nt, Human
agcugagagccccugcccugug

SEQ ID NO: 124533 - RNA, 22 nt, Human
ugggaguggggcauagaaggua

SEQ ID NO: 124534 - RNA, 22 nt, Human
cuguccccgcgaguccagagcu

SEQ ID NO: 124535 - RNA, 19 nt, Human
aggcugugagggaggacuc

SEQ ID NO: 124536 - RNA, 22 nt, Human
gacaucauguucugcuaauagu

SEQ ID NO: 124537 - RNA, 22 nt, Human
aaagggcuuuauaucagugugu

SEQ ID NO: 124538 - RNA, 22 nt, Human
augcaaauaaagcaacuauaca

SEQ ID NO: 124539 - RNA, 21 nt, Human
aaguggagaagaaaagcugga

SEQ ID NO: 124540 - RNA, 22 nt, Human
ugaggcucagaaauguaaguuu

SEQ ID NO: 124541 - RNA, 22 nt, Human
cugagggaagggguacauggcu

SEQ ID NO: 124542 - RNA, 22 nt, Human
acagggcagaaauguugcaucu

SEQ ID NO: 124543 - RNA, 22 nt, Human
ucaaaggcauugccaauaagua

SEQ ID NO: 124544 - RNA, 22 nt, Human
ucacacacauaaucuaagauua

SEQ ID NO: 124545 - RNA, 18 nt, Human
uguaaacacuuucauucu

SEQ ID NO: 124546 - RNA, 22 nt, Human
uggcaggauuugcccggaagga

SEQ ID NO: 124547 - RNA, 22 nt, Human
agggugucagccacggaauggg

SEQ ID NO: 124548 - RNA, 18 nt, Human
cccagcccaccauuucuc

SEQ ID NO: 124549 - RNA, 22 nt, Human
aggcugaggcagguggaucauu

SEQ ID NO: 124550 - RNA, 23 nt, Human
aggcagagccaaggucaaaaccc

SEQ ID NO: 124551 - RNA, 22 nt, Human
agagcaaagggacauggaagag

SEQ ID NO: 124552 - RNA, 22 nt, Human
caaaggcuucaucucagagcag

SEQ ID NO: 124553 - RNA, 22 nt, Human
ugcugagaucugccaguagaug

SEQ ID NO: 124554 - RNA, 22 nt, Human
gaaacaaucaucaugugauuug

SEQ ID NO: 124555 - RNA, 22 nt, Human
ccugugcauccgguggucauug

SEQ ID NO: 124556 - RNA, 22 nt, Human
ggcuguggcagcuggaaguggu

SEQ ID NO: 124557 - RNA, 18 nt, Human
uuuauauggauagagacc

SEQ ID NO: 124558 - RNA, 22 nt, Human
accagaguaauguguggaaauu

SEQ ID NO: 124559 - RNA, 22 nt, Human
aagggcugcaauccaaaacacu

SEQ ID NO: 124560 - RNA, 22 nt, Human
acagugcagggugggaagaagg

SEQ ID NO: 124561 - RNA, 22 nt, Human
uccauccauguaggaagauggu

SEQ ID NO: 124562 - RNA, 22 nt, Human
cagcugugcugauugcucagua

SEQ ID NO: 124563 - RNA, 22 nt, Human
cauguacauucuguagauggag

SEQ ID NO: 124564 - RNA, 22 nt, Human
ggcaggcagaggcugagacagg

SEQ ID NO: 124565 - RNA, 22 nt, Human
cugagcagccccaccagccauu

SEQ ID NO: 124566 - RNA, 22 nt, Human
gacuucaaaggucaaacaucgc

SEQ ID NO: 124567 - RNA, 22 nt, Human
uguuaaucaacaacaaacagug

SEQ ID NO: 124568 - RNA, 22 nt, Human
ucuucagagugaaagucuguga

SEQ ID NO: 124569 - RNA, 22 nt, Human
gagacgggguuugagacggguu

SEQ ID NO: 124570 - RNA, 22 nt, Human
agggucagagucaggugcagua

SEQ ID NO: 124571 - RNA, 22 nt, Human
agauguggauccuaggguagaa

SEQ ID NO: 124572 - RNA, 22 nt, Human
ugaagccagucaauguuaaguu

SEQ ID NO: 124573 - RNA, 22 nt, Human
cuggccagguuuugaacaguug

SEQ ID NO: 124574 - RNA, 22 nt, Human
aggcugaggugugcugugaucg

SEQ ID NO: 124575 - RNA, 22 nt, Human
gauaaaagaggaaauuuguuca

SEQ ID NO: 124576 - RNA, 22 nt, Human
agagcagagggcucugggacaa

SEQ ID NO: 124577 - RNA, 22 nt, Human
uuacuguagaagagaaugauuc

SEQ ID NO: 124578 - RNA, 22 nt, Human
gauaaacuggaaccauugccuc

SEQ ID NO: 124579 - RNA, 22 nt, Human
cauccacuagaaugacagaguu

SEQ ID NO: 124580 - RNA, 22 nt, Human
augaauaaaacauuuuaaucag

SEQ ID NO: 124581 - RNA, 22 nt, Human
agagugcaugacaugaucuugg

SEQ ID NO: 124582 - RNA, 22 nt, Human
uuccucagccaaggcugggauc

SEQ ID NO: 124583 - RNA, 22 nt, Human
agguggagugaaggaaaggcag

SEQ ID NO: 124584 - RNA, 22 nt, Human
agggccagcuagagcccucgcc

SEQ ID NO: 124585 - RNA, 22 nt, Human
gugagaguguuuggaaauagaa

SEQ ID NO: 124586 - RNA, 22 nt, Human
auccucagaccucagcaaagcc

SEQ ID NO: 124587 - RNA, 22 nt, Human
agaagccauagucugggaggca

SEQ ID NO: 124588 - RNA, 19 nt, Human
acuagcacccagguaaaug

SEQ ID NO: 124589 - RNA, 22 nt, Human
ugcaaacaauuuccuauaaagu

SEQ ID NO: 124590 - RNA, 22 nt, Human
acuaacauuuguguaugucuug

SEQ ID NO: 124591 - RNA, 22 nt, Human
cugagaggcggagcuugcagug

SEQ ID NO: 124592 - RNA, 22 nt, Human
ggaggagacggagugauuagug

SEQ ID NO: 124593 - RNA, 22 nt, Human
uguuagcagagcagcugacaga

SEQ ID NO: 124594 - RNA, 22 nt, Human
uacaucaugaaagcauacauca

SEQ ID NO: 124595 - RNA, 22 nt, Human
acuuucauuuguaauaaacuuc

SEQ ID NO: 124596 - RNA, 22 nt, Human
ucagggcacugucaccugauau

SEQ ID NO: 124597 - RNA, 22 nt, Human
guggcaggagagacacagccau

SEQ ID NO: 124598 - RNA, 22 nt, Human
ugaggcagcccacuuuccuuag

SEQ ID NO: 124599 - RNA, 22 nt, Human
agggcaguucagccacaggcuc

SEQ ID NO: 124600 - RNA, 22 nt, Human
ugccaggcccugcgggguccca

SEQ ID NO: 124601 - RNA, 22 nt, Human
gucucuuuuauggugaguugau

SEQ ID NO: 124602 - RNA, 22 nt, Human
gcagggcagugugucugugggg

SEQ ID NO: 124603 - RNA, 22 nt, Human
ugagaugcugggaacaaggaag

SEQ ID NO: 124604 - RNA, 22 nt, Human
aggcucagauucacauuugguu

SEQ ID NO: 124605 - RNA, 22 nt, Human
caguggcgugaucucugcucac

SEQ ID NO: 124606 - RNA, 22 nt, Human
aacaucauuauguccauuaaug

SEQ ID NO: 124607 - RNA, 22 nt, Human
agggaggaaggauguuccaaag

SEQ ID NO: 124608 - RNA, 22 nt, Human
ucacugggcccugaggugggac

SEQ ID NO: 124609 - RNA, 22 nt, Human
gaauuagguaauagaacuagua

SEQ ID NO: 124610 - RNA, 19 nt, Human
uacagugaaccaggaggag

SEQ ID NO: 124611 - RNA, 22 nt, Human
ugcagagaaaccaguggaggac

SEQ ID NO: 124612 - RNA, 22 nt, Human
uagggcagaguccaggaugggc

SEQ ID NO: 124613 - RNA, 22 nt, Human
uggcugcagaucaagggcaggc

SEQ ID NO: 124614 - RNA, 22 nt, Human
gggggacuaacuggauccugga

SEQ ID NO: 124615 - RNA, 22 nt, Human
ccuguggggcugaaagaggcuu

SEQ ID NO: 124616 - RNA, 22 nt, Human
gaggcucacuuucauccucuuc

SEQ ID NO: 124617 - RNA, 22 nt, Human
caggucagagucccccuguccu

SEQ ID NO: 124618 - RNA, 22 nt, Human
cagaaguggccucagagggagu

SEQ ID NO: 124619 - RNA, 22 nt, Human
aucacaucucaccacugcaacc

SEQ ID NO: 124620 - RNA, 22 nt, Human
augaggcaaggaucagguaagg

SEQ ID NO: 124621 - RNA, 22 nt, Human
agaggcagcagucauacuacag

SEQ ID NO: 124622 - RNA, 22 nt, Human
gaugcaaacugugacauagagu

SEQ ID NO: 124623 - RNA, 22 nt, Human
cuuuccaacucuagugaaauuu

SEQ ID NO: 124624 - RNA, 22 nt, Human
augaggcagcugcuggagaacg

SEQ ID NO: 124625 - RNA, 22 nt, Human
agaaauacuuuguaaaucucac

SEQ ID NO: 124626 - RNA, 22 nt, Human
augccaggaacaaacaguggug

SEQ ID NO: 124627 - RNA, 22 nt, Human
ugaggcaggaggauugcaggau

SEQ ID NO: 124628 - RNA, 21 nt, Human
acagccugucaucucaugguc

SEQ ID NO: 124629 - RNA, 22 nt, Human
gcaguggaagccucuuuaagca

SEQ ID NO: 124630 - RNA, 22 nt, Human
aaacaugaugccuguacuaaga

SEQ ID NO: 124631 - RNA, 22 nt, Human
uacuggcaauuucauauggugc

SEQ ID NO: 124632 - RNA, 22 nt, Human
cugggcagcuguaucagggagu

SEQ ID NO: 124633 - RNA, 21 nt, Human
gggcagaggggccuccugggu

SEQ ID NO: 124634 - RNA, 22 nt, Human
aaauuagucgguuuaggaauuu

SEQ ID NO: 124635 - RNA, 20 nt, Human
agggucagagagcgugagug

SEQ ID NO: 124636 - RNA, 22 nt, Human
ccuccuagaggaaccccagggc

SEQ ID NO: 124637 - RNA, 22 nt, Human
ucugaaggugcuagagaaagcu

SEQ ID NO: 124638 - RNA, 22 nt, Human
aauguggaugauacuaguacuu

SEQ ID NO: 124639 - RNA, 22 nt, Human
cagugcagaggccagggaggau

SEQ ID NO: 124640 - RNA, 22 nt, Human
augggcagcugcagcaguggug

SEQ ID NO: 124641 - RNA, 19 nt, Human
aggugcaggucacagggga

SEQ ID NO: 124642 - RNA, 22 nt, Human
uggcagagccuugccaaacucc

SEQ ID NO: 124643 - RNA, 22 nt, Human
agccagggagguggagguugca

SEQ ID NO: 124644 - RNA, 21 nt, Human
uguggcagauguugggaggca

SEQ ID NO: 124645 - RNA, 21 nt, Human
aggugcaggccucaagcccca

SEQ ID NO: 124646 - RNA, 22 nt, Human
ugcagggccgcuggaggucaug

SEQ ID NO: 124647 - RNA, 22 nt, Human
aggcucagcugguggugaucgc

SEQ ID NO: 124648 - RNA, 22 nt, Human
cgaugcuggaaugacagcugcu

SEQ ID NO: 124649 - RNA, 22 nt, Human
ugcagggccccucugcaugagu

SEQ ID NO: 124650 - RNA, 22 nt, Human
uggcugagccuuuggggcuuuc

SEQ ID NO: 124651 - RNA, 22 nt, Human
acuaaaugcauugguaucuauu

SEQ ID NO: 124652 - RNA, 22 nt, Human
auggcaagcaagcugaagagau

SEQ ID NO: 124653 - RNA, 22 nt, Human
ggggcaggagcccuucuucagc

SEQ ID NO: 124654 - RNA, 22 nt, Human
aauaugcauuauacagacugau

SEQ ID NO: 124655 - RNA, 22 nt, Human
ggaggagcacuucugagcucag

SEQ ID NO: 124656 - RNA, 22 nt, Human
caaggcugugcaggguccauau

SEQ ID NO: 124657 - RNA, 22 nt, Human
ggaggcacuucccgucucagcc

SEQ ID NO: 124658 - RNA, 22 nt, Human
ggccaggagcaagccaggcucu

SEQ ID NO: 124659 - RNA, 22 nt, Human
caggaagcugagcugcacugca

SEQ ID NO: 124660 - RNA, 22 nt, Human
ccagggcaggagaaagacucac

SEQ ID NO: 124661 - RNA, 22 nt, Human
ucaaacaggacuacauucucau

SEQ ID NO: 124662 - RNA, 22 nt, Human
ggcugcagaggcgaucugaggu

SEQ ID NO: 124663 - RNA, 22 nt, Human
caugaauauacauccugauggc

SEQ ID NO: 124664 - RNA, 19 nt, Human
agagaugcuaagagucuuu

SEQ ID NO: 124665 - RNA, 22 nt, Human
gggagggaaagcuugaucuguc

SEQ ID NO: 124666 - RNA, 22 nt, Human
cgcaccacugaauuccagccug

SEQ ID NO: 124667 - RNA, 22 nt, Human
ucccaggcaaaggcagcucauu

SEQ ID NO: 124668 - RNA, 22 nt, Human
ggaggcagaauagagugugggu

SEQ ID NO: 124669 - RNA, 22 nt, Human
acaggcagguugagaaacauuu

SEQ ID NO: 124670 - RNA, 22 nt, Human
ucaguaaccuuuagcacaguug

SEQ ID NO: 124671 - RNA, 22 nt, Human
uacagugagacuggcucaggga

SEQ ID NO: 124672 - RNA, 22 nt, Human
ucucugagcaugccauauugcu

SEQ ID NO: 124673 - RNA, 22 nt, Human
ggcugugaacccuggcagugug

SEQ ID NO: 124674 - RNA, 22 nt, Human
gagcaugguuccauagguuggu

SEQ ID NO: 124675 - RNA, 22 nt, Human
cggcagggcuccaugcauuucu

SEQ ID NO: 124676 - RNA, 22 nt, Human
gccaccuguuucgcuugcccag

SEQ ID NO: 124677 - RNA, 22 nt, Human
caggagcaugcugaugccagaa

SEQ ID NO: 124678 - RNA, 22 nt, Human
ggagcacccugcucagccaagc

SEQ ID NO: 124679 - RNA, 20 nt, Human
accagguggcugaugacacc

SEQ ID NO: 124680 - RNA, 22 nt, Human
uggcagaguuauggguauuuau

SEQ ID NO: 124681 - RNA, 22 nt, Human
gcagaugaggaagcuaaugcug

SEQ ID NO: 124682 - RNA, 22 nt, Human
gcagccacagaggagggaugca

SEQ ID NO: 124683 - RNA, 22 nt, Human
aauuacugaugccuguguucca

SEQ ID NO: 124684 - RNA, 22 nt, Human
gggagagguuacccgagcaacu

SEQ ID NO: 124685 - RNA, 22 nt, Human
ggagagggggcucccugcuugg

SEQ ID NO: 124686 - RNA, 22 nt, Human
caguggaggcucaagugugcuu

SEQ ID NO: 124687 - RNA, 19 nt, Human
ucaaaggcuuuuaggagac

SEQ ID NO: 124688 - RNA, 22 nt, Human
ggugaaggcacaagagggcaag

SEQ ID NO: 124689 - RNA, 22 nt, Human
augcuuuuccaggagaaauaua

SEQ ID NO: 124690 - RNA, 22 nt, Human
ucucccagaggaucccagugga

SEQ ID NO: 124691 - RNA, 22 nt, Human
uaaaggcucacuggcuuggggu

SEQ ID NO: 124692 - RNA, 22 nt, Human
ucucccaggcuggagugcagug

SEQ ID NO: 124693 - RNA, 22 nt, Human
gcugugcauggagggccguuca

SEQ ID NO: 124694 - RNA, 22 nt, Human
cauuuguagcuauuuacuguau

SEQ ID NO: 124695 - RNA, 22 nt, Human
uuugagaagcaucugguccacu

SEQ ID NO: 124696 - RNA, 19 nt, Human
aggcagaggcuuggcuagc

SEQ ID NO: 124697 - RNA, 22 nt, Human
uugggacagaaaaggagaagau

SEQ ID NO: 124698 - RNA, 22 nt, Human
cacugcccagcgucuuaggcac

SEQ ID NO: 124699 - RNA, 22 nt, Human
ugaggcagcuuuuucugugugu

SEQ ID NO: 124700 - RNA, 22 nt, Human
uuugacaugcaaagcacuuuag

SEQ ID NO: 124701 - RNA, 22 nt, Human
ugucauauagauauuagacagg

SEQ ID NO: 124702 - RNA, 22 nt, Human
aggaaggagggcagauauuaag

SEQ ID NO: 124703 - RNA, 22 nt, Human
uuauagcagcaugauuuauagu

SEQ ID NO: 124704 - RNA, 22 nt, Human
ccugggcaacauagggagaccc

SEQ ID NO: 124705 - RNA, 22 nt, Human
aaagucugagcagaauuucuca

SEQ ID NO: 124706 - RNA, 22 nt, Human
ccuguuuauugugaagaaccca

SEQ ID NO: 124707 - RNA, 22 nt, Human
augauauacuuccuagaacagu

SEQ ID NO: 124708 - RNA, 23 nt, Human
uagggcagcugggagggacaugc

SEQ ID NO: 124709 - RNA, 22 nt, Human
aagagaaggauucugagccugg

SEQ ID NO: 124710 - RNA, 22 nt, Human
uuauagugcauaauuaacaugg

SEQ ID NO: 124711 - RNA, 22 nt, Human
gagucugaugucccccaggcca

SEQ ID NO: 124712 - RNA, 22 nt, Human
ccugcccagcuucccgagugca

SEQ ID NO: 124713 - RNA, 22 nt, Human
aggucagcugcugauaggcagc

SEQ ID NO: 124714 - RNA, 22 nt, Human
gacagaggcaagaccagaagcc

SEQ ID NO: 124715 - RNA, 20 nt, Human
agagugagacuccaucucag

SEQ ID NO: 124716 - RNA, 22 nt, Human
gcugagagugagcacuggauau

SEQ ID NO: 124717 - RNA, 22 nt, Human
aggugcagcugguggagucugg

SEQ ID NO: 124718 - RNA, 22 nt, Human
uguguugugacauucuuggaug

SEQ ID NO: 124719 - RNA, 22 nt, Human
ucaccaggauuccuaucaguag

SEQ ID NO: 124720 - RNA, 22 nt, Human
ugauuucucuuggcaauauguu

SEQ ID NO: 124721 - RNA, 22 nt, Human
aacauugaauuuaaaauacagu

SEQ ID NO: 124722 - RNA, 22 nt, Human
agagaaggucacuaaggaccca

SEQ ID NO: 124723 - RNA, 22 nt, Human
uaucuguugucuuuuacaugua

SEQ ID NO: 124724 - RNA, 22 nt, Human
aagacaugcaauuagcaaggaa

SEQ ID NO: 124725 - RNA, 22 nt, Human
caugaauauuuaguauuuacuu

SEQ ID NO: 124726 - RNA, 18 nt, Human
auaauaggagauaaaaau

SEQ ID NO: 124727 - RNA, 22 nt, Human
auuuauugguuugcauggugaa

SEQ ID NO: 124728 - RNA, 22 nt, Human
agccuauuccaggaugagcuca

SEQ ID NO: 124729 - RNA, 22 nt, Human
ugcagugggccggaggccaggg

SEQ ID NO: 124730 - RNA, 22 nt, Human
caccaggcuggagugcagaggu

SEQ ID NO: 124731 - RNA, 22 nt, Human
cagcuguguaugagagcaugcu

SEQ ID NO: 124732 - RNA, 22 nt, Human
ugccgcagugcggggagggccc

SEQ ID NO: 124733 - RNA, 22 nt, Human
augauuacucccauuugauaga

SEQ ID NO: 124734 - RNA, 22 nt, Human
aggccaggaccauuagcccaga

SEQ ID NO: 124735 - RNA, 22 nt, Human
ugggaggucucuugcggccuag

SEQ ID NO: 124736 - RNA, 22 nt, Human
ugaugacaaacuuuccugaugc

SEQ ID NO: 124737 - RNA, 22 nt, Human
gcagccucaaacuccccagcuc

SEQ ID NO: 124738 - RNA, 22 nt, Human
guaaucucagcuacuugggagg

SEQ ID NO: 124739 - RNA, 22 nt, Human
ggagaaggaauauuggaguagg

SEQ ID NO: 124740 - RNA, 22 nt, Human
auacaguagacaaucucaugaa

SEQ ID NO: 124741 - RNA, 22 nt, Human
gccuggaguagcauggcaagcc

SEQ ID NO: 124742 - RNA, 22 nt, Human
uuccucaguuagugccugaggc

SEQ ID NO: 124743 - RNA, 22 nt, Human
auucucaauuuugccaaagggu

SEQ ID NO: 124744 - RNA, 22 nt, Human
gagucugagucuaauggcccca

SEQ ID NO: 124745 - RNA, 19 nt, Human
uggcagaggacaaggacuu

SEQ ID NO: 124746 - RNA, 22 nt, Human
ccaguggaaauguggucaggau

SEQ ID NO: 124747 - RNA, 22 nt, Human
uggagcuggcuuguggaaguug

SEQ ID NO: 124748 - RNA, 22 nt, Human
cuuagaugaagucacagaaccc

SEQ ID NO: 124749 - RNA, 22 nt, Human
ggcaggaggugaguggcgggug

SEQ ID NO: 124750 - RNA, 22 nt, Human
uccuguggaagacaguguuggg

SEQ ID NO: 124751 - RNA, 22 nt, Human
ugaggcuccagccaggccagca

SEQ ID NO: 124752 - RNA, 22 nt, Human
auaaugcaccuuugaguauggc

SEQ ID NO: 124753 - RNA, 22 nt, Human
uuauuuacaacucuucucuucc

SEQ ID NO: 124754 - RNA, 22 nt, Human
ucuguccuguuuccuccugaca

SEQ ID NO: 124755 - RNA, 22 nt, Human
auuccaaaaggauguuagaaug

SEQ ID NO: 124756 - RNA, 22 nt, Human
agaagccagcuucagcugcccg

SEQ ID NO: 124757 - RNA, 22 nt, Human
uagagcuagcuucaaaaugcga

SEQ ID NO: 124758 - RNA, 22 nt, Human
gauggcaggcaggugaguagag

SEQ ID NO: 124759 - RNA, 22 nt, Human
gagcucagggcauugagcaaga

SEQ ID NO: 124760 - RNA, 23 nt, Human
ccacuagcaccuguucaacuucu

SEQ ID NO: 124761 - RNA, 22 nt, Human
aguggcagggcuggcugcugca

SEQ ID NO: 124762 - RNA, 22 nt, Human
caggaccccauauucacugaac

SEQ ID NO: 124763 - RNA, 22 nt, Human
uguaaagcaucucugucauaua

SEQ ID NO: 124764 - RNA, 22 nt, Human
acagggcagcaacuuugugccu

SEQ ID NO: 124765 - RNA, 22 nt, Human
gccaggugggagacagacagca

SEQ ID NO: 124766 - RNA, 22 nt, Human
gggggaggugaaugcaauaagg

SEQ ID NO: 124767 - RNA, 22 nt, Human
auacauacauguacacauaaau

SEQ ID NO: 124768 - RNA, 18 nt, Human
aggcagcagcaucuucuc

SEQ ID NO: 124769 - RNA, 22 nt, Human
augcuuuuaugucacaugguca

SEQ ID NO: 124770 - RNA, 22 nt, Human
aggugcaguggcucaugccugu

SEQ ID NO: 124771 - RNA, 22 nt, Human
uucacuuauagggauguuauug

SEQ ID NO: 124772 - RNA, 22 nt, Human
uuguccaaggucccacaguuag

SEQ ID NO: 124773 - RNA, 20 nt, Human
uaggcagagcugugcagccu

SEQ ID NO: 124774 - RNA, 22 nt, Human
ucacaucauggagaauuauggg

SEQ ID NO: 124775 - RNA, 22 nt, Human
uacugugacagaguacuuaaac

SEQ ID NO: 124776 - RNA, 22 nt, Human
gacagggaggagcagagcuucu

SEQ ID NO: 124777 - RNA, 22 nt, Human
uccugguggcuuucccugccuu

SEQ ID NO: 124778 - RNA, 22 nt, Human
aagacauuuauuugaaucaauu

SEQ ID NO: 124779 - RNA, 22 nt, Human
agagguaugguauauuggaaga

SEQ ID NO: 124780 - RNA, 22 nt, Human
cggggcaggagucccuguagag

SEQ ID NO: 124781 - RNA, 22 nt, Human
ucaucaaagucaaagaaugacu

SEQ ID NO: 124782 - RNA, 22 nt, Human
agugucuuuagcaaguuuaguc

SEQ ID NO: 124783 - RNA, 20 nt, Human
agguuuauauuuagaggugu

SEQ ID NO: 124784 - RNA, 22 nt, Human
guguuuuauuggugcagucaga

SEQ ID NO: 124785 - RNA, 22 nt, Human
ggcugcaggaugcccagccgug

SEQ ID NO: 124786 - RNA, 22 nt, Human
gaggagaagcuaagaaacacag

SEQ ID NO: 124787 - RNA, 22 nt, Human
cugaggaggggccugagugaga

SEQ ID NO: 124788 - RNA, 22 nt, Human
ugccagaguuacaugaggguca

SEQ ID NO: 124789 - RNA, 22 nt, Human
ccagggcagccaacccagaugc

SEQ ID NO: 124790 - RNA, 22 nt, Human
cauuguuauagcauuacacacc

SEQ ID NO: 124791 - RNA, 22 nt, Human
aguggcagaucucuggucugga

SEQ ID NO: 124792 - RNA, 22 nt, Human
ucagaggagaaguugggaaaau

SEQ ID NO: 124793 - RNA, 22 nt, Human
gggcaugagaggcaggcaagug

SEQ ID NO: 124794 - RNA, 22 nt, Barmah Forest virus
auaagauuaguuuguuauguaa

SEQ ID NO: 124795 - RNA, 22 nt, Barmah Forest virus
cuagacucgcuaguacugugau

SEQ ID NO: 124796 - RNA, 22 nt, Barmah Forest virus
gucauaguaaugugagacuaug

SEQ ID NO: 124797 - RNA, 22 nt, Human
agcugugggauuugggugugcc

SEQ ID NO: 124798 - RNA, 20 nt, Human
uggcaggaggcagcagugga

SEQ ID NO: 124799 - RNA, 22 nt, Human
agucaacaaaaauguggagccu

SEQ ID NO: 124800 - RNA, 22 nt, Human
caagauggagaagcagcaaggg

SEQ ID NO: 124801 - RNA, 22 nt, Human
gggccagugaacaaugagggaa

SEQ ID NO: 124802 - RNA, 22 nt, Human
cagagcugagaauguugaugcu

SEQ ID NO: 124803 - RNA, 23 nt, Human
agguucaggagauggaggaacaa

SEQ ID NO: 124804 - RNA, 22 nt, Human
aaggcugccucugccagaggag

SEQ ID NO: 124805 - RNA, 22 nt, Human
ugaaauuccaggagaguuaaaa

SEQ ID NO: 124806 - RNA, 22 nt, Human
gaggcuggcagaaaagcacagg

SEQ ID NO: 124807 - RNA, 22 nt, Human
ugaguccaucgcagggaagugg

SEQ ID NO: 124808 - RNA, 22 nt, Human
cagaagaggacuggguagcuca

SEQ ID NO: 124809 - RNA, 22 nt, Human
agccaggccagcugucuugagu

SEQ ID NO: 124810 - RNA, 22 nt, Human
cugaggcagagggcagaccaga

SEQ ID NO: 124811 - RNA, 22 nt, Human
ccucgcggcacucgggccggau

SEQ ID NO: 124812 - RNA, 22 nt, Human
cauuugcauaugaagaaguaag

SEQ ID NO: 124813 - RNA, 22 nt, Human
agggucuguggaugcaucuggg

SEQ ID NO: 124814 - RNA, 22 nt, Human
gucucuuuuauggugaguugau

SEQ ID NO: 124815 - RNA, 22 nt, Human
aggcuucagaugaccuuagcau

SEQ ID NO: 124816 - RNA, 22 nt, Human
ucccaggaaaacacucgaggac

SEQ ID NO: 124817 - RNA, 22 nt, Human
ugaggcaggacugagcgggaug

SEQ ID NO: 124818 - RNA, 22 nt, Human
cagagcuggggacuguuggaug

SEQ ID NO: 124819 - RNA, 22 nt, Human
gccaguggcaugcggcagggac

SEQ ID NO: 124820 - RNA, 22 nt, Human
ucagggcacauucugcaguggc

SEQ ID NO: 124821 - RNA, 22 nt, Human
guuguacagcauccagugcaga

SEQ ID NO: 124822 - RNA, 22 nt, Human
gccucgaggcugagaaggcaca

SEQ ID NO: 124823 - RNA, 22 nt, Human
ugaagccaaucugccaggcaga

SEQ ID NO: 124824 - RNA, 21 nt, Human
ugaggcucaucuuauguggcu

SEQ ID NO: 124825 - RNA, 22 nt, Human
gaaggagagggucaaggauaau

SEQ ID NO: 124826 - RNA, 22 nt, Human
cugaggcugggcauggggucca

SEQ ID NO: 124827 - RNA, 22 nt, Human
auuuccaaucucugcauauggg

SEQ ID NO: 124828 - RNA, 22 nt, Human
cugugacuguguuggaugcaca

SEQ ID NO: 124829 - RNA, 22 nt, Human
gagagaggccuccauguacuga

SEQ ID NO: 124830 - RNA, 22 nt, Human
uuccucagagggcgcuggggaa

SEQ ID NO: 124831 - RNA, 22 nt, Human
aggcugagcugaccugguuugg

SEQ ID NO: 124832 - RNA, 22 nt, Human
uggaaggagcuaaggaccuggg

SEQ ID NO: 124833 - RNA, 23 nt, Human
uuccuuaacuguuaagauugucu

SEQ ID NO: 124834 - RNA, 22 nt, Human
gagagcugugguuugaccaggc

SEQ ID NO: 124835 - RNA, 22 nt, Human
ugcagggcaguuuguuucggca

SEQ ID NO: 124836 - RNA, 22 nt, Human
gaggcucauugcauugugcauu

SEQ ID NO: 124837 - RNA, 22 nt, Human
agccuccuguagcccucaccca

SEQ ID NO: 124838 - RNA, 23 nt, Human
cagugcagggcaacucagacucc

SEQ ID NO: 124839 - RNA, 22 nt, Human
caccuagggcaucccugcccca

SEQ ID NO: 124840 - RNA, 22 nt, Human
ccagaggagggcucugaugagg

SEQ ID NO: 124841 - RNA, 22 nt, Human
aggcagagcuaggaagaauugu

SEQ ID NO: 124842 - RNA, 22 nt, Human
cugccagguuggcgcucgcucu

SEQ ID NO: 124843 - RNA, 22 nt, Human
gaaggaagucauuagugcagac

SEQ ID NO: 124844 - RNA, 22 nt, Human
agcuaagacuuagugacuuagu

SEQ ID NO: 124845 - RNA, 22 nt, Human
cagagcccagggccuacguccc

SEQ ID NO: 124846 - RNA, 22 nt, Human
ucagaggacuaccuucuccagu

SEQ ID NO: 124847 - RNA, 22 nt, Human
gcaaaggccacuggggcgaugg

SEQ ID NO: 124848 - RNA, 22 nt, Human
aggggaaggccagccuguagag

SEQ ID NO: 124849 - RNA, 19 nt, Human
ucucccagcugagaagggc

SEQ ID NO: 124850 - RNA, 22 nt, Human
ccagugcacagccaggcaggug

SEQ ID NO: 124851 - RNA, 22 nt, Human
gugcaggagguaacauagcaaa

SEQ ID NO: 124852 - RNA, 22 nt, Human
ugacauuuaagccucugauuuc

SEQ ID NO: 124853 - RNA, 22 nt, Human
gugugggcugcagaggcacagc

SEQ ID NO: 124854 - RNA, 22 nt, Human
gaaggcugaguggguacggagg

SEQ ID NO: 124855 - RNA, 22 nt, Human
aggccaggaccauuagcccaga

SEQ ID NO: 124856 - RNA, 22 nt, Human
uugaucagguugcuguggugua

SEQ ID NO: 124857 - RNA, 22 nt, Human
ccagaggaugcuggucagccuc

SEQ ID NO: 124858 - RNA, 20 nt, Human
aguggggagucaggagugcc

SEQ ID NO: 124859 - RNA, 22 nt, Human
ggaagccaguugcuuggugugg

SEQ ID NO: 124860 - RNA, 22 nt, Human
aggcagagaaaaaccagauaug

SEQ ID NO: 124861 - RNA, 22 nt, Human
ucagaggaggcauuuaaacaga

SEQ ID NO: 124862 - RNA, 22 nt, Human
uucucagauccaucagaagucc

SEQ ID NO: 124863 - RNA, 22 nt, Human
uuuucaagggcagggaaaucau

SEQ ID NO: 124864 - RNA, 22 nt, Human
gagggcugauaaaugcgcaugg

SEQ ID NO: 124865 - RNA, 17 nt, Human
gcagccagugcagcagg

SEQ ID NO: 124866 - RNA, 22 nt, Human
ucuccugguuuguuaaauaauu

SEQ ID NO: 124867 - RNA, 22 nt, Human
aaagccagaguguguuagagac

SEQ ID NO: 124868 - RNA, 18 nt, Human
acagaggcagacauguau

SEQ ID NO: 124869 - RNA, 22 nt, Human
aggcugaggaucguacuuucca

SEQ ID NO: 124870 - RNA, 19 nt, Human
accaggccucagaggcccu

SEQ ID NO: 124871 - RNA, 22 nt, Human
acagaguuaauggauaggcagg

SEQ ID NO: 124872 - RNA, 18 nt, Human
cagggcuguggggucacu

SEQ ID NO: 124873 - RNA, 22 nt, Human
ugcaggaauuuuuugcagaaag

SEQ ID NO: 124874 - RNA, 22 nt, Human
ugucagagcaaugagguucagc

SEQ ID NO: 124875 - RNA, 22 nt, Human
gaggcucaccuagggagcacug

SEQ ID NO: 124876 - RNA, 22 nt, Human
agugugagccuacaggccaaag

SEQ ID NO: 124877 - RNA, 22 nt, Human
aaagcagcagcaccugcauuuc

SEQ ID NO: 124878 - RNA, 23 nt, Human
acagccaguucaccucuccuugg

SEQ ID NO: 124879 - RNA, 22 nt, Human
ugaguccaagagccagugggaa

SEQ ID NO: 124880 - RNA, 22 nt, Human
cagagcggccacuagagggcgc

SEQ ID NO: 124881 - RNA, 22 nt, Human
uuacucagucucccauacauug

SEQ ID NO: 124882 - RNA, 22 nt, Human
gggaggaaaugugcagcgaauu

SEQ ID NO: 124883 - RNA, 22 nt, Human
gcuguggaugcuauggaucauc

SEQ ID NO: 124884 - RNA, 22 nt, Human
cagggcuggcuguggcaaucuc

SEQ ID NO: 124885 - RNA, 22 nt, Human
cccaggucugccagccuguggg

SEQ ID NO: 124886 - RNA, 23 nt, Human
acacauuuuucccguucugaggu

SEQ ID NO: 124887 - RNA, 22 nt, Human
ugaggcagcuuuuucugugugu

SEQ ID NO: 124888 - RNA, 22 nt, Human
ccggcucggcgaccaggcugaa

SEQ ID NO: 124889 - RNA, 22 nt, Human
gguucccggaucuccgaguccc

SEQ ID NO: 124890 - RNA, 22 nt, Human
ugaggcagccugcauuaaagag

SEQ ID NO: 124891 - RNA, 22 nt, Human
aggcagcauccagaggagaaug

SEQ ID NO: 124892 - RNA, 22 nt, Human
ucaccaggcuccuguuaagaug

SEQ ID NO: 124893 - RNA, 22 nt, Human
cccagguguuuguggcagaggu

SEQ ID NO: 124894 - RNA, 22 nt, Human
gaggcgagaagcuggagauggu

SEQ ID NO: 124895 - RNA, 22 nt, Human
cuuuccaacucuagugaaauuu

SEQ ID NO: 124896 - RNA, 22 nt, Human
gcugagagugagcacuggauau

SEQ ID NO: 124897 - RNA, 23 nt, Human
ugccagaggcagucacaguggug

SEQ ID NO: 124898 - RNA, 22 nt, Human
gugugcaggccacaggccaggg

SEQ ID NO: 124899 - RNA, 22 nt, Human
agagccaguuacaacuguggag

SEQ ID NO: 124900 - RNA, 22 nt, Human
aggcugagguaggaggaucgcu

SEQ ID NO: 124901 - RNA, 22 nt, Human
ucccaggauguuggcggcaggu

SEQ ID NO: 124902 - RNA, 22 nt, Human
auggcagagggauugaacagcu

SEQ ID NO: 124903 - RNA, 22 nt, Human
uacacacaugcauuugccuuau

SEQ ID NO: 124904 - RNA, 22 nt, Human
uuucauuacguguuugacuugu

SEQ ID NO: 124905 - RNA, 22 nt, Human
caggaaggcgcggcugugccug

SEQ ID NO: 124906 - RNA, 22 nt, Human
uagagcugcuggacuguaacag

SEQ ID NO: 124907 - RNA, 22 nt, Human
cagagcagacguugagauuaag

SEQ ID NO: 124908 - RNA, 22 nt, Human
guggcagggugcucaucaugca

SEQ ID NO: 124909 - RNA, 22 nt, Human
gggggcaguaaccucaaagugu

SEQ ID NO: 124910 - RNA, 22 nt, Human
aaguccagcagugcuuguugau

SEQ ID NO: 124911 - RNA, 22 nt, Human
agcagggcaugaauaaggguuu

SEQ ID NO: 124912 - RNA, 22 nt, Human
cggggcaggagucccuguagag

SEQ ID NO: 124913 - RNA, 22 nt, Human
ucaguggagcuaagcaugagau

SEQ ID NO: 124914 - RNA, 22 nt, Human
augcugugccuggaaagcggcu

SEQ ID NO: 124915 - RNA, 22 nt, Human
agaaugcauuuuguguagcuau

SEQ ID NO: 124916 - RNA, 20 nt, Human
acaguggaaauugaugucug

SEQ ID NO: 124917 - RNA, 19 nt, Human
caguggagauuggaggagg

SEQ ID NO: 124918 - RNA, 22 nt, Human
caccagggcucugagcucugaa

SEQ ID NO: 124919 - RNA, 22 nt, Human
guuucaaagcacagcucacauu

SEQ ID NO: 124920 - RNA, 22 nt, Human
aaagucugagcagaauuucuca

SEQ ID NO: 124921 - RNA, 22 nt, Human
caguggaauauauaggggauuu

SEQ ID NO: 124922 - RNA, 22 nt, Human
cugcugugagugguucuugccu

SEQ ID NO: 124923 - RNA, 22 nt, Human
ugccaggccacguagcuucaag

SEQ ID NO: 124924 - RNA, 22 nt, Human
uagggcaggugaagaaaagcua

SEQ ID NO: 124925 - RNA, 22 nt, Human
gaggcugaauggccagaagcca

SEQ ID NO: 124926 - RNA, 22 nt, Human
aggcugucucaccucaggaggg

SEQ ID NO: 124927 - RNA, 22 nt, Human
gccucccugagucacccaagca

SEQ ID NO: 124928 - RNA, 19 nt, Human
aggcaggugcagagguccc

SEQ ID NO: 124929 - RNA, 16 nt, Human
gcagaggaaaggggag

SEQ ID NO: 124930 - RNA, 22 nt, Human
aggcagcagagguugaggaaag

SEQ ID NO: 124931 - RNA, 22 nt, Human
gaggcacaauacaugucucaag

SEQ ID NO: 124932 - RNA, 22 nt, Human
agggucagguuaagggagucau

SEQ ID NO: 124933 - RNA, 22 nt, Human
acacacuguugcucauccaggc

SEQ ID NO: 124934 - RNA, 22 nt, Human
uggcagguuuccuccucauagu

SEQ ID NO: 124935 - RNA, 22 nt, Human
uugccucccagcaugggcagcu

SEQ ID NO: 124936 - RNA, 22 nt, Human
agcccucugcaaacaccugaua

SEQ ID NO: 124937 - RNA, 22 nt, Human
gcaggagcuggaaagugauguu

SEQ ID NO: 124938 - RNA, 22 nt, Human
uuuaucacagaauaagaaguca

SEQ ID NO: 124939 - RNA, 22 nt, Human
agguggcaggaggucagagaaa

SEQ ID NO: 124940 - RNA, 22 nt, Human
ggaggaagugcaguucuacuac

SEQ ID NO: 124941 - RNA, 22 nt, Human
augaggcaucuaacauugcaaa

SEQ ID NO: 124942 - RNA, 22 nt, Human
ccucccuggccagagcagcagc

SEQ ID NO: 124943 - RNA, 22 nt, Human
gcaggagccaggccgagcuggu

SEQ ID NO: 124944 - RNA, 22 nt, Human
aguggcagagguugacugcagu

SEQ ID NO: 124945 - RNA, 20 nt, Human
aggccaggaaauguaguucu

SEQ ID NO: 124946 - RNA, 22 nt, Human
gcagccugaggcccuuucuggc

SEQ ID NO: 124947 - RNA, 23 nt, Human
agggcaugaagcagaggacgugg

SEQ ID NO: 124948 - RNA, 22 nt, Human
aggcucaggucucaggucuggc

SEQ ID NO: 124949 - RNA, 20 nt, Human
ugaggcaggagaauggcaug

SEQ ID NO: 124950 - RNA, 22 nt, Human
caccaggcuggagugcagaggu

SEQ ID NO: 124951 - RNA, 22 nt, Human
acaaguggguccuacauaaagc

SEQ ID NO: 124952 - RNA, 22 nt, Human
cacaggaaugaacagggaaaga

SEQ ID NO: 124953 - RNA, 22 nt, Human
aggcuucacgaugggugaggug

SEQ ID NO: 124954 - RNA, 22 nt, Human
ggcagaggaagcuggaaguggg

SEQ ID NO: 124955 - RNA, 22 nt, Human
uaaaggcuuuuagugaugguaa

SEQ ID NO: 124956 - RNA, 22 nt, Human
cauuuucagcacccaucugaaa

SEQ ID NO: 124957 - RNA, 22 nt, Human
uggccaccccuuucucugcacu

SEQ ID NO: 124958 - RNA, 17 nt, Human
aggugcagaggcagagc

SEQ ID NO: 124959 - RNA, 22 nt, Human
gaggcagugucgguggcaggau

SEQ ID NO: 124960 - RNA, 22 nt, Human
acaguggaagaagcacugaacu

SEQ ID NO: 124961 - RNA, 23 nt, Human
gccuggagaaaagcugcaguuca

SEQ ID NO: 124962 - RNA, 22 nt, Human
cacugcccagcgucuuaggcac

SEQ ID NO: 124963 - RNA, 20 nt, Human
agugggagagggcagacugc

SEQ ID NO: 124964 - RNA, 19 nt, Human
aggcagcauucuggggcuu

SEQ ID NO: 124965 - RNA, 22 nt, Human
ucccaggcuggcaggcagcagu

SEQ ID NO: 124966 - RNA, 22 nt, Human
uccugaaaaauuacauguucag

SEQ ID NO: 124967 - RNA, 22 nt, Human
ucaggcugcuguacugugaaug

SEQ ID NO: 124968 - RNA, 22 nt, Human
ggcuugggagcaggcaugugac

SEQ ID NO: 124969 - RNA, 22 nt, Human
ucauccaguaccauggaaggca

SEQ ID NO: 124970 - RNA, 22 nt, Human
ggaggagcacuucugagcucag

SEQ ID NO: 124971 - RNA, 22 nt, Human
uuuucaucucugcuuuguaccu

SEQ ID NO: 124972 - RNA, 22 nt, Human
cggcagggcuccaugcauuucu

SEQ ID NO: 124973 - RNA, 22 nt, Human
ugaaggagcugauguaaggggu

SEQ ID NO: 124974 - RNA, 22 nt, Human
aaggaagaagacucuuuacucc

SEQ ID NO: 124975 - RNA, 22 nt, Human
cucugguucagggcucccuggc

SEQ ID NO: 124976 - RNA, 22 nt, Human
ccagaagaggacacagugugga

SEQ ID NO: 124977 - RNA, 22 nt, Human
ccaggcucugagccucacucuu

SEQ ID NO: 124978 - RNA, 22 nt, Human
agcagggcagcugaugcgcacg

SEQ ID NO: 124979 - RNA, 22 nt, Human
uggcaggauuugcccggaagga

SEQ ID NO: 124980 - RNA, 22 nt, Human
ugccaggcugcccuccagucug

SEQ ID NO: 124981 - RNA, 22 nt, Human
agaggcaacauggggaacagau

SEQ ID NO: 124982 - RNA, 22 nt, Human
ugaccuauuagauuuccuugcc

SEQ ID NO: 124983 - RNA, 22 nt, Human
aaugggaagccagaagacaagg

SEQ ID NO: 124984 - RNA, 22 nt, Human
gccaggcugacucccccggccu

SEQ ID NO: 124985 - RNA, 22 nt, Human
uggcagagucucuccuuuccag

SEQ ID NO: 124986 - RNA, 23 nt, Human
aggagacagggaagugccuggcu

SEQ ID NO: 124987 - RNA, 21 nt, Human
aucccagcacccaggagugca

SEQ ID NO: 124988 - RNA, 22 nt, Human
agaguggagagaaacaacucug

SEQ ID NO: 124989 - RNA, 22 nt, Human
augcagaaggagccaugcuugc

SEQ ID NO: 124990 - RNA, 22 nt, Human
ugaggcucagugagcccugcag

SEQ ID NO: 124991 - RNA, 22 nt, Human
uggagaauucuauguugagggg

SEQ ID NO: 124992 - RNA, 22 nt, Human
gcucaaagaauauucagaauga

SEQ ID NO: 124993 - RNA, 22 nt, Human
gagccagggcugugagcugagc

SEQ ID NO: 124994 - RNA, 22 nt, Human
gggcaguggcucacgccuguaa

SEQ ID NO: 124995 - RNA, 22 nt, Human
agucaggauaugccuugugggc

SEQ ID NO: 124996 - RNA, 22 nt, Human
ccaggugugauuuggcaguguc

SEQ ID NO: 124997 - RNA, 22 nt, Human
gcaaaggcuagagacacaggga

SEQ ID NO: 124998 - RNA, 22 nt, Human
ggggccagguccagcuuccaaa

SEQ ID NO: 124999 - RNA, 22 nt, Human
ggaggaguguggggcacucugc

SEQ ID NO: 125000 - RNA, 22 nt, Human
cggcagagcuuccugcucagcg

SEQ ID NO: 125001 - RNA, 22 nt, Human
agcagggcccacuaggggagau

SEQ ID NO: 125002 - RNA, 22 nt, Human
gagggccagcagccucagcaug

SEQ ID NO: 125003 - RNA, 22 nt, Human
gaggagaagcuauuggaaggac

SEQ ID NO: 125004 - RNA, 22 nt, Human
agcagcagaagggagacccagg

SEQ ID NO: 125005 - RNA, 22 nt, Human
guaaucucagcuacuugggagg

SEQ ID NO: 125006 - RNA, 22 nt, Human
gggagccagcagggcauggagc

SEQ ID NO: 125007 - RNA, 22 nt, Human
ggcugagcguggcugccguggg

SEQ ID NO: 125008 - RNA, 22 nt, Human
aggcagcauuucugcuuaucca

SEQ ID NO: 125009 - RNA, 22 nt, Human
uggcugaguuccuggcacacgg

SEQ ID NO: 125010 - RNA, 22 nt, Human
gagaaagggaacuuacagagug

SEQ ID NO: 125011 - RNA, 20 nt, Human
gcaugaggaaucauugcagc

SEQ ID NO: 125012 - RNA, 22 nt, Human
gcccaggauucuuucuuccuua

SEQ ID NO: 125013 - RNA, 22 nt, Human
gcagggcagcugaagcuaggug

SEQ ID NO: 125014 - RNA, 22 nt, Human
ucaccacugaacagaccuuugg

SEQ ID NO: 125015 - RNA, 22 nt, Human
gagcugcuggcuccucagguua

SEQ ID NO: 125016 - RNA, 22 nt, Human
ggucagcagugcagggcagagc

SEQ ID NO: 125017 - RNA, 22 nt, Human
gcaggagagucugugccagguu

SEQ ID NO: 125018 - RNA, 22 nt, Human
cuguccccgcgaguccagagcu

SEQ ID NO: 125019 - RNA, 22 nt, Human
aaguccagacuccuuugcgugg

SEQ ID NO: 125020 - RNA, 22 nt, Human
ugaggcaggagaaucaccggaa

SEQ ID NO: 125021 - RNA, 22 nt, Human
ugaggcucuccaagcagaugag

SEQ ID NO: 125022 - RNA, 22 nt, Human
ggcagugaacagaaaugcagaa

SEQ ID NO: 125023 - RNA, 22 nt, Human
accugccucuaagcagcaggug

SEQ ID NO: 125024 - RNA, 22 nt, Human
gggcugagugggccucuuacuu

SEQ ID NO: 125025 - RNA, 22 nt, Human
auggagugggccaauuuuagug

SEQ ID NO: 125026 - RNA, 22 nt, Human
gcagaggcauuucugacgcugc

SEQ ID NO: 125027 - RNA, 22 nt, Human
guggagcaaucagagggucagu

SEQ ID NO: 125028 - RNA, 22 nt, Human
ugggccacacacagaagaauca

SEQ ID NO: 125029 - RNA, 22 nt, Human
ggcugcaggaugcccagccgug

SEQ ID NO: 125030 - RNA, 19 nt, Human
aggcagucauuggaauaua

SEQ ID NO: 125031 - RNA, 22 nt, Human
augaggcagauguugcaugagg

SEQ ID NO: 125032 - RNA, 22 nt, Human
aggaggaggugggacacaguga

SEQ ID NO: 125033 - RNA, 22 nt, Human
agaagccauaguaucucagggu

SEQ ID NO: 125034 - RNA, 22 nt, Human
acaguggaauggugggccugca

SEQ ID NO: 125035 - RNA, 19 nt, Human
gguguccuagagauaagag

SEQ ID NO: 125036 - RNA, 22 nt, Human
ggagaggcgaugagucacagcc

SEQ ID NO: 125037 - RNA, 22 nt, Human
caguggcaaugggacagagcac

SEQ ID NO: 125038 - RNA, 22 nt, Human
uggagaagucaaagugaacagg

SEQ ID NO: 125039 - RNA, 22 nt, Human
agagcugaaaaagcugacccgg

SEQ ID NO: 125040 - RNA, 19 nt, Human
cugugcaggccgggcugag

SEQ ID NO: 125041 - RNA, 21 nt, Human
ugaggcucuguugugccugca

SEQ ID NO: 125042 - RNA, 22 nt, Human
ggagaugcuauguaguuugguu

SEQ ID NO: 125043 - RNA, 22 nt, Human
uuucacaaacugaggagacaau

SEQ ID NO: 125044 - RNA, 22 nt, Human
agccugcuucccuuugugcccc

SEQ ID NO: 125045 - RNA, 22 nt, Human
ugagccaggaguuugaggcugu

SEQ ID NO: 125046 - RNA, 21 nt, Human
uuuucccacugaaagcuccca

SEQ ID NO: 125047 - RNA, 22 nt, Human
aggcaggcuagucgcuugagcc

SEQ ID NO: 125048 - RNA, 22 nt, Human
agccagggacgcugcaggcuac

SEQ ID NO: 125049 - RNA, 21 nt, Human
ugccaggccugagcugggguc

SEQ ID NO: 125050 - RNA, 22 nt, Human
gcggcaggaagagcgcagcccc

SEQ ID NO: 125051 - RNA, 22 nt, Human
ccugggcagggagaccaggcuc

SEQ ID NO: 125052 - RNA, 22 nt, Human
uucugcaggagcccuaguguau

SEQ ID NO: 125053 - RNA, 22 nt, Human
aggcugagacugugcauuagug

SEQ ID NO: 125054 - RNA, 22 nt, Human
gcagggcuguggacacuuuggu

SEQ ID NO: 125055 - RNA, 22 nt, Human
cugcccucuagaggaggacuga

SEQ ID NO: 125056 - RNA, 22 nt, Human
gacagaggcaagaccagaagcc

SEQ ID NO: 125057 - RNA, 22 nt, Human
agggcagcccuucugggagggc

SEQ ID NO: 125058 - RNA, 22 nt, Human
gcagaggagugauuaugccgug

SEQ ID NO: 125059 - RNA, 22 nt, Human
gggcugagccacagcuuuuguu

SEQ ID NO: 125060 - RNA, 21 nt, Human
uggcagagugcagucuauaca

SEQ ID NO: 125061 - RNA, 22 nt, Human
gggcagguggcagggucucugg

SEQ ID NO: 125062 - RNA, 22 nt, Human
cccagccucagcuuuacuucca

SEQ ID NO: 125063 - RNA, 22 nt, Human
agugcagccgagaucaggugcu

SEQ ID NO: 125064 - RNA, 22 nt, Human
gaggcagagaccuucaggaccu

SEQ ID NO: 125065 - RNA, 22 nt, Human
agggccagaguacaucagggcu

SEQ ID NO: 125066 - RNA, 22 nt, Human
gagaaggcuggucuuaagucga

SEQ ID NO: 125067 - RNA, 22 nt, Human
gaggcucagggaaacagcgcag

SEQ ID NO: 125068 - RNA, 22 nt, Human
agcugacugaugaagaggccuu

SEQ ID NO: 125069 - RNA, 23 nt, Human
ccagcugugccuggcccaggagc

SEQ ID NO: 125070 - RNA, 22 nt, Human
ucaguuaagaggccacggcagu

SEQ ID NO: 125071 - RNA, 22 nt, Human
ucccugcagacguccugcgggu

SEQ ID NO: 125072 - RNA, 22 nt, Human
uaguggaggggaugcaaagcuu

SEQ ID NO: 125073 - RNA, 17 nt, Human
caggcagacauguaagc

SEQ ID NO: 125074 - RNA, 22 nt, Human
gcagggcacaaggacgcacagg

SEQ ID NO: 125075 - RNA, 22 nt, Human
guccucuuagccacuuaauuau

SEQ ID NO: 125076 - RNA, 22 nt, Human
gcaggugauucacccugggccu

SEQ ID NO: 125077 - RNA, 18 nt, Human
cccagcccaccauuucuc

SEQ ID NO: 125078 - RNA, 22 nt, Human
cagggcccagucccugcuguca

SEQ ID NO: 125079 - RNA, 17 nt, Human
aggcaggagauuggaga

SEQ ID NO: 125080 - RNA, 18 nt, Human
gagcugggagaaggaagg

SEQ ID NO: 125081 - RNA, 22 nt, Human
ucaggcuggaaugcaguggggc

SEQ ID NO: 125082 - RNA, 22 nt, Human
uggcagagaacacggcugaucu

SEQ ID NO: 125083 - RNA, 22 nt, Human
cagcacaauuuucaggagucca

SEQ ID NO: 125084 - RNA, 19 nt, Human
ggagaagcaucuagaaaua

SEQ ID NO: 125085 - RNA, 22 nt, Human
gcgagggcacgcgguugaaggc

SEQ ID NO: 125086 - RNA, 22 nt, Human
agggcagccucucagccuaggu

SEQ ID NO: 125087 - RNA, 22 nt, Human
ccagaagacaagaauguucuua

SEQ ID NO: 125088 - RNA, 22 nt, Human
gcagaugaggaagcuaaugcug

SEQ ID NO: 125089 - RNA, 22 nt, Human
aacaggcaaacugugggauccc

SEQ ID NO: 125090 - RNA, 22 nt, Human
ugccaaggagcuggaucagggc

SEQ ID NO: 125091 - RNA, 22 nt, Human
cagggcuggauccuccagacuc

SEQ ID NO: 125092 - RNA, 22 nt, Human
gaaggccuaggaaggaagccuu

SEQ ID NO: 125093 - RNA, 22 nt, Human
acaguggaagcaugaugcuauc

SEQ ID NO: 125094 - RNA, 22 nt, Human
agggaggaguccucaaagucau

SEQ ID NO: 125095 - RNA, 22 nt, Human
cagugcaguugguggcaggggu

SEQ ID NO: 125096 - RNA, 22 nt, Human
agugggggccaacgagggcagc

SEQ ID NO: 125097 - RNA, 22 nt, Human
aggcccaguagugcugccuuua

SEQ ID NO: 125098 - RNA, 22 nt, Human
uggagaugcacgagcaggugga

SEQ ID NO: 125099 - RNA, 22 nt, Human
cagcuguguagaugcaggguca

SEQ ID NO: 125100 - RNA, 22 nt, Human
ggcugagcaauuuugaugacau

SEQ ID NO: 125101 - RNA, 22 nt, Human
gaaaggaaauauucuaagcacu

SEQ ID NO: 125102 - RNA, 22 nt, Human
ggaagccagaaagugagaauau

SEQ ID NO: 125103 - RNA, 22 nt, Human
ucagaggagggacucagaccca

SEQ ID NO: 125104 - RNA, 22 nt, Human
cuggaaguauaggggagaugau

SEQ ID NO: 125105 - RNA, 22 nt, Human
aaggccagaguacuagaggcug

SEQ ID NO: 125106 - RNA, 22 nt, Human
cagcacaguacaaggcacggau

SEQ ID NO: 125107 - RNA, 22 nt, Human
agugagcauucguuuggaaccc

SEQ ID NO: 125108 - RNA, 22 nt, Human
agccaguguuaagugacugguu

SEQ ID NO: 125109 - RNA, 22 nt, Human
uggagaagcuguagguggacuc

SEQ ID NO: 125110 - RNA, 22 nt, Human
agcaguggugugaggagggcuc

SEQ ID NO: 125111 - RNA, 22 nt, Human
gagccagcuacauggucugcaa

SEQ ID NO: 125112 - RNA, 22 nt, Human
ggcaggagaaaggucucuucuu

SEQ ID NO: 125113 - RNA, 21 nt, Human
cacuggaauuuucugugacau

SEQ ID NO: 125114 - RNA, 22 nt, Human
gcuccucugucaaaugagagug

SEQ ID NO: 125115 - RNA, 22 nt, Human
agggagcaugggugaagcaggc

SEQ ID NO: 125116 - RNA, 22 nt, Human
cucccagggccaucgagucacu

SEQ ID NO: 125117 - RNA, 22 nt, Human
cugugaauuaaguauuguuauc

SEQ ID NO: 125118 - RNA, 22 nt, Human
agcagggcuccugaaagccgcg

SEQ ID NO: 125119 - RNA, 22 nt, Human
ugaggaaacuuacaaggcagaa

SEQ ID NO: 125120 - RNA, 23 nt, Human
gaagccacacaaaggucgccaag

SEQ ID NO: 125121 - RNA, 22 nt, Human
agcagggcuuugucucugugaa

SEQ ID NO: 125122 - RNA, 22 nt, Human
gggcaugguggugcacaccugu

SEQ ID NO: 125123 - RNA, 22 nt, Human
caggaaagagcugccaggcagg

SEQ ID NO: 125124 - RNA, 22 nt, Human
gcugaaggcccggaggacaggg

SEQ ID NO: 125125 - RNA, 22 nt, Human
gccuggaggguugagguuuugu

SEQ ID NO: 125126 - RNA, 22 nt, Human
agaagccagaggcaguggguac

SEQ ID NO: 125127 - RNA, 19 nt, Human
gagcugagaguagcacugg

SEQ ID NO: 125128 - RNA, 22 nt, Human
ggggcaggagguguucucuuuu

SEQ ID NO: 125129 - RNA, 22 nt, Human
agugaagaggaaguggggcaca

SEQ ID NO: 125130 - RNA, 22 nt, Human
uccuguggagaggacuggaggu

SEQ ID NO: 125131 - RNA, 22 nt, Human
gggaagggacuuguuuaagguc

SEQ ID NO: 125132 - RNA, 22 nt, Human
agaggcagaaguguucaaaccc

SEQ ID NO: 125133 - RNA, 22 nt, Human
aguggcagagaccccagccagc

SEQ ID NO: 125134 - RNA, 22 nt, Human
ugagaagcugcuugugcuguau

SEQ ID NO: 125135 - RNA, 22 nt, Human
cgcagggccgcgagcgggacca

SEQ ID NO: 125136 - RNA, 22 nt, Human
aggaauucaagaccagcugggc

SEQ ID NO: 125137 - RNA, 22 nt, Human
gauuuucaugauaaacuuguga

SEQ ID NO: 125138 - RNA, 22 nt, Human
ccacugcccaccccgacgucua

SEQ ID NO: 125139 - RNA, 19 nt, Human
gcgaggaagucacuguggc

SEQ ID NO: 125140 - RNA, 22 nt, Human
ugggacuugccucgagggcugc

SEQ ID NO: 125141 - RNA, 22 nt, Human
agggccugcucuaucacucuca

SEQ ID NO: 125142 - RNA, 22 nt, Human
ggaagccagagugcugggcagg

SEQ ID NO: 125143 - RNA, 22 nt, Human
cagaagcaaaugccuugcugag

SEQ ID NO: 125144 - RNA, 22 nt, Human
ccuaggccuuacuuuccugugc

SEQ ID NO: 125145 - RNA, 22 nt, Human
augcugugauuguagaaauauu

SEQ ID NO: 125146 - RNA, 22 nt, Human
uaggcagauguuaacaggaaaa

SEQ ID NO: 125147 - RNA, 22 nt, Human
aggcagugagugugacuucaca

SEQ ID NO: 125148 - RNA, 22 nt, Human
ggagugaaguggcgcgaucucg

SEQ ID NO: 125149 - RNA, 22 nt, Human
uacugugaauacaaaauaaauu

SEQ ID NO: 125150 - RNA, 22 nt, Human
aaguaaaacacacaguccaccg

SEQ ID NO: 125151 - RNA, 22 nt, Human
uuuugaaagaguccugcuacag

SEQ ID NO: 125152 - RNA, 22 nt, Human
uugaccuauguuucuucaucug

SEQ ID NO: 125153 - RNA, 22 nt, Human
agagacuggagaugggcagugu

SEQ ID NO: 125154 - RNA, 22 nt, Human
cuguuuucccuggaguucagca

SEQ ID NO: 125155 - RNA, 22 nt, Human
cgggcagugcccagcggggcag

SEQ ID NO: 125156 - RNA, 22 nt, Human
caggggcaagaaugcugucagc

SEQ ID NO: 125157 - RNA, 22 nt, Human
aggcucagaggugagcaucugc

SEQ ID NO: 125158 - RNA, 22 nt, Human
agggcagcacaaggcauggacu

SEQ ID NO: 125159 - RNA, 22 nt, Human
gugcagugacccuggagagcug

SEQ ID NO: 125160 - RNA, 19 nt, Human
cuggaaugagaacaugccc

SEQ ID NO: 125161 - RNA, 22 nt, Human
agaaagcuuaugaaugggcaag

SEQ ID NO: 125162 - RNA, 22 nt, Human
agugggaccggugcuauuccag

SEQ ID NO: 125163 - RNA, 22 nt, Human
ugaggcaguucuuacuuguauu

SEQ ID NO: 125164 - RNA, 22 nt, Human
uagucucugcuuugcccuuggc

SEQ ID NO: 125165 - RNA, 22 nt, Human
aggaggggcauagaaauguaau

SEQ ID NO: 125166 - RNA, 22 nt, Human
cuccucuuuacccgcauggucu

SEQ ID NO: 125167 - RNA, 22 nt, Human
cgccaggcuugguagcucaugc

SEQ ID NO: 125168 - RNA, 22 nt, Human
ugaagccauuacuguguuaggg

SEQ ID NO: 125169 - RNA, 22 nt, Human
ucucugagguuguuuccagcac

SEQ ID NO: 125170 - RNA, 22 nt, Human
gaggcucagagggacuuucaag

SEQ ID NO: 125171 - RNA, 22 nt, Human
uuacaagugucagguacuggca

SEQ ID NO: 125172 - RNA, 22 nt, Human
aguggcagccgagcaggagaug

SEQ ID NO: 125173 - RNA, 22 nt, Human
cagagcuggagcuugaauggag

SEQ ID NO: 125174 - RNA, 22 nt, Human
ugaagccaucccucagauggcc

SEQ ID NO: 125175 - RNA, 22 nt, Human
gggcagguggcaaagccagagg

SEQ ID NO: 125176 - RNA, 19 nt, Human
gguagaagggaaguguuuu

SEQ ID NO: 125177 - RNA, 22 nt, Human
agaagaaaugugaaggccacug

SEQ ID NO: 125178 - RNA, 22 nt, Human
ugaagaauguugcagugagcau

SEQ ID NO: 125179 - RNA, 22 nt, Human
uggcucagaagaaaagguaaac

SEQ ID NO: 125180 - RNA, 22 nt, Human
gcucccaggaugaggagccagg

SEQ ID NO: 125181 - RNA, 22 nt, Human
agcuguggcaaccuugucagac

SEQ ID NO: 125182 - RNA, 22 nt, Human
ccagaagggcuauugcagugac

SEQ ID NO: 125183 - RNA, 22 nt, Human
accaaagggcagaacaugagca

SEQ ID NO: 125184 - RNA, 22 nt, Human
uggcucagagcagggacucugg

SEQ ID NO: 125185 - RNA, 21 nt, Human
agcagaggggacauguuugau

SEQ ID NO: 125186 - RNA, 22 nt, Human
gaggcagcggcucacagagaaa

SEQ ID NO: 125187 - RNA, 21 nt, Human
ggcaggauggcaguggacccc

SEQ ID NO: 125188 - RNA, 22 nt, Human
agagcugccgagcuggggccau

SEQ ID NO: 125189 - RNA, 22 nt, Human
uccuguggucuggaaggaaugg

SEQ ID NO: 125190 - RNA, 22 nt, Human
caccaggcugaaccagagggga

SEQ ID NO: 125191 - RNA, 22 nt, Human
agggcagaaaucgauuacaccu

SEQ ID NO: 125192 - RNA, 22 nt, Human
uggcagcaaaaccagaaucaga

SEQ ID NO: 125193 - RNA, 21 nt, Human
agcagaggcugccuggugacu

SEQ ID NO: 125194 - RNA, 22 nt, Human
gaauucugguccuguccaaggu

SEQ ID NO: 125195 - RNA, 22 nt, Human
gcagggcagugugucugugggg

SEQ ID NO: 125196 - RNA, 22 nt, Human
aaggaagacuugagaagguucc

SEQ ID NO: 125197 - RNA, 22 nt, Human
ccagagccucgcccggagccuc

SEQ ID NO: 125198 - RNA, 22 nt, Human
uagaggcagaagaaauugacaa

SEQ ID NO: 125199 - RNA, 22 nt, Human
gcagagcucaugccugcaccuc

SEQ ID NO: 125200 - RNA, 22 nt, Human
cuaguucuagaucccugaggaa

SEQ ID NO: 125201 - RNA, 22 nt, Human
ucagggcaggcgagcagcugcu

SEQ ID NO: 125202 - RNA, 22 nt, Human
gccuggagccucagcaaggagg

SEQ ID NO: 125203 - RNA, 22 nt, Human
gccagcugcuggaacagcgcga

SEQ ID NO: 125204 - RNA, 22 nt, Human
aggagucagauuguuugaaugu

SEQ ID NO: 125205 - RNA, 22 nt, Human
cauuugcaagagauaaauguuu

SEQ ID NO: 125206 - RNA, 22 nt, Human
ccagggcugcugugggacucca

SEQ ID NO: 125207 - RNA, 22 nt, Human
gggcagguuauuggaguaggga

SEQ ID NO: 125208 - RNA, 20 nt, Human
agaagccaagugacauguuu

SEQ ID NO: 125209 - RNA, 22 nt, Human
ucagggcagaauccaaagaauu

SEQ ID NO: 125210 - RNA, 22 nt, Human
caggcagaaggaaguaccaggc

SEQ ID NO: 125211 - RNA, 22 nt, Human
gccuucccaagacgccugaguu

SEQ ID NO: 125212 - RNA, 22 nt, Human
gaggcagaggaagguggucucu

SEQ ID NO: 125213 - RNA, 22 nt, Human
cagugaggcucugcugagcggu

SEQ ID NO: 125214 - RNA, 22 nt, Human
ugcagggccccucugcaugagu

SEQ ID NO: 125215 - RNA, 19 nt, Human
ccugugacuaucuuuguaa

SEQ ID NO: 125216 - RNA, 22 nt, Human
gggaaggagguggcuugaagug

SEQ ID NO: 125217 - RNA, 22 nt, Human
cagagugaaauaggggaucaag

SEQ ID NO: 125218 - RNA, 22 nt, Human
uguccuuuucuuuagugcagcu

SEQ ID NO: 125219 - RNA, 22 nt, Human
aggcucagggacggggccccuu

SEQ ID NO: 125220 - RNA, 22 nt, Human
cuaguccagucucaaaaugcua

SEQ ID NO: 125221 - RNA, 22 nt, Human
gcagggcauagaggcacggagg

SEQ ID NO: 125222 - RNA, 22 nt, Human
agggcagacuaggauggaagug

SEQ ID NO: 125223 - RNA, 22 nt, Human
ggcaggagcucuccaguuugcc

SEQ ID NO: 125224 - RNA, 21 nt, Human
gugguucuagagaaacagaau

SEQ ID NO: 125225 - RNA, 22 nt, Human
acagagcuaaauuucaauccca

SEQ ID NO: 125226 - RNA, 22 nt, Human
aauuuuaucucuaagcaggcuu

SEQ ID NO: 125227 - RNA, 17 nt, Human
cugaagauaauggcaac

SEQ ID NO: 125228 - RNA, 23 nt, Human
agggccacugggaaggauuacug

SEQ ID NO: 125229 - RNA, 21 nt, Human
cagaggcagguccugggacgg

SEQ ID NO: 125230 - RNA, 22 nt, Human
ugcagggcuacaggacuacaac

SEQ ID NO: 125231 - RNA, 22 nt, Human
agggcagagaucugagugggca

SEQ ID NO: 125232 - RNA, 22 nt, Human
augaggcaugugaggagaaggg

SEQ ID NO: 125233 - RNA, 22 nt, Human
acagaggccgccucucucacgg

SEQ ID NO: 125234 - RNA, 22 nt, Human
uggcagcauguuauguaaggaa

SEQ ID NO: 125235 - RNA, 22 nt, Human
uggcugagcugcagcguggcuu

SEQ ID NO: 125236 - RNA, 22 nt, Human
cagugcagaggugcaagcaugu

SEQ ID NO: 125237 - RNA, 22 nt, Human
gggucaggcucagcagggcagc

SEQ ID NO: 125238 - RNA, 20 nt, Human
ccagagcugauggcugcccg

SEQ ID NO: 125239 - RNA, 22 nt, Human
uagaggcacccuggaggagacu

SEQ ID NO: 125240 - RNA, 22 nt, Human
acguggagagaauagggcacca

SEQ ID NO: 125241 - RNA, 22 nt, Human
acucccagguugccuggcaggc

SEQ ID NO: 125242 - RNA, 19 nt, Human
uggcaggcccaggauggac

SEQ ID NO: 125243 - RNA, 22 nt, Human
gaggccacgguuuuccuugggg

SEQ ID NO: 125244 - RNA, 22 nt, Human
ccagugcccagcugcccaggca

SEQ ID NO: 125245 - RNA, 22 nt, Human
cagaaggcaaacaaaaggauuu

SEQ ID NO: 125246 - RNA, 22 nt, Human
ugugaaggagcaugcagagggg

SEQ ID NO: 125247 - RNA, 22 nt, Human
agagccugcuaccucauuccag

SEQ ID NO: 125248 - RNA, 22 nt, Human
auuucuacugugagaaacauga

SEQ ID NO: 125249 - RNA, 21 nt, Human
aucaccagcagaagcugcaga

SEQ ID NO: 125250 - RNA, 22 nt, Human
gagggcagaaaauuaugcggug

SEQ ID NO: 125251 - RNA, 22 nt, Human
uaguaugggaagaacuuuguag

SEQ ID NO: 125252 - RNA, 22 nt, Human
cugacucccaaagaggacgcgu

SEQ ID NO: 125253 - RNA, 22 nt, Human
cacagcugaaguagccaugugg

SEQ ID NO: 125254 - RNA, 22 nt, Human
uggcagagugcggcauccccug

SEQ ID NO: 125255 - RNA, 22 nt, Human
aggagugggggcgagaaguuaa

SEQ ID NO: 125256 - RNA, 22 nt, Human
ugggagcaccuugagggcagaa

SEQ ID NO: 125257 - RNA, 22 nt, Human
cgcaccacugaauuccagccug

SEQ ID NO: 125258 - RNA, 22 nt, Human
gugcagauccugauugcaguuc

SEQ ID NO: 125259 - RNA, 20 nt, Human
uggcagaguugucccaccca

SEQ ID NO: 125260 - RNA, 22 nt, Human
cagaggcacaagaaagcaaggc

SEQ ID NO: 125261 - RNA, 22 nt, Human
gcugcugugugggagacaggcg

SEQ ID NO: 125262 - RNA, 22 nt, Human
ggcaggguggcagaggcucaga

SEQ ID NO: 125263 - RNA, 22 nt, Human
ggccaggagauggacaccacau

SEQ ID NO: 125264 - RNA, 22 nt, Human
auguggaaugaacaaaggaggc

SEQ ID NO: 125265 - RNA, 22 nt, Human
gaaaggagaggguuaaggagcu

SEQ ID NO: 125266 - RNA, 22 nt, Human
cugaggcaugaaugugggcuuu

SEQ ID NO: 125267 - RNA, 22 nt, Human
gaaaugcauggaucuuggcaga

SEQ ID NO: 125268 - RNA, 22 nt, Human
ggggccagcacugugccuuugu

SEQ ID NO: 125269 - RNA, 22 nt, Human
aggcucaguuugguuuccauug

SEQ ID NO: 125270 - RNA, 22 nt, Human
cauuucauaguugucacaauaa

SEQ ID NO: 125271 - RNA, 22 nt, Human
aagaagguguggaaagaugcuc

SEQ ID NO: 125272 - RNA, 22 nt, Human
caggcagcgcucguggccuggc

SEQ ID NO: 125273 - RNA, 22 nt, Human
uugcagagugguugugaggauu

SEQ ID NO: 125274 - RNA, 22 nt, Human
gcugcagugagccaagaucgug

SEQ ID NO: 125275 - RNA, 22 nt, Human
agaagccaccagcugaggaaga

SEQ ID NO: 125276 - RNA, 19 nt, Human
aggacccuuauccuggcuu

SEQ ID NO: 125277 - RNA, 22 nt, Human
uggagcuggcuuguggaaguug

SEQ ID NO: 125278 - RNA, 16 nt, Human
ucagggcagaauggca

SEQ ID NO: 125279 - RNA, 22 nt, Human
aggcugagccacggggcuggcu

SEQ ID NO: 125280 - RNA, 22 nt, Human
ugaagugaccuggggcagugua

SEQ ID NO: 125281 - RNA, 19 nt, Human
ggagaggcuggagggaugc

SEQ ID NO: 125282 - RNA, 22 nt, Human
ugcagugugaccuguagcgagc

SEQ ID NO: 125283 - RNA, 19 nt, Human
gcugugggacagcagggug

SEQ ID NO: 125284 - RNA, 22 nt, Human
cuauuauuuccucaucuauaaa

SEQ ID NO: 125285 - RNA, 22 nt, Human
ggaggcagaacuucccgucagu

SEQ ID NO: 125286 - RNA, 22 nt, Human
ugggggacugcacuggcgucag

SEQ ID NO: 125287 - RNA, 22 nt, Human
cugaggcucaagggcagguggg

SEQ ID NO: 125288 - RNA, 22 nt, Human
ucaggaguaaagacagaguucc

SEQ ID NO: 125289 - RNA, 16 nt, Human
gaggcuggcagauguc

SEQ ID NO: 125290 - RNA, 21 nt, Human
acacugugucauaaugcuuaa

SEQ ID NO: 125291 - RNA, 22 nt, Human
gggagccacagugaggugcaug

SEQ ID NO: 125292 - RNA, 22 nt, Human
ccugcucagagcgucuugugug

SEQ ID NO: 125293 - RNA, 22 nt, Human
ggaaggaggggcaaagcaguuc

SEQ ID NO: 125294 - RNA, 22 nt, Human
cagagcuguauuuaucuuucca

SEQ ID NO: 125295 - RNA, 22 nt, Human
agcagggccucuggcacugguc

SEQ ID NO: 125296 - RNA, 22 nt, Human
ggcagauggagaagcagcaggu

SEQ ID NO: 125297 - RNA, 22 nt, Human
cagcugugcuagaagccacgaa

SEQ ID NO: 125298 - RNA, 22 nt, Human
aggagcagaccguaguccugca

SEQ ID NO: 125299 - RNA, 22 nt, Human
agggccaguaccaggugggugg

SEQ ID NO: 125300 - RNA, 22 nt, Human
aaugccucuuggaagaagacuu

SEQ ID NO: 125301 - RNA, 22 nt, Human
ucugccugcaguguggcagggc

SEQ ID NO: 125302 - RNA, 22 nt, Human
ucucccuggagcccugaagcau

SEQ ID NO: 125303 - RNA, 22 nt, Human
aaagcaaugggucuaagguaaa

SEQ ID NO: 125304 - RNA, 22 nt, Human
uggcugagggggcaguucagga

SEQ ID NO: 125305 - RNA, 22 nt, Human
uccagcuuauagguagauuuaa

SEQ ID NO: 125306 - RNA, 22 nt, Human
cugagaauuacucugaugagua

SEQ ID NO: 125307 - RNA, 22 nt, Human
ggcaguggugggaggcucgcuc

SEQ ID NO: 125308 - RNA, 22 nt, Human
uuaaugcuugucuagaucuucu

SEQ ID NO: 125309 - RNA, 22 nt, Human
ccagggcaauuauuuggagggu

SEQ ID NO: 125310 - RNA, 22 nt, Human
ggccaggcugcugggaccccgc

SEQ ID NO: 125311 - RNA, 22 nt, Human
aagagaaggauucugagccugg

SEQ ID NO: 125312 - RNA, 22 nt, Human
ccacccugagccgcaagagcag

SEQ ID NO: 125313 - RNA, 22 nt, Human
gcauccagagguagccacugug

SEQ ID NO: 125314 - RNA, 22 nt, Human
gcuguggaaaugccuaacauga

SEQ ID NO: 125315 - RNA, 22 nt, Human
aagggcugcauuugauguguca

SEQ ID NO: 125316 - RNA, 22 nt, Human
augcuguguccuagugaaagaa

SEQ ID NO: 125317 - RNA, 22 nt, Human
cagcugccuaugaccuagccuc

SEQ ID NO: 125318 - RNA, 22 nt, Human
cagccucuuuccacaucaggca

SEQ ID NO: 125319 - RNA, 22 nt, Human
ugaggaagcaaaggcuugugug

SEQ ID NO: 125320 - RNA, 20 nt, Human
gcagggcaucuuggccccca

SEQ ID NO: 125321 - RNA, 22 nt, Human
agcuggggguuggauaagggua

SEQ ID NO: 125322 - RNA, 22 nt, Human
caggaagcugugaaggagacgg

SEQ ID NO: 125323 - RNA, 20 nt, Human
ggaagccagggugcagggga

SEQ ID NO: 125324 - RNA, 22 nt, Human
gaagagcuccaaaaacagugag

SEQ ID NO: 125325 - RNA, 22 nt, Human
cagugcagucaaggaagaacca

SEQ ID NO: 125326 - RNA, 22 nt, Human
cugaggcuggcguuugaggaag

SEQ ID NO: 125327 - RNA, 22 nt, Human
cccaggaccgcgcggcugagcg

SEQ ID NO: 125328 - RNA, 22 nt, Human
agagccugucugccuuucuacc

SEQ ID NO: 125329 - RNA, 22 nt, Human
aggcugugagcaagaacaccua

SEQ ID NO: 125330 - RNA, 22 nt, Human
gcaggcugggguagccccacuu

SEQ ID NO: 125331 - RNA, 22 nt, Human
uaccucaugcuguacagcacgu

SEQ ID NO: 125332 - RNA, 22 nt, Human
uguuugcucugacuaucuugcg

SEQ ID NO: 125333 - RNA, 22 nt, Human
cgccuggaaccucuaggaccag

SEQ ID NO: 125334 - RNA, 22 nt, Human
aaaaugaacagaacaaugggga

SEQ ID NO: 125335 - RNA, 22 nt, Human
cucuggagaugguucucaauug

SEQ ID NO: 125336 - RNA, 22 nt, Human
auggcaagcaagcugaagagau

SEQ ID NO: 125337 - RNA, 22 nt, Human
agggcagccaugagccuucagg

SEQ ID NO: 125338 - RNA, 22 nt, Human
gggcugagagcuggaaucugag

SEQ ID NO: 125339 - RNA, 22 nt, Human
agggcagagggugccucaccug

SEQ ID NO: 125340 - RNA, 22 nt, Human
agcagggcugugcuccuuccga

SEQ ID NO: 125341 - RNA, 22 nt, Human
uccagcuuugagauuuuaugga

SEQ ID NO: 125342 - RNA, 22 nt, Human
gcucccagacugaccagaggug

SEQ ID NO: 125343 - RNA, 22 nt, Human
cggcugagacggccauagacac

SEQ ID NO: 125344 - RNA, 22 nt, Human
gggagccacaguuuauagugau

SEQ ID NO: 125345 - RNA, 22 nt, Human
uggcaggagacacauggcauag

SEQ ID NO: 125346 - RNA, 21 nt, Human
ggcagcacuaccugaagcaua

SEQ ID NO: 125347 - RNA, 22 nt, Human
caggagccagcugucccaacca

SEQ ID NO: 125348 - RNA, 22 nt, Human
accaaaaauuguggggcugaau

SEQ ID NO: 125349 - RNA, 22 nt, Human
gcagggcagaaggugcugagga

SEQ ID NO: 125350 - RNA, 22 nt, Human
aagggcaggagaagacggauau

SEQ ID NO: 125351 - RNA, 22 nt, Human
uggcagcaguagccaccccagc

SEQ ID NO: 125352 - RNA, 22 nt, Human
ucagaggacaagcucccuggug

SEQ ID NO: 125353 - RNA, 22 nt, Human
uccaucaccacagaggacagag

SEQ ID NO: 125354 - RNA, 22 nt, Human
cuccaggggccagaagccuggc

SEQ ID NO: 125355 - RNA, 22 nt, Human
ggugaaggucagagcaggaaaa

SEQ ID NO: 125356 - RNA, 18 nt, Human
aggcagcagcaucuucuc

SEQ ID NO: 125357 - RNA, 20 nt, Human
ugccaggcugcacgccugcc

SEQ ID NO: 125358 - RNA, 22 nt, Human
gcagccagggagagaaccaggg

SEQ ID NO: 125359 - RNA, 22 nt, Human
aaguggagagcccuggaggucu

SEQ ID NO: 125360 - RNA, 22 nt, Human
gcacaugguaggcauuugaugu

SEQ ID NO: 125361 - RNA, 22 nt, Human
gcagagcugucuaagucacuuc

SEQ ID NO: 125362 - RNA, 20 nt, Human
ucagggcaugggacagcccc

SEQ ID NO: 125363 - RNA, 22 nt, Human
gcaccaggaggcccuucucauc

SEQ ID NO: 125364 - RNA, 22 nt, Human
caguccaggccuggaggagcca

SEQ ID NO: 125365 - RNA, 22 nt, Human
ggcagagguagcuggaaccagg

SEQ ID NO: 125366 - RNA, 22 nt, Human
ggcugcagaggcgaucugaggu

SEQ ID NO: 125367 - RNA, 22 nt, Human
gaggcagcagaacauggaagag

SEQ ID NO: 125368 - RNA, 22 nt, Human
caggucagagucccccuguccu

SEQ ID NO: 125369 - RNA, 20 nt, Human
cagaggcaaggagacuugga

SEQ ID NO: 125370 - RNA, 22 nt, Human
gccagguguccucacagugagg

SEQ ID NO: 125371 - RNA, 22 nt, Human
ugaaggaagaauaggcaguguu

SEQ ID NO: 125372 - RNA, 21 nt, Human
ggacaccagucacacuggauu

SEQ ID NO: 125373 - RNA, 22 nt, Human
agcagugaaacagcugcauaug

SEQ ID NO: 125374 - RNA, 22 nt, Human
ugcagggcccucauuccugucc

SEQ ID NO: 125375 - RNA, 20 nt, Human
ugccaggcacggagugcaug

SEQ ID NO: 125376 - RNA, 22 nt, Human
cggcagagacggcgcuuugaac

SEQ ID NO: 125377 - RNA, 22 nt, Human
aagggugggcccuggcagccau

SEQ ID NO: 125378 - RNA, 22 nt, Human
cagggcagggccacacccccug

SEQ ID NO: 125379 - RNA, 22 nt, Human
uagaaacccauguuuauucagu

SEQ ID NO: 125380 - RNA, 22 nt, Human
agggccagaugaagccacaagc

SEQ ID NO: 125381 - RNA, 22 nt, Human
ugaguccaccuuaguauauggg

SEQ ID NO: 125382 - RNA, 22 nt, Human
gggcagugacaaaggggaugaa

SEQ ID NO: 125383 - RNA, 22 nt, Human
aagccacugagauuucacugca

SEQ ID NO: 125384 - RNA, 22 nt, Human
ccagagagaaaauggagggcca

SEQ ID NO: 125385 - RNA, 22 nt, Human
aggcgcagacauacagggucug

SEQ ID NO: 125386 - RNA, 22 nt, Human
ccacugucuuuuccaggcugaa

SEQ ID NO: 125387 - RNA, 22 nt, Human
gagcuggaagucuguggucaga

SEQ ID NO: 125388 - RNA, 22 nt, Human
uuucacaauuuuaaggagcaaa

SEQ ID NO: 125389 - RNA, 22 nt, Human
caggaugcacuaggaaccaggg

SEQ ID NO: 125390 - RNA, 22 nt, Human
ucccaaggauaagagagucuga

SEQ ID NO: 125391 - RNA, 22 nt, Human
aaagaagguagggcuggugacu

SEQ ID NO: 125392 - RNA, 22 nt, Human
uggaagaaggcagagaggcauu

SEQ ID NO: 125393 - RNA, 22 nt, Human
cggcagagcccugagucagccu

SEQ ID NO: 125394 - RNA, 22 nt, Human
aggcagcagugauaagauagga

SEQ ID NO: 125395 - RNA, 22 nt, Human
cuccucuuuggggauuuacaca

SEQ ID NO: 125396 - RNA, 22 nt, Human
ucucugucccuaggagccuugc

SEQ ID NO: 125397 - RNA, 22 nt, Human
acagggcaccugagguaggaag

SEQ ID NO: 125398 - RNA, 22 nt, Human
cagcugugagcagccaguugcc

SEQ ID NO: 125399 - RNA, 20 nt, Human
uuuacauuuugaaacaguga

SEQ ID NO: 125400 - RNA, 22 nt, Human
ugaggaaguuguuucucuucua

SEQ ID NO: 125401 - RNA, 22 nt, Human
cagggcaggacagauacauuac

SEQ ID NO: 125402 - RNA, 19 nt, Human
gaggaggcuucagcuuucu

SEQ ID NO: 125403 - RNA, 22 nt, Human
aagccaggccauucucugguuc

SEQ ID NO: 125404 - RNA, 18 nt, Human
uggcagagugucuguucu

SEQ ID NO: 125405 - RNA, 22 nt, Human
acagaggcagugugagauacug

SEQ ID NO: 125406 - RNA, 23 nt, Human
ggcaccaggccauggagcgggag

SEQ ID NO: 125407 - RNA, 22 nt, Human
aggugcuagguguguaguggag

SEQ ID NO: 125408 - RNA, 22 nt, Human
aggcuucagguuugcuuugcag

SEQ ID NO: 125409 - RNA, 22 nt, Human
uacaggcacugaaaugcuuauu

SEQ ID NO: 125410 - RNA, 22 nt, Human
ggggaaggauugaguugaccca

SEQ ID NO: 125411 - RNA, 22 nt, Human
gcagggcagaccuccagccuau

SEQ ID NO: 125412 - RNA, 22 nt, Human
uucuccucuguuggccuucccu

SEQ ID NO: 125413 - RNA, 22 nt, Human
aggcgcaggguuuggacccagg

SEQ ID NO: 125414 - RNA, 23 nt, Human
cagagcuggcucagagcugccug

SEQ ID NO: 125415 - RNA, 22 nt, Human
ucaggcagguggcuggcuaugg

SEQ ID NO: 125416 - RNA, 22 nt, Human
agggccaggaucacagccaaga

SEQ ID NO: 125417 - RNA, 22 nt, Human
cagagugaaaacugagcucaaa

SEQ ID NO: 125418 - RNA, 22 nt, Human
cagagcugauuggauccagaga

SEQ ID NO: 125419 - RNA, 22 nt, Human
uugaaaggaauacagaggccua

SEQ ID NO: 125420 - RNA, 21 nt, Human
aggcagccagucaugcucccu

SEQ ID NO: 125421 - RNA, 20 nt, Human
cagggcacacugcagccucg

SEQ ID NO: 125422 - RNA, 22 nt, Human
ggcagugagucccggagaggcc

SEQ ID NO: 125423 - RNA, 22 nt, Human
gggcaggagagaacagucaugg

SEQ ID NO: 125424 - RNA, 20 nt, Human
agcaggaaaagugccagucu

SEQ ID NO: 125425 - RNA, 22 nt, Human
aagggcuggagacugggucuuc

SEQ ID NO: 125426 - RNA, 22 nt, Human
uucuccccugacccugaugagg

SEQ ID NO: 125427 - RNA, 22 nt, Human
ucaggcagguuggcugcagguc

SEQ ID NO: 125428 - RNA, 22 nt, Human
gaggcagagguuguugcaguga

SEQ ID NO: 125429 - RNA, 22 nt, Human
ccacauuuuugauacucucacu

SEQ ID NO: 125430 - RNA, 22 nt, Human
cagggcuggguuaaaagcaggg

SEQ ID NO: 125431 - RNA, 22 nt, Human
ggccugaggccaccagcagccc

SEQ ID NO: 125432 - RNA, 22 nt, Human
uuugggcaauucagugggaccu

SEQ ID NO: 125433 - RNA, 22 nt, Human
gagagaagggggauaugagccu

SEQ ID NO: 125434 - RNA, 22 nt, Human
ccagugccugugggcauggugc

SEQ ID NO: 125435 - RNA, 22 nt, Human
ggguguccugugccaagcuggg

SEQ ID NO: 125436 - RNA, 22 nt, Human
gaagccacagagauuguggggg

SEQ ID NO: 125437 - RNA, 18 nt, Human
uguagagccagguuugcc

SEQ ID NO: 125438 - RNA, 22 nt, Human
acacaccaugauuuauuuaccc

SEQ ID NO: 125439 - RNA, 22 nt, Human
cagagcugcgcuuuuuccuggu

SEQ ID NO: 125440 - RNA, 22 nt, Human
acacacacaagcagguugugga

SEQ ID NO: 125441 - RNA, 22 nt, Human
gaaggcugcugggaaguguggu

SEQ ID NO: 125442 - RNA, 22 nt, Human
gcagaaggauccgcaggugcaa

SEQ ID NO: 125443 - RNA, 22 nt, Human
cagccagugugaccgaggagga

SEQ ID NO: 125444 - RNA, 19 nt, Human
ucaggaguuaguugugcuc

SEQ ID NO: 125445 - RNA, 22 nt, Human
ugaauaaacuaugaggaggaau

SEQ ID NO: 125446 - RNA, 22 nt, Human
uggcagagaaccugggcuuugu

SEQ ID NO: 125447 - RNA, 22 nt, Human
gcucccagcauugcugcugaau

SEQ ID NO: 125448 - RNA, 22 nt, Human
gggcagaggcucuggcccaucc

SEQ ID NO: 125449 - RNA, 22 nt, Human
uggcugagguaacuaugaauaa

SEQ ID NO: 125450 - RNA, 22 nt, Human
augaggcuaugaauggggagau

SEQ ID NO: 125451 - RNA, 22 nt, Human
gggcaguugauggaggucugga

SEQ ID NO: 125452 - RNA, 22 nt, Human
cccagccucuggauucugcccu

SEQ ID NO: 125453 - RNA, 22 nt, Human
ggugaagguggaacgcagagca

SEQ ID NO: 125454 - RNA, 22 nt, Human
gaggaaaauaacaacuaagggc

SEQ ID NO: 125455 - RNA, 22 nt, Human
agaagccauguuuaguaggaug

SEQ ID NO: 125456 - RNA, 20 nt, Human
ggcaccaggcuaggauugga

SEQ ID NO: 125457 - RNA, 22 nt, Human
uggcaggaaaguaacagagcac

SEQ ID NO: 125458 - RNA, 22 nt, Human
ugaggaagggugugacggcacc

SEQ ID NO: 125459 - RNA, 22 nt, Human
caggacagaaauaaggaauaua

SEQ ID NO: 125460 - RNA, 22 nt, Human
uuuauccauaucauuaaaaucu

SEQ ID NO: 125461 - RNA, 22 nt, Human
caguggaaacuaugcugcugga

SEQ ID NO: 125462 - RNA, 22 nt, Human
ccucccacuucuugcugagguc

SEQ ID NO: 125463 - RNA, 18 nt, Human
ggcuuugcugggguuucu

SEQ ID NO: 125464 - RNA, 22 nt, Human
uuauccaacaugacuuaugucc

SEQ ID NO: 125465 - RNA, 22 nt, Human
agggagguaggagcuucuagcu

SEQ ID NO: 125466 - RNA, 22 nt, Human
ccagccuggacugggucuugug

SEQ ID NO: 125467 - RNA, 22 nt, Human
gggcacuguguucagagugcag

SEQ ID NO: 125468 - RNA, 20 nt, Human
aaagucuguuuaucucugga

SEQ ID NO: 125469 - RNA, 22 nt, Human
gaggcucagagagguccacaua

SEQ ID NO: 125470 - RNA, 22 nt, Human
aggcugggaaauguauuccagc

SEQ ID NO: 125471 - RNA, 22 nt, Human
uccuggccgccgcguggggccg

SEQ ID NO: 125472 - RNA, 22 nt, Human
ucagggcaucaucaugaauaua

SEQ ID NO: 125473 - RNA, 22 nt, Human
ugaggcaggacauggacaacug

SEQ ID NO: 125474 - RNA, 22 nt, Human
agggcugacaguaaaaguauga

SEQ ID NO: 125475 - RNA, 22 nt, Human
ccguggaguugugcugaguaug

SEQ ID NO: 125476 - RNA, 22 nt, Human
gaggagcaugggaaggcucugg

SEQ ID NO: 125477 - RNA, 19 nt, Human
cagaaauagcgaaguguaa

SEQ ID NO: 125478 - RNA, 22 nt, Human
gagcugagccuggguggaccgc

SEQ ID NO: 125479 - RNA, 22 nt, Human
uguggcaguauaagagcuagaa

SEQ ID NO: 125480 - RNA, 22 nt, Human
ucucugaguucuccuccagccc

SEQ ID NO: 125481 - RNA, 21 nt, Human
aggcucagagaucaaacagua

SEQ ID NO: 125482 - RNA, 22 nt, Human
ucccugcacagccgagccaugc

SEQ ID NO: 125483 - RNA, 22 nt, Human
ggugaggaaagauggugacagu

SEQ ID NO: 125484 - RNA, 22 nt, Human
ugaggaagaacaagaauuuaga

SEQ ID NO: 125485 - RNA, 22 nt, Human
guguccuuauuucugucucuca

SEQ ID NO: 125486 - RNA, 22 nt, Human
uggcaagagggaugcaagguuu

SEQ ID NO: 125487 - RNA, 22 nt, Human
gagcaggaugggagcuggggcc

SEQ ID NO: 125488 - RNA, 22 nt, Human
ugaagaagccaauugguaggcu

SEQ ID NO: 125489 - RNA, 22 nt, Human
aguuaacaaguuggcaaucaac

SEQ ID NO: 125490 - RNA, 22 nt, Human
auuuuccaaaauaauuguuacu

SEQ ID NO: 125491 - RNA, 22 nt, Human
agcagggcacuggaaggcacug

SEQ ID NO: 125492 - RNA, 19 nt, Human
uggcagaggcaguuuguac

SEQ ID NO: 125493 - RNA, 22 nt, Human
uucugcagcccaacaguaguuu

SEQ ID NO: 125494 - RNA, 19 nt, Human
uagagcugcuuccuggcag

SEQ ID NO: 125495 - RNA, 22 nt, Human
acagggcagagugaaaugcuau

SEQ ID NO: 125496 - RNA, 22 nt, Human
ucccaggcuggggccaggugac

SEQ ID NO: 125497 - RNA, 22 nt, Human
caggagaagucucuagggggug

SEQ ID NO: 125498 - RNA, 22 nt, Human
ugaguccauguggaggggaggu

SEQ ID NO: 125499 - RNA, 22 nt, Human
auccucaguguuucugacaucu

SEQ ID NO: 125500 - RNA, 22 nt, Human
guggaggguuugcaaugugcag

SEQ ID NO: 125501 - RNA, 22 nt, Human
ggcuguggcauuaggugaggcc

SEQ ID NO: 125502 - RNA, 22 nt, Human
cagugcaguggcugagcuggag

SEQ ID NO: 125503 - RNA, 23 nt, Human
uggcugagguccagguaguuuca

SEQ ID NO: 125504 - RNA, 22 nt, Human
gaggaagcugcguggcauuuca

SEQ ID NO: 125505 - RNA, 22 nt, Human
ugccaggcugucaauucaccca

SEQ ID NO: 125506 - RNA, 22 nt, Human
agccaggcggggcagguuuccu

SEQ ID NO: 125507 - RNA, 22 nt, Human
gaggagagaagcuaacggugcu

SEQ ID NO: 125508 - RNA, 22 nt, Human
ccagagcagauguggccuuggu

SEQ ID NO: 125509 - RNA, 22 nt, Human
ccacuggcauccagcugccauc

SEQ ID NO: 125510 - RNA, 22 nt, Human
caguccugugucccuugguggg

SEQ ID NO: 125511 - RNA, 22 nt, Human
caagaaggcuauaugggccagg

SEQ ID NO: 125512 - RNA, 22 nt, Human
aguggcagagugcacucaggca

SEQ ID NO: 125513 - RNA, 22 nt, Human
cucagccccaauucuccccauu

SEQ ID NO: 125514 - RNA, 22 nt, Human
agaggcaguauacaauccgagc

SEQ ID NO: 125515 - RNA, 22 nt, Human
gcugagaguccaggaaaacauc

SEQ ID NO: 125516 - RNA, 22 nt, Human
aaggcugaauucaaggguaggc

SEQ ID NO: 125517 - RNA, 18 nt, Human
ggcagcaagaagggaggg

SEQ ID NO: 125518 - RNA, 22 nt, Human
ugcagggccgcuggaggucaug

SEQ ID NO: 125519 - RNA, 22 nt, Human
agggcugacacaccuuauccuc

SEQ ID NO: 125520 - RNA, 22 nt, Human
gcuggcagacugggggcagaac

SEQ ID NO: 125521 - RNA, 21 nt, Human
gcaggcuggucaaaccucagu

SEQ ID NO: 125522 - RNA, 22 nt, Human
caccaggcugcccaggacaggg

SEQ ID NO: 125523 - RNA, 18 nt, Human
uggaggcagaguucuggc

SEQ ID NO: 125524 - RNA, 23 nt, Human
aggaggaaaaguuaucugcugag

SEQ ID NO: 125525 - RNA, 22 nt, Human
cugcuguguaucauuuuagaug

SEQ ID NO: 125526 - RNA, 22 nt, Human
uagaaaggauauugagaugaau

SEQ ID NO: 125527 - RNA, 22 nt, Human
gcagggcaaugaucccgagagg

SEQ ID NO: 125528 - RNA, 22 nt, Human
ugcagggaacuuggacagcuag

SEQ ID NO: 125529 - RNA, 22 nt, Human
uggccagaaccugcaguaggcc

SEQ ID NO: 125530 - RNA, 22 nt, Human
ccaggaggcagaaguugcagug

SEQ ID NO: 125531 - RNA, 19 nt, Human
cagcugcaccgugaccauc

SEQ ID NO: 125532 - RNA, 22 nt, Human
gggcagugguuacacagcugag

SEQ ID NO: 125533 - RNA, 22 nt, Human
gcucccagggaccgcagggcag

SEQ ID NO: 125534 - RNA, 22 nt, Human
ggcgcaggccuuggauccuggu

SEQ ID NO: 125535 - RNA, 22 nt, Human
caacagagagaccagaaacagg

SEQ ID NO: 125536 - RNA, 22 nt, Human
agccagcaggugagugcagccu

SEQ ID NO: 125537 - RNA, 22 nt, Human
gggcaugagaggcaggcaagug

SEQ ID NO: 125538 - RNA, 22 nt, Human
ucagaggaccuuacugagaacc

SEQ ID NO: 125539 - RNA, 22 nt, Human
agugugaguaauucagggaggg

SEQ ID NO: 125540 - RNA, 22 nt, Human
aagagcuggcucuugcagcagc

SEQ ID NO: 125541 - RNA, 22 nt, Human
ucacauuuauuucaaaguuacu

SEQ ID NO: 125542 - RNA, 21 nt, Human
ugaggcaggggugcuuuuguc

SEQ ID NO: 125543 - RNA, 22 nt, Human
uuucucaaggugucauguauuu

SEQ ID NO: 125544 - RNA, 22 nt, Human
uggcaggaggaugaggcggcua

SEQ ID NO: 125545 - RNA, 22 nt, Human
augcaccugaacuccaucagcu

SEQ ID NO: 125546 - RNA, 22 nt, Human
ggcuguggccagcggggcugag

SEQ ID NO: 125547 - RNA, 22 nt, Human
gggcagauggggcacaggcuga

SEQ ID NO: 125548 - RNA, 22 nt, Human
aaggaagguucauagucaaaga

SEQ ID NO: 125549 - RNA, 22 nt, Human
ugcagagggacagccacagcuc

SEQ ID NO: 125550 - RNA, 22 nt, Human
gggaggagugaagauucaccug

SEQ ID NO: 125551 - RNA, 22 nt, Human
acagcuguauccccagagcuca

SEQ ID NO: 125552 - RNA, 22 nt, Human
caggagcaugcugaugccagaa

SEQ ID NO: 125553 - RNA, 22 nt, Human
uggcugagagaagacggggaag

SEQ ID NO: 125554 - RNA, 22 nt, Human
acccagggaccccgcugacgcc

SEQ ID NO: 125555 - RNA, 22 nt, Human
ccuucccuaaagcgucgcuuag

SEQ ID NO: 125556 - RNA, 22 nt, Human
caguggagugggacuggucuga

SEQ ID NO: 125557 - RNA, 22 nt, Human
ggaggaggggugacugaaugcu

SEQ ID NO: 125558 - RNA, 22 nt, Human
ugccaggcaggacccuagaacc

SEQ ID NO: 125559 - RNA, 22 nt, Human
agggucagagaucggccaugug

SEQ ID NO: 125560 - RNA, 22 nt, Human
gggcaugccugcgcagugcaug

SEQ ID NO: 125561 - RNA, 23 nt, Human
cagcugaagcagccugggcugga

SEQ ID NO: 125562 - RNA, 22 nt, Human
agggccaggaacaccugaaggg

SEQ ID NO: 125563 - RNA, 21 nt, Human
augggcagaggcagagaggcu

SEQ ID NO: 125564 - RNA, 22 nt, Human
aggugcaguggcucaugccugu

SEQ ID NO: 125565 - RNA, 22 nt, Human
augaggcaucugcagucacuag

SEQ ID NO: 125566 - RNA, 22 nt, Human
gucagcacuuuuccgaggcaga

SEQ ID NO: 125567 - RNA, 22 nt, Human
ugcagagguuuccaggcaaguu

SEQ ID NO: 125568 - RNA, 22 nt, Human
agggcagcacagcugugcuccu

SEQ ID NO: 125569 - RNA, 22 nt, Human
aggccagcaagaaagagagucu

SEQ ID NO: 125570 - RNA, 22 nt, Human
gcagggcaaacccagguguuca

SEQ ID NO: 125571 - RNA, 21 nt, Human
gggcaggucucugaugucaac

SEQ ID NO: 125572 - RNA, 22 nt, Human
cgaggcagggaagcugcaaaag

SEQ ID NO: 125573 - RNA, 22 nt, Human
agagccacggcaggccuaggaa

SEQ ID NO: 125574 - RNA, 22 nt, Human
agcaggaaggucugugugaguc

SEQ ID NO: 125575 - RNA, 19 nt, Human
agccacagaacuugcagga

SEQ ID NO: 125576 - RNA, 22 nt, Human
aguucccaggugaugcugaugu

SEQ ID NO: 125577 - RNA, 22 nt, Human
cuggagugauacucagaaugug

SEQ ID NO: 125578 - RNA, 22 nt, Human
gaggcacauauauacagagccc

SEQ ID NO: 125579 - RNA, 22 nt, Human
agugcagaguacauuuguggca

SEQ ID NO: 125580 - RNA, 22 nt, Human
agggccaccucucuggguuccc

SEQ ID NO: 125581 - RNA, 22 nt, Human
cagagcuggagggaacccuggc

SEQ ID NO: 125582 - RNA, 22 nt, Human
uguguccuuuggaggaucagcg

SEQ ID NO: 125583 - RNA, 18 nt, Human
cggcagagugcuucuagc

SEQ ID NO: 125584 - RNA, 19 nt, Human
ccagaggacuguuaaugaa

SEQ ID NO: 125585 - RNA, 22 nt, Human
uccuggugucgccuggucaguu

SEQ ID NO: 125586 - RNA, 19 nt, Human
agccagugagccucugggu

SEQ ID NO: 125587 - RNA, 22 nt, Human
cagggcagggauguugcggcag

SEQ ID NO: 125588 - RNA, 22 nt, Human
agaagccaauucugugugaguc

SEQ ID NO: 125589 - RNA, 22 nt, Human
cccagccucuggguucugccgg

SEQ ID NO: 125590 - RNA, 22 nt, Human
uagccggguguugugucaugca

SEQ ID NO: 125591 - RNA, 22 nt, Human
cagauggaacacagaaaggaga

SEQ ID NO: 125592 - RNA, 22 nt, Human
ucucugagaaguuccuuuguga

SEQ ID NO: 125593 - RNA, 20 nt, Human
aagggcagagggaacagacu

SEQ ID NO: 125594 - RNA, 22 nt, Human
accagagcucuucagcacagga

SEQ ID NO: 125595 - RNA, 22 nt, Human
uugauuuauagaauguucaagc

SEQ ID NO: 125596 - RNA, 22 nt, Human
agggcugagugggagagaguug

SEQ ID NO: 125597 - RNA, 22 nt, Human
uguccuuuaugaaaugguguuu

SEQ ID NO: 125598 - RNA, 22 nt, Human
uguggcagaaccagaauucaaa

SEQ ID NO: 125599 - RNA, 22 nt, Human
ugaggcagcccacuuuccuuag

SEQ ID NO: 125600 - RNA, 22 nt, Human
aagggcagcugacagaugcuua

SEQ ID NO: 125601 - RNA, 22 nt, Human
acacuguguggucucucucgga

SEQ ID NO: 125602 - RNA, 22 nt, Human
aggcucagauucacauuugguu

SEQ ID NO: 125603 - RNA, 22 nt, Human
ugaggcagcaauuguauuguau

SEQ ID NO: 125604 - RNA, 22 nt, Human
ggagccuggcaaugcugcgucc

SEQ ID NO: 125605 - RNA, 22 nt, Human
agugcugucuccuucccccggg

SEQ ID NO: 125606 - RNA, 22 nt, Human
aggcuguccucucuugcucagu

SEQ ID NO: 125607 - RNA, 20 nt, Human
ugggcugaggaucaggugcc

SEQ ID NO: 125608 - RNA, 22 nt, Human
agaagccaaucagcucucugcu

SEQ ID NO: 125609 - RNA, 22 nt, Human
agaggcaggaagagcugauuuu

SEQ ID NO: 125610 - RNA, 22 nt, Human
uaaggguucagaaugcaguggu

SEQ ID NO: 125611 - RNA, 22 nt, Human
agaagccaacagggcaggagag

SEQ ID NO: 125612 - RNA, 19 nt, Human
cuccucagucccagagguc

SEQ ID NO: 125613 - RNA, 22 nt, Human
ugccaggcccagcuccagagcu

SEQ ID NO: 125614 - RNA, 22 nt, Human
ucucccagaaguccucaguaca

SEQ ID NO: 125615 - RNA, 22 nt, Human
ugugggaggaauuagaauggga

SEQ ID NO: 125616 - RNA, 23 nt, Human
agcagugaguaaacagauaggau

SEQ ID NO: 125617 - RNA, 22 nt, Human
gccugugguuugauuaagcauu

SEQ ID NO: 125618 - RNA, 22 nt, Human
agccugguuuaagcauuuuaua

SEQ ID NO: 125619 - RNA, 22 nt, Human
cucagaagaacaaaggcucuac

SEQ ID NO: 125620 - RNA, 22 nt, Human
cugaggcuuggaggggucuggu

SEQ ID NO: 125621 - RNA, 22 nt, Human
ccugggcaacauagugagaccc

SEQ ID NO: 125622 - RNA, 22 nt, Human
gcauggcagugaggauggugcu

SEQ ID NO: 125623 - RNA, 22 nt, Human
ccagaauagaaggcagcuguca

SEQ ID NO: 125624 - RNA, 22 nt, Human
guuauuuuaucucugagagguu

SEQ ID NO: 125625 - RNA, 22 nt, Human
aguuuccaaauauuguuuuagc

SEQ ID NO: 125626 - RNA, 22 nt, Human
ugccaggcucaggaugucccug

SEQ ID NO: 125627 - RNA, 23 nt, Human
uggcugagauccuacuguuugcu

SEQ ID NO: 125628 - RNA, 22 nt, Human
agagggaaugugauugcaccau

SEQ ID NO: 125629 - RNA, 22 nt, Human
gggcugagugaccucaggccaa

SEQ ID NO: 125630 - RNA, 22 nt, Human
agaagccagaauauucauggau

SEQ ID NO: 125631 - RNA, 23 nt, Human
agugagcagcuguagggcaagga

SEQ ID NO: 125632 - RNA, 17 nt, Human
agggacagcaguuuagg

SEQ ID NO: 125633 - RNA, 19 nt, Human
agacagagacugaaauaga

SEQ ID NO: 125634 - RNA, 22 nt, Human
ccagggcaauaggaacacuuuu

SEQ ID NO: 125635 - RNA, 20 nt, Human
uguggcaggaugagggcgga

SEQ ID NO: 125636 - RNA, 22 nt, Human
cagaaguggccucagagggagu

SEQ ID NO: 125637 - RNA, 22 nt, Human
aggaggaauacaauccagcagc

SEQ ID NO: 125638 - RNA, 22 nt, Human
cauccacuagaaugacagaguu

SEQ ID NO: 125639 - RNA, 22 nt, Human
uccgcccgcacguauggagugg

SEQ ID NO: 125640 - RNA, 22 nt, Human
cguagguggcucagcaccuggg

SEQ ID NO: 125641 - RNA, 22 nt, Human
gccagggcucgcggucccucgu

SEQ ID NO: 125642 - RNA, 23 nt, Human
aggugcagcccuggaccugcccc

SEQ ID NO: 125643 - RNA, 22 nt, Human
ggcagccaugucccagggcuuc

SEQ ID NO: 125644 - RNA, 22 nt, Human
aaggagaaaugguagaugugca

SEQ ID NO: 125645 - RNA, 22 nt, Human
auggcagccugagcagaggaau

SEQ ID NO: 125646 - RNA, 22 nt, Human
gccaccagcagaaaaggggcca

SEQ ID NO: 125647 - RNA, 22 nt, Human
gccaguggcuugccaggcagga

SEQ ID NO: 125648 - RNA, 22 nt, Human
cagccugcucucagauguugag

SEQ ID NO: 125649 - RNA, 20 nt, Human
accaggagauggaggcaggg

SEQ ID NO: 125650 - RNA, 22 nt, Human
agggcugcugaggaagccuugc

SEQ ID NO: 125651 - RNA, 22 nt, Human
agggagaagguuuagcugugag

SEQ ID NO: 125652 - RNA, 22 nt, Human
ucaguggauauuucuguggcug

SEQ ID NO: 125653 - RNA, 22 nt, Human
ccagggcaggagaaagacucac

SEQ ID NO: 125654 - RNA, 22 nt, Human
augcugugucaccuuaggauuu

SEQ ID NO: 125655 - RNA, 22 nt, Human
agcugagcuaguaguuccagug

SEQ ID NO: 125656 - RNA, 22 nt, Human
acaguggaugacauccuuuugc

SEQ ID NO: 125657 - RNA, 23 nt, Human
ucccagggaaggugagcgaggcu

SEQ ID NO: 125658 - RNA, 22 nt, Human
uuugagaaaugggcucugugcu

SEQ ID NO: 125659 - RNA, 21 nt, Human
agccaggcaagcacccccacu

SEQ ID NO: 125660 - RNA, 20 nt, Human
ggggcaguggcucaugccug

SEQ ID NO: 125661 - RNA, 22 nt, Human
uccauccauguaggaagauggu

SEQ ID NO: 125662 - RNA, 22 nt, Human
gagagcugcaagguagggcggg

SEQ ID NO: 125663 - RNA, 22 nt, Human
cagaggaaggcucugggaaugu

SEQ ID NO: 125664 - RNA, 22 nt, Human
aacccgggaggcagagguugug

SEQ ID NO: 125665 - RNA, 22 nt, Human
gaggaggaaguucucuguaggc

SEQ ID NO: 125666 - RNA, 22 nt, Human
cuggagugaagucuggcagcuu

SEQ ID NO: 125667 - RNA, 22 nt, Human
aaauauaauuucugccucaaua

SEQ ID NO: 125668 - RNA, 22 nt, Human
cagaggcauauaauugcugggg

SEQ ID NO: 125669 - RNA, 22 nt, Human
acaguggaggccauaugguccu

SEQ ID NO: 125670 - RNA, 22 nt, Human
agcagggcucugccaugggccc

SEQ ID NO: 125671 - RNA, 18 nt, Human
agaaggagcuaugggcag

SEQ ID NO: 125672 - RNA, 22 nt, Human
gaguccagacaccauaccugau

SEQ ID NO: 125673 - RNA, 22 nt, Human
cuccagggagcugcgggagcca

SEQ ID NO: 125674 - RNA, 22 nt, Human
gagggccaacuagcaccacuuu

SEQ ID NO: 125675 - RNA, 22 nt, Human
ggcaggcagaggcugagacagg

SEQ ID NO: 125676 - RNA, 23 nt, Human
aggaaggagguccuaacaguauc

SEQ ID NO: 125677 - RNA, 22 nt, Human
gcagagcugggucuguauccaa

SEQ ID NO: 125678 - RNA, 22 nt, Human
ucuuccugaaacccuguuccag

SEQ ID NO: 125679 - RNA, 23 nt, Human
ccugcucaggcgugugcccugcu

SEQ ID NO: 125680 - RNA, 22 nt, Human
ucuguccauuuuccauuuuggc

SEQ ID NO: 125681 - RNA, 22 nt, Human
uuccucagacccucauugugag

SEQ ID NO: 125682 - RNA, 22 nt, Human
gccgugcgugcgcaggugcugu

SEQ ID NO: 125683 - RNA, 22 nt, Human
caagcugguaucagcuagagcg

SEQ ID NO: 125684 - RNA, 22 nt, Human
caucagagugguggccuggugu

SEQ ID NO: 125685 - RNA, 22 nt, Human
ucagaggauagaaauacuuauu

SEQ ID NO: 125686 - RNA, 22 nt, Human
gggcagguguugucaaucuaau

SEQ ID NO: 125687 - RNA, 22 nt, Human
ucugccuggaugauggcagggc

SEQ ID NO: 125688 - RNA, 22 nt, Human
ccagagcugcauccagcagguu

SEQ ID NO: 125689 - RNA, 22 nt, Human
aaagccagugguaugagagaaa

SEQ ID NO: 125690 - RNA, 22 nt, Human
uggcugaguuacgaacagagca

SEQ ID NO: 125691 - RNA, 22 nt, Human
agcuguggaguaggggguugga

SEQ ID NO: 125692 - RNA, 22 nt, Human
gggagagguuacccgagcaacu

SEQ ID NO: 125693 - RNA, 22 nt, Human
ggcuguggucauuaggagguug

SEQ ID NO: 125694 - RNA, 22 nt, Human
gaagccaguacugugcucugca

SEQ ID NO: 125695 - RNA, 22 nt, Human
ugaagccacuuuccagaaucac

SEQ ID NO: 125696 - RNA, 22 nt, Human
gagggcagugaauuuugaagcu

SEQ ID NO: 125697 - RNA, 21 nt, Human
uggcugagccaggugugugga

SEQ ID NO: 125698 - RNA, 22 nt, Human
augggcagaguggggacaggaa

SEQ ID NO: 125699 - RNA, 22 nt, Human
gcugagccccccugcguggguc

SEQ ID NO: 125700 - RNA, 22 nt, Human
gcugagagaucaaggcaggauu

SEQ ID NO: 125701 - RNA, 22 nt, Human
aagggcagccugacucacgguc

SEQ ID NO: 125702 - RNA, 22 nt, Human
gggcaggaggcuaauucugcau

SEQ ID NO: 125703 - RNA, 22 nt, Human
acaaaggugagcagaagacaca

SEQ ID NO: 125704 - RNA, 22 nt, Human
cauauuucagucuaagaugugu

SEQ ID NO: 125705 - RNA, 20 nt, Human
cuccagggaacagacuggag

SEQ ID NO: 125706 - RNA, 22 nt, Human
ugaaaugcuguagagacuguau

SEQ ID NO: 125707 - RNA, 22 nt, Human
ggagaagcagcuucuugaugaa

SEQ ID NO: 125708 - RNA, 22 nt, Human
augcugaauugaugcgagggag

SEQ ID NO: 125709 - RNA, 22 nt, Human
gaaggagaggauugugaggcug

SEQ ID NO: 125710 - RNA, 22 nt, Human
caggcagcagccacucugguau

SEQ ID NO: 125711 - RNA, 22 nt, Human
auuuucuauucugcugguuuag

SEQ ID NO: 125712 - RNA, 22 nt, Human
uuuugaaagggugauuuggcuu

SEQ ID NO: 125713 - RNA, 19 nt, Human
acagagcucucugcuucug

SEQ ID NO: 125714 - RNA, 22 nt, Human
uggcugagagucauccugugug

SEQ ID NO: 125715 - RNA, 22 nt, Human
gguguccuugcagaaggcggcg

SEQ ID NO: 125716 - RNA, 22 nt, Human
uccugccuugccugggacauca

SEQ ID NO: 125717 - RNA, 22 nt, Human
ccaguuuuuccagugcuuucug

SEQ ID NO: 125718 - RNA, 22 nt, Human
agaaauacuuuguaaaucucac

SEQ ID NO: 125719 - RNA, 22 nt, Human
aggagggcuaggaaaaccagga

SEQ ID NO: 125720 - RNA, 22 nt, Human
gaggaagaaagcauaggugggg

SEQ ID NO: 125721 - RNA, 22 nt, Human
guucagcccacagagggggccg

SEQ ID NO: 125722 - RNA, 22 nt, Human
gcagauggcagcccaggcuggg

SEQ ID NO: 125723 - RNA, 22 nt, Human
ucacacacauuugcugucugau

SEQ ID NO: 125724 - RNA, 22 nt, Human
agcagggcuuugcagacuuggg

SEQ ID NO: 125725 - RNA, 22 nt, Human
gcagaggacagggauuuagauu

SEQ ID NO: 125726 - RNA, 22 nt, Human
gaagucugcugcucaggaguuu

SEQ ID NO: 125727 - RNA, 22 nt, Human
ccagggcaggggcuggaguuca

SEQ ID NO: 125728 - RNA, 22 nt, Human
ugaggcagucacccccuccugc

SEQ ID NO: 125729 - RNA, 22 nt, Human
cuaguccacuguccugccucca

SEQ ID NO: 125730 - RNA, 22 nt, Human
gagggcugugaaggagcggguu

SEQ ID NO: 125731 - RNA, 22 nt, Human
auccaggguguggagagagcuc

SEQ ID NO: 125732 - RNA, 22 nt, Human
cacaaaugacugaaacgacugu

SEQ ID NO: 125733 - RNA, 22 nt, Human
acccaggggcagccuugcugug

SEQ ID NO: 125734 - RNA, 22 nt, Human
acacugugacaaaggcuguucu

SEQ ID NO: 125735 - RNA, 22 nt, Human
ucaggcagagggagaagccaag

SEQ ID NO: 125736 - RNA, 22 nt, Human
ugccaggcuuagagcaggggcu

SEQ ID NO: 125737 - RNA, 22 nt, Human
cagaggaagcuggguguggagu

SEQ ID NO: 125738 - RNA, 22 nt, Human
gcacggcuaauuuuuguauuuu

SEQ ID NO: 125739 - RNA, 22 nt, Human
ggggccagcaauguugaggaau

SEQ ID NO: 125740 - RNA, 22 nt, Human
ugaagccauaggacagaggaua

SEQ ID NO: 125741 - RNA, 22 nt, Human
aggcugagccugggcguggugg

SEQ ID NO: 125742 - RNA, 22 nt, Human
uauuugcaaagaacuacacuag

SEQ ID NO: 125743 - RNA, 22 nt, Human
aaggugaaacuggaagcuggcc

SEQ ID NO: 125744 - RNA, 22 nt, Human
ccagggcagcagaauuggggca

SEQ ID NO: 125745 - RNA, 22 nt, Human
uuugaaguccaucuggcccagu

SEQ ID NO: 125746 - RNA, 22 nt, Human
caugaauauuuaguauuuacuu

SEQ ID NO: 125747 - RNA, 21 nt, Human
aucucacagcccagagaagcc

SEQ ID NO: 125748 - RNA, 22 nt, Human
gcucccaggaagagaagggcca

SEQ ID NO: 125749 - RNA, 22 nt, Human
uggcucagagagggagugugga

SEQ ID NO: 125750 - RNA, 22 nt, Human
agcugccuggagucauuuccug

SEQ ID NO: 125751 - RNA, 22 nt, Human
cagcugugaauugucuuaucua

SEQ ID NO: 125752 - RNA, 22 nt, Human
agcugaggcucugagagggaag

SEQ ID NO: 125753 - RNA, 22 nt, Human
ggagcagccgcgucucagggca

SEQ ID NO: 125754 - RNA, 22 nt, Human
aaggguugaagauaaauaaggu

SEQ ID NO: 125755 - RNA, 22 nt, Human
agggcugaugcaccauguagcc

SEQ ID NO: 125756 - RNA, 22 nt, Human
caggcagcucaaccuugggagc

SEQ ID NO: 125757 - RNA, 21 nt, Human
guuauuuuaagugagcuuugc

SEQ ID NO: 125758 - RNA, 23 nt, Human
ugggcagcuucugcaugcccacc

SEQ ID NO: 125759 - RNA, 22 nt, Human
ggcaggcaguguggugugaaac

SEQ ID NO: 125760 - RNA, 22 nt, Human
uagagcugauaaugaggccaag

SEQ ID NO: 125761 - RNA, 22 nt, Human
aguccccucuaacccaacuuua

SEQ ID NO: 125762 - RNA, 22 nt, Human
aggcugaggcgggaggaucacu

SEQ ID NO: 125763 - RNA, 22 nt, Human
cagcugcaugucuguggugguc

SEQ ID NO: 125764 - RNA, 22 nt, Human
gugcugaguagaaugaaugccu

SEQ ID NO: 125765 - RNA, 22 nt, Human
agcaggugagcacagccaggcu

SEQ ID NO: 125766 - RNA, 22 nt, Human
augcuguguggucaaguuaauu

SEQ ID NO: 125767 - RNA, 22 nt, Human
caugaauauacauccugauggc

SEQ ID NO: 125768 - RNA, 22 nt, Human
cgaggcagacaaaaguuggaag

SEQ ID NO: 125769 - RNA, 23 nt, Human
uccuggugacaugccugagcauc

SEQ ID NO: 125770 - RNA, 22 nt, Human
agggcugacaaauggcagugac

SEQ ID NO: 125771 - RNA, 18 nt, Human
cagaugagaugcaaucuc

SEQ ID NO: 125772 - RNA, 22 nt, Human
uggguaggccaggaagcagugu

SEQ ID NO: 125773 - RNA, 22 nt, Human
gaggaggcacuugagcagaugu

SEQ ID NO: 125774 - RNA, 22 nt, Human
gaauucugguuuugaaaugaau

SEQ ID NO: 125775 - RNA, 22 nt, Human
cagggcaguaccgcccucuggc

SEQ ID NO: 125776 - RNA, 22 nt, Human
uucugugaaucuuuuuucccac

SEQ ID NO: 125777 - RNA, 22 nt, Human
uggcucagauaauucaaggggc

SEQ ID NO: 125778 - RNA, 22 nt, Human
ggugaggaauuggggacugacc

SEQ ID NO: 125779 - RNA, 21 nt, Human
uggcagggguaguaguacagc

SEQ ID NO: 125780 - RNA, 22 nt, Human
cagggcagugaagaacacacgu

SEQ ID NO: 125781 - RNA, 18 nt, Human
cccagccucuccuuucua

SEQ ID NO: 125782 - RNA, 22 nt, Human
aaguggaggccgaguucacgca

SEQ ID NO: 125783 - RNA, 22 nt, Human
uggccuggaaaaaugcagaugg

SEQ ID NO: 125784 - RNA, 22 nt, Human
augggcaguguauuggaaggaa

SEQ ID NO: 125785 - RNA, 22 nt, Human
aggccagcaccagagucaagaa

SEQ ID NO: 125786 - RNA, 22 nt, Human
gagcaugguuccauagguuggu

SEQ ID NO: 125787 - RNA, 23 nt, Human
cagggcccugcucaauuucucca

SEQ ID NO: 125788 - RNA, 21 nt, Human
ccauaauuuuguuucagaagu

SEQ ID NO: 125789 - RNA, 22 nt, Human
ucucaaacuaacaaugauuaua

SEQ ID NO: 125790 - RNA, 22 nt, Human
agucaguuaaccucacagcauc

SEQ ID NO: 125791 - RNA, 22 nt, Human
ggcagcaaauauugucagcugu

SEQ ID NO: 125792 - RNA, 22 nt, Human
acaguggauauauuaaaugaga

SEQ ID NO: 125793 - RNA, 22 nt, Human
agggaggucuuugaggggcuua

SEQ ID NO: 125794 - RNA, 22 nt, Human
uuucccaauugagagguucugu

SEQ ID NO: 125795 - RNA, 22 nt, Human
gcugccucugcacagcucacuc

SEQ ID NO: 125796 - RNA, 22 nt, Human
aagggcaggcacccacccucac

SEQ ID NO: 125797 - RNA, 22 nt, Human
uagggcaguuauaacauuagug

SEQ ID NO: 125798 - RNA, 22 nt, Human
aagggcuguaagccaaguaaag

SEQ ID NO: 125799 - RNA, 22 nt, Human
auggcagauggcuggagcaggu

SEQ ID NO: 125800 - RNA, 21 nt, Human
aucagaaguuuuggucaguag

SEQ ID NO: 125801 - RNA, 22 nt, Human
cucccagguuacaucugagccu

SEQ ID NO: 125802 - RNA, 22 nt, Human
agagccuguaacaucuuucuua

SEQ ID NO: 125803 - RNA, 19 nt, Human
aggugcaggucacagggga

SEQ ID NO: 125804 - RNA, 22 nt, Human
cagggcugaagaaauucaaaag

SEQ ID NO: 125805 - RNA, 22 nt, Human
uggggcagaguaggauuuuggc

SEQ ID NO: 125806 - RNA, 22 nt, Human
ucaggcagaauuaucaaaagau

SEQ ID NO: 125807 - RNA, 22 nt, Human
auuuccacauaagggaaauaag

SEQ ID NO: 125808 - RNA, 22 nt, Human
ugggagaugguucugagacuuu

SEQ ID NO: 125809 - RNA, 18 nt, Human
gccagagggaagcaggug

SEQ ID NO: 125810 - RNA, 22 nt, Human
ucagaggaacacuguuucaugc

SEQ ID NO: 125811 - RNA, 17 nt, Human
ccaggugggaggugggg

SEQ ID NO: 125812 - RNA, 22 nt, Human
ugaggcaggaugcuugcacagg

SEQ ID NO: 125813 - RNA, 22 nt, Human
cacaggagugcugcuauuguug

SEQ ID NO: 125814 - RNA, 22 nt, Human
agggagccuuccuggcuguggu

SEQ ID NO: 125815 - RNA, 22 nt, Human
ccagggcagcgccccuccacgc

SEQ ID NO: 125816 - RNA, 22 nt, Human
cagagccccucagcucucuccc

SEQ ID NO: 125817 - RNA, 21 nt, Human
gaguggaacgcucuucacacc

SEQ ID NO: 125818 - RNA, 22 nt, Human
aaauagcacagcagcugaggcu

SEQ ID NO: 125819 - RNA, 22 nt, Human
gccuuaggggucagacagagcu

SEQ ID NO: 125820 - RNA, 22 nt, Human
gcagauggaaagugcuugaggg

SEQ ID NO: 125821 - RNA, 18 nt, Human
gagcagaggcucaacugg

SEQ ID NO: 125822 - RNA, 22 nt, Human
guguccuuauaagaagagaugc

SEQ ID NO: 125823 - RNA, 22 nt, Human
caggcagagucagauuagacuu

SEQ ID NO: 125824 - RNA, 22 nt, Human
aggaagugcuaagagaacauca

SEQ ID NO: 125825 - RNA, 22 nt, Human
gaagccaguguuugaagaauuu

SEQ ID NO: 125826 - RNA, 22 nt, Human
cagagcaggcccacugcccucc

SEQ ID NO: 125827 - RNA, 22 nt, Human
ggcagaggugaaguucacaagg

SEQ ID NO: 125828 - RNA, 22 nt, Human
aggcaguuguagagagggcucu

SEQ ID NO: 125829 - RNA, 22 nt, Human
ucaggcugaaucauccuagcuu

SEQ ID NO: 125830 - RNA, 22 nt, Human
uggggcaguuaauaaacauucu

SEQ ID NO: 125831 - RNA, 18 nt, Human
uccgaggcaccauaaaaa

SEQ ID NO: 125832 - RNA, 22 nt, Human
ccagggcagaaaaagagggaau

SEQ ID NO: 125833 - RNA, 22 nt, Human
cugcugugcacccaggaaggcu

SEQ ID NO: 125834 - RNA, 22 nt, Human
ggcaguggaggacccugugucu

SEQ ID NO: 125835 - RNA, 22 nt, Human
ggaggccaugaggcucuaggug

SEQ ID NO: 125836 - RNA, 19 nt, Human
aggcagaggcuuggcuagc

SEQ ID NO: 125837 - RNA, 22 nt, Human
uggagccaaugaacauuugcug

SEQ ID NO: 125838 - RNA, 22 nt, Human
cagcacacagugacucgcaccu

SEQ ID NO: 125839 - RNA, 22 nt, Human
aggugcagcugguggagucugg

SEQ ID NO: 125840 - RNA, 22 nt, Human
uacaggcauguagcauggugau

SEQ ID NO: 125841 - RNA, 16 nt, Human
uggcagagguucagcc

SEQ ID NO: 125842 - RNA, 23 nt, Human
agaguccacaagauuuuccagug

SEQ ID NO: 125843 - RNA, 22 nt, Human
acuugguuggucucacccuguu

SEQ ID NO: 125844 - RNA, 22 nt, Human
uaaaggcucacuggcuuggggu

SEQ ID NO: 125845 - RNA, 22 nt, Human
caugggcaccuuaaaaugaggc

SEQ ID NO: 125846 - RNA, 22 nt, Human
ccaggguuuaaauucugacuau

SEQ ID NO: 125847 - RNA, 22 nt, Human
ugggcagguuguuauuugacau

SEQ ID NO: 125848 - RNA, 22 nt, Human
ggcagccauacucagaccuggg

SEQ ID NO: 125849 - RNA, 22 nt, Human
gggcugagagugacuguucugu

SEQ ID NO: 125850 - RNA, 22 nt, Human
uggcagagucugggcuugggca

SEQ ID NO: 125851 - RNA, 22 nt, Human
ucuguccauucagccauccauc

SEQ ID NO: 125852 - RNA, 22 nt, Human
gaggccagcgcgcagcacuuuu

SEQ ID NO: 125853 - RNA, 22 nt, Human
auggcagggaccaagcugucau

SEQ ID NO: 125854 - RNA, 22 nt, Human
agcugccuccauggucaaagau

SEQ ID NO: 125855 - RNA, 22 nt, Human
augaggcagguggaggcugcca

SEQ ID NO: 125856 - RNA, 20 nt, Human
gcuguugccaguacagaugg

SEQ ID NO: 125857 - RNA, 22 nt, Human
gggcacuggaggccaaggagcu

SEQ ID NO: 125858 - RNA, 22 nt, Human
gaaagguugggugaauggugga

SEQ ID NO: 125859 - RNA, 22 nt, Human
acagggcagcaacuuugugccu

SEQ ID NO: 125860 - RNA, 22 nt, Human
acagcuguggggacucuugccc

SEQ ID NO: 125861 - RNA, 22 nt, Human
acacugugucuagcauuuuaca

SEQ ID NO: 125862 - RNA, 22 nt, Human
uuucugcucgcucucaaucagg

SEQ ID NO: 125863 - RNA, 22 nt, Human
cagggcaguuuuacuucucucu

SEQ ID NO: 125864 - RNA, 22 nt, Human
gaggaggcacuaguuagugaca

SEQ ID NO: 125865 - RNA, 22 nt, Human
uggcugaggagagggcggaagu

SEQ ID NO: 125866 - RNA, 22 nt, Human
cugagaguguggcuuccaggcc

SEQ ID NO: 125867 - RNA, 19 nt, Human
ugcagccacgugagagacu

SEQ ID NO: 125868 - RNA, 22 nt, Human
ccaaaggcggaacugagucucu

SEQ ID NO: 125869 - RNA, 22 nt, Human
aggcugagugcuccccuagaug

SEQ ID NO: 125870 - RNA, 22 nt, Human
gaauuaguguugaaaucagggc

SEQ ID NO: 125871 - RNA, 19 nt, Human
ugggcagguucaguaaugg

SEQ ID NO: 125872 - RNA, 22 nt, Human
ccaggugugccagcagggacug

SEQ ID NO: 125873 - RNA, 22 nt, Human
gcacagggcugccaggcggcuu

SEQ ID NO: 125874 - RNA, 22 nt, Human
gcagcuggauuucaagagggag

SEQ ID NO: 125875 - RNA, 22 nt, Human
agugcagagagcaauacucuac

SEQ ID NO: 125876 - RNA, 16 nt, Human
aggcagagauuuaccc

SEQ ID NO: 125877 - RNA, 17 nt, Human
agccaggcauaugaagu

SEQ ID NO: 125878 - RNA, 22 nt, Human
gaggcucagagggagcaugguc

SEQ ID NO: 125879 - RNA, 22 nt, Human
ucagaggagaugguuaccaggg

SEQ ID NO: 125880 - RNA, 18 nt, Human
aggggcagcuugugugga

SEQ ID NO: 125881 - RNA, 22 nt, Human
ucuuuccauggccacacagucu

SEQ ID NO: 125882 - RNA, 22 nt, Human
uccaagaucuacagcaguuuag

SEQ ID NO: 125883 - RNA, 22 nt, Human
aggcugaggcaagaggaucacu

SEQ ID NO: 125884 - RNA, 22 nt, Human
cugggcaguaugaauauucaaa

SEQ ID NO: 125885 - RNA, 22 nt, Human
gcagggcagagggagaaucucu

SEQ ID NO: 125886 - RNA, 22 nt, Human
ucuuugcuccacacucuagaga

SEQ ID NO: 125887 - RNA, 22 nt, Human
augcaguguuuggaagcuuaag

SEQ ID NO: 125888 - RNA, 22 nt, Human
augaggcagcugcuggagaacg

SEQ ID NO: 125889 - RNA, 22 nt, Human
agcagccauagauagcaugcaa

SEQ ID NO: 125890 - RNA, 22 nt, Human
cggcugaggaucuccaggccug

SEQ ID NO: 125891 - RNA, 22 nt, Human
gcagaagaccaugguggaaaga

SEQ ID NO: 125892 - RNA, 22 nt, Human
aaggcagaaagggaugugagug

SEQ ID NO: 125893 - RNA, 22 nt, Human
ccagggcacuuaggcccagccc

SEQ ID NO: 125894 - RNA, 22 nt, Human
cccaguggagauaggagugugg

SEQ ID NO: 125895 - RNA, 22 nt, Human
ggcaggagcucagguugguucc

SEQ ID NO: 125896 - RNA, 22 nt, Human
ccuccacaggagcugcagugcu

SEQ ID NO: 125897 - RNA, 22 nt, Human
agggaggucuggcugcccugag

SEQ ID NO: 125898 - RNA, 23 nt, Human
cuagggcaguauuucacagacac

SEQ ID NO: 125899 - RNA, 22 nt, Human
gugccaggcccagggagcgggg

SEQ ID NO: 125900 - RNA, 22 nt, Human
gggcugagcuguucugaguuua

SEQ ID NO: 125901 - RNA, 22 nt, Human
cagagcugcacauucuaugaug

SEQ ID NO: 125902 - RNA, 22 nt, Human
caggaggcagagguugcaguga

SEQ ID NO: 125903 - RNA, 22 nt, Human
gagaaacuaacaucugaaggug

SEQ ID NO: 125904 - RNA, 22 nt, Human
guuauuuuaacuucucaguaau

SEQ ID NO: 125905 - RNA, 20 nt, Human
accagguggcugaugacacc

SEQ ID NO: 125906 - RNA, 22 nt, Human
ccucccugcgcuccugcggcgg

SEQ ID NO: 125907 - RNA, 22 nt, Human
aggcugaggcagguggaucauu

SEQ ID NO: 125908 - RNA, 22 nt, Human
uaacugauauugaaaaacauca

SEQ ID NO: 125909 - RNA, 22 nt, Human
gcuggggagcaagaguagugag

SEQ ID NO: 125910 - RNA, 22 nt, Human
uagagcugaguugacuccauuu

SEQ ID NO: 125911 - RNA, 22 nt, Human
agagugcaaccgaaacaagcag

SEQ ID NO: 125912 - RNA, 22 nt, Human
uugcagagccaugaggcuggcu

SEQ ID NO: 125913 - RNA, 22 nt, Human
caaggcugugcaggguccauau

SEQ ID NO: 125914 - RNA, 23 nt, Human
caggcaggaugaggacuacacuc

SEQ ID NO: 125915 - RNA, 19 nt, Human
uggcugagcuggacugagg

SEQ ID NO: 125916 - RNA, 22 nt, Human
ccaguggaguuuuuauacccag

SEQ ID NO: 125917 - RNA, 22 nt, Human
ugcaggagacauaauagggacu

SEQ ID NO: 125918 - RNA, 19 nt, Human
ugcagggcugcgccugggg

SEQ ID NO: 125919 - RNA, 23 nt, Human
gcagauggccccagagugcugcc

SEQ ID NO: 125920 - RNA, 22 nt, Human
agggcugcuccuccuucaggcc

SEQ ID NO: 125921 - RNA, 22 nt, Human
acaaaggcauagugaauguuuu

SEQ ID NO: 125922 - RNA, 22 nt, Human
uaggcagagguaugguaaggac

SEQ ID NO: 125923 - RNA, 16 nt, Human
gcacacacaucaauga

SEQ ID NO: 125924 - RNA, 22 nt, Human
gagugcaguaucuucugugucc

SEQ ID NO: 125925 - RNA, 21 nt, Human
agagccugagaucuuccagca

SEQ ID NO: 125926 - RNA, 22 nt, Human
auuuuccagccuuucuagaacu

SEQ ID NO: 125927 - RNA, 22 nt, Human
ggacagaggguugacagaguau

SEQ ID NO: 125928 - RNA, 22 nt, Human
agaugcagaaaaacuaagugau

SEQ ID NO: 125929 - RNA, 22 nt, Human
ucaaaggcuugugguucuggga

SEQ ID NO: 125930 - RNA, 22 nt, Human
gaaggcuggcuuucugagagca

SEQ ID NO: 125931 - RNA, 22 nt, Human
gggcugagauuggugcccuguc

SEQ ID NO: 125932 - RNA, 22 nt, Human
cucucuguuaugcuuucaugaa

SEQ ID NO: 125933 - RNA, 22 nt, Human
gaggcucagagaagucauggua

SEQ ID NO: 125934 - RNA, 22 nt, Human
accaggcugugaagugagacua

SEQ ID NO: 125935 - RNA, 22 nt, Human
gaggaagccccauugaagccag

SEQ ID NO: 125936 - RNA, 22 nt, Human
uccucccugaguggggacagcu

SEQ ID NO: 125937 - RNA, 22 nt, Human
auuuccaaaaccacuuauugcc

SEQ ID NO: 125938 - RNA, 22 nt, Human
aggacagagggaccagagccca

SEQ ID NO: 125939 - RNA, 22 nt, Human
uaaaggcucguauuguugugug

SEQ ID NO: 125940 - RNA, 22 nt, Human
gcucuugucaaaaauuaguuga

SEQ ID NO: 125941 - RNA, 22 nt, Human
ugaggcagcauucuucaagaca

SEQ ID NO: 125942 - RNA, 22 nt, Human
ggcugagccuggagcaucuggu

SEQ ID NO: 125943 - RNA, 22 nt, Human
cagaggguugaugugaggcuua

SEQ ID NO: 125944 - RNA, 18 nt, Human
cgaggcaggcggaucacg

SEQ ID NO: 125945 - RNA, 22 nt, Human
uggcagaguggaccauacucaa

SEQ ID NO: 125946 - RNA, 22 nt, Human
aggagugaguguccucagcaga

SEQ ID NO: 125947 - RNA, 22 nt, Human
ucauccagccucaucaggagcu

SEQ ID NO: 125948 - RNA, 22 nt, Human
aggaagugaaagggaaggaguu

SEQ ID NO: 125949 - RNA, 22 nt, Human
agcagggcagugcuucagcucu

SEQ ID NO: 125950 - RNA, 22 nt, Human
aaagggaggggcgauaagccgg

SEQ ID NO: 125951 - RNA, 18 nt, Human
cccagcuggugggucagu

SEQ ID NO: 125952 - RNA, 22 nt, Human
caaagccaggcuuucuaaugua

SEQ ID NO: 125953 - RNA, 22 nt, Human
cagugagggaagaucucagcac

SEQ ID NO: 125954 - RNA, 22 nt, Human
ggcagccauggacacuggcuag

SEQ ID NO: 125955 - RNA, 22 nt, Human
gggcugagacgauggggucuuc

SEQ ID NO: 125956 - RNA, 22 nt, Human
cacagcuggugacagagcccag

SEQ ID NO: 125957 - RNA, 21 nt, Human
aggcucagagagaaacucuug

SEQ ID NO: 125958 - RNA, 22 nt, Human
uuuauuaugauggacaccuucg

SEQ ID NO: 125959 - RNA, 22 nt, Human
gagagcuggccagcuucaguau

SEQ ID NO: 125960 - RNA, 22 nt, Human
gaggcucaacccacagggguug

SEQ ID NO: 125961 - RNA, 22 nt, Human
cagagcuguugcggggcuuggc

SEQ ID NO: 125962 - RNA, 22 nt, Human
uuaacauuucuuuuccacucau

SEQ ID NO: 125963 - RNA, 22 nt, Human
gaaggcugagcagacaggccaa

SEQ ID NO: 125964 - RNA, 22 nt, Human
uagggcugccuauggcuagaua

SEQ ID NO: 125965 - RNA, 22 nt, Human
agcagggcugcagugugucuuu

SEQ ID NO: 125966 - RNA, 22 nt, Human
caucaucaaaacaaauggaguc

SEQ ID NO: 125967 - RNA, 22 nt, Human
uuggauccaucucaggcauagg

SEQ ID NO: 125968 - RNA, 22 nt, Human
ucugggagagcacguggcugac

SEQ ID NO: 125969 - RNA, 22 nt, Human
uggcugaguguuccaaggagca

SEQ ID NO: 125970 - RNA, 22 nt, Human
gccugagaguugaaguucagug

SEQ ID NO: 125971 - RNA, 22 nt, Human
uaguggaggccuguugugugca

SEQ ID NO: 125972 - RNA, 22 nt, Human
gguggcagaauaauugaagguc

SEQ ID NO: 125973 - RNA, 22 nt, Human
ugaaggagggaagaaggcucug

SEQ ID NO: 125974 - RNA, 22 nt, Human
aaugucugaaaaucagacugca

SEQ ID NO: 125975 - RNA, 22 nt, Human
uccugccuaccuugcggaggug

SEQ ID NO: 125976 - RNA, 22 nt, Human
agccaggccuuagggagaggca

SEQ ID NO: 125977 - RNA, 22 nt, Human
aguggagaauaugcagaaagcc

SEQ ID NO: 125978 - RNA, 22 nt, Human
cccagccucugggcucacccaa

SEQ ID NO: 125979 - RNA, 22 nt, Human
ugucagcagcugguuugcuguu

SEQ ID NO: 125980 - RNA, 22 nt, Human
aggguagggcccggagacagac

SEQ ID NO: 125981 - RNA, 22 nt, Human
agcagugagugggaggaccaug

SEQ ID NO: 125982 - RNA, 22 nt, Human
agcuggcagagcauuuguggcc

SEQ ID NO: 125983 - RNA, 22 nt, Human
uauaauccugcuucacauugaa

SEQ ID NO: 125984 - RNA, 22 nt, Human
cuugucagccaauuguggauuu

SEQ ID NO: 125985 - RNA, 22 nt, Human
gggaggaaagagaaguggucca

SEQ ID NO: 125986 - RNA, 22 nt, Human
ggacaggaugcugaagaugaag

SEQ ID NO: 125987 - RNA, 22 nt, Human
gaggcucaguuauuuuagccug

SEQ ID NO: 125988 - RNA, 22 nt, Human
uuccucaguuagugccugaggc

SEQ ID NO: 125989 - RNA, 22 nt, Human
acacugugcagauucccuguga

SEQ ID NO: 125990 - RNA, 22 nt, Human
cuguggaguggggaguacuggu

SEQ ID NO: 125991 - RNA, 22 nt, Human
gccaggcuccccggaucccugg

SEQ ID NO: 125992 - RNA, 22 nt, Human
aagccaguguuuuugagaguug

SEQ ID NO: 125993 - RNA, 22 nt, Human
gggauggggagcuggaaagggg

SEQ ID NO: 125994 - RNA, 16 nt, Human
aggcucagaggcugga

SEQ ID NO: 125995 - RNA, 22 nt, Human
ggagaaggaauauuggaguagg

SEQ ID NO: 125996 - RNA, 18 nt, Human
ugaauuaguuugugguuu

SEQ ID NO: 125997 - RNA, 22 nt, Human
ggaaagccaggugcucuggugu

SEQ ID NO: 125998 - RNA, 22 nt, Human
ugcagugggccggaggccaggg

SEQ ID NO: 125999 - RNA, 22 nt, Human
acagccugcugccugcuucuug

SEQ ID NO: 126000 - RNA, 22 nt, Human
ucccggcgcugggagguggguc

SEQ ID NO: 126001 - RNA, 22 nt, Human
gggcaagcacagcgagcgugcg

SEQ ID NO: 126002 - RNA, 22 nt, Human
agagcugcaauuucauguggug

SEQ ID NO: 126003 - RNA, 22 nt, Human
agcagugaugcaugacagccua

SEQ ID NO: 126004 - RNA, 22 nt, Human
ugucacaguuuguacuuuauag

SEQ ID NO: 126005 - RNA, 22 nt, Human
agaagccaauccuugucucucu

SEQ ID NO: 126006 - RNA, 22 nt, Human
gagcagagacaguacaacuggc

SEQ ID NO: 126007 - RNA, 22 nt, Human
agaagccaugguaugcaacuac

SEQ ID NO: 126008 - RNA, 22 nt, Human
gcucccagcaauugaggcagcc

SEQ ID NO: 126009 - RNA, 22 nt, Human
caggaggcuuugggauccaagu

SEQ ID NO: 126010 - RNA, 22 nt, Human
gggcugagcacauacugacagc

SEQ ID NO: 126011 - RNA, 22 nt, Human
ggcugugggaugcauaggagcu

SEQ ID NO: 126012 - RNA, 20 nt, Human
ggcagagggccugggagaag

SEQ ID NO: 126013 - RNA, 21 nt, Human
gagagggcauuauaggaagug

SEQ ID NO: 126014 - RNA, 22 nt, Human
aggcaggagugacccugacagg

SEQ ID NO: 126015 - RNA, 21 nt, Human
uggcaggcagcuggaagcuug

SEQ ID NO: 126016 - RNA, 22 nt, Human
ucagagguaguagcagaguuga

SEQ ID NO: 126017 - RNA, 23 nt, Human
uggcagagacccagaaucuacau

SEQ ID NO: 126018 - RNA, 22 nt, Human
uggcagagaacacacaugauuc

SEQ ID NO: 126019 - RNA, 22 nt, Human
gcagaggaucaggcucuggaaa

SEQ ID NO: 126020 - RNA, 22 nt, Human
cuuguagaauugaaauggucuc

SEQ ID NO: 126021 - RNA, 22 nt, Human
aggugcuuggcucgugcacaca

SEQ ID NO: 126022 - RNA, 22 nt, Human
agggucagugaugagggagccc

SEQ ID NO: 126023 - RNA, 22 nt, Human
gcagccucaaacuccccagcuc

SEQ ID NO: 126024 - RNA, 22 nt, Human
acaggcagagaacucagccaga

SEQ ID NO: 126025 - RNA, 22 nt, Human
cagaggguugucaggcgccuug

SEQ ID NO: 126026 - RNA, 22 nt, Human
acugcccuguaacugccaggua

SEQ ID NO: 126027 - RNA, 22 nt, Human
aaucaggaugacugucauuuca

SEQ ID NO: 126028 - RNA, 22 nt, Human
aggaaggagggcagauauuaag

SEQ ID NO: 126029 - RNA, 22 nt, Human
auuccauuguguaaggauaucg

SEQ ID NO: 126030 - RNA, 22 nt, Human
gggcugacaaccaucugacaag

SEQ ID NO: 126031 - RNA, 22 nt, Human
ugagcauggugggugcagagca

SEQ ID NO: 126032 - RNA, 19 nt, Human
ggccaccucucuucccagg

SEQ ID NO: 126033 - RNA, 22 nt, Human
uccagcuugacaaaugauuuua

SEQ ID NO: 126034 - RNA, 22 nt, Human
ugcagggcuuccucuuggaguu

SEQ ID NO: 126035 - RNA, 22 nt, Human
gaggcugguucugaaguacugu

SEQ ID NO: 126036 - RNA, 22 nt, Human
cugggcagguauacaaaaaaug

SEQ ID NO: 126037 - RNA, 22 nt, Human
accaggcuugaugauuugcuua

SEQ ID NO: 126038 - RNA, 22 nt, Human
ugccaggcgugguggugcgcac

SEQ ID NO: 126039 - RNA, 22 nt, Human
uggggcagggaugggaaacuau

SEQ ID NO: 126040 - RNA, 21 nt, Human
uuucacaaaaguaugugacaa

SEQ ID NO: 126041 - RNA, 22 nt, Human
gcaggcagguggcaucuuguga

SEQ ID NO: 126042 - RNA, 22 nt, Human
caggaagagguaucaccgagca

SEQ ID NO: 126043 - RNA, 22 nt, Human
ugagaagcugcugacuuagccu

SEQ ID NO: 126044 - RNA, 22 nt, Human
cagcagcaacaacggaagccuu

SEQ ID NO: 126045 - RNA, 22 nt, Human
aaugucugcucuacucaggagg

SEQ ID NO: 126046 - RNA, 18 nt, Human
agcagggcauuuugccau

SEQ ID NO: 126047 - RNA, 22 nt, Human
ggcagagacuggguuggcagag

SEQ ID NO: 126048 - RNA, 17 nt, Human
aggaagggcaaguuucu

SEQ ID NO: 126049 - RNA, 22 nt, Human
aggcucagugauguaaaauaua

SEQ ID NO: 126050 - RNA, 22 nt, Human
uguccuuuuggcugucuauggu

SEQ ID NO: 126051 - RNA, 22 nt, Human
agaagagccuggggaccauggc

SEQ ID NO: 126052 - RNA, 22 nt, Human
aaagccagagcaagcugucaca

SEQ ID NO: 126053 - RNA, 22 nt, Human
aggagugagcuuuggggucaga

SEQ ID NO: 126054 - RNA, 22 nt, Human
cuggaguguaaagagcauagaa

SEQ ID NO: 126055 - RNA, 22 nt, Human
uggagaaggggcagggucucca

SEQ ID NO: 126056 - RNA, 22 nt, Human
ucagggcaagucucagaagguu

SEQ ID NO: 126057 - RNA, 22 nt, Human
gaggcagaaguugcagugagca

SEQ ID NO: 126058 - RNA, 22 nt, Human
gggagaagaaugugucaauugu

SEQ ID NO: 126059 - RNA, 22 nt, Human
uauuugcaacauaaaacucuga

SEQ ID NO: 126060 - RNA, 22 nt, Human
agggaggaccaaugugugguua

SEQ ID NO: 126061 - RNA, 22 nt, Human
uuguggcagaccaugagucuaa

SEQ ID NO: 126062 - RNA, 22 nt, Human
ugcccaggguggagugcagcgg

SEQ ID NO: 126063 - RNA, 22 nt, Human
caccagguggaaaugucacagc

SEQ ID NO: 126064 - RNA, 22 nt, Human
aguggagaagaggauggucucc

SEQ ID NO: 126065 - RNA, 22 nt, Human
gccuggagcccaguguggggcu

SEQ ID NO: 126066 - RNA, 22 nt, Human
ccugucucuguuaccacauuug

SEQ ID NO: 126067 - RNA, 22 nt, Human
aaggcagaaauucaacuacugg

SEQ ID NO: 126068 - RNA, 22 nt, Human
gagugcaggccugagcaccauc

SEQ ID NO: 126069 - RNA, 22 nt, Human
gcagggcacacaagaaugauaa

SEQ ID NO: 126070 - RNA, 22 nt, Human
agggucagcuggcugucagggg

SEQ ID NO: 126071 - RNA, 22 nt, Human
gcagagugagauaugaacccag

SEQ ID NO: 126072 - RNA, 22 nt, Human
cuggagguaauguuauuuuugu

SEQ ID NO: 126073 - RNA, 18 nt, Human
agggucagugucacuggc

SEQ ID NO: 126074 - RNA, 22 nt, Human
aagggcugcuguagaagcagag

SEQ ID NO: 126075 - RNA, 22 nt, Human
gcagagcagcaaauggaaagga

SEQ ID NO: 126076 - RNA, 22 nt, Human
cagcuguguaugagagcaugcu

SEQ ID NO: 126077 - RNA, 23 nt, Human
gaggccacauuccccugcuugag

SEQ ID NO: 126078 - RNA, 22 nt, Human
uggcacagacagaucaggaguc

SEQ ID NO: 126079 - RNA, 22 nt, Human
uggcugagagcaauugacucug

SEQ ID NO: 126080 - RNA, 22 nt, Human
uagggcaggggaggaaucugaa

SEQ ID NO: 126081 - RNA, 22 nt, Human
ccauggagcgggugagugagug

SEQ ID NO: 126082 - RNA, 22 nt, Human
cagugagggcauucagugcugg

SEQ ID NO: 126083 - RNA, 22 nt, Human
ugaguccaauaggggccuggaa

SEQ ID NO: 126084 - RNA, 22 nt, Human
aggcccagcccguccucgugcu

SEQ ID NO: 126085 - RNA, 22 nt, Human
auacuaaaguauagaacuuagu

SEQ ID NO: 126086 - RNA, 22 nt, Human
gcagagugccgagauggaagcg

SEQ ID NO: 126087 - RNA, 22 nt, Human
aggcagagagcaguggccgucu

SEQ ID NO: 126088 - RNA, 22 nt, Human
ccaggugcucuugccagggcug

SEQ ID NO: 126089 - RNA, 22 nt, Human
uccuggccucacaguccugggu

SEQ ID NO: 126090 - RNA, 22 nt, Human
cagaggaagagauacaagcccu

SEQ ID NO: 126091 - RNA, 19 nt, Human
ggccaggcugacugugguc

SEQ ID NO: 126092 - RNA, 22 nt, Human
guggugaagccccaucucugcu

SEQ ID NO: 126093 - RNA, 22 nt, Human
cuccagggagcuguggagguuu

SEQ ID NO: 126094 - RNA, 22 nt, Human
aguggcagaucucuggucugga

SEQ ID NO: 126095 - RNA, 23 nt, Human
ugagaagccauuagagcaggugg

SEQ ID NO: 126096 - RNA, 22 nt, Human
gaggcucacugggcaaagacuc

SEQ ID NO: 126097 - RNA, 22 nt, Human
uacuguuuucuauaauggcugu

SEQ ID NO: 126098 - RNA, 22 nt, Human
uggcugagaaugggaugaugcc

SEQ ID NO: 126099 - RNA, 22 nt, Human
cccuuccuccucgccugucaga

SEQ ID NO: 126100 - RNA, 22 nt, Human
aaggaagauauaucaagcuuaa

SEQ ID NO: 126101 - RNA, 22 nt, Human
gagucugagucuaauggcccca

SEQ ID NO: 126102 - RNA, 22 nt, Human
ugggcaggauaauaucucaugu

SEQ ID NO: 126103 - RNA, 22 nt, Human
uggcagaggcucugugauguug

SEQ ID NO: 126104 - RNA, 22 nt, Human
cugaggcugaagagggccuacg

SEQ ID NO: 126105 - RNA, 22 nt, Human
gcaggugaaugauggacuagga

SEQ ID NO: 126106 - RNA, 22 nt, Human
uccugaaaauaauuucacaaga

SEQ ID NO: 126107 - RNA, 18 nt, Human
gcugcugguggagggagc

SEQ ID NO: 126108 - RNA, 22 nt, Human
gggcugagucugcugccuguca

SEQ ID NO: 126109 - RNA, 22 nt, Human
cagggcagaaggcacucuacuc

SEQ ID NO: 126110 - RNA, 19 nt, Human
gaaaggcugcugcuaccug

SEQ ID NO: 126111 - RNA, 22 nt, Human
agagcagcuggggcagagacca

SEQ ID NO: 126112 - RNA, 21 nt, Human
ccaaaggcuauguaucuucug

SEQ ID NO: 126113 - RNA, 22 nt, Human
caguggauuagccagagcugga

SEQ ID NO: 126114 - RNA, 22 nt, Human
agaucacaguggcaacucccuu

SEQ ID NO: 126115 - RNA, 22 nt, Human
gcugaggccucagaaggcugag

SEQ ID NO: 126116 - RNA, 22 nt, Human
ucaccagggagcuuguccucug

SEQ ID NO: 126117 - RNA, 22 nt, Human
ugccaggcuccggaacgacagu

SEQ ID NO: 126118 - RNA, 19 nt, Human
ugcaagugucuuggacaag

SEQ ID NO: 126119 - RNA, 22 nt, Human
ugcagggcaucuuugaagugug

SEQ ID NO: 126120 - RNA, 22 nt, Human
cagggcaggaugcugugauuau

SEQ ID NO: 126121 - RNA, 22 nt, Human
agaagccaaaugccagugaccu

SEQ ID NO: 126122 - RNA, 22 nt, Human
agcuguggcagcagccguggca

SEQ ID NO: 126123 - RNA, 22 nt, Human
ggccaggcacugugugagauau

SEQ ID NO: 126124 - RNA, 22 nt, Human
aggugucuuugcggcccgccgc

SEQ ID NO: 126125 - RNA, 22 nt, Human
cuguugucuccucucagauuau

SEQ ID NO: 126126 - RNA, 22 nt, Human
gagggcagagucuaaugaugca

SEQ ID NO: 126127 - RNA, 22 nt, Human
ggcagugaaucugagagccugg

SEQ ID NO: 126128 - RNA, 22 nt, Human
augcuguguuuuaaauggaaau

SEQ ID NO: 126129 - RNA, 22 nt, Human
gaagucuggcugacgagaguua

SEQ ID NO: 126130 - RNA, 22 nt, Human
accaaaggcagagcugaacacu

SEQ ID NO: 126131 - RNA, 22 nt, Human
agggcgaggagacggaggcaca

SEQ ID NO: 126132 - RNA, 22 nt, Human
ggcagugaaugaaacagaggcu

SEQ ID NO: 126133 - RNA, 19 nt, Human
aggagaagacucucucccc

SEQ ID NO: 126134 - RNA, 22 nt, Human
ggagccugacagugcccagcau

SEQ ID NO: 126135 - RNA, 22 nt, Human
cagggcugaacugagcuuguga

SEQ ID NO: 126136 - RNA, 22 nt, Human
cuucuuaaugcauaaacugugu

SEQ ID NO: 126137 - RNA, 22 nt, Human
ucaaaggcgguccaggaauaaa

SEQ ID NO: 126138 - RNA, 22 nt, Human
auuuccuauagauauggugagu

SEQ ID NO: 126139 - RNA, 22 nt, Human
gcugagagugggugcagugcuu

SEQ ID NO: 126140 - RNA, 22 nt, Human
uuucacacuagucagaauacca

SEQ ID NO: 126141 - RNA, 21 nt, Human
uccuguaagcuuggguggcuc

SEQ ID NO: 126142 - RNA, 22 nt, Human
ggcucacgcaauuaucccggcc

SEQ ID NO: 126143 - RNA, 22 nt, Human
aaguccaguuuuuccagguggu

SEQ ID NO: 126144 - RNA, 22 nt, Human
uggcagagagacucuccuugau

SEQ ID NO: 126145 - RNA, 22 nt, Human
caaaugcaggucauaaccugag

SEQ ID NO: 126146 - RNA, 22 nt, Human
aaggaagggaaauagugauguc

SEQ ID NO: 126147 - RNA, 22 nt, Human
ugaggcaggaggauugcaggau

SEQ ID NO: 126148 - RNA, 22 nt, Human
uggcagaggagaauuaagauua

SEQ ID NO: 126149 - RNA, 22 nt, Human
agaggcagccguauuucaaagg

SEQ ID NO: 126150 - RNA, 22 nt, Human
agggaaggagguuagaacccac

SEQ ID NO: 126151 - RNA, 22 nt, Human
aggcagccugguuugaauggaa

SEQ ID NO: 126152 - RNA, 22 nt, Human
uguucccaagauaagauuauga

SEQ ID NO: 126153 - RNA, 22 nt, Human
agagccugggcagcuccucugg

SEQ ID NO: 126154 - RNA, 22 nt, Human
ccagaagaccccguccaccucc

SEQ ID NO: 126155 - RNA, 22 nt, Human
caaaggcuuugcuaugaugcau

SEQ ID NO: 126156 - RNA, 22 nt, Human
agcagggcuugccgcuuguccu

SEQ ID NO: 126157 - RNA, 23 nt, Human
aggaaagcauucauuuuuaccau

SEQ ID NO: 126158 - RNA, 22 nt, Human
caggaagauuagaccaagagcu

SEQ ID NO: 126159 - RNA, 22 nt, Human
gaggccugucgcuaggccucug

SEQ ID NO: 126160 - RNA, 23 nt, Human
guuuucaacacaauaaauguaac

SEQ ID NO: 126161 - RNA, 22 nt, Human
cugcuguggguuaagacacugu

SEQ ID NO: 126162 - RNA, 22 nt, Human
aguggcaguuugggagcuacag

SEQ ID NO: 126163 - RNA, 22 nt, Human
cuggagccggcgagccccagcc

SEQ ID NO: 126164 - RNA, 18 nt, Human
uauauuucacacauauuc

SEQ ID NO: 126165 - RNA, 22 nt, Human
aggcaggagcaagcccuacaag

SEQ ID NO: 126166 - RNA, 18 nt, Human
ggcuguggacaagauuag

SEQ ID NO: 126167 - RNA, 22 nt, Human
ggcugaaguguaguggcucacu

SEQ ID NO: 126168 - RNA, 22 nt, Human
cugaggcuggggaagggaagug

SEQ ID NO: 126169 - RNA, 22 nt, Human
cagggacaauggcagagccuga

SEQ ID NO: 126170 - RNA, 22 nt, Human
acacaucagaaauaugaaugag

SEQ ID NO: 126171 - RNA, 23 nt, Human
cacuccuguuucuaagccagcau

SEQ ID NO: 126172 - RNA, 22 nt, Human
ccagagaggccaaggucguggu

SEQ ID NO: 126173 - RNA, 22 nt, Human
uuccuaaaagaauacacuggau

SEQ ID NO: 126174 - RNA, 22 nt, Human
ucaccaggcuggaaugcagugg

SEQ ID NO: 126175 - RNA, 23 nt, Human
ugaagugaaauuucacaagggac

SEQ ID NO: 126176 - RNA, 22 nt, Human
aagagcuggucacagguccauu

SEQ ID NO: 126177 - RNA, 22 nt, Human
uuucacaacguuguggugagag

SEQ ID NO: 126178 - RNA, 22 nt, Human
aggugucugggcuuuggaguca

SEQ ID NO: 126179 - RNA, 22 nt, Human
ggccaccucugcccuacugagu

SEQ ID NO: 126180 - RNA, 22 nt, Human
aggggcaggugcugcacuuaga

SEQ ID NO: 126181 - RNA, 22 nt, Human
gccagagguaucaaagauagua

SEQ ID NO: 126182 - RNA, 17 nt, Human
uagagcugguucaggag

SEQ ID NO: 126183 - RNA, 22 nt, Human
acaguggagaagcaaaugcagu

SEQ ID NO: 126184 - RNA, 22 nt, Human
aaaaugaauaaguuaacccagg

SEQ ID NO: 126185 - RNA, 22 nt, Human
accaugggucagccaccucagc

SEQ ID NO: 126186 - RNA, 22 nt, Human
cugaguccagggacagaggcgu

SEQ ID NO: 126187 - RNA, 22 nt, Human
gaaaccagcuagaggcagaggg

SEQ ID NO: 126188 - RNA, 22 nt, Human
ccagagggccuuuggaguuauc

SEQ ID NO: 126189 - RNA, 20 nt, Human
ucaaaggcaaaggugggugu

SEQ ID NO: 126190 - RNA, 22 nt, Human
cagcugugggccugacguggca

SEQ ID NO: 126191 - RNA, 22 nt, Human
gggcaguggguggcugcagccu

SEQ ID NO: 126192 - RNA, 22 nt, Human
agggccagcuagagcccucgcc

SEQ ID NO: 126193 - RNA, 22 nt, Human
aggcaggucacaugcuuggcga

SEQ ID NO: 126194 - RNA, 22 nt, Human
ccaggugucaugcgugugaccc

SEQ ID NO: 126195 - RNA, 22 nt, Human
ucagggcauucaagaggccugg

SEQ ID NO: 126196 - RNA, 22 nt, Human
ugcugugggcaguacauaagcu

SEQ ID NO: 126197 - RNA, 21 nt, Human
agaguaauuccugcuggaaag

SEQ ID NO: 126198 - RNA, 22 nt, Human
cggcugagcagugcugauggaa

SEQ ID NO: 126199 - RNA, 22 nt, Human
ggcaggguccacaccugggaaa

SEQ ID NO: 126200 - RNA, 22 nt, Human
agggccagggaaacgaucagca

SEQ ID NO: 126201 - RNA, 22 nt, Human
cagaagcauuccagcaaauagu

SEQ ID NO: 126202 - RNA, 22 nt, Human
caguggaggccuugggaccuuu

SEQ ID NO: 126203 - RNA, 16 nt, Human
agccaggcugccucgg

SEQ ID NO: 126204 - RNA, 22 nt, Human
ccaggcuuucccagccucucca

SEQ ID NO: 126205 - RNA, 22 nt, Human
uccugccugcaaucccagcacu

SEQ ID NO: 126206 - RNA, 22 nt, Human
gcagacaauuuauuagcagauu

SEQ ID NO: 126207 - RNA, 20 nt, Human
gaaauucucguauuaguuua

SEQ ID NO: 126208 - RNA, 22 nt, Human
ugccagagaagacccagucacu

SEQ ID NO: 126209 - RNA, 22 nt, Human
uggcugagguuaugcugguugu

SEQ ID NO: 126210 - RNA, 22 nt, Human
uggcugcagacaccuauggcag

SEQ ID NO: 126211 - RNA, 19 nt, Human
ugggaguggggaagguccu

SEQ ID NO: 126212 - RNA, 22 nt, Human
ggcagggcagcgcugauuaggg

SEQ ID NO: 126213 - RNA, 22 nt, Human
cuguggcauugugaggacugca

SEQ ID NO: 126214 - RNA, 22 nt, Human
ugccaggcaacugcccagccau

SEQ ID NO: 126215 - RNA, 22 nt, Human
gccuguuggguaacagaguuca

SEQ ID NO: 126216 - RNA, 22 nt, Human
gagaagcaaucgugacaucucc

SEQ ID NO: 126217 - RNA, 22 nt, Human
cagagcugcucaugguggccag

SEQ ID NO: 126218 - RNA, 22 nt, Human
ggaagccacccagcuuugauag

SEQ ID NO: 126219 - RNA, 22 nt, Human
gcagccacagaggagggaugca

SEQ ID NO: 126220 - RNA, 22 nt, Human
ugacauuuaucaaagaaauggu

SEQ ID NO: 126221 - RNA, 22 nt, Human
gcucccagguucuugggccuug

SEQ ID NO: 126222 - RNA, 22 nt, Human
gauggcagcagcagccagggau

SEQ ID NO: 126223 - RNA, 23 nt, Human
agggcugaaugcagagaagcaga

SEQ ID NO: 126224 - RNA, 22 nt, Human
gcaccuggacagugacccuagc

SEQ ID NO: 126225 - RNA, 21 nt, Human
agaagccaugugguggagaac

SEQ ID NO: 126226 - RNA, 22 nt, Human
uuguugucauuguagaggauuu

SEQ ID NO: 126227 - RNA, 22 nt, Human
gaaguggaauuacugggucaua

SEQ ID NO: 126228 - RNA, 22 nt, Human
ugaggcucagaagugccaagug

SEQ ID NO: 126229 - RNA, 22 nt, Human
gccaggcauuauuccgaucccu

SEQ ID NO: 126230 - RNA, 22 nt, Human
uaggcugggaagaaagauucuc

SEQ ID NO: 126231 - RNA, 22 nt, Human
augaggcaguacacacaaagcc

SEQ ID NO: 126232 - RNA, 22 nt, Human
gugggcugcccuugaggucagc

SEQ ID NO: 126233 - RNA, 23 nt, Human
cagaggguuccauggagcauggu

SEQ ID NO: 126234 - RNA, 22 nt, Human
ugaggcagauauuuauuggguu

SEQ ID NO: 126235 - RNA, 22 nt, Human
aaggcaggaugcggacccaucu

SEQ ID NO: 126236 - RNA, 22 nt, Human
gagagggcugccuggugugagg

SEQ ID NO: 126237 - RNA, 22 nt, Human
aaguccagugcuuuagauucca

SEQ ID NO: 126238 - RNA, 22 nt, Human
gagagugaggccugggaaucua

SEQ ID NO: 126239 - RNA, 19 nt, Human
aucugaaguaggugcagcu

SEQ ID NO: 126240 - RNA, 21 nt, Human
aagggagauaggaaucaggcc

SEQ ID NO: 126241 - RNA, 22 nt, Human
ucagccuuguggcccugcucca

SEQ ID NO: 126242 - RNA, 22 nt, Human
agggcuggcaagggauugaaau

SEQ ID NO: 126243 - RNA, 22 nt, Human
aggaagagcuggaccagaggac

SEQ ID NO: 126244 - RNA, 23 nt, Human
gcaguggaaugucucuguuugga

SEQ ID NO: 126245 - RNA, 22 nt, Human
aagggcaggugggcauuucugg

SEQ ID NO: 126246 - RNA, 22 nt, Human
ucccaggugaugcugaggccac

SEQ ID NO: 126247 - RNA, 22 nt, Human
agccaggcagacucucuuucuu

SEQ ID NO: 126248 - RNA, 21 nt, Human
accaggcuugugggagggagc

SEQ ID NO: 126249 - RNA, 21 nt, Human
aaagagcccgcugagagguuc

SEQ ID NO: 126250 - RNA, 22 nt, Human
cagugcagaggccagggaggau

SEQ ID NO: 126251 - RNA, 22 nt, Human
aggugucugugaugggagcgau

SEQ ID NO: 126252 - RNA, 22 nt, Human
uagagcuggccgggacagcugg

SEQ ID NO: 126253 - RNA, 22 nt, Human
ugagcagggacuuugaguguag

SEQ ID NO: 126254 - RNA, 22 nt, Human
ccagggaggguccuguggcuuc

SEQ ID NO: 126255 - RNA, 22 nt, Human
gggaagcagcauugugcuggcu

SEQ ID NO: 126256 - RNA, 22 nt, Human
cugaagaggacgcagcagcaag

SEQ ID NO: 126257 - RNA, 22 nt, Human
gaagagcuaaaggcacaggcuu

SEQ ID NO: 126258 - RNA, 22 nt, Human
cccuucucuuucacucacuauu

SEQ ID NO: 126259 - RNA, 22 nt, Human
gccuggagagcacugugcgcuu

SEQ ID NO: 126260 - RNA, 22 nt, Human
ggggcagcucccgagggcagga

SEQ ID NO: 126261 - RNA, 22 nt, Human
gcagggcacagacagugccaag

SEQ ID NO: 126262 - RNA, 22 nt, Human
gccagaagggguggauccaggc

SEQ ID NO: 126263 - RNA, 22 nt, Human
gaauucugucgcuuacuagaug

SEQ ID NO: 126264 - RNA, 22 nt, Human
aguggcaggcggagauguagga

SEQ ID NO: 126265 - RNA, 22 nt, Human
aguggcagagccaagauaugau

SEQ ID NO: 126266 - RNA, 22 nt, Human
cugagggccuuggcuccugccc

SEQ ID NO: 126267 - RNA, 22 nt, Human
caagcuggcugggagaggcacg

SEQ ID NO: 126268 - RNA, 22 nt, Human
gggcugaguuccugccucacuc

SEQ ID NO: 126269 - RNA, 22 nt, Human
agcugggcagacugcagugguu

SEQ ID NO: 126270 - RNA, 23 nt, Human
ugggucagcugccuccaggacaa

SEQ ID NO: 126271 - RNA, 22 nt, Human
caguggcacccacgggcugggc

SEQ ID NO: 126272 - RNA, 22 nt, Human
ccagggcauguccaagacuuag

SEQ ID NO: 126273 - RNA, 22 nt, Human
gugugccaccagucaaggugaa

SEQ ID NO: 126274 - RNA, 22 nt, Human
aggcucagugcaaaucauucug

SEQ ID NO: 126275 - RNA, 22 nt, Human
gggcugaggcuaccacuggucu

SEQ ID NO: 126276 - RNA, 22 nt, Human
ugcagagaaaccaguggaggac

SEQ ID NO: 126277 - RNA, 22 nt, Human
cagugguauuugagagaaugga

SEQ ID NO: 126278 - RNA, 19 nt, Human
acagggcagcaauaggaua

SEQ ID NO: 126279 - RNA, 22 nt, Human
ggccaggcuggucucagacuuc

SEQ ID NO: 126280 - RNA, 22 nt, Human
cucugucccagacccaccucuc

SEQ ID NO: 126281 - RNA, 22 nt, Human
cugggcagcuguaucagggagu

SEQ ID NO: 126282 - RNA, 22 nt, Human
ggaggaagagguuguucucuca

SEQ ID NO: 126283 - RNA, 22 nt, Human
aaggcaggagcuguaucuuauu

SEQ ID NO: 126284 - RNA, 22 nt, Human
cugaggcacagugaacuucucc

SEQ ID NO: 126285 - RNA, 22 nt, Human
ucacacacauggauaguauuuu

SEQ ID NO: 126286 - RNA, 22 nt, Human
ggcugaguugagaggauuacuu

SEQ ID NO: 126287 - RNA, 22 nt, Human
gugagggcagcuuggucagugu

SEQ ID NO: 126288 - RNA, 18 nt, Human
acagggagggcgcugggg

SEQ ID NO: 126289 - RNA, 22 nt, Human
ugggcagggagcuggaaccaca

SEQ ID NO: 126290 - RNA, 22 nt, Human
ugcuaaauaaguggaauagaca

SEQ ID NO: 126291 - RNA, 22 nt, Human
gagaaggacuacacaucuggcc

SEQ ID NO: 126292 - RNA, 22 nt, Human
acagagcuuaggaugacuccca

SEQ ID NO: 126293 - RNA, 22 nt, Human
ugcugaaggcaggggagguggc

SEQ ID NO: 126294 - RNA, 22 nt, Human
acccaggaggcagagguugcag

SEQ ID NO: 126295 - RNA, 22 nt, Human
aucaggaagaagaauguguugg

SEQ ID NO: 126296 - RNA, 22 nt, Human
gggccagguggaccccagccuc

SEQ ID NO: 126297 - RNA, 22 nt, Human
gugaagagcuguugcagagauu

SEQ ID NO: 126298 - RNA, 22 nt, Human
acaguggagcucagaugaaaau

SEQ ID NO: 126299 - RNA, 22 nt, Human
gggaaggacauucugggcucag

SEQ ID NO: 126300 - RNA, 22 nt, Human
caguggaagcuggcugugaaga

SEQ ID NO: 126301 - RNA, 20 nt, Human
uaggcagagcugugcagccu

SEQ ID NO: 126302 - RNA, 22 nt, Human
gucagaggggacaagacacaga

SEQ ID NO: 126303 - RNA, 22 nt, Human
cauaucauaggucuuggauaau

SEQ ID NO: 126304 - RNA, 22 nt, Human
gcaggaagaugagcucagguaa

SEQ ID NO: 126305 - RNA, 22 nt, Human
gugugcagggaugagugcaggu

SEQ ID NO: 126306 - RNA, 22 nt, Human
aacauugcagcuuaauugcagg

SEQ ID NO: 126307 - RNA, 22 nt, Human
gccaccagggggcuccagugag

SEQ ID NO: 126308 - RNA, 22 nt, Human
gccagggcugugcagguuuguu

SEQ ID NO: 126309 - RNA, 19 nt, Human
gaucagagugucagcuugu

SEQ ID NO: 126310 - RNA, 22 nt, Human
gcuucgggguccaagcgcgugu

SEQ ID NO: 126311 - RNA, 23 nt, Human
ccucagggucuagcagagagaag

SEQ ID NO: 126312 - RNA, 22 nt, Human
gaaauucugugucccagagugc

SEQ ID NO: 126313 - RNA, 22 nt, Human
gagggcugcaaugagacagaga

SEQ ID NO: 126314 - RNA, 22 nt, Human
gucaggcugccagucuuuauug

SEQ ID NO: 126315 - RNA, 22 nt, Human
agcucugcaggcacagcugagg

SEQ ID NO: 126316 - RNA, 22 nt, Human
gcagaggacacaggagggcaag

SEQ ID NO: 126317 - RNA, 22 nt, Human
gcagaggcucuuuaaugcuuag

SEQ ID NO: 126318 - RNA, 22 nt, Human
ugccaggcauauggccucuuug

SEQ ID NO: 126319 - RNA, 22 nt, Human
cagucaccaccagguggcagua

SEQ ID NO: 126320 - RNA, 22 nt, Human
cuggagugaggucugggagccu

SEQ ID NO: 126321 - RNA, 22 nt, Human
gagccugccucuagucucuaga

SEQ ID NO: 126322 - RNA, 22 nt, Human
aagaugcacaauguggcaauua

SEQ ID NO: 126323 - RNA, 20 nt, Human
ccugucucacguuccgcccc

SEQ ID NO: 126324 - RNA, 22 nt, Human
uggagaaggacagccugagaaa

SEQ ID NO: 126325 - RNA, 22 nt, Human
ucuucagagugaaagucuguga

SEQ ID NO: 126326 - RNA, 22 nt, Human
aggucagcugcugauaggcagc

SEQ ID NO: 126327 - RNA, 22 nt, Human
ucauuuucaaguuugaacagga

SEQ ID NO: 126328 - RNA, 18 nt, Human
acacacacaccuguguau

SEQ ID NO: 126329 - RNA, 22 nt, Human
gccagaagacuggagucagcug

SEQ ID NO: 126330 - RNA, 22 nt, Human
agccagugggauuagagccucu

SEQ ID NO: 126331 - RNA, 22 nt, Human
ucuauacaugugcacacacauc

SEQ ID NO: 126332 - RNA, 22 nt, Human
ucagaggaaagggaacauaguc

SEQ ID NO: 126333 - RNA, 22 nt, Human
gaggcacaucacuuggugcauu

SEQ ID NO: 126334 - RNA, 22 nt, Human
agugccuugugugugggcagcc

SEQ ID NO: 126335 - RNA, 22 nt, Human
acaguggaguugggguagcccu

SEQ ID NO: 126336 - RNA, 22 nt, Human
aggcaagcauugggaacagggc

SEQ ID NO: 126337 - RNA, 22 nt, Human
ucggggucuuugacacgcucug

SEQ ID NO: 126338 - RNA, 16 nt, Human
gagggcagaggcggaa

SEQ ID NO: 126339 - RNA, 22 nt, Human
aguggcagagccaaguagagcc

SEQ ID NO: 126340 - RNA, 22 nt, Human
gggcuggaggugagcaggacag

SEQ ID NO: 126341 - RNA, 22 nt, Human
aggcucaggcaggaauggcgga

SEQ ID NO: 126342 - RNA, 22 nt, Human
ugggcugagcacugaggaagga

SEQ ID NO: 126343 - RNA, 22 nt, Human
cugcuguguuucacaccucugg

SEQ ID NO: 126344 - RNA, 22 nt, Human
ucgggguagacgccagcucgga

SEQ ID NO: 126345 - RNA, 22 nt, Human
ucugcucuccauacuuccgcac

SEQ ID NO: 126346 - RNA, 22 nt, Human
aggcugcguuagccucacuccc

SEQ ID NO: 126347 - RNA, 22 nt, Human
agaagugccgaaaggaagacag

SEQ ID NO: 126348 - RNA, 22 nt, Human
caccagggacaaugcuaggggu

SEQ ID NO: 126349 - RNA, 22 nt, Human
agggcugaaacauaauccuucu

SEQ ID NO: 126350 - RNA, 22 nt, Human
cagugcccuuccaggacugcag

SEQ ID NO: 126351 - RNA, 22 nt, Human
aguaggaggcgggagcaugaag

SEQ ID NO: 126352 - RNA, 20 nt, Human
gcagggcaagggauaugaaa

SEQ ID NO: 126353 - RNA, 22 nt, Human
caacauauaauauuugaguucu

SEQ ID NO: 126354 - RNA, 22 nt, Human
caggcccagcccagcccuucga

SEQ ID NO: 126355 - RNA, 22 nt, Human
ugggaguggggcauagaaggua

SEQ ID NO: 126356 - RNA, 21 nt, Human
ucagggcagcugcucuucaga

SEQ ID NO: 126357 - RNA, 22 nt, Human
agguggcucugacagcucuggu

SEQ ID NO: 126358 - RNA, 22 nt, Human
caggggcagucugugugcgugg

SEQ ID NO: 126359 - RNA, 22 nt, Human
gggggacuggaccguccugggu

SEQ ID NO: 126360 - RNA, 22 nt, Human
gccaggcuguuuuuauuacugu

SEQ ID NO: 126361 - RNA, 22 nt, Human
uccaggcugggcugaagggugc

SEQ ID NO: 126362 - RNA, 22 nt, Human
aagacauuuauuugaaucaauu

SEQ ID NO: 126363 - RNA, 22 nt, Human
caacaguguugcaaucugaaaa

SEQ ID NO: 126364 - RNA, 22 nt, Human
cacuguuuuauuccaacauagg

SEQ ID NO: 126365 - RNA, 22 nt, Human
gugaaggcuacaagagaucaag

SEQ ID NO: 126366 - RNA, 19 nt, Human
gcgaggaagucacuguggu

SEQ ID NO: 126367 - RNA, 18 nt, Human
ggcaugugagugcugagg

SEQ ID NO: 126368 - RNA, 22 nt, Human
caggugucuaauucucaccccc

SEQ ID NO: 126369 - RNA, 22 nt, Human
gugccagggaguggaggagcuu

SEQ ID NO: 126370 - RNA, 22 nt, Human
aggcaguguguagcuggaagag

SEQ ID NO: 126371 - RNA, 19 nt, Human
ucaggcaguuauucacaaa

SEQ ID NO: 126372 - RNA, 22 nt, Human
gggcugacucaaccuugcaaag

SEQ ID NO: 126373 - RNA, 22 nt, Human
ggccaggcugcccugggagcag

SEQ ID NO: 126374 - RNA, 22 nt, Human
acagcugugagggucacuugua

SEQ ID NO: 126375 - RNA, 22 nt, Human
gcagggcagcucacugugguuc

SEQ ID NO: 126376 - RNA, 22 nt, Human
uggcugagugaacauguccauu

SEQ ID NO: 126377 - RNA, 23 nt, Human
ugugaagguggguccaagggcug

SEQ ID NO: 126378 - RNA, 22 nt, Human
agccaggcgggucuuugcuccu

SEQ ID NO: 126379 - RNA, 22 nt, Human
agaggaggcuggguccagauaa

SEQ ID NO: 126380 - RNA, 22 nt, Human
acaggcuguugggguccagggu

SEQ ID NO: 126381 - RNA, 22 nt, Human
cagagcugcaaaugccccuccg

SEQ ID NO: 126382 - RNA, 22 nt, Human
cugagagaugauauagcuuaau

SEQ ID NO: 126383 - RNA, 22 nt, Human
caggcagaugcugacaagaguu

SEQ ID NO: 126384 - RNA, 22 nt, Human
ugcagggcauaggguccaguuu

SEQ ID NO: 126385 - RNA, 22 nt, Human
cucuguccuccaccugcuuuca

SEQ ID NO: 126386 - RNA, 22 nt, Human
cagagugaacagugggaugugc

SEQ ID NO: 126387 - RNA, 22 nt, Human
gcugaggcuccucgggaggaca

SEQ ID NO: 126388 - RNA, 22 nt, Human
aaggugucaccagauuggcagg

SEQ ID NO: 126389 - RNA, 22 nt, Human
gagcgggaggaacggcucgggc

SEQ ID NO: 126390 - RNA, 22 nt, Human
ucaaaggcaccaaggucacugc

SEQ ID NO: 126391 - RNA, 22 nt, Human
gggcugaggaacauauuuuguu

SEQ ID NO: 126392 - RNA, 22 nt, Human
agaauuagguaaguucaucuga

SEQ ID NO: 126393 - RNA, 22 nt, Human
gugggcagacagugcuuugcag

SEQ ID NO: 126394 - RNA, 22 nt, Human
cugcugugugcuuacuuggguu

SEQ ID NO: 126395 - RNA, 22 nt, Human
aggcucaguauagcuggcaagu

SEQ ID NO: 126396 - RNA, 22 nt, Human
acagggcagagggcaguuggua

SEQ ID NO: 126397 - RNA, 22 nt, Human
cucaggcuugggaggaggccca

SEQ ID NO: 126398 - RNA, 22 nt, Human
ggcagauguuauaugaucugag

SEQ ID NO: 126399 - RNA, 22 nt, Human
agcagagguuuguuggaaaccu

SEQ ID NO: 126400 - RNA, 17 nt, Human
uggcacagaggugcuau

SEQ ID NO: 126401 - RNA, 22 nt, Human
gagaagcagguuuagcagacaa

SEQ ID NO: 126402 - RNA, 22 nt, Human
ugccaggcuuuggucaaaggcu

SEQ ID NO: 126403 - RNA, 22 nt, Human
ugcucccaggcucuguggucug

SEQ ID NO: 126404 - RNA, 22 nt, Human
cuuauuuugcugaugacccagg

SEQ ID NO: 126405 - RNA, 22 nt, Human
agaagccacaggccucgucugg

SEQ ID NO: 126406 - RNA, 22 nt, Human
ugacauuuuaucaauaucacag

SEQ ID NO: 126407 - RNA, 22 nt, Human
ggggcagcuaccggaaguaggg

SEQ ID NO: 126408 - RNA, 22 nt, Human
ccaguggacuucucccuguggu

SEQ ID NO: 126409 - RNA, 22 nt, Human
ugguagggacacuaugcagaaa

SEQ ID NO: 126410 - RNA, 22 nt, Human
guucaagguuuuacagagugua

SEQ ID NO: 126411 - RNA, 22 nt, Human
ggcugagccaugggcacugcag

SEQ ID NO: 126412 - RNA, 22 nt, Human
uguggcagcuggagguggagaa

SEQ ID NO: 126413 - RNA, 22 nt, Human
aggcucagagaugaguaagcac

SEQ ID NO: 126414 - RNA, 22 nt, Human
gagaaggcugauccuuggaguu

SEQ ID NO: 126415 - RNA, 22 nt, Human
agcuguggcagcacuuuggagu

SEQ ID NO: 126416 - RNA, 22 nt, Human
ucagggcaagauugguuaauaa

SEQ ID NO: 126417 - RNA, 19 nt, Human
gucagcaccauggacaggg

SEQ ID NO: 126418 - RNA, 22 nt, Human
uccuggcccggccgggccugcu

SEQ ID NO: 126419 - RNA, 22 nt, Human
gguccagggaacuuugaaggau

SEQ ID NO: 126420 - RNA, 22 nt, Human
gucagaggaggcugaguaggaa

SEQ ID NO: 126421 - RNA, 22 nt, Human
aggcucagucuguucaugcacu

SEQ ID NO: 126422 - RNA, 22 nt, Human
cagagcugugauaaauagauau

SEQ ID NO: 126423 - RNA, 22 nt, Human
agcuguggaagacugucagggu

SEQ ID NO: 126424 - RNA, 22 nt, Human
aggccagggucccacacucgca

SEQ ID NO: 126425 - RNA, 22 nt, Human
gcagaggaggacccaggaauua

SEQ ID NO: 126426 - RNA, 22 nt, Human
gagggcugcuggaaaaaugcag

SEQ ID NO: 126427 - RNA, 22 nt, Human
gaauacaaauaauaccaaggug

SEQ ID NO: 126428 - RNA, 22 nt, Human
aagucuguuugagugucacacu

SEQ ID NO: 126429 - RNA, 22 nt, Human
aggcacaggaaugucauccagu

SEQ ID NO: 126430 - RNA, 21 nt, Human
agccugggaggcggagguugc

SEQ ID NO: 126431 - RNA, 20 nt, Human
ucucugagcuucucuugggg

SEQ ID NO: 126432 - RNA, 22 nt, Human
ugccaggcauuugacagacacu

SEQ ID NO: 126433 - RNA, 22 nt, Human
agaaggcagaugggacggagca

SEQ ID NO: 126434 - RNA, 22 nt, Human
agcagccacacgccuccuucuc

SEQ ID NO: 126435 - RNA, 22 nt, Human
uguacuugaacuugacuguaga

SEQ ID NO: 126436 - RNA, 22 nt, Human
aagggcagagggaaucccacau

SEQ ID NO: 126437 - RNA, 22 nt, Human
gaagcccagcaaacugugauca

SEQ ID NO: 126438 - RNA, 22 nt, Human
agggcccuuacgcaggcccuuc

SEQ ID NO: 126439 - RNA, 22 nt, Human
ccaguggaauuaaaaauaagug

SEQ ID NO: 126440 - RNA, 22 nt, Human
agagggcaugcuugguggccug

SEQ ID NO: 126441 - RNA, 22 nt, Human
cugagccuguguuucucuggca

SEQ ID NO: 126442 - RNA, 22 nt, Human
cggcuggugucgggcacagcaa

SEQ ID NO: 126443 - RNA, 21 nt, Human
ggcagugaugugaagugcauc

SEQ ID NO: 126444 - RNA, 22 nt, Human
caguaggaaggaugcagaaaaa

SEQ ID NO: 126445 - RNA, 20 nt, Human
uccuggccucccuggggcuc

SEQ ID NO: 126446 - RNA, 22 nt, Human
caggcugccgugaagcaggccu

SEQ ID NO: 126447 - RNA, 22 nt, Human
cucuggaguucuucaagcuacu

SEQ ID NO: 126448 - RNA, 22 nt, Human
ggagcagggaauuacagcgcag

SEQ ID NO: 126449 - RNA, 22 nt, Human
ccagagccucaacacagguccu

SEQ ID NO: 126450 - RNA, 22 nt, Human
auucuggccuuggcucugucac

SEQ ID NO: 126451 - RNA, 22 nt, Human
gagaaagggauaauuugaagag

SEQ ID NO: 126452 - RNA, 20 nt, Human
ugcagggcugccucccagcu

SEQ ID NO: 126453 - RNA, 22 nt, Human
cucccagguuccgacgccucuu

SEQ ID NO: 126454 - RNA, 22 nt, Human
gcaccaggcagcugagcaggcc

SEQ ID NO: 126455 - RNA, 22 nt, Human
gcuguggcugaagaugcaggga

SEQ ID NO: 126456 - RNA, 22 nt, Human
ccagagcuaaacacacaggcug

SEQ ID NO: 126457 - RNA, 22 nt, Human
uccaggcuagaagucacaggcc

SEQ ID NO: 126458 - RNA, 22 nt, Human
gcaguggauccaaugguaucuu

SEQ ID NO: 126459 - RNA, 22 nt, Human
agugcacuggcaccaucucagc

SEQ ID NO: 126460 - RNA, 22 nt, Human
agggccaccagagcagggcagu

SEQ ID NO: 126461 - RNA, 22 nt, Human
cagaguaaggagcugucaaacg

SEQ ID NO: 126462 - RNA, 22 nt, Human
cagaggcauuacugaaaaggug

SEQ ID NO: 126463 - RNA, 22 nt, Human
aggcucagucccggcccgcgcc

SEQ ID NO: 126464 - RNA, 22 nt, Human
gugugcagucugcuaggcaggg

SEQ ID NO: 126465 - RNA, 22 nt, Human
ugaggcucagagcaccugcucc

SEQ ID NO: 126466 - RNA, 22 nt, Human
agcugucucugguauuauguga

SEQ ID NO: 126467 - RNA, 22 nt, Human
ucucugagcccagugucccccu

SEQ ID NO: 126468 - RNA, 22 nt, Human
cagugaaguuuaaaguguagau

SEQ ID NO: 126469 - RNA, 22 nt, Human
ugaaggcagcaugcacacuagu

SEQ ID NO: 126470 - RNA, 22 nt, Human
gcagugaacauaacacagaagg

SEQ ID NO: 126471 - RNA, 22 nt, Human
gugaauggggcaggaaggaugg

SEQ ID NO: 126472 - RNA, 18 nt, Human
cugaggcuggcaggagcc

SEQ ID NO: 126473 - RNA, 22 nt, Human
ccuccaguacuccaguccagcg

SEQ ID NO: 126474 - RNA, 22 nt, Human
ugaagccaccgaaccagaagag

SEQ ID NO: 126475 - RNA, 22 nt, Human
ggcgcucaguguugccccagag

SEQ ID NO: 126476 - RNA, 22 nt, Human
agugcaugccuuccuguggaug

SEQ ID NO: 126477 - RNA, 22 nt, Human
caggcaggucagugaagaagga

SEQ ID NO: 126478 - RNA, 22 nt, Human
ccugaagggacuccagagagca

SEQ ID NO: 126479 - RNA, 22 nt, Human
gggggaagaaagaacauggcau

SEQ ID NO: 126480 - RNA, 22 nt, Human
ugccaggcccucccacagauua

SEQ ID NO: 126481 - RNA, 22 nt, Human
cacucacuuauuucuaacagaa

SEQ ID NO: 126482 - RNA, 22 nt, Human
acugucuuguguuaaagaacca

SEQ ID NO: 126483 - RNA, 22 nt, Human
ugugcagcucuagagccaagcc

SEQ ID NO: 126484 - RNA, 22 nt, Human
guggcacagugggagagcccca

SEQ ID NO: 126485 - RNA, 22 nt, Human
ugcccagggauaagccuagaga

SEQ ID NO: 126486 - RNA, 19 nt, Human
auuucaagagguuuauugg

SEQ ID NO: 126487 - RNA, 22 nt, Human
ggccaggcugguuccuugaccu

SEQ ID NO: 126488 - RNA, 20 nt, Human
agaaggcuccuuuugccaag

SEQ ID NO: 126489 - RNA, 22 nt, Human
gggcaguguggucgugccuuug

SEQ ID NO: 126490 - RNA, 22 nt, Human
aguggagacaggacagucgaua

SEQ ID NO: 126491 - RNA, 22 nt, Human
caggcagccugcggucugcaca

SEQ ID NO: 126492 - RNA, 22 nt, Human
uccuuugguuguagacaggaau

SEQ ID NO: 126493 - RNA, 22 nt, Human
ccaggagcaccaggccugugcc

SEQ ID NO: 126494 - RNA, 22 nt, Human
cagugcaguuucccagaugcug

SEQ ID NO: 126495 - RNA, 22 nt, Human
agagccugucaauuguaaagag

SEQ ID NO: 126496 - RNA, 22 nt, Human
uuccucuuucucugugcuaugu

SEQ ID NO: 126497 - RNA, 22 nt, Human
auuuccaagaaagcuuuaggau

SEQ ID NO: 126498 - RNA, 22 nt, Human
gaguggagcaaaagagguagau

SEQ ID NO: 126499 - RNA, 16 nt, Human
gcaggcagaucacaug

SEQ ID NO: 126500 - RNA, 18 nt, Human
uggcaggaaaugcacuuu

SEQ ID NO: 126501 - RNA, 22 nt, Human
ggaagccaggccaaugagaaca

SEQ ID NO: 126502 - RNA, 22 nt, Human
agggucugacugaauggaaaag

SEQ ID NO: 126503 - RNA, 22 nt, Human
agcagccaggaaucugcagagc

SEQ ID NO: 126504 - RNA, 22 nt, Human
uggcaugauaggaggugcagaa

SEQ ID NO: 126505 - RNA, 23 nt, Human
gcagaggagcaagcuggacacca

SEQ ID NO: 126506 - RNA, 22 nt, Human
gagggcaguagccucguacccu

SEQ ID NO: 126507 - RNA, 22 nt, Human
ugaggcagaaaauagcaguuca

SEQ ID NO: 126508 - RNA, 16 nt, Human
ggcaccagugaacaca

SEQ ID NO: 126509 - RNA, 22 nt, Human
ucagccucucugaguccagacc

SEQ ID NO: 126510 - RNA, 22 nt, Human
ugcagggcuaagucagagccug

SEQ ID NO: 126511 - RNA, 22 nt, Human
gaggcuggaggucaaagaugaa

SEQ ID NO: 126512 - RNA, 20 nt, Human
gaagccagaggggaaaggag

SEQ ID NO: 126513 - RNA, 20 nt, Human
acauccuggugacuagaacu

SEQ ID NO: 126514 - RNA, 17 nt, Human
acagggcagaaacagcu

SEQ ID NO: 126515 - RNA, 21 nt, Human
cccaggucguggucuucccag

SEQ ID NO: 126516 - RNA, 18 nt, Human
uggagcugagugcugugc

SEQ ID NO: 126517 - RNA, 22 nt, Human
uccuuugguucucuaagaugcu

SEQ ID NO: 126518 - RNA, 22 nt, Human
ucaguggauugacaugaaaaag

SEQ ID NO: 126519 - RNA, 22 nt, Human
ucagggcauacucuucaagguc

SEQ ID NO: 126520 - RNA, 22 nt, Human
ugcagggcagcuagggagcuuu

SEQ ID NO: 126521 - RNA, 22 nt, Human
gcuggcagguccaagauagagc

SEQ ID NO: 126522 - RNA, 22 nt, Human
agucucuuuugcgaagaguguu

SEQ ID NO: 126523 - RNA, 22 nt, Human
aacauaaauuugaaguggcaaa

SEQ ID NO: 126524 - RNA, 22 nt, Human
aagauuauggcagauaacaauu

SEQ ID NO: 126525 - RNA, 22 nt, Human
cugagcaggauauucacagcag

SEQ ID NO: 126526 - RNA, 22 nt, Human
ucaggcuggagugcaguggcgc

SEQ ID NO: 126527 - RNA, 22 nt, Human
ucagcuggauguggaagugcua

SEQ ID NO: 126528 - RNA, 22 nt, Human
acuguggcgucaggaagaaauu

SEQ ID NO: 126529 - RNA, 22 nt, Human
gcaggagcaaacugcagugugg

SEQ ID NO: 126530 - RNA, 22 nt, Human
ugggacuuguguggcaguauuu

SEQ ID NO: 126531 - RNA, 22 nt, Human
gugugcaggugucagugcagcu

SEQ ID NO: 126532 - RNA, 22 nt, Human
ugugggcacuaaugacaugcag

SEQ ID NO: 126533 - RNA, 22 nt, Human
gcaugagggggguuaggaaguu

SEQ ID NO: 126534 - RNA, 22 nt, Human
agaauucugacaauagaauugg

SEQ ID NO: 126535 - RNA, 22 nt, Human
gcagagugaagcaguauggaaa

SEQ ID NO: 126536 - RNA, 22 nt, Human
ugaggcagaaauuccuguuuuc

SEQ ID NO: 126537 - RNA, 22 nt, Human
ugcaggcaggggaugagcagcc

SEQ ID NO: 126538 - RNA, 22 nt, Human
gcuccucucccagagcugcagg

SEQ ID NO: 126539 - RNA, 22 nt, Human
uuguuaaaaauagauuuccagg

SEQ ID NO: 126540 - RNA, 22 nt, Human
ccagaggacuugggggcugaau

SEQ ID NO: 126541 - RNA, 22 nt, Human
agggccugggauguccuccuag

SEQ ID NO: 126542 - RNA, 22 nt, Human
cucccugggccucaguuucucu

SEQ ID NO: 126543 - RNA, 22 nt, Human
aguggcaguagaugagcugguu

SEQ ID NO: 126544 - RNA, 22 nt, Human
aagggcugagcacagugagcca

SEQ ID NO: 126545 - RNA, 22 nt, Human
auuauucaacacuugagaaauu

SEQ ID NO: 126546 - RNA, 22 nt, Human
ucagggcaaaagggaaaccauu

SEQ ID NO: 126547 - RNA, 22 nt, Human
acaggcagguaauuuacauauu

SEQ ID NO: 126548 - RNA, 23 nt, Human
cagggcugguagggaagagcgug

SEQ ID NO: 126549 - RNA, 22 nt, Human
uccuguguuacugccuggagcg

SEQ ID NO: 126550 - RNA, 22 nt, Human
ugcucugucaagaaaagaugcc

SEQ ID NO: 126551 - RNA, 20 nt, Human
uggcaggaauagggccagag

SEQ ID NO: 126552 - RNA, 22 nt, Human
uuagggcaggcaugagagaacu

SEQ ID NO: 126553 - RNA, 22 nt, Human
gccaggaguucagaugcauguu

SEQ ID NO: 126554 - RNA, 18 nt, Human
cacaggcaggugauaggu

SEQ ID NO: 126555 - RNA, 22 nt, Human
ggccagagucuauaugcagaca

SEQ ID NO: 126556 - RNA, 22 nt, Human
ccagcugucugguuccagagcc

SEQ ID NO: 126557 - RNA, 22 nt, Human
cgagaguuagcuaggagucaca

SEQ ID NO: 126558 - RNA, 22 nt, Human
gaaagcaguaaaugggucccau

SEQ ID NO: 126559 - RNA, 19 nt, Human
ucagggcaguccggucccc

SEQ ID NO: 126560 - RNA, 20 nt, Human
uccaguggccugaaucugga

SEQ ID NO: 126561 - RNA, 22 nt, Human
ggcugaggcucaugccaucuug

SEQ ID NO: 126562 - RNA, 22 nt, Human
uaggugugggcucaggaaugug

SEQ ID NO: 126563 - RNA, 22 nt, Human
aguggcaguggcugggcagagc

SEQ ID NO: 126564 - RNA, 22 nt, Human
gcagagcaccaaagugaaagau

SEQ ID NO: 126565 - RNA, 22 nt, Human
ugcugugguucccagaguggau

SEQ ID NO: 126566 - RNA, 22 nt, Human
gccaguggcccucuggagaagg

SEQ ID NO: 126567 - RNA, 22 nt, Human
guggcagagggugagcuggacu

SEQ ID NO: 126568 - RNA, 22 nt, Human
aggcugaguuucucauucucgc

SEQ ID NO: 126569 - RNA, 22 nt, Human
agaggaggcucugggaucgucc

SEQ ID NO: 126570 - RNA, 22 nt, Human
gugaggcagagaugccaaaacu

SEQ ID NO: 126571 - RNA, 22 nt, Human
gaaggcuguuucugguagugau

SEQ ID NO: 126572 - RNA, 22 nt, Human
uaaaggcuucugcagggacuga

SEQ ID NO: 126573 - RNA, 22 nt, Human
gggaggaaggcuugggugagua

SEQ ID NO: 126574 - RNA, 22 nt, Human
cuguugucccugggagcucagc

SEQ ID NO: 126575 - RNA, 22 nt, Human
uggagauggguuaauggagaga

SEQ ID NO: 126576 - RNA, 22 nt, Human
ccagagggcaaaaugaagcuua

SEQ ID NO: 126577 - RNA, 22 nt, Human
gagcagggagacaacucuggug

SEQ ID NO: 126578 - RNA, 23 nt, Human
ucuggcucuaugugacagcucuc

SEQ ID NO: 126579 - RNA, 22 nt, Human
uccugggguccugacugcuucc

SEQ ID NO: 126580 - RNA, 22 nt, Human
gcauggaauucccuuaugggcc

SEQ ID NO: 126581 - RNA, 22 nt, Human
agauguggccggcuagggagag

SEQ ID NO: 126582 - RNA, 22 nt, Human
uuuauccagaaucaggauuuuu

SEQ ID NO: 126583 - RNA, 22 nt, Human
uggucagacaaaggagaauguu

SEQ ID NO: 126584 - RNA, 22 nt, Human
agaguccauaugugggaggagu

SEQ ID NO: 126585 - RNA, 22 nt, Human
gaguccaguguuuaccaggggu

SEQ ID NO: 126586 - RNA, 22 nt, Human
ucucccaggcuggagugcagug

SEQ ID NO: 126587 - RNA, 22 nt, Human
ccaggguaccccaagggcaggu

SEQ ID NO: 126588 - RNA, 22 nt, Human
uccaggcugauccaugaagaau

SEQ ID NO: 126589 - RNA, 22 nt, Human
agcagggcuccauuucacugcc

SEQ ID NO: 126590 - RNA, 22 nt, Human
gagugcaguuggggugagggga

SEQ ID NO: 126591 - RNA, 19 nt, Human
agggccaggauucuggaac

SEQ ID NO: 126592 - RNA, 22 nt, Human
gaaugcagauggcugguguaug

SEQ ID NO: 126593 - RNA, 22 nt, Human
agggcugaguggugcagucaaa

SEQ ID NO: 126594 - RNA, 20 nt, Human
cagagcugggauuugaacac

SEQ ID NO: 126595 - RNA, 22 nt, Human
gcuccucuccucggagucgggg

SEQ ID NO: 126596 - RNA, 19 nt, Human
cagaggcaccagguauaga

SEQ ID NO: 126597 - RNA, 22 nt, Human
caggucagaggcgcagccccca

SEQ ID NO: 126598 - RNA, 22 nt, Human
aggcuggggaauugaauuugcu

SEQ ID NO: 126599 - RNA, 22 nt, Human
ucugccuguugcuagaauguca

SEQ ID NO: 126600 - RNA, 20 nt, Human
cccaggugucugaagcucug

SEQ ID NO: 126601 - RNA, 22 nt, Human
agucaggagcugcugcauugua

SEQ ID NO: 126602 - RNA, 22 nt, Human
cuaguggaaacuaacuggaauu

SEQ ID NO: 126603 - RNA, 22 nt, Human
aggcagaggagaaugaucuucc

SEQ ID NO: 126604 - RNA, 22 nt, Human
gaauacaagccugccaccugga

SEQ ID NO: 126605 - RNA, 22 nt, Human
gaguccaguuguucacagaggc

SEQ ID NO: 126606 - RNA, 22 nt, Human
ggaagggcaauaaaaucucagg

SEQ ID NO: 126607 - RNA, 22 nt, Human
gacacagggggauguguggacg

SEQ ID NO: 126608 - RNA, 22 nt, Human
agaagcagcuuucaaggugauu

SEQ ID NO: 126609 - RNA, 22 nt, Human
aaagcagcagcacguggaagag

SEQ ID NO: 126610 - RNA, 22 nt, Human
gccucccuguagaggccagccu

SEQ ID NO: 126611 - RNA, 22 nt, Human
cuccugguucagagagcugaga

SEQ ID NO: 126612 - RNA, 22 nt, Human
uagggcagcugcaucaggcacu

SEQ ID NO: 126613 - RNA, 22 nt, Human
auccucagaccucagcaaagcc

SEQ ID NO: 126614 - RNA, 22 nt, Human
uagggcagaguccaggaugggc

SEQ ID NO: 126615 - RNA, 22 nt, Human
ccaggugucuguggccagcccu

SEQ ID NO: 126616 - RNA, 22 nt, Human
cagaggcacagcuucuuuuaau

SEQ ID NO: 126617 - RNA, 18 nt, Human
cagaggagagacauucag

SEQ ID NO: 126618 - RNA, 20 nt, Human
agcaagaguaaggacagcga

SEQ ID NO: 126619 - RNA, 22 nt, Human
ugggcagcauccuccacaguca

SEQ ID NO: 126620 - RNA, 22 nt, Human
aagggcugccagggggugccag

SEQ ID NO: 126621 - RNA, 22 nt, Human
gaagucugacucuuuguaagcu

SEQ ID NO: 126622 - RNA, 22 nt, Human
gaggcucaaaccuggacagagc

SEQ ID NO: 126623 - RNA, 21 nt, Human
agaggcaggcauuaaguacac

SEQ ID NO: 126624 - RNA, 22 nt, Human
ccauguggugggaaggagaaug

SEQ ID NO: 126625 - RNA, 22 nt, Human
ugggcaggggcccugcuuccgu

SEQ ID NO: 126626 - RNA, 22 nt, Human
agcagagguguuuauuauggga

SEQ ID NO: 126627 - RNA, 22 nt, Human
aggugucuggauggguguccuu

SEQ ID NO: 126628 - RNA, 22 nt, Human
acaaaggcaggauugacuuagu

SEQ ID NO: 126629 - RNA, 22 nt, Human
uuucucaaguucagauauuuga

SEQ ID NO: 126630 - RNA, 22 nt, Human
ccagggcaucacauccaguguu

SEQ ID NO: 126631 - RNA, 16 nt, Human
gagaagagcccggcag

SEQ ID NO: 126632 - RNA, 23 nt, Human
agcaggaaaccgagggugauguu

SEQ ID NO: 126633 - RNA, 22 nt, Human
agaggagguccuuuucugaugu

SEQ ID NO: 126634 - RNA, 22 nt, Human
uaggugucugcucuuauuuaac

SEQ ID NO: 126635 - RNA, 22 nt, Human
agcagaggacaguucuuaggaa

SEQ ID NO: 126636 - RNA, 19 nt, Human
aaggcagaaguuggauaug

SEQ ID NO: 126637 - RNA, 22 nt, Human
uggcagagcccagacuccaguc

SEQ ID NO: 126638 - RNA, 21 nt, Human
auuuccaaggguaccuaagau

SEQ ID NO: 126639 - RNA, 22 nt, Human
caccaggugcuggaggacauca

SEQ ID NO: 126640 - RNA, 22 nt, Human
gcuuugcauuguuuaaucagga

SEQ ID NO: 126641 - RNA, 22 nt, Human
gcagaugguggggcaggaaaau

SEQ ID NO: 126642 - RNA, 22 nt, Human
agcccagguugaggcugcagug

SEQ ID NO: 126643 - RNA, 22 nt, Human
aagaggcagcccgcugaggcug

SEQ ID NO: 126644 - RNA, 22 nt, Human
gccaggcuccaggcccuccuga

SEQ ID NO: 126645 - RNA, 22 nt, Human
ugaggcaggaauggggaaaagu

SEQ ID NO: 126646 - RNA, 19 nt, Human
aggcagcaggccagggaug

SEQ ID NO: 126647 - RNA, 21 nt, Human
uggcucaguugcugggcacag

SEQ ID NO: 126648 - RNA, 19 nt, Human
ccagguggaacugagguag

SEQ ID NO: 126649 - RNA, 19 nt, Human
cagugcccgacgcaggucu

SEQ ID NO: 126650 - RNA, 22 nt, Human
gaagccagccuugucugccucu

SEQ ID NO: 126651 - RNA, 22 nt, Human
cagcugggagcuccauuagaua

SEQ ID NO: 126652 - RNA, 18 nt, Human
gguggcaggucagaugcc

SEQ ID NO: 126653 - RNA, 22 nt, Human
guggcgcagaggguggcagaga

SEQ ID NO: 126654 - RNA, 23 nt, Human
uucaaagcuuaagcucuuuccac

SEQ ID NO: 126655 - RNA, 22 nt, Human
uggcugagccacuuguucagau

SEQ ID NO: 126656 - RNA, 22 nt, Human
gugcaugaagacucagaaaguc

SEQ ID NO: 126657 - RNA, 22 nt, Human
gcaccugggcaaggauucagag

SEQ ID NO: 126658 - RNA, 22 nt, Human
aaagccaguucuuagagaaagc

SEQ ID NO: 126659 - RNA, 22 nt, Human
gggaauuauagcugucacaggc

SEQ ID NO: 126660 - RNA, 22 nt, Human
aggcugugcaauuaggguaaga

SEQ ID NO: 126661 - RNA, 22 nt, Human
gagggccaauggauuucaacug

SEQ ID NO: 126662 - RNA, 22 nt, Human
ugaggcaguauucuccauucca

SEQ ID NO: 126663 - RNA, 22 nt, Human
acccaggaugauaauguucaca

SEQ ID NO: 126664 - RNA, 22 nt, Human
agggcagcugugagccacugug

SEQ ID NO: 126665 - RNA, 22 nt, Human
gagcagcugagcuggaaugaga

SEQ ID NO: 126666 - RNA, 22 nt, Human
uagggcugcugcagaugacagg

SEQ ID NO: 126667 - RNA, 22 nt, Human
gccagguggcugagcagcugca

SEQ ID NO: 126668 - RNA, 22 nt, Human
gugagcaggauaggggcucccu

SEQ ID NO: 126669 - RNA, 22 nt, Human
aagggagacaguugugugagga

SEQ ID NO: 126670 - RNA, 22 nt, Human
gaaggcaacaccaggaugcacu

SEQ ID NO: 126671 - RNA, 22 nt, Human
aggcaggugcuuaugacuugcu

SEQ ID NO: 126672 - RNA, 20 nt, Human
ugcagggcucugcuucucuc

SEQ ID NO: 126673 - RNA, 22 nt, Human
gggauuugugggauggccagug

SEQ ID NO: 126674 - RNA, 22 nt, Human
aucagaagcuuguagucucucu

SEQ ID NO: 126675 - RNA, 22 nt, Human
cgcauacauagaaacacacaga

SEQ ID NO: 126676 - RNA, 22 nt, Human
uggcugagaaaaaagagcuaua

SEQ ID NO: 126677 - RNA, 22 nt, Human
ucccaggaucugagggcagaga

SEQ ID NO: 126678 - RNA, 22 nt, Human
cugcugugcaacauugcaccua

SEQ ID NO: 126679 - RNA, 22 nt, Human
caggguuucaccauguuagcag

SEQ ID NO: 126680 - RNA, 22 nt, Human
aggcagcagucaugaggaaaga

SEQ ID NO: 126681 - RNA, 22 nt, Human
gagugggcaccgugggcacacu

SEQ ID NO: 126682 - RNA, 22 nt, Human
gcagaggauagcauaugaaccu

SEQ ID NO: 126683 - RNA, 22 nt, Human
augaggcucucaggggagcugu

SEQ ID NO: 126684 - RNA, 22 nt, Human
cagaggaaaguauuucuggaag

SEQ ID NO: 126685 - RNA, 22 nt, Human
uggcagaggaaaaagucacugg

SEQ ID NO: 126686 - RNA, 20 nt, Human
ggggcagguuuuuauggcua

SEQ ID NO: 126687 - RNA, 22 nt, Human
uguuucauguggacauaguugu

SEQ ID NO: 126688 - RNA, 22 nt, Human
ugggcugaguggcagccagagu

SEQ ID NO: 126689 - RNA, 22 nt, Human
guggggaaaggaguggggcuca

SEQ ID NO: 126690 - RNA, 22 nt, Human
cccucccaagcacucugacaua

SEQ ID NO: 126691 - RNA, 22 nt, Human
cagggcaggaauuugacauugc

SEQ ID NO: 126692 - RNA, 22 nt, Human
gccucccuggcccacagcagcg

SEQ ID NO: 126693 - RNA, 22 nt, Human
ucagggcauccauugccuguug

SEQ ID NO: 126694 - RNA, 22 nt, Human
aguuccagcugugaccagaaaa

SEQ ID NO: 126695 - RNA, 22 nt, Human
caggcagagcaacugguccaga

SEQ ID NO: 126696 - RNA, 22 nt, Human
ugcgcaggagcucugccaggag

SEQ ID NO: 126697 - RNA, 22 nt, Human
agccaggccagacucacacccu

SEQ ID NO: 126698 - RNA, 22 nt, Human
agauguaaacucucaugucauu

SEQ ID NO: 126699 - RNA, 22 nt, Human
guuauuuucauuggcucagacu

SEQ ID NO: 126700 - RNA, 22 nt, Human
gcccagugguaaaagcaggccu

SEQ ID NO: 126701 - RNA, 22 nt, Human
ccagcugucacucagaaaggcc

SEQ ID NO: 126702 - RNA, 22 nt, Human
gaaggcugucagagaggagggc

SEQ ID NO: 126703 - RNA, 22 nt, Human
accaggaggccuggagcacaaa

SEQ ID NO: 126704 - RNA, 22 nt, Human
agaguccaugaagacagcugag

SEQ ID NO: 126705 - RNA, 22 nt, Human
gacccuguuucuacaaauaauu

SEQ ID NO: 126706 - RNA, 22 nt, Human
aggcagcaugggccccagcucc

SEQ ID NO: 126707 - RNA, 22 nt, Human
ugcagggccuugggaugugucc

SEQ ID NO: 126708 - RNA, 22 nt, Human
aucaggaaugaauacuuuugga

SEQ ID NO: 126709 - RNA, 21 nt, Human
uuucccagcugaaaauaaaug

SEQ ID NO: 126710 - RNA, 22 nt, Human
uccagcuugccuggucuuuugg

SEQ ID NO: 126711 - RNA, 22 nt, Human
ggaagccaugagggacaguucu

SEQ ID NO: 126712 - RNA, 22 nt, Human
ccagcucugcagggccuggggu

SEQ ID NO: 126713 - RNA, 22 nt, Human
ugggcaggagagaagcuaaaga

SEQ ID NO: 126714 - RNA, 22 nt, Human
aagggcaggcagagaucauaua

SEQ ID NO: 126715 - RNA, 21 nt, Human
aggcucagcagguguauaaag

SEQ ID NO: 126716 - RNA, 22 nt, Human
agcugugguucugggcagcgac

SEQ ID NO: 126717 - RNA, 22 nt, Human
ucagaggaauuugcuuuucaug

SEQ ID NO: 126718 - RNA, 22 nt, Human
uagagcuggaauuugcagcaag

SEQ ID NO: 126719 - RNA, 22 nt, Human
ugcagggcagauaugacuguag

SEQ ID NO: 126720 - RNA, 22 nt, Human
gccugccacgcaugcagaguca

SEQ ID NO: 126721 - RNA, 22 nt, Human
aggcaguuuauccccagagccu

SEQ ID NO: 126722 - RNA, 22 nt, Human
acaacacagcaaaaccccaucu

SEQ ID NO: 126723 - RNA, 22 nt, Human
auuuucaucauggguuuaacau

SEQ ID NO: 126724 - RNA, 22 nt, Human
cacaggagauugaucuauuggu

SEQ ID NO: 126725 - RNA, 22 nt, Human
ucaccaggauuccuaucaguag

SEQ ID NO: 126726 - RNA, 22 nt, Human
agggcuguuuuuggcaccuggg

SEQ ID NO: 126727 - RNA, 22 nt, Human
cucugugagggucuguacagaa

SEQ ID NO: 126728 - RNA, 22 nt, Human
aagucuggaagucucaguuuuc

SEQ ID NO: 126729 - RNA, 22 nt, Human
acauaugcucaucugcauuccc

SEQ ID NO: 126730 - RNA, 22 nt, Human
ugaggaagccaaacagcuacac

SEQ ID NO: 126731 - RNA, 22 nt, Human
ggcagcaacucggagagaagag

SEQ ID NO: 126732 - RNA, 22 nt, Human
ugcaguggaaucuggagagcag

SEQ ID NO: 126733 - RNA, 22 nt, Human
gaaagccauagcccagcuuuac

SEQ ID NO: 126734 - RNA, 22 nt, Human
aggugcagaaaaaaguccuuua

SEQ ID NO: 126735 - RNA, 22 nt, Human
ugccaggccaaugaaggcaggg

SEQ ID NO: 126736 - RNA, 22 nt, Human
uccaggcuggccucgcgugaca

SEQ ID NO: 126737 - RNA, 22 nt, Human
cagggcagcuuccuuuguuagg

SEQ ID NO: 126738 - RNA, 22 nt, Human
gaagggagaagguugggugacg

SEQ ID NO: 126739 - RNA, 22 nt, Human
uccuggcccgaucccugugaag

SEQ ID NO: 126740 - RNA, 22 nt, Human
uacacacagaggccaugggauu

SEQ ID NO: 126741 - RNA, 21 nt, Human
ccaccaggucuucugcucggg

SEQ ID NO: 126742 - RNA, 22 nt, Human
cauucugcauuuggaaggggca

SEQ ID NO: 126743 - RNA, 22 nt, Human
ucacauuuuaucuauuuuaagu

SEQ ID NO: 126744 - RNA, 22 nt, Human
caggaaagggaugggcugccac

SEQ ID NO: 126745 - RNA, 22 nt, Human
agggcagcuagcuguagaaaga

SEQ ID NO: 126746 - RNA, 22 nt, Human
aaaugcaugagaaaguauucug

SEQ ID NO: 126747 - RNA, 18 nt, Human
ugcccagaaaagcaggga

SEQ ID NO: 126748 - RNA, 20 nt, Human
cugcugugugugccucagcc

SEQ ID NO: 126749 - RNA, 20 nt, Human
uccuuuggccuuagagcugu

SEQ ID NO: 126750 - RNA, 22 nt, Human
uccaugggaagauuuugagugg

SEQ ID NO: 126751 - RNA, 22 nt, Human
gaguccaguuagugaggcuggg

SEQ ID NO: 126752 - RNA, 22 nt, Human
ugcuggagaggaaggugggguc

SEQ ID NO: 126753 - RNA, 21 nt, Human
gcagaugggagucaucaggcu

SEQ ID NO: 126754 - RNA, 22 nt, Human
cuauuauuagauaaucuacuug

SEQ ID NO: 126755 - RNA, 22 nt, Human
gaggcucagagugguuaaauaa

SEQ ID NO: 126756 - RNA, 22 nt, Human
gaagggugcauggagggaaguc

SEQ ID NO: 126757 - RNA, 22 nt, Human
augaggcauucacagaaggcac

SEQ ID NO: 126758 - RNA, 22 nt, Human
agcagggccugagugaccuaac

SEQ ID NO: 126759 - RNA, 22 nt, Human
cuuagaugaagucacagaaccc

SEQ ID NO: 126760 - RNA, 22 nt, Human
uagggcugugucuccaggacca

SEQ ID NO: 126761 - RNA, 22 nt, Human
agccugugugcuuuggacaggg

SEQ ID NO: 126762 - RNA, 22 nt, Human
gcagaggagcaagcuggacacc

SEQ ID NO: 126763 - RNA, 19 nt, Human
uaguggagugacaaguucu

SEQ ID NO: 126764 - RNA, 22 nt, Human
gcaggagcagucaggggcagcu

SEQ ID NO: 126765 - RNA, 22 nt, Human
agucaccaacaugguucccagg

SEQ ID NO: 126766 - RNA, 22 nt, Human
gggcaguuuauucuagaugguu

SEQ ID NO: 126767 - RNA, 22 nt, Human
guggcaggagagacacagccau

SEQ ID NO: 126768 - RNA, 22 nt, Human
cucgcaggacagugcuaggacu

SEQ ID NO: 126769 - RNA, 22 nt, Human
cagaaggcuuuguggaguagac

SEQ ID NO: 126770 - RNA, 22 nt, Human
ucugcucuaguugcuuccugcc

SEQ ID NO: 126771 - RNA, 22 nt, Human
ggccagagagcagccaggauuc

SEQ ID NO: 126772 - RNA, 19 nt, Human
agagaaggauccuaugguu

SEQ ID NO: 126773 - RNA, 22 nt, Human
gcaguggauggccagcaggggc

SEQ ID NO: 126774 - RNA, 22 nt, Human
gaauuagguaauagaacuagua

SEQ ID NO: 126775 - RNA, 22 nt, Human
cagggcugagaauuuagagaca

SEQ ID NO: 126776 - RNA, 20 nt, Human
ggcagggcaucaacagcucu

SEQ ID NO: 126777 - RNA, 22 nt, Human
caagggcagcagccucaagcgg

SEQ ID NO: 126778 - RNA, 22 nt, Human
auggcagagaaagcgagccaca

SEQ ID NO: 126779 - RNA, 22 nt, Human
agcugaagaaaugggaagcauu

SEQ ID NO: 126780 - RNA, 22 nt, Human
cugaggcucccucgggucugcu

SEQ ID NO: 126781 - RNA, 19 nt, Human
uggcagaggacaaggacuu

SEQ ID NO: 126782 - RNA, 22 nt, Human
ugagccagucugucugggugaa

SEQ ID NO: 126783 - RNA, 22 nt, Human
ucccuccuggugagcaggggcu

SEQ ID NO: 126784 - RNA, 22 nt, Human
ugugaagguaaggaggggcaag

SEQ ID NO: 126785 - RNA, 22 nt, Human
agaggccggccgagcccauggg

SEQ ID NO: 126786 - RNA, 22 nt, Human
caguggcagagaacagagaccu

SEQ ID NO: 126787 - RNA, 22 nt, Human
aaagcaaucagauucagauguc

SEQ ID NO: 126788 - RNA, 22 nt, Human
agagugguacuucuuuuucuuc

SEQ ID NO: 126789 - RNA, 22 nt, Human
agagccaggaaguggcgugggg

SEQ ID NO: 126790 - RNA, 22 nt, Human
ugggccaggcaugugaucagca

SEQ ID NO: 126791 - RNA, 22 nt, Human
gcagugaagccagaucugaaau

SEQ ID NO: 126792 - RNA, 22 nt, Human
gggggaagacugggcuagugau

SEQ ID NO: 126793 - RNA, 22 nt, Human
agugggguccucaguaugguuc

SEQ ID NO: 126794 - RNA, 22 nt, Human
gcuggcagccaagugaagaggg

SEQ ID NO: 126795 - RNA, 22 nt, Human
gagccuggacaucucaggccca

SEQ ID NO: 126796 - RNA, 22 nt, Human
gcugagacuggcagcaggaagu

SEQ ID NO: 126797 - RNA, 22 nt, Human
gcagaagcugggcagcgaggug

SEQ ID NO: 126798 - RNA, 22 nt, Human
cgaggcagaggcugaaacggcu

SEQ ID NO: 126799 - RNA, 22 nt, Human
cccuuccuugugacuggugggg

SEQ ID NO: 126800 - RNA, 22 nt, Human
ucucccagugucuggcagucag

SEQ ID NO: 126801 - RNA, 22 nt, Human
aggaaagcucccaguagggcuc

SEQ ID NO: 126802 - RNA, 22 nt, Human
aagccacuauggugauucucaa

SEQ ID NO: 126803 - RNA, 22 nt, Human
ccaguggacaauuucugaggaa

SEQ ID NO: 126804 - RNA, 22 nt, Human
cagggcagccaggccccguggg

SEQ ID NO: 126805 - RNA, 22 nt, Human
cagggcugucuccaaaggcccc

SEQ ID NO: 126806 - RNA, 22 nt, Human
gaagccagcaguggagaaagga

SEQ ID NO: 126807 - RNA, 22 nt, Human
gaugcaggauagcuucacccag

SEQ ID NO: 126808 - RNA, 22 nt, Human
ggugaccucaccuggucccacc

SEQ ID NO: 126809 - RNA, 22 nt, Human
ggcugagacuagagugaggcau

SEQ ID NO: 126810 - RNA, 22 nt, Human
agcaggugggcaugaaagcuga

SEQ ID NO: 126811 - RNA, 22 nt, Human
acaucuguuugagaaaaagaag

SEQ ID NO: 126812 - RNA, 22 nt, Human
aagggcuggcccugggaagagu

SEQ ID NO: 126813 - RNA, 23 nt, Human
agucagagagugugagacaacug

SEQ ID NO: 126814 - RNA, 22 nt, Human
ccagggcauccucacaucgcag

SEQ ID NO: 126815 - RNA, 21 nt, Human
gggcgaggccugauguggcuc

SEQ ID NO: 126816 - RNA, 22 nt, Human
ugaaaaaacaaguuggcccauu

SEQ ID NO: 126817 - RNA, 22 nt, Human
gcaggcuggucugaccaucccu

SEQ ID NO: 126818 - RNA, 22 nt, Human
augaggcacaucacagccaaug

SEQ ID NO: 126819 - RNA, 22 nt, Human
agcaugaagacuucagagcuag

SEQ ID NO: 126820 - RNA, 22 nt, Human
aggcugagucaaguuaggguga

SEQ ID NO: 126821 - RNA, 22 nt, Human
cugauuccaaagccaaagcuau

SEQ ID NO: 126822 - RNA, 22 nt, Human
gggcaguagcuucguaggcauc

SEQ ID NO: 126823 - RNA, 22 nt, Human
aggcugaggagggauguugcuu

SEQ ID NO: 126824 - RNA, 22 nt, Human
uggcugcagaucaagggcaggc

SEQ ID NO: 126825 - RNA, 22 nt, Human
uggagcaggacggggaguggua

SEQ ID NO: 126826 - RNA, 22 nt, Human
cccacacauuuuucacuuaccg

SEQ ID NO: 126827 - RNA, 22 nt, Human
aggaaaaagaguugcugccuuc

SEQ ID NO: 126828 - RNA, 22 nt, Human
ugaggcaggacuugcauaaagu

SEQ ID NO: 126829 - RNA, 22 nt, Human
aaggaaaggaugagcaugcauu

SEQ ID NO: 126830 - RNA, 22 nt, Human
caggaagcugagcugcacugca

SEQ ID NO: 126831 - RNA, 22 nt, Human
ucacauuuguucuugaaucuaa

SEQ ID NO: 126832 - RNA, 22 nt, Human
ucagggcaccaaaaaagaugcc

SEQ ID NO: 126833 - RNA, 19 nt, Human
agcuguggaugugggauuu

SEQ ID NO: 126834 - RNA, 22 nt, Human
gccacucaugggaggugugcaa

SEQ ID NO: 126835 - RNA, 22 nt, Human
agucagcagccuggccaggaga

SEQ ID NO: 126836 - RNA, 20 nt, Human
agccaggccucaaguuaagu

SEQ ID NO: 126837 - RNA, 22 nt, Human
ugaagccaucaggaagccagca

SEQ ID NO: 126838 - RNA, 22 nt, Human
ugggcagccaucccagccucuc

SEQ ID NO: 126839 - RNA, 22 nt, Human
gggcaggucugggucagccuga

SEQ ID NO: 126840 - RNA, 22 nt, Human
caagggcagaggcagggccccg

SEQ ID NO: 126841 - RNA, 18 nt, Human
ccagguggugacagagau

SEQ ID NO: 126842 - RNA, 22 nt, Human
gcugaaggucucuggagagguc

SEQ ID NO: 126843 - RNA, 22 nt, Human
aagggcugaaugaaggguugaa

SEQ ID NO: 126844 - RNA, 20 nt, Human
ucccaagggcugagaggauc

SEQ ID NO: 126845 - RNA, 22 nt, Human
gaggagaaagcagugauuugug

SEQ ID NO: 126846 - RNA, 22 nt, Human
cagagcugacccaaggauugaa

SEQ ID NO: 126847 - RNA, 22 nt, Human
ggagauaguccaggugaaggga

SEQ ID NO: 126848 - RNA, 22 nt, Human
uggagcugguaaacagugacau

SEQ ID NO: 126849 - RNA, 22 nt, Human
aggcagagcugauguucuguga

SEQ ID NO: 126850 - RNA, 22 nt, Human
gggcgccgugggaaacagccgg

SEQ ID NO: 126851 - RNA, 17 nt, Human
agauggcaggaggcaga

SEQ ID NO: 126852 - RNA, 22 nt, Human
ggagccugagcggcccagggcc

SEQ ID NO: 126853 - RNA, 22 nt, Human
cacauggaagagauacagugag

SEQ ID NO: 126854 - RNA, 22 nt, Human
accagagcuggcucugagcacc

SEQ ID NO: 126855 - RNA, 22 nt, Human
ugcaguggaggccgugagacag

SEQ ID NO: 126856 - RNA, 22 nt, Human
caguggaaaucagagugagagu

SEQ ID NO: 126857 - RNA, 22 nt, Human
caagggcauugcuugggaccuu

SEQ ID NO: 126858 - RNA, 22 nt, Human
ucccaggguuacagccagggca

SEQ ID NO: 126859 - RNA, 21 nt, Human
ucacacacguuuccaagggca

SEQ ID NO: 126860 - RNA, 22 nt, Human
agagggcuggacgcagguugga

SEQ ID NO: 126861 - RNA, 22 nt, Human
ugacauuucgguguaugugaug

SEQ ID NO: 126862 - RNA, 22 nt, Human
aaggggaaaaaguguuaggagu

SEQ ID NO: 126863 - RNA, 22 nt, Human
aacucuauuuacccuacuaaac

SEQ ID NO: 126864 - RNA, 22 nt, Human
auaguuguguggggauucuggu

SEQ ID NO: 126865 - RNA, 22 nt, Human
caugucuuauauccugucuuca

SEQ ID NO: 126866 - RNA, 22 nt, Human
gaguucaguguuucuaguagug

SEQ ID NO: 126867 - RNA, 22 nt, Human
gaagaggaugacaggagccggu

SEQ ID NO: 126868 - RNA, 22 nt, Human
gccaccuggacagcugugcccu

SEQ ID NO: 126869 - RNA, 22 nt, Human
gggagggacacaaagaguuccc

SEQ ID NO: 126870 - RNA, 22 nt, Human
cagagcugcuucccaguuugug

SEQ ID NO: 126871 - RNA, 22 nt, Human
acaguggaaaugugggagggga

SEQ ID NO: 126872 - RNA, 22 nt, Human
aggcagcaagauuauuuaaucc

SEQ ID NO: 126873 - RNA, 22 nt, Human
uggcugagaccuucccaaauuc

SEQ ID NO: 126874 - RNA, 22 nt, Human
ccucccagugccuccagagcag

SEQ ID NO: 126875 - RNA, 22 nt, Human
agguaaggcuguaagcuaagcc

SEQ ID NO: 126876 - RNA, 22 nt, Human
aagagcuggagcugcuacagga

SEQ ID NO: 126877 - RNA, 19 nt, Human
acauggcaucccaggaggu

SEQ ID NO: 126878 - RNA, 22 nt, Human
aauuuuauuagaaggcaagggg

SEQ ID NO: 126879 - RNA, 22 nt, Human
gagggcaggggucuugcacggu

SEQ ID NO: 126880 - RNA, 22 nt, Human
caggaggcaguuucagaaguca

SEQ ID NO: 126881 - RNA, 20 nt, Human
gagggcaggcacccauuuca

SEQ ID NO: 126882 - RNA, 22 nt, Human
cauuuuauccucugggaagcua

SEQ ID NO: 126883 - RNA, 20 nt, Human
cauuaugguugggcacagug

SEQ ID NO: 126884 - RNA, 22 nt, Human
ggaagaggcucucauugagggc

SEQ ID NO: 126885 - RNA, 22 nt, Human
agucagcagugaaagcacagcc

SEQ ID NO: 126886 - RNA, 20 nt, Human
uuacucaguuccugccaugc

SEQ ID NO: 126887 - RNA, 22 nt, Human
ugccaggcccagcagggcggcc

SEQ ID NO: 126888 - RNA, 22 nt, Human
ucugggagggagccucagaauc

SEQ ID NO: 126889 - RNA, 21 nt, Human
gggcagaggggccuccugggu

SEQ ID NO: 126890 - RNA, 22 nt, Human
acagccuggccugaguuaaggc

SEQ ID NO: 126891 - RNA, 22 nt, Human
aaguccagguccucauuccauc

SEQ ID NO: 126892 - RNA, 22 nt, Human
ugugaaggagaugaagggagug

SEQ ID NO: 126893 - RNA, 22 nt, Human
ucacaagacagaaaacauuuag

SEQ ID NO: 126894 - RNA, 22 nt, Human
agggccagagucuguguagaua

SEQ ID NO: 126895 - RNA, 22 nt, Human
acaguggagaaggcaugaggcu

SEQ ID NO: 126896 - RNA, 22 nt, Human
caggcugcagcagcaguggccc

SEQ ID NO: 126897 - RNA, 22 nt, Human
ugcagggcaguggagguugagu

SEQ ID NO: 126898 - RNA, 22 nt, Human
agggcuagaguugagaugggga

SEQ ID NO: 126899 - RNA, 22 nt, Human
augcuguguuugagaaccuagg

SEQ ID NO: 126900 - RNA, 22 nt, Human
agcagccacagucugggacagg

SEQ ID NO: 126901 - RNA, 22 nt, Human
uggcucaguuugggggauugaa

SEQ ID NO: 126902 - RNA, 22 nt, Human
gccaccuguuucgcuugcccag

SEQ ID NO: 126903 - RNA, 19 nt, Human
agacagagcucaguggguu

SEQ ID NO: 126904 - RNA, 22 nt, Human
aagggcuggaucucucugagca

SEQ ID NO: 126905 - RNA, 22 nt, Human
gagaggaguagacacuuugguu

SEQ ID NO: 126906 - RNA, 22 nt, Human
cacaugcaucugucauguuugg

SEQ ID NO: 126907 - RNA, 22 nt, Human
ucucccagaggaucccagugga

SEQ ID NO: 126908 - RNA, 22 nt, Human
gagagcugcagccgagaggggg

SEQ ID NO: 126909 - RNA, 22 nt, Human
gagagugagauccuccugggga

SEQ ID NO: 126910 - RNA, 22 nt, Human
gagcagugacuggagcaugaga

SEQ ID NO: 126911 - RNA, 22 nt, Human
aacaggcaacaguugacucuga

SEQ ID NO: 126912 - RNA, 22 nt, Human
cagcugcuguucaguuuuguuu

SEQ ID NO: 126913 - RNA, 22 nt, Human
gggaagggagggccuccaguca

SEQ ID NO: 126914 - RNA, 22 nt, Human
ggcagggcuugucucugugaug

SEQ ID NO: 126915 - RNA, 23 nt, Human
agagccugaaagacuucuggcac

SEQ ID NO: 126916 - RNA, 22 nt, Human
ucucugagcugcuucuugcaua

SEQ ID NO: 126917 - RNA, 22 nt, Human
caggagcagaggguggucagca

SEQ ID NO: 126918 - RNA, 22 nt, Human
aggcucaguucacgucaacuuu

SEQ ID NO: 126919 - RNA, 22 nt, Human
aggcugaggaucccuguguucu

SEQ ID NO: 126920 - RNA, 22 nt, Human
cugcugugcagacagacucucu

SEQ ID NO: 126921 - RNA, 22 nt, Human
aguggcagaagccaagucugca

SEQ ID NO: 126922 - RNA, 22 nt, Human
uagccgggugugguggaacucc

SEQ ID NO: 126923 - RNA, 22 nt, Human
uuugauuuacuggauauucuca

SEQ ID NO: 126924 - RNA, 22 nt, Human
uccaggcuggaaaugucaaacu

SEQ ID NO: 126925 - RNA, 22 nt, Human
gaguccaguaguuaggacagag

SEQ ID NO: 126926 - RNA, 22 nt, Human
agagaagggccuguauguaauc

SEQ ID NO: 126927 - RNA, 22 nt, Human
cuacccaggcuggagugcagua

SEQ ID NO: 126928 - RNA, 22 nt, Human
aguggcagagcaggugcuggaa

SEQ ID NO: 126929 - RNA, 22 nt, Human
gguccccguggaggcuggagcg

SEQ ID NO: 126930 - RNA, 22 nt, Human
gagggcugcugccagauaugcc

SEQ ID NO: 126931 - RNA, 22 nt, Human
guaauuaggaauaaaaugggaa

SEQ ID NO: 126932 - RNA, 22 nt, Human
uguugauuaguguuuagacuua

SEQ ID NO: 126933 - RNA, 19 nt, Human
agggccugcagcucaagcu

SEQ ID NO: 126934 - RNA, 18 nt, Human
uucaccagugugaugggu

SEQ ID NO: 126935 - RNA, 22 nt, Human
agaaauacuaggaauauucaua

SEQ ID NO: 126936 - RNA, 22 nt, Human
cagguggaucucuaaggacuga

SEQ ID NO: 126937 - RNA, 22 nt, Human
ggccaggagcaagccaggcucu

SEQ ID NO: 126938 - RNA, 22 nt, Human
aggagucacucagggcuucauc

SEQ ID NO: 126939 - RNA, 22 nt, Human
aggcugagcggggucccagagc

SEQ ID NO: 126940 - RNA, 22 nt, Human
agcagggcuuuggcuggcuuuc

SEQ ID NO: 126941 - RNA, 22 nt, Human
gccuggaguacuccuugaagug

SEQ ID NO: 126942 - RNA, 22 nt, Human
agcagggcuggauuuggcaaga

SEQ ID NO: 126943 - RNA, 23 nt, Human
agcauggaauaggaaagaggcag

SEQ ID NO: 126944 - RNA, 22 nt, Human
gucccaggaguugcugggccuu

SEQ ID NO: 126945 - RNA, 22 nt, Human
cauggcagugauucagccuuug

SEQ ID NO: 126946 - RNA, 22 nt, Human
guaggaaagggagugaagggaa

SEQ ID NO: 126947 - RNA, 21 nt, Human
aggaggaacccguggcugggc

SEQ ID NO: 126948 - RNA, 22 nt, Human
ucuggagcuggagggcaaggca

SEQ ID NO: 126949 - RNA, 22 nt, Human
ucucccaguccucugugcuuac

SEQ ID NO: 126950 - RNA, 17 nt, Human
uguuuucauucauugcu

SEQ ID NO: 126951 - RNA, 22 nt, Human
acacauaugguugcugcaguga

SEQ ID NO: 126952 - RNA, 20 nt, Human
agggucagagagcgugagug

SEQ ID NO: 126953 - RNA, 22 nt, Human
gagaaagauggaaucuuacagg

SEQ ID NO: 126954 - RNA, 22 nt, Human
ggccaggcgaugaccccuccac

SEQ ID NO: 126955 - RNA, 23 nt, Human
gccauggcugccccacaggccuc

SEQ ID NO: 126956 - RNA, 22 nt, Human
aggcuucagaaagaguaauugg

SEQ ID NO: 126957 - RNA, 22 nt, Human
ucagggcacugucaccugauau

SEQ ID NO: 126958 - RNA, 22 nt, Human
aggcagaggaaggguggauuug

SEQ ID NO: 126959 - RNA, 16 nt, Human
uggcugagagaggguu

SEQ ID NO: 126960 - RNA, 22 nt, Human
uacuguuuuuuagacucauggu

SEQ ID NO: 126961 - RNA, 20 nt, Human
agagugagacuccaucucag

SEQ ID NO: 126962 - RNA, 22 nt, Human
ugaggcagugcugggaagccug

SEQ ID NO: 126963 - RNA, 22 nt, Human
agagugaaaagcuagagcagua

SEQ ID NO: 126964 - RNA, 22 nt, Human
cucccaggguagggagagacua

SEQ ID NO: 126965 - RNA, 22 nt, Human
uggcagagcccagaacugagca

SEQ ID NO: 126966 - RNA, 22 nt, Human
gcaggaguguauuugcauguaa

SEQ ID NO: 126967 - RNA, 19 nt, Human
ucaaaggcaaggaggaacu

SEQ ID NO: 126968 - RNA, 22 nt, Human
ucagggcacguuucugcaaugc

SEQ ID NO: 126969 - RNA, 18 nt, Human
acaaaggucugcaagacc

SEQ ID NO: 126970 - RNA, 19 nt, Human
ugggcagcucccucugucc

SEQ ID NO: 126971 - RNA, 22 nt, Human
cagaggcaggauaagaacugcg

SEQ ID NO: 126972 - RNA, 22 nt, Human
acaugggaucaaugaggcaggc

SEQ ID NO: 126973 - RNA, 22 nt, Human
aggcugaggcuggcagcuccag

SEQ ID NO: 126974 - RNA, 21 nt, Human
ugcaggaaagugcugcgaccc

SEQ ID NO: 126975 - RNA, 22 nt, Human
ugccaggcgauugcuaucagca

SEQ ID NO: 126976 - RNA, 22 nt, Human
uucuugcucaaugucuguuuaa

SEQ ID NO: 126977 - RNA, 22 nt, Human
ucaggcagcauuaaacuucagc

SEQ ID NO: 126978 - RNA, 22 nt, Human
caggagcaguuagaagcccacu

SEQ ID NO: 126979 - RNA, 22 nt, Human
cagagcugucauuugccaguga

SEQ ID NO: 126980 - RNA, 22 nt, Human
cauucacagagggggaagcauc

SEQ ID NO: 126981 - RNA, 22 nt, Human
cuggacagaaaccaguccuggg

SEQ ID NO: 126982 - RNA, 22 nt, Human
caggguugcaugcaucuguggg

SEQ ID NO: 126983 - RNA, 22 nt, Human
cagggccaggcugauggccugg

SEQ ID NO: 126984 - RNA, 22 nt, Human
ucccagauucuucugugugggc

SEQ ID NO: 126985 - RNA, 22 nt, Human
ccugagugcuuccagagucaug

SEQ ID NO: 126986 - RNA, 22 nt, Human
uggcagaguuauggguauuuau

SEQ ID NO: 126987 - RNA, 22 nt, Human
ggcagcacgacaggaguggaag

SEQ ID NO: 126988 - RNA, 23 nt, Human
uuucacaaugagcauuacagaau

SEQ ID NO: 126989 - RNA, 22 nt, Human
auuccaaagcacaucagaacua

SEQ ID NO: 126990 - RNA, 22 nt, Human
ugaggcagcaauugauuauuca

SEQ ID NO: 126991 - RNA, 22 nt, Human
cagagcugguguuacaagucca

SEQ ID NO: 126992 - RNA, 22 nt, Human
ugggcagggucucuguuaucag

SEQ ID NO: 126993 - RNA, 21 nt, Human
gaaggagaaagcaagugcugc

SEQ ID NO: 126994 - RNA, 22 nt, Human
ucucugagcgcauuccuccggc

SEQ ID NO: 126995 - RNA, 22 nt, Human
gaggcagagucacaaagagucu

SEQ ID NO: 126996 - RNA, 22 nt, Human
agggcugacaguggcguggcgu

SEQ ID NO: 126997 - RNA, 22 nt, Human
gggggcaguaaggauauggaaa

SEQ ID NO: 126998 - RNA, 22 nt, Human
ugggccacgugacccuuacccu

SEQ ID NO: 126999 - RNA, 22 nt, Human
gaggcugggaaguccaagauca

SEQ ID NO: 127000 - RNA, 22 nt, Human
ccagggcaugggaagaacugaa

SEQ ID NO: 127001 - RNA, 22 nt, Human
agggcccucuggcaggccaggc

SEQ ID NO: 127002 - RNA, 22 nt, Human
ucaggcaggacaauuauuuagg

SEQ ID NO: 127003 - RNA, 20 nt, Human
ucucccaggcucagggaaga

SEQ ID NO: 127004 - RNA, 22 nt, Human
uccuguggaagacaguguuggg

SEQ ID NO: 127005 - RNA, 22 nt, Human
ggccagagaagucagacccuug

SEQ ID NO: 127006 - RNA, 22 nt, Human
uggcagagucaucacaucugga

SEQ ID NO: 127007 - RNA, 22 nt, Human
ugcagggccagacuggguugga

SEQ ID NO: 127008 - RNA, 22 nt, Human
agggcugagacuaaggccagau

SEQ ID NO: 127009 - RNA, 21 nt, Human
acagggcaugcagcuggcugu

SEQ ID NO: 127010 - RNA, 22 nt, Human
gaggcaggguguugauuacaga

SEQ ID NO: 127011 - RNA, 21 nt, Human
aggugcagagccagggaccag

SEQ ID NO: 127012 - RNA, 22 nt, Human
agaagccagcuucagcugcccg

SEQ ID NO: 127013 - RNA, 22 nt, Human
uaguggagaguuguuuugugca

SEQ ID NO: 127014 - RNA, 21 nt, Human
aaguggagaagaaaagcugga

SEQ ID NO: 127015 - RNA, 22 nt, Human
ccuuguccucugguuuccuguu

SEQ ID NO: 127016 - RNA, 22 nt, Human
cugcuguggaugcaggaccuca

SEQ ID NO: 127017 - RNA, 22 nt, Human
cugugacuagaccugcaggaga

SEQ ID NO: 127018 - RNA, 22 nt, Human
ucuuaagcagagaagaaguuga

SEQ ID NO: 127019 - RNA, 22 nt, Human
aaagaagggacagacugccucu

SEQ ID NO: 127020 - RNA, 22 nt, Human
gcagugauuggaucagagaugg

SEQ ID NO: 127021 - RNA, 22 nt, Human
gccaggcugcuccagggaggcc

SEQ ID NO: 127022 - RNA, 22 nt, Human
ggagaggaaaugccagcacuuc

SEQ ID NO: 127023 - RNA, 22 nt, Human
agccaggcugcaguuggcuggc

SEQ ID NO: 127024 - RNA, 22 nt, Human
gaggcacaguguuuggucagug

SEQ ID NO: 127025 - RNA, 22 nt, Human
cagagcuggguuugggaaaccu

SEQ ID NO: 127026 - RNA, 22 nt, Human
aguccagggcucucugugggau

SEQ ID NO: 127027 - RNA, 22 nt, Human
ggcugugagcaggcagaaugcu

SEQ ID NO: 127028 - RNA, 22 nt, Human
cugcugugcaggugccuaugau

SEQ ID NO: 127029 - RNA, 19 nt, Human
gaagaagcuugagaaguag

SEQ ID NO: 127030 - RNA, 22 nt, Human
gccaccagggggugcaaggucc

SEQ ID NO: 127031 - RNA, 22 nt, Human
acagcuguggucuccuuagugu

SEQ ID NO: 127032 - RNA, 22 nt, Human
aaagaacaauguggaaucuccu

SEQ ID NO: 127033 - RNA, 22 nt, Human
agagcagagggcucugggacaa

SEQ ID NO: 127034 - RNA, 22 nt, Human
caggcagggagcuggaaaggau

SEQ ID NO: 127035 - RNA, 22 nt, Human
gcagggcaucccugagcgggug

SEQ ID NO: 127036 - RNA, 22 nt, Human
ggagggagucagcugauuagaa

SEQ ID NO: 127037 - RNA, 22 nt, Human
aggcucaguucuguggugagcc

SEQ ID NO: 127038 - RNA, 22 nt, Human
ucaggcagaaaaaucacuaauu

SEQ ID NO: 127039 - RNA, 22 nt, Human
aggcgugggaggaucugaggcc

SEQ ID NO: 127040 - RNA, 22 nt, Human
ugccaggcuaaguggaggacuu

SEQ ID NO: 127041 - RNA, 22 nt, Human
agagccuggacuuuucugagcc

SEQ ID NO: 127042 - RNA, 22 nt, Human
aaguggagcuauaggcucagau

SEQ ID NO: 127043 - RNA, 22 nt, Human
cagggagcuggcuggcugugcc

SEQ ID NO: 127044 - RNA, 22 nt, Human
gaggggaagacuucuggacagu

SEQ ID NO: 127045 - RNA, 22 nt, Human
gaggcaggcccugaaugaguca

SEQ ID NO: 127046 - RNA, 22 nt, Human
agggcaugaagcaguggacagc

SEQ ID NO: 127047 - RNA, 22 nt, Human
cccagugccaggcacaggcagc

SEQ ID NO: 127048 - RNA, 22 nt, Human
ggagaaagcuguaguggaaugu

SEQ ID NO: 127049 - RNA, 22 nt, Human
agggcugcuuugcuaaauaugg

SEQ ID NO: 127050 - RNA, 22 nt, Human
cagccagggucaggcagcuucu

SEQ ID NO: 127051 - RNA, 22 nt, Human
cugaggcauguuacaggacaua

SEQ ID NO: 127052 - RNA, 22 nt, Human
gcagggaagacccggagcagcg

SEQ ID NO: 127053 - RNA, 22 nt, Human
ugaggcagugauguuuaagcac

SEQ ID NO: 127054 - RNA, 22 nt, Human
agcagccagaaauccagaggug

SEQ ID NO: 127055 - RNA, 22 nt, Human
ccagugcccagucucccugguc

SEQ ID NO: 127056 - RNA, 22 nt, Human
agggaggaucugcuccuugucu

SEQ ID NO: 127057 - RNA, 22 nt, Human
uggaggaaaaaaccaggcagag

SEQ ID NO: 127058 - RNA, 22 nt, Human
ggcagccagcaaugagaaguuu

SEQ ID NO: 127059 - RNA, 22 nt, Human
cagcccuggcuagggcgagggc

SEQ ID NO: 127060 - RNA, 22 nt, Human
auuccaaagacagaagcagcug

SEQ ID NO: 127061 - RNA, 22 nt, Human
gaggcugcacuggcuaaaggcu

SEQ ID NO: 127062 - RNA, 18 nt, Human
aggaaagaaaggcaggug

SEQ ID NO: 127063 - RNA, 22 nt, Human
gggcagagacucagaaacagaa

SEQ ID NO: 127064 - RNA, 22 nt, Human
uugcagaggcaaaaaugaacuc

SEQ ID NO: 127065 - RNA, 22 nt, Human
cugcugugcuuguggccacccg

SEQ ID NO: 127066 - RNA, 18 nt, Human
aggcaggugcuggaaguc

SEQ ID NO: 127067 - RNA, 22 nt, Human
gcacaggcacagagggccacug

SEQ ID NO: 127068 - RNA, 19 nt, Human
ggagaagcccaggaauccu

SEQ ID NO: 127069 - RNA, 21 nt, Human
ugcagaggcacaaacaagccc

SEQ ID NO: 127070 - RNA, 22 nt, Human
aaggcugugucagaagcucccu

SEQ ID NO: 127071 - RNA, 22 nt, Human
ugagccagaguggagugugccu

SEQ ID NO: 127072 - RNA, 22 nt, Human
cugagucucccggcaguggagg

SEQ ID NO: 127073 - RNA, 22 nt, Human
aaaugcaaggccaugugaagga

SEQ ID NO: 127074 - RNA, 22 nt, Human
ccagaaggcggagauugcagug

SEQ ID NO: 127075 - RNA, 22 nt, Human
gauggcaggcaggugaguagag

SEQ ID NO: 127076 - RNA, 22 nt, Human
gaguccaggcucagaaacccgu

SEQ ID NO: 127077 - RNA, 22 nt, Human
agaugugguaguugaagggaag

SEQ ID NO: 127078 - RNA, 22 nt, Human
cagcugaagagaggugcugagu

SEQ ID NO: 127079 - RNA, 17 nt, Human
ucucuuucccuuucugc

SEQ ID NO: 127080 - RNA, 23 nt, Human
aggcagugucucuuauccugucc

SEQ ID NO: 127081 - RNA, 22 nt, Human
auccagcuuugucuggucuucg

SEQ ID NO: 127082 - RNA, 22 nt, Human
aagggcagcuuaaauugguagc

SEQ ID NO: 127083 - RNA, 22 nt, Human
ggcagggcaggaaagucaggaa

SEQ ID NO: 127084 - RNA, 22 nt, Human
gaggcucaguuaugucaucagg

SEQ ID NO: 127085 - RNA, 22 nt, Human
gggaagccaugcucagagguac

SEQ ID NO: 127086 - RNA, 22 nt, Human
ccaucccuucaccacagcagua

SEQ ID NO: 127087 - RNA, 22 nt, Human
gggcagguggagggcccagcca

SEQ ID NO: 127088 - RNA, 22 nt, Human
gaaguggaagccaucggcaguc

SEQ ID NO: 127089 - RNA, 22 nt, Human
gccaggugggagacagacagca

SEQ ID NO: 127090 - RNA, 22 nt, Human
cgggcagcggcguggccauggu

SEQ ID NO: 127091 - RNA, 22 nt, Human
gaaugcuaagcaugugggaguu

SEQ ID NO: 127092 - RNA, 22 nt, Human
cagggcugugcccaucuucccc

SEQ ID NO: 127093 - RNA, 22 nt, Human
aauauaaauuccugggcccagc

SEQ ID NO: 127094 - RNA, 22 nt, Human
caggugucaaaauacuaagugg

SEQ ID NO: 127095 - RNA, 22 nt, Human
uggcaggaaaaagggccagagg

SEQ ID NO: 127096 - RNA, 23 nt, Human
gcugggcuuacucuuucagugag

SEQ ID NO: 127097 - RNA, 22 nt, Human
agccuggccaggccugcccagg

SEQ ID NO: 127098 - RNA, 19 nt, Human
gaggaggaaaacuagugua

SEQ ID NO: 127099 - RNA, 22 nt, Human
gcacccagaggucagcagugcu

SEQ ID NO: 127100 - RNA, 21 nt, Human
uuugagaauuggucagagugc

SEQ ID NO: 127101 - RNA, 22 nt, Human
augaggcaaggcuggccguguu

SEQ ID NO: 127102 - RNA, 22 nt, Human
gacaauuucucaauauagaaac

SEQ ID NO: 127103 - RNA, 22 nt, Human
ucugccugagcagagggaggcc

SEQ ID NO: 127104 - RNA, 22 nt, Human
gcaccugggacccagaggcacc

SEQ ID NO: 127105 - RNA, 19 nt, Human
cagauguuuucaguucauu

SEQ ID NO: 127106 - RNA, 22 nt, Human
ugcaguggugguaaagaugcuc

SEQ ID NO: 127107 - RNA, 22 nt, Human
ugaggcucaagaaagauuuguu

SEQ ID NO: 127108 - RNA, 22 nt, Human
cagggccaugaggcacaggguc

SEQ ID NO: 127109 - RNA, 22 nt, Human
aagggcagaauagagaagaugg

SEQ ID NO: 127110 - RNA, 22 nt, Human
ucucccaggcugcccuguggac

SEQ ID NO: 127111 - RNA, 22 nt, Human
ugcaggaguccaaucaggagac

SEQ ID NO: 127112 - RNA, 23 nt, Human
cccagaccuugugcugcccuugg

SEQ ID NO: 127113 - RNA, 22 nt, Human
aagcuggacucugccauuuacu

SEQ ID NO: 127114 - RNA, 20 nt, Human
aggcucagcugagcucuugg

SEQ ID NO: 127115 - RNA, 22 nt, Human
cccugcagacgucuugaugccu

SEQ ID NO: 127116 - RNA, 22 nt, Human
ucagggcaucucuuaaguggug

SEQ ID NO: 127117 - RNA, 22 nt, Human
ucaaaggcugcuugucuucugg

SEQ ID NO: 127118 - RNA, 21 nt, Human
uguggcagauguugggaggca

SEQ ID NO: 127119 - RNA, 22 nt, Human
ugaaggugaaugucuaugggga

SEQ ID NO: 127120 - RNA, 22 nt, Human
aaaagcaguuaucugggaggaa

SEQ ID NO: 127121 - RNA, 22 nt, Human
cugaggaggggccugagugaga

SEQ ID NO: 127122 - RNA, 22 nt, Human
ccagugcaggugagcaccaggu

SEQ ID NO: 127123 - RNA, 22 nt, Human
agaagggccagcuggacaccug

SEQ ID NO: 127124 - RNA, 22 nt, Human
gccagucugcucccacaaguuc

SEQ ID NO: 127125 - RNA, 22 nt, Human
ugaggcaggagguugagaacug

SEQ ID NO: 127126 - RNA, 22 nt, Human
cugagccagcgggcucacuuuu

SEQ ID NO: 127127 - RNA, 22 nt, Human
ccagcugcagguguuccagaug

SEQ ID NO: 127128 - RNA, 22 nt, Human
cagggcagaacauauagauagu

SEQ ID NO: 127129 - RNA, 22 nt, Human
uggcagagcuggcugcggauga

SEQ ID NO: 127130 - RNA, 22 nt, Human
agagcugcccacacagcagauu

SEQ ID NO: 127131 - RNA, 22 nt, Human
ugagaagcaguuucaguaagaa

SEQ ID NO: 127132 - RNA, 22 nt, Human
gggagaaggagcuaguucuuga

SEQ ID NO: 127133 - RNA, 22 nt, Human
agggcaugugggagaggagccu

SEQ ID NO: 127134 - RNA, 22 nt, Human
agggcagagagaugaaugggau

SEQ ID NO: 127135 - RNA, 22 nt, Human
cagaggacaauagaauggaaag

SEQ ID NO: 127136 - RNA, 22 nt, Human
uccaucaccauuucugcgagcu

SEQ ID NO: 127137 - RNA, 22 nt, Human
gcagggucuugagaggcagcca

SEQ ID NO: 127138 - RNA, 22 nt, Human
ucagggcagguuaacuugggug

SEQ ID NO: 127139 - RNA, 22 nt, Human
ugggcaggaugcguugauucuu

SEQ ID NO: 127140 - RNA, 22 nt, Human
ccagggcugguggcugcagagg

SEQ ID NO: 127141 - RNA, 22 nt, Human
accaggagccacaggaggagcc

SEQ ID NO: 127142 - RNA, 22 nt, Human
ucgccagggaugcuguaaggaa

SEQ ID NO: 127143 - RNA, 22 nt, Human
agcugacuucuugauccaauga

SEQ ID NO: 127144 - RNA, 22 nt, Human
ucagaggacagcagcuaaauaa

SEQ ID NO: 127145 - RNA, 22 nt, Human
ugaagccacacuagcuuguccu

SEQ ID NO: 127146 - RNA, 22 nt, Human
cagaagaguagcugaacaaguu

SEQ ID NO: 127147 - RNA, 23 nt, Human
ccagggccccuacaccacugucc

SEQ ID NO: 127148 - RNA, 22 nt, Human
gagaggcauggaacagauucuu

SEQ ID NO: 127149 - RNA, 22 nt, Human
cucagggcuggaaagccaggaa

SEQ ID NO: 127150 - RNA, 22 nt, Human
aaagaggauggaguagucagcu

SEQ ID NO: 127151 - RNA, 22 nt, Human
uaguggagaaguggagucugug

SEQ ID NO: 127152 - RNA, 22 nt, Human
ucugccugagggagcugaggaa

SEQ ID NO: 127153 - RNA, 22 nt, Human
ggagaggcuuggcccagccugg

SEQ ID NO: 127154 - RNA, 22 nt, Human
uggcagagacuccuccugggag

SEQ ID NO: 127155 - RNA, 22 nt, Human
gagggcugauguugccaccuca

SEQ ID NO: 127156 - RNA, 22 nt, Human
uggagagcaagucgcagacaug

SEQ ID NO: 127157 - RNA, 18 nt, Human
gugccaggaggcgcagcc

SEQ ID NO: 127158 - RNA, 22 nt, Human
agcaggaaggcuuuggggguuc

SEQ ID NO: 127159 - RNA, 22 nt, Human
ccagggcacguugggacaguac

SEQ ID NO: 127160 - RNA, 22 nt, Human
ggaggaagcacacggcuuguau

SEQ ID NO: 127161 - RNA, 22 nt, Human
aagucagcacuccaggaagcca

SEQ ID NO: 127162 - RNA, 22 nt, Human
cuggagugaagcuuauuuuuca

SEQ ID NO: 127163 - RNA, 22 nt, Human
gggcagagguucaacuucaaca

SEQ ID NO: 127164 - RNA, 18 nt, Human
gagaggagccagaauuuu

SEQ ID NO: 127165 - RNA, 22 nt, Human
ugaggcaggaaguuauauaaug

SEQ ID NO: 127166 - RNA, 20 nt, Human
ugaggcucagagagguugag

SEQ ID NO: 127167 - RNA, 22 nt, Human
cugggcagcugugcaaacaaua

SEQ ID NO: 127168 - RNA, 22 nt, Human
ucagcccugaggacagaggcag

SEQ ID NO: 127169 - RNA, 22 nt, Human
ugcagaggagcuggaaggcugg

SEQ ID NO: 127170 - RNA, 22 nt, Human
accagggcccgggagagcucuc

SEQ ID NO: 127171 - RNA, 22 nt, Human
uagggcagccacccaggcugcu

SEQ ID NO: 127172 - RNA, 22 nt, Human
cagcaggaccauugaggcauca

SEQ ID NO: 127173 - RNA, 22 nt, Human
uugggggaagaggauagacagu

SEQ ID NO: 127174 - RNA, 22 nt, Human
uggagcuggaauuugagcugga

SEQ ID NO: 127175 - RNA, 22 nt, Human
uaggcucagggcugggugacgg

SEQ ID NO: 127176 - RNA, 22 nt, Human
uuguccuuggaugaagcuggga

SEQ ID NO: 127177 - RNA, 22 nt, Human
gagccugcccagcccuguccac

SEQ ID NO: 127178 - RNA, 17 nt, Human
agaggcagauacuugga

SEQ ID NO: 127179 - RNA, 22 nt, Human
ccagccugaaaugccucauccu

SEQ ID NO: 127180 - RNA, 22 nt, Human
ucagaggaaaggucagauggcu

SEQ ID NO: 127181 - RNA, 22 nt, Human
gaguucaguaguuauagucuag

SEQ ID NO: 127182 - RNA, 22 nt, Human
agaggcaggagguugacuugag

SEQ ID NO: 127183 - RNA, 22 nt, Human
gcagaagggaauaaggagcuuu

SEQ ID NO: 127184 - RNA, 22 nt, Human
ggcuguggacacugagcucaga

SEQ ID NO: 127185 - RNA, 22 nt, Human
acccuggacuggggcugaggcu

SEQ ID NO: 127186 - RNA, 22 nt, Human
ugcagggaaugcuugcagcaug

SEQ ID NO: 127187 - RNA, 22 nt, Human
ucuaauccuugcuaccugggug

SEQ ID NO: 127188 - RNA, 22 nt, Human
ugccagucucacccuggguccu

SEQ ID NO: 127189 - RNA, 22 nt, Human
gagcacagggaauagacagaua

SEQ ID NO: 127190 - RNA, 22 nt, Human
ugaggcaggaguuaaugugcuc

SEQ ID NO: 127191 - RNA, 22 nt, Human
agugggcaggcagggugcgcag

SEQ ID NO: 127192 - RNA, 22 nt, Human
ggcugugaacccuggcagugug

SEQ ID NO: 127193 - RNA, 22 nt, Human
uggcugaguucuccaggaguag

SEQ ID NO: 127194 - RNA, 22 nt, Human
uguauuuaagcuuuaccuaaaa

SEQ ID NO: 127195 - RNA, 22 nt, Human
agggccagggaagcuguauuuu

SEQ ID NO: 127196 - RNA, 21 nt, Human
aggcccagagucuugggggga

SEQ ID NO: 127197 - RNA, 22 nt, Human
agagccuguacuuuucugugaa

SEQ ID NO: 127198 - RNA, 22 nt, Human
gcagugaaaaagugcacccugu

SEQ ID NO: 127199 - RNA, 21 nt, Human
uggcagaguugaguaguuaug

SEQ ID NO: 127200 - RNA, 22 nt, Human
agggucaguucugugagguguu

SEQ ID NO: 127201 - RNA, 22 nt, Human
gugugcagggcugccugugccg

SEQ ID NO: 127202 - RNA, 22 nt, Human
gaggcagugaacaauuccugug

SEQ ID NO: 127203 - RNA, 22 nt, Human
cagagcucagagcugccaggca

SEQ ID NO: 127204 - RNA, 22 nt, Human
agguaguguagcugagugggau

SEQ ID NO: 127205 - RNA, 22 nt, Human
gcaccaggcuuagagccccagg

SEQ ID NO: 127206 - RNA, 22 nt, Human
ucccacugugccuguuguaauc

SEQ ID NO: 127207 - RNA, 22 nt, Human
cagaggaaaugggaaggagaua

SEQ ID NO: 127208 - RNA, 23 nt, Human
agcagggccagaauacuugcugu

SEQ ID NO: 127209 - RNA, 21 nt, Human
acagccugucaucucaugguc

SEQ ID NO: 127210 - RNA, 23 nt, Human
gacacaggagcacccagcugagc

SEQ ID NO: 127211 - RNA, 22 nt, Human
ugaggaaguugaucucaucagu

SEQ ID NO: 127212 - RNA, 22 nt, Human
gagucacaaaagaugcccaggg

SEQ ID NO: 127213 - RNA, 22 nt, Human
gcauggcauuaacaagauggaa

SEQ ID NO: 127214 - RNA, 20 nt, Human
agagccuggaaaaagacauc

SEQ ID NO: 127215 - RNA, 18 nt, Human
aggugcagccucugaggc

SEQ ID NO: 127216 - RNA, 22 nt, Human
cacaggagaacccacagauucu

SEQ ID NO: 127217 - RNA, 22 nt, Human
gggcugagggguaucucauggg

SEQ ID NO: 127218 - RNA, 22 nt, Human
uaguggaguagaaaccaaagaa

SEQ ID NO: 127219 - RNA, 22 nt, Human
ucagaaaugaucguuauucauu

SEQ ID NO: 127220 - RNA, 22 nt, Human
acagagcugggaucugaaccca

SEQ ID NO: 127221 - RNA, 22 nt, Human
gcagccacccucaaggcugaau

SEQ ID NO: 127222 - RNA, 22 nt, Human
ccaguggccaugcacgagcagc

SEQ ID NO: 127223 - RNA, 22 nt, Human
agaggcugaaugaugucaucau

SEQ ID NO: 127224 - RNA, 22 nt, Human
ugugaaggcagagccagugaaa

SEQ ID NO: 127225 - RNA, 22 nt, Human
gcauggcaaauaucgagggcag

SEQ ID NO: 127226 - RNA, 22 nt, Human
gcagccuguuguaccagccugu

SEQ ID NO: 127227 - RNA, 22 nt, Human
gaggccagaagucugagaucag

SEQ ID NO: 127228 - RNA, 22 nt, Human
gggcugagggccaauuccuacu

SEQ ID NO: 127229 - RNA, 22 nt, Human
cagaggaggcgguauacacugc

SEQ ID NO: 127230 - RNA, 22 nt, Human
cuuauuuuaagucaguuugggu

SEQ ID NO: 127231 - RNA, 22 nt, Human
aaguggugguaugaaccgaggg

SEQ ID NO: 127232 - RNA, 22 nt, Human
uggaggcaacugaagauguagu

SEQ ID NO: 127233 - RNA, 22 nt, Human
acagagcuaauguugcauaggc

SEQ ID NO: 127234 - RNA, 20 nt, Human
aggcucaggguguuuaggaa

SEQ ID NO: 127235 - RNA, 22 nt, Human
gagggcugauaacaggaauaca

SEQ ID NO: 127236 - RNA, 22 nt, Human
gccuggaguucagccaaguccc

SEQ ID NO: 127237 - RNA, 23 nt, Human
caguggagacucaugcuuccuua

SEQ ID NO: 127238 - RNA, 22 nt, Human
agggccacaguggggccugaga

SEQ ID NO: 127239 - RNA, 22 nt, Human
aaggagucugggccauucagag

SEQ ID NO: 127240 - RNA, 22 nt, Human
cugcaguguucuggaaugcauu

SEQ ID NO: 127241 - RNA, 18 nt, Human
cagcugugcccuguuugg

SEQ ID NO: 127242 - RNA, 22 nt, Human
aaagccagcucugagcugcacc

SEQ ID NO: 127243 - RNA, 22 nt, Human
gaagggugugugugagggacac

SEQ ID NO: 127244 - RNA, 22 nt, Human
acagagcuguacaugugccaug

SEQ ID NO: 127245 - RNA, 22 nt, Human
caggcccagugaucagggcucu

SEQ ID NO: 127246 - RNA, 22 nt, Human
ugggcugaaaugcuguggacua

SEQ ID NO: 127247 - RNA, 22 nt, Human
cacaggcagccuuguagaagaa

SEQ ID NO: 127248 - RNA, 20 nt, Human
aggcugggguguuuugccca

SEQ ID NO: 127249 - RNA, 22 nt, Human
uccuggccuugcuccugaugcc

SEQ ID NO: 127250 - RNA, 22 nt, Human
agccagggagguggagguugca

SEQ ID NO: 127251 - RNA, 23 nt, Human
uuacuuuugcaccaaccuaauau

SEQ ID NO: 127252 - RNA, 22 nt, Human
aaaugcagcagcuaauugaaaa

SEQ ID NO: 127253 - RNA, 22 nt, Human
acaggcugcugggcuccgugcu

SEQ ID NO: 127254 - RNA, 22 nt, Human
uuucccaaguguaaacauggca

SEQ ID NO: 127255 - RNA, 22 nt, Human
ucuugcacuucaugaauauguu

SEQ ID NO: 127256 - RNA, 17 nt, Human
aguggcaggcagauggg

SEQ ID NO: 127257 - RNA, 22 nt, Human
gggugcagggucuccagcagcu

SEQ ID NO: 127258 - RNA, 22 nt, Human
ugaggcagguggauuacaaggu

SEQ ID NO: 127259 - RNA, 22 nt, Human
gaaagccaucuggcugcuggga

SEQ ID NO: 127260 - RNA, 20 nt, Human
agccaggcucaagcuccccc

SEQ ID NO: 127261 - RNA, 22 nt, Human
cagcaucccucaggggccucug

SEQ ID NO: 127262 - RNA, 22 nt, Human
uccugccugagcguggaggagg

SEQ ID NO: 127263 - RNA, 22 nt, Human
uggaggcagucaaaugacugac

SEQ ID NO: 127264 - RNA, 22 nt, Human
aggcagguuucccggcugucaa

SEQ ID NO: 127265 - RNA, 22 nt, Human
agaagugagugugacucagcag

SEQ ID NO: 127266 - RNA, 22 nt, Human
cauccugcggggagcagagggc

SEQ ID NO: 127267 - RNA, 22 nt, Human
uggagaagauuggucaccauuc

SEQ ID NO: 127268 - RNA, 22 nt, Human
acccuguaugcuauaucccuaa

SEQ ID NO: 127269 - RNA, 22 nt, Human
agcaggggcaggguuuugugcu

SEQ ID NO: 127270 - RNA, 22 nt, Human
agcagggcuguguagguaauga

SEQ ID NO: 127271 - RNA, 22 nt, Human
ugggcugaguguggaacuaguu

SEQ ID NO: 127272 - RNA, 19 nt, Human
uggaagaggaagggaaaua

SEQ ID NO: 127273 - RNA, 22 nt, Human
gagugcaguaugagaggcugcu

SEQ ID NO: 127274 - RNA, 22 nt, Human
accaggcuggagugcaguggcg

SEQ ID NO: 127275 - RNA, 21 nt, Human
cacuauuuauauaugccagcu

SEQ ID NO: 127276 - RNA, 22 nt, Human
acacaaacagucuauagcacca

SEQ ID NO: 127277 - RNA, 22 nt, Human
agauguggauccuaggguagaa

SEQ ID NO: 127278 - RNA, 22 nt, Human
ucacauuuguguuuuauuagag

SEQ ID NO: 127279 - RNA, 22 nt, Human
uccugguggugccagcugcagg

SEQ ID NO: 127280 - RNA, 22 nt, Human
gaggaagaagcaaaccagcuaa

SEQ ID NO: 127281 - RNA, 22 nt, Human
aggaggggcaaugauagucugg

SEQ ID NO: 127282 - RNA, 22 nt, Human
caguggcgugaucucugcucac

SEQ ID NO: 127283 - RNA, 22 nt, Human
uggcucaguagcagugugguca

SEQ ID NO: 127284 - RNA, 22 nt, Human
agcagggcaaagucaggcuaac

SEQ ID NO: 127285 - RNA, 22 nt, Human
acagggcagugucuugaaaaau

SEQ ID NO: 127286 - RNA, 22 nt, Human
caguucagcuagaagaaacaaa

SEQ ID NO: 127287 - RNA, 22 nt, Human
gcuucucgggccugaugucguc

SEQ ID NO: 127288 - RNA, 22 nt, Human
uuucuggcagcgggacaggggu

SEQ ID NO: 127289 - RNA, 22 nt, Human
accagggcaaauguuuguacuc

SEQ ID NO: 127290 - RNA, 22 nt, Human
gacaugcaugaaugcaggucuc

SEQ ID NO: 127291 - RNA, 22 nt, Human
cugcuguguuggcauuggauag

SEQ ID NO: 127292 - RNA, 22 nt, Human
aggcucagccugggccuagagc

SEQ ID NO: 127293 - RNA, 18 nt, Human
ugaggcagucagugaugg

SEQ ID NO: 127294 - RNA, 22 nt, Human
ugcacuccaggcugggugacag

SEQ ID NO: 127295 - RNA, 22 nt, Human
cugcugugggcaggguagcugg

SEQ ID NO: 127296 - RNA, 22 nt, Human
agaggcagcagucauacuacag

SEQ ID NO: 127297 - RNA, 22 nt, Human
agccugcuggaccaagcucaug

SEQ ID NO: 127298 - RNA, 22 nt, Human
aggggccauuguucugcccgcu

SEQ ID NO: 127299 - RNA, 16 nt, Human
agcagggcgggaagga

SEQ ID NO: 127300 - RNA, 22 nt, Human
ugccagaguuacaugaggguca

SEQ ID NO: 127301 - RNA, 22 nt, Human
caaggcaguuccccagagggcu

SEQ ID NO: 127302 - RNA, 22 nt, Human
cuggagggggaaauguucauug

SEQ ID NO: 127303 - RNA, 22 nt, Human
caggcagccugagggaucuggg

SEQ ID NO: 127304 - RNA, 22 nt, Human
gaggaaggcuaaggggcuuaga

SEQ ID NO: 127305 - RNA, 22 nt, Human
ucaccaggcaacuauguacucc

SEQ ID NO: 127306 - RNA, 22 nt, Human
ggggcagccuccaggaaagcug

SEQ ID NO: 127307 - RNA, 22 nt, Human
ugcagggccuuguugaugugcu

SEQ ID NO: 127308 - RNA, 22 nt, Human
uuguacuugccauagaacaaca

SEQ ID NO: 127309 - RNA, 23 nt, Human
cagagcugauuaaacuuaaucuc

SEQ ID NO: 127310 - RNA, 22 nt, Human
uugcucugauuagguggaaaca

SEQ ID NO: 127311 - RNA, 20 nt, Human
uucugcuugcaaauaucaag

SEQ ID NO: 127312 - RNA, 22 nt, Human
gggacaggcugagacuugagcu

SEQ ID NO: 127313 - RNA, 22 nt, Human
ugaggcaggagaauggcgggaa

SEQ ID NO: 127314 - RNA, 22 nt, Human
aggcaguggagcuggaauaggc

SEQ ID NO: 127315 - RNA, 23 nt, Human
ucucugaguuguacuuucccuug

SEQ ID NO: 127316 - RNA, 23 nt, Human
ccuggaguacuaaggggauggaa

SEQ ID NO: 127317 - RNA, 22 nt, Human
ucuggaaguuagaggaggaaag

SEQ ID NO: 127318 - RNA, 22 nt, Human
aaggccaggagacuuggaguca

SEQ ID NO: 127319 - RNA, 22 nt, Human
ugcacacacucugcauauacuu

SEQ ID NO: 127320 - RNA, 22 nt, Human
uagaugaccuuguguuaggcaa

SEQ ID NO: 127321 - RNA, 22 nt, Human
aagagcugcacauauuuauauc

SEQ ID NO: 127322 - RNA, 19 nt, Human
ggcuggaguggccaucugu

SEQ ID NO: 127323 - RNA, 22 nt, Human
gcagggcaggauuugaacccag

SEQ ID NO: 127324 - RNA, 22 nt, Human
gccuggagggcucuagagaggc

SEQ ID NO: 127325 - RNA, 22 nt, Human
agaggaggccaggcccacaccu

SEQ ID NO: 127326 - RNA, 22 nt, Human
uacuuguuaucaucuuuuccuu

SEQ ID NO: 127327 - RNA, 22 nt, Human
aagggcagggaguuugugucua

SEQ ID NO: 127328 - RNA, 22 nt, Human
cuagggcacuaggacucaugug

SEQ ID NO: 127329 - RNA, 22 nt, Human
cugagcagccccaccagccauu

SEQ ID NO: 127330 - RNA, 22 nt, Human
accagggcacaggagucugaag

SEQ ID NO: 127331 - RNA, 22 nt, Human
aagagcugugggugguaguccu

SEQ ID NO: 127332 - RNA, 22 nt, Human
ugagaggcagaauggugccugc

SEQ ID NO: 127333 - RNA, 21 nt, Human
gguugguguguccaguggcca

SEQ ID NO: 127334 - RNA, 22 nt, Human
gaggagaaauuauccuuggugu

SEQ ID NO: 127335 - RNA, 21 nt, Human
uagggcaggcauuggaagaga

SEQ ID NO: 127336 - RNA, 22 nt, Human
augggcagcugcagcaguggug

SEQ ID NO: 127337 - RNA, 22 nt, Human
ggcagaguugguggagucaguu

SEQ ID NO: 127338 - RNA, 22 nt, Human
guccaagagucaagaagggggc

SEQ ID NO: 127339 - RNA, 22 nt, Human
guguccuuuuaugugacugguu

SEQ ID NO: 127340 - RNA, 22 nt, Human
ccagaagagaucacaguucuug

SEQ ID NO: 127341 - RNA, 21 nt, Human
gcugcucgagauccagugcuu

SEQ ID NO: 127342 - RNA, 22 nt, Human
ggcagggcccugauuccugggg

SEQ ID NO: 127343 - RNA, 22 nt, Human
cuggccagguuuugaacaguug

SEQ ID NO: 127344 - RNA, 22 nt, Human
agagccugggaauuugcauguu

SEQ ID NO: 127345 - RNA, 22 nt, Human
ucugugaacaucacauugacag

SEQ ID NO: 127346 - RNA, 18 nt, Human
ccucacagacuuccaugu

SEQ ID NO: 127347 - RNA, 22 nt, Human
aggcagccuuuagacagucugc

SEQ ID NO: 127348 - RNA, 18 nt, Human
gugagcagagagcaucac

SEQ ID NO: 127349 - RNA, 22 nt, Human
gcugaggccccagggugauggg

SEQ ID NO: 127350 - RNA, 22 nt, Human
gcagaggagcaaguugcuacag

SEQ ID NO: 127351 - RNA, 19 nt, Human
agcuguggggccuagcacc

SEQ ID NO: 127352 - RNA, 22 nt, Human
uagaggcauuaaugaauaaaca

SEQ ID NO: 127353 - RNA, 22 nt, Human
ugaggcaguugagcuuccugag

SEQ ID NO: 127354 - RNA, 22 nt, Human
uuccucagccagcacuuagggg

SEQ ID NO: 127355 - RNA, 21 nt, Human
cccaagggaggcaggauaagg

SEQ ID NO: 127356 - RNA, 22 nt, Human
acccaggacucucuuccaguag

SEQ ID NO: 127357 - RNA, 22 nt, Human
uuuauccauucaccaguugaac

SEQ ID NO: 127358 - RNA, 22 nt, Human
acagggcagaaauguugcaucu

SEQ ID NO: 127359 - RNA, 22 nt, Human
caguggaggcucaagugugcuu

SEQ ID NO: 127360 - RNA, 17 nt, Human
agccugcugaucucaca

SEQ ID NO: 127361 - RNA, 22 nt, Human
ugaggaaacugaggcacagaug

SEQ ID NO: 127362 - RNA, 22 nt, Human
augaggcaaggaucagguaagg

SEQ ID NO: 127363 - RNA, 22 nt, Human
ugggcaggcaagugaauaccuu

SEQ ID NO: 127364 - RNA, 22 nt, Human
gaggcaguuugccaugccagga

SEQ ID NO: 127365 - RNA, 22 nt, Human
cagcugagcucccaggccauca

SEQ ID NO: 127366 - RNA, 22 nt, Human
ggcagaggaaggaugaauucac

SEQ ID NO: 127367 - RNA, 22 nt, Human
cagaaggcauagaugaaggccu

SEQ ID NO: 127368 - RNA, 22 nt, Human
guauuauuggguaguaugguaa

SEQ ID NO: 127369 - RNA, 22 nt, Human
uagggcagauucgguggaguuu

SEQ ID NO: 127370 - RNA, 20 nt, Human
cagagcuguuauggaugaug

SEQ ID NO: 127371 - RNA, 22 nt, Human
aggugcuggaguagaagaaaaa

SEQ ID NO: 127372 - RNA, 22 nt, Human
ucucugagcccaauguagcaau

SEQ ID NO: 127373 - RNA, 22 nt, Human
cugaggcaguuuaauuuuugaa

SEQ ID NO: 127374 - RNA, 22 nt, Human
ccagagcugaugggcccagggu

SEQ ID NO: 127375 - RNA, 22 nt, Human
aguucaggcauaaggcaugaac

SEQ ID NO: 127376 - RNA, 22 nt, Human
aggguaggguaaaugaugcauc

SEQ ID NO: 127377 - RNA, 21 nt, Human
ugucagcaacaauacuuucuc

SEQ ID NO: 127378 - RNA, 18 nt, Human
cugcugugucgucugggc

SEQ ID NO: 127379 - RNA, 22 nt, Human
uaggcaggcugaauguagauuu

SEQ ID NO: 127380 - RNA, 22 nt, Human
uguggcaggcaagauguacaga

SEQ ID NO: 127381 - RNA, 22 nt, Human
auacaaagcuaaauaugguuuc

SEQ ID NO: 127382 - RNA, 22 nt, Human
gugcuugggggaaguaacagac

SEQ ID NO: 127383 - RNA, 22 nt, Human
uggcagugggaagcuggaaguc

SEQ ID NO: 127384 - RNA, 22 nt, Human
caggggaagaugccaagggaga

SEQ ID NO: 127385 - RNA, 20 nt, Human
gaaggaagggggcaagguga

SEQ ID NO: 127386 - RNA, 22 nt, Human
ugaagggcaaccccaggcccag

SEQ ID NO: 127387 - RNA, 22 nt, Human
ucauccaguaugacuggugucu

SEQ ID NO: 127388 - RNA, 23 nt, Human
gggcagguuuuuauaggcuucag

SEQ ID NO: 127389 - RNA, 22 nt, Human
ggaaagagcuaaaagggugaga

SEQ ID NO: 127390 - RNA, 22 nt, Human
agggccagcccauaaugccaaa

SEQ ID NO: 127391 - RNA, 22 nt, Human
aggcaggccccugagaauagac

SEQ ID NO: 127392 - RNA, 22 nt, Human
gccuggaguggacuuggccccu

SEQ ID NO: 127393 - RNA, 19 nt, Human
ucugugcugggaggcagca

SEQ ID NO: 127394 - RNA, 22 nt, Human
caggaggcaucauggagcggac

SEQ ID NO: 127395 - RNA, 22 nt, Human
uuuuaucaaucauuaagacauu

SEQ ID NO: 127396 - RNA, 22 nt, Human
accagugcuuccugcuggagcu

SEQ ID NO: 127397 - RNA, 22 nt, Human
ggcagaccucuccagccccaca

SEQ ID NO: 127398 - RNA, 22 nt, Human
agcugaggaggaaugaugggua

SEQ ID NO: 127399 - RNA, 19 nt, Human
gcaucagagcagaaggggu

SEQ ID NO: 127400 - RNA, 22 nt, Human
gcaccugguuuauauaaucaua

SEQ ID NO: 127401 - RNA, 22 nt, Human
cauccugguuaccccauaguca

SEQ ID NO: 127402 - RNA, 22 nt, Human
cugccaggccucaucccagcca

SEQ ID NO: 127403 - RNA, 22 nt, Human
acauucuguuuccccaaagaga

SEQ ID NO: 127404 - RNA, 22 nt, Human
agcagggcugcggccccaccac

SEQ ID NO: 127405 - RNA, 22 nt, Human
gccacaugucaugugcucagua

SEQ ID NO: 127406 - RNA, 22 nt, Human
gggcagaggggcgcuucccucu

SEQ ID NO: 127407 - RNA, 22 nt, Human
agggcccuaaggaaggcacaca

SEQ ID NO: 127408 - RNA, 22 nt, Human
agcaugaaagcauaggacaguc

SEQ ID NO: 127409 - RNA, 22 nt, Human
gaggcugguaggaaaggaaaca

SEQ ID NO: 127410 - RNA, 22 nt, Human
agggagguccaucccugcagag

SEQ ID NO: 127411 - RNA, 22 nt, Human
ggagaugccagaauugcaaauu

SEQ ID NO: 127412 - RNA, 22 nt, Human
agagcugcaggguggacccagg

SEQ ID NO: 127413 - RNA, 22 nt, Human
acauuugacauuuaguaucagc

SEQ ID NO: 127414 - RNA, 18 nt, Human
gcaaggcucaggccaggc

SEQ ID NO: 127415 - RNA, 22 nt, Human
ucagggcauguauguuucuuua

SEQ ID NO: 127416 - RNA, 22 nt, Human
aggcagcagacuguuaaucaga

SEQ ID NO: 127417 - RNA, 22 nt, Human
uggagagcgugcuuagcacucu

SEQ ID NO: 127418 - RNA, 22 nt, Human
caaaggcuucaucucagagcag

SEQ ID NO: 127419 - RNA, 22 nt, Human
cagagcauaauugacaugaggu

SEQ ID NO: 127420 - RNA, 22 nt, Human
aguggcagcugucaugcccuag

SEQ ID NO: 127421 - RNA, 22 nt, Human
ugcagggccuucuagaccaugg

SEQ ID NO: 127422 - RNA, 22 nt, Human
cccagccugucuuucccaauga

SEQ ID NO: 127423 - RNA, 22 nt, Human
ucagaggaucaugucccuacuc

SEQ ID NO: 127424 - RNA, 22 nt, Human
augggcaguuaggaggccagga

SEQ ID NO: 127425 - RNA, 22 nt, Human
auccuucagcugcccuguuacc

SEQ ID NO: 127426 - RNA, 22 nt, Human
uggcagagcaaaaagauagaau

SEQ ID NO: 127427 - RNA, 22 nt, Human
ggggcaggagcccuucuucagc

SEQ ID NO: 127428 - RNA, 22 nt, Human
ucaguggauuggaugagaucug

SEQ ID NO: 127429 - RNA, 22 nt, Human
aaggugucacugggacaggaaa

SEQ ID NO: 127430 - RNA, 22 nt, Human
agaagugcuccagugaguuggg

SEQ ID NO: 127431 - RNA, 22 nt, Human
aggaaggguucuuugugaaaga

SEQ ID NO: 127432 - RNA, 22 nt, Human
uggaggaauaacagcaaccuua

SEQ ID NO: 127433 - RNA, 22 nt, Human
acagggcagguggcuacugguc

SEQ ID NO: 127434 - RNA, 22 nt, Human
agcagccacccagcugcucauu

SEQ ID NO: 127435 - RNA, 22 nt, Human
uggcucaggaucuaagcagaau

SEQ ID NO: 127436 - RNA, 17 nt, Human
gcuuuggaaggguagac

SEQ ID NO: 127437 - RNA, 22 nt, Human
guggcaggucccauuggagcag

SEQ ID NO: 127438 - RNA, 22 nt, Human
ugccaggcagugucagauugag

SEQ ID NO: 127439 - RNA, 20 nt, Human
gccaacgcgcuggggcugcc

SEQ ID NO: 127440 - RNA, 22 nt, Human
cugagaggcggagcuugcagug

SEQ ID NO: 127441 - RNA, 22 nt, Human
cagaggaagcagacacaucuug

SEQ ID NO: 127442 - RNA, 22 nt, Human
cuucccacagaauucaaucagu

SEQ ID NO: 127443 - RNA, 22 nt, Human
cggcagagugugugcgugcaug

SEQ ID NO: 127444 - RNA, 22 nt, Human
ucacauuugcaauugcauuguu

SEQ ID NO: 127445 - RNA, 22 nt, Human
agcuggggcugcagagaacagg

SEQ ID NO: 127446 - RNA, 22 nt, Human
agcugccccaugagaggcaggu

SEQ ID NO: 127447 - RNA, 22 nt, Human
uccuccucuaucagacagugcc

SEQ ID NO: 127448 - RNA, 22 nt, Human
ccagaggaguugaggcuuuggg

SEQ ID NO: 127449 - RNA, 22 nt, Human
gccaggcuggccagcaccuucu

SEQ ID NO: 127450 - RNA, 23 nt, Human
aggcagagccaaggucaaaaccc

SEQ ID NO: 127451 - RNA, 22 nt, Human
uccaaaaaacguuugaauaguu

SEQ ID NO: 127452 - RNA, 22 nt, Human
aagcuggaacaucuugaggaag

SEQ ID NO: 127453 - RNA, 22 nt, Human
aguggcagacacaaugugggca

SEQ ID NO: 127454 - RNA, 22 nt, Human
ggccugaggcgucccagcugug

SEQ ID NO: 127455 - RNA, 22 nt, Human
ugaggcagaguaagauacauga

SEQ ID NO: 127456 - RNA, 22 nt, Human
cccaggugggcaccucgaggaa

SEQ ID NO: 127457 - RNA, 22 nt, Human
uggcucagucauggaugaguaa

SEQ ID NO: 127458 - RNA, 22 nt, Human
uggucgaccaguuggaaaguaa

SEQ ID NO: 127459 - RNA, 19 nt, Human
ucugaaguccagggcauac

SEQ ID NO: 127460 - RNA, 21 nt, Human
gcugugcacauaguagaagug

SEQ ID NO: 127461 - RNA, 22 nt, Human
agggcagaaguacagacacuua

SEQ ID NO: 127462 - RNA, 22 nt, Human
aggaagcccaagucucaucuuc

SEQ ID NO: 127463 - RNA, 22 nt, Human
agcagggcuucugugccugugc

SEQ ID NO: 127464 - RNA, 22 nt, Human
gguggaaggccuggaaggaggc

SEQ ID NO: 127465 - RNA, 22 nt, Human
aggcaggcaaccaccugggaag

SEQ ID NO: 127466 - RNA, 22 nt, Human
gaaggcuaaaggggcagagguu

SEQ ID NO: 127467 - RNA, 22 nt, Human
uaucaacauuaauauuuucugg

SEQ ID NO: 127468 - RNA, 18 nt, Human
guucaaggucaagagaga

SEQ ID NO: 127469 - RNA, 22 nt, Human
acagagcuguacuacuuacuga

SEQ ID NO: 127470 - RNA, 22 nt, Human
uaggggaacuggcacagggcag

SEQ ID NO: 127471 - RNA, 20 nt, Human
ucacauccucucccaacaug

SEQ ID NO: 127472 - RNA, 22 nt, Human
gcaggaagccuuaccaagccca

SEQ ID NO: 127473 - RNA, 22 nt, Human
uggaggaaguggacaguugugu

SEQ ID NO: 127474 - RNA, 22 nt, Human
agcagggccaacaguaaacacc

SEQ ID NO: 127475 - RNA, 22 nt, Human
gugccagggggcacugaacaga

SEQ ID NO: 127476 - RNA, 22 nt, Human
cagccagugguugaagaugcag

SEQ ID NO: 127477 - RNA, 22 nt, Human
agggcugagcccaggcauguag

SEQ ID NO: 127478 - RNA, 22 nt, Human
gagagggcucuguguggguacu

SEQ ID NO: 127479 - RNA, 22 nt, Human
aggcucagggacucccucccuc

SEQ ID NO: 127480 - RNA, 23 nt, Human
cugcuguguuggucucgauggga

SEQ ID NO: 127481 - RNA, 22 nt, Human
ucauuuucacacauaaauagca

SEQ ID NO: 127482 - RNA, 22 nt, Human
gaagaaggugcuacacagggca

SEQ ID NO: 127483 - RNA, 22 nt, Human
aguauggggcugugugugcaca

SEQ ID NO: 127484 - RNA, 22 nt, Human
gggcagguuggcaucccgggca

SEQ ID NO: 127485 - RNA, 22 nt, Human
uggcagagaauaaaucuugacu

SEQ ID NO: 127486 - RNA, 22 nt, Human
ugcagggcuauaacuccauucu

SEQ ID NO: 127487 - RNA, 22 nt, Human
cauggcagaaaccugagcugcu

SEQ ID NO: 127488 - RNA, 22 nt, Human
aggcugagggcuccugagggca

SEQ ID NO: 127489 - RNA, 22 nt, Human
gcugugcagauguagggagugg

SEQ ID NO: 127490 - RNA, 22 nt, Human
uggcugagaaaaugguuuuagg

SEQ ID NO: 127491 - RNA, 22 nt, Human
cccaggucccgccccagcucua

SEQ ID NO: 127492 - RNA, 22 nt, Human
ugacuccaaacagaaaacgaau

SEQ ID NO: 127493 - RNA, 22 nt, Human
aggcucagacaggaaaaguaac

SEQ ID NO: 127494 - RNA, 21 nt, Human
ccagagagagggaaguggguu

SEQ ID NO: 127495 - RNA, 18 nt, Human
ucagaggagauaccuaaa

SEQ ID NO: 127496 - RNA, 22 nt, Human
gcuguggcugaccaccaggggg

SEQ ID NO: 127497 - RNA, 22 nt, Human
ucaggcugaaggaggccuaucu

SEQ ID NO: 127498 - RNA, 22 nt, Human
uccaggcucucaggugucagca

SEQ ID NO: 127499 - RNA, 22 nt, Human
aggcagaugguaacugugauau

SEQ ID NO: 127500 - RNA, 22 nt, Human
ugcagggcacacgcacgggugu

SEQ ID NO: 127501 - RNA, 23 nt, Human
aggagaagagauuuccacaugca

SEQ ID NO: 127502 - RNA, 22 nt, Human
ugaguccacuuuaaaaugucag

SEQ ID NO: 127503 - RNA, 22 nt, Human
gaggcucagagacuuuaaguuu

SEQ ID NO: 127504 - RNA, 22 nt, Human
aggcccagacucagcggggcgg

SEQ ID NO: 127505 - RNA, 18 nt, Human
gcagugaagaaagagcuu

SEQ ID NO: 127506 - RNA, 22 nt, Human
ugaggcucagaaauguaaguuu

SEQ ID NO: 127507 - RNA, 22 nt, Human
ugccaggcuguccugggccugg

SEQ ID NO: 127508 - RNA, 22 nt, Human
agggaggcaggaaaguugucug

SEQ ID NO: 127509 - RNA, 22 nt, Human
uggcagagccuugccaaacucc

SEQ ID NO: 127510 - RNA, 22 nt, Human
gcagaagcuguucgaaggccgc

SEQ ID NO: 127511 - RNA, 22 nt, Human
cacagccuugagcgaggacaag

SEQ ID NO: 127512 - RNA, 22 nt, Human
gagucgagcagaaagccgucgg

SEQ ID NO: 127513 - RNA, 22 nt, Human
agaggaaguaaucaggaccugc

SEQ ID NO: 127514 - RNA, 22 nt, Human
cccaguggaaggaguagaagac

SEQ ID NO: 127515 - RNA, 22 nt, Human
ucugaaggugcuagagaaagcu

SEQ ID NO: 127516 - RNA, 22 nt, Human
aucagaagaaauggaugugacu

SEQ ID NO: 127517 - RNA, 22 nt, Human
aaacaucauaggcaugcaugau

SEQ ID NO: 127518 - RNA, 22 nt, Human
agccaggaagaaggucacacca

SEQ ID NO: 127519 - RNA, 22 nt, Human
ggcagugaugucaaacagugaa

SEQ ID NO: 127520 - RNA, 22 nt, Human
aggcaggggagcuggaagggua

SEQ ID NO: 127521 - RNA, 22 nt, Human
ggcccagaauacuuuguaaaau

SEQ ID NO: 127522 - RNA, 22 nt, Human
gagcugaaauaugaagccaauu

SEQ ID NO: 127523 - RNA, 20 nt, Human
caggcaguuugugguuaggg

SEQ ID NO: 127524 - RNA, 22 nt, Human
agucaccaucuguggcagccug

SEQ ID NO: 127525 - RNA, 22 nt, Human
gcagggcagggcaagaacuggg

SEQ ID NO: 127526 - RNA, 22 nt, Human
cagggccacacggaagggaaca

SEQ ID NO: 127527 - RNA, 22 nt, Human
ugggggaagagcuuguuaaagu

SEQ ID NO: 127528 - RNA, 22 nt, Human
gccugagaaggauaggaagcga

SEQ ID NO: 127529 - RNA, 22 nt, Human
caggaggcagaggaugcccagu

SEQ ID NO: 127530 - RNA, 20 nt, Human
aggcugaguucuaugcacuu

SEQ ID NO: 127531 - RNA, 22 nt, Human
uacugugacagaguacuuaaac

SEQ ID NO: 127532 - RNA, 22 nt, Human
auuuuaucugcuuacuuucagg

SEQ ID NO: 127533 - RNA, 22 nt, Human
augaggcagaaaaaagucggag

SEQ ID NO: 127534 - RNA, 22 nt, Human
aggcagguguuaccucugguuu

SEQ ID NO: 127535 - RNA, 22 nt, Human
cggcagagcggcgagccccucc

SEQ ID NO: 127536 - RNA, 22 nt, Human
ccccaccagcacccucucuauc

SEQ ID NO: 127537 - RNA, 22 nt, Human
gggugaagcuccugcaggggcc

SEQ ID NO: 127538 - RNA, 22 nt, Human
gaagccacaacuuuuucuuagc

SEQ ID NO: 127539 - RNA, 23 nt, Human
uagggcagcugggagggacaugc

SEQ ID NO: 127540 - RNA, 20 nt, Human
aacauugcuucaauguaacc

SEQ ID NO: 127541 - RNA, 22 nt, Human
gccuguuggugacuuucuguug

SEQ ID NO: 127542 - RNA, 22 nt, Human
gaguggagaucgugccacugca

SEQ ID NO: 127543 - RNA, 22 nt, Human
aggcucagcugguggugaucgc

SEQ ID NO: 127544 - RNA, 22 nt, Human
ggggccagcuucgcgugcucuu

SEQ ID NO: 127545 - RNA, 22 nt, Human
ccugagugccaugagagcaccc

SEQ ID NO: 127546 - RNA, 22 nt, Human
ccagguguagcacugcucacag

SEQ ID NO: 127547 - RNA, 22 nt, Human
cagagcuguccaaacccugaca

SEQ ID NO: 127548 - RNA, 22 nt, Human
caugucuuuguuaugcucacca

SEQ ID NO: 127549 - RNA, 17 nt, Human
ucaggcugugccuggua

SEQ ID NO: 127550 - RNA, 22 nt, Human
ucaaagcuuagauaauuucuuu

SEQ ID NO: 127551 - RNA, 18 nt, Human
ggaaaccacaggguucug

SEQ ID NO: 127552 - RNA, 22 nt, Human
gcaggaagcauagaagaaugcc

SEQ ID NO: 127553 - RNA, 22 nt, Human
uacagaagcugagacacugaga

SEQ ID NO: 127554 - RNA, 22 nt, Human
uaaaggcuuuuacaggagugca

SEQ ID NO: 127555 - RNA, 22 nt, Human
cagcuguggagauggggugcau

SEQ ID NO: 127556 - RNA, 22 nt, Human
agagccccugguggagugagaa

SEQ ID NO: 127557 - RNA, 22 nt, Human
uggcaggagguuuucuccagga

SEQ ID NO: 127558 - RNA, 22 nt, Human
ccagggcucaggcucccagugg

SEQ ID NO: 127559 - RNA, 19 nt, Human
gaaggcugaaaugaagcac

SEQ ID NO: 127560 - RNA, 22 nt, Human
ggcucaguguuuguggaacaua

SEQ ID NO: 127561 - RNA, 22 nt, Human
agcacccuccaacuucccugua

SEQ ID NO: 127562 - RNA, 22 nt, Human
aggcugaggcagguggaucacu

SEQ ID NO: 127563 - RNA, 22 nt, Human
uuucccaagaaaaauaauugga

SEQ ID NO: 127564 - RNA, 22 nt, Human
auuuucucucaaaccuuaaaau

SEQ ID NO: 127565 - RNA, 22 nt, Human
aaggaagagaauccuucucaga

SEQ ID NO: 127566 - RNA, 22 nt, Human
acacugugagcugaagggcugc

SEQ ID NO: 127567 - RNA, 22 nt, Human
aggcaguuucugggacagcaua

SEQ ID NO: 127568 - RNA, 22 nt, Human
aggcugagaaagugggaagaug

SEQ ID NO: 127569 - RNA, 22 nt, Human
gagggcagagacagugauucac

SEQ ID NO: 127570 - RNA, 22 nt, Human
aguugaagguuggcugauccau

SEQ ID NO: 127571 - RNA, 22 nt, Human
augaggcaggagugcaguggca

SEQ ID NO: 127572 - RNA, 22 nt, Human
gaguccaguucuuuccagcagu

SEQ ID NO: 127573 - RNA, 22 nt, Human
ucagaggagccaaaguucugag

SEQ ID NO: 127574 - RNA, 22 nt, Human
gcagauggcucagacacugggg

SEQ ID NO: 127575 - RNA, 22 nt, Human
gaggcucacuaggcauccuggg

SEQ ID NO: 127576 - RNA, 22 nt, Human
agaauaaacugcuuuagggcag

SEQ ID NO: 127577 - RNA, 22 nt, Human
ucuuuugugauucuucaguuac

SEQ ID NO: 127578 - RNA, 18 nt, Human
cugugcagcaaacugagc

SEQ ID NO: 127579 - RNA, 22 nt, Human
aggcccagagcaggaaaggguu

SEQ ID NO: 127580 - RNA, 22 nt, Human
agccaggcagggcucucgcucu

SEQ ID NO: 127581 - RNA, 22 nt, Human
aauuuuauuaacuggauguagc

SEQ ID NO: 127582 - RNA, 22 nt, Human
ccagcugcccaagaggcauccu

SEQ ID NO: 127583 - RNA, 22 nt, Human
aggcagccaguucagguuucuu

SEQ ID NO: 127584 - RNA, 22 nt, Human
ggcagugagcuggagggaagga

SEQ ID NO: 127585 - RNA, 22 nt, Human
aggcaggaaaaucgcuugaacc

SEQ ID NO: 127586 - RNA, 22 nt, Human
gcugaguugaaagcagaggaua

SEQ ID NO: 127587 - RNA, 19 nt, Human
agugguagaugagcaggag

SEQ ID NO: 127588 - RNA, 22 nt, Human
gaaacaaucaucaugugauuug

SEQ ID NO: 127589 - RNA, 18 nt, Human
cugaggcuuagagagguu

SEQ ID NO: 127590 - RNA, 22 nt, Human
agagggcauuaacucugucuug

SEQ ID NO: 127591 - RNA, 22 nt, Human
guauuuucaugauuucagacca

SEQ ID NO: 127592 - RNA, 22 nt, Human
gaagaagcaggaguguguagca

SEQ ID NO: 127593 - RNA, 21 nt, Human
aggcuguccuuugccagcccu

SEQ ID NO: 127594 - RNA, 22 nt, Human
gcaguaggagaagaggaugcuu

SEQ ID NO: 127595 - RNA, 22 nt, Human
uggagaaggccggccaggagug

SEQ ID NO: 127596 - RNA, 22 nt, Human
uggcagagagagugcagucgac

SEQ ID NO: 127597 - RNA, 22 nt, Human
guuuuccauggaggucugaccu

SEQ ID NO: 127598 - RNA, 21 nt, Human
uggcugaguggaugcaugaau

SEQ ID NO: 127599 - RNA, 20 nt, Human
gggcagccucgggagugggu

SEQ ID NO: 127600 - RNA, 22 nt, Human
cagaaauggagcccaggaaucu

SEQ ID NO: 127601 - RNA, 22 nt, Human
aggcagcaugcucugcuucuac

SEQ ID NO: 127602 - RNA, 22 nt, Human
agggcaugcuggaggagagaca

SEQ ID NO: 127603 - RNA, 22 nt, Human
uggaauggaaacaaacugagga

SEQ ID NO: 127604 - RNA, 22 nt, Human
gcagggcagccacaggcccccu

SEQ ID NO: 127605 - RNA, 22 nt, Human
ucaggcagagcuguggagcucu

SEQ ID NO: 127606 - RNA, 22 nt, Human
agccucaguuucaggccuccuc

SEQ ID NO: 127607 - RNA, 22 nt, Human
agggcugaagggaggugcucau

SEQ ID NO: 127608 - RNA, 22 nt, Human
uuccaggacaagauguuucagg

SEQ ID NO: 127609 - RNA, 22 nt, Human
gcacacacuguuuuccucacau

SEQ ID NO: 127610 - RNA, 19 nt, Human
cucuccagcuccaguagcu

SEQ ID NO: 127611 - RNA, 20 nt, Human
gggcuagaccagggcagagg

SEQ ID NO: 127612 - RNA, 22 nt, Human
ugggagcacccugaggagcuuc

SEQ ID NO: 127613 - RNA, 22 nt, Human
uggcagaguucgcugugccuuu

SEQ ID NO: 127614 - RNA, 22 nt, Human
gaaaauuauugaaaauggcucu

SEQ ID NO: 127615 - RNA, 19 nt, Human
cagagcagugguuccugaa

SEQ ID NO: 127616 - RNA, 22 nt, Human
ugagagugaaaugucacauguc

SEQ ID NO: 127617 - RNA, 22 nt, Human
gcugugcaguaguagguacagu

SEQ ID NO: 127618 - RNA, 22 nt, Human
aaagccagggacagugugcaug

SEQ ID NO: 127619 - RNA, 22 nt, Human
agcagccagagucugaacauua

SEQ ID NO: 127620 - RNA, 22 nt, Human
ccaggggaaacagggagcacuc

SEQ ID NO: 127621 - RNA, 22 nt, Human
caagcuggaguuccucagagug

SEQ ID NO: 127622 - RNA, 22 nt, Human
augccaggaacaaacaguggug

SEQ ID NO: 127623 - RNA, 22 nt, Human
uggagcugagaaguggagcucu

SEQ ID NO: 127624 - RNA, 22 nt, Human
uggcugagugauauuugcaaag

SEQ ID NO: 127625 - RNA, 22 nt, Human
cugugcaguaggucagggcugg

SEQ ID NO: 127626 - RNA, 22 nt, Human
cagggcuggauuucauuucuag

SEQ ID NO: 127627 - RNA, 22 nt, Human
caggaggcagagguugcagcga

SEQ ID NO: 127628 - RNA, 22 nt, Human
ccagggcagggaccacgugucu

SEQ ID NO: 127629 - RNA, 22 nt, Human
accaugccaguggcagccagac

SEQ ID NO: 127630 - RNA, 19 nt, Human
auuuccaagaauuggagag

SEQ ID NO: 127631 - RNA, 22 nt, Human
gcagcugagagaagaacagggc

SEQ ID NO: 127632 - RNA, 22 nt, Human
accaggagccauagagucaggc

SEQ ID NO: 127633 - RNA, 22 nt, Human
ccaggugggaggaaagcagaga

SEQ ID NO: 127634 - RNA, 22 nt, Human
uggcugagcucccuguguguug

SEQ ID NO: 127635 - RNA, 22 nt, Human
uugcagagagguuaggaacuca

SEQ ID NO: 127636 - RNA, 22 nt, Human
ucaguggaacugucugggugag

SEQ ID NO: 127637 - RNA, 22 nt, Human
gcagccucagggcacucagaug

SEQ ID NO: 127638 - RNA, 22 nt, Human
gggcagguguuuccaaggugag

SEQ ID NO: 127639 - RNA, 22 nt, Human
cagaggaaguuccuugaugaga

SEQ ID NO: 127640 - RNA, 22 nt, Human
cagagcugggcauggugaaagg

SEQ ID NO: 127641 - RNA, 20 nt, Human
aggcucagagcaguaguaca

SEQ ID NO: 127642 - RNA, 21 nt, Human
agagacugucacugcaguacc

SEQ ID NO: 127643 - RNA, 17 nt, Human
agccgggcauggaccag

SEQ ID NO: 127644 - RNA, 20 nt, Human
aggaaaaggguggugguaga

SEQ ID NO: 127645 - RNA, 22 nt, Human
gccacccugagcugggccaggg

SEQ ID NO: 127646 - RNA, 22 nt, Human
aagccaguccucuacugggcac

SEQ ID NO: 127647 - RNA, 22 nt, Human
uggaggcaguuuaagucugaga

SEQ ID NO: 127648 - RNA, 22 nt, Human
gagaagguggaccugaaggagc

SEQ ID NO: 127649 - RNA, 22 nt, Human
uagggcuguuuaaaagugaggu

SEQ ID NO: 127650 - RNA, 22 nt, Human
agcagggcagguaaggaucaga

SEQ ID NO: 127651 - RNA, 22 nt, Human
gaggagaagcuaagaaacacag

SEQ ID NO: 127652 - RNA, 22 nt, Human
ugcuguggcaguuuauguauag

SEQ ID NO: 127653 - RNA, 22 nt, Human
aggcccagagagccaguuagug

SEQ ID NO: 127654 - RNA, 22 nt, Human
gcaggcagagucaauuugaucc

SEQ ID NO: 127655 - RNA, 21 nt, Human
ccagcugucuguccuuaggca

SEQ ID NO: 127656 - RNA, 17 nt, Human
gcugagaggcagcacag

SEQ ID NO: 127657 - RNA, 22 nt, Human
agggcagaccacgugcaaggau

SEQ ID NO: 127658 - RNA, 22 nt, Human
agugcaaaauucagaagcaauu

SEQ ID NO: 127659 - RNA, 20 nt, Human
agcaccagugggggcagccc

SEQ ID NO: 127660 - RNA, 22 nt, Human
uccaggcaagggaggagcaugg

SEQ ID NO: 127661 - RNA, 22 nt, Human
agggaggugguuccccagugga

SEQ ID NO: 127662 - RNA, 22 nt, Human
agggaagugaaugacagauauc

SEQ ID NO: 127663 - RNA, 22 nt, Human
ggugucuguugccuccugguua

SEQ ID NO: 127664 - RNA, 22 nt, Human
gagggcuguggggcaugaccag

SEQ ID NO: 127665 - RNA, 22 nt, Human
ggcagccaugcacgcugccugg

SEQ ID NO: 127666 - RNA, 22 nt, Human
gaggaaacauuguagaagcagu

SEQ ID NO: 127667 - RNA, 22 nt, Human
agugcagagaccuggucaggca

SEQ ID NO: 127668 - RNA, 22 nt, Human
ucagggcacaggccuguggguu

SEQ ID NO: 127669 - RNA, 22 nt, Human
cagaggcagaauggagauuugg

SEQ ID NO: 127670 - RNA, 22 nt, Human
gcuccucuucucccacugaaug

SEQ ID NO: 127671 - RNA, 22 nt, Human
gaggcucacgacgggacgaacu

SEQ ID NO: 127672 - RNA, 22 nt, Human
gccaggcauguccucugcagaa

SEQ ID NO: 127673 - RNA, 22 nt, Human
ugaggcuuagagaagaugggau

SEQ ID NO: 127674 - RNA, 22 nt, Human
uaggcuggaggaagcagugccu

SEQ ID NO: 127675 - RNA, 22 nt, Human
cacacacaguuuuguauucugu

SEQ ID NO: 127676 - RNA, 22 nt, Human
acagcuguggccacuugcaucc

SEQ ID NO: 127677 - RNA, 22 nt, Human
caggaggcccaaagggcgcaga

SEQ ID NO: 127678 - RNA, 22 nt, Human
aggcagggugaugauaaugauu

SEQ ID NO: 127679 - RNA, 23 nt, Human
uggcugagcccacuaucuuggcc

SEQ ID NO: 127680 - RNA, 22 nt, Human
ggcaggcaagucugcucuguga

SEQ ID NO: 127681 - RNA, 22 nt, Human
cuccacagccccuccaguggca

SEQ ID NO: 127682 - RNA, 22 nt, Human
gcaggcagucaucuuucauauu

SEQ ID NO: 127683 - RNA, 22 nt, Human
ugccaggcauguaguagacuug

SEQ ID NO: 127684 - RNA, 22 nt, Human
gccaccaggagcccaguccaaa

SEQ ID NO: 127685 - RNA, 22 nt, Human
caggagccgccaggcacguugg

SEQ ID NO: 127686 - RNA, 22 nt, Human
gaggaggaggaaguggaaccca

SEQ ID NO: 127687 - RNA, 22 nt, Human
caaaugcauagaaagaugaaac

SEQ ID NO: 127688 - RNA, 22 nt, Human
cagggcagggagcuuagaauga

SEQ ID NO: 127689 - RNA, 22 nt, Human
ucagggcaaagggcagaguuug

SEQ ID NO: 127690 - RNA, 22 nt, Human
cugugaccuccaggaaggggug

SEQ ID NO: 127691 - RNA, 22 nt, Human
uaagccacuagucuguuaugaa

SEQ ID NO: 127692 - RNA, 22 nt, Human
ucagaggagaccaaggggaaua

SEQ ID NO: 127693 - RNA, 22 nt, Human
aggcaggaacccugugugcgcc

SEQ ID NO: 127694 - RNA, 22 nt, Human
agcaggaacgaguucaugggga

SEQ ID NO: 127695 - RNA, 22 nt, Human
ugaggcaggagaaucacaugaa

SEQ ID NO: 127696 - RNA, 22 nt, Human
aggcucagcaucugauucauau

SEQ ID NO: 127697 - RNA, 22 nt, Human
gcagggcagcuuagucccuguc

SEQ ID NO: 127698 - RNA, 20 nt, Human
cagaggcauuuucagacucu

SEQ ID NO: 127699 - RNA, 22 nt, Human
ucacuccucauugcugcccauu

SEQ ID NO: 127700 - RNA, 22 nt, Human
auucauuccaggucagucagac

SEQ ID NO: 127701 - RNA, 22 nt, Human
uggcugaggcuggagugcagug

SEQ ID NO: 127702 - RNA, 22 nt, Human
gggcagagagcuggaacuccuu

SEQ ID NO: 127703 - RNA, 22 nt, Human
ugccaggcucagccccuaucuu

SEQ ID NO: 127704 - RNA, 22 nt, Human
gaggcaggcagauugcuugagg

SEQ ID NO: 127705 - RNA, 18 nt, Human
uguggcaggggugggaga

SEQ ID NO: 127706 - RNA, 22 nt, Human
aggcgcagaaggccaggggccu

SEQ ID NO: 127707 - RNA, 22 nt, Human
ugcagggcccuugggguugaac

SEQ ID NO: 127708 - RNA, 22 nt, Human
cagggcagagggaaacuccuuu

SEQ ID NO: 127709 - RNA, 22 nt, Human
agggaaggaaaagcugucgcuu

SEQ ID NO: 127710 - RNA, 22 nt, Human
agggaggaaggauguuccaaag

SEQ ID NO: 127711 - RNA, 22 nt, Human
uucacaaagcuggagcauuucc

SEQ ID NO: 127712 - RNA, 22 nt, Human
aggcugaggugugcugugaucg

SEQ ID NO: 127713 - RNA, 22 nt, Human
caguucaggccggcugacucag

SEQ ID NO: 127714 - RNA, 22 nt, Human
uagagcugggcagugcucugag

SEQ ID NO: 127715 - RNA, 22 nt, Human
augggcagacagggagcucacg

SEQ ID NO: 127716 - RNA, 22 nt, Human
uuauuauugugaccugagaaug

SEQ ID NO: 127717 - RNA, 22 nt, Human
aggcugagagcaacgugucaga

SEQ ID NO: 127718 - RNA, 22 nt, Human
ggcugcaggcaggguauccacu

SEQ ID NO: 127719 - RNA, 22 nt, Human
cuccagggcagcauggcagugg

SEQ ID NO: 127720 - RNA, 22 nt, Human
accugagaccuaaucugacugu

SEQ ID NO: 127721 - RNA, 22 nt, Human
gcacacacaugugaguacaugc

SEQ ID NO: 127722 - RNA, 22 nt, Human
acccaggagccgugagagguua

SEQ ID NO: 127723 - RNA, 22 nt, Human
gccagguggagguugcagugag

SEQ ID NO: 127724 - RNA, 22 nt, Human
ugaggcagguaagcaaguuuug

SEQ ID NO: 127725 - RNA, 22 nt, Human
ugucuucaguaaaauacacuau

SEQ ID NO: 127726 - RNA, 22 nt, Human
ugcuggaggcaguggaggugcc

SEQ ID NO: 127727 - RNA, 22 nt, Human
cugccaggggccucacaggcca

SEQ ID NO: 127728 - RNA, 23 nt, Human
agaggcaggaguggcuugcccgg

SEQ ID NO: 127729 - RNA, 22 nt, Human
auccagggauaaaaguaagguu

SEQ ID NO: 127730 - RNA, 22 nt, Human
ugaggcuugucucagauggggg

SEQ ID NO: 127731 - RNA, 22 nt, Human
ucaguggauuguagaaggcuua

SEQ ID NO: 127732 - RNA, 22 nt, Human
agcaugaaaggcgugccaacuu

SEQ ID NO: 127733 - RNA, 22 nt, Human
agaguccagaaaacagugugcu

SEQ ID NO: 127734 - RNA, 22 nt, Human
acaggcugcccgcuccccaccu

SEQ ID NO: 127735 - RNA, 22 nt, Human
uggcagaguucgcuccuauuca

SEQ ID NO: 127736 - RNA, 22 nt, Human
ccuggccagaggcgugccugug

SEQ ID NO: 127737 - RNA, 22 nt, Human
ggagucaccaaguaggagucuu

SEQ ID NO: 127738 - RNA, 22 nt, Human
aggggcaguuccaaguuuugug

SEQ ID NO: 127739 - RNA, 22 nt, Human
caaaugcauaguuuauaagaag

SEQ ID NO: 127740 - RNA, 22 nt, Human
gcuggcagagagcuggugagga

SEQ ID NO: 127741 - RNA, 21 nt, Human
ucagggcagugggagguuccu

SEQ ID NO: 127742 - RNA, 22 nt, Human
ggcucaccauuuucacucucug

SEQ ID NO: 127743 - RNA, 20 nt, Human
uuggucagugguucaguuug

SEQ ID NO: 127744 - RNA, 22 nt, Human
cuuccccaaccccgacugugug

SEQ ID NO: 127745 - RNA, 22 nt, Human
agcuguggggcaggcagcgagg

SEQ ID NO: 127746 - RNA, 22 nt, Human
caucaucaaaagugacagagaa

SEQ ID NO: 127747 - RNA, 22 nt, Human
gaggcucacuuucauccucuuc

SEQ ID NO: 127748 - RNA, 22 nt, Human
uuccagcuaacucacaucccuu

SEQ ID NO: 127749 - RNA, 22 nt, Human
gcauggcauuugaagguagaag

SEQ ID NO: 127750 - RNA, 22 nt, Human
ucacagcuaagcuuggucacug

SEQ ID NO: 127751 - RNA, 22 nt, Human
ccaagggaaaccgagaggcugg

SEQ ID NO: 127752 - RNA, 22 nt, Human
uggaagugcucuucugaccaac

SEQ ID NO: 127753 - RNA, 22 nt, Human
cugagagaaucaugcugcaggu

SEQ ID NO: 127754 - RNA, 22 nt, Human
gaagaaggugccagaggcuuac

SEQ ID NO: 127755 - RNA, 22 nt, Human
acuugguugaugucauaagguu

SEQ ID NO: 127756 - RNA, 22 nt, Human
ccaucccuccuccaccagcuag

SEQ ID NO: 127757 - RNA, 22 nt, Human
ccccuuccuuccucagacagcc

SEQ ID NO: 127758 - RNA, 22 nt, Human
caaaagaagcucuuggggcuag

SEQ ID NO: 127759 - RNA, 22 nt, Human
gaagccacuauagauauucuaa

SEQ ID NO: 127760 - RNA, 18 nt, Human
ccagagcuggcuccucgc

SEQ ID NO: 127761 - RNA, 22 nt, Human
ggagccugcgggagcucccauu

SEQ ID NO: 127762 - RNA, 22 nt, Human
cccaggacucuucacugcagcc

SEQ ID NO: 127763 - RNA, 22 nt, Human
ggcuguggggccggguacagug

SEQ ID NO: 127764 - RNA, 22 nt, Human
aggcugaggcggguagaucacc

SEQ ID NO: 127765 - RNA, 21 nt, Human
ccagccucagaucagggagcu

SEQ ID NO: 127766 - RNA, 22 nt, Human
aagggcuggaauaucucuuaga

SEQ ID NO: 127767 - RNA, 22 nt, Human
uugggacagaaaaggagaagau

SEQ ID NO: 127768 - RNA, 18 nt, Human
agaagccacgaggagucc

SEQ ID NO: 127769 - RNA, 22 nt, Human
uccaggcuaauuuugcauuguu

SEQ ID NO: 127770 - RNA, 22 nt, Human
aggugucuucagggugagacag

SEQ ID NO: 127771 - RNA, 22 nt, Human
caggcagcuagauuuauaacaa

SEQ ID NO: 127772 - RNA, 22 nt, Human
ugcccaggauugugaggucagg

SEQ ID NO: 127773 - RNA, 22 nt, Human
uggcagggucuugcuguguugc

SEQ ID NO: 127774 - RNA, 22 nt, Human
uggcugaggcacagcugccgcc

SEQ ID NO: 127775 - RNA, 22 nt, Human
ucacucagguucaugucuuugu

SEQ ID NO: 127776 - RNA, 22 nt, Human
ugcagggccuugggucuuucuu

SEQ ID NO: 127777 - RNA, 17 nt, Human
ucaggcugggugcagug

SEQ ID NO: 127778 - RNA, 22 nt, Human
ucaggcugcccguucagggcuc

SEQ ID NO: 127779 - RNA, 22 nt, Human
ccucacuggccagccaggggug

SEQ ID NO: 127780 - RNA, 22 nt, Human
cagcuguggagggaggaaaugc

SEQ ID NO: 127781 - RNA, 22 nt, Human
cagagcuggagaaguggauuua

SEQ ID NO: 127782 - RNA, 22 nt, Human
aagggcugggucugguuaaccc

SEQ ID NO: 127783 - RNA, 22 nt, Human
gggcugaaaggccgccucagau

SEQ ID NO: 127784 - RNA, 22 nt, Human
uuccucagccaaggcugggauc

SEQ ID NO: 127785 - RNA, 22 nt, Human
ccaccaggacagcccugagggg

SEQ ID NO: 127786 - RNA, 22 nt, Human
aggcucagauccuuguguccug

SEQ ID NO: 127787 - RNA, 22 nt, Human
aggcucaggugccucauucaca

SEQ ID NO: 127788 - RNA, 22 nt, Human
caggguagacaguaggugucug

SEQ ID NO: 127789 - RNA, 22 nt, Human
uccuggcccuguggccugcagu

SEQ ID NO: 127790 - RNA, 22 nt, Human
cuucaguuuaucccaucaucca

SEQ ID NO: 127791 - RNA, 22 nt, Human
aaggaggagcggaggcuuguug

SEQ ID NO: 127792 - RNA, 22 nt, Human
gccaguggucacugaggaagaa

SEQ ID NO: 127793 - RNA, 22 nt, Human
agccuggcuaaauucucccaug

SEQ ID NO: 127794 - RNA, 22 nt, Human
guggggcaguggccugggagca

SEQ ID NO: 127795 - RNA, 20 nt, Human
ugcagggccuaaaaagggaa

SEQ ID NO: 127796 - RNA, 22 nt, Human
ucugggagauccaagcagaacu

SEQ ID NO: 127797 - RNA, 22 nt, Human
gcagacagccagacugcacugg

SEQ ID NO: 127798 - RNA, 22 nt, Human
accgggaaguccugcacugggc

SEQ ID NO: 127799 - RNA, 22 nt, Human
ggagaagccacacauugggugu

SEQ ID NO: 127800 - RNA, 22 nt, Human
caccagggcagcagccuagucu

SEQ ID NO: 127801 - RNA, 22 nt, Human
ucagggcagccuaaggcaccuc

SEQ ID NO: 127802 - RNA, 22 nt, Human
caggcccauucuaggcuugcua

SEQ ID NO: 127803 - RNA, 22 nt, Human
uauuuccaagcugaauccaaug

SEQ ID NO: 127804 - RNA, 22 nt, Human
gucaccagcaccaaugccacau

SEQ ID NO: 127805 - RNA, 22 nt, Human
agagaaggucacuaaggaccca

SEQ ID NO: 127806 - RNA, 21 nt, Human
caaagccaggcaacucucucc

SEQ ID NO: 127807 - RNA, 22 nt, Human
ugaagccacagagcaucugccu

SEQ ID NO: 127808 - RNA, 22 nt, Human
uaggcagaaaggaaggcaaguu

SEQ ID NO: 127809 - RNA, 22 nt, Human
cagugcaggcugggggcccugc

SEQ ID NO: 127810 - RNA, 22 nt, Human
ccaguggaaauguggucaggau

SEQ ID NO: 127811 - RNA, 22 nt, Human
gccagguguaguggccacaccu

SEQ ID NO: 127812 - RNA, 21 nt, Human
ggagaaggacaauguugagua

SEQ ID NO: 127813 - RNA, 22 nt, Human
gccuggagaagauggaacuagc

SEQ ID NO: 127814 - RNA, 22 nt, Human
ugaccugcagucaagaggggaa

SEQ ID NO: 127815 - RNA, 22 nt, Human
uccuguggcguuaucaugugau

SEQ ID NO: 127816 - RNA, 21 nt, Human
aggaaguggccagauugggaa

SEQ ID NO: 127817 - RNA, 22 nt, Human
ugugaccucaucuuaacuggaa

SEQ ID NO: 127818 - RNA, 22 nt, Human
augcugaagagugcacaggcua

SEQ ID NO: 127819 - RNA, 22 nt, Human
gggagaaggaggacugugcugu

SEQ ID NO: 127820 - RNA, 22 nt, Human
ucugaagggcugaguggaggag

SEQ ID NO: 127821 - RNA, 22 nt, Human
uugcagagcaguaggaauauag

SEQ ID NO: 127822 - RNA, 22 nt, Human
agggcugccugacuccagagcc

SEQ ID NO: 127823 - RNA, 22 nt, Human
cgaggcaggcaggcggaggaua

SEQ ID NO: 127824 - RNA, 22 nt, Human
cagagcugcagauugaaggcau

SEQ ID NO: 127825 - RNA, 22 nt, Human
aggagggagcuuaagccaggca

SEQ ID NO: 127826 - RNA, 22 nt, Human
acagaggaagcauauagcacaa

SEQ ID NO: 127827 - RNA, 18 nt, Human
cugucaccgccaccacac

SEQ ID NO: 127828 - RNA, 22 nt, Human
ccagagcuccagggcuacagaa

SEQ ID NO: 127829 - RNA, 22 nt, Human
uggcagaggaggcucagauuga

SEQ ID NO: 127830 - RNA, 22 nt, Human
acuuccaaauaccaucacauug

SEQ ID NO: 127831 - RNA, 22 nt, Human
ugagcaguaacagcucacaggg

SEQ ID NO: 127832 - RNA, 22 nt, Human
cucccuggcuuuguccugaggc

SEQ ID NO: 127833 - RNA, 22 nt, Human
agguguguauaaacauacauau

SEQ ID NO: 127834 - RNA, 23 nt, Human
uugaaagguagcuggcagcuaga

SEQ ID NO: 127835 - RNA, 22 nt, Human
agcagaggaggauuuaguuagg

SEQ ID NO: 127836 - RNA, 22 nt, Human
aguggcaggcagaagcuucuca

SEQ ID NO: 127837 - RNA, 22 nt, Human
augcugugucaggaauuugaua

SEQ ID NO: 127838 - RNA, 22 nt, Human
uggaggaaguugcuggaaguca

SEQ ID NO: 127839 - RNA, 22 nt, Human
gcaccugggguacacagcuaca

SEQ ID NO: 127840 - RNA, 22 nt, Human
accagaguaauguguggaaauu

SEQ ID NO: 127841 - RNA, 20 nt, Human
cugcccagccacugagggau

SEQ ID NO: 127842 - RNA, 22 nt, Human
ccugcucagccccagcucaccc

SEQ ID NO: 127843 - RNA, 22 nt, Human
cuccagggaggagcacggguuc

SEQ ID NO: 127844 - RNA, 22 nt, Human
auuuccaccggcucaggaaguu

SEQ ID NO: 127845 - RNA, 22 nt, Human
ccagggcuccauugcucauccu

SEQ ID NO: 127846 - RNA, 22 nt, Human
ugcagggcuccuggcuccaauc

SEQ ID NO: 127847 - RNA, 22 nt, Human
aucgagggugaguacagcggac

SEQ ID NO: 127848 - RNA, 22 nt, Human
cgcccagggcaggaggccgcuc

SEQ ID NO: 127849 - RNA, 22 nt, Human
cucagaagaacccaggguccca

SEQ ID NO: 127850 - RNA, 22 nt, Human
aggugcaggagcugugcaggga

SEQ ID NO: 127851 - RNA, 16 nt, Human
gccuggaguggcaggg

SEQ ID NO: 127852 - RNA, 20 nt, Human
aagggagaauaaugauugua

SEQ ID NO: 127853 - RNA, 22 nt, Human
ccugggcagugcuggaguugaa

SEQ ID NO: 127854 - RNA, 22 nt, Human
aaggugucggguuagcucagcc

SEQ ID NO: 127855 - RNA, 22 nt, Human
gcaguggaagccucuuuaagca

SEQ ID NO: 127856 - RNA, 20 nt, Human
ccagguggugccuggagagg

SEQ ID NO: 127857 - RNA, 22 nt, Human
aaggcugcuuuuaacaugcaua

SEQ ID NO: 127858 - RNA, 22 nt, Human
ucaggcugccuaucagacugug

SEQ ID NO: 127859 - RNA, 22 nt, Human
aagugccugaccuagccuggag

SEQ ID NO: 127860 - RNA, 20 nt, Human
aggcugagggugauuguguc

SEQ ID NO: 127861 - RNA, 20 nt, Human
agggcagcuugaggagccgg

SEQ ID NO: 127862 - RNA, 17 nt, Human
gacaggcucagugacga

SEQ ID NO: 127863 - RNA, 22 nt, Human
ccacugcccccugaagaccagg

SEQ ID NO: 127864 - RNA, 22 nt, Human
acacuucuauucccugcacaaa

SEQ ID NO: 127865 - RNA, 22 nt, Human
aggccucaggaagguaaagaag

SEQ ID NO: 127866 - RNA, 20 nt, Human
uccugguggauacugcuuaa

SEQ ID NO: 127867 - RNA, 22 nt, Human
caguggagaggcaugcuuggca

SEQ ID NO: 127868 - RNA, 17 nt, Human
agcugagcuggccaggg

SEQ ID NO: 127869 - RNA, 23 nt, Human
cagugugacgaggugaggcaggc

SEQ ID NO: 127870 - RNA, 22 nt, Human
ggagcugugcugggugaucagg

SEQ ID NO: 127871 - RNA, 22 nt, Human
ggcaggucagguccaugaccaa

SEQ ID NO: 127872 - RNA, 22 nt, Human
caggggaaggagccuugaaacu

SEQ ID NO: 127873 - RNA, 22 nt, Human
ggagaugcuuuccaguggggau

SEQ ID NO: 127874 - RNA, 18 nt, Human
cagcugccagcucaugga

SEQ ID NO: 127875 - RNA, 22 nt, Human
acaguggaauuuguagaugugu

SEQ ID NO: 127876 - RNA, 22 nt, Human
gccagcagccacagaagucacu

SEQ ID NO: 127877 - RNA, 22 nt, Human
ucagaagguggagguugcagug

SEQ ID NO: 127878 - RNA, 22 nt, Human
aggcagagcuggguuuugaaau

SEQ ID NO: 127879 - RNA, 22 nt, Human
agguggagugaaggaaaggcag

SEQ ID NO: 127880 - RNA, 23 nt, Human
aggcagcagguuguccaggguga

SEQ ID NO: 127881 - RNA, 22 nt, Human
ugggcagggaucucuuuugcaa

SEQ ID NO: 127882 - RNA, 22 nt, Human
aagagccagugggaaagucuug

SEQ ID NO: 127883 - RNA, 22 nt, Human
auuccaaaggcuggccuggagg

SEQ ID NO: 127884 - RNA, 22 nt, Human
acaggcagguugagaaacauuu

SEQ ID NO: 127885 - RNA, 22 nt, Human
agccuggcacugccccauccau

SEQ ID NO: 127886 - RNA, 22 nt, Human
uaaaaucauucuggugucagua

SEQ ID NO: 127887 - RNA, 22 nt, Human
cugugcaguggcagcguguggg

SEQ ID NO: 127888 - RNA, 22 nt, Human
gagcugagaucgugccauugca

SEQ ID NO: 127889 - RNA, 22 nt, Human
agggccugggccagcacccuuu

SEQ ID NO: 127890 - RNA, 22 nt, Human
uuuaccaaauagauuaugucag

SEQ ID NO: 127891 - RNA, 22 nt, Human
auggcagggcagccucucagag

SEQ ID NO: 127892 - RNA, 22 nt, Human
acaggcuggugguccuggccau

SEQ ID NO: 127893 - RNA, 22 nt, Human
agggcagugggaaagccugcuc

SEQ ID NO: 127894 - RNA, 22 nt, Human
gguguccucaugauuuucuaga

SEQ ID NO: 127895 - RNA, 22 nt, Human
ggggcagggagguuaucgccga

SEQ ID NO: 127896 - RNA, 22 nt, Human
acuguggcucaucaggcuggug

SEQ ID NO: 127897 - RNA, 22 nt, Human
ccuggaggcucugggagggcag

SEQ ID NO: 127898 - RNA, 22 nt, Human
cagucacuggaauagcugagga

SEQ ID NO: 127899 - RNA, 22 nt, Human
aagcagaauuuaauagaaaggu

SEQ ID NO: 127900 - RNA, 22 nt, Human
acagggcaugugcaagagacau

SEQ ID NO: 127901 - RNA, 22 nt, Human
ggaggcagaauagagugugggu

SEQ ID NO: 127902 - RNA, 22 nt, Human
agcugccucagcaacacagacc

SEQ ID NO: 127903 - RNA, 21 nt, Human
auggagucaggggaaugggcc

SEQ ID NO: 127904 - RNA, 20 nt, Human
aggcucagauacccagggaa

SEQ ID NO: 127905 - RNA, 22 nt, Human
caugagaaguggccuucaaaaa

SEQ ID NO: 127906 - RNA, 22 nt, Human
ccuggccagccagggcuggggu

SEQ ID NO: 127907 - RNA, 23 nt, Human
cuggaagugcuuuuauagcuuug

SEQ ID NO: 127908 - RNA, 22 nt, Human
ggagcagccacgucucagggca

SEQ ID NO: 127909 - RNA, 21 nt, Human
ugacauuuccaauauaaagcc

SEQ ID NO: 127910 - RNA, 22 nt, Human
gggcugagaaguugaucccaag

SEQ ID NO: 127911 - RNA, 20 nt, Human
cuuguacaugauaaagauuu

SEQ ID NO: 127912 - RNA, 22 nt, Human
uggcugagaccaucagggugua

SEQ ID NO: 127913 - RNA, 23 nt, Human
cagaagcaccuguugacugcugc

SEQ ID NO: 127914 - RNA, 22 nt, Human
cagcagugucuccagcaucaca

SEQ ID NO: 127915 - RNA, 22 nt, Human
ggggaggaagcuggaacacggg

SEQ ID NO: 127916 - RNA, 22 nt, Human
ugggcaggugcuauuuuccaug

SEQ ID NO: 127917 - RNA, 23 nt, Human
agugcugaauugaaagcuccagg

SEQ ID NO: 127918 - RNA, 19 nt, Human
aggagaaguagcagaaauu

SEQ ID NO: 127919 - RNA, 22 nt, Human
aucaggaaauacuuauuuauaa

SEQ ID NO: 127920 - RNA, 22 nt, Human
ggcuagaguggaacuggagcgg

SEQ ID NO: 127921 - RNA, 22 nt, Human
gggcaugagagggcagcuggca

SEQ ID NO: 127922 - RNA, 22 nt, Human
uagcagagaggggacaguggca

SEQ ID NO: 127923 - RNA, 22 nt, Human
gcagucaguaaggcagccagaa

SEQ ID NO: 127924 - RNA, 22 nt, Human
uagagcuggaaaacugcaggua

SEQ ID NO: 127925 - RNA, 22 nt, Human
caaaggcugccacuguggcugu

SEQ ID NO: 127926 - RNA, 22 nt, Human
aggacccugaggucuccuguga

SEQ ID NO: 127927 - RNA, 22 nt, Human
cagugcagguuuagggcugggg

SEQ ID NO: 127928 - RNA, 22 nt, Human
ucaccccuacauuucccuugcu

SEQ ID NO: 127929 - RNA, 22 nt, Human
ccuggccaggcauggagucaca

SEQ ID NO: 127930 - RNA, 20 nt, Human
aaaagcagccagagauggua

SEQ ID NO: 127931 - RNA, 22 nt, Human
guggaggacaaaagaagccuuu

SEQ ID NO: 127932 - RNA, 22 nt, Human
ccaggacccugcaaacccuguu

SEQ ID NO: 127933 - RNA, 22 nt, Human
gaggccaggguaccaucaacau

SEQ ID NO: 127934 - RNA, 22 nt, Human
gggcugagugucccaggccgaa

SEQ ID NO: 127935 - RNA, 22 nt, Human
aagggcugcaauccaaaacacu

SEQ ID NO: 127936 - RNA, 22 nt, Human
gggcugagucaucuggggccuc

SEQ ID NO: 127937 - RNA, 21 nt, Human
agggucaggaaccaggguacc

SEQ ID NO: 127938 - RNA, 22 nt, Human
uagcuguguagacacucagagc

SEQ ID NO: 127939 - RNA, 22 nt, Human
guggcagguuauaagcaucuca

SEQ ID NO: 127940 - RNA, 22 nt, Human
ugaguccauugauggauaguga

SEQ ID NO: 127941 - RNA, 22 nt, Human
gcauggcaagaucaggagacca

SEQ ID NO: 127942 - RNA, 22 nt, Human
agcugacucuggccucuggucc

SEQ ID NO: 127943 - RNA, 22 nt, Human
ucagcccugggacccagggaug

SEQ ID NO: 127944 - RNA, 22 nt, Human
aagacaugcaauuagcaaggaa

SEQ ID NO: 127945 - RNA, 22 nt, Human
aaagccagcaaggugaguuuca

SEQ ID NO: 127946 - RNA, 22 nt, Human
agggcaguguggugggacugac

SEQ ID NO: 127947 - RNA, 22 nt, Human
aggcugugcacagggcaccugc

SEQ ID NO: 127948 - RNA, 19 nt, Human
agaggcagucuccaacagg

SEQ ID NO: 127949 - RNA, 22 nt, Human
gagagcuguguucauucuacca

SEQ ID NO: 127950 - RNA, 22 nt, Human
cuguggcauugccgaggcuggc

SEQ ID NO: 127951 - RNA, 22 nt, Human
uggcagagguaauucaaauccc

SEQ ID NO: 127952 - RNA, 20 nt, Human
cgcccaggagggcccaugug

SEQ ID NO: 127953 - RNA, 22 nt, Human
gcaggcagaucaccugucagga

SEQ ID NO: 127954 - RNA, 22 nt, Human
uuguccaaggucccacaguuag

SEQ ID NO: 127955 - RNA, 22 nt, Human
ucccaggcaaaggcagcucauu

SEQ ID NO: 127956 - RNA, 22 nt, Human
agcugcccuuaauaggcauuca

SEQ ID NO: 127957 - RNA, 22 nt, Human
agcagggcucacauuaguggau

SEQ ID NO: 127958 - RNA, 22 nt, Human
uggcugaggcuuuucuuaaaga

SEQ ID NO: 127959 - RNA, 22 nt, Human
ggaggcacuucccgucucagcc

SEQ ID NO: 127960 - RNA, 22 nt, Human
gaagaagguggcccagggguag

SEQ ID NO: 127961 - RNA, 22 nt, Human
uguguugugacauucuuggaug

SEQ ID NO: 127962 - RNA, 22 nt, Human
uaguggagguggucugugaacu

SEQ ID NO: 127963 - RNA, 22 nt, Human
gccuggagaggaagccggugga

SEQ ID NO: 127964 - RNA, 22 nt, Human
cugucuccagggcaggugcagg

SEQ ID NO: 127965 - RNA, 22 nt, Human
aaagccacugcauguguaguau

SEQ ID NO: 127966 - RNA, 22 nt, Human
ccaggugugcucugcaguggau

SEQ ID NO: 127967 - RNA, 21 nt, Human
agaugcugugcuccaggagca

SEQ ID NO: 127968 - RNA, 22 nt, Human
augucuuuuaugauuacgggau

SEQ ID NO: 127969 - RNA, 22 nt, Human
cagggcagagccaggauuucaa

SEQ ID NO: 127970 - RNA, 22 nt, Human
gagaggagguggcuaugacagc

SEQ ID NO: 127971 - RNA, 22 nt, Human
acaaaggcagagaauucaacau

SEQ ID NO: 127972 - RNA, 22 nt, Human
aggagaaguaaggcuagaugau

SEQ ID NO: 127973 - RNA, 22 nt, Human
gccuggaguagcauggcaagcc

SEQ ID NO: 127974 - RNA, 22 nt, Human
ucaaaggcccauugucccguug

SEQ ID NO: 127975 - RNA, 22 nt, Human
ucucccaguggugcagaaagca

SEQ ID NO: 127976 - RNA, 20 nt, Human
cugcuguguuauuguagaac

SEQ ID NO: 127977 - RNA, 22 nt, Human
uagggcagagcuuguacacgau

SEQ ID NO: 127978 - RNA, 22 nt, Human
gcaggguccauggaggcagccc

SEQ ID NO: 127979 - RNA, 22 nt, Human
uuccagaauuuuguucugcuug

SEQ ID NO: 127980 - RNA, 22 nt, Human
aggcugaugcuggcugaggcug

SEQ ID NO: 127981 - RNA, 22 nt, Human
gaaggcugcgaggggagugccg

SEQ ID NO: 127982 - RNA, 22 nt, Human
cagggcaguaacgggaacaucu

SEQ ID NO: 127983 - RNA, 22 nt, Human
agcaggaacucagggaguucuc

SEQ ID NO: 127984 - RNA, 22 nt, Human
agcgugaaggcgggcagucggc

SEQ ID NO: 127985 - RNA, 22 nt, Human
agggaguuccgaucugugcacc

SEQ ID NO: 127986 - RNA, 22 nt, Human
aggcugaggcagguggaucacc

SEQ ID NO: 127987 - RNA, 22 nt, Human
agaggaggcagcuuaacucagu

SEQ ID NO: 127988 - RNA, 22 nt, Human
gaugaggcucaugcacccugcg

SEQ ID NO: 127989 - RNA, 22 nt, Human
gaggcagagacuccaccuucag

SEQ ID NO: 127990 - RNA, 22 nt, Human
aggcccaguccucugccgucug

SEQ ID NO: 127991 - RNA, 22 nt, Human
guucaaggaagggaggaaagcc

SEQ ID NO: 127992 - RNA, 22 nt, Human
gccugagaaggacacagcaggu

SEQ ID NO: 127993 - RNA, 22 nt, Human
gaagccacccuccuuccagccc

SEQ ID NO: 127994 - RNA, 22 nt, Human
gggcugagaauucagcuuuccu

SEQ ID NO: 127995 - RNA, 22 nt, Human
cugagagguaagcagcgcagug

SEQ ID NO: 127996 - RNA, 18 nt, Human
gggaagccgggaagccgg

SEQ ID NO: 127997 - RNA, 22 nt, Human
guguuuggucagacguccgggg

SEQ ID NO: 127998 - RNA, 22 nt, Human
caaaggcuuccacugcauccuu

SEQ ID NO: 127999 - RNA, 22 nt, Human
ugaaggcacuugccuaggggca

SEQ ID NO: 128000 - RNA, 22 nt, Human
agcuggugcucaggggcaugga

SEQ ID NO: 128001 - RNA, 22 nt, Human
agagcugaggauccagcugagc

SEQ ID NO: 128002 - RNA, 22 nt, Human
caggcagagaggagcauuuaau

SEQ ID NO: 128003 - RNA, 22 nt, Human
cagcugagaaauggggaaaggg

SEQ ID NO: 128004 - RNA, 22 nt, Human
gggcuguaggagcuggaauggg

SEQ ID NO: 128005 - RNA, 21 nt, Human
cagagcuguccaaacccugac

SEQ ID NO: 128006 - RNA, 21 nt, Human
agacagagugcagucuacaua

SEQ ID NO: 128007 - RNA, 22 nt, Human
ucaggcugaggucaucugcauc

SEQ ID NO: 128008 - RNA, 22 nt, Human
aaagccacguggccuggggagc

SEQ ID NO: 128009 - RNA, 22 nt, Human
ugccaggcacgugagaguggcc

SEQ ID NO: 128010 - RNA, 21 nt, Human
aagccagcccacagugguuug

SEQ ID NO: 128011 - RNA, 22 nt, Human
caggcugggcuccggagauaaa

SEQ ID NO: 128012 - RNA, 22 nt, Human
agaagccagucgcucucccgca

SEQ ID NO: 128013 - RNA, 22 nt, Human
agggccagcacuccuggcagga

SEQ ID NO: 128014 - RNA, 22 nt, Human
cacagcugugagaagggagccu

SEQ ID NO: 128015 - RNA, 17 nt, Human
cagucgaggaggaccug

SEQ ID NO: 128016 - RNA, 22 nt, Human
cagggccagccauccugcuggg

SEQ ID NO: 128017 - RNA, 22 nt, Human
gacaggcuuccuaagugccaga

SEQ ID NO: 128018 - RNA, 21 nt, Human
aggagggcacaaggccaggaa

SEQ ID NO: 128019 - RNA, 22 nt, Human
aggucaggguauucacgucugu

SEQ ID NO: 128020 - RNA, 22 nt, Human
ggcagaggagcuggaaacaugg

SEQ ID NO: 128021 - RNA, 23 nt, Human
ucagaggaucaucaaacguuuuc

SEQ ID NO: 128022 - RNA, 22 nt, Human
agcugcagcguucauuuuucca

SEQ ID NO: 128023 - RNA, 22 nt, Human
ggcagaggugacagugucuuuu

SEQ ID NO: 128024 - RNA, 22 nt, Human
ggagcugucuguagggcacagg

SEQ ID NO: 128025 - RNA, 22 nt, Human
aucugaagggaaguggaaggca

SEQ ID NO: 128026 - RNA, 22 nt, Human
augaggcaaucaugguccaguu

SEQ ID NO: 128027 - RNA, 22 nt, Human
cuguugucuucauugucauauc

SEQ ID NO: 128028 - RNA, 22 nt, Human
cugcagugcaagcccagaugga

SEQ ID NO: 128029 - RNA, 22 nt, Human
uaggcuggaacuuaggcagagg

SEQ ID NO: 128030 - RNA, 22 nt, Human
caggcagaguuagugauuuagg

SEQ ID NO: 128031 - RNA, 22 nt, Human
gagucugagaacugggcucagu

SEQ ID NO: 128032 - RNA, 22 nt, Human
ucuccccaaaggacucacucuc

SEQ ID NO: 128033 - RNA, 18 nt, Human
aggcacagagcauacaua

SEQ ID NO: 128034 - RNA, 22 nt, Human
ugaggcaguauuuuagugacuu

SEQ ID NO: 128035 - RNA, 22 nt, Human
gagaagucauuugaccaccuag

SEQ ID NO: 128036 - RNA, 22 nt, Human
agagcugagcaccaagcauggu

SEQ ID NO: 128037 - RNA, 23 nt, Human
aggcagugggggccacuuugcuu

SEQ ID NO: 128038 - RNA, 22 nt, Human
ugagaagcagcuuacagguguc

SEQ ID NO: 128039 - RNA, 22 nt, Human
aggcucagcccaagguggagag

SEQ ID NO: 128040 - RNA, 22 nt, Human
auuauuuuaugugcggccugau

SEQ ID NO: 128041 - RNA, 22 nt, Human
gcaggaagaggcucgaagcccc

SEQ ID NO: 128042 - RNA, 22 nt, Human
ugaggcucaagaaucugcauuu

SEQ ID NO: 128043 - RNA, 22 nt, Human
gaggcagcaggcugaggaggau

SEQ ID NO: 128044 - RNA, 21 nt, Human
ccacauucucauucugacugc

SEQ ID NO: 128045 - RNA, 18 nt, Human
cccagugcucacugccuc

SEQ ID NO: 128046 - RNA, 22 nt, Human
cagcuggaggagcagcuuccag

SEQ ID NO: 128047 - RNA, 22 nt, Human
gcagaggccaggccaccagcaa

SEQ ID NO: 128048 - RNA, 22 nt, Human
cagcugggugaucuugggcagg

SEQ ID NO: 128049 - RNA, 22 nt, Human
ccuaggcccuaggcuuccauca

SEQ ID NO: 128050 - RNA, 22 nt, Human
acagccuguguaccagcuggga

SEQ ID NO: 128051 - RNA, 22 nt, Human
agaagccagauuguagugggac

SEQ ID NO: 128052 - RNA, 23 nt, Human
aggcugagcucucccagcuucag

SEQ ID NO: 128053 - RNA, 22 nt, Human
agccaggcuacuccuugcugac

SEQ ID NO: 128054 - RNA, 22 nt, Human
uggaagaauaggauagaagaac

SEQ ID NO: 128055 - RNA, 22 nt, Human
uaguggaggguguagcugcugg

SEQ ID NO: 128056 - RNA, 22 nt, Human
cugggcaguuuauucaguucug

SEQ ID NO: 128057 - RNA, 22 nt, Human
uccugagaaggcacagcuugca

SEQ ID NO: 128058 - RNA, 22 nt, Human
uggcugagggggcucugcucag

SEQ ID NO: 128059 - RNA, 22 nt, Human
ugccaggcugaacagggucuua

SEQ ID NO: 128060 - RNA, 19 nt, Human
agggucaggacaaggacuu

SEQ ID NO: 128061 - RNA, 22 nt, Human
ugaggcucacaaaucugcauuu

SEQ ID NO: 128062 - RNA, 22 nt, Human
gguggcagucuuaagagaucuu

SEQ ID NO: 128063 - RNA, 22 nt, Human
gcagccagguuugaggaccacu

SEQ ID NO: 128064 - RNA, 23 nt, Human
agggcugaugccauugcagcucu

SEQ ID NO: 128065 - RNA, 22 nt, Human
gagccaccuucaacucaggaau

SEQ ID NO: 128066 - RNA, 22 nt, Human
aggagaaggaggccccucacac

SEQ ID NO: 128067 - RNA, 22 nt, Human
agcacccucagccuuauccaga

SEQ ID NO: 128068 - RNA, 22 nt, Human
ugaggcucugcuucuguggcuc

SEQ ID NO: 128069 - RNA, 22 nt, Human
agggcugaccuaagcuccacuu

SEQ ID NO: 128070 - RNA, 23 nt, Human
ugagaagccaggggagcgugagg

SEQ ID NO: 128071 - RNA, 18 nt, Human
gugcugugggcaguggcc

SEQ ID NO: 128072 - RNA, 22 nt, Human
guccuuugaaggcaaaaggaga

SEQ ID NO: 128073 - RNA, 22 nt, Human
augaggcagucuggccugaggg

SEQ ID NO: 128074 - RNA, 22 nt, Human
aagaugcgguugaccauggugu

SEQ ID NO: 128075 - RNA, 22 nt, Human
ucucuuauuuugccuuugacaa

SEQ ID NO: 128076 - RNA, 22 nt, Human
cagagcuggccugugauuuuug

SEQ ID NO: 128077 - RNA, 22 nt, Human
uccugccuuagagcaaggaaaa

SEQ ID NO: 128078 - RNA, 22 nt, Human
aaugggaagucacuacuguuac

SEQ ID NO: 128079 - RNA, 22 nt, Human
ucaguggaguauggaugaaguc

SEQ ID NO: 128080 - RNA, 22 nt, Human
ggaggcaggaaagacagguuca

SEQ ID NO: 128081 - RNA, 22 nt, Human
uggcugagaaguucugguggga

SEQ ID NO: 128082 - RNA, 22 nt, Human
aauuaggaauaaaugaguacuu

SEQ ID NO: 128083 - RNA, 22 nt, Human
ccugggcaauauagugaggccc

SEQ ID NO: 128084 - RNA, 20 nt, Human
ggagaugcagcccaggugcc

SEQ ID NO: 128085 - RNA, 20 nt, Human
ggaagccagcauccuugagg

SEQ ID NO: 128086 - RNA, 22 nt, Human
uagucucuggagacucuagggg

SEQ ID NO: 128087 - RNA, 19 nt, Human
ucaguggagaaaggggaag

SEQ ID NO: 128088 - RNA, 23 nt, Human
acaugggagggacauggaggcug

SEQ ID NO: 128089 - RNA, 16 nt, Human
cagccugcagugguca

SEQ ID NO: 128090 - RNA, 22 nt, Human
uagccaggucacacuguguguu

SEQ ID NO: 128091 - RNA, 22 nt, Human
guuuuccacuggauuguuugga

SEQ ID NO: 128092 - RNA, 22 nt, Human
gagagggccagggugagaacua

SEQ ID NO: 128093 - RNA, 19 nt, Human
ugcagaagacacaguggug

SEQ ID NO: 128094 - RNA, 19 nt, Human
ugagcaugcgagcugagaa

SEQ ID NO: 128095 - RNA, 22 nt, Human
ucaggcaggcucagaggaaaac

SEQ ID NO: 128096 - RNA, 22 nt, Human
agcagggccuggcacuccuggg

SEQ ID NO: 128097 - RNA, 23 nt, Human
ccucccaggcugcgagucccgag

SEQ ID NO: 128098 - RNA, 22 nt, Human
uggcugcaguucacaggagcaa

SEQ ID NO: 128099 - RNA, 22 nt, Human
aguucuagaagacuuuuccauu

SEQ ID NO: 128100 - RNA, 22 nt, Human
aaggaagagucuagaacaggca

SEQ ID NO: 128101 - RNA, 22 nt, Human
ggucugagcuugagcccaugcu

SEQ ID NO: 128102 - RNA, 22 nt, Human
uuuugcuugagugcacaaaaug

SEQ ID NO: 128103 - RNA, 22 nt, Human
ugcccaggcuccucgcagccuu

SEQ ID NO: 128104 - RNA, 22 nt, Human
uccugggagagugggacuguau

SEQ ID NO: 128105 - RNA, 22 nt, Human
cugaggcuuugugugcaugccu

SEQ ID NO: 128106 - RNA, 22 nt, Human
cugccaggcacgugcagcauca

SEQ ID NO: 128107 - RNA, 22 nt, Human
ugcagggacacgaagacaaaua

SEQ ID NO: 128108 - RNA, 22 nt, Human
gguguagcucugugucccacug

SEQ ID NO: 128109 - RNA, 22 nt, Human
auuccaaacagugcugcagacu

SEQ ID NO: 128110 - RNA, 22 nt, Human
ccagggcagugggagaaggugc

SEQ ID NO: 128111 - RNA, 22 nt, Human
ggucucugacuuagagauggau

SEQ ID NO: 128112 - RNA, 22 nt, Human
ggcaggugaccuggccucccag

SEQ ID NO: 128113 - RNA, 17 nt, Human
aaguccagccugcagcu

SEQ ID NO: 128114 - RNA, 22 nt, Human
auagugggaauuacgauauacu

SEQ ID NO: 128115 - RNA, 22 nt, Human
aucaccaggcaaaaugucagag

SEQ ID NO: 128116 - RNA, 22 nt, Human
uuccauaauaggcuuaagugaa

SEQ ID NO: 128117 - RNA, 22 nt, Human
cagggcuggcucaugaaaaguu

SEQ ID NO: 128118 - RNA, 22 nt, Human
gaggucaggcuugcagcagggu

SEQ ID NO: 128119 - RNA, 22 nt, Human
cugcuguguuccuccugcaucu

SEQ ID NO: 128120 - RNA, 22 nt, Human
ucacacacauaaucuaagauua

SEQ ID NO: 128121 - RNA, 22 nt, Human
uggagcagcacaagaaagggga

SEQ ID NO: 128122 - RNA, 22 nt, Human
ugcagggccaugguggcggcug

SEQ ID NO: 128123 - RNA, 22 nt, Human
cagcugugcugauugcucagua

SEQ ID NO: 128124 - RNA, 22 nt, Human
cuggaagugggguuggcuugaa

SEQ ID NO: 128125 - RNA, 22 nt, Human
ccagggagccuggugugucagc

SEQ ID NO: 128126 - RNA, 22 nt, Human
ggcucaccauggccucccugcu

SEQ ID NO: 128127 - RNA, 22 nt, Human
agggccagccaggcccuacaaa

SEQ ID NO: 128128 - RNA, 22 nt, Human
acagccugcagccccaggucgc

SEQ ID NO: 128129 - RNA, 21 nt, Human
aggaaaggccagcacguaggg

SEQ ID NO: 128130 - RNA, 22 nt, Human
cagugcagguggcagaggacag

SEQ ID NO: 128131 - RNA, 22 nt, Human
gagagugaggcaucaggggcag

SEQ ID NO: 128132 - RNA, 22 nt, Human
agggucagagucaggugcagua

SEQ ID NO: 128133 - RNA, 22 nt, Human
ccaaaggccaagcucagguaaa

SEQ ID NO: 128134 - RNA, 17 nt, Human
gcaguggagggguaguu

SEQ ID NO: 128135 - RNA, 20 nt, Human
aggcagagcgcacuuuuaga

SEQ ID NO: 128136 - RNA, 21 nt, Human
ccuggccaaucugauaggguu

SEQ ID NO: 128137 - RNA, 22 nt, Human
cuguggaccugcucuuagagac

SEQ ID NO: 128138 - RNA, 22 nt, Human
cugaggcugggcugaggguaua

SEQ ID NO: 128139 - RNA, 22 nt, Human
aggccacaguacuuugcagacc

SEQ ID NO: 128140 - RNA, 22 nt, Human
agccaggcucaaggccugcucc

SEQ ID NO: 128141 - RNA, 22 nt, Human
gggggucccaagcugggcugcu

SEQ ID NO: 128142 - RNA, 22 nt, Human
gcagggcaugggcccugucugc

SEQ ID NO: 128143 - RNA, 22 nt, Human
agagccugaggaugucccagcu

SEQ ID NO: 128144 - RNA, 22 nt, Human
aaaagcagagacucuggagcua

SEQ ID NO: 128145 - RNA, 22 nt, Human
gcaaaggcuucuuuuauucucc

SEQ ID NO: 128146 - RNA, 18 nt, Human
gaucgggggcgccccaag

SEQ ID NO: 128147 - RNA, 22 nt, Human
gcuguggcuugcagcuggggcu

SEQ ID NO: 128148 - RNA, 22 nt, Human
gaauucugggagagaucugaca

SEQ ID NO: 128149 - RNA, 22 nt, Human
cagugcagccaaggacaggcac

SEQ ID NO: 128150 - RNA, 22 nt, Human
cagcaguggcugcaggcagcug

SEQ ID NO: 128151 - RNA, 22 nt, Human
agaaggcacucacacuggcacg

SEQ ID NO: 128152 - RNA, 22 nt, Human
agggcagcuggaagguggcuuc

SEQ ID NO: 128153 - RNA, 19 nt, Human
cagagcugcuggccucguc

SEQ ID NO: 128154 - RNA, 20 nt, Human
aagagcugacucacaguggu

SEQ ID NO: 128155 - RNA, 22 nt, Human
gaggcuggaauauuagaaaugu

SEQ ID NO: 128156 - RNA, 22 nt, Human
agcagccagaaagggcagucga

SEQ ID NO: 128157 - RNA, 22 nt, Human
ugaggcaggaguucaggcugcg

SEQ ID NO: 128158 - RNA, 22 nt, Human
gacagggaggagcagagcuucu

SEQ ID NO: 128159 - RNA, 22 nt, Human
cagagcuggcggugagaagaca

SEQ ID NO: 128160 - RNA, 22 nt, Human
aggcugaaaacgagauggcaau

SEQ ID NO: 128161 - RNA, 20 nt, Human
ggcagccaaucagcgugccg

SEQ ID NO: 128162 - RNA, 22 nt, Human
uauuuuaucugccagaguggag

SEQ ID NO: 128163 - RNA, 22 nt, Human
caaaugaagggagcugaagucu

SEQ ID NO: 128164 - RNA, 22 nt, Human
ggugaagggccuuaggagacag

SEQ ID NO: 128165 - RNA, 22 nt, Human
aggaguggaauuacuggguucu

SEQ ID NO: 128166 - RNA, 22 nt, Human
ccugggcaacauagugagaccu

SEQ ID NO: 128167 - RNA, 22 nt, Human
auacauacauguacacauaaau

SEQ ID NO: 128168 - RNA, 22 nt, Human
gaggagaaauuuggggaccuga

SEQ ID NO: 128169 - RNA, 19 nt, Human
ucagaggauuuggcuauga

SEQ ID NO: 128170 - RNA, 22 nt, Human
accagggcugacaaucugaugg

SEQ ID NO: 128171 - RNA, 22 nt, Human
ccaucccuucucuggccagcag

SEQ ID NO: 128172 - RNA, 17 nt, Human
ggcaccagacggagagu

SEQ ID NO: 128173 - RNA, 22 nt, Human
uggcagagguauauugggagga

SEQ ID NO: 128174 - RNA, 22 nt, Human
agggccagcugcagaauuagca

SEQ ID NO: 128175 - RNA, 22 nt, Human
gggcagugucggggcccaggga

SEQ ID NO: 128176 - RNA, 22 nt, Human
agggccugggucuguacuccuc

SEQ ID NO: 128177 - RNA, 22 nt, Human
agccagugaugaagacucugga

SEQ ID NO: 128178 - RNA, 22 nt, Human
ucugcagaauucgaggaagaaa

SEQ ID NO: 128179 - RNA, 22 nt, Human
uggaggagggcuggugucugua

SEQ ID NO: 128180 - RNA, 22 nt, Human
gggcuagaaauucugcagugga

SEQ ID NO: 128181 - RNA, 22 nt, Human
gggcugagcuaagcuggguuga

SEQ ID NO: 128182 - RNA, 22 nt, Human
ugcaggcucacccuggagcuga

SEQ ID NO: 128183 - RNA, 22 nt, Human
ugcaggaauagcuacagagcug

SEQ ID NO: 128184 - RNA, 22 nt, Human
ugcaguggaagagguggagauc

SEQ ID NO: 128185 - RNA, 22 nt, Human
gaguccuucuggcuggcaggau

SEQ ID NO: 128186 - RNA, 22 nt, Human
ucugaaggucugagaaccagga

SEQ ID NO: 128187 - RNA, 22 nt, Human
ucaggcugcuggccagcaggcu

SEQ ID NO: 128188 - RNA, 22 nt, Human
aagaugcaugcugaagcuggcu

SEQ ID NO: 128189 - RNA, 22 nt, Human
aggaaccagagguugagcaacu

SEQ ID NO: 128190 - RNA, 22 nt, Human
caggcagaaauuuuguuucauu

SEQ ID NO: 128191 - RNA, 22 nt, Human
uccaggcuccccugcgugcucc

SEQ ID NO: 128192 - RNA, 22 nt, Human
cagagcuguuacuauucaugaa

SEQ ID NO: 128193 - RNA, 22 nt, Human
cagcugaagaaagagugguuag

SEQ ID NO: 128194 - RNA, 22 nt, Human
acaguggaaagaacauggauuu

SEQ ID NO: 128195 - RNA, 22 nt, Human
aggagaaggaagugcaucacua

SEQ ID NO: 128196 - RNA, 22 nt, Human
gggcagugguccaggcuacagc

SEQ ID NO: 128197 - RNA, 22 nt, Human
aagggcagcuauuaucgucauc

SEQ ID NO: 128198 - RNA, 22 nt, Human
agccaggcgcaguggcuuaugc

SEQ ID NO: 128199 - RNA, 17 nt, Human
gcaagggaugggagauu
